United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 193

SEQ ID NO: 8030934 - DNA, 22 bp, Homo sapiens
tgcctcagctgaggccgctcca

SEQ ID NO: 8030935 - DNA, 22 bp, Homo sapiens
tgcctcagagtgggcttgctat

SEQ ID NO: 8030936 - DNA, 22 bp, Homo sapiens
tgcctcagagtgggcttgctat

SEQ ID NO: 8030937 - DNA, 22 bp, Homo sapiens
tgcctcagtctaaagtctctca

SEQ ID NO: 8030938 - DNA, 22 bp, Homo sapiens
tgcctcagtctaaagtctctca

SEQ ID NO: 8030939 - DNA, 22 bp, Homo sapiens
tgcctcagtctaaagtctctca

SEQ ID NO: 8030940 - DNA, 22 bp, Homo sapiens
tgcctcagtcagcttccctggg

SEQ ID NO: 8030941 - DNA, 22 bp, Homo sapiens
tgcctccattcctgggtcattg

SEQ ID NO: 8030942 - DNA, 22 bp, Homo sapiens
tgcctcagtctaaagtctctca

SEQ ID NO: 8030943 - DNA, 22 bp, Homo sapiens
tgcctccattcctgggtcattg

SEQ ID NO: 8030944 - DNA, 22 bp, Homo sapiens
tgcctcaggcacctggcaggtt

SEQ ID NO: 8030945 - DNA, 19 bp, Homo sapiens
tgcctcagggctttgagga

SEQ ID NO: 8030946 - DNA, 19 bp, Homo sapiens
tgcctcagggctttgagga

SEQ ID NO: 8030947 - DNA, 19 bp, Homo sapiens
tgcctcagggctttgagga

SEQ ID NO: 8030948 - DNA, 22 bp, Homo sapiens
tgcctcaggcacctggcaggtt

SEQ ID NO: 8030949 - DNA, 19 bp, Homo sapiens
tgcctcagggctttgagga

SEQ ID NO: 8030950 - DNA, 19 bp, Homo sapiens
tgcctcagggctttgagga

SEQ ID NO: 8030951 - DNA, 22 bp, Homo sapiens
tgcctcagtcagcttccctggg

SEQ ID NO: 8030952 - DNA, 22 bp, Homo sapiens
tgcctcagtcagcttccctggg

SEQ ID NO: 8030953 - DNA, 22 bp, Homo sapiens
tgcctctctaacccatgcccaa

SEQ ID NO: 8030954 - DNA, 23 bp, Homo sapiens
tgcctctgcctccctagtctgca

SEQ ID NO: 8030955 - DNA, 22 bp, Homo sapiens
tgcctctgcctccattgttagt

SEQ ID NO: 8030956 - DNA, 22 bp, Homo sapiens
tgcctctgctgctgtggcatca

SEQ ID NO: 8030957 - DNA, 22 bp, Homo sapiens
tgcctctgctgctgtggcatca

SEQ ID NO: 8030958 - DNA, 22 bp, Homo sapiens
tgcctctgctgcatattcacct

SEQ ID NO: 8030959 - DNA, 22 bp, Homo sapiens
tgcctctgctgctgtggcatca

SEQ ID NO: 8030960 - DNA, 23 bp, Homo sapiens
tgcctctgcctccctagtctgca

SEQ ID NO: 8030961 - DNA, 23 bp, Homo sapiens
tgcctctgcctccctagtctgca

SEQ ID NO: 8030962 - DNA, 23 bp, Homo sapiens
tgcctctgcctccctagtctgca

SEQ ID NO: 8030963 - DNA, 22 bp, Homo sapiens
tgcctccctggcaagtctctcc

SEQ ID NO: 8030964 - DNA, 22 bp, Homo sapiens
tgcctcctctttgccaaggtca

SEQ ID NO: 8030965 - DNA, 22 bp, Homo sapiens
tgcctccttcaggagggcccgg

SEQ ID NO: 8030966 - DNA, 22 bp, Homo sapiens
tgcctctaaagtcatgatttat

SEQ ID NO: 8030967 - DNA, 22 bp, Homo sapiens
tgcctccttcaggagggcccgg

SEQ ID NO: 8030968 - DNA, 22 bp, Homo sapiens
tgcctccttcaggagggcccgg

SEQ ID NO: 8030969 - DNA, 22 bp, Homo sapiens
tgcctccctctctgccactgga

SEQ ID NO: 8030970 - DNA, 22 bp, Homo sapiens
tgcctccctctctgccactgga

SEQ ID NO: 8030971 - DNA, 22 bp, Homo sapiens
tgcctccctggcaagtctctcc

SEQ ID NO: 8030972 - DNA, 22 bp, Homo sapiens
tgcctccctggcaagtctctcc

SEQ ID NO: 8030973 - DNA, 22 bp, Homo sapiens
tgcctgaggagtcagggcaggt

SEQ ID NO: 8030974 - DNA, 22 bp, Homo sapiens
tgcctgaggagtcagggcaggt

SEQ ID NO: 8030975 - DNA, 22 bp, Homo sapiens
tgcctgaggagtcagggcaggt

SEQ ID NO: 8030976 - DNA, 22 bp, Homo sapiens
tgcctgagggagtaagagtcct

SEQ ID NO: 8030977 - DNA, 22 bp, Homo sapiens
tgcctgagggagtaagagtcct

SEQ ID NO: 8030978 - DNA, 22 bp, Homo sapiens
tgcctgagggagtaagagtcct

SEQ ID NO: 8030979 - DNA, 22 bp, Homo sapiens
tgcctgaggtggtctgcaaatg

SEQ ID NO: 8030980 - DNA, 22 bp, Homo sapiens
tgcctgaggtggtctgcaaatg

SEQ ID NO: 8030981 - DNA, 22 bp, Homo sapiens
tgcctgagtgatgtggcagcca

SEQ ID NO: 8030982 - DNA, 22 bp, Homo sapiens
tgcctgagtgatgtggcagcca

SEQ ID NO: 8030983 - DNA, 22 bp, Homo sapiens
tgcctgagtgatgtggcagcca

SEQ ID NO: 8030984 - DNA, 22 bp, Homo sapiens
tgcctgagtgatgtggcagcca

SEQ ID NO: 8030985 - DNA, 22 bp, Homo sapiens
tgcctgagtttaaccctcagag

SEQ ID NO: 8030986 - DNA, 22 bp, Homo sapiens
tgcctcttggagcctttcctct

SEQ ID NO: 8030987 - DNA, 22 bp, Homo sapiens
tgcctctgttgagccttggctg

SEQ ID NO: 8030988 - DNA, 22 bp, Homo sapiens
tgcctctgttgagccttggctg

SEQ ID NO: 8030989 - DNA, 22 bp, Homo sapiens
tgcctctgttgagccttggctg

SEQ ID NO: 8030990 - DNA, 22 bp, Homo sapiens
tgcctctgtgtgcaggtgagca

SEQ ID NO: 8030991 - DNA, 22 bp, Homo sapiens
tgcctctgtgtgcaggtgagca

SEQ ID NO: 8030992 - DNA, 22 bp, Homo sapiens
tgcctctgtgtgcaggtgagca

SEQ ID NO: 8030993 - DNA, 22 bp, Homo sapiens
tgcctctgtgtgcaggtgagca

SEQ ID NO: 8030994 - DNA, 22 bp, Homo sapiens
tgcctgaacatgaatagtttat

SEQ ID NO: 8030995 - DNA, 22 bp, Homo sapiens
tgcctgaattcaattcctggct

SEQ ID NO: 8030996 - DNA, 22 bp, Homo sapiens
tgcctgaatgatcagtcagatt

SEQ ID NO: 8030997 - DNA, 22 bp, Homo sapiens
tgcctctgtggaaatggtggtc

SEQ ID NO: 8030998 - DNA, 22 bp, Homo sapiens
tgcctctgtggaaatggtggtc

SEQ ID NO: 8030999 - DNA, 22 bp, Homo sapiens
tgcctctgtggaaatggtggtc

SEQ ID NO: 8031000 - DNA, 22 bp, Homo sapiens
tgcctctggttatctggtacct

SEQ ID NO: 8031001 - DNA, 22 bp, Homo sapiens
tgcctctgctgctgtggcatca

SEQ ID NO: 8031002 - DNA, 22 bp, Homo sapiens
tgcctctgctgctgtggcatca

SEQ ID NO: 8031003 - DNA, 22 bp, Homo sapiens
tgcctctggcctttggtgccca

SEQ ID NO: 8031004 - DNA, 22 bp, Homo sapiens
tgcctctggcctttggtgccca

SEQ ID NO: 8031005 - DNA, 22 bp, Homo sapiens
tgcctctggcctttggtgccca

SEQ ID NO: 8031006 - DNA, 22 bp, Homo sapiens
tgcctctggcctttggtgccca

SEQ ID NO: 8031007 - DNA, 22 bp, Homo sapiens
tgcctctggttatctggtacct

SEQ ID NO: 8031008 - DNA, 22 bp, Homo sapiens
tgcctctggttatctggtacct

SEQ ID NO: 8031009 - DNA, 22 bp, Homo sapiens
tgcctctggttatctggtacct

SEQ ID NO: 8031010 - DNA, 22 bp, Homo sapiens
tgcctctgggtgaccaaggagc

SEQ ID NO: 8031011 - DNA, 22 bp, Homo sapiens
tgcctctgggtgaccaaggagc

SEQ ID NO: 8031012 - DNA, 22 bp, Homo sapiens
tgcctctgtgggcagagctgcc

SEQ ID NO: 8031013 - DNA, 22 bp, Homo sapiens
tgcctctgtgggcagagctgcc

SEQ ID NO: 8031014 - DNA, 22 bp, Homo sapiens
tgcctctgtgggccttcctggc

SEQ ID NO: 8031015 - DNA, 22 bp, Homo sapiens
tgcctctgtgggcagagctgcc

SEQ ID NO: 8031016 - DNA, 22 bp, Homo sapiens
tgcctctgtgggcagagctgcc

SEQ ID NO: 8031017 - DNA, 22 bp, Homo sapiens
tgcctctgtgggcagagctgcc

SEQ ID NO: 8031018 - DNA, 22 bp, Homo sapiens
tgcctctgtgggcagagctgcc

SEQ ID NO: 8031019 - DNA, 22 bp, Homo sapiens
tgcctctgtgggccttcctggc

SEQ ID NO: 8031020 - DNA, 22 bp, Homo sapiens
tgcctctgtgggccttcctggc

SEQ ID NO: 8031021 - DNA, 22 bp, Homo sapiens
tgcctctgtgggccttcctggc

SEQ ID NO: 8031022 - DNA, 22 bp, Homo sapiens
tgcctctgtgggccttcctggc

SEQ ID NO: 8031023 - DNA, 22 bp, Homo sapiens
tgcctgccaggtgcttcttcat

SEQ ID NO: 8031024 - DNA, 22 bp, Homo sapiens
tgcctgcccacgactacagcag

SEQ ID NO: 8031025 - DNA, 17 bp, Homo sapiens
tgcctgccagcattgga

SEQ ID NO: 8031026 - DNA, 17 bp, Homo sapiens
tgcctgccagcattgga

SEQ ID NO: 8031027 - DNA, 22 bp, Homo sapiens
tgcctgccacgcttgctaccac

SEQ ID NO: 8031028 - DNA, 22 bp, Homo sapiens
tgcctgccacgcttgctaccac

SEQ ID NO: 8031029 - DNA, 22 bp, Homo sapiens
tgcctgatgcaggagtatcaga

SEQ ID NO: 8031030 - DNA, 22 bp, Homo sapiens
tgcctgatgcaggagtatcaga

SEQ ID NO: 8031031 - DNA, 22 bp, Homo sapiens
tgcctgagtttaaccctcagag

SEQ ID NO: 8031032 - DNA, 22 bp, Homo sapiens
tgcctgagtttaaccctcagag

SEQ ID NO: 8031033 - DNA, 22 bp, Homo sapiens
tgcctgagtttaaccctcagag

SEQ ID NO: 8031034 - DNA, 22 bp, Homo sapiens
tgcctgatgcaggagtatcaga

SEQ ID NO: 8031035 - DNA, 22 bp, Homo sapiens
tgcctgatgcaggagtatcaga

SEQ ID NO: 8031036 - DNA, 22 bp, Homo sapiens
tgcctgataccctctgtctctc

SEQ ID NO: 8031037 - DNA, 22 bp, Homo sapiens
tgcctgcatcttggaggcccca

SEQ ID NO: 8031038 - DNA, 22 bp, Homo sapiens
tgcctgcatcttggaggcccca

SEQ ID NO: 8031039 - DNA, 22 bp, Homo sapiens
tgcctgcatcttggaggcccca

SEQ ID NO: 8031040 - DNA, 22 bp, Homo sapiens
tgcctgcagcgtctccagcagg

SEQ ID NO: 8031041 - DNA, 21 bp, Homo sapiens
tgcctgcattctatcagacca

SEQ ID NO: 8031042 - DNA, 21 bp, Homo sapiens
tgcctgcattctatcagacca

SEQ ID NO: 8031043 - DNA, 22 bp, Homo sapiens
tgcctgccaatgatgcttgtgt

SEQ ID NO: 8031044 - DNA, 22 bp, Homo sapiens
tgcctgcattttgtggctggct

SEQ ID NO: 8031045 - DNA, 22 bp, Homo sapiens
tgcctggaaggcccatgggaag

SEQ ID NO: 8031046 - DNA, 22 bp, Homo sapiens
tgcctggaaggcccatgggaag

SEQ ID NO: 8031047 - DNA, 22 bp, Homo sapiens
tgcctggaaggcccatgggaag

SEQ ID NO: 8031048 - DNA, 18 bp, Homo sapiens
tgcctggaaggaacagga

SEQ ID NO: 8031049 - DNA, 18 bp, Homo sapiens
tgcctggaaggaacagga

SEQ ID NO: 8031050 - DNA, 22 bp, Homo sapiens
tgcctgctttctcctcaactca

SEQ ID NO: 8031051 - DNA, 19 bp, Homo sapiens
tgcctggacaaatgtgggg

SEQ ID NO: 8031052 - DNA, 22 bp, Homo sapiens
tgcctggaccccacctccggaa

SEQ ID NO: 8031053 - DNA, 23 bp, Homo sapiens
tgcctggagaagcatgaaatgta

SEQ ID NO: 8031054 - DNA, 22 bp, Homo sapiens
tgcctggagaaggcaccatctg

SEQ ID NO: 8031055 - DNA, 20 bp, Homo sapiens
tgcctgcccaggtcctgcac

SEQ ID NO: 8031056 - DNA, 20 bp, Homo sapiens
tgcctgcccaggtcctgcac

SEQ ID NO: 8031057 - DNA, 20 bp, Homo sapiens
tgcctgcccaggtcctgcac

SEQ ID NO: 8031058 - DNA, 20 bp, Homo sapiens
tgcctgcccaggtcctgcac

SEQ ID NO: 8031059 - DNA, 22 bp, Homo sapiens
tgcctgctgattggagttgaat

SEQ ID NO: 8031060 - DNA, 22 bp, Homo sapiens
tgcctgctgccactgctgttac

SEQ ID NO: 8031061 - DNA, 22 bp, Homo sapiens
tgcctgctgcctttcatcccaa

SEQ ID NO: 8031062 - DNA, 22 bp, Homo sapiens
tgcctgcttgtgtacctggtga

SEQ ID NO: 8031063 - DNA, 19 bp, Homo sapiens
tgcctgctgtattccagag

SEQ ID NO: 8031064 - DNA, 19 bp, Homo sapiens
tgcctggcaccagctccac

SEQ ID NO: 8031065 - DNA, 22 bp, Homo sapiens
tgcctggcaccccagtctgcac

SEQ ID NO: 8031066 - DNA, 22 bp, Homo sapiens
tgcctggcaccccagtctgcac

SEQ ID NO: 8031067 - DNA, 19 bp, Homo sapiens
tgcctggcaccagctccac

SEQ ID NO: 8031068 - DNA, 19 bp, Homo sapiens
tgcctggcaccagctccac

SEQ ID NO: 8031069 - DNA, 19 bp, Homo sapiens
tgcctggcaccagctccac

SEQ ID NO: 8031070 - DNA, 19 bp, Homo sapiens
tgcctggcaccagctccac

SEQ ID NO: 8031071 - DNA, 22 bp, Homo sapiens
tgcctggcacagagcaggtggc

SEQ ID NO: 8031072 - DNA, 22 bp, Homo sapiens
tgcctggcaatgccagaagcca

SEQ ID NO: 8031073 - DNA, 22 bp, Homo sapiens
tgcctggcacagagcaggtggc

SEQ ID NO: 8031074 - DNA, 22 bp, Homo sapiens
tgcctggcactcctggagctca

SEQ ID NO: 8031075 - DNA, 22 bp, Homo sapiens
tgcctggcactcctggagctca

SEQ ID NO: 8031076 - DNA, 22 bp, Homo sapiens
tgcctggcagcttgaaagaaat

SEQ ID NO: 8031077 - DNA, 22 bp, Homo sapiens
tgcctggcagcttgaaagaaat

SEQ ID NO: 8031078 - DNA, 22 bp, Homo sapiens
tgcctggcaccccagtctgcac

SEQ ID NO: 8031079 - DNA, 22 bp, Homo sapiens
tgcctggcaccccagtctgcac

SEQ ID NO: 8031080 - DNA, 22 bp, Homo sapiens
tgcctggcatctagccctggga

SEQ ID NO: 8031081 - DNA, 22 bp, Homo sapiens
tgcctggcatctagccctggga

SEQ ID NO: 8031082 - DNA, 22 bp, Homo sapiens
tgcctggcatctagccctggga

SEQ ID NO: 8031083 - DNA, 22 bp, Homo sapiens
tgcctggcagcttgaaagaaat

SEQ ID NO: 8031084 - DNA, 22 bp, Homo sapiens
tgcctggcatctagccctggga

SEQ ID NO: 8031085 - DNA, 22 bp, Homo sapiens
tgcctggcatgttatagacaca

SEQ ID NO: 8031086 - DNA, 22 bp, Homo sapiens
tgcctggcatctagccctggga

SEQ ID NO: 8031087 - DNA, 19 bp, Homo sapiens
tgcctggagcataacaggc

SEQ ID NO: 8031088 - DNA, 22 bp, Homo sapiens
tgcctggagtccccaagtccat

SEQ ID NO: 8031089 - DNA, 22 bp, Homo sapiens
tgcctggagtccccaagtccat

SEQ ID NO: 8031090 - DNA, 22 bp, Homo sapiens
tgcctggatactcattaatttc

SEQ ID NO: 8031091 - DNA, 22 bp, Homo sapiens
tgcctggatctgaggacccatt

SEQ ID NO: 8031092 - DNA, 22 bp, Homo sapiens
tgcctggatgtgctggcctcac

SEQ ID NO: 8031093 - DNA, 22 bp, Homo sapiens
tgcctggattcaaagctcatgt

SEQ ID NO: 8031094 - DNA, 22 bp, Homo sapiens
tgcctggatctgaggacccatt

SEQ ID NO: 8031095 - DNA, 22 bp, Homo sapiens
tgcctggatggctctgagcagg

SEQ ID NO: 8031096 - DNA, 22 bp, Homo sapiens
tgcctggatggctctgagcagg

SEQ ID NO: 8031097 - DNA, 22 bp, Homo sapiens
tgcctggatggctctgagcagg

SEQ ID NO: 8031098 - DNA, 22 bp, Homo sapiens
tgcctggcaatgccagaagcca

SEQ ID NO: 8031099 - DNA, 22 bp, Homo sapiens
tgcctggcaatgccagaagcca

SEQ ID NO: 8031100 - DNA, 22 bp, Homo sapiens
tgcctggcaatgccagaagcca

SEQ ID NO: 8031101 - DNA, 22 bp, Homo sapiens
tgcctggcaagaggggctggct

SEQ ID NO: 8031102 - DNA, 22 bp, Homo sapiens
tgcctggcaagaggggctggct

SEQ ID NO: 8031103 - DNA, 22 bp, Homo sapiens
tgcctggcaactgtggtgggct

SEQ ID NO: 8031104 - DNA, 22 bp, Homo sapiens
tgcctggcaagaggggctggct

SEQ ID NO: 8031105 - DNA, 22 bp, Homo sapiens
tgcctggattcggttgttgtca

SEQ ID NO: 8031106 - DNA, 22 bp, Homo sapiens
tgcccccttttcttgttacact

SEQ ID NO: 8031107 - DNA, 22 bp, Homo sapiens
tgcccctcagggaacgggtatc

SEQ ID NO: 8031108 - DNA, 22 bp, Homo sapiens
tgcccctctcctgtgatccaag

SEQ ID NO: 8031109 - DNA, 22 bp, Homo sapiens
tgcccctcgacgcaatgaaggg

SEQ ID NO: 8031110 - DNA, 22 bp, Homo sapiens
tgcccctctcctgtgatccaag

SEQ ID NO: 8031111 - DNA, 22 bp, Homo sapiens
tgcccctctcctgtgatccaag

SEQ ID NO: 8031112 - DNA, 22 bp, Homo sapiens
tgccccctggtggccagagccg

SEQ ID NO: 8031113 - DNA, 22 bp, Homo sapiens
tgccccaggtgctgaggttgga

SEQ ID NO: 8031114 - DNA, 22 bp, Homo sapiens
tgccccaggtgctgaggttgga

SEQ ID NO: 8031115 - DNA, 19 bp, Homo sapiens
tgcccccagcacctccctg

SEQ ID NO: 8031116 - DNA, 20 bp, Homo sapiens
tgccccaggcctgcacctgc

SEQ ID NO: 8031117 - DNA, 20 bp, Homo sapiens
tgccccaggcctgcacctgc

SEQ ID NO: 8031118 - DNA, 20 bp, Homo sapiens
tgccccaggcctgcacctgc

SEQ ID NO: 8031119 - DNA, 20 bp, Homo sapiens
tgccccaggcctgcacctgc

SEQ ID NO: 8031120 - DNA, 22 bp, Homo sapiens
tgccccaggtgctgaggttgga

SEQ ID NO: 8031121 - DNA, 20 bp, Homo sapiens
tgccccaggcctgcacctgc

SEQ ID NO: 8031122 - DNA, 22 bp, Homo sapiens
tgccccagacctactgaatggg

SEQ ID NO: 8031123 - DNA, 22 bp, Homo sapiens
tgccccagacctactgaatggg

SEQ ID NO: 8031124 - DNA, 22 bp, Homo sapiens
tgccccagactctgctcacctc

SEQ ID NO: 8031125 - DNA, 22 bp, Homo sapiens
tgccccagactctgctcacctc

SEQ ID NO: 8031126 - DNA, 22 bp, Homo sapiens
tgccccagacctactgaatggg

SEQ ID NO: 8031127 - DNA, 22 bp, Homo sapiens
tgcccatgtttctctgtatccc

SEQ ID NO: 8031128 - DNA, 21 bp, Homo sapiens
tgcccatgagcagaagtcacc

SEQ ID NO: 8031129 - DNA, 21 bp, Homo sapiens
tgcccatcagctccaggatgt

SEQ ID NO: 8031130 - DNA, 22 bp, Homo sapiens
tgcccatgcatgacagatggct

SEQ ID NO: 8031131 - DNA, 22 bp, Homo sapiens
tgcccaggtttgagtgcccaag

SEQ ID NO: 8031132 - DNA, 22 bp, Homo sapiens
tgcccaggtttgagtgcccaag

SEQ ID NO: 8031133 - DNA, 22 bp, Homo sapiens
tgcccaggtttgagtgcccaag

SEQ ID NO: 8031134 - DNA, 22 bp, Homo sapiens
tgcccaggtttgagtgcccaag

SEQ ID NO: 8031135 - DNA, 22 bp, Homo sapiens
tgcccagggtggagtgcagcgg

SEQ ID NO: 8031136 - DNA, 22 bp, Homo sapiens
tgcccagggtggagtgcagcgg

SEQ ID NO: 8031137 - DNA, 22 bp, Homo sapiens
tgcccagggtggagtgcagcgg

SEQ ID NO: 8031138 - DNA, 22 bp, Homo sapiens
tgcccagggtggagtgcagtgg

SEQ ID NO: 8031139 - DNA, 22 bp, Homo sapiens
tgcccagggtggagtgcagtgg

SEQ ID NO: 8031140 - DNA, 22 bp, Homo sapiens
tgcccaggtttgagtgcccaag

SEQ ID NO: 8031141 - DNA, 22 bp, Homo sapiens
tgcccaggtttgagtgcccaag

SEQ ID NO: 8031142 - DNA, 22 bp, Homo sapiens
tgcccagggtttctaagagcag

SEQ ID NO: 8031143 - DNA, 22 bp, Homo sapiens
tgcccagggtggagtgcagtgg

SEQ ID NO: 8031144 - DNA, 22 bp, Homo sapiens
tgcccaggctggagtgcagtgg

SEQ ID NO: 8031145 - DNA, 22 bp, Homo sapiens
tgcccaggctggagtgcagtgg

SEQ ID NO: 8031146 - DNA, 22 bp, Homo sapiens
tgcccaggcttcaccctcagag

SEQ ID NO: 8031147 - DNA, 22 bp, Homo sapiens
tgcccaggcttcaccctcagag

SEQ ID NO: 8031148 - DNA, 22 bp, Homo sapiens
tgcccaggcttcaccctcagag

SEQ ID NO: 8031149 - DNA, 22 bp, Homo sapiens
tgcccaggcttcaccctcagag

SEQ ID NO: 8031150 - DNA, 22 bp, Homo sapiens
tgcccaggctggagtgcagagg

SEQ ID NO: 8031151 - DNA, 22 bp, Homo sapiens
tgcccaggctggagtgcagagg

SEQ ID NO: 8031152 - DNA, 22 bp, Homo sapiens
tgcccaggctggagtgcagtgg

SEQ ID NO: 8031153 - DNA, 22 bp, Homo sapiens
tgcccaggctggagtgcagagg

SEQ ID NO: 8031154 - DNA, 22 bp, Homo sapiens
tgcccaggctggagtgcagagg

SEQ ID NO: 8031155 - DNA, 22 bp, Homo sapiens
tgcccagggataagcctagaga

SEQ ID NO: 8031156 - DNA, 22 bp, Homo sapiens
tgcccaggcttcaccctcagag

SEQ ID NO: 8031157 - DNA, 22 bp, Homo sapiens
tgcccagggataagcctagaga

SEQ ID NO: 8031158 - DNA, 21 bp, Homo sapiens
tgcccaggggccaaccgctgc

SEQ ID NO: 8031159 - DNA, 22 bp, Homo sapiens
tgcccagggtggagtgcagcgg

SEQ ID NO: 8031160 - DNA, 22 bp, Homo sapiens
tgcccagggtggagtgcagcgg

SEQ ID NO: 8031161 - DNA, 22 bp, Homo sapiens
tgcccagggtggagtgcagcgg

SEQ ID NO: 8031162 - DNA, 22 bp, Homo sapiens
tgcccagggtggagtgcagcgg

SEQ ID NO: 8031163 - DNA, 19 bp, Homo sapiens
tgcccaggccaggttgggc

SEQ ID NO: 8031164 - DNA, 19 bp, Homo sapiens
tgcccaggcctcccaaaag

SEQ ID NO: 8031165 - DNA, 19 bp, Homo sapiens
tgcccaggcctcccaaaag

SEQ ID NO: 8031166 - DNA, 22 bp, Homo sapiens
tgcccaggattgtgaggtcagg

SEQ ID NO: 8031167 - DNA, 22 bp, Homo sapiens
tgcccaggattgtgaggtcagg

SEQ ID NO: 8031168 - DNA, 22 bp, Homo sapiens
tgcccaggattgtgaggtcagg

SEQ ID NO: 8031169 - DNA, 22 bp, Homo sapiens
tgcccaggattgtgaggtcagg

SEQ ID NO: 8031170 - DNA, 22 bp, Homo sapiens
tgcccaggctggaatgcagtgg

SEQ ID NO: 8031171 - DNA, 22 bp, Homo sapiens
tgcccaggctggagtacagtgg

SEQ ID NO: 8031172 - DNA, 22 bp, Homo sapiens
tgcccaggctggagtacagtgg

SEQ ID NO: 8031173 - DNA, 22 bp, Homo sapiens
tgcccaggctcctcgcagcctt

SEQ ID NO: 8031174 - DNA, 22 bp, Homo sapiens
tgcccaggctcctcgcagcctt

SEQ ID NO: 8031175 - DNA, 22 bp, Homo sapiens
tgcccagcagggagctacctgg

SEQ ID NO: 8031176 - DNA, 22 bp, Homo sapiens
tgcccagccaatttgttatgtt

SEQ ID NO: 8031177 - DNA, 22 bp, Homo sapiens
tgcccagcagggagctacctgg

SEQ ID NO: 8031178 - DNA, 22 bp, Homo sapiens
tgcccagcagggagctacctgg

SEQ ID NO: 8031179 - DNA, 22 bp, Homo sapiens
tgcccagcagggagctacctgg

SEQ ID NO: 8031180 - DNA, 22 bp, Homo sapiens
tgcccagcagggagctacctgg

SEQ ID NO: 8031181 - DNA, 22 bp, Homo sapiens
tgcccagcagggagctacctgg

SEQ ID NO: 8031182 - DNA, 22 bp, Homo sapiens
tgcccagcactgtgccagtcac

SEQ ID NO: 8031183 - DNA, 22 bp, Homo sapiens
tgcccagcactgtgccagtcac

SEQ ID NO: 8031184 - DNA, 22 bp, Homo sapiens
tgcccagcactgtgccagtcac

SEQ ID NO: 8031185 - DNA, 22 bp, Homo sapiens
tgcccagcactgtgccagtcac

SEQ ID NO: 8031186 - DNA, 22 bp, Homo sapiens
tgcccagcactgtgccagtcac

SEQ ID NO: 8031187 - DNA, 22 bp, Homo sapiens
tgcccagcactgtgccagtcac

SEQ ID NO: 8031188 - DNA, 22 bp, Homo sapiens
tgcccagcactgtgccagtcac

SEQ ID NO: 8031189 - DNA, 20 bp, Homo sapiens
tgcccagcaagagtgcagtt

SEQ ID NO: 8031190 - DNA, 20 bp, Homo sapiens
tgcccagcaagagtgcagtt

SEQ ID NO: 8031191 - DNA, 22 bp, Homo sapiens
tgcccagcaataaaccagaaga

SEQ ID NO: 8031192 - DNA, 22 bp, Homo sapiens
tgcccagcaataaaccagaaga

SEQ ID NO: 8031193 - DNA, 22 bp, Homo sapiens
tgcccagcaataaaccagaaga

SEQ ID NO: 8031194 - DNA, 22 bp, Homo sapiens
tgcccagcaataaaccagaaga

SEQ ID NO: 8031195 - DNA, 22 bp, Homo sapiens
tgcccagcacccagcatgatgc

SEQ ID NO: 8031196 - DNA, 22 bp, Homo sapiens
tgcccagcacccagcatgatgc

SEQ ID NO: 8031197 - DNA, 22 bp, Homo sapiens
tgcccagcactgtgccagtcac

SEQ ID NO: 8031198 - DNA, 22 bp, Homo sapiens
tgcccagcacccagcatgatgc

SEQ ID NO: 8031199 - DNA, 22 bp, Homo sapiens
tgcccagcacccagcatgatgc

SEQ ID NO: 8031200 - DNA, 22 bp, Homo sapiens
tgcccagcacccagcatgatgc

SEQ ID NO: 8031201 - DNA, 22 bp, Homo sapiens
tgcccagcaataaaccagaaga

SEQ ID NO: 8031202 - DNA, 20 bp, Homo sapiens
tgcccagcaagagtgcagtt

SEQ ID NO: 8031203 - DNA, 20 bp, Homo sapiens
tgcccagcaagagtgcagtt

SEQ ID NO: 8031204 - DNA, 20 bp, Homo sapiens
tgcccagcaagagtgcagtt

SEQ ID NO: 8031205 - DNA, 20 bp, Homo sapiens
tgcccagcaagagtgcagtt

SEQ ID NO: 8031206 - DNA, 20 bp, Homo sapiens
tgcccagcaagagtgcagtt

SEQ ID NO: 8031207 - DNA, 22 bp, Homo sapiens
tgcccagagcctcttacctcca

SEQ ID NO: 8031208 - DNA, 19 bp, Homo sapiens
tgcccagagtgtatgcgca

SEQ ID NO: 8031209 - DNA, 20 bp, Homo sapiens
tgcccagcaagagtgcagtt

SEQ ID NO: 8031210 - DNA, 22 bp, Homo sapiens
tgcccacttcaaaatcttcatt

SEQ ID NO: 8031211 - DNA, 18 bp, Homo sapiens
tgcccagaaaagcaggga

SEQ ID NO: 8031212 - DNA, 22 bp, Homo sapiens
tgcccacatggtgccatggcca

SEQ ID NO: 8031213 - DNA, 22 bp, Homo sapiens
tgcccacatggtgccatggcca

SEQ ID NO: 8031214 - DNA, 22 bp, Homo sapiens
tgcccacattcaaaaggtgatg

SEQ ID NO: 8031215 - DNA, 22 bp, Homo sapiens
tgcccacatggtgccatggcca

SEQ ID NO: 8031216 - DNA, 22 bp, Homo sapiens
tgcccacattctgaagctccct

SEQ ID NO: 8031217 - DNA, 21 bp, Homo sapiens
tgcccaccaagctccacactg

SEQ ID NO: 8031218 - DNA, 22 bp, Homo sapiens
tgcccacattcaaaaggtgatg

SEQ ID NO: 8031219 - DNA, 18 bp, Homo sapiens
tgcccaccagaagaggga

SEQ ID NO: 8031220 - DNA, 18 bp, Homo sapiens
tgcccaccagaagaggga

SEQ ID NO: 8031221 - DNA, 22 bp, Homo sapiens
tgcccacctaacagtgtttgga

SEQ ID NO: 8031222 - DNA, 22 bp, Homo sapiens
tgcccacctttactgtgattta

SEQ ID NO: 8031223 - DNA, 22 bp, Homo sapiens
tgccatttataaccagtggcct

SEQ ID NO: 8031224 - DNA, 22 bp, Homo sapiens
tgccatttactgagattagaag

SEQ ID NO: 8031225 - DNA, 22 bp, Homo sapiens
tgccatttagtgcatcattagt

SEQ ID NO: 8031226 - DNA, 22 bp, Homo sapiens
tgccatgtttaaagttgaaggg

SEQ ID NO: 8031227 - DNA, 22 bp, Homo sapiens
tgccattatgacaattgaggaa

SEQ ID NO: 8031228 - DNA, 22 bp, Homo sapiens
tgccattcatttttaaggaagg

SEQ ID NO: 8031229 - DNA, 22 bp, Homo sapiens
tgccatttaaaaatgaccaaat

SEQ ID NO: 8031230 - DNA, 20 bp, Homo sapiens
tgccatggtaacagagtgtg

SEQ ID NO: 8031231 - DNA, 22 bp, Homo sapiens
tgccatggattaagtgggtggc

SEQ ID NO: 8031232 - DNA, 22 bp, Homo sapiens
tgccatggaatcacctccagct

SEQ ID NO: 8031233 - DNA, 22 bp, Homo sapiens
tgccatttctcaggctatttca

SEQ ID NO: 8031234 - DNA, 22 bp, Homo sapiens
tgccatttgccccagcactgtc

SEQ ID NO: 8031235 - DNA, 22 bp, Homo sapiens
tgccatttgttactatcaggac

SEQ ID NO: 8031236 - DNA, 23 bp, Homo sapiens
tgccatttggaagttgggggtct

SEQ ID NO: 8031237 - DNA, 21 bp, Homo sapiens
tgcccacagcaaatgcagagg

SEQ ID NO: 8031238 - DNA, 21 bp, Homo sapiens
tgcccacagcaaatgcagagg

SEQ ID NO: 8031239 - DNA, 21 bp, Homo sapiens
tgcccacagcaaatgcagagg

SEQ ID NO: 8031240 - DNA, 22 bp, Homo sapiens
tgcccacagcaaagaggtagga

SEQ ID NO: 8031241 - DNA, 22 bp, Homo sapiens
tgcccacacctgggggaggctg

SEQ ID NO: 8031242 - DNA, 20 bp, Homo sapiens
tgcccacaattcacaatgcc

SEQ ID NO: 8031243 - DNA, 22 bp, Homo sapiens
tgcccacaggaagacaccagcg

SEQ ID NO: 8031244 - DNA, 20 bp, Homo sapiens
tgcccacatcactcaggagt

SEQ ID NO: 8031245 - DNA, 22 bp, Homo sapiens
tgcccacaggaagacaccagcg

SEQ ID NO: 8031246 - DNA, 20 bp, Homo sapiens
tgcccacatcactcaggagt

SEQ ID NO: 8031247 - DNA, 20 bp, Homo sapiens
tgcccacatcactcaggagt

SEQ ID NO: 8031248 - DNA, 22 bp, Homo sapiens
tgcccaaggatccattggctgg

SEQ ID NO: 8031249 - DNA, 22 bp, Homo sapiens
tgcccaaggatccattggctgg

SEQ ID NO: 8031250 - DNA, 22 bp, Homo sapiens
tgcccaaggatccattggctgg

SEQ ID NO: 8031251 - DNA, 22 bp, Homo sapiens
tgcccaagtcctccaccgaggt

SEQ ID NO: 8031252 - DNA, 22 bp, Homo sapiens
tgcccaagtgtttggctgagtc

SEQ ID NO: 8031253 - DNA, 22 bp, Homo sapiens
tgcccaagtgtttggctgagtc

SEQ ID NO: 8031254 - DNA, 20 bp, Homo sapiens
tgcccacaattcacaatgcc

SEQ ID NO: 8031255 - DNA, 23 bp, Homo sapiens
tgcccacaaaagtaaagacattt

SEQ ID NO: 8031256 - DNA, 22 bp, Homo sapiens
tgcccaagcagaggagtgattc

SEQ ID NO: 8031257 - DNA, 22 bp, Homo sapiens
tgcccaagatcctacatcctga

SEQ ID NO: 8031258 - DNA, 22 bp, Homo sapiens
tgcccaagatcctacatcctga

SEQ ID NO: 8031259 - DNA, 22 bp, Homo sapiens
tgcccaagattcttacatcatg

SEQ ID NO: 8031260 - DNA, 22 bp, Homo sapiens
tgcccaagatcctacatcctga

SEQ ID NO: 8031261 - DNA, 22 bp, Homo sapiens
tgcccaaactgacattggcagt

SEQ ID NO: 8031262 - DNA, 22 bp, Homo sapiens
tgcccaaacctctcctagctct

SEQ ID NO: 8031263 - DNA, 22 bp, Homo sapiens
tgccatttttgagtggggcctc

SEQ ID NO: 8031264 - DNA, 17 bp, Homo sapiens
tgccagcctgtcccagg

SEQ ID NO: 8031265 - DNA, 17 bp, Homo sapiens
tgccagcctgtcccagg

SEQ ID NO: 8031266 - DNA, 17 bp, Homo sapiens
tgccagcctgtcccagg

SEQ ID NO: 8031267 - DNA, 19 bp, Homo sapiens
tgccagctcacaggagctc

SEQ ID NO: 8031268 - DNA, 22 bp, Homo sapiens
tgccagctagagaagctagaaa

SEQ ID NO: 8031269 - DNA, 22 bp, Homo sapiens
tgccagctactctgtaggctga

SEQ ID NO: 8031270 - DNA, 22 bp, Homo sapiens
tgccagctactctgtaggctga

SEQ ID NO: 8031271 - DNA, 18 bp, Homo sapiens
tgccagccgactggcctg

SEQ ID NO: 8031272 - DNA, 18 bp, Homo sapiens
tgccagccgactggcctg

SEQ ID NO: 8031273 - DNA, 18 bp, Homo sapiens
tgccagccgactggcctg

SEQ ID NO: 8031274 - DNA, 22 bp, Homo sapiens
tgccagcctggcctgagtcttt

SEQ ID NO: 8031275 - DNA, 22 bp, Homo sapiens
tgccagcctggcctgagtcttt

SEQ ID NO: 8031276 - DNA, 22 bp, Homo sapiens
tgccagcctcctgatatcatcc

SEQ ID NO: 8031277 - DNA, 18 bp, Homo sapiens
tgccagccgactggcctg

SEQ ID NO: 8031278 - DNA, 22 bp, Homo sapiens
tgccagcctggcctgagtcttt

SEQ ID NO: 8031279 - DNA, 22 bp, Homo sapiens
tgccagctcagagttaggactg

SEQ ID NO: 8031280 - DNA, 22 bp, Homo sapiens
tgccagctagagaagctagaaa

SEQ ID NO: 8031281 - DNA, 19 bp, Homo sapiens
tgccagctcacaggagctc

SEQ ID NO: 8031282 - DNA, 19 bp, Homo sapiens
tgccagctcacaggagctc

SEQ ID NO: 8031283 - DNA, 19 bp, Homo sapiens
tgccagctcacaggagctc

SEQ ID NO: 8031284 - DNA, 19 bp, Homo sapiens
tgccagctcacaggagctc

SEQ ID NO: 8031285 - DNA, 20 bp, Homo sapiens
tgccaggcacggagtgcatg

SEQ ID NO: 8031286 - DNA, 20 bp, Homo sapiens
tgccaggcacggagtgcatg

SEQ ID NO: 8031287 - DNA, 22 bp, Homo sapiens
tgccaggattgttgagatgatt

SEQ ID NO: 8031288 - DNA, 22 bp, Homo sapiens
tgccaggcaactgcccagccat

SEQ ID NO: 8031289 - DNA, 22 bp, Homo sapiens
tgccaggcaactgcccagccat

SEQ ID NO: 8031290 - DNA, 22 bp, Homo sapiens
tgccaggcaactgcccagccat

SEQ ID NO: 8031291 - DNA, 22 bp, Homo sapiens
tgccaggcaactgcccagccat

SEQ ID NO: 8031292 - DNA, 22 bp, Homo sapiens
tgccaggcagtgtcagattgag

SEQ ID NO: 8031293 - DNA, 22 bp, Homo sapiens
tgccaggcagtgtcagattgag

SEQ ID NO: 8031294 - DNA, 22 bp, Homo sapiens
tgccaggcagtgtcagattgag

SEQ ID NO: 8031295 - DNA, 22 bp, Homo sapiens
tgccaggcagtgtcagattgag

SEQ ID NO: 8031296 - DNA, 22 bp, Homo sapiens
tgccaggcagtgtcagattgag

SEQ ID NO: 8031297 - DNA, 22 bp, Homo sapiens
tgccaggcatatggcctctttg

SEQ ID NO: 8031298 - DNA, 22 bp, Homo sapiens
tgccaggcatatggcctctttg

SEQ ID NO: 8031299 - DNA, 22 bp, Homo sapiens
tgccaggcatatggcctctttg

SEQ ID NO: 8031300 - DNA, 22 bp, Homo sapiens
tgccaggcatatggcctctttg

SEQ ID NO: 8031301 - DNA, 22 bp, Homo sapiens
tgccaggcatatggcctctttg

SEQ ID NO: 8031302 - DNA, 22 bp, Homo sapiens
tgccaggcatatggcctctttg

SEQ ID NO: 8031303 - DNA, 22 bp, Homo sapiens
tgccaggcatgtagtagacttg

SEQ ID NO: 8031304 - DNA, 22 bp, Homo sapiens
tgccaggcatgtagtagacttg

SEQ ID NO: 8031305 - DNA, 22 bp, Homo sapiens
tgccaggcatgtagtagacttg

SEQ ID NO: 8031306 - DNA, 22 bp, Homo sapiens
tgccaggcatgtagtagacttg

SEQ ID NO: 8031307 - DNA, 22 bp, Homo sapiens
tgccaggcatgtagtagacttg

SEQ ID NO: 8031308 - DNA, 22 bp, Homo sapiens
tgccaggcatatggcctctttg

SEQ ID NO: 8031309 - DNA, 22 bp, Homo sapiens
tgccaggcatgtagtagacttg

SEQ ID NO: 8031310 - DNA, 22 bp, Homo sapiens
tgccaggcacgtgagagtggcc

SEQ ID NO: 8031311 - DNA, 22 bp, Homo sapiens
tgccaggcacgtgagagtggcc

SEQ ID NO: 8031312 - DNA, 22 bp, Homo sapiens
tgccaggcaggaccctagaacc

SEQ ID NO: 8031313 - DNA, 22 bp, Homo sapiens
tgccaggcaggaccctagaacc

SEQ ID NO: 8031314 - DNA, 22 bp, Homo sapiens
tgccaggcaggaccctagaacc

SEQ ID NO: 8031315 - DNA, 22 bp, Homo sapiens
tgccaggcaggaccctagaacc

SEQ ID NO: 8031316 - DNA, 22 bp, Homo sapiens
tgccaggcacgtgagagtggcc

SEQ ID NO: 8031317 - DNA, 22 bp, Homo sapiens
tgccaggcacgtgagagtggcc

SEQ ID NO: 8031318 - DNA, 22 bp, Homo sapiens
tgccaggcacgtgagagtggcc

SEQ ID NO: 8031319 - DNA, 22 bp, Homo sapiens
tgccaggcacgtgagagtggcc

SEQ ID NO: 8031320 - DNA, 22 bp, Homo sapiens
tgccaggcacgtgagagtggcc

SEQ ID NO: 8031321 - DNA, 22 bp, Homo sapiens
tgccaggcacgtgagagtggcc

SEQ ID NO: 8031322 - DNA, 20 bp, Homo sapiens
tgccaggcacggagtgcatg

SEQ ID NO: 8031323 - DNA, 22 bp, Homo sapiens
tgccaggattgttgagatgatt

SEQ ID NO: 8031324 - DNA, 20 bp, Homo sapiens
tgccaggcacggagtgcatg

SEQ ID NO: 8031325 - DNA, 20 bp, Homo sapiens
tgccaggcacggagtgcatg

SEQ ID NO: 8031326 - DNA, 22 bp, Homo sapiens
tgccaggcccagctccagagct

SEQ ID NO: 8031327 - DNA, 22 bp, Homo sapiens
tgccaggcccagctccagagct

SEQ ID NO: 8031328 - DNA, 22 bp, Homo sapiens
tgccaggcccagctccagagct

SEQ ID NO: 8031329 - DNA, 22 bp, Homo sapiens
tgccaggcccagcagggcggcc

SEQ ID NO: 8031330 - DNA, 22 bp, Homo sapiens
tgccaggcccagcagggcggcc

SEQ ID NO: 8031331 - DNA, 22 bp, Homo sapiens
tgccaggcccagctccagagct

SEQ ID NO: 8031332 - DNA, 22 bp, Homo sapiens
tgccaggccacgtagcttcaag

SEQ ID NO: 8031333 - DNA, 22 bp, Homo sapiens
tgccaggccacgtagcttcaag

SEQ ID NO: 8031334 - DNA, 22 bp, Homo sapiens
tgccaggccacgtagcttcaag

SEQ ID NO: 8031335 - DNA, 22 bp, Homo sapiens
tgccaggccacgtagcttcaag

SEQ ID NO: 8031336 - DNA, 22 bp, Homo sapiens
tgccaggccacgtagcttcaag

SEQ ID NO: 8031337 - DNA, 22 bp, Homo sapiens
tgccaggcccagcagggcggcc

SEQ ID NO: 8031338 - DNA, 22 bp, Homo sapiens
tgccaggcccagcagggcggcc

SEQ ID NO: 8031339 - DNA, 22 bp, Homo sapiens
tgccaggcccagcagggcggcc

SEQ ID NO: 8031340 - DNA, 22 bp, Homo sapiens
tgccaggccaatgaaggcaggg

SEQ ID NO: 8031341 - DNA, 22 bp, Homo sapiens
tgccaggccaatgaaggcaggg

SEQ ID NO: 8031342 - DNA, 22 bp, Homo sapiens
tgccaggccaatgaaggcaggg

SEQ ID NO: 8031343 - DNA, 22 bp, Homo sapiens
tgccaggccaatgaaggcaggg

SEQ ID NO: 8031344 - DNA, 22 bp, Homo sapiens
tgccaggccaattctatttgac

SEQ ID NO: 8031345 - DNA, 22 bp, Homo sapiens
tgccaggccaattctatttgac

SEQ ID NO: 8031346 - DNA, 22 bp, Homo sapiens
tgccaggcatttgacagacact

SEQ ID NO: 8031347 - DNA, 22 bp, Homo sapiens
tgccaggcatttgacagacact

SEQ ID NO: 8031348 - DNA, 22 bp, Homo sapiens
tgccaggcatttgacagacact

SEQ ID NO: 8031349 - DNA, 22 bp, Homo sapiens
tgccaggcatttgacagacact

SEQ ID NO: 8031350 - DNA, 22 bp, Homo sapiens
tgccaggcatttgacagacact

SEQ ID NO: 8031351 - DNA, 22 bp, Homo sapiens
tgccaggcatttgacagacact

SEQ ID NO: 8031352 - DNA, 22 bp, Homo sapiens
tgccaggccaatgaaggcaggg

SEQ ID NO: 8031353 - DNA, 22 bp, Homo sapiens
tgccaggcatttgacagacact

SEQ ID NO: 8031354 - DNA, 22 bp, Homo sapiens
tgccaggccctgtgctggatgc

SEQ ID NO: 8031355 - DNA, 22 bp, Homo sapiens
tgccaggccctgtgctggatgc

SEQ ID NO: 8031356 - DNA, 22 bp, Homo sapiens
tgccaggccctgtgctggatgc

SEQ ID NO: 8031357 - DNA, 22 bp, Homo sapiens
tgccaggccctgcggggtccca

SEQ ID NO: 8031358 - DNA, 22 bp, Homo sapiens
tgccaggccctgcggggtccca

SEQ ID NO: 8031359 - DNA, 22 bp, Homo sapiens
tgccaggctaagtggaggactt

SEQ ID NO: 8031360 - DNA, 22 bp, Homo sapiens
tgccaggccctgtgctggatgc

SEQ ID NO: 8031361 - DNA, 22 bp, Homo sapiens
tgccaggctcagcccctatctt

SEQ ID NO: 8031362 - DNA, 22 bp, Homo sapiens
tgccaggctcaggatgtccctg

SEQ ID NO: 8031363 - DNA, 22 bp, Homo sapiens
tgccaggctcaggatgtccctg

SEQ ID NO: 8031364 - DNA, 22 bp, Homo sapiens
tgccaggctcagcccctatctt

SEQ ID NO: 8031365 - DNA, 22 bp, Homo sapiens
tgccaggctaagtggaggactt

SEQ ID NO: 8031366 - DNA, 22 bp, Homo sapiens
tgccaggctcagcccctatctt

SEQ ID NO: 8031367 - DNA, 22 bp, Homo sapiens
tgccaggccctcccacagatta

SEQ ID NO: 8031368 - DNA, 22 bp, Homo sapiens
tgccaggccctcccacagatta

SEQ ID NO: 8031369 - DNA, 22 bp, Homo sapiens
tgccaggccctgcggggtccca

SEQ ID NO: 8031370 - DNA, 22 bp, Homo sapiens
tgccaggccctgcggggtccca

SEQ ID NO: 8031371 - DNA, 22 bp, Homo sapiens
tgccaggccctgtgctggatgc

SEQ ID NO: 8031372 - DNA, 22 bp, Homo sapiens
tgccaggcccagctccagagct

SEQ ID NO: 8031373 - DNA, 22 bp, Homo sapiens
tgccaggcccagctccagagct

SEQ ID NO: 8031374 - DNA, 22 bp, Homo sapiens
tgccaggccctcccacagatta

SEQ ID NO: 8031375 - DNA, 22 bp, Homo sapiens
tgccaggccctcccacagatta

SEQ ID NO: 8031376 - DNA, 22 bp, Homo sapiens
tgccaggccctcccacagatta

SEQ ID NO: 8031377 - DNA, 22 bp, Homo sapiens
tgccaggccctcccacagatta

SEQ ID NO: 8031378 - DNA, 22 bp, Homo sapiens
tgccaggtacacaagtagccag

SEQ ID NO: 8031379 - DNA, 23 bp, Homo sapiens
tgccagggtttgtttgtggttca

SEQ ID NO: 8031380 - DNA, 22 bp, Homo sapiens
tgccagggtgtcaggagagcta

SEQ ID NO: 8031381 - DNA, 22 bp, Homo sapiens
tgccagggtgtcaggagagcta

SEQ ID NO: 8031382 - DNA, 22 bp, Homo sapiens
tgccagggtgtcaggagagcta

SEQ ID NO: 8031383 - DNA, 22 bp, Homo sapiens
tgccagggtgtcaggagagcta

SEQ ID NO: 8031384 - DNA, 22 bp, Homo sapiens
tgccagggtgtcaggagagcta

SEQ ID NO: 8031385 - DNA, 22 bp, Homo sapiens
tgccatccaacagttccatctt

SEQ ID NO: 8031386 - DNA, 22 bp, Homo sapiens
tgccatccaacagttccatctt

SEQ ID NO: 8031387 - DNA, 22 bp, Homo sapiens
tgccatccatcagtatttgtgg

SEQ ID NO: 8031388 - DNA, 18 bp, Homo sapiens
tgccatccccagtcaagt

SEQ ID NO: 8031389 - DNA, 22 bp, Homo sapiens
tgccaggtacacaagtagccag

SEQ ID NO: 8031390 - DNA, 22 bp, Homo sapiens
tgccagtcacagttctcaaaga

SEQ ID NO: 8031391 - DNA, 22 bp, Homo sapiens
tgccagtcacgtataagaaaat

SEQ ID NO: 8031392 - DNA, 22 bp, Homo sapiens
tgccagtcagtggtttaaaagt

SEQ ID NO: 8031393 - DNA, 22 bp, Homo sapiens
tgccatgcccacctcccttctg

SEQ ID NO: 8031394 - DNA, 22 bp, Homo sapiens
tgccatctgcacccacctgccc

SEQ ID NO: 8031395 - DNA, 22 bp, Homo sapiens
tgccatctcttcctcgtgctgc

SEQ ID NO: 8031396 - DNA, 22 bp, Homo sapiens
tgccatctgaaaattacatcct

SEQ ID NO: 8031397 - DNA, 22 bp, Homo sapiens
tgccatcctgtgtcatgctcat

SEQ ID NO: 8031398 - DNA, 22 bp, Homo sapiens
tgccatccccatgtggtggaga

SEQ ID NO: 8031399 - DNA, 22 bp, Homo sapiens
tgccatcctgtgtcatgctcat

SEQ ID NO: 8031400 - DNA, 17 bp, Homo sapiens
tgccatcccccttgggc

SEQ ID NO: 8031401 - DNA, 18 bp, Homo sapiens
tgccatccccagtcaagt

SEQ ID NO: 8031402 - DNA, 22 bp, Homo sapiens
tgccatccttgaggaagggcaa

SEQ ID NO: 8031403 - DNA, 22 bp, Homo sapiens
tgccatccttgaggaagggcaa

SEQ ID NO: 8031404 - DNA, 22 bp, Homo sapiens
tgccatcctgtgtcatgctcat

SEQ ID NO: 8031405 - DNA, 22 bp, Homo sapiens
tgccatcctgtgtcatgctcat

SEQ ID NO: 8031406 - DNA, 22 bp, Homo sapiens
tgccatcgctttgaacatcact

SEQ ID NO: 8031407 - DNA, 22 bp, Homo sapiens
tgccatctctgcaatgcctggg

SEQ ID NO: 8031408 - DNA, 22 bp, Homo sapiens
tgccatctctccatagcataga

SEQ ID NO: 8031409 - DNA, 22 bp, Homo sapiens
tgccatctctccatagcataga

SEQ ID NO: 8031410 - DNA, 22 bp, Homo sapiens
tgccagggctgctactggctga

SEQ ID NO: 8031411 - DNA, 22 bp, Homo sapiens
tgccagggctgctactggctga

SEQ ID NO: 8031412 - DNA, 23 bp, Homo sapiens
tgccagggccctgtgtgcaatgc

SEQ ID NO: 8031413 - DNA, 23 bp, Homo sapiens
tgccagggccctgtgtgcaatgc

SEQ ID NO: 8031414 - DNA, 23 bp, Homo sapiens
tgccagggccctgtgtgcaatgc

SEQ ID NO: 8031415 - DNA, 23 bp, Homo sapiens
tgccagggccctgtgtgcaatgc

SEQ ID NO: 8031416 - DNA, 22 bp, Homo sapiens
tgccaggggacctagggatgtc

SEQ ID NO: 8031417 - DNA, 22 bp, Homo sapiens
tgccaggggacctagggatgtc

SEQ ID NO: 8031418 - DNA, 22 bp, Homo sapiens
tgccagggctgctactggctga

SEQ ID NO: 8031419 - DNA, 22 bp, Homo sapiens
tgccagggccatagggagtcta

SEQ ID NO: 8031420 - DNA, 22 bp, Homo sapiens
tgccagggccatagggagtcta

SEQ ID NO: 8031421 - DNA, 22 bp, Homo sapiens
tgccagggccatagggagtcta

SEQ ID NO: 8031422 - DNA, 22 bp, Homo sapiens
tgccagggccatagggagtcta

SEQ ID NO: 8031423 - DNA, 22 bp, Homo sapiens
tgccagggccatagggagtcta

SEQ ID NO: 8031424 - DNA, 22 bp, Homo sapiens
tgccagggccatagggagtcta

SEQ ID NO: 8031425 - DNA, 22 bp, Homo sapiens
tgccagggccatagggagtcta

SEQ ID NO: 8031426 - DNA, 20 bp, Homo sapiens
tgccagggccagcagaggct

SEQ ID NO: 8031427 - DNA, 22 bp, Homo sapiens
tgccagggccatagggagtcta

SEQ ID NO: 8031428 - DNA, 22 bp, Homo sapiens
tgccagggccatagggagtcta

SEQ ID NO: 8031429 - DNA, 22 bp, Homo sapiens
tgccagggtcctgagggccttg

SEQ ID NO: 8031430 - DNA, 22 bp, Homo sapiens
tgccagggtcctgagggccttg

SEQ ID NO: 8031431 - DNA, 22 bp, Homo sapiens
tgccagggtcctgagggccttg

SEQ ID NO: 8031432 - DNA, 22 bp, Homo sapiens
tgccagggtcctgagggccttg

SEQ ID NO: 8031433 - DNA, 22 bp, Homo sapiens
tgccagggtgtcaggagagcta

SEQ ID NO: 8031434 - DNA, 22 bp, Homo sapiens
tgccagggtgtcaggagagcta

SEQ ID NO: 8031435 - DNA, 22 bp, Homo sapiens
tgccagggtgtcaggagagcta

SEQ ID NO: 8031436 - DNA, 22 bp, Homo sapiens
tgccagggtcctgagggccttg

SEQ ID NO: 8031437 - DNA, 22 bp, Homo sapiens
tgccagggtcctgagggccttg

SEQ ID NO: 8031438 - DNA, 22 bp, Homo sapiens
tgccaggggacctagggatgtc

SEQ ID NO: 8031439 - DNA, 22 bp, Homo sapiens
tgccaggggacctagggatgtc

SEQ ID NO: 8031440 - DNA, 22 bp, Homo sapiens
tgccaggggacctagggatgtc

SEQ ID NO: 8031441 - DNA, 22 bp, Homo sapiens
tgccagggtcagctgcagctct

SEQ ID NO: 8031442 - DNA, 22 bp, Homo sapiens
tgccagggtcagctgcagctct

SEQ ID NO: 8031443 - DNA, 22 bp, Homo sapiens
tgccagggtcagctgcagctct

SEQ ID NO: 8031444 - DNA, 22 bp, Homo sapiens
tgccagggagccctgctgacca

SEQ ID NO: 8031445 - DNA, 22 bp, Homo sapiens
tgccagggagccctgctgacca

SEQ ID NO: 8031446 - DNA, 22 bp, Homo sapiens
tgccagggaccctgtcggccct

SEQ ID NO: 8031447 - DNA, 22 bp, Homo sapiens
tgccagggagccctgctgacca

SEQ ID NO: 8031448 - DNA, 22 bp, Homo sapiens
tgccagggaccctgtcggccct

SEQ ID NO: 8031449 - DNA, 22 bp, Homo sapiens
tgccagggaccctgtcggccct

SEQ ID NO: 8031450 - DNA, 22 bp, Homo sapiens
tgccagggaccctgtcggccct

SEQ ID NO: 8031451 - DNA, 22 bp, Homo sapiens
tgccagggaccctgtcggccct

SEQ ID NO: 8031452 - DNA, 22 bp, Homo sapiens
tgccaggctttggtcaaaggct

SEQ ID NO: 8031453 - DNA, 22 bp, Homo sapiens
tgccaggctttggtcaaaggct

SEQ ID NO: 8031454 - DNA, 22 bp, Homo sapiens
tgccaggctttggtcaaaggct

SEQ ID NO: 8031455 - DNA, 22 bp, Homo sapiens
tgccaggctttggtcaaaggct

SEQ ID NO: 8031456 - DNA, 22 bp, Homo sapiens
tgccaggcttagagcaggggct

SEQ ID NO: 8031457 - DNA, 22 bp, Homo sapiens
tgccaggcttagagcaggggct

SEQ ID NO: 8031458 - DNA, 22 bp, Homo sapiens
tgccaggcttagagcaggggct

SEQ ID NO: 8031459 - DNA, 22 bp, Homo sapiens
tgccaggcttagagcaggggct

SEQ ID NO: 8031460 - DNA, 20 bp, Homo sapiens
tgccagggccagcagaggct

SEQ ID NO: 8031461 - DNA, 20 bp, Homo sapiens
tgccagggccagcagaggct

SEQ ID NO: 8031462 - DNA, 20 bp, Homo sapiens
tgccagggccagcagaggct

SEQ ID NO: 8031463 - DNA, 21 bp, Homo sapiens
tgccagggatttacagagcct

SEQ ID NO: 8031464 - DNA, 20 bp, Homo sapiens
tgccagggccagcagaggct

SEQ ID NO: 8031465 - DNA, 20 bp, Homo sapiens
tgccagggccagcagaggct

SEQ ID NO: 8031466 - DNA, 20 bp, Homo sapiens
tgccagggccagcagaggct

SEQ ID NO: 8031467 - DNA, 20 bp, Homo sapiens
tgccagggccagcagaggct

SEQ ID NO: 8031468 - DNA, 20 bp, Homo sapiens
tgccagggccagcagaggct

SEQ ID NO: 8031469 - DNA, 21 bp, Homo sapiens
tgccagggatttacagagcct

SEQ ID NO: 8031470 - DNA, 22 bp, Homo sapiens
tgccagggagccctgctgacca

SEQ ID NO: 8031471 - DNA, 22 bp, Homo sapiens
tgccagggagccctgctgacca

SEQ ID NO: 8031472 - DNA, 21 bp, Homo sapiens
tgccagggatttacagagcct

SEQ ID NO: 8031473 - DNA, 21 bp, Homo sapiens
tgccagggatttacagagcct

SEQ ID NO: 8031474 - DNA, 21 bp, Homo sapiens
tgccagggatttacagagcct

SEQ ID NO: 8031475 - DNA, 21 bp, Homo sapiens
tgccagggatttacagagcct

SEQ ID NO: 8031476 - DNA, 22 bp, Homo sapiens
tgccaggctccggaacgacagt

SEQ ID NO: 8031477 - DNA, 22 bp, Homo sapiens
tgccaggctccggaacgacagt

SEQ ID NO: 8031478 - DNA, 22 bp, Homo sapiens
tgccaggctccggaacgacagt

SEQ ID NO: 8031479 - DNA, 22 bp, Homo sapiens
tgccaggctccggaacgacagt

SEQ ID NO: 8031480 - DNA, 22 bp, Homo sapiens
tgccaggctcaggatgtccctg

SEQ ID NO: 8031481 - DNA, 22 bp, Homo sapiens
tgccaggctcaggatgtccctg

SEQ ID NO: 8031482 - DNA, 22 bp, Homo sapiens
tgccaggctccggaacgacagt

SEQ ID NO: 8031483 - DNA, 22 bp, Homo sapiens
tgccaggctccggaacgacagt

SEQ ID NO: 8031484 - DNA, 20 bp, Homo sapiens
tgccaggctgcacgcctgcc

SEQ ID NO: 8031485 - DNA, 20 bp, Homo sapiens
tgccaggctgcacgcctgcc

SEQ ID NO: 8031486 - DNA, 20 bp, Homo sapiens
tgccaggctgcacgcctgcc

SEQ ID NO: 8031487 - DNA, 22 bp, Homo sapiens
tgccaggctgaacagggtctta

SEQ ID NO: 8031488 - DNA, 22 bp, Homo sapiens
tgccaggctgaacagggtctta

SEQ ID NO: 8031489 - DNA, 22 bp, Homo sapiens
tgccaggctgaacagggtctta

SEQ ID NO: 8031490 - DNA, 22 bp, Homo sapiens
tgccaggctgaacagggtctta

SEQ ID NO: 8031491 - DNA, 22 bp, Homo sapiens
tgccaggctgaacagggtctta

SEQ ID NO: 8031492 - DNA, 22 bp, Homo sapiens
tgccaggctgccctccagtctg

SEQ ID NO: 8031493 - DNA, 22 bp, Homo sapiens
tgccaggctgccctccagtctg

SEQ ID NO: 8031494 - DNA, 22 bp, Homo sapiens
tgccaggctgtcaattcaccca

SEQ ID NO: 8031495 - DNA, 20 bp, Homo sapiens
tgccaggctgcacgcctgcc

SEQ ID NO: 8031496 - DNA, 20 bp, Homo sapiens
tgccaggctgcacgcctgcc

SEQ ID NO: 8031497 - DNA, 20 bp, Homo sapiens
tgccaggctgcacgcctgcc

SEQ ID NO: 8031498 - DNA, 22 bp, Homo sapiens
tgccaggctgccctccagtctg

SEQ ID NO: 8031499 - DNA, 22 bp, Homo sapiens
tgccaggctgtcaattcaccca

SEQ ID NO: 8031500 - DNA, 22 bp, Homo sapiens
tgccaggctgtcaattcaccca

SEQ ID NO: 8031501 - DNA, 22 bp, Homo sapiens
tgccaggctgtcctgggcctgg

SEQ ID NO: 8031502 - DNA, 22 bp, Homo sapiens
tgccaggctgtcctgggcctgg

SEQ ID NO: 8031503 - DNA, 22 bp, Homo sapiens
tgccaggctgtcctgggcctgg

SEQ ID NO: 8031504 - DNA, 22 bp, Homo sapiens
tgccaggctgtcctgggcctgg

SEQ ID NO: 8031505 - DNA, 22 bp, Homo sapiens
tgccaggctgtcctgggcctgg

SEQ ID NO: 8031506 - DNA, 22 bp, Homo sapiens
tgccaggctgtcctgggcctgg

SEQ ID NO: 8031507 - DNA, 22 bp, Homo sapiens
tgccaggctgtcctgggcctgg

SEQ ID NO: 8031508 - DNA, 22 bp, Homo sapiens
tgcagatattctcccaagtgtt

SEQ ID NO: 8031509 - DNA, 22 bp, Homo sapiens
tgcagatgaatgctgagacact

SEQ ID NO: 8031510 - DNA, 21 bp, Homo sapiens
tgcagataattgaaagctgac

SEQ ID NO: 8031511 - DNA, 22 bp, Homo sapiens
tgcagagttgctttgatagtcc

SEQ ID NO: 8031512 - DNA, 22 bp, Homo sapiens
tgcagagtcctctggagggact

SEQ ID NO: 8031513 - DNA, 22 bp, Homo sapiens
tgcagagtggattctgtatacc

SEQ ID NO: 8031514 - DNA, 22 bp, Homo sapiens
tgcagagtgggagaggtgcggg

SEQ ID NO: 8031515 - DNA, 23 bp, Homo sapiens
tgcagagtgtcacttgaaaacca

SEQ ID NO: 8031516 - DNA, 22 bp, Homo sapiens
tgcagagtgggagaggtgcggg

SEQ ID NO: 8031517 - DNA, 22 bp, Homo sapiens
tgcagagtagctataccatttt

SEQ ID NO: 8031518 - DNA, 22 bp, Homo sapiens
tgcagagtagtgaggggacaga

SEQ ID NO: 8031519 - DNA, 22 bp, Homo sapiens
tgcagagtcacccagataatta

SEQ ID NO: 8031520 - DNA, 19 bp, Homo sapiens
tgcagagggtaggaaggcc

SEQ ID NO: 8031521 - DNA, 19 bp, Homo sapiens
tgcagagggtaggaaggcc

SEQ ID NO: 8031522 - DNA, 19 bp, Homo sapiens
tgcagagggtaggaaggcc

SEQ ID NO: 8031523 - DNA, 22 bp, Homo sapiens
tgcagagggacagccacagctc

SEQ ID NO: 8031524 - DNA, 22 bp, Homo sapiens
tgcagagggacagccacagctc

SEQ ID NO: 8031525 - DNA, 22 bp, Homo sapiens
tgcagagggacagccacagctc

SEQ ID NO: 8031526 - DNA, 22 bp, Homo sapiens
tgcagagggacagccacagctc

SEQ ID NO: 8031527 - DNA, 22 bp, Homo sapiens
tgcagagggacagccacagctc

SEQ ID NO: 8031528 - DNA, 23 bp, Homo sapiens
tgcagagggactgaagccagctt

SEQ ID NO: 8031529 - DNA, 22 bp, Homo sapiens
tgcagagggaaaaggtgctcct

SEQ ID NO: 8031530 - DNA, 22 bp, Homo sapiens
tgcagagggaaaaggtgctcct

SEQ ID NO: 8031531 - DNA, 22 bp, Homo sapiens
tgcagagggaaaaggtgctcct

SEQ ID NO: 8031532 - DNA, 22 bp, Homo sapiens
tgcagagggaaaaggtgctcct

SEQ ID NO: 8031533 - DNA, 22 bp, Homo sapiens
tgcagagggacagccacagctc

SEQ ID NO: 8031534 - DNA, 22 bp, Homo sapiens
tgcagagggacagccacagctc

SEQ ID NO: 8031535 - DNA, 22 bp, Homo sapiens
tgcagagggacagccacagctc

SEQ ID NO: 8031536 - DNA, 23 bp, Homo sapiens
tgcagagggactgaagccagctt

SEQ ID NO: 8031537 - DNA, 23 bp, Homo sapiens
tgcagagggactgaagccagctt

SEQ ID NO: 8031538 - DNA, 23 bp, Homo sapiens
tgcagagggactgaagccagctt

SEQ ID NO: 8031539 - DNA, 23 bp, Homo sapiens
tgcagagggactgaagccagctt

SEQ ID NO: 8031540 - DNA, 23 bp, Homo sapiens
tgcagagggactgaagccagctt

SEQ ID NO: 8031541 - DNA, 23 bp, Homo sapiens
tgcagagggactgaagccagctt

SEQ ID NO: 8031542 - DNA, 22 bp, Homo sapiens
tgcagagggagtgacggttcac

SEQ ID NO: 8031543 - DNA, 19 bp, Homo sapiens
tgcagagggtaggaaggcc

SEQ ID NO: 8031544 - DNA, 19 bp, Homo sapiens
tgcagagggtaggaaggcc

SEQ ID NO: 8031545 - DNA, 19 bp, Homo sapiens
tgcagagggtaggaaggcc

SEQ ID NO: 8031546 - DNA, 19 bp, Homo sapiens
tgcagagggtaggaaggcc

SEQ ID NO: 8031547 - DNA, 19 bp, Homo sapiens
tgcagagggtaggaaggcc

SEQ ID NO: 8031548 - DNA, 22 bp, Homo sapiens
tgcagagggagtgacggttcac

SEQ ID NO: 8031549 - DNA, 22 bp, Homo sapiens
tgcagagggagtgacggttcac

SEQ ID NO: 8031550 - DNA, 22 bp, Homo sapiens
tgcagagggagtgacggttcac

SEQ ID NO: 8031551 - DNA, 22 bp, Homo sapiens
tgcagagggagtgacggttcac

SEQ ID NO: 8031552 - DNA, 22 bp, Homo sapiens
tgcagatgagagggagttttta

SEQ ID NO: 8031553 - DNA, 22 bp, Homo sapiens
tgcagatgagggatgaaaatga

SEQ ID NO: 8031554 - DNA, 22 bp, Homo sapiens
tgcagatgcctgggctgcacca

SEQ ID NO: 8031555 - DNA, 22 bp, Homo sapiens
tgcagatggggatcagtggctc

SEQ ID NO: 8031556 - DNA, 22 bp, Homo sapiens
tgcagatggggatcagtggctc

SEQ ID NO: 8031557 - DNA, 22 bp, Homo sapiens
tgcagattcaaatgaaatgcaa

SEQ ID NO: 8031558 - DNA, 22 bp, Homo sapiens
tgcagattcaaatgaaatgcaa

SEQ ID NO: 8031559 - DNA, 22 bp, Homo sapiens
tgcagcaaaaggtcagagggag

SEQ ID NO: 8031560 - DNA, 22 bp, Homo sapiens
tgcagattcaaatgaaatgcaa

SEQ ID NO: 8031561 - DNA, 22 bp, Homo sapiens
tgcagattcaaatgaaatgcaa

SEQ ID NO: 8031562 - DNA, 22 bp, Homo sapiens
tgcagattcaaatgaaatgcaa

SEQ ID NO: 8031563 - DNA, 22 bp, Homo sapiens
tgcagattcaaatgaaatgcaa

SEQ ID NO: 8031564 - DNA, 22 bp, Homo sapiens
tgcagattcaaatgaaatgcaa

SEQ ID NO: 8031565 - DNA, 22 bp, Homo sapiens
tgcagcaagtaaccatcttcct

SEQ ID NO: 8031566 - DNA, 22 bp, Homo sapiens
tgcagcaatttgcagtaattta

SEQ ID NO: 8031567 - DNA, 22 bp, Homo sapiens
tgcagcaatttgcagtaattta

SEQ ID NO: 8031568 - DNA, 22 bp, Homo sapiens
tgcagcaatgtagtttgggaca

SEQ ID NO: 8031569 - DNA, 17 bp, Homo sapiens
tgcagcaaatgggggac

SEQ ID NO: 8031570 - DNA, 17 bp, Homo sapiens
tgcagcaaatgggggac

SEQ ID NO: 8031571 - DNA, 23 bp, Homo sapiens
tgcagcaaccttggaagcatttc

SEQ ID NO: 8031572 - DNA, 22 bp, Homo sapiens
tgcagcaagcaagtatggttct

SEQ ID NO: 8031573 - DNA, 22 bp, Homo sapiens
tgcagcaagaccggatatgtcg

SEQ ID NO: 8031574 - DNA, 20 bp, Homo sapiens
tgcagcacgggccctttcca

SEQ ID NO: 8031575 - DNA, 20 bp, Homo sapiens
tgcagcacgggccctttcca

SEQ ID NO: 8031576 - DNA, 22 bp, Homo sapiens
tgcagcacctatggacacttgt

SEQ ID NO: 8031577 - DNA, 22 bp, Homo sapiens
tgcagcacttgccaaactaact

SEQ ID NO: 8031578 - DNA, 22 bp, Homo sapiens
tgcagcacttgccaaactaact

SEQ ID NO: 8031579 - DNA, 22 bp, Homo sapiens
tgcagcactgttcacaatagcc

SEQ ID NO: 8031580 - DNA, 19 bp, Homo sapiens
tgcagcactaaaaactttc

SEQ ID NO: 8031581 - DNA, 19 bp, Homo sapiens
tgcagcactaaaaactttc

SEQ ID NO: 8031582 - DNA, 22 bp, Homo sapiens
tgcagcaccacacctggctaat

SEQ ID NO: 8031583 - DNA, 22 bp, Homo sapiens
tgcagcaccgtcccactggcta

SEQ ID NO: 8031584 - DNA, 22 bp, Homo sapiens
tgcagcaccgtcccactggcta

SEQ ID NO: 8031585 - DNA, 22 bp, Homo sapiens
tgcagcacctatggacacttgt

SEQ ID NO: 8031586 - DNA, 20 bp, Homo sapiens
tgcagcacgggccctttcca

SEQ ID NO: 8031587 - DNA, 21 bp, Homo sapiens
tgcagcagaagtctctgtgtc

SEQ ID NO: 8031588 - DNA, 21 bp, Homo sapiens
tgcagcagaagtctctgtgtc

SEQ ID NO: 8031589 - DNA, 22 bp, Homo sapiens
tgcagcagaatatggctgcagg

SEQ ID NO: 8031590 - DNA, 22 bp, Homo sapiens
tgcagcagaatatggctgcagg

SEQ ID NO: 8031591 - DNA, 22 bp, Homo sapiens
tgcagcagaatatggctgcagg

SEQ ID NO: 8031592 - DNA, 22 bp, Homo sapiens
tgcagcagaatatggctgcagg

SEQ ID NO: 8031593 - DNA, 22 bp, Homo sapiens
tgcagcagaatatggctgcagg

SEQ ID NO: 8031594 - DNA, 21 bp, Homo sapiens
tgcagcagaagtctctgtgtc

SEQ ID NO: 8031595 - DNA, 22 bp, Homo sapiens
tgcagcagaatatggctgcagg

SEQ ID NO: 8031596 - DNA, 22 bp, Homo sapiens
tgcagcagaatatggctgcagg

SEQ ID NO: 8031597 - DNA, 22 bp, Homo sapiens
tgcagcagaatatggctgcagg

SEQ ID NO: 8031598 - DNA, 22 bp, Homo sapiens
tgcagcagaagtgttcttctct

SEQ ID NO: 8031599 - DNA, 21 bp, Homo sapiens
tgcagaggcacaaacaagccc

SEQ ID NO: 8031600 - DNA, 21 bp, Homo sapiens
tgcagaggcacaaacaagccc

SEQ ID NO: 8031601 - DNA, 21 bp, Homo sapiens
tgcagaggcacaaacaagccc

SEQ ID NO: 8031602 - DNA, 22 bp, Homo sapiens
tgcagaggagtcagcctgggca

SEQ ID NO: 8031603 - DNA, 22 bp, Homo sapiens
tgcagaggagtcagcctgggca

SEQ ID NO: 8031604 - DNA, 22 bp, Homo sapiens
tgcagaggagtcagcctgggca

SEQ ID NO: 8031605 - DNA, 22 bp, Homo sapiens
tgcagaggagtcagcctgggca

SEQ ID NO: 8031606 - DNA, 22 bp, Homo sapiens
tgcagaggagctggaaggctgg

SEQ ID NO: 8031607 - DNA, 22 bp, Homo sapiens
tgcagaggagtcagcctgggca

SEQ ID NO: 8031608 - DNA, 22 bp, Homo sapiens
tgcagaggagtcagcctgggca

SEQ ID NO: 8031609 - DNA, 22 bp, Homo sapiens
tgcagaggagtcagcctgggca

SEQ ID NO: 8031610 - DNA, 22 bp, Homo sapiens
tgcagaggagtcagcctgggca

SEQ ID NO: 8031611 - DNA, 22 bp, Homo sapiens
tgcagaggagctggaaggctgg

SEQ ID NO: 8031612 - DNA, 22 bp, Homo sapiens
tgcagaggagctggaaggctgg

SEQ ID NO: 8031613 - DNA, 22 bp, Homo sapiens
tgcagaggagctggaaggctgg

SEQ ID NO: 8031614 - DNA, 22 bp, Homo sapiens
tgcagaggagctggaaggctgg

SEQ ID NO: 8031615 - DNA, 22 bp, Homo sapiens
tgcagaggagctggaaggctgg

SEQ ID NO: 8031616 - DNA, 22 bp, Homo sapiens
tgcagaggagctggaaggctgg

SEQ ID NO: 8031617 - DNA, 22 bp, Homo sapiens
tgcagaggagctggaaggctgg

SEQ ID NO: 8031618 - DNA, 22 bp, Homo sapiens
tgcagaggagctggaaggctgg

SEQ ID NO: 8031619 - DNA, 22 bp, Homo sapiens
tgcagaggagctggaaggctgg

SEQ ID NO: 8031620 - DNA, 22 bp, Homo sapiens
tgcagaggagctggaaggctgg

SEQ ID NO: 8031621 - DNA, 22 bp, Homo sapiens
tgcagaggagctggaaggctgg

SEQ ID NO: 8031622 - DNA, 22 bp, Homo sapiens
tgcagaggagctggaaggctgg

SEQ ID NO: 8031623 - DNA, 22 bp, Homo sapiens
tgcagaggagctggaaggctgg

SEQ ID NO: 8031624 - DNA, 22 bp, Homo sapiens
tgcagaggcgccgtgggtgggg

SEQ ID NO: 8031625 - DNA, 22 bp, Homo sapiens
tgcagaggcgccgtgggtgggg

SEQ ID NO: 8031626 - DNA, 22 bp, Homo sapiens
tgcagaggcgccgtgggtgggg

SEQ ID NO: 8031627 - DNA, 22 bp, Homo sapiens
tgcagaggcgccgtgggtgggg

SEQ ID NO: 8031628 - DNA, 22 bp, Homo sapiens
tgcagaggcgccgtgggtgggg

SEQ ID NO: 8031629 - DNA, 22 bp, Homo sapiens
tgcagaggcgccgtgggtgggg

SEQ ID NO: 8031630 - DNA, 22 bp, Homo sapiens
tgcagaggctggctcgccgggt

SEQ ID NO: 8031631 - DNA, 22 bp, Homo sapiens
tgcagagggaaaaggtgctcct

SEQ ID NO: 8031632 - DNA, 22 bp, Homo sapiens
tgcagaggctggctcgccgggt

SEQ ID NO: 8031633 - DNA, 22 bp, Homo sapiens
tgcagaggctggctcgccgggt

SEQ ID NO: 8031634 - DNA, 22 bp, Homo sapiens
tgcagaggctggctcgccgggt

SEQ ID NO: 8031635 - DNA, 22 bp, Homo sapiens
tgcagaggctggctcgccgggt

SEQ ID NO: 8031636 - DNA, 22 bp, Homo sapiens
tgcagaggcccagcggttcttc

SEQ ID NO: 8031637 - DNA, 22 bp, Homo sapiens
tgcagaggcccagcggttcttc

SEQ ID NO: 8031638 - DNA, 22 bp, Homo sapiens
tgcagaggcccagcggttcttc

SEQ ID NO: 8031639 - DNA, 22 bp, Homo sapiens
tgcagaggcatttattgatgta

SEQ ID NO: 8031640 - DNA, 22 bp, Homo sapiens
tgcagaggcatttattgatgta

SEQ ID NO: 8031641 - DNA, 23 bp, Homo sapiens
tgcagaggcatgatcactgctca

SEQ ID NO: 8031642 - DNA, 23 bp, Homo sapiens
tgcagaggcatgatcactgctca

SEQ ID NO: 8031643 - DNA, 23 bp, Homo sapiens
tgcagaggcatgatcactgctca

SEQ ID NO: 8031644 - DNA, 23 bp, Homo sapiens
tgcagaggcatgatcactgctca

SEQ ID NO: 8031645 - DNA, 23 bp, Homo sapiens
tgcagaggcatgatcactgctca

SEQ ID NO: 8031646 - DNA, 23 bp, Homo sapiens
tgcagaggcatgatcactgctca

SEQ ID NO: 8031647 - DNA, 21 bp, Homo sapiens
tgcagaggcacaaacaagccc

SEQ ID NO: 8031648 - DNA, 23 bp, Homo sapiens
tgcagaggcatgatcactgctca

SEQ ID NO: 8031649 - DNA, 21 bp, Homo sapiens
tgcagaggcacaaacaagccc

SEQ ID NO: 8031650 - DNA, 21 bp, Homo sapiens
tgcagaggcacaaacaagccc

SEQ ID NO: 8031651 - DNA, 22 bp, Homo sapiens
tgcagaggagctggaaggctgg

SEQ ID NO: 8031652 - DNA, 22 bp, Homo sapiens
tgcagaggagctggaaggctgg

SEQ ID NO: 8031653 - DNA, 22 bp, Homo sapiens
tgcagaggagctggaaggctgg

SEQ ID NO: 8031654 - DNA, 22 bp, Homo sapiens
tgcagaggagctggaaggctgg

SEQ ID NO: 8031655 - DNA, 22 bp, Homo sapiens
tgcagaggagctggaaggctgg

SEQ ID NO: 8031656 - DNA, 22 bp, Homo sapiens
tgcagaggaccattgtcctgga

SEQ ID NO: 8031657 - DNA, 22 bp, Homo sapiens
tgcagaggaccattgtcctgga

SEQ ID NO: 8031658 - DNA, 22 bp, Homo sapiens
tgcagaggaccattgtcctgga

SEQ ID NO: 8031659 - DNA, 22 bp, Homo sapiens
tgcagaggagctggaaggctgg

SEQ ID NO: 8031660 - DNA, 20 bp, Homo sapiens
tgcagagctggctggctcct

SEQ ID NO: 8031661 - DNA, 20 bp, Homo sapiens
tgcagagctggctggctcct

SEQ ID NO: 8031662 - DNA, 20 bp, Homo sapiens
tgcagagctggctggctcct

SEQ ID NO: 8031663 - DNA, 22 bp, Homo sapiens
tgcagagcttcattgcataggc

SEQ ID NO: 8031664 - DNA, 22 bp, Homo sapiens
tgcagagcttcattgcataggc

SEQ ID NO: 8031665 - DNA, 22 bp, Homo sapiens
tgcagagcttcattgcataggc

SEQ ID NO: 8031666 - DNA, 22 bp, Homo sapiens
tgcagagcttcattgcataggc

SEQ ID NO: 8031667 - DNA, 22 bp, Homo sapiens
tgcagaggaccattgtcctgga

SEQ ID NO: 8031668 - DNA, 22 bp, Homo sapiens
tgcagagccccagattggagag

SEQ ID NO: 8031669 - DNA, 20 bp, Homo sapiens
tgcagagctggctggctcct

SEQ ID NO: 8031670 - DNA, 20 bp, Homo sapiens
tgcagagctgacattacctg

SEQ ID NO: 8031671 - DNA, 20 bp, Homo sapiens
tgcagagctgacattacctg

SEQ ID NO: 8031672 - DNA, 22 bp, Homo sapiens
tgcagagccccagattggagag

SEQ ID NO: 8031673 - DNA, 22 bp, Homo sapiens
tgcagagcagcaactgcgtgcg

SEQ ID NO: 8031674 - DNA, 22 bp, Homo sapiens
tgcagagcagcaactgcgtgcg

SEQ ID NO: 8031675 - DNA, 22 bp, Homo sapiens
tgcagagcagcaactgcgtgcg

SEQ ID NO: 8031676 - DNA, 22 bp, Homo sapiens
tgcagagcagcaactgcgtgcg

SEQ ID NO: 8031677 - DNA, 22 bp, Homo sapiens
tgcagagcagcaactgcgtgcg

SEQ ID NO: 8031678 - DNA, 22 bp, Homo sapiens
tgcagagatttggctcttaaag

SEQ ID NO: 8031679 - DNA, 22 bp, Homo sapiens
tgcagagatctgggcgtcggct

SEQ ID NO: 8031680 - DNA, 22 bp, Homo sapiens
tgcagagatctgggcgtcggct

SEQ ID NO: 8031681 - DNA, 22 bp, Homo sapiens
tgcagaattatggtgctggctt

SEQ ID NO: 8031682 - DNA, 22 bp, Homo sapiens
tgcagaatttagggaggcagca

SEQ ID NO: 8031683 - DNA, 22 bp, Homo sapiens
tgcagacaagaagaaccaagga

SEQ ID NO: 8031684 - DNA, 22 bp, Homo sapiens
tgcagaatgttatcaaagttag

SEQ ID NO: 8031685 - DNA, 22 bp, Homo sapiens
tgcagaatgttatcaaagttag

SEQ ID NO: 8031686 - DNA, 22 bp, Homo sapiens
tgcagaatgtggacagtgggtt

SEQ ID NO: 8031687 - DNA, 22 bp, Homo sapiens
tgcagaatgtggacagtgggtt

SEQ ID NO: 8031688 - DNA, 22 bp, Homo sapiens
tgcagacaagtcgtgggatctt

SEQ ID NO: 8031689 - DNA, 22 bp, Homo sapiens
tgcagacaagtgcatctaaccc

SEQ ID NO: 8031690 - DNA, 22 bp, Homo sapiens
tgcagacaagtcgtgggatctt

SEQ ID NO: 8031691 - DNA, 22 bp, Homo sapiens
tgcagacaagccaggctatggc

SEQ ID NO: 8031692 - DNA, 22 bp, Homo sapiens
tgcagacaagccaggctatggc

SEQ ID NO: 8031693 - DNA, 21 bp, Homo sapiens
tgcagacagggacagaatgga

SEQ ID NO: 8031694 - DNA, 22 bp, Homo sapiens
tgcagacagagaaatgaggccc

SEQ ID NO: 8031695 - DNA, 22 bp, Homo sapiens
tgcagagaaaactcctgggtac

SEQ ID NO: 8031696 - DNA, 23 bp, Homo sapiens
tgcagacttcgaggagggggata

SEQ ID NO: 8031697 - DNA, 22 bp, Homo sapiens
tgcagagaaaccagtggaggac

SEQ ID NO: 8031698 - DNA, 22 bp, Homo sapiens
tgcagagaaaactcctgggtac

SEQ ID NO: 8031699 - DNA, 22 bp, Homo sapiens
tgcagagaaaccagtggaggac

SEQ ID NO: 8031700 - DNA, 22 bp, Homo sapiens
tgcagagaaaccagtggaggac

SEQ ID NO: 8031701 - DNA, 22 bp, Homo sapiens
tgcagagatcctggactgagcg

SEQ ID NO: 8031702 - DNA, 22 bp, Homo sapiens
tgcagagatcctggactgagcg

SEQ ID NO: 8031703 - DNA, 22 bp, Homo sapiens
tgcagagatcctggactgagcg

SEQ ID NO: 8031704 - DNA, 22 bp, Homo sapiens
tgcagaaataaagatattatca

SEQ ID NO: 8031705 - DNA, 22 bp, Homo sapiens
tgcagaaataactcatattgca

SEQ ID NO: 8031706 - DNA, 22 bp, Homo sapiens
tgcagaaagcattgactcttcc

SEQ ID NO: 8031707 - DNA, 21 bp, Homo sapiens
tgcagaaagcggcttgaagca

SEQ ID NO: 8031708 - DNA, 21 bp, Homo sapiens
tgcagaaagcggcttgaagca

SEQ ID NO: 8031709 - DNA, 22 bp, Homo sapiens
tgcagaaagtcacattcccttt

SEQ ID NO: 8031710 - DNA, 22 bp, Homo sapiens
tgcagaaaccaattcaagtaag

SEQ ID NO: 8031711 - DNA, 22 bp, Homo sapiens
tgcagaaaccaattcaagtaag

SEQ ID NO: 8031712 - DNA, 22 bp, Homo sapiens
tgcagaaaccaattcaagtaag

SEQ ID NO: 8031713 - DNA, 22 bp, Homo sapiens
tgcagaaaccaattcaagtaag

SEQ ID NO: 8031714 - DNA, 22 bp, Homo sapiens
tgcagaaagcattgactcttcc

SEQ ID NO: 8031715 - DNA, 22 bp, Homo sapiens
tgcagaaattcagaaagcataa

SEQ ID NO: 8031716 - DNA, 21 bp, Homo sapiens
tgcagaaatggtttttctaag

SEQ ID NO: 8031717 - DNA, 22 bp, Homo sapiens
tgcagaacaatgagagctgaga

SEQ ID NO: 8031718 - DNA, 21 bp, Homo sapiens
tgcagaaatggtttttctaag

SEQ ID NO: 8031719 - DNA, 22 bp, Homo sapiens
tgcagaaattcagaaagcataa

SEQ ID NO: 8031720 - DNA, 22 bp, Homo sapiens
tgcagaaattcagaaagcataa

SEQ ID NO: 8031721 - DNA, 22 bp, Homo sapiens
tgcagaaattcagaaagcataa

SEQ ID NO: 8031722 - DNA, 22 bp, Homo sapiens
tgcagaaattcagaaagcataa

SEQ ID NO: 8031723 - DNA, 21 bp, Homo sapiens
tgcagaaatggtttttctaag

SEQ ID NO: 8031724 - DNA, 22 bp, Homo sapiens
tgcagaaataactcatattgca

SEQ ID NO: 8031725 - DNA, 21 bp, Homo sapiens
tgcagaaatggtttttctaag

SEQ ID NO: 8031726 - DNA, 22 bp, Homo sapiens
tgcagaaataactcatattgca

SEQ ID NO: 8031727 - DNA, 22 bp, Homo sapiens
tgcagaaataactcatattgca

SEQ ID NO: 8031728 - DNA, 22 bp, Homo sapiens
tgcagaaataactcatattgca

SEQ ID NO: 8031729 - DNA, 22 bp, Homo sapiens
tgcagaaataactcatattgca

SEQ ID NO: 8031730 - DNA, 22 bp, Homo sapiens
tgcacgtgggctctctgctctt

SEQ ID NO: 8031731 - DNA, 22 bp, Homo sapiens
tgcacgtgggctctctgctctt

SEQ ID NO: 8031732 - DNA, 22 bp, Homo sapiens
tgcacgaaatctttctagtctt

SEQ ID NO: 8031733 - DNA, 22 bp, Homo sapiens
tgcacctttaaattcagcagta

SEQ ID NO: 8031734 - DNA, 22 bp, Homo sapiens
tgcacctttaaattcagcagta

SEQ ID NO: 8031735 - DNA, 19 bp, Homo sapiens
tgcacgttggaatcacctg

SEQ ID NO: 8031736 - DNA, 22 bp, Homo sapiens
tgcacgttgaagtcccaggttg

SEQ ID NO: 8031737 - DNA, 22 bp, Homo sapiens
tgcacgtgtgagcattcacatg

SEQ ID NO: 8031738 - DNA, 22 bp, Homo sapiens
tgcacgtgggctctctgctctt

SEQ ID NO: 8031739 - DNA, 22 bp, Homo sapiens
tgcacgtgggctctctgctctt

SEQ ID NO: 8031740 - DNA, 22 bp, Homo sapiens
tgcacgtgggctctctgctctt

SEQ ID NO: 8031741 - DNA, 22 bp, Homo sapiens
tgcacgtgtgagcattcacatg

SEQ ID NO: 8031742 - DNA, 18 bp, Homo sapiens
tgcactagatgctggcag

SEQ ID NO: 8031743 - DNA, 22 bp, Homo sapiens
tgcactttgcaggcatggaaac

SEQ ID NO: 8031744 - DNA, 21 bp, Homo sapiens
tgcactttgggggacaggctg

SEQ ID NO: 8031745 - DNA, 22 bp, Homo sapiens
tgcactactgtgatacacagcc

SEQ ID NO: 8031746 - DNA, 22 bp, Homo sapiens
tgcactactgtgatacacagcc

SEQ ID NO: 8031747 - DNA, 22 bp, Homo sapiens
tgcactactgtgatacacagcc

SEQ ID NO: 8031748 - DNA, 22 bp, Homo sapiens
tgcagaaacaagccatcattca

SEQ ID NO: 8031749 - DNA, 22 bp, Homo sapiens
tgcagaaacaagccatcattca

SEQ ID NO: 8031750 - DNA, 22 bp, Homo sapiens
tgcagaaacaagccatcattca

SEQ ID NO: 8031751 - DNA, 22 bp, Homo sapiens
tgcagaaacaagccatcattca

SEQ ID NO: 8031752 - DNA, 22 bp, Homo sapiens
tgcagaaacagagttttgccat

SEQ ID NO: 8031753 - DNA, 22 bp, Homo sapiens
tgcagaaacagtcattaatgta

SEQ ID NO: 8031754 - DNA, 22 bp, Homo sapiens
tgcagaaacagtcattaatgta

SEQ ID NO: 8031755 - DNA, 22 bp, Homo sapiens
tgcagaagcagagccggtggcc

SEQ ID NO: 8031756 - DNA, 22 bp, Homo sapiens
tgcagaagcagagccggtggcc

SEQ ID NO: 8031757 - DNA, 22 bp, Homo sapiens
tgcagaagctgcaggtcagtgg

SEQ ID NO: 8031758 - DNA, 22 bp, Homo sapiens
tgcagaagctgcaggtcagtgg

SEQ ID NO: 8031759 - DNA, 22 bp, Homo sapiens
tgcagaagcagagagttgccaa

SEQ ID NO: 8031760 - DNA, 22 bp, Homo sapiens
tgcagaagaccttccagggctg

SEQ ID NO: 8031761 - DNA, 22 bp, Homo sapiens
tgcagaagatggtctgagcacc

SEQ ID NO: 8031762 - DNA, 22 bp, Homo sapiens
tgcagaagatggtctgagcacc

SEQ ID NO: 8031763 - DNA, 22 bp, Homo sapiens
tgcagaagcagagagttgccaa

SEQ ID NO: 8031764 - DNA, 22 bp, Homo sapiens
tgcagaagcagagagttgccaa

SEQ ID NO: 8031765 - DNA, 22 bp, Homo sapiens
tgcagaagctgcaggtcagtgg

SEQ ID NO: 8031766 - DNA, 22 bp, Homo sapiens
tgcagaaggcctgacattgcac

SEQ ID NO: 8031767 - DNA, 22 bp, Homo sapiens
tgcagaagtgagtcatgaggaa

SEQ ID NO: 8031768 - DNA, 22 bp, Homo sapiens
tgcagaagtgagtcatgaggaa

SEQ ID NO: 8031769 - DNA, 22 bp, Homo sapiens
tgcagaagtattccaggcccca

SEQ ID NO: 8031770 - DNA, 22 bp, Homo sapiens
tgcagaagtattccaggcccca

SEQ ID NO: 8031771 - DNA, 22 bp, Homo sapiens
tgcagaagacacaaggtaacgt

SEQ ID NO: 8031772 - DNA, 19 bp, Homo sapiens
tgcagaagacacagtggtg

SEQ ID NO: 8031773 - DNA, 19 bp, Homo sapiens
tgcagaagacacagtggtg

SEQ ID NO: 8031774 - DNA, 22 bp, Homo sapiens
tgcagaagaatgtaggcataag

SEQ ID NO: 8031775 - DNA, 22 bp, Homo sapiens
tgcagaagaatgtaggcataag

SEQ ID NO: 8031776 - DNA, 20 bp, Homo sapiens
tgcagaagaacgttctggtt

SEQ ID NO: 8031777 - DNA, 22 bp, Homo sapiens
tgcagaagaatgagcttggagt

SEQ ID NO: 8031778 - DNA, 22 bp, Homo sapiens
tgcagaagaatgagcttggagt

SEQ ID NO: 8031779 - DNA, 20 bp, Homo sapiens
tgcagaagaacgttctggtt

SEQ ID NO: 8031780 - DNA, 22 bp, Homo sapiens
tgcagaagaaaacagctgtgtg

SEQ ID NO: 8031781 - DNA, 22 bp, Homo sapiens
tgcagaacagggccatgtcacc

SEQ ID NO: 8031782 - DNA, 22 bp, Homo sapiens
tgcagaaccagtcctcagaccc

SEQ ID NO: 8031783 - DNA, 22 bp, Homo sapiens
tgcagaaccagtcctcagaccc

SEQ ID NO: 8031784 - DNA, 22 bp, Homo sapiens
tgcagaagaaaacagctgtgtg

SEQ ID NO: 8031785 - DNA, 22 bp, Homo sapiens
tgcagaagaaaacagctgtgtg

SEQ ID NO: 8031786 - DNA, 22 bp, Homo sapiens
tgcagaaccccttcccaggccc

SEQ ID NO: 8031787 - DNA, 22 bp, Homo sapiens
tgcagaagaaaacagctgtgtg

SEQ ID NO: 8031788 - DNA, 22 bp, Homo sapiens
tgcacaggtgagactcaggaag

SEQ ID NO: 8031789 - DNA, 22 bp, Homo sapiens
tgcacaggtgagactcaggaag

SEQ ID NO: 8031790 - DNA, 22 bp, Homo sapiens
tgcacaggtgagactcaggaag

SEQ ID NO: 8031791 - DNA, 22 bp, Homo sapiens
tgcacaggtatgcaaagcatgt

SEQ ID NO: 8031792 - DNA, 22 bp, Homo sapiens
tgcacaggtatgcaaagcatgt

SEQ ID NO: 8031793 - DNA, 22 bp, Homo sapiens
tgcacaggtgagactcaggaag

SEQ ID NO: 8031794 - DNA, 22 bp, Homo sapiens
tgcacaggtgagactcaggaag

SEQ ID NO: 8031795 - DNA, 20 bp, Homo sapiens
tgcacagggtgggaagcaac

SEQ ID NO: 8031796 - DNA, 22 bp, Homo sapiens
tgcacaggtatgcaaagcatgt

SEQ ID NO: 8031797 - DNA, 22 bp, Homo sapiens
tgcacaggtatgcaaagcatgt

SEQ ID NO: 8031798 - DNA, 20 bp, Homo sapiens
tgcacagggtgggaagcaac

SEQ ID NO: 8031799 - DNA, 20 bp, Homo sapiens
tgcacagggtgggaagcaac

SEQ ID NO: 8031800 - DNA, 20 bp, Homo sapiens
tgcacagggtgggaagcaac

SEQ ID NO: 8031801 - DNA, 20 bp, Homo sapiens
tgcacagggtgggaagcaac

SEQ ID NO: 8031802 - DNA, 21 bp, Homo sapiens
tgcacagggcccaggagagcc

SEQ ID NO: 8031803 - DNA, 22 bp, Homo sapiens
tgcacagggagggggccagctc

SEQ ID NO: 8031804 - DNA, 22 bp, Homo sapiens
tgcacagggagggggccagctc

SEQ ID NO: 8031805 - DNA, 21 bp, Homo sapiens
tgcacagggcccaggagagcc

SEQ ID NO: 8031806 - DNA, 21 bp, Homo sapiens
tgcacagggcccaggagagcc

SEQ ID NO: 8031807 - DNA, 21 bp, Homo sapiens
tgcacagggcccaggagagcc

SEQ ID NO: 8031808 - DNA, 21 bp, Homo sapiens
tgcacagggcccaggagagcc

SEQ ID NO: 8031809 - DNA, 21 bp, Homo sapiens
tgcacagggcccaggagagcc

SEQ ID NO: 8031810 - DNA, 21 bp, Homo sapiens
tgcacagggcccaggagagcc

SEQ ID NO: 8031811 - DNA, 22 bp, Homo sapiens
tgcacaggccttgaagggagag

SEQ ID NO: 8031812 - DNA, 22 bp, Homo sapiens
tgcacagggagggggccagctc

SEQ ID NO: 8031813 - DNA, 22 bp, Homo sapiens
tgcacagggagggggccagctc

SEQ ID NO: 8031814 - DNA, 22 bp, Homo sapiens
tgcacaggccttgaagggagag

SEQ ID NO: 8031815 - DNA, 22 bp, Homo sapiens
tgcacaggccttgaagggagag

SEQ ID NO: 8031816 - DNA, 22 bp, Homo sapiens
tgcacaggccttgaagggagag

SEQ ID NO: 8031817 - DNA, 22 bp, Homo sapiens
tgcacaggaggctgtggagaag

SEQ ID NO: 8031818 - DNA, 22 bp, Homo sapiens
tgcacaggaggctgtggagaag

SEQ ID NO: 8031819 - DNA, 23 bp, Homo sapiens
tgcacaggacggccttataagta

SEQ ID NO: 8031820 - DNA, 23 bp, Homo sapiens
tgcacaggacggccttataagta

SEQ ID NO: 8031821 - DNA, 23 bp, Homo sapiens
tgcacaggacggccttataagta

SEQ ID NO: 8031822 - DNA, 18 bp, Homo sapiens
tgcacagctgtgggctgg

SEQ ID NO: 8031823 - DNA, 18 bp, Homo sapiens
tgcacagctgtgggctgg

SEQ ID NO: 8031824 - DNA, 22 bp, Homo sapiens
tgcacagctgcctcctctctgc

SEQ ID NO: 8031825 - DNA, 22 bp, Homo sapiens
tgcacagcgggtgtctgtcagg

SEQ ID NO: 8031826 - DNA, 22 bp, Homo sapiens
tgcacagctgcctcctctctgc

SEQ ID NO: 8031827 - DNA, 22 bp, Homo sapiens
tgcacagctgcctcctctctgc

SEQ ID NO: 8031828 - DNA, 20 bp, Homo sapiens
tgcacagctgtgaataggat

SEQ ID NO: 8031829 - DNA, 20 bp, Homo sapiens
tgcacagctgtgaataggat

SEQ ID NO: 8031830 - DNA, 22 bp, Homo sapiens
tgcacagctggctctccttttc

SEQ ID NO: 8031831 - DNA, 22 bp, Homo sapiens
tgcacagctggctctccttttc

SEQ ID NO: 8031832 - DNA, 22 bp, Homo sapiens
tgcacagcgggtgtctgtcagg

SEQ ID NO: 8031833 - DNA, 22 bp, Homo sapiens
tgcacagcgcttgtcgggtgtg

SEQ ID NO: 8031834 - DNA, 22 bp, Homo sapiens
tgcacagcgggtgtctgtcagg

SEQ ID NO: 8031835 - DNA, 21 bp, Homo sapiens
tgcacagccataccctccttg

SEQ ID NO: 8031836 - DNA, 22 bp, Homo sapiens
tgcacagcaaatattgactacc

SEQ ID NO: 8031837 - DNA, 21 bp, Homo sapiens
tgcacagccataccctccttg

SEQ ID NO: 8031838 - DNA, 22 bp, Homo sapiens
tgcacacagtggacaagtcttg

SEQ ID NO: 8031839 - DNA, 22 bp, Homo sapiens
tgcacacagttctcaggaaaga

SEQ ID NO: 8031840 - DNA, 22 bp, Homo sapiens
tgcacacagtggacaagtcttg

SEQ ID NO: 8031841 - DNA, 22 bp, Homo sapiens
tgcacacagttctcaggaaaga

SEQ ID NO: 8031842 - DNA, 22 bp, Homo sapiens
tgcacacagtggacaagtcttg

SEQ ID NO: 8031843 - DNA, 22 bp, Homo sapiens
tgcacacatacatgggaagtgc

SEQ ID NO: 8031844 - DNA, 21 bp, Homo sapiens
tgcacagcaaaagttgagtaa

SEQ ID NO: 8031845 - DNA, 22 bp, Homo sapiens
tgcacagttggctacatcgtgg

SEQ ID NO: 8031846 - DNA, 22 bp, Homo sapiens
tgcacatctttcagcatcatac

SEQ ID NO: 8031847 - DNA, 22 bp, Homo sapiens
tgcacatggcaatgctgctccc

SEQ ID NO: 8031848 - DNA, 22 bp, Homo sapiens
tgcacatctttcagcatcatac

SEQ ID NO: 8031849 - DNA, 22 bp, Homo sapiens
tgcacatggcctgagtgcctga

SEQ ID NO: 8031850 - DNA, 22 bp, Homo sapiens
tgcacattgaaatgaccagctg

SEQ ID NO: 8031851 - DNA, 22 bp, Homo sapiens
tgcacattgaaatgaccagctg

SEQ ID NO: 8031852 - DNA, 22 bp, Homo sapiens
tgcacattcacttaggtattgt

SEQ ID NO: 8031853 - DNA, 22 bp, Homo sapiens
tgcacattagtgtttgagatgc

SEQ ID NO: 8031854 - DNA, 22 bp, Homo sapiens
tgcacagtaaacatgactggag

SEQ ID NO: 8031855 - DNA, 22 bp, Homo sapiens
tgcacagtaaacatgactggag

SEQ ID NO: 8031856 - DNA, 22 bp, Homo sapiens
tgcacagtgaccactgagcaag

SEQ ID NO: 8031857 - DNA, 22 bp, Homo sapiens
tgcacagtgaccactgagcaag

SEQ ID NO: 8031858 - DNA, 22 bp, Homo sapiens
tgcacagtaaacatgactggag

SEQ ID NO: 8031859 - DNA, 22 bp, Homo sapiens
tgcacaggtgagactcaggaag

SEQ ID NO: 8031860 - DNA, 22 bp, Homo sapiens
tgcacaggtggtccatctgcac

SEQ ID NO: 8031861 - DNA, 22 bp, Homo sapiens
tgcacaggtggtccatctgcac

SEQ ID NO: 8031862 - DNA, 22 bp, Homo sapiens
tgcacaggtggtccatctgcac

SEQ ID NO: 8031863 - DNA, 22 bp, Homo sapiens
tgcacagtgtaatgaatcagaa

SEQ ID NO: 8031864 - DNA, 22 bp, Homo sapiens
tgcacagtgacccctggtgact

SEQ ID NO: 8031865 - DNA, 22 bp, Homo sapiens
tgcacagtgacccctggtgact

SEQ ID NO: 8031866 - DNA, 22 bp, Homo sapiens
tgcacagtgacccctggtgact

SEQ ID NO: 8031867 - DNA, 22 bp, Homo sapiens
tgcacagtgtaatgaatcagaa

SEQ ID NO: 8031868 - DNA, 22 bp, Homo sapiens
tgcacagtgtaatgaatcagaa

SEQ ID NO: 8031869 - DNA, 22 bp, Homo sapiens
tgcacagttaatatgtgacaga

SEQ ID NO: 8031870 - DNA, 22 bp, Homo sapiens
tgcacagttggctacatcgtgg

SEQ ID NO: 8031871 - DNA, 22 bp, Homo sapiens
tgcaccgttgcactccagagtg

SEQ ID NO: 8031872 - DNA, 22 bp, Homo sapiens
tgcacctgagaggtctctgagg

SEQ ID NO: 8031873 - DNA, 22 bp, Homo sapiens
tgcaccctgcctgcctgcgggt

SEQ ID NO: 8031874 - DNA, 22 bp, Homo sapiens
tgcaccctctgctatgtgctcc

SEQ ID NO: 8031875 - DNA, 22 bp, Homo sapiens
tgcacctggactaactaactca

SEQ ID NO: 8031876 - DNA, 22 bp, Homo sapiens
tgcacctgctcagactcctgtc

SEQ ID NO: 8031877 - DNA, 22 bp, Homo sapiens
tgcacctgctcagactcctgtc

SEQ ID NO: 8031878 - DNA, 22 bp, Homo sapiens
tgcacctgcaatacctgtacct

SEQ ID NO: 8031879 - DNA, 22 bp, Homo sapiens
tgcaccttcattttaggcagct

SEQ ID NO: 8031880 - DNA, 21 bp, Homo sapiens
tgcacctgttcactgcagttc

SEQ ID NO: 8031881 - DNA, 21 bp, Homo sapiens
tgcacctgttcactgcagttc

SEQ ID NO: 8031882 - DNA, 21 bp, Homo sapiens
tgcacctgtgccccatccttc

SEQ ID NO: 8031883 - DNA, 21 bp, Homo sapiens
tgcacctgtgccccatccttc

SEQ ID NO: 8031884 - DNA, 21 bp, Homo sapiens
tgcacctgtgccccatccttc

SEQ ID NO: 8031885 - DNA, 22 bp, Homo sapiens
tgcacctgtagtgagctgtgcc

SEQ ID NO: 8031886 - DNA, 22 bp, Homo sapiens
tgcacctgtagtgagctgtgcc

SEQ ID NO: 8031887 - DNA, 22 bp, Homo sapiens
tgcaccacccgtgggaggactg

SEQ ID NO: 8031888 - DNA, 22 bp, Homo sapiens
tgcaccagagcagggtgcccaa

SEQ ID NO: 8031889 - DNA, 22 bp, Homo sapiens
tgcaccattttgtcaggctact

SEQ ID NO: 8031890 - DNA, 22 bp, Homo sapiens
tgcaccattaatttatgtgaga

SEQ ID NO: 8031891 - DNA, 22 bp, Homo sapiens
tgcacccatagcacacactcct

SEQ ID NO: 8031892 - DNA, 19 bp, Homo sapiens
tgcacccatgtatgcatgc

SEQ ID NO: 8031893 - DNA, 22 bp, Homo sapiens
tgcacccacttagctgaagttc

SEQ ID NO: 8031894 - DNA, 20 bp, Homo sapiens
tgcacccagagcctgaagat

SEQ ID NO: 8031895 - DNA, 22 bp, Homo sapiens
tgcaccctcatcagtcaaatgg

SEQ ID NO: 8031896 - DNA, 18 bp, Homo sapiens
tgcaccctaagggcccca

SEQ ID NO: 8031897 - DNA, 22 bp, Homo sapiens
tgcagcagggcccaggcacaga

SEQ ID NO: 8031898 - DNA, 22 bp, Homo sapiens
tgcagcagggcccaggcacaga

SEQ ID NO: 8031899 - DNA, 22 bp, Homo sapiens
tgcagcagggcccaggcacaga

SEQ ID NO: 8031900 - DNA, 22 bp, Homo sapiens
tgcagcagggcccaggcacaga

SEQ ID NO: 8031901 - DNA, 22 bp, Homo sapiens
tgcagcaggcacaggacggaag

SEQ ID NO: 8031902 - DNA, 22 bp, Homo sapiens
tgcagcagggacctctatgtga

SEQ ID NO: 8031903 - DNA, 22 bp, Homo sapiens
tgcagcaggcacaggacggaag

SEQ ID NO: 8031904 - DNA, 22 bp, Homo sapiens
tgcagcaggcacaggacggaag

SEQ ID NO: 8031905 - DNA, 22 bp, Homo sapiens
tgcagcaggcacaggacggaag

SEQ ID NO: 8031906 - DNA, 22 bp, Homo sapiens
tgcagcaggagccaggcctggt

SEQ ID NO: 8031907 - DNA, 22 bp, Homo sapiens
tgcagcaggagccaggcctggt

SEQ ID NO: 8031908 - DNA, 22 bp, Homo sapiens
tgcagcagctccaggttaccct

SEQ ID NO: 8031909 - DNA, 22 bp, Homo sapiens
tgcagcagcctcatctggtttc

SEQ ID NO: 8031910 - DNA, 22 bp, Homo sapiens
tgcagcagcagggaggaggctc

SEQ ID NO: 8031911 - DNA, 22 bp, Homo sapiens
tgcagcagcagggaggaggctc

SEQ ID NO: 8031912 - DNA, 22 bp, Homo sapiens
tgcagcagcagggaggaggctc

SEQ ID NO: 8031913 - DNA, 22 bp, Homo sapiens
tgcagcagccaaggttctgtgc

SEQ ID NO: 8031914 - DNA, 22 bp, Homo sapiens
tgcagcagcagggaggaggctc

SEQ ID NO: 8031915 - DNA, 22 bp, Homo sapiens
tgcagcagagtgggcctgggtg

SEQ ID NO: 8031916 - DNA, 21 bp, Homo sapiens
tgcagcagagtaagcagggga

SEQ ID NO: 8031917 - DNA, 22 bp, Homo sapiens
tgcagcagagtgggcctgggtg

SEQ ID NO: 8031918 - DNA, 22 bp, Homo sapiens
tgcagcagagtgggcctgggtg

SEQ ID NO: 8031919 - DNA, 22 bp, Homo sapiens
tgcagcagagtgggcctgggtg

SEQ ID NO: 8031920 - DNA, 22 bp, Homo sapiens
tgcagcagagtgggcctgggtg

SEQ ID NO: 8031921 - DNA, 22 bp, Homo sapiens
tgcagcagcagggaggaggctc

SEQ ID NO: 8031922 - DNA, 22 bp, Homo sapiens
tgcagcagcagggaggaggctc

SEQ ID NO: 8031923 - DNA, 22 bp, Homo sapiens
tgcagcagcagggaggaggctc

SEQ ID NO: 8031924 - DNA, 21 bp, Homo sapiens
tgcagcagatttgggggaaga

SEQ ID NO: 8031925 - DNA, 21 bp, Homo sapiens
tgcagcagatttgggggaaga

SEQ ID NO: 8031926 - DNA, 21 bp, Homo sapiens
tgcagcagatttgggggaaga

SEQ ID NO: 8031927 - DNA, 21 bp, Homo sapiens
tgcagcagatttgggggaaga

SEQ ID NO: 8031928 - DNA, 21 bp, Homo sapiens
tgcagcagagtaagcagggga

SEQ ID NO: 8031929 - DNA, 21 bp, Homo sapiens
tgcagcagagtaagcagggga

SEQ ID NO: 8031930 - DNA, 21 bp, Homo sapiens
tgcagcagagtaagcagggga

SEQ ID NO: 8031931 - DNA, 21 bp, Homo sapiens
tgcagcagagtaagcagggga

SEQ ID NO: 8031932 - DNA, 22 bp, Homo sapiens
tgcagcagactgagtatgagaa

SEQ ID NO: 8031933 - DNA, 22 bp, Homo sapiens
tgcagcagactgagtatgagaa

SEQ ID NO: 8031934 - DNA, 21 bp, Homo sapiens
tgcagcagagtaagcagggga

SEQ ID NO: 8031935 - DNA, 21 bp, Homo sapiens
tgcagcagagtaagcagggga

SEQ ID NO: 8031936 - DNA, 22 bp, Homo sapiens
tgcagcagactgagtatgagaa

SEQ ID NO: 8031937 - DNA, 22 bp, Homo sapiens
tgcagcagacataatgtggatt

SEQ ID NO: 8031938 - DNA, 22 bp, Homo sapiens
tgcagcagacataatgtggatt

SEQ ID NO: 8031939 - DNA, 22 bp, Homo sapiens
tgcagcagacataatgtggatt

SEQ ID NO: 8031940 - DNA, 22 bp, Homo sapiens
tgcagcagacataatgtggatt

SEQ ID NO: 8031941 - DNA, 22 bp, Homo sapiens
tgcagcagacataatgtggatt

SEQ ID NO: 8031942 - DNA, 22 bp, Homo sapiens
tgcagcctagacattctggtca

SEQ ID NO: 8031943 - DNA, 22 bp, Homo sapiens
tgcagcccttccttcctctggg

SEQ ID NO: 8031944 - DNA, 22 bp, Homo sapiens
tgcagcccttccttcctctggg

SEQ ID NO: 8031945 - DNA, 22 bp, Homo sapiens
tgcagccctgtgcacatcccct

SEQ ID NO: 8031946 - DNA, 22 bp, Homo sapiens
tgcagcctctctgcttcaggaa

SEQ ID NO: 8031947 - DNA, 22 bp, Homo sapiens
tgcagcctagacattctggtca

SEQ ID NO: 8031948 - DNA, 22 bp, Homo sapiens
tgcagcctagacattctggtca

SEQ ID NO: 8031949 - DNA, 22 bp, Homo sapiens
tgcagcctagacattctggtca

SEQ ID NO: 8031950 - DNA, 22 bp, Homo sapiens
tgcagcccaggcgtcaggtggt

SEQ ID NO: 8031951 - DNA, 22 bp, Homo sapiens
tgcagcccaggcgtcaggtggt

SEQ ID NO: 8031952 - DNA, 22 bp, Homo sapiens
tgcagcccaggcgtcaggtggt

SEQ ID NO: 8031953 - DNA, 22 bp, Homo sapiens
tgcagcccaggcgtcaggtggt

SEQ ID NO: 8031954 - DNA, 19 bp, Homo sapiens
tgcagcccctaccacattc

SEQ ID NO: 8031955 - DNA, 22 bp, Homo sapiens
tgcagccccccagatggccgta

SEQ ID NO: 8031956 - DNA, 22 bp, Homo sapiens
tgcagcccctgaaaatggcagc

SEQ ID NO: 8031957 - DNA, 22 bp, Homo sapiens
tgcagcccctatcgcggacagg

SEQ ID NO: 8031958 - DNA, 22 bp, Homo sapiens
tgcagcccctgaaaatggcagc

SEQ ID NO: 8031959 - DNA, 22 bp, Homo sapiens
tgcagccctgtgcacatcccct

SEQ ID NO: 8031960 - DNA, 22 bp, Homo sapiens
tgcagcctctctgcttcaggaa

SEQ ID NO: 8031961 - DNA, 21 bp, Homo sapiens
tgcagcctctgcccagcagtg

SEQ ID NO: 8031962 - DNA, 21 bp, Homo sapiens
tgcagcctctgcccagcagtg

SEQ ID NO: 8031963 - DNA, 21 bp, Homo sapiens
tgcagcctctgcccagcagtg

SEQ ID NO: 8031964 - DNA, 21 bp, Homo sapiens
tgcagcctctgcccagcagtg

SEQ ID NO: 8031965 - DNA, 21 bp, Homo sapiens
tgcagcctctgcccagcagtg

SEQ ID NO: 8031966 - DNA, 21 bp, Homo sapiens
tgcagcctctgcccagcagtg

SEQ ID NO: 8031967 - DNA, 22 bp, Homo sapiens
tgcagcctggtggtcactggag

SEQ ID NO: 8031968 - DNA, 22 bp, Homo sapiens
tgcagcctggtggtcactggag

SEQ ID NO: 8031969 - DNA, 21 bp, Homo sapiens
tgcagcctctgcccagcagtg

SEQ ID NO: 8031970 - DNA, 18 bp, Homo sapiens
tgcagcctgtagtcttgt

SEQ ID NO: 8031971 - DNA, 22 bp, Homo sapiens
tgcagcctggtggtcactggag

SEQ ID NO: 8031972 - DNA, 22 bp, Homo sapiens
tgcagccagactttgtgcgaaa

SEQ ID NO: 8031973 - DNA, 23 bp, Homo sapiens
tgcagccactcaggagctcagtg

SEQ ID NO: 8031974 - DNA, 23 bp, Homo sapiens
tgcagccactcaggagctcagtg

SEQ ID NO: 8031975 - DNA, 23 bp, Homo sapiens
tgcagccactcaggagctcagtg

SEQ ID NO: 8031976 - DNA, 19 bp, Homo sapiens
tgcagccacgtgagagact

SEQ ID NO: 8031977 - DNA, 22 bp, Homo sapiens
tgcagccagactttgtgcgaaa

SEQ ID NO: 8031978 - DNA, 22 bp, Homo sapiens
tgcagccagactttgtgcgaaa

SEQ ID NO: 8031979 - DNA, 22 bp, Homo sapiens
tgcagccagcaagtgaatacat

SEQ ID NO: 8031980 - DNA, 22 bp, Homo sapiens
tgcagccaggaaatatttgctg

SEQ ID NO: 8031981 - DNA, 22 bp, Homo sapiens
tgcagcaggtatggcaagctcc

SEQ ID NO: 8031982 - DNA, 19 bp, Homo sapiens
tgcagccacgtgagagact

SEQ ID NO: 8031983 - DNA, 19 bp, Homo sapiens
tgcagccacgtgagagact

SEQ ID NO: 8031984 - DNA, 22 bp, Homo sapiens
tgcagcaggtatggcaagctcc

SEQ ID NO: 8031985 - DNA, 22 bp, Homo sapiens
tgcagcaggtatggcaagctcc

SEQ ID NO: 8031986 - DNA, 22 bp, Homo sapiens
tgcagcaggtatggcaagctcc

SEQ ID NO: 8031987 - DNA, 22 bp, Homo sapiens
tgcagccatctttcttggagga

SEQ ID NO: 8031988 - DNA, 22 bp, Homo sapiens
tgcagccatctttcttggagga

SEQ ID NO: 8031989 - DNA, 22 bp, Homo sapiens
tgcagccatctttcttggagga

SEQ ID NO: 8031990 - DNA, 22 bp, Homo sapiens
tgcagccatcgcagagtctgta

SEQ ID NO: 8031991 - DNA, 22 bp, Homo sapiens
tgcagccatctttcttggagga

SEQ ID NO: 8031992 - DNA, 22 bp, Homo sapiens
tgcagccattttctgccaatgc

SEQ ID NO: 8031993 - DNA, 22 bp, Homo sapiens
tgcagcccagccccagaacctt

SEQ ID NO: 8031994 - DNA, 22 bp, Homo sapiens
tgcagccatttgaaaagcagtt

SEQ ID NO: 8031995 - DNA, 22 bp, Homo sapiens
tgcagccatttgaaaagcagtt

SEQ ID NO: 8031996 - DNA, 21 bp, Homo sapiens
tgcagccattcagccctatgc

SEQ ID NO: 8031997 - DNA, 22 bp, Homo sapiens
tgcagctcattggtgtcctggt

SEQ ID NO: 8031998 - DNA, 22 bp, Homo sapiens
tgcagctcatattagagagaag

SEQ ID NO: 8031999 - DNA, 22 bp, Homo sapiens
tgcagctcaggattctcagggc

SEQ ID NO: 8032000 - DNA, 22 bp, Homo sapiens
tgcagctcaagctggtgaggtg

SEQ ID NO: 8032001 - DNA, 19 bp, Homo sapiens
tgcagctcagggcaggggc

SEQ ID NO: 8032002 - DNA, 22 bp, Homo sapiens
tgcagctcaggattctcagggc

SEQ ID NO: 8032003 - DNA, 22 bp, Homo sapiens
tgcagctctgcatggctggttc

SEQ ID NO: 8032004 - DNA, 22 bp, Homo sapiens
tgcagctctgaacagtcatgaa

SEQ ID NO: 8032005 - DNA, 22 bp, Homo sapiens
tgcagctcctgtgctgagtgtg

SEQ ID NO: 8032006 - DNA, 22 bp, Homo sapiens
tgcagctcgggcttagggtggg

SEQ ID NO: 8032007 - DNA, 22 bp, Homo sapiens
tgcagctcctgtgctgagtgtg

SEQ ID NO: 8032008 - DNA, 22 bp, Homo sapiens
tgcagccttgcctcctcccagc

SEQ ID NO: 8032009 - DNA, 18 bp, Homo sapiens
tgcagcctgtagtcttgt

SEQ ID NO: 8032010 - DNA, 22 bp, Homo sapiens
tgcagcctggtggtcactggag

SEQ ID NO: 8032011 - DNA, 22 bp, Homo sapiens
tgcagcctggtggtcactggag

SEQ ID NO: 8032012 - DNA, 18 bp, Homo sapiens
tgcagcctgtagtcttgt

SEQ ID NO: 8032013 - DNA, 22 bp, Homo sapiens
tgcagccttggcaaccagggac

SEQ ID NO: 8032014 - DNA, 22 bp, Homo sapiens
tgcagccttggcaaccagggac

SEQ ID NO: 8032015 - DNA, 22 bp, Homo sapiens
tgcagccttgcctcctcccagc

SEQ ID NO: 8032016 - DNA, 22 bp, Homo sapiens
tgcagccttgcctcctcccagc

SEQ ID NO: 8032017 - DNA, 22 bp, Homo sapiens
tgcagccttggcaaccagggac

SEQ ID NO: 8032018 - DNA, 22 bp, Homo sapiens
tgcagcctttagaagttcagat

SEQ ID NO: 8032019 - DNA, 22 bp, Homo sapiens
tgcagcctttagaagttcagat

SEQ ID NO: 8032020 - DNA, 22 bp, Homo sapiens
tgcagccttggcaaccagggac

SEQ ID NO: 8032021 - DNA, 22 bp, Homo sapiens
tgcagccttggcaaccagggac

SEQ ID NO: 8032022 - DNA, 22 bp, Homo sapiens
tgcagctcaagctggtgaggtg

SEQ ID NO: 8032023 - DNA, 22 bp, Homo sapiens
tgcagcctttagaagttcagat

SEQ ID NO: 8032024 - DNA, 21 bp, Homo sapiens
tgcagctgacaccctttggga

SEQ ID NO: 8032025 - DNA, 21 bp, Homo sapiens
tgcagctgacactggtatgcc

SEQ ID NO: 8032026 - DNA, 21 bp, Homo sapiens
tgcagctgacaccctttggga

SEQ ID NO: 8032027 - DNA, 22 bp, Homo sapiens
tgcagctgaacctagagtctgt

SEQ ID NO: 8032028 - DNA, 21 bp, Homo sapiens
tgcagctgacaccctttggga

SEQ ID NO: 8032029 - DNA, 22 bp, Homo sapiens
tgcagctgaaaggactgaatga

SEQ ID NO: 8032030 - DNA, 22 bp, Homo sapiens
tgcagctgaacctagagtctgt

SEQ ID NO: 8032031 - DNA, 22 bp, Homo sapiens
tgcagctgaacctagagtctgt

SEQ ID NO: 8032032 - DNA, 22 bp, Homo sapiens
tgcagctgaacctagagtctgt

SEQ ID NO: 8032033 - DNA, 22 bp, Homo sapiens
tgcagctgaacctagagtctgt

SEQ ID NO: 8032034 - DNA, 22 bp, Homo sapiens
tgcagctgaacctagagtctgt

SEQ ID NO: 8032035 - DNA, 22 bp, Homo sapiens
tgcagctctgggtgtagaggct

SEQ ID NO: 8032036 - DNA, 22 bp, Homo sapiens
tgcagctctgggtgtagaggct

SEQ ID NO: 8032037 - DNA, 22 bp, Homo sapiens
tgcagctctgggcaagtgcctt

SEQ ID NO: 8032038 - DNA, 22 bp, Homo sapiens
tgcagctctgtatgctgattat

SEQ ID NO: 8032039 - DNA, 22 bp, Homo sapiens
tgcagctcttacggagggcggg

SEQ ID NO: 8032040 - DNA, 22 bp, Homo sapiens
tgcagctgaaaggactgaatga

SEQ ID NO: 8032041 - DNA, 22 bp, Homo sapiens
tgcagctgaaaggactgaatga

SEQ ID NO: 8032042 - DNA, 21 bp, Homo sapiens
tgcagctgacactggtatgcc

SEQ ID NO: 8032043 - DNA, 21 bp, Homo sapiens
tgcagctgacactggtatgcc

SEQ ID NO: 8032044 - DNA, 21 bp, Homo sapiens
tgcagctgacactggtatgcc

SEQ ID NO: 8032045 - DNA, 21 bp, Homo sapiens
tgcagctgacactggtatgcc

SEQ ID NO: 8032046 - DNA, 22 bp, Homo sapiens
tgcagctgaccagcaagtcctg

SEQ ID NO: 8032047 - DNA, 22 bp, Homo sapiens
tgcagctgaccagcaagtcctg

SEQ ID NO: 8032048 - DNA, 22 bp, Homo sapiens
tgcagctgaccagcaagtcctg

SEQ ID NO: 8032049 - DNA, 22 bp, Homo sapiens
tgcagctgaccagcaagtcctg

SEQ ID NO: 8032050 - DNA, 22 bp, Homo sapiens
tgcagctgaccagcaagtcctg

SEQ ID NO: 8032051 - DNA, 22 bp, Homo sapiens
tgcagctgaccagcaagtcctg

SEQ ID NO: 8032052 - DNA, 22 bp, Homo sapiens
tgcagctgacccactccagtcc

SEQ ID NO: 8032053 - DNA, 22 bp, Homo sapiens
tgcagctgaccagcaagtcctg

SEQ ID NO: 8032054 - DNA, 22 bp, Homo sapiens
tgcagctgacccactccagtcc

SEQ ID NO: 8032055 - DNA, 22 bp, Homo sapiens
tgcagctgacccactccagtcc

SEQ ID NO: 8032056 - DNA, 22 bp, Homo sapiens
tgcagctgacccactccagtcc

SEQ ID NO: 8032057 - DNA, 22 bp, Homo sapiens
tgcagctgacccactccagtcc

SEQ ID NO: 8032058 - DNA, 22 bp, Homo sapiens
tgcagctgaggccagctatgcc

SEQ ID NO: 8032059 - DNA, 22 bp, Homo sapiens
tgcagctgaggccagctatgcc

SEQ ID NO: 8032060 - DNA, 22 bp, Homo sapiens
tgcagctgacccactccagtcc

SEQ ID NO: 8032061 - DNA, 22 bp, Homo sapiens
tgcagctgacccactccagtcc

SEQ ID NO: 8032062 - DNA, 22 bp, Homo sapiens
tgcagctgacccactccagtcc

SEQ ID NO: 8032063 - DNA, 22 bp, Homo sapiens
tgcagctggtttagaactagat

SEQ ID NO: 8032064 - DNA, 22 bp, Homo sapiens
tgcagctggtttagaactagat

SEQ ID NO: 8032065 - DNA, 22 bp, Homo sapiens
tgcagctggtttagaactagat

SEQ ID NO: 8032066 - DNA, 22 bp, Homo sapiens
tgcagctggtttagaactagat

SEQ ID NO: 8032067 - DNA, 22 bp, Homo sapiens
tgcagctggtttagaactagat

SEQ ID NO: 8032068 - DNA, 22 bp, Homo sapiens
tgcagctggtttagaactagat

SEQ ID NO: 8032069 - DNA, 22 bp, Homo sapiens
tgcagctggtatcccatggatt

SEQ ID NO: 8032070 - DNA, 22 bp, Homo sapiens
tgcagctggtttagaactagat

SEQ ID NO: 8032071 - DNA, 22 bp, Homo sapiens
tgcagctggtttagaactagat

SEQ ID NO: 8032072 - DNA, 21 bp, Homo sapiens
tgcagctgggttctggtttgc

SEQ ID NO: 8032073 - DNA, 21 bp, Homo sapiens
tgcagctgggttctggtttgc

SEQ ID NO: 8032074 - DNA, 22 bp, Homo sapiens
tgcagctgggtctgccctggct

SEQ ID NO: 8032075 - DNA, 21 bp, Homo sapiens
tgcagctgggttctggtttgc

SEQ ID NO: 8032076 - DNA, 21 bp, Homo sapiens
tgcagctgggttctggtttgc

SEQ ID NO: 8032077 - DNA, 21 bp, Homo sapiens
tgcagctgggttctggtttgc

SEQ ID NO: 8032078 - DNA, 22 bp, Homo sapiens
tgcagctggtatcccatggatt

SEQ ID NO: 8032079 - DNA, 22 bp, Homo sapiens
tgcagctggtatcccatggatt

SEQ ID NO: 8032080 - DNA, 22 bp, Homo sapiens
tgcagctggtatcccatggatt

SEQ ID NO: 8032081 - DNA, 22 bp, Homo sapiens
tgcagctggtatcccatggatt

SEQ ID NO: 8032082 - DNA, 22 bp, Homo sapiens
tgcagctgcttgattcatcttg

SEQ ID NO: 8032083 - DNA, 22 bp, Homo sapiens
tgcagctgcttgattcatcttg

SEQ ID NO: 8032084 - DNA, 22 bp, Homo sapiens
tgcagctgcttgattcatcttg

SEQ ID NO: 8032085 - DNA, 22 bp, Homo sapiens
tgcagctggaacttagaggaga

SEQ ID NO: 8032086 - DNA, 22 bp, Homo sapiens
tgcagctgcttgattcatcttg

SEQ ID NO: 8032087 - DNA, 22 bp, Homo sapiens
tgcagctggaacttagaggaga

SEQ ID NO: 8032088 - DNA, 22 bp, Homo sapiens
tgcagctggatttatcttttcc

SEQ ID NO: 8032089 - DNA, 22 bp, Homo sapiens
tgcagctggaacttagaggaga

SEQ ID NO: 8032090 - DNA, 22 bp, Homo sapiens
tgcagctggaacttagaggaga

SEQ ID NO: 8032091 - DNA, 22 bp, Homo sapiens
tgcagctggaacttagaggaga

SEQ ID NO: 8032092 - DNA, 22 bp, Homo sapiens
tgcagctggaacttagaggaga

SEQ ID NO: 8032093 - DNA, 22 bp, Homo sapiens
tgcagctggaacttagaggaga

SEQ ID NO: 8032094 - DNA, 22 bp, Homo sapiens
tgcagctgggtctgccctggct

SEQ ID NO: 8032095 - DNA, 22 bp, Homo sapiens
tgcagctgggtctgccctggct

SEQ ID NO: 8032096 - DNA, 22 bp, Homo sapiens
tgcagctgggtctgccctggct

SEQ ID NO: 8032097 - DNA, 22 bp, Homo sapiens
tgcagctgggtctgccctggct

SEQ ID NO: 8032098 - DNA, 22 bp, Homo sapiens
tgcagctgggtctgccctggct

SEQ ID NO: 8032099 - DNA, 22 bp, Homo sapiens
tgcagctgggtctgccctggct

SEQ ID NO: 8032100 - DNA, 22 bp, Homo sapiens
tgcagctgggacatttttgata

SEQ ID NO: 8032101 - DNA, 22 bp, Homo sapiens
tgcagctgggtctgccctggct

SEQ ID NO: 8032102 - DNA, 22 bp, Homo sapiens
tgcagctgggacatttttgata

SEQ ID NO: 8032103 - DNA, 22 bp, Homo sapiens
tgcagctggatttatcttttcc

SEQ ID NO: 8032104 - DNA, 22 bp, Homo sapiens
tgcagctggatttatcttttcc

SEQ ID NO: 8032105 - DNA, 22 bp, Homo sapiens
tgcagctgggacatttttgata

SEQ ID NO: 8032106 - DNA, 17 bp, Homo sapiens
tgcagctgatggggaaa

SEQ ID NO: 8032107 - DNA, 17 bp, Homo sapiens
tgcagctgatggggaaa

SEQ ID NO: 8032108 - DNA, 17 bp, Homo sapiens
tgcagctgatggggaaa

SEQ ID NO: 8032109 - DNA, 17 bp, Homo sapiens
tgcagctgatggggaaa

SEQ ID NO: 8032110 - DNA, 17 bp, Homo sapiens
tgcagctgatggggaaa

SEQ ID NO: 8032111 - DNA, 17 bp, Homo sapiens
tgcagctgctcccaggc

SEQ ID NO: 8032112 - DNA, 17 bp, Homo sapiens
tgcagctgctcccaggc

SEQ ID NO: 8032113 - DNA, 22 bp, Homo sapiens
tgcagctgatgatacccccatg

SEQ ID NO: 8032114 - DNA, 22 bp, Homo sapiens
tgcagctgatgatacccccatg

SEQ ID NO: 8032115 - DNA, 22 bp, Homo sapiens
tgcagctgatgatacccccatg

SEQ ID NO: 8032116 - DNA, 22 bp, Homo sapiens
tgcagctgatgatacccccatg

SEQ ID NO: 8032117 - DNA, 22 bp, Homo sapiens
tgcagctgataattacatgttc

SEQ ID NO: 8032118 - DNA, 22 bp, Homo sapiens
tgcagctgataattacatgttc

SEQ ID NO: 8032119 - DNA, 22 bp, Homo sapiens
tgcagctgaggccagctatgcc

SEQ ID NO: 8032120 - DNA, 22 bp, Homo sapiens
tgcagctgaggccagctatgcc

SEQ ID NO: 8032121 - DNA, 22 bp, Homo sapiens
tgcagctgaggccagctatgcc

SEQ ID NO: 8032122 - DNA, 22 bp, Homo sapiens
tgcagctgagtcacccagccat

SEQ ID NO: 8032123 - DNA, 22 bp, Homo sapiens
tgcagctgataattacatgttc

SEQ ID NO: 8032124 - DNA, 22 bp, Homo sapiens
tgcagctgataattacatgttc

SEQ ID NO: 8032125 - DNA, 22 bp, Homo sapiens
tgcagctgagtcacccagccat

SEQ ID NO: 8032126 - DNA, 22 bp, Homo sapiens
tgcagctgagtcacccagccat

SEQ ID NO: 8032127 - DNA, 22 bp, Homo sapiens
tgcagctgagtcacccagccat

SEQ ID NO: 8032128 - DNA, 22 bp, Homo sapiens
tgcagctgctcttcatttcccc

SEQ ID NO: 8032129 - DNA, 22 bp, Homo sapiens
tgcagctgctcttcatttcccc

SEQ ID NO: 8032130 - DNA, 22 bp, Homo sapiens
tgcagctgctcttcatttcccc

SEQ ID NO: 8032131 - DNA, 22 bp, Homo sapiens
tgcagctgctggcccaggtgct

SEQ ID NO: 8032132 - DNA, 22 bp, Homo sapiens
tgcagctgctggcccaggtgct

SEQ ID NO: 8032133 - DNA, 22 bp, Homo sapiens
tgcagctgctggcccaggtgct

SEQ ID NO: 8032134 - DNA, 17 bp, Homo sapiens
tgcagctgctcccaggc

SEQ ID NO: 8032135 - DNA, 17 bp, Homo sapiens
tgcagctgatggggaaa

SEQ ID NO: 8032136 - DNA, 17 bp, Homo sapiens
tgcagctgctcccaggc

SEQ ID NO: 8032137 - DNA, 17 bp, Homo sapiens
tgcagctgctcccaggc

SEQ ID NO: 8032138 - DNA, 17 bp, Homo sapiens
tgcagctgctcccaggc

SEQ ID NO: 8032139 - DNA, 22 bp, Homo sapiens
tgcagctgctggtggctgaaag

SEQ ID NO: 8032140 - DNA, 22 bp, Homo sapiens
tgcagctgctggtggctgaaag

SEQ ID NO: 8032141 - DNA, 22 bp, Homo sapiens
tgcagctgctggtggctgaaag

SEQ ID NO: 8032142 - DNA, 22 bp, Homo sapiens
tgcagctgctggtggctgaaag

SEQ ID NO: 8032143 - DNA, 22 bp, Homo sapiens
tgcagctgctggtggctgaaag

SEQ ID NO: 8032144 - DNA, 22 bp, Homo sapiens
tgcagctgctggtggctgaaag

SEQ ID NO: 8032145 - DNA, 22 bp, Homo sapiens
tgcagctgctggtggctgaaag

SEQ ID NO: 8032146 - DNA, 22 bp, Homo sapiens
tgcagctgctggcccaggtgct

SEQ ID NO: 8032147 - DNA, 22 bp, Homo sapiens
tgcagctgctggcccaggtgct

SEQ ID NO: 8032148 - DNA, 22 bp, Homo sapiens
tgcagctgctggcccaggtgct

SEQ ID NO: 8032149 - DNA, 22 bp, Homo sapiens
tgcagcttcaaagaacctttcc

SEQ ID NO: 8032150 - DNA, 22 bp, Homo sapiens
tgcagcttcactcaggaagcca

SEQ ID NO: 8032151 - DNA, 20 bp, Homo sapiens
tgcagcttcacctgtgtcat

SEQ ID NO: 8032152 - DNA, 22 bp, Homo sapiens
tgcagcttatctctttggcagt

SEQ ID NO: 8032153 - DNA, 22 bp, Homo sapiens
tgcagcttagtagggtaaagtt

SEQ ID NO: 8032154 - DNA, 22 bp, Homo sapiens
tgcagctgttacggaccctgtc

SEQ ID NO: 8032155 - DNA, 22 bp, Homo sapiens
tgcagcttaaatcagggtttct

SEQ ID NO: 8032156 - DNA, 22 bp, Homo sapiens
tgcagcttccacatccacactc

SEQ ID NO: 8032157 - DNA, 22 bp, Homo sapiens
tgcagcttcactcctgaagcca

SEQ ID NO: 8032158 - DNA, 22 bp, Homo sapiens
tgcagcttccacatccacactc

SEQ ID NO: 8032159 - DNA, 20 bp, Homo sapiens
tgcagcttctcatcttcaaa

SEQ ID NO: 8032160 - DNA, 22 bp, Homo sapiens
tgcagcttctccatctccttgt

SEQ ID NO: 8032161 - DNA, 22 bp, Homo sapiens
tgcagcttctccaaatattaca

SEQ ID NO: 8032162 - DNA, 20 bp, Homo sapiens
tgcagcttctcatcttcaaa

SEQ ID NO: 8032163 - DNA, 22 bp, Homo sapiens
tgcagcttctccaaatattaca

SEQ ID NO: 8032164 - DNA, 22 bp, Homo sapiens
tgcaggaaacagaggctcaaat

SEQ ID NO: 8032165 - DNA, 22 bp, Homo sapiens
tgcaggaaaaccaacacgcctt

SEQ ID NO: 8032166 - DNA, 22 bp, Homo sapiens
tgcaggaaacagaggctcaaat

SEQ ID NO: 8032167 - DNA, 22 bp, Homo sapiens
tgcaggaaacagaggctcaaat

SEQ ID NO: 8032168 - DNA, 22 bp, Homo sapiens
tgcaggaaaaccaacacgcctt

SEQ ID NO: 8032169 - DNA, 22 bp, Homo sapiens
tgcaggaaaacacctatcaccc

SEQ ID NO: 8032170 - DNA, 22 bp, Homo sapiens
tgcaggaaaacacctatcaccc

SEQ ID NO: 8032171 - DNA, 22 bp, Homo sapiens
tgcaggaaaacacctatcaccc

SEQ ID NO: 8032172 - DNA, 22 bp, Homo sapiens
tgcagctttgctctggtcccca

SEQ ID NO: 8032173 - DNA, 22 bp, Homo sapiens
tgcagctttaagctttcatcag

SEQ ID NO: 8032174 - DNA, 22 bp, Homo sapiens
tgcagcttgctgtaggctaagt

SEQ ID NO: 8032175 - DNA, 22 bp, Homo sapiens
tgcagcttcttgtcctgtgatt

SEQ ID NO: 8032176 - DNA, 22 bp, Homo sapiens
tgcagcttctctgcaacaggag

SEQ ID NO: 8032177 - DNA, 22 bp, Homo sapiens
tgcagcttcttgtcctgtgatt

SEQ ID NO: 8032178 - DNA, 22 bp, Homo sapiens
tgcagcttcttgtcctgtgatt

SEQ ID NO: 8032179 - DNA, 22 bp, Homo sapiens
tgcagctgtaacagaggcctca

SEQ ID NO: 8032180 - DNA, 20 bp, Homo sapiens
tgcagctggtttcacaggga

SEQ ID NO: 8032181 - DNA, 22 bp, Homo sapiens
tgcagctgtaacagaggcctca

SEQ ID NO: 8032182 - DNA, 22 bp, Homo sapiens
tgcagctgtaacagaggcctca

SEQ ID NO: 8032183 - DNA, 20 bp, Homo sapiens
tgcagctggtttcacaggga

SEQ ID NO: 8032184 - DNA, 20 bp, Homo sapiens
tgcagctggtttcacaggga

SEQ ID NO: 8032185 - DNA, 20 bp, Homo sapiens
tgcagctggtttcacaggga

SEQ ID NO: 8032186 - DNA, 20 bp, Homo sapiens
tgcagctggtttcacaggga

SEQ ID NO: 8032187 - DNA, 20 bp, Homo sapiens
tgcagctggtttcacaggga

SEQ ID NO: 8032188 - DNA, 20 bp, Homo sapiens
tgcagctggtttcacaggga

SEQ ID NO: 8032189 - DNA, 19 bp, Homo sapiens
tgcagctgtatgagcttaa

SEQ ID NO: 8032190 - DNA, 19 bp, Homo sapiens
tgcagctgtatgagcttaa

SEQ ID NO: 8032191 - DNA, 22 bp, Homo sapiens
tgcagctgtaacagaggcctca

SEQ ID NO: 8032192 - DNA, 19 bp, Homo sapiens
tgcagctgtatgagcttaa

SEQ ID NO: 8032193 - DNA, 19 bp, Homo sapiens
tgcagctgtatgagcttaa

SEQ ID NO: 8032194 - DNA, 19 bp, Homo sapiens
tgcagctgtatgagcttaa

SEQ ID NO: 8032195 - DNA, 19 bp, Homo sapiens
tgcagctgtctctatatta

SEQ ID NO: 8032196 - DNA, 22 bp, Homo sapiens
tgcagctgtaacagaggcctca

SEQ ID NO: 8032197 - DNA, 22 bp, Homo sapiens
tgcagctgtaacagaggcctca

SEQ ID NO: 8032198 - DNA, 22 bp, Homo sapiens
tgcagctgtaacagaggcctca

SEQ ID NO: 8032199 - DNA, 22 bp, Homo sapiens
tgcagctgtaacagaggcctca

SEQ ID NO: 8032200 - DNA, 22 bp, Homo sapiens
tgcagctgtgcctgaaaagtac

SEQ ID NO: 8032201 - DNA, 22 bp, Homo sapiens
tgcagctgtgaaagggaaccaa

SEQ ID NO: 8032202 - DNA, 22 bp, Homo sapiens
tgcagctgtgaaagggaaccaa

SEQ ID NO: 8032203 - DNA, 22 bp, Homo sapiens
tgcagctgtgcctgaaaagtac

SEQ ID NO: 8032204 - DNA, 22 bp, Homo sapiens
tgcagctgtgcctgaaaagtac

SEQ ID NO: 8032205 - DNA, 22 bp, Homo sapiens
tgcagctgtgcctgaaaagtac

SEQ ID NO: 8032206 - DNA, 22 bp, Homo sapiens
tgcagctgtgcctgaaaagtac

SEQ ID NO: 8032207 - DNA, 22 bp, Homo sapiens
tgcagctgtgaaagggaaccaa

SEQ ID NO: 8032208 - DNA, 22 bp, Homo sapiens
tgcagctgtgaaagggaaccaa

SEQ ID NO: 8032209 - DNA, 22 bp, Homo sapiens
tgcagctgtgaaagggaaccaa

SEQ ID NO: 8032210 - DNA, 19 bp, Homo sapiens
tgcagctgtctctatatta

SEQ ID NO: 8032211 - DNA, 22 bp, Homo sapiens
tgcagctgtgaaagggaaccaa

SEQ ID NO: 8032212 - DNA, 22 bp, Homo sapiens
tgcagctgttacggaccctgtc

SEQ ID NO: 8032213 - DNA, 22 bp, Homo sapiens
tgcagctgttacggaccctgtc

SEQ ID NO: 8032214 - DNA, 22 bp, Homo sapiens
tgcagctgtgggagaatctctg

SEQ ID NO: 8032215 - DNA, 22 bp, Homo sapiens
tgcagctgttacggaccctgtc

SEQ ID NO: 8032216 - DNA, 22 bp, Homo sapiens
tgcagctgtgggagaatctctg

SEQ ID NO: 8032217 - DNA, 22 bp, Homo sapiens
tgcagctgtgcctgaaaagtac

SEQ ID NO: 8032218 - DNA, 22 bp, Homo sapiens
tgcagctgtgggagaatctctg

SEQ ID NO: 8032219 - DNA, 22 bp, Homo sapiens
tgcagctgtgggagaatctctg

SEQ ID NO: 8032220 - DNA, 22 bp, Homo sapiens
tgcagctgtgggagaatctctg

SEQ ID NO: 8032221 - DNA, 22 bp, Homo sapiens
tgcaggagacataatagggact

SEQ ID NO: 8032222 - DNA, 22 bp, Homo sapiens
tgcaggagaaagtacggagcgt

SEQ ID NO: 8032223 - DNA, 22 bp, Homo sapiens
tgcaggagacataatagggact

SEQ ID NO: 8032224 - DNA, 22 bp, Homo sapiens
tgcaggagacataatagggact

SEQ ID NO: 8032225 - DNA, 22 bp, Homo sapiens
tgcaggaagacttcccaagcca

SEQ ID NO: 8032226 - DNA, 22 bp, Homo sapiens
tgcaggaagacttcccaagcca

SEQ ID NO: 8032227 - DNA, 21 bp, Homo sapiens
tgcaggaagtatggtgcctat

SEQ ID NO: 8032228 - DNA, 22 bp, Homo sapiens
tgcaggaagcaaccaggtccaa

SEQ ID NO: 8032229 - DNA, 21 bp, Homo sapiens
tgcaggaagtatggtgcctat

SEQ ID NO: 8032230 - DNA, 21 bp, Homo sapiens
tgcaggaagtatggtgcctat

SEQ ID NO: 8032231 - DNA, 22 bp, Homo sapiens
tgcaggaactgggagggatagt

SEQ ID NO: 8032232 - DNA, 22 bp, Homo sapiens
tgcaggaactcgaaaactatag

SEQ ID NO: 8032233 - DNA, 22 bp, Homo sapiens
tgcaggaactgggagggatagt

SEQ ID NO: 8032234 - DNA, 22 bp, Homo sapiens
tgcaggaactcgaaaactatag

SEQ ID NO: 8032235 - DNA, 22 bp, Homo sapiens
tgcaggaactcgaaaactatag

SEQ ID NO: 8032236 - DNA, 22 bp, Homo sapiens
tgcaggaacagaactcactccc

SEQ ID NO: 8032237 - DNA, 21 bp, Homo sapiens
tgcaggaaagtgctgcgaccc

SEQ ID NO: 8032238 - DNA, 22 bp, Homo sapiens
tgcaggaaattccagggtggcc

SEQ ID NO: 8032239 - DNA, 22 bp, Homo sapiens
tgcaggaacagaactcactccc

SEQ ID NO: 8032240 - DNA, 22 bp, Homo sapiens
tgcaggaacagaactcactccc

SEQ ID NO: 8032241 - DNA, 22 bp, Homo sapiens
tgcaggaaattccagggtggcc

SEQ ID NO: 8032242 - DNA, 22 bp, Homo sapiens
tgcaggagagctggtctggccc

SEQ ID NO: 8032243 - DNA, 22 bp, Homo sapiens
tgcaggagagctggtctggccc

SEQ ID NO: 8032244 - DNA, 22 bp, Homo sapiens
tgcaggagagctggtctggccc

SEQ ID NO: 8032245 - DNA, 22 bp, Homo sapiens
tgcaggagagctggtctggccc

SEQ ID NO: 8032246 - DNA, 22 bp, Homo sapiens
tgcaggagagctggtctggccc

SEQ ID NO: 8032247 - DNA, 22 bp, Homo sapiens
tgcaggagagctggtctggccc

SEQ ID NO: 8032248 - DNA, 22 bp, Homo sapiens
tgcaggagagctggtctggccc

SEQ ID NO: 8032249 - DNA, 22 bp, Homo sapiens
tgcaggagagctggtctggccc

SEQ ID NO: 8032250 - DNA, 22 bp, Homo sapiens
tgcaggagagctggtctggccc

SEQ ID NO: 8032251 - DNA, 22 bp, Homo sapiens
tgcaggagataatggtgcttag

SEQ ID NO: 8032252 - DNA, 22 bp, Homo sapiens
tgcaggagataatggtgcttag

SEQ ID NO: 8032253 - DNA, 22 bp, Homo sapiens
tgcaggagagtgagtcagtagg

SEQ ID NO: 8032254 - DNA, 22 bp, Homo sapiens
tgcaggagagtgagtcagtagg

SEQ ID NO: 8032255 - DNA, 22 bp, Homo sapiens
tgcaggagagtgagtcagtagg

SEQ ID NO: 8032256 - DNA, 22 bp, Homo sapiens
tgcaggagagtgagtcagtagg

SEQ ID NO: 8032257 - DNA, 22 bp, Homo sapiens
tgcaggagagtgagtcagtagg

SEQ ID NO: 8032258 - DNA, 22 bp, Homo sapiens
tgcaggagcagagatggctgga

SEQ ID NO: 8032259 - DNA, 22 bp, Homo sapiens
tgcaggagcagagatggctgga

SEQ ID NO: 8032260 - DNA, 22 bp, Homo sapiens
tgcaggagcagagatggctgga

SEQ ID NO: 8032261 - DNA, 22 bp, Homo sapiens
tgcaggagcagagatggctgga

SEQ ID NO: 8032262 - DNA, 22 bp, Homo sapiens
tgcaggagcaccagctcaccct

SEQ ID NO: 8032263 - DNA, 22 bp, Homo sapiens
tgcaggagcaccagctcaccct

SEQ ID NO: 8032264 - DNA, 22 bp, Homo sapiens
tgcaggagcaccagctcaccct

SEQ ID NO: 8032265 - DNA, 22 bp, Homo sapiens
tgcaggagcaccagctcaccct

SEQ ID NO: 8032266 - DNA, 22 bp, Homo sapiens
tgcaggagcccttgggctctgg

SEQ ID NO: 8032267 - DNA, 22 bp, Homo sapiens
tgcaggagcagagatggctgga

SEQ ID NO: 8032268 - DNA, 22 bp, Homo sapiens
tgcaggagcagagatggctgga

SEQ ID NO: 8032269 - DNA, 22 bp, Homo sapiens
tgcaggagcagagatggctgga

SEQ ID NO: 8032270 - DNA, 22 bp, Homo sapiens
tgcaggagctgtgcggtgaggg

SEQ ID NO: 8032271 - DNA, 22 bp, Homo sapiens
tgcaggagctgtgcggtgaggg

SEQ ID NO: 8032272 - DNA, 22 bp, Homo sapiens
tgcaggagctgtgcggtgaggg

SEQ ID NO: 8032273 - DNA, 22 bp, Homo sapiens
tgcaggagcttggctctgtccc

SEQ ID NO: 8032274 - DNA, 22 bp, Homo sapiens
tgcaggagcttggctctgtccc

SEQ ID NO: 8032275 - DNA, 22 bp, Homo sapiens
tgcaggagctgtgcggtgaggg

SEQ ID NO: 8032276 - DNA, 19 bp, Homo sapiens
tgcaggaggactgagcaga

SEQ ID NO: 8032277 - DNA, 19 bp, Homo sapiens
tgcaggaggactgagcaga

SEQ ID NO: 8032278 - DNA, 19 bp, Homo sapiens
tgcaggaggactgagcaga

SEQ ID NO: 8032279 - DNA, 19 bp, Homo sapiens
tgcaggaggactgagcaga

SEQ ID NO: 8032280 - DNA, 22 bp, Homo sapiens
tgcaggagcttggctctgtccc

SEQ ID NO: 8032281 - DNA, 22 bp, Homo sapiens
tgcaggagcttggctctgtccc

SEQ ID NO: 8032282 - DNA, 22 bp, Homo sapiens
tgcaggagcccaggaatactat

SEQ ID NO: 8032283 - DNA, 22 bp, Homo sapiens
tgcaggagcccttgggctctgg

SEQ ID NO: 8032284 - DNA, 22 bp, Homo sapiens
tgcaggagcccttgggctctgg

SEQ ID NO: 8032285 - DNA, 22 bp, Homo sapiens
tgcaggagcccttgggctctgg

SEQ ID NO: 8032286 - DNA, 22 bp, Homo sapiens
tgcaggagcccttgggctctgg

SEQ ID NO: 8032287 - DNA, 22 bp, Homo sapiens
tgcaggagccttggacttgaaa

SEQ ID NO: 8032288 - DNA, 22 bp, Homo sapiens
tgcaggagcccttgggctctgg

SEQ ID NO: 8032289 - DNA, 22 bp, Homo sapiens
tgcaggagccttggacttgaaa

SEQ ID NO: 8032290 - DNA, 22 bp, Homo sapiens
tgcaggagccttggacttgaaa

SEQ ID NO: 8032291 - DNA, 22 bp, Homo sapiens
tgcaggagccttggacttgaaa

SEQ ID NO: 8032292 - DNA, 22 bp, Homo sapiens
tgcaggagctgctgtcctgctc

SEQ ID NO: 8032293 - DNA, 22 bp, Homo sapiens
tgcaggagctgctgtcctgctc

SEQ ID NO: 8032294 - DNA, 22 bp, Homo sapiens
tgcaggagctgctgtcctgctc

SEQ ID NO: 8032295 - DNA, 22 bp, Homo sapiens
tgcaggagctgctgtcctgctc

SEQ ID NO: 8032296 - DNA, 22 bp, Homo sapiens
tgcaggagctgctgtcctgctc

SEQ ID NO: 8032297 - DNA, 22 bp, Homo sapiens
tgcaggagctgctgtcctgctc

SEQ ID NO: 8032298 - DNA, 22 bp, Homo sapiens
tgcaggagctgctgtcctgctc

SEQ ID NO: 8032299 - DNA, 22 bp, Homo sapiens
tgcaggagctgctgtcctgctc

SEQ ID NO: 8032300 - DNA, 22 bp, Homo sapiens
tgcaggaggattttgtggagct

SEQ ID NO: 8032301 - DNA, 22 bp, Homo sapiens
tgcaggaggattttgtggagct

SEQ ID NO: 8032302 - DNA, 22 bp, Homo sapiens
tgcaggaggattttgtggagct

SEQ ID NO: 8032303 - DNA, 19 bp, Homo sapiens
tgcaggaggactgagcaga

SEQ ID NO: 8032304 - DNA, 19 bp, Homo sapiens
tgcaggaggactgagcaga

SEQ ID NO: 8032305 - DNA, 19 bp, Homo sapiens
tgcaggaggactgagcaga

SEQ ID NO: 8032306 - DNA, 22 bp, Homo sapiens
tgcaggaggattttgtggagct

SEQ ID NO: 8032307 - DNA, 19 bp, Homo sapiens
tgcaggaggactgagcaga

SEQ ID NO: 8032308 - DNA, 22 bp, Homo sapiens
tgcaggaggccccatggaaccg

SEQ ID NO: 8032309 - DNA, 22 bp, Homo sapiens
tgcaggaggccccatggaaccg

SEQ ID NO: 8032310 - DNA, 22 bp, Homo sapiens
tgcaggaggccccatggaaccg

SEQ ID NO: 8032311 - DNA, 22 bp, Homo sapiens
tgcaggaggccccatggaaccg

SEQ ID NO: 8032312 - DNA, 22 bp, Homo sapiens
tgcaggaggctttattcaggat

SEQ ID NO: 8032313 - DNA, 22 bp, Homo sapiens
tgcaggaggccccatggaaccg

SEQ ID NO: 8032314 - DNA, 22 bp, Homo sapiens
tgcaggaggccccatggaaccg

SEQ ID NO: 8032315 - DNA, 22 bp, Homo sapiens
tgcaggaggctttattcaggat

SEQ ID NO: 8032316 - DNA, 22 bp, Homo sapiens
tgcaggagggagggttacagtt

SEQ ID NO: 8032317 - DNA, 22 bp, Homo sapiens
tgcaggagggagggttacagtt

SEQ ID NO: 8032318 - DNA, 22 bp, Homo sapiens
tgcaggagggagggttacagtt

SEQ ID NO: 8032319 - DNA, 22 bp, Homo sapiens
tgcaggagtccaatcaggagac

SEQ ID NO: 8032320 - DNA, 22 bp, Homo sapiens
tgcaggagtccaatcaggagac

SEQ ID NO: 8032321 - DNA, 22 bp, Homo sapiens
tgcaggaggctttattcaggat

SEQ ID NO: 8032322 - DNA, 22 bp, Homo sapiens
tgcaggagtccaatcaggagac

SEQ ID NO: 8032323 - DNA, 22 bp, Homo sapiens
tgcaggagtccaatcaggagac

SEQ ID NO: 8032324 - DNA, 22 bp, Homo sapiens
tgcaggagtccaatcaggagac

SEQ ID NO: 8032325 - DNA, 22 bp, Homo sapiens
tgcaggagtccaatcaggagac

SEQ ID NO: 8032326 - DNA, 22 bp, Homo sapiens
tgcaggagtccaatcaggagac

SEQ ID NO: 8032327 - DNA, 22 bp, Homo sapiens
tgcaggagtccaatcaggagac

SEQ ID NO: 8032328 - DNA, 21 bp, Homo sapiens
tgcaggagtctgtgagtcagg

SEQ ID NO: 8032329 - DNA, 21 bp, Homo sapiens
tgcaggagtctgtgagtcagg

SEQ ID NO: 8032330 - DNA, 22 bp, Homo sapiens
tgcaggagtccaatcaggagac

SEQ ID NO: 8032331 - DNA, 21 bp, Homo sapiens
tgcaggagtctgtgagtcagg

SEQ ID NO: 8032332 - DNA, 22 bp, Homo sapiens
tgcaggctccacgttgttgtcc

SEQ ID NO: 8032333 - DNA, 22 bp, Homo sapiens
tgcaggctccaggtgcacatat

SEQ ID NO: 8032334 - DNA, 22 bp, Homo sapiens
tgcaggctcatctcaagagtag

SEQ ID NO: 8032335 - DNA, 22 bp, Homo sapiens
tgcaggctcacctgccagggcc

SEQ ID NO: 8032336 - DNA, 22 bp, Homo sapiens
tgcaggctcacctgccagggcc

SEQ ID NO: 8032337 - DNA, 22 bp, Homo sapiens
tgcaggctcaccctggagctga

SEQ ID NO: 8032338 - DNA, 22 bp, Homo sapiens
tgcaggctcacctgccagggcc

SEQ ID NO: 8032339 - DNA, 22 bp, Homo sapiens
tgcaggctcaccctggagctga

SEQ ID NO: 8032340 - DNA, 22 bp, Homo sapiens
tgcaggctcaccctggagctga

SEQ ID NO: 8032341 - DNA, 23 bp, Homo sapiens
tgcaggctaggaagagagccttc

SEQ ID NO: 8032342 - DNA, 21 bp, Homo sapiens
tgcaggctacttctgactcta

SEQ ID NO: 8032343 - DNA, 22 bp, Homo sapiens
tgcaggctatcctttgctgcaa

SEQ ID NO: 8032344 - DNA, 22 bp, Homo sapiens
tgcaggctatcctttgctgcaa

SEQ ID NO: 8032345 - DNA, 22 bp, Homo sapiens
tgcaggctatcctttgctgcaa

SEQ ID NO: 8032346 - DNA, 23 bp, Homo sapiens
tgcaggctaggaagagagccttc

SEQ ID NO: 8032347 - DNA, 21 bp, Homo sapiens
tgcaggctacttctgactcta

SEQ ID NO: 8032348 - DNA, 22 bp, Homo sapiens
tgcaggcctggactgatgtggt

SEQ ID NO: 8032349 - DNA, 21 bp, Homo sapiens
tgcaggctacttctgactcta

SEQ ID NO: 8032350 - DNA, 22 bp, Homo sapiens
tgcaggcctcagacttagccat

SEQ ID NO: 8032351 - DNA, 22 bp, Homo sapiens
tgcaggcctcagacttagccat

SEQ ID NO: 8032352 - DNA, 22 bp, Homo sapiens
tgcaggcagctgaaaggtgcct

SEQ ID NO: 8032353 - DNA, 22 bp, Homo sapiens
tgcaggcagctgaaaggtgcct

SEQ ID NO: 8032354 - DNA, 21 bp, Homo sapiens
tgcaggagtgtaatgtgaccc

SEQ ID NO: 8032355 - DNA, 21 bp, Homo sapiens
tgcaggagtgtaatgtgaccc

SEQ ID NO: 8032356 - DNA, 21 bp, Homo sapiens
tgcaggagtgtaatgtgaccc

SEQ ID NO: 8032357 - DNA, 22 bp, Homo sapiens
tgcaggagttaagtgctctcct

SEQ ID NO: 8032358 - DNA, 22 bp, Homo sapiens
tgcaggagttaagtgctctcct

SEQ ID NO: 8032359 - DNA, 21 bp, Homo sapiens
tgcaggagtgtaatgtgaccc

SEQ ID NO: 8032360 - DNA, 21 bp, Homo sapiens
tgcaggagtgtaatgtgaccc

SEQ ID NO: 8032361 - DNA, 21 bp, Homo sapiens
tgcaggagtgtaatgtgaccc

SEQ ID NO: 8032362 - DNA, 18 bp, Homo sapiens
tgcaggagtgaccccggc

SEQ ID NO: 8032363 - DNA, 18 bp, Homo sapiens
tgcaggagtgaccccggc

SEQ ID NO: 8032364 - DNA, 18 bp, Homo sapiens
tgcaggagtgaccccggc

SEQ ID NO: 8032365 - DNA, 21 bp, Homo sapiens
tgcaggagtctgtgagtcagg

SEQ ID NO: 8032366 - DNA, 21 bp, Homo sapiens
tgcaggagtctgtgagtcagg

SEQ ID NO: 8032367 - DNA, 22 bp, Homo sapiens
tgcaggcagctaaaccatgtaa

SEQ ID NO: 8032368 - DNA, 22 bp, Homo sapiens
tgcaggcagctaaaccatgtaa

SEQ ID NO: 8032369 - DNA, 22 bp, Homo sapiens
tgcaggcagctgaaaggtgcct

SEQ ID NO: 8032370 - DNA, 22 bp, Homo sapiens
tgcaggcagctgaaaggtgcct

SEQ ID NO: 8032371 - DNA, 22 bp, Homo sapiens
tgcaggcaccattctgcctctc

SEQ ID NO: 8032372 - DNA, 22 bp, Homo sapiens
tgcaggcaccattctgcctctc

SEQ ID NO: 8032373 - DNA, 21 bp, Homo sapiens
tgcaggattccaggtcagtat

SEQ ID NO: 8032374 - DNA, 22 bp, Homo sapiens
tgcaggagttcccctctgcctg

SEQ ID NO: 8032375 - DNA, 22 bp, Homo sapiens
tgcaggagttcccctctgcctg

SEQ ID NO: 8032376 - DNA, 22 bp, Homo sapiens
tgcaggagttcccctctgcctg

SEQ ID NO: 8032377 - DNA, 22 bp, Homo sapiens
tgcaggagttcccctctgcctg

SEQ ID NO: 8032378 - DNA, 22 bp, Homo sapiens
tgcaggagttcccctctgcctg

SEQ ID NO: 8032379 - DNA, 21 bp, Homo sapiens
tgcaggagtgtaatgtgaccc

SEQ ID NO: 8032380 - DNA, 22 bp, Homo sapiens
tgcaggagttaagtgctctcct

SEQ ID NO: 8032381 - DNA, 22 bp, Homo sapiens
tgcaggagttaagtgctctcct

SEQ ID NO: 8032382 - DNA, 22 bp, Homo sapiens
tgagtgtggggaatgtcatgag

SEQ ID NO: 8032383 - DNA, 22 bp, Homo sapiens
tgagtgtgaggtgggagcttgg

SEQ ID NO: 8032384 - DNA, 22 bp, Homo sapiens
tgagtgtgctaggtgtctcggt

SEQ ID NO: 8032385 - DNA, 22 bp, Homo sapiens
tgagtgtctggtcatggcaggc

SEQ ID NO: 8032386 - DNA, 22 bp, Homo sapiens
tgagtgtgctaggtgtctcggt

SEQ ID NO: 8032387 - DNA, 22 bp, Homo sapiens
tgagtgtggggaatgtcatgag

SEQ ID NO: 8032388 - DNA, 23 bp, Homo sapiens
tgagtgtggggacagtggtttgc

SEQ ID NO: 8032389 - DNA, 19 bp, Homo sapiens
tgagtgtgtgtttctctaa

SEQ ID NO: 8032390 - DNA, 22 bp, Homo sapiens
tgagtgtgtattatgtatcagg

SEQ ID NO: 8032391 - DNA, 22 bp, Homo sapiens
tgagtgtgtattatgtatcagg

SEQ ID NO: 8032392 - DNA, 23 bp, Homo sapiens
tgagtgtgaaaatcctggagatg

SEQ ID NO: 8032393 - DNA, 22 bp, Homo sapiens
tgagtgtctggtcatggcaggc

SEQ ID NO: 8032394 - DNA, 23 bp, Homo sapiens
tgagtgtgaaaatcctggagatg

SEQ ID NO: 8032395 - DNA, 22 bp, Homo sapiens
tgagtgggttatcaggaaaggt

SEQ ID NO: 8032396 - DNA, 19 bp, Homo sapiens
tgagtgtcacgtcagtgcc

SEQ ID NO: 8032397 - DNA, 22 bp, Homo sapiens
tgagtgtatatgaaggttgtaa

SEQ ID NO: 8032398 - DNA, 19 bp, Homo sapiens
tgagtgggcccctgcagac

SEQ ID NO: 8032399 - DNA, 19 bp, Homo sapiens
tgagtgggcccctgcagac

SEQ ID NO: 8032400 - DNA, 22 bp, Homo sapiens
tgagtgggttatcaggaaaggt

SEQ ID NO: 8032401 - DNA, 22 bp, Homo sapiens
tgagtgttgtaaccatatgatt

SEQ ID NO: 8032402 - DNA, 19 bp, Homo sapiens
tgagtgtgtgtttctctaa

SEQ ID NO: 8032403 - DNA, 23 bp, Homo sapiens
tgagtgtgttccctgtgagattt

SEQ ID NO: 8032404 - DNA, 22 bp, Homo sapiens
tgagttaaatgagaacatgaaa

SEQ ID NO: 8032405 - DNA, 22 bp, Homo sapiens
tgagttataatgaatatttgaa

SEQ ID NO: 8032406 - DNA, 22 bp, Homo sapiens
tgagttatatatactggctctg

SEQ ID NO: 8032407 - DNA, 22 bp, Homo sapiens
tgagttataacatattcgtagt

SEQ ID NO: 8032408 - DNA, 22 bp, Homo sapiens
tgagttactgcctagtaacttg

SEQ ID NO: 8032409 - DNA, 22 bp, Homo sapiens
tgagttataatgaatatttgaa

SEQ ID NO: 8032410 - DNA, 22 bp, Homo sapiens
tgagttatctaaaatagtcaaa

SEQ ID NO: 8032411 - DNA, 22 bp, Homo sapiens
tgagttatctaaaatagtcaaa

SEQ ID NO: 8032412 - DNA, 22 bp, Homo sapiens
tgagttattgagaaataactgc

SEQ ID NO: 8032413 - DNA, 22 bp, Homo sapiens
tgagttatggagaataaagtca

SEQ ID NO: 8032414 - DNA, 22 bp, Homo sapiens
tgagttcaaattttggctctgc

SEQ ID NO: 8032415 - DNA, 22 bp, Homo sapiens
tgagttattgcagcttcctcct

SEQ ID NO: 8032416 - DNA, 22 bp, Homo sapiens
tgagttctaggcttaaaactaa

SEQ ID NO: 8032417 - DNA, 22 bp, Homo sapiens
tgagttctaggcttaaaactaa

SEQ ID NO: 8032418 - DNA, 20 bp, Homo sapiens
tgagttcatttgcatgtggt

SEQ ID NO: 8032419 - DNA, 18 bp, Homo sapiens
tgagttcattagacttcc

SEQ ID NO: 8032420 - DNA, 22 bp, Homo sapiens
tgagttcaaattttggctctgc

SEQ ID NO: 8032421 - DNA, 22 bp, Homo sapiens
tgagttcacatgaggtctggtc

SEQ ID NO: 8032422 - DNA, 22 bp, Homo sapiens
tgagttcagatcctggctctgc

SEQ ID NO: 8032423 - DNA, 22 bp, Homo sapiens
tgagttcagatcctggctctgc

SEQ ID NO: 8032424 - DNA, 22 bp, Homo sapiens
tgagtgctaagaataatctgca

SEQ ID NO: 8032425 - DNA, 22 bp, Homo sapiens
tgagtgctctgtatgtgccaga

SEQ ID NO: 8032426 - DNA, 20 bp, Homo sapiens
tgagtgctccattctgccca

SEQ ID NO: 8032427 - DNA, 22 bp, Homo sapiens
tgagtgcctacggcacaggcgc

SEQ ID NO: 8032428 - DNA, 22 bp, Homo sapiens
tgagtgcctacggcacaggcgc

SEQ ID NO: 8032429 - DNA, 22 bp, Homo sapiens
tgagtgaggctgggcagtccct

SEQ ID NO: 8032430 - DNA, 22 bp, Homo sapiens
tgagtgaggtgcttagggcaca

SEQ ID NO: 8032431 - DNA, 20 bp, Homo sapiens
tgagtgagtttgtggcagga

SEQ ID NO: 8032432 - DNA, 20 bp, Homo sapiens
tgagtgagtttgtggcagga

SEQ ID NO: 8032433 - DNA, 20 bp, Homo sapiens
tgagtgagtttgtggcagga

SEQ ID NO: 8032434 - DNA, 22 bp, Homo sapiens
tgagtgatctcagatgccgcat

SEQ ID NO: 8032435 - DNA, 22 bp, Homo sapiens
tgagtgagttttcacggtcagc

SEQ ID NO: 8032436 - DNA, 22 bp, Homo sapiens
tgagtgattaggtttttccttc

SEQ ID NO: 8032437 - DNA, 22 bp, Homo sapiens
tgagtgatgagcatgattttag

SEQ ID NO: 8032438 - DNA, 22 bp, Homo sapiens
tgagtgatgagcatgattttag

SEQ ID NO: 8032439 - DNA, 22 bp, Homo sapiens
tgagtgactccactggggcaga

SEQ ID NO: 8032440 - DNA, 22 bp, Homo sapiens
tgagtgaccagaagtccccctc

SEQ ID NO: 8032441 - DNA, 22 bp, Homo sapiens
tgagtgaccagaagtccccctc

SEQ ID NO: 8032442 - DNA, 22 bp, Homo sapiens
tgagtgaattcaagtaaagggc

SEQ ID NO: 8032443 - DNA, 22 bp, Homo sapiens
tgagtgacattttatattgcca

SEQ ID NO: 8032444 - DNA, 22 bp, Homo sapiens
tgagtgaattcaagtaaagggc

SEQ ID NO: 8032445 - DNA, 19 bp, Homo sapiens
tgagtgaaggccgtggtgg

SEQ ID NO: 8032446 - DNA, 22 bp, Homo sapiens
tgagtgaattcaagtaaagggc

SEQ ID NO: 8032447 - DNA, 22 bp, Homo sapiens
tgagtgaaaaatttgcctggag

SEQ ID NO: 8032448 - DNA, 22 bp, Homo sapiens
tgagtgaaattctggtaaagga

SEQ ID NO: 8032449 - DNA, 22 bp, Homo sapiens
tgagtcttttatcctgggaatg

SEQ ID NO: 8032450 - DNA, 21 bp, Homo sapiens
tgagtcttttgcacaaggaat

SEQ ID NO: 8032451 - DNA, 22 bp, Homo sapiens
tgagtgaaattctggtaaagga

SEQ ID NO: 8032452 - DNA, 22 bp, Homo sapiens
tgagtgagacatcctgtcttaa

SEQ ID NO: 8032453 - DNA, 22 bp, Homo sapiens
tgagtgagacaccaaaggctgt

SEQ ID NO: 8032454 - DNA, 22 bp, Homo sapiens
tgagtgagctggggagccggtg

SEQ ID NO: 8032455 - DNA, 22 bp, Homo sapiens
tgagtgaggtgcttagggcaca

SEQ ID NO: 8032456 - DNA, 22 bp, Homo sapiens
tgagtgaggaagcggtggagga

SEQ ID NO: 8032457 - DNA, 18 bp, Homo sapiens
tgagtggaatgagggggc

SEQ ID NO: 8032458 - DNA, 22 bp, Homo sapiens
tgagtgctggctaaatagaaaa

SEQ ID NO: 8032459 - DNA, 22 bp, Homo sapiens
tgagtggacacctgcttcttta

SEQ ID NO: 8032460 - DNA, 22 bp, Homo sapiens
tgagtggacacctgcttcttta

SEQ ID NO: 8032461 - DNA, 22 bp, Homo sapiens
tgagtggacacctgcttcttta

SEQ ID NO: 8032462 - DNA, 22 bp, Homo sapiens
tgagtgctttaaatgttatttt

SEQ ID NO: 8032463 - DNA, 22 bp, Homo sapiens
tgagtgctgcattagcagatat

SEQ ID NO: 8032464 - DNA, 22 bp, Homo sapiens
tgagtgctggctaaatagaaaa

SEQ ID NO: 8032465 - DNA, 22 bp, Homo sapiens
tgagtggacgtgaggctgagta

SEQ ID NO: 8032466 - DNA, 22 bp, Homo sapiens
tgagtggacgtgaggctgagta

SEQ ID NO: 8032467 - DNA, 22 bp, Homo sapiens
tgagtggagaacagaggctctc

SEQ ID NO: 8032468 - DNA, 22 bp, Homo sapiens
tgagtggagaacagaggctctc

SEQ ID NO: 8032469 - DNA, 22 bp, Homo sapiens
tgagtggagaacagaggctctc

SEQ ID NO: 8032470 - DNA, 22 bp, Homo sapiens
tgagtggacacctgcttcttta

SEQ ID NO: 8032471 - DNA, 20 bp, Homo sapiens
tgagtggccactgggtcgca

SEQ ID NO: 8032472 - DNA, 19 bp, Homo sapiens
tgagtggagtgcaatgaag

SEQ ID NO: 8032473 - DNA, 22 bp, Homo sapiens
tgagtggagactgtgtgtagag

SEQ ID NO: 8032474 - DNA, 22 bp, Homo sapiens
tgagtggagtagtgaatgcatt

SEQ ID NO: 8032475 - DNA, 17 bp, Homo sapiens
tgagtggccgggggaca

SEQ ID NO: 8032476 - DNA, 22 bp, Homo sapiens
tgagtgggacctgcgtgtgtca

SEQ ID NO: 8032477 - DNA, 22 bp, Homo sapiens
tgagtgggacctgcgtgtgtca

SEQ ID NO: 8032478 - DNA, 20 bp, Homo sapiens
tgagtggccactgggtcgca

SEQ ID NO: 8032479 - DNA, 22 bp, Homo sapiens
tgagtgggattaaatgaggtga

SEQ ID NO: 8032480 - DNA, 16 bp, Homo sapiens
tgagtgggagaagggg

SEQ ID NO: 8032481 - DNA, 19 bp, Homo sapiens
tgagtgggagcccaggtat

SEQ ID NO: 8032482 - DNA, 22 bp, Homo sapiens
tgatagagcactaagtagtgta

SEQ ID NO: 8032483 - DNA, 23 bp, Homo sapiens
tgatagatgtcatggtcttgagt

SEQ ID NO: 8032484 - DNA, 22 bp, Homo sapiens
tgatagtatctgattatttcac

SEQ ID NO: 8032485 - DNA, 22 bp, Homo sapiens
tgatataagaagtagtatggat

SEQ ID NO: 8032486 - DNA, 17 bp, Homo sapiens
tgatagttcattttaag

SEQ ID NO: 8032487 - DNA, 22 bp, Homo sapiens
tgatagtattggtgatttatag

SEQ ID NO: 8032488 - DNA, 22 bp, Homo sapiens
tgatagtatctgattatttcac

SEQ ID NO: 8032489 - DNA, 22 bp, Homo sapiens
tgatagtattggtgatttatag

SEQ ID NO: 8032490 - DNA, 22 bp, Homo sapiens
tgatagaaaatgctgtcaagct

SEQ ID NO: 8032491 - DNA, 22 bp, Homo sapiens
tgatagaaaatgctgtcaagct

SEQ ID NO: 8032492 - DNA, 22 bp, Homo sapiens
tgatagaaaggaaattaattgg

SEQ ID NO: 8032493 - DNA, 22 bp, Homo sapiens
tgatagaaaggaaattaattgg

SEQ ID NO: 8032494 - DNA, 22 bp, Homo sapiens
tgatagaaaggaaattaattgg

SEQ ID NO: 8032495 - DNA, 22 bp, Homo sapiens
tgatagaaaggaaattaattgg

SEQ ID NO: 8032496 - DNA, 22 bp, Homo sapiens
tgatagaaaggaaattaattgg

SEQ ID NO: 8032497 - DNA, 22 bp, Homo sapiens
tgatagaagcagaagcatacca

SEQ ID NO: 8032498 - DNA, 22 bp, Homo sapiens
tgatagaagcagaagcatacca

SEQ ID NO: 8032499 - DNA, 22 bp, Homo sapiens
tgagttctcacccattcttctt

SEQ ID NO: 8032500 - DNA, 22 bp, Homo sapiens
tgagttctagtggctgcagatt

SEQ ID NO: 8032501 - DNA, 22 bp, Homo sapiens
tgagttctcacccattcttctt

SEQ ID NO: 8032502 - DNA, 22 bp, Homo sapiens
tgagttctccaagagaaggtaa

SEQ ID NO: 8032503 - DNA, 22 bp, Homo sapiens
tgagttctcatgaaatctagtt

SEQ ID NO: 8032504 - DNA, 23 bp, Homo sapiens
tgagttctaggcttaaaactagc

SEQ ID NO: 8032505 - DNA, 22 bp, Homo sapiens
tgagttctagtggctgcagatt

SEQ ID NO: 8032506 - DNA, 22 bp, Homo sapiens
tgagttctcacccattcttctt

SEQ ID NO: 8032507 - DNA, 22 bp, Homo sapiens
tgagttctccaagagaaggtat

SEQ ID NO: 8032508 - DNA, 22 bp, Homo sapiens
tgagttctcatgaaatctagtt

SEQ ID NO: 8032509 - DNA, 22 bp, Homo sapiens
tgagttctccaggaagcagact

SEQ ID NO: 8032510 - DNA, 22 bp, Homo sapiens
tgagttctccaggaagcagact

SEQ ID NO: 8032511 - DNA, 22 bp, Homo sapiens
tgagttctgactgtgatgccag

SEQ ID NO: 8032512 - DNA, 22 bp, Homo sapiens
tgatacttttcttttagactaa

SEQ ID NO: 8032513 - DNA, 22 bp, Homo sapiens
tgatactagcagtattttttac

SEQ ID NO: 8032514 - DNA, 22 bp, Homo sapiens
tgatacatgattggtatggcga

SEQ ID NO: 8032515 - DNA, 22 bp, Homo sapiens
tgagttctgactgtgatgccag

SEQ ID NO: 8032516 - DNA, 22 bp, Homo sapiens
tgatatttaagcaaaaatatgg

SEQ ID NO: 8032517 - DNA, 22 bp, Homo sapiens
tgatatgtgaagctattagttc

SEQ ID NO: 8032518 - DNA, 22 bp, Homo sapiens
tgatatttaagcaaaaatatgg

SEQ ID NO: 8032519 - DNA, 22 bp, Homo sapiens
tgatatttgctgactgcattgt

SEQ ID NO: 8032520 - DNA, 22 bp, Homo sapiens
tgatatttgctgactgcattgt

SEQ ID NO: 8032521 - DNA, 22 bp, Homo sapiens
tgatattttatgagctttcata

SEQ ID NO: 8032522 - DNA, 22 bp, Homo sapiens
tgatatgcatgtaagggagaca

SEQ ID NO: 8032523 - DNA, 22 bp, Homo sapiens
tgatatgcatgtaagggagaca

SEQ ID NO: 8032524 - DNA, 22 bp, Homo sapiens
tgatatgcatgtaagggagaca

SEQ ID NO: 8032525 - DNA, 22 bp, Homo sapiens
tgatatctaccataaccattcg

SEQ ID NO: 8032526 - DNA, 22 bp, Homo sapiens
tgatatctaagaaattctacca

SEQ ID NO: 8032527 - DNA, 20 bp, Homo sapiens
tgatatattactcaggggaa

SEQ ID NO: 8032528 - DNA, 20 bp, Homo sapiens
tgatatggtttggctgtgtt

SEQ ID NO: 8032529 - DNA, 22 bp, Homo sapiens
tgatatgtaactactccttata

SEQ ID NO: 8032530 - DNA, 22 bp, Homo sapiens
tgatatgggaaaagggctcgga

SEQ ID NO: 8032531 - DNA, 20 bp, Homo sapiens
tgatatggtttggctgtgtt

SEQ ID NO: 8032532 - DNA, 22 bp, Homo sapiens
tgatatgggaaaagggctcgga

SEQ ID NO: 8032533 - DNA, 22 bp, Homo sapiens
tgatcaggtctgaacagggagg

SEQ ID NO: 8032534 - DNA, 22 bp, Homo sapiens
tgatcagcatcttcccagctcg

SEQ ID NO: 8032535 - DNA, 22 bp, Homo sapiens
tgatcagacagttatgtgcatg

SEQ ID NO: 8032536 - DNA, 22 bp, Homo sapiens
tgatcagcatcttcccagctcg

SEQ ID NO: 8032537 - DNA, 22 bp, Homo sapiens
tgatcagcatcttcccagctcg

SEQ ID NO: 8032538 - DNA, 22 bp, Homo sapiens
tgatcagacagttatgtgcatg

SEQ ID NO: 8032539 - DNA, 21 bp, Homo sapiens
tgatcacatgaaaaccatgca

SEQ ID NO: 8032540 - DNA, 22 bp, Homo sapiens
tgatccatatgtgttacttctc

SEQ ID NO: 8032541 - DNA, 21 bp, Homo sapiens
tgatcatttgtgtaaaggaga

SEQ ID NO: 8032542 - DNA, 22 bp, Homo sapiens
tgatcagtaaccaatcacatca

SEQ ID NO: 8032543 - DNA, 22 bp, Homo sapiens
tgatcagtaaccaatcacatca

SEQ ID NO: 8032544 - DNA, 22 bp, Homo sapiens
tgatattttatgagctttcata

SEQ ID NO: 8032545 - DNA, 22 bp, Homo sapiens
tgatattttatgagctttcata

SEQ ID NO: 8032546 - DNA, 22 bp, Homo sapiens
tgatcaaaacattactccacca

SEQ ID NO: 8032547 - DNA, 22 bp, Homo sapiens
tgatcaaaacattactccacca

SEQ ID NO: 8032548 - DNA, 22 bp, Homo sapiens
tgatcaaaacattactccacca

SEQ ID NO: 8032549 - DNA, 22 bp, Homo sapiens
tgatcaaaacattactccacca

SEQ ID NO: 8032550 - DNA, 22 bp, Homo sapiens
tgatcacaagtctgaagaatga

SEQ ID NO: 8032551 - DNA, 22 bp, Homo sapiens
tgatcacaagtctgaagaatga

SEQ ID NO: 8032552 - DNA, 22 bp, Homo sapiens
tgatcacaagtctgaagaatga

SEQ ID NO: 8032553 - DNA, 22 bp, Homo sapiens
tgatcgtaccacttcactcaag

SEQ ID NO: 8032554 - DNA, 22 bp, Homo sapiens
tgatctaggttggcttcaactg

SEQ ID NO: 8032555 - DNA, 22 bp, Homo sapiens
tgatctaggttggcttcaactg

SEQ ID NO: 8032556 - DNA, 22 bp, Homo sapiens
tgatccctgattgccttgactc

SEQ ID NO: 8032557 - DNA, 22 bp, Homo sapiens
tgatctcctgaccttgtaatcc

SEQ ID NO: 8032558 - DNA, 22 bp, Homo sapiens
tgatctcctgaccttgtaatcc

SEQ ID NO: 8032559 - DNA, 22 bp, Homo sapiens
tgatctcctgaccttgtaatcc

SEQ ID NO: 8032560 - DNA, 22 bp, Homo sapiens
tgatctaggttggcttcaactg

SEQ ID NO: 8032561 - DNA, 22 bp, Homo sapiens
tgatcccaatctttcctgctcc

SEQ ID NO: 8032562 - DNA, 22 bp, Homo sapiens
tgatctggtcctactgtgggca

SEQ ID NO: 8032563 - DNA, 22 bp, Homo sapiens
tgatctggtcctactgtgggca

SEQ ID NO: 8032564 - DNA, 19 bp, Homo sapiens
tgatctggaaggaaccagg

SEQ ID NO: 8032565 - DNA, 22 bp, Homo sapiens
tgatctggaattccctgtggta

SEQ ID NO: 8032566 - DNA, 22 bp, Homo sapiens
tgatcttcaccttgttctttgg

SEQ ID NO: 8032567 - DNA, 22 bp, Homo sapiens
tgatctttactgctgtttataa

SEQ ID NO: 8032568 - DNA, 22 bp, Homo sapiens
tgatctttactgctgtttataa

SEQ ID NO: 8032569 - DNA, 22 bp, Homo sapiens
tgatctttactgctgtttataa

SEQ ID NO: 8032570 - DNA, 22 bp, Homo sapiens
tgatctttactgctgtttataa

SEQ ID NO: 8032571 - DNA, 22 bp, Homo sapiens
tgatctttactgctgtttataa

SEQ ID NO: 8032572 - DNA, 18 bp, Homo sapiens
tgatctttcatgattcca

SEQ ID NO: 8032573 - DNA, 18 bp, Homo sapiens
tgatctttcatgattcca

SEQ ID NO: 8032574 - DNA, 22 bp, Homo sapiens
tgatctttcctcttgtttgtct

SEQ ID NO: 8032575 - DNA, 22 bp, Homo sapiens
tgattctttggagagctatata

SEQ ID NO: 8032576 - DNA, 22 bp, Homo sapiens
tgattctttggagagctatata

SEQ ID NO: 8032577 - DNA, 23 bp, Homo sapiens
tgattgaaagcctgagaaagctg

SEQ ID NO: 8032578 - DNA, 23 bp, Homo sapiens
tgattgaaatgaggagtatttgt

SEQ ID NO: 8032579 - DNA, 22 bp, Homo sapiens
tgattgaactgagcttcaagat

SEQ ID NO: 8032580 - DNA, 22 bp, Homo sapiens
tgattgaagaggtgaggaagtt

SEQ ID NO: 8032581 - DNA, 22 bp, Homo sapiens
tgattgaatattcccttgggcc

SEQ ID NO: 8032582 - DNA, 22 bp, Homo sapiens
tgattgaagtgttctgttccag

SEQ ID NO: 8032583 - DNA, 22 bp, Homo sapiens
tgattgaagctagaacaaccat

SEQ ID NO: 8032584 - DNA, 22 bp, Homo sapiens
tgattctgtctccttcactccg

SEQ ID NO: 8032585 - DNA, 22 bp, Homo sapiens
tgattctgtaagtcatattgtt

SEQ ID NO: 8032586 - DNA, 22 bp, Homo sapiens
tgattgatacaactcaatccaa

SEQ ID NO: 8032587 - DNA, 22 bp, Homo sapiens
tgattgaattcaaatgcaatct

SEQ ID NO: 8032588 - DNA, 22 bp, Homo sapiens
tgattgaattcaaatgcaatct

SEQ ID NO: 8032589 - DNA, 22 bp, Homo sapiens
tgattgcttctttgctatctgt

SEQ ID NO: 8032590 - DNA, 18 bp, Homo sapiens
tgattggctcaaggctgt

SEQ ID NO: 8032591 - DNA, 22 bp, Homo sapiens
tgattggtcaggctgtggtgac

SEQ ID NO: 8032592 - DNA, 22 bp, Homo sapiens
tgattgtatgattgaaatattt

SEQ ID NO: 8032593 - DNA, 22 bp, Homo sapiens
tgatttaaaagaaacattgtct

SEQ ID NO: 8032594 - DNA, 22 bp, Homo sapiens
tgatttaaaagaaacattgtct

SEQ ID NO: 8032595 - DNA, 22 bp, Homo sapiens
tgattcatcagaataggagttt

SEQ ID NO: 8032596 - DNA, 22 bp, Homo sapiens
tgattccaaagaatttaagttc

SEQ ID NO: 8032597 - DNA, 22 bp, Homo sapiens
tgattccaaagaatttaagttc

SEQ ID NO: 8032598 - DNA, 22 bp, Homo sapiens
tgattccaagacctattctatt

SEQ ID NO: 8032599 - DNA, 22 bp, Homo sapiens
tgattccaaattcacatgcttt

SEQ ID NO: 8032600 - DNA, 22 bp, Homo sapiens
tgattccaaattcacatgcttt

SEQ ID NO: 8032601 - DNA, 22 bp, Homo sapiens
tgattccactctgaggatcgta

SEQ ID NO: 8032602 - DNA, 22 bp, Homo sapiens
tgattccaagacctattctatt

SEQ ID NO: 8032603 - DNA, 21 bp, Homo sapiens
tgattccctaatcccagcacc

SEQ ID NO: 8032604 - DNA, 22 bp, Homo sapiens
tgattcctaggcactcttctcc

SEQ ID NO: 8032605 - DNA, 22 bp, Homo sapiens
tgattccagataatagtactga

SEQ ID NO: 8032606 - DNA, 22 bp, Homo sapiens
tgattccagcaacccaggaatt

SEQ ID NO: 8032607 - DNA, 22 bp, Homo sapiens
tgattccagcaacccaggaatt

SEQ ID NO: 8032608 - DNA, 22 bp, Homo sapiens
tgattccatggtcaattccagg

SEQ ID NO: 8032609 - DNA, 22 bp, Homo sapiens
tgattccatgcagtaaaaggca

SEQ ID NO: 8032610 - DNA, 21 bp, Homo sapiens
tgattccctaatcccagcacc

SEQ ID NO: 8032611 - DNA, 22 bp, Homo sapiens
tgattccatggtcaattccagg

SEQ ID NO: 8032612 - DNA, 22 bp, Homo sapiens
tgattctatggaaggcataagg

SEQ ID NO: 8032613 - DNA, 22 bp, Homo sapiens
tgattctcattatcttggggtg

SEQ ID NO: 8032614 - DNA, 22 bp, Homo sapiens
tgattctcacagtgggacctca

SEQ ID NO: 8032615 - DNA, 22 bp, Homo sapiens
tgattctcaaaggtagactggg

SEQ ID NO: 8032616 - DNA, 22 bp, Homo sapiens
tgattctgagggagcattctgc

SEQ ID NO: 8032617 - DNA, 22 bp, Homo sapiens
tgattctgaggaccctgtgacg

SEQ ID NO: 8032618 - DNA, 22 bp, Homo sapiens
tgattctctgatggagaaagac

SEQ ID NO: 8032619 - DNA, 23 bp, Homo sapiens
tgattctgctttgagaatcatgg

SEQ ID NO: 8032620 - DNA, 22 bp, Homo sapiens
tgattctgccctttcttctgac

SEQ ID NO: 8032621 - DNA, 22 bp, Homo sapiens
tgattctgatcatcatcatggt

SEQ ID NO: 8032622 - DNA, 22 bp, Homo sapiens
tgattctgccccttggctctgg

SEQ ID NO: 8032623 - DNA, 21 bp, Homo sapiens
tgattctgcatttctaacagg

SEQ ID NO: 8032624 - DNA, 22 bp, Homo sapiens
tgattaaaggtggaaggcaggt

SEQ ID NO: 8032625 - DNA, 22 bp, Homo sapiens
tgatgtttaatactatgctttt

SEQ ID NO: 8032626 - DNA, 22 bp, Homo sapiens
tgattaaaatttaacttagtta

SEQ ID NO: 8032627 - DNA, 22 bp, Homo sapiens
tgatgtttaatactatgctttt

SEQ ID NO: 8032628 - DNA, 22 bp, Homo sapiens
tgattaaaatttaacttagtta

SEQ ID NO: 8032629 - DNA, 22 bp, Homo sapiens
tgatgtttaatactatgctttt

SEQ ID NO: 8032630 - DNA, 22 bp, Homo sapiens
tgatgttctgtatatcatatag

SEQ ID NO: 8032631 - DNA, 22 bp, Homo sapiens
tgatgttcagtgaagaggaccg

SEQ ID NO: 8032632 - DNA, 22 bp, Homo sapiens
tgatgttcaacaagtacatatt

SEQ ID NO: 8032633 - DNA, 22 bp, Homo sapiens
tgatgtgtggcagttaaactgt

SEQ ID NO: 8032634 - DNA, 22 bp, Homo sapiens
tgatgtgtgggcatgcagacag

SEQ ID NO: 8032635 - DNA, 22 bp, Homo sapiens
tgatgtgtgggcatgcagacag

SEQ ID NO: 8032636 - DNA, 22 bp, Homo sapiens
tgatggtctagtcaaattgcca

SEQ ID NO: 8032637 - DNA, 22 bp, Homo sapiens
tgatggtcaggatgcatggaga

SEQ ID NO: 8032638 - DNA, 22 bp, Homo sapiens
tgatgtaggacattattatttc

SEQ ID NO: 8032639 - DNA, 22 bp, Homo sapiens
tgatgtagctggtattcacgtg

SEQ ID NO: 8032640 - DNA, 22 bp, Homo sapiens
tgatgtcaggcaagatacttaa

SEQ ID NO: 8032641 - DNA, 22 bp, Homo sapiens
tgatgtctgccagggtcctggg

SEQ ID NO: 8032642 - DNA, 22 bp, Homo sapiens
tgatgtctgccagggtcctggg

SEQ ID NO: 8032643 - DNA, 22 bp, Homo sapiens
tgatgtctagtacatacaagag

SEQ ID NO: 8032644 - DNA, 22 bp, Homo sapiens
tgatgtcctcatgtcaagctcc

SEQ ID NO: 8032645 - DNA, 22 bp, Homo sapiens
tgatgtctagtacatacaagag

SEQ ID NO: 8032646 - DNA, 22 bp, Homo sapiens
tgatgtctgccagggtcctggg

SEQ ID NO: 8032647 - DNA, 22 bp, Homo sapiens
tgatgtctctctatactctaac

SEQ ID NO: 8032648 - DNA, 22 bp, Homo sapiens
tgattacaaaagattgtttgaa

SEQ ID NO: 8032649 - DNA, 23 bp, Homo sapiens
tgattacaagggccaaagaaagg

SEQ ID NO: 8032650 - DNA, 23 bp, Homo sapiens
tgattacaagggccaaagaaagg

SEQ ID NO: 8032651 - DNA, 22 bp, Homo sapiens
tgattaaattaattaagatgag

SEQ ID NO: 8032652 - DNA, 22 bp, Homo sapiens
tgattaaattaattaagatgag

SEQ ID NO: 8032653 - DNA, 22 bp, Homo sapiens
tgattaactgtctattaatcat

SEQ ID NO: 8032654 - DNA, 22 bp, Homo sapiens
tgattaactgtctattaatcat

SEQ ID NO: 8032655 - DNA, 22 bp, Homo sapiens
tgattaactgtctattaatcat

SEQ ID NO: 8032656 - DNA, 22 bp, Homo sapiens
tgattaatatcaccaccattgg

SEQ ID NO: 8032657 - DNA, 22 bp, Homo sapiens
tgattaagttcaaaatatagaa

SEQ ID NO: 8032658 - DNA, 22 bp, Homo sapiens
tgattcagacctgtcagacttc

SEQ ID NO: 8032659 - DNA, 22 bp, Homo sapiens
tgattcaagctactgttactgg

SEQ ID NO: 8032660 - DNA, 22 bp, Homo sapiens
tgattcatcagaataggagttt

SEQ ID NO: 8032661 - DNA, 22 bp, Homo sapiens
tgattcagtctcttcaggagaa

SEQ ID NO: 8032662 - DNA, 23 bp, Homo sapiens
tgattcagcaagtccacttctgg

SEQ ID NO: 8032663 - DNA, 22 bp, Homo sapiens
tgattcagtactttctctaact

SEQ ID NO: 8032664 - DNA, 23 bp, Homo sapiens
tgattcagcaagtccacttctgg

SEQ ID NO: 8032665 - DNA, 23 bp, Homo sapiens
tgattcagcaagtccacttctgg

SEQ ID NO: 8032666 - DNA, 22 bp, Homo sapiens
tgattcagaggctattctcctt

SEQ ID NO: 8032667 - DNA, 22 bp, Homo sapiens
tgatggaaataaaagcatagct

SEQ ID NO: 8032668 - DNA, 22 bp, Homo sapiens
tgatggaaatatgtaatctggt

SEQ ID NO: 8032669 - DNA, 22 bp, Homo sapiens
tgatggaaatattgacaccaca

SEQ ID NO: 8032670 - DNA, 21 bp, Homo sapiens
tgatggaaaggattttgggtc

SEQ ID NO: 8032671 - DNA, 22 bp, Homo sapiens
tgatggaaacttgggtaagtca

SEQ ID NO: 8032672 - DNA, 22 bp, Homo sapiens
tgatggaaaataaatcttattc

SEQ ID NO: 8032673 - DNA, 22 bp, Homo sapiens
tgatggaacagcctttgccaaa

SEQ ID NO: 8032674 - DNA, 22 bp, Homo sapiens
tgatggaaatttgggaagcttt

SEQ ID NO: 8032675 - DNA, 22 bp, Homo sapiens
tgatggaaatgttctgtatctg

SEQ ID NO: 8032676 - DNA, 23 bp, Homo sapiens
tgatggaaatgatctgggtctgt

SEQ ID NO: 8032677 - DNA, 22 bp, Homo sapiens
tgatggaaatgttctgtatctg

SEQ ID NO: 8032678 - DNA, 22 bp, Homo sapiens
tgatggaaatattgacaccaca

SEQ ID NO: 8032679 - DNA, 22 bp, Homo sapiens
tgatggaaatatgtaatctggt

SEQ ID NO: 8032680 - DNA, 22 bp, Homo sapiens
tgatggaatataccttcgggag

SEQ ID NO: 8032681 - DNA, 22 bp, Homo sapiens
tgatggaagtgactgtcagttc

SEQ ID NO: 8032682 - DNA, 22 bp, Homo sapiens
tgatggaatggaggacatgtgg

SEQ ID NO: 8032683 - DNA, 22 bp, Homo sapiens
tgatggaagagctaacaatatc

SEQ ID NO: 8032684 - DNA, 22 bp, Homo sapiens
tgatggaaggtttctcggtgat

SEQ ID NO: 8032685 - DNA, 19 bp, Homo sapiens
tgatggaatttgacattcc

SEQ ID NO: 8032686 - DNA, 22 bp, Homo sapiens
tgatggaatggaggacatgtgg

SEQ ID NO: 8032687 - DNA, 19 bp, Homo sapiens
tgatggaatttgacattcc

SEQ ID NO: 8032688 - DNA, 22 bp, Homo sapiens
tgatggagcatgtgtgcttcct

SEQ ID NO: 8032689 - DNA, 22 bp, Homo sapiens
tgatggagcatgtgtgcttcct

SEQ ID NO: 8032690 - DNA, 22 bp, Homo sapiens
tgatggaggacccagcgtggga

SEQ ID NO: 8032691 - DNA, 22 bp, Homo sapiens
tgatggaggacccagcgtggga

SEQ ID NO: 8032692 - DNA, 22 bp, Homo sapiens
tgatggaggacccagcgtggga

SEQ ID NO: 8032693 - DNA, 18 bp, Homo sapiens
tgatggaggagggctggt

SEQ ID NO: 8032694 - DNA, 22 bp, Homo sapiens
tgatggccagtcgcactggagg

SEQ ID NO: 8032695 - DNA, 22 bp, Homo sapiens
tgatggcttcggacctgggcag

SEQ ID NO: 8032696 - DNA, 22 bp, Homo sapiens
tgatggctgtagggtccggggc

SEQ ID NO: 8032697 - DNA, 22 bp, Homo sapiens
tgatggctgtagggtccggggc

SEQ ID NO: 8032698 - DNA, 22 bp, Homo sapiens
tgatggctggaagttcaaaaat

SEQ ID NO: 8032699 - DNA, 19 bp, Homo sapiens
tgatggctggaactatact

SEQ ID NO: 8032700 - DNA, 22 bp, Homo sapiens
tgatgggaggtgctgcaggacc

SEQ ID NO: 8032701 - DNA, 22 bp, Homo sapiens
tgatgggaggtgctgcaggacc

SEQ ID NO: 8032702 - DNA, 22 bp, Homo sapiens
tgatgggactgccagctgctga

SEQ ID NO: 8032703 - DNA, 22 bp, Homo sapiens
tgatgggactgccagctgctga

SEQ ID NO: 8032704 - DNA, 22 bp, Homo sapiens
tgatgggaaaatgaggcctggg

SEQ ID NO: 8032705 - DNA, 23 bp, Homo sapiens
tgatgggaaggaacgactaccac

SEQ ID NO: 8032706 - DNA, 22 bp, Homo sapiens
tgatggtaaacaaagacattta

SEQ ID NO: 8032707 - DNA, 22 bp, Homo sapiens
tgatggtaaatccatatacctt

SEQ ID NO: 8032708 - DNA, 22 bp, Homo sapiens
tgatggtagggatactacagga

SEQ ID NO: 8032709 - DNA, 22 bp, Homo sapiens
tgatggtagtttatcaaaaaga

SEQ ID NO: 8032710 - DNA, 20 bp, Homo sapiens
tgatggtattaggaggtgtg

SEQ ID NO: 8032711 - DNA, 22 bp, Homo sapiens
tgatggtcaacaattttgagtg

SEQ ID NO: 8032712 - DNA, 22 bp, Homo sapiens
tgatggtcaggatgcatggaga

SEQ ID NO: 8032713 - DNA, 22 bp, Homo sapiens
tgatggtatgggattaccatgt

SEQ ID NO: 8032714 - DNA, 22 bp, Homo sapiens
tgatggtattaggaggtgaggc

SEQ ID NO: 8032715 - DNA, 22 bp, Homo sapiens
tgatgaaagttcagtagtgaat

SEQ ID NO: 8032716 - DNA, 22 bp, Homo sapiens
tgatgaaagttcagtagtgaat

SEQ ID NO: 8032717 - DNA, 22 bp, Homo sapiens
tgatgaaaatgttcagcaatta

SEQ ID NO: 8032718 - DNA, 22 bp, Homo sapiens
tgatgaatgtcatacataatga

SEQ ID NO: 8032719 - DNA, 22 bp, Homo sapiens
tgatgaataaccttgagcatat

SEQ ID NO: 8032720 - DNA, 22 bp, Homo sapiens
tgatgaatgtcatacataatga

SEQ ID NO: 8032721 - DNA, 22 bp, Homo sapiens
tgatgaaaatgttcagcaatta

SEQ ID NO: 8032722 - DNA, 22 bp, Homo sapiens
tgatgaaaatatgattctgagg

SEQ ID NO: 8032723 - DNA, 22 bp, Homo sapiens
tgatgaaaaccagaactctcat

SEQ ID NO: 8032724 - DNA, 22 bp, Homo sapiens
tgatgaaaaccagaactctcat

SEQ ID NO: 8032725 - DNA, 22 bp, Homo sapiens
tgatctttttggtcatttgggt

SEQ ID NO: 8032726 - DNA, 22 bp, Homo sapiens
tgatcttttcaaagacaagctt

SEQ ID NO: 8032727 - DNA, 22 bp, Homo sapiens
tgatcttttctatttatggtag

SEQ ID NO: 8032728 - DNA, 22 bp, Homo sapiens
tgatctttcctcttgtttgtct

SEQ ID NO: 8032729 - DNA, 18 bp, Homo sapiens
tgatctttgagtataatg

SEQ ID NO: 8032730 - DNA, 22 bp, Homo sapiens
tgatctttgggccattaataaa

SEQ ID NO: 8032731 - DNA, 22 bp, Homo sapiens
tgatctttggtaatctggcaca

SEQ ID NO: 8032732 - DNA, 22 bp, Homo sapiens
tgatctttggtagtacgataat

SEQ ID NO: 8032733 - DNA, 22 bp, Homo sapiens
tgatgctgttccagttatattg

SEQ ID NO: 8032734 - DNA, 22 bp, Homo sapiens
tgatgctttaagattaatctgg

SEQ ID NO: 8032735 - DNA, 22 bp, Homo sapiens
tgatgctgtgtacctcatggga

SEQ ID NO: 8032736 - DNA, 20 bp, Homo sapiens
tgatgctggtctgaattgca

SEQ ID NO: 8032737 - DNA, 23 bp, Homo sapiens
tgatgctgctttcttgaagtatg

SEQ ID NO: 8032738 - DNA, 22 bp, Homo sapiens
tgatgctgtgtacctcatggga

SEQ ID NO: 8032739 - DNA, 22 bp, Homo sapiens
tgatgctgtgtacctcatggga

SEQ ID NO: 8032740 - DNA, 22 bp, Homo sapiens
tgatgctgtcaaggaggtgaac

SEQ ID NO: 8032741 - DNA, 22 bp, Homo sapiens
tgatgctgctgggagtggtgct

SEQ ID NO: 8032742 - DNA, 22 bp, Homo sapiens
tgatgctctcctaatatgaaaa

SEQ ID NO: 8032743 - DNA, 22 bp, Homo sapiens
tgatgctctcctaatatgaaaa

SEQ ID NO: 8032744 - DNA, 22 bp, Homo sapiens
tgatgctgagcctgggactgac

SEQ ID NO: 8032745 - DNA, 22 bp, Homo sapiens
tgatgcctatgaattgtaatgt

SEQ ID NO: 8032746 - DNA, 22 bp, Homo sapiens
tgatgcctaatatacttcaatt

SEQ ID NO: 8032747 - DNA, 22 bp, Homo sapiens
tgatgccctgctgggcggacag

SEQ ID NO: 8032748 - DNA, 22 bp, Homo sapiens
tgatgcctatgaattgtaatgt

SEQ ID NO: 8032749 - DNA, 22 bp, Homo sapiens
tgatgcctaatatacttcaatt

SEQ ID NO: 8032750 - DNA, 22 bp, Homo sapiens
tgatgcaattagattgtaattt

SEQ ID NO: 8032751 - DNA, 22 bp, Homo sapiens
tgatgcacaaagtcagcatcct

SEQ ID NO: 8032752 - DNA, 22 bp, Homo sapiens
tgatgcaatcctttagaagtaa

SEQ ID NO: 8032753 - DNA, 22 bp, Homo sapiens
tgatgcaatcctttagaagtaa

SEQ ID NO: 8032754 - DNA, 22 bp, Homo sapiens
tgatgcaatagagagatagata

SEQ ID NO: 8032755 - DNA, 22 bp, Homo sapiens
tgatgatttcatttctagctgt

SEQ ID NO: 8032756 - DNA, 22 bp, Homo sapiens
tgatgattgggagacatttggg

SEQ ID NO: 8032757 - DNA, 22 bp, Homo sapiens
tgatgattgggagacatttggg

SEQ ID NO: 8032758 - DNA, 22 bp, Homo sapiens
tgatgatttgaaaccagtttct

SEQ ID NO: 8032759 - DNA, 22 bp, Homo sapiens
tgatgcattgccgacttactgg

SEQ ID NO: 8032760 - DNA, 22 bp, Homo sapiens
tgatgcccccaaatctggctca

SEQ ID NO: 8032761 - DNA, 22 bp, Homo sapiens
tgatgcacaaagtcagcatcct

SEQ ID NO: 8032762 - DNA, 22 bp, Homo sapiens
tgatgcagaatcctagagtgtc

SEQ ID NO: 8032763 - DNA, 22 bp, Homo sapiens
tgatgcagtgtcctcccatgca

SEQ ID NO: 8032764 - DNA, 22 bp, Homo sapiens
tgcaagggtgtttgagctgccc

SEQ ID NO: 8032765 - DNA, 22 bp, Homo sapiens
tgcaagggtgtttgagctgccc

SEQ ID NO: 8032766 - DNA, 22 bp, Homo sapiens
tgcaagggtgacaggttgctct

SEQ ID NO: 8032767 - DNA, 22 bp, Homo sapiens
tgcaagggtgacaggttgctct

SEQ ID NO: 8032768 - DNA, 19 bp, Homo sapiens
tgcaagggtggtctcctgg

SEQ ID NO: 8032769 - DNA, 22 bp, Homo sapiens
tgcaaggggtttatgcagatga

SEQ ID NO: 8032770 - DNA, 22 bp, Homo sapiens
tgcaagggtagaagtgatggca

SEQ ID NO: 8032771 - DNA, 22 bp, Homo sapiens
tgcaagggtagaagtgatggca

SEQ ID NO: 8032772 - DNA, 22 bp, Homo sapiens
tgcaagggtagaagtgatggca

SEQ ID NO: 8032773 - DNA, 22 bp, Homo sapiens
tgcaagggtagaagtgatggca

SEQ ID NO: 8032774 - DNA, 22 bp, Homo sapiens
tgcaagggtagaagtgatggca

SEQ ID NO: 8032775 - DNA, 21 bp, Homo sapiens
tgcaatccagcctgggcgaca

SEQ ID NO: 8032776 - DNA, 21 bp, Homo sapiens
tgcaatccagcctgggcgaca

SEQ ID NO: 8032777 - DNA, 21 bp, Homo sapiens
tgcaatccagcctgggcgaca

SEQ ID NO: 8032778 - DNA, 21 bp, Homo sapiens
tgcaatccagcctgggcgaca

SEQ ID NO: 8032779 - DNA, 22 bp, Homo sapiens
tgcaagtaacttgtttgggagg

SEQ ID NO: 8032780 - DNA, 22 bp, Homo sapiens
tgcaaggtcttctctctggagg

SEQ ID NO: 8032781 - DNA, 22 bp, Homo sapiens
tgcaaggtgctccaagggcgct

SEQ ID NO: 8032782 - DNA, 21 bp, Homo sapiens
tgcaatccagcctgggcgaca

SEQ ID NO: 8032783 - DNA, 21 bp, Homo sapiens
tgcaatccagcctgggcgaca

SEQ ID NO: 8032784 - DNA, 21 bp, Homo sapiens
tgcaatccagcctgggcgaca

SEQ ID NO: 8032785 - DNA, 21 bp, Homo sapiens
tgcaatccagcctgggcgaca

SEQ ID NO: 8032786 - DNA, 21 bp, Homo sapiens
tgcaatccagcctgggcgaca

SEQ ID NO: 8032787 - DNA, 21 bp, Homo sapiens
tgcaatccagcctgggcgaca

SEQ ID NO: 8032788 - DNA, 22 bp, Homo sapiens
tgcaagcaatccaggaaggcta

SEQ ID NO: 8032789 - DNA, 20 bp, Homo sapiens
tgcaagatgggtggggagaa

SEQ ID NO: 8032790 - DNA, 21 bp, Homo sapiens
tgcaagcctctgtgagattct

SEQ ID NO: 8032791 - DNA, 22 bp, Homo sapiens
tgcaagctgacatccagagaga

SEQ ID NO: 8032792 - DNA, 22 bp, Homo sapiens
tgcaagcttggctgatgttgat

SEQ ID NO: 8032793 - DNA, 21 bp, Homo sapiens
tgcaagcagcagagatatggg

SEQ ID NO: 8032794 - DNA, 19 bp, Homo sapiens
tgcaagctttttcttgtta

SEQ ID NO: 8032795 - DNA, 19 bp, Homo sapiens
tgcaagctttttcttgtta

SEQ ID NO: 8032796 - DNA, 22 bp, Homo sapiens
tgcaaggaagggacagctgaga

SEQ ID NO: 8032797 - DNA, 22 bp, Homo sapiens
tgcaaggcagcaccagctcttg

SEQ ID NO: 8032798 - DNA, 22 bp, Homo sapiens
tgcaaggatatttagtctagtg

SEQ ID NO: 8032799 - DNA, 22 bp, Homo sapiens
tgcaagggcttagggggctgtg

SEQ ID NO: 8032800 - DNA, 22 bp, Homo sapiens
tgcaagggcttagggggctgtg

SEQ ID NO: 8032801 - DNA, 22 bp, Homo sapiens
tgcaaggcttgcaatggtgatc

SEQ ID NO: 8032802 - DNA, 22 bp, Homo sapiens
tgcaaggctgcctctgaggacc

SEQ ID NO: 8032803 - DNA, 22 bp, Homo sapiens
tgcaaggctgcctctgaggacc

SEQ ID NO: 8032804 - DNA, 22 bp, Homo sapiens
tgcaaggctgcctctgaggacc

SEQ ID NO: 8032805 - DNA, 22 bp, Homo sapiens
tgcaaggcccagacaagagctc

SEQ ID NO: 8032806 - DNA, 22 bp, Homo sapiens
tgcaaggcccagacaagagctc

SEQ ID NO: 8032807 - DNA, 22 bp, Homo sapiens
tgcaaggctattcacatgtatt

SEQ ID NO: 8032808 - DNA, 22 bp, Homo sapiens
tgcaagaggattgtatcaataa

SEQ ID NO: 8032809 - DNA, 22 bp, Homo sapiens
tgcaagaggagactgtactcag

SEQ ID NO: 8032810 - DNA, 22 bp, Homo sapiens
tgcaagaggcatcttttaaaaa

SEQ ID NO: 8032811 - DNA, 22 bp, Homo sapiens
tgcaagaggaattctagaagca

SEQ ID NO: 8032812 - DNA, 22 bp, Homo sapiens
tgcaagaggaattctagaagca

SEQ ID NO: 8032813 - DNA, 22 bp, Homo sapiens
tgcaagagctgtggcaaaagca

SEQ ID NO: 8032814 - DNA, 22 bp, Homo sapiens
tgcaagagcccagggccaggaa

SEQ ID NO: 8032815 - DNA, 22 bp, Homo sapiens
tgcaagagcccagggccaggaa

SEQ ID NO: 8032816 - DNA, 22 bp, Homo sapiens
tgcaagagggtgttcagtttgt

SEQ ID NO: 8032817 - DNA, 22 bp, Homo sapiens
tgcaagaggttggattttaaga

SEQ ID NO: 8032818 - DNA, 22 bp, Homo sapiens
tgcaagaggtaaaatgaaagga

SEQ ID NO: 8032819 - DNA, 22 bp, Homo sapiens
tgcaagataacctgcttcttcc

SEQ ID NO: 8032820 - DNA, 23 bp, Homo sapiens
tgcaagagttccaaactgttcaa

SEQ ID NO: 8032821 - DNA, 22 bp, Homo sapiens
tgcaagaggttggattttaaga

SEQ ID NO: 8032822 - DNA, 23 bp, Homo sapiens
tgcaagagttccaaactgttcaa

SEQ ID NO: 8032823 - DNA, 22 bp, Homo sapiens
tgcaagagcccagggccaggaa

SEQ ID NO: 8032824 - DNA, 22 bp, Homo sapiens
tgcaagagcccaccacacactt

SEQ ID NO: 8032825 - DNA, 22 bp, Homo sapiens
tgcaagagcccaaactatatac

SEQ ID NO: 8032826 - DNA, 22 bp, Homo sapiens
tgcaagagcagaaagaactgag

SEQ ID NO: 8032827 - DNA, 22 bp, Homo sapiens
tgcaagagcagaaagaactgag

SEQ ID NO: 8032828 - DNA, 22 bp, Homo sapiens
tgcaagagcagaaagaactgag

SEQ ID NO: 8032829 - DNA, 22 bp, Homo sapiens
tgcaagagcagaaagaactgag

SEQ ID NO: 8032830 - DNA, 22 bp, Homo sapiens
tgcaagagacatgggttgtgtg

SEQ ID NO: 8032831 - DNA, 22 bp, Homo sapiens
tgcaagagattcaaaccataaa

SEQ ID NO: 8032832 - DNA, 22 bp, Homo sapiens
tgcaagagacagacatgactca

SEQ ID NO: 8032833 - DNA, 22 bp, Homo sapiens
tgcaagacgtgaaattgagaca

SEQ ID NO: 8032834 - DNA, 21 bp, Homo sapiens
tgcaagaatcaggaagctgcc

SEQ ID NO: 8032835 - DNA, 21 bp, Homo sapiens
tgcaagaatcaggaagctgcc

SEQ ID NO: 8032836 - DNA, 21 bp, Homo sapiens
tgcaagaatcaggaagctgcc

SEQ ID NO: 8032837 - DNA, 22 bp, Homo sapiens
tgcaacctgacccagccagccc

SEQ ID NO: 8032838 - DNA, 22 bp, Homo sapiens
tgcaacctgcactctgtcttta

SEQ ID NO: 8032839 - DNA, 22 bp, Homo sapiens
tgcaacattattaaactaagca

SEQ ID NO: 8032840 - DNA, 22 bp, Homo sapiens
tgcaacctgacccagccagccc

SEQ ID NO: 8032841 - DNA, 22 bp, Homo sapiens
tgcaacttgtttggagagaaag

SEQ ID NO: 8032842 - DNA, 22 bp, Homo sapiens
tgcaagaaaggtggggccaggc

SEQ ID NO: 8032843 - DNA, 22 bp, Homo sapiens
tgcaagaaatgtgaagctacaa

SEQ ID NO: 8032844 - DNA, 22 bp, Homo sapiens
tgcaagaaatgtgaagctacaa

SEQ ID NO: 8032845 - DNA, 17 bp, Homo sapiens
tgcaagaagattaggaa

SEQ ID NO: 8032846 - DNA, 23 bp, Homo sapiens
tgcaacaatgaggaaagctactg

SEQ ID NO: 8032847 - DNA, 22 bp, Homo sapiens
tgcaacaaggcctcatttcttg

SEQ ID NO: 8032848 - DNA, 22 bp, Homo sapiens
tgcaaatttctttagtacataa

SEQ ID NO: 8032849 - DNA, 22 bp, Homo sapiens
tgcaaatttgacttcacacatc

SEQ ID NO: 8032850 - DNA, 22 bp, Homo sapiens
tgcaatttgacgtcagcacagt

SEQ ID NO: 8032851 - DNA, 22 bp, Homo sapiens
tgcaatttggcttccattttct

SEQ ID NO: 8032852 - DNA, 22 bp, Homo sapiens
tgcaatttggggaagaaagaga

SEQ ID NO: 8032853 - DNA, 22 bp, Homo sapiens
tgcaatttggggaagaaagaga

SEQ ID NO: 8032854 - DNA, 22 bp, Homo sapiens
tgcaatttcaaatatcagaaag

SEQ ID NO: 8032855 - DNA, 22 bp, Homo sapiens
tgcaatttgacgtcagcacagt

SEQ ID NO: 8032856 - DNA, 21 bp, Homo sapiens
tgcaatttagacttgaacatt

SEQ ID NO: 8032857 - DNA, 21 bp, Homo sapiens
tgcaatttagacttgaacatt

SEQ ID NO: 8032858 - DNA, 22 bp, Homo sapiens
tgcaattagcgtattagtttat

SEQ ID NO: 8032859 - DNA, 22 bp, Homo sapiens
tgcaatttatgtgcaagtggtt

SEQ ID NO: 8032860 - DNA, 21 bp, Homo sapiens
tgcaatttagacttgaacatt

SEQ ID NO: 8032861 - DNA, 22 bp, Homo sapiens
tgcaatttcaaatatcagaaag

SEQ ID NO: 8032862 - DNA, 22 bp, Homo sapiens
tgcaatttcaaatatcagaaag

SEQ ID NO: 8032863 - DNA, 22 bp, Homo sapiens
tgcaatctcggcactttgggag

SEQ ID NO: 8032864 - DNA, 22 bp, Homo sapiens
tgcaatgagaatatattaacca

SEQ ID NO: 8032865 - DNA, 22 bp, Homo sapiens
tgcaatctcggcactttgggag

SEQ ID NO: 8032866 - DNA, 22 bp, Homo sapiens
tgcaatccccgcctcaacagga

SEQ ID NO: 8032867 - DNA, 21 bp, Homo sapiens
tgcaatgcattgacagcagca

SEQ ID NO: 8032868 - DNA, 22 bp, Homo sapiens
tgcaattaatttacatgcttaa

SEQ ID NO: 8032869 - DNA, 22 bp, Homo sapiens
tgcacacacacgtagagaaaag

SEQ ID NO: 8032870 - DNA, 22 bp, Homo sapiens
tgcacacaagttggagaatgaa

SEQ ID NO: 8032871 - DNA, 22 bp, Homo sapiens
tgcacacaaatgtgaacgtgcc

SEQ ID NO: 8032872 - DNA, 22 bp, Homo sapiens
tgcacacaagttggagaatgaa

SEQ ID NO: 8032873 - DNA, 22 bp, Homo sapiens
tgcacacaagttggagaatgaa

SEQ ID NO: 8032874 - DNA, 22 bp, Homo sapiens
tgcacaaatttgtgtatgctca

SEQ ID NO: 8032875 - DNA, 22 bp, Homo sapiens
tgcacaaatttgtgtatgctca

SEQ ID NO: 8032876 - DNA, 22 bp, Homo sapiens
tgcacaaatttgtgtatgctca

SEQ ID NO: 8032877 - DNA, 22 bp, Homo sapiens
tgcacaaatttgtgtatgctca

SEQ ID NO: 8032878 - DNA, 22 bp, Homo sapiens
tgcacaaaggctccctgctgag

SEQ ID NO: 8032879 - DNA, 17 bp, Homo sapiens
tgcacaagagacaatag

SEQ ID NO: 8032880 - DNA, 17 bp, Homo sapiens
tgcacaagagacaatag

SEQ ID NO: 8032881 - DNA, 22 bp, Homo sapiens
tgcacaagtcagagtaacattt

SEQ ID NO: 8032882 - DNA, 21 bp, Homo sapiens
tgcacaaactttctgtggctt

SEQ ID NO: 8032883 - DNA, 22 bp, Homo sapiens
tgcacaaacttgtgtcccaggg

SEQ ID NO: 8032884 - DNA, 22 bp, Homo sapiens
tgcacaaagcattctagacgca

SEQ ID NO: 8032885 - DNA, 21 bp, Homo sapiens
tgcacaaactttctgtggctt

SEQ ID NO: 8032886 - DNA, 22 bp, Homo sapiens
tgcaattttttagcacaaggag

SEQ ID NO: 8032887 - DNA, 22 bp, Homo sapiens
tgcacaaacacagagaatagat

SEQ ID NO: 8032888 - DNA, 22 bp, Homo sapiens
tgcacaaacacagagaatagat

SEQ ID NO: 8032889 - DNA, 22 bp, Homo sapiens
tgcacaaacacagagaatagat

SEQ ID NO: 8032890 - DNA, 22 bp, Homo sapiens
tgcaatttttatcaattcagca

SEQ ID NO: 8032891 - DNA, 22 bp, Homo sapiens
tgcaattttcagaaattccaaa

SEQ ID NO: 8032892 - DNA, 22 bp, Homo sapiens
tgcaatttggggaagaaagaga

SEQ ID NO: 8032893 - DNA, 22 bp, Homo sapiens
tgcaatttggggaagaaagaga

SEQ ID NO: 8032894 - DNA, 22 bp, Homo sapiens
tgcaattttaatacattagagg

SEQ ID NO: 8032895 - DNA, 22 bp, Homo sapiens
tgcaattttaatacattagagg

SEQ ID NO: 8032896 - DNA, 22 bp, Homo sapiens
tgcaattttaatacattagagg

SEQ ID NO: 8032897 - DNA, 19 bp, Homo sapiens
tgcacacagataagtatct

SEQ ID NO: 8032898 - DNA, 19 bp, Homo sapiens
tgcacacagataagtatct

SEQ ID NO: 8032899 - DNA, 19 bp, Homo sapiens
tgcacacagataagtatct

SEQ ID NO: 8032900 - DNA, 19 bp, Homo sapiens
tgcacacagataagtatct

SEQ ID NO: 8032901 - DNA, 22 bp, Homo sapiens
tgcacacactctgcatatactt

SEQ ID NO: 8032902 - DNA, 20 bp, Homo sapiens
tgcacacagaaatttgcatt

SEQ ID NO: 8032903 - DNA, 22 bp, Homo sapiens
tgcacacactctgcatatactt

SEQ ID NO: 8032904 - DNA, 22 bp, Homo sapiens
tgcacacactctgcatatactt

SEQ ID NO: 8032905 - DNA, 22 bp, Homo sapiens
tgcacacactctgcatatactt

SEQ ID NO: 8032906 - DNA, 20 bp, Homo sapiens
tgcacacagaaatttgcatt

SEQ ID NO: 8032907 - DNA, 22 bp, Homo sapiens
tgcacacactctgcatatactt

SEQ ID NO: 8032908 - DNA, 22 bp, Homo sapiens
tgcacacactctgcatatactt

SEQ ID NO: 8032909 - DNA, 22 bp, Homo sapiens
tgcacacactctgcatatactt

SEQ ID NO: 8032910 - DNA, 22 bp, Homo sapiens
tgcacacactcgtgtatatgag

SEQ ID NO: 8032911 - DNA, 22 bp, Homo sapiens
tgcacacactcgtgtatatgag

SEQ ID NO: 8032912 - DNA, 22 bp, Homo sapiens
tgcacacacggagataggcttt

SEQ ID NO: 8032913 - DNA, 22 bp, Homo sapiens
tgcacacactctgcatatactt

SEQ ID NO: 8032914 - DNA, 22 bp, Homo sapiens
tgcacacagctgggcctggctg

SEQ ID NO: 8032915 - DNA, 22 bp, Homo sapiens
tgcacacagctgggcctggctg

SEQ ID NO: 8032916 - DNA, 22 bp, Homo sapiens
tgcacacaggtctaggacatgg

SEQ ID NO: 8032917 - DNA, 22 bp, Homo sapiens
tgcacacaggtctaggacatgg

SEQ ID NO: 8032918 - DNA, 22 bp, Homo sapiens
tgcacacaggtctaggacatgg

SEQ ID NO: 8032919 - DNA, 22 bp, Homo sapiens
tgcacacagtggacaagtcttg

SEQ ID NO: 8032920 - DNA, 22 bp, Homo sapiens
tgcacacagatggtacatgcat

SEQ ID NO: 8032921 - DNA, 22 bp, Homo sapiens
tgcacacagccagtgagtggca

SEQ ID NO: 8032922 - DNA, 22 bp, Homo sapiens
tgcacacagctgggcctggctg

SEQ ID NO: 8032923 - DNA, 22 bp, Homo sapiens
tgcacacagctgggcctggctg

SEQ ID NO: 8032924 - DNA, 22 bp, Homo sapiens
tgcacacagatggtacatgcat

SEQ ID NO: 8032925 - DNA, 22 bp, Homo sapiens
tgcacacagatggtacatgcat

SEQ ID NO: 8032926 - DNA, 22 bp, Homo sapiens
tgcacacagatggtacatgcat

SEQ ID NO: 8032927 - DNA, 22 bp, Homo sapiens
tgcacacagatggtacatgcat

SEQ ID NO: 8032928 - DNA, 22 bp, Homo sapiens
tgcacacacggagataggcttt

SEQ ID NO: 8032929 - DNA, 22 bp, Homo sapiens
tgcacacacgcggcacatctgt

SEQ ID NO: 8032930 - DNA, 22 bp, Homo sapiens
tgcacacacgcggcacatctgt

SEQ ID NO: 8032931 - DNA, 22 bp, Homo sapiens
tgcacacacggagataggcttt

SEQ ID NO: 8032932 - DNA, 22 bp, Homo sapiens
tgcacacacggagataggcttt

SEQ ID NO: 8032933 - DNA, 22 bp, Homo sapiens
tgcacacacgcggcacatctgt

SEQ ID NO: 8032934 - DNA, 22 bp, Homo sapiens
tgcacacaccgtgcttcactga

SEQ ID NO: 8032935 - DNA, 22 bp, Homo sapiens
tgcacacacgcggcacatctgt

SEQ ID NO: 8032936 - DNA, 22 bp, Homo sapiens
tgcacacacgcggcacatctgt

SEQ ID NO: 8032937 - DNA, 20 bp, Homo sapiens
tgcacacaccctgtcctcca

SEQ ID NO: 8032938 - DNA, 20 bp, Homo sapiens
tgcacacaccctgtcctcca

SEQ ID NO: 8032939 - DNA, 22 bp, Homo sapiens
tgcacacaccgtgcttcactga

SEQ ID NO: 8032940 - DNA, 22 bp, Homo sapiens
tgcacacaccgtgcttcactga

SEQ ID NO: 8032941 - DNA, 22 bp, Homo sapiens
tgcacacacatgcagagggaga

SEQ ID NO: 8032942 - DNA, 20 bp, Homo sapiens
tgcacacaccctgtcctcca

SEQ ID NO: 8032943 - DNA, 22 bp, Homo sapiens
tgcacacacatgaagtagcatg

SEQ ID NO: 8032944 - DNA, 22 bp, Homo sapiens
tgcacacacatgcagagggaga

SEQ ID NO: 8032945 - DNA, 22 bp, Homo sapiens
tgcacacacatgcagagggaga

SEQ ID NO: 8032946 - DNA, 22 bp, Homo sapiens
tgcacacacatgaagtagcatg

SEQ ID NO: 8032947 - DNA, 22 bp, Homo sapiens
tgcacacacatgaagtagcatg

SEQ ID NO: 8032948 - DNA, 22 bp, Homo sapiens
tgcacacacatgaagtagcatg

SEQ ID NO: 8032949 - DNA, 22 bp, Homo sapiens
tgcacacacacgtagagaaaag

SEQ ID NO: 8032950 - DNA, 22 bp, Homo sapiens
tgcacacacaggagtctcctcc

SEQ ID NO: 8032951 - DNA, 22 bp, Homo sapiens
tgcacacacaggagtctcctcc

SEQ ID NO: 8032952 - DNA, 22 bp, Homo sapiens
tgcacacacaggagtctcctcc

SEQ ID NO: 8032953 - DNA, 22 bp, Homo sapiens
tgcacacacatgaagtagcatg

SEQ ID NO: 8032954 - DNA, 22 bp, Homo sapiens
tgcacacacatgaagtagcatg

SEQ ID NO: 8032955 - DNA, 22 bp, Homo sapiens
tgcacacacatgaagtagcatg

SEQ ID NO: 8032956 - DNA, 22 bp, Homo sapiens
tgcaaatgagttgcagatcagg

SEQ ID NO: 8032957 - DNA, 22 bp, Homo sapiens
tgcaaatgatgaaactaacttt

SEQ ID NO: 8032958 - DNA, 22 bp, Homo sapiens
tgcaaatgcccatttattttct

SEQ ID NO: 8032959 - DNA, 22 bp, Homo sapiens
tgcaaatgcccatttattttct

SEQ ID NO: 8032960 - DNA, 19 bp, Homo sapiens
tgcaaatgctgttgagaat

SEQ ID NO: 8032961 - DNA, 22 bp, Homo sapiens
tgcaaatgagttgcagatcagg

SEQ ID NO: 8032962 - DNA, 22 bp, Homo sapiens
tgcaaatggagcatgtataaga

SEQ ID NO: 8032963 - DNA, 22 bp, Homo sapiens
tgcaaagatgaaatattaaagg

SEQ ID NO: 8032964 - DNA, 22 bp, Homo sapiens
tgcaaagatgaaatattaaagg

SEQ ID NO: 8032965 - DNA, 22 bp, Homo sapiens
tgcaaagaagcctttgccttct

SEQ ID NO: 8032966 - DNA, 22 bp, Homo sapiens
tgcaaagatatgagaagctgta

SEQ ID NO: 8032967 - DNA, 22 bp, Homo sapiens
tgcaaagatatgagaagctgta

SEQ ID NO: 8032968 - DNA, 22 bp, Homo sapiens
tgcaaactattggtagagatgg

SEQ ID NO: 8032969 - DNA, 22 bp, Homo sapiens
tgcaaagaagccacagtcccag

SEQ ID NO: 8032970 - DNA, 22 bp, Homo sapiens
tgcaaagaagggctgaggagca

SEQ ID NO: 8032971 - DNA, 22 bp, Homo sapiens
tgcaaagaaggggaggaggatt

SEQ ID NO: 8032972 - DNA, 22 bp, Homo sapiens
tgcaaagaagcctttgccttct

SEQ ID NO: 8032973 - DNA, 22 bp, Homo sapiens
tgcaaagaagcaacatccttgt

SEQ ID NO: 8032974 - DNA, 22 bp, Homo sapiens
tgcaaagaagcaacatccttgt

SEQ ID NO: 8032975 - DNA, 22 bp, Homo sapiens
tgcaaatgggcatctccaagtg

SEQ ID NO: 8032976 - DNA, 22 bp, Homo sapiens
tgcaaatggagcatgtataaga

SEQ ID NO: 8032977 - DNA, 18 bp, Homo sapiens
tgcaaatggctgtttgat

SEQ ID NO: 8032978 - DNA, 18 bp, Homo sapiens
tgcaaatggctgtttgat

SEQ ID NO: 8032979 - DNA, 22 bp, Homo sapiens
tgcaaatgtgtaggtttacata

SEQ ID NO: 8032980 - DNA, 22 bp, Homo sapiens
tgcaaatgtgtggtgaggcatt

SEQ ID NO: 8032981 - DNA, 19 bp, Homo sapiens
tgcaaatgtaggaagaata

SEQ ID NO: 8032982 - DNA, 22 bp, Homo sapiens
tgcaaatgtgttttaaaccaaa

SEQ ID NO: 8032983 - DNA, 22 bp, Homo sapiens
tgcaaattgcgatttttattag

SEQ ID NO: 8032984 - DNA, 22 bp, Homo sapiens
tgcaaatttaatgaaactatgt

SEQ ID NO: 8032985 - DNA, 22 bp, Homo sapiens
tgcaaatttaatgaaactatgt

SEQ ID NO: 8032986 - DNA, 22 bp, Homo sapiens
tgcaaatttatatggtgactgc

SEQ ID NO: 8032987 - DNA, 19 bp, Homo sapiens
tgcaaattctaaaaactga

SEQ ID NO: 8032988 - DNA, 19 bp, Homo sapiens
tgcaaattctaaaaactga

SEQ ID NO: 8032989 - DNA, 22 bp, Homo sapiens
tgcaaacatccgactgaaagcc

SEQ ID NO: 8032990 - DNA, 22 bp, Homo sapiens
tgcaaacatccgactgaaagcc

SEQ ID NO: 8032991 - DNA, 22 bp, Homo sapiens
tgcaaactattggtagagatgg

SEQ ID NO: 8032992 - DNA, 22 bp, Homo sapiens
tgcaaaccagttcaaccaatct

SEQ ID NO: 8032993 - DNA, 22 bp, Homo sapiens
tgcaaactagcatcaactagta

SEQ ID NO: 8032994 - DNA, 22 bp, Homo sapiens
tgcaaagaaaacactgcaagac

SEQ ID NO: 8032995 - DNA, 23 bp, Homo sapiens
tgcaaagaaatctgggtcattgt

SEQ ID NO: 8032996 - DNA, 22 bp, Homo sapiens
tgcaaagaactaagcagcctta

SEQ ID NO: 8032997 - DNA, 22 bp, Homo sapiens
tgcaaacaggagagtaagtata

SEQ ID NO: 8032998 - DNA, 22 bp, Homo sapiens
tgcaaacaggagagtaagtata

SEQ ID NO: 8032999 - DNA, 22 bp, Homo sapiens
tgcaaacaggagagtaagtata

SEQ ID NO: 8033000 - DNA, 22 bp, Homo sapiens
tgcaaacaggcatttcacaaac

SEQ ID NO: 8033001 - DNA, 22 bp, Homo sapiens
tgcaaacaggcatttcacaaac

SEQ ID NO: 8033002 - DNA, 22 bp, Homo sapiens
tgcaaacagaaaagctactttg

SEQ ID NO: 8033003 - DNA, 22 bp, Homo sapiens
tgcaaacagaaagtttattgtg

SEQ ID NO: 8033004 - DNA, 22 bp, Homo sapiens
tgcaaacaggcatttcacaaac

SEQ ID NO: 8033005 - DNA, 22 bp, Homo sapiens
tgcaaacagttaagatgcaggc

SEQ ID NO: 8033006 - DNA, 22 bp, Homo sapiens
tgcaaacagttaagatgcaggc

SEQ ID NO: 8033007 - DNA, 22 bp, Homo sapiens
tgcaaacagttaagatgcaggc

SEQ ID NO: 8033008 - DNA, 22 bp, Homo sapiens
tgcaaacatcaatggcctgagc

SEQ ID NO: 8033009 - DNA, 22 bp, Homo sapiens
tgcaaacagttaagatgcaggc

SEQ ID NO: 8033010 - DNA, 20 bp, Homo sapiens
tgcaaacacagagtgtatga

SEQ ID NO: 8033011 - DNA, 20 bp, Homo sapiens
tgcaaacacagagtgtatga

SEQ ID NO: 8033012 - DNA, 22 bp, Homo sapiens
tgcaaacaccacagagacaatt

SEQ ID NO: 8033013 - DNA, 20 bp, Homo sapiens
tgcaaacacagagtgtatga

SEQ ID NO: 8033014 - DNA, 20 bp, Homo sapiens
tgcaaacacagagtgtatga

SEQ ID NO: 8033015 - DNA, 22 bp, Homo sapiens
tgcaaacagaaaagctactttg

SEQ ID NO: 8033016 - DNA, 22 bp, Homo sapiens
tgcaaacagaaagtttattgtg

SEQ ID NO: 8033017 - DNA, 22 bp, Homo sapiens
tgcaaacacttcaacgtgcatc

SEQ ID NO: 8033018 - DNA, 22 bp, Homo sapiens
tgcaaacaccacagagacaatt

SEQ ID NO: 8033019 - DNA, 22 bp, Homo sapiens
tgcaaacaccacagagacaatt

SEQ ID NO: 8033020 - DNA, 22 bp, Homo sapiens
tgcaaacacttcaacgtgcatc

SEQ ID NO: 8033021 - DNA, 22 bp, Homo sapiens
tgcaaacacttcaacgtgcatc

SEQ ID NO: 8033022 - DNA, 22 bp, Homo sapiens
tgcaaacacttcaacgtgcatc

SEQ ID NO: 8033023 - DNA, 22 bp, Homo sapiens
tgcaaacacttcaacgtgcatc

SEQ ID NO: 8033024 - DNA, 17 bp, Homo sapiens
tgcaaacaatcacatat

SEQ ID NO: 8033025 - DNA, 17 bp, Homo sapiens
tgcaaacaatcacatat

SEQ ID NO: 8033026 - DNA, 17 bp, Homo sapiens
tgcaaacaatcacatat

SEQ ID NO: 8033027 - DNA, 17 bp, Homo sapiens
tgcaaacaatcacatat

SEQ ID NO: 8033028 - DNA, 22 bp, Homo sapiens
tgcaaacaatttcctataaagt

SEQ ID NO: 8033029 - DNA, 22 bp, Homo sapiens
tgcaaacaatttcctataaagt

SEQ ID NO: 8033030 - DNA, 22 bp, Homo sapiens
tgcaaacaatttcctataaagt

SEQ ID NO: 8033031 - DNA, 22 bp, Homo sapiens
tgcaaacaatttcctataaagt

SEQ ID NO: 8033032 - DNA, 22 bp, Homo sapiens
tgcaaacaatttcctataaagt

SEQ ID NO: 8033033 - DNA, 22 bp, Homo sapiens
tgcaaacaatttcctataaagt

SEQ ID NO: 8033034 - DNA, 23 bp, Homo sapiens
tgcaaaatttgcagagttcgatg

SEQ ID NO: 8033035 - DNA, 23 bp, Homo sapiens
tgcaaaatttgcagagttcgatg

SEQ ID NO: 8033036 - DNA, 23 bp, Homo sapiens
tgcaaaatttgcagagttcgatg

SEQ ID NO: 8033037 - DNA, 22 bp, Homo sapiens
tgcaaaatgacttctgaaaaga

SEQ ID NO: 8033038 - DNA, 22 bp, Homo sapiens
tgatttcatagtatatacatga

SEQ ID NO: 8033039 - DNA, 22 bp, Homo sapiens
tgatttcatagtatatacatga

SEQ ID NO: 8033040 - DNA, 22 bp, Homo sapiens
tgatttcaggaatgtcttagca

SEQ ID NO: 8033041 - DNA, 22 bp, Homo sapiens
tgatttcaggaatgtcttagca

SEQ ID NO: 8033042 - DNA, 22 bp, Homo sapiens
tgatttcaagccagggggcgtt

SEQ ID NO: 8033043 - DNA, 22 bp, Homo sapiens
tgatttatgaccaagttagaat

SEQ ID NO: 8033044 - DNA, 22 bp, Homo sapiens
tgatttatgcattatactgttg

SEQ ID NO: 8033045 - DNA, 22 bp, Homo sapiens
tgatttatgcattatactgttg

SEQ ID NO: 8033046 - DNA, 22 bp, Homo sapiens
tgatttatgcattatactgttg

SEQ ID NO: 8033047 - DNA, 22 bp, Homo sapiens
tgatttccccagtcttgctgct

SEQ ID NO: 8033048 - DNA, 22 bp, Homo sapiens
tgatttccctcatcataacaga

SEQ ID NO: 8033049 - DNA, 22 bp, Homo sapiens
tgatttacacatcaaagcagca

SEQ ID NO: 8033050 - DNA, 22 bp, Homo sapiens
tgatttacagtagtgtctaaac

SEQ ID NO: 8033051 - DNA, 22 bp, Homo sapiens
tgatttacacatcaaagcagca

SEQ ID NO: 8033052 - DNA, 22 bp, Homo sapiens
tgatttacacatcaaagcagca

SEQ ID NO: 8033053 - DNA, 22 bp, Homo sapiens
tgatttacacacctatgattta

SEQ ID NO: 8033054 - DNA, 22 bp, Homo sapiens
tgatttacacacctatgattta

SEQ ID NO: 8033055 - DNA, 22 bp, Homo sapiens
tgatttacagtagtgtctaaac

SEQ ID NO: 8033056 - DNA, 22 bp, Homo sapiens
tgatttacagtagtgtctaaac

SEQ ID NO: 8033057 - DNA, 22 bp, Homo sapiens
tgatttaccagttactatcttg

SEQ ID NO: 8033058 - DNA, 22 bp, Homo sapiens
tgatttaccagttactatcttg

SEQ ID NO: 8033059 - DNA, 22 bp, Homo sapiens
tgatttaccagttactatcttg

SEQ ID NO: 8033060 - DNA, 22 bp, Homo sapiens
tgatttacaattgtaaaagttt

SEQ ID NO: 8033061 - DNA, 22 bp, Homo sapiens
tgatttacacacctatgattta

SEQ ID NO: 8033062 - DNA, 22 bp, Homo sapiens
tgatttacacacctatgattta

SEQ ID NO: 8033063 - DNA, 22 bp, Homo sapiens
tgatttacacacctatgattta

SEQ ID NO: 8033064 - DNA, 22 bp, Homo sapiens
tgatttacaattgtaaaagttt

SEQ ID NO: 8033065 - DNA, 22 bp, Homo sapiens
tgatttaaaagaaacattgtct

SEQ ID NO: 8033066 - DNA, 22 bp, Homo sapiens
tgatttacttctggataaatcc

SEQ ID NO: 8033067 - DNA, 22 bp, Homo sapiens
tgatttacttctggataaatcc

SEQ ID NO: 8033068 - DNA, 22 bp, Homo sapiens
tgatttacttctggataaatcc

SEQ ID NO: 8033069 - DNA, 22 bp, Homo sapiens
tgatttaggaaacagctacagg

SEQ ID NO: 8033070 - DNA, 22 bp, Homo sapiens
tgatttacttcccagctgggtt

SEQ ID NO: 8033071 - DNA, 22 bp, Homo sapiens
tgatttactcccacttagagcc

SEQ ID NO: 8033072 - DNA, 22 bp, Homo sapiens
tgatttacccgtccaggcccta

SEQ ID NO: 8033073 - DNA, 22 bp, Homo sapiens
tgatttacccgtaactatttct

SEQ ID NO: 8033074 - DNA, 22 bp, Homo sapiens
tgatttacccgtaactatttct

SEQ ID NO: 8033075 - DNA, 22 bp, Homo sapiens
tgatttaccagttactatcttg

SEQ ID NO: 8033076 - DNA, 22 bp, Homo sapiens
tgatttatgaccaagttagaat

SEQ ID NO: 8033077 - DNA, 22 bp, Homo sapiens
tgatttatgaccaagttagaat

SEQ ID NO: 8033078 - DNA, 22 bp, Homo sapiens
tgatttacttctggataaatcc

SEQ ID NO: 8033079 - DNA, 22 bp, Homo sapiens
tgatttatgaccaagttagaat

SEQ ID NO: 8033080 - DNA, 17 bp, Homo sapiens
tgatttagtaagctgcc

SEQ ID NO: 8033081 - DNA, 22 bp, Homo sapiens
tgatttatgaccaagttagaat

SEQ ID NO: 8033082 - DNA, 22 bp, Homo sapiens
tgatttttaaaattctccttgc

SEQ ID NO: 8033083 - DNA, 22 bp, Homo sapiens
tgatttttaaaattctccttgc

SEQ ID NO: 8033084 - DNA, 22 bp, Homo sapiens
tgatttttaaaattctccttgc

SEQ ID NO: 8033085 - DNA, 22 bp, Homo sapiens
tgatttttaaaattctccttgc

SEQ ID NO: 8033086 - DNA, 22 bp, Homo sapiens
tgatttttagctattctgaaga

SEQ ID NO: 8033087 - DNA, 22 bp, Homo sapiens
tgatttttagctattctgaaga

SEQ ID NO: 8033088 - DNA, 22 bp, Homo sapiens
tgatttttagctattctgaaga

SEQ ID NO: 8033089 - DNA, 22 bp, Homo sapiens
tgatttttagctattctgaaga

SEQ ID NO: 8033090 - DNA, 22 bp, Homo sapiens
tgatttttagctattctgaaga

SEQ ID NO: 8033091 - DNA, 22 bp, Homo sapiens
tgatttttggatctgagctgca

SEQ ID NO: 8033092 - DNA, 22 bp, Homo sapiens
tgcaaaaacagccttgaggcct

SEQ ID NO: 8033093 - DNA, 22 bp, Homo sapiens
tgcaaaaacagccttgaggcct

SEQ ID NO: 8033094 - DNA, 22 bp, Homo sapiens
tgcaaaaacagccttgaggcct

SEQ ID NO: 8033095 - DNA, 22 bp, Homo sapiens
tgatttttagctattctgaaga

SEQ ID NO: 8033096 - DNA, 22 bp, Homo sapiens
tgatttttggatctgagctgca

SEQ ID NO: 8033097 - DNA, 22 bp, Homo sapiens
tgatttttggatctgagctgca

SEQ ID NO: 8033098 - DNA, 22 bp, Homo sapiens
tgatttttggatctgagctgca

SEQ ID NO: 8033099 - DNA, 22 bp, Homo sapiens
tgattttcatgggtgatctttg

SEQ ID NO: 8033100 - DNA, 22 bp, Homo sapiens
tgattttcatgggtgatctttg

SEQ ID NO: 8033101 - DNA, 22 bp, Homo sapiens
tgatttcctggctttggagttc

SEQ ID NO: 8033102 - DNA, 22 bp, Homo sapiens
tgattttgtcatgtttctgata

SEQ ID NO: 8033103 - DNA, 22 bp, Homo sapiens
tgattttgtcatgtttctgata

SEQ ID NO: 8033104 - DNA, 22 bp, Homo sapiens
tgattttgtcatgtttctgata

SEQ ID NO: 8033105 - DNA, 20 bp, Homo sapiens
tgattttctgaaacagcaca

SEQ ID NO: 8033106 - DNA, 22 bp, Homo sapiens
tgattttcatgggtgatctttg

SEQ ID NO: 8033107 - DNA, 20 bp, Homo sapiens
tgattttctgaaacagcaca

SEQ ID NO: 8033108 - DNA, 22 bp, Homo sapiens
tgattttctccattgtaaattc

SEQ ID NO: 8033109 - DNA, 22 bp, Homo sapiens
tgattttcatgggtgatctttg

SEQ ID NO: 8033110 - DNA, 22 bp, Homo sapiens
tgattttctccattgtaaattc

SEQ ID NO: 8033111 - DNA, 22 bp, Homo sapiens
tgattttctccattgtaaattc

SEQ ID NO: 8033112 - DNA, 22 bp, Homo sapiens
tgcaaaagaatatagatattgt

SEQ ID NO: 8033113 - DNA, 22 bp, Homo sapiens
tgcaaaataatgaacgattttt

SEQ ID NO: 8033114 - DNA, 22 bp, Homo sapiens
tgcaaaataatgaacgattttt

SEQ ID NO: 8033115 - DNA, 22 bp, Homo sapiens
tgcaaaataatgaacgattttt

SEQ ID NO: 8033116 - DNA, 22 bp, Homo sapiens
tgcaaaataatgaacgattttt

SEQ ID NO: 8033117 - DNA, 22 bp, Homo sapiens
tgcaaaataatgaacgattttt

SEQ ID NO: 8033118 - DNA, 22 bp, Homo sapiens
tgcaaaatgacttctgaaaaga

SEQ ID NO: 8033119 - DNA, 22 bp, Homo sapiens
tgcaaaatgacttctgaaaaga

SEQ ID NO: 8033120 - DNA, 22 bp, Homo sapiens
tgcaaaaattgctggaatcttt

SEQ ID NO: 8033121 - DNA, 22 bp, Homo sapiens
tgcaaaaattgctggaatcttt

SEQ ID NO: 8033122 - DNA, 22 bp, Homo sapiens
tgcaaaaattgctggaatcttt

SEQ ID NO: 8033123 - DNA, 22 bp, Homo sapiens
tgcaaaacttctcagagccttt

SEQ ID NO: 8033124 - DNA, 22 bp, Homo sapiens
tgcaaaagaatatagatattgt

SEQ ID NO: 8033125 - DNA, 22 bp, Homo sapiens
tgcaaaagaatatagatattgt

SEQ ID NO: 8033126 - DNA, 22 bp, Homo sapiens
tgcaaaaagagcgaggagccct

SEQ ID NO: 8033127 - DNA, 22 bp, Homo sapiens
tgcaaaaagagcgaggagccct

SEQ ID NO: 8033128 - DNA, 22 bp, Homo sapiens
tgcaaaaagagcgaggagccct

SEQ ID NO: 8033129 - DNA, 22 bp, Homo sapiens
tgcaaaaagagcgaggagccct

SEQ ID NO: 8033130 - DNA, 22 bp, Homo sapiens
tgcaaaaaggcagactggtgat

SEQ ID NO: 8033131 - DNA, 22 bp, Homo sapiens
tgcaaaaaggcagactggtgat

SEQ ID NO: 8033132 - DNA, 22 bp, Homo sapiens
tgcaaaaaggcagactggtgat

SEQ ID NO: 8033133 - DNA, 22 bp, Homo sapiens
tgcaaaaaggcagactggtgat

SEQ ID NO: 8033134 - DNA, 22 bp, Homo sapiens
tgcaaaaactgcaattgctttt

SEQ ID NO: 8033135 - DNA, 22 bp, Homo sapiens
tgcaaaaactgcaattgctttt

SEQ ID NO: 8033136 - DNA, 22 bp, Homo sapiens
tgcaaaaactgcaattgctttt

SEQ ID NO: 8033137 - DNA, 22 bp, Homo sapiens
tgcaaaaactgcaattgctttt

SEQ ID NO: 8033138 - DNA, 22 bp, Homo sapiens
tgcaaaaagagcgaggagccct

SEQ ID NO: 8033139 - DNA, 22 bp, Homo sapiens
tgcaaaaactgcaattgctttt

SEQ ID NO: 8033140 - DNA, 22 bp, Homo sapiens
tcctggctcctggagacctgct

SEQ ID NO: 8033141 - DNA, 22 bp, Homo sapiens
tcctggctcctggagacctgct

SEQ ID NO: 8033142 - DNA, 22 bp, Homo sapiens
tcctggctcctgatctgtcact

SEQ ID NO: 8033143 - DNA, 22 bp, Homo sapiens
tcctggctcctggagacctgct

SEQ ID NO: 8033144 - DNA, 17 bp, Homo sapiens
tcctggcctggtgtgtg

SEQ ID NO: 8033145 - DNA, 17 bp, Homo sapiens
tcctggcctggtgtgtg

SEQ ID NO: 8033146 - DNA, 15 bp, Homo sapiens
tcctggcctgctctg

SEQ ID NO: 8033147 - DNA, 22 bp, Homo sapiens
tcctggcctctgagtcaagaac

SEQ ID NO: 8033148 - DNA, 22 bp, Homo sapiens
tcctggcctctgagtcaagaac

SEQ ID NO: 8033149 - DNA, 15 bp, Homo sapiens
tcctggcctgctctg

SEQ ID NO: 8033150 - DNA, 22 bp, Homo sapiens
tcctggcctctgagtcaagaac

SEQ ID NO: 8033151 - DNA, 22 bp, Homo sapiens
tcctggcctcgctgtccacctt

SEQ ID NO: 8033152 - DNA, 22 bp, Homo sapiens
tcctggcctcgctgtccacctt

SEQ ID NO: 8033153 - DNA, 22 bp, Homo sapiens
tcctggcctcgctgtccacctt

SEQ ID NO: 8033154 - DNA, 22 bp, Homo sapiens
tcctggcctccgttctctgcat

SEQ ID NO: 8033155 - DNA, 22 bp, Homo sapiens
tcctggcctcgctgtccacctt

SEQ ID NO: 8033156 - DNA, 22 bp, Homo sapiens
tcctggcctccgttctctgcat

SEQ ID NO: 8033157 - DNA, 22 bp, Homo sapiens
tcctggcctccgttctctgcat

SEQ ID NO: 8033158 - DNA, 22 bp, Homo sapiens
tcctggcctccgttctctgcat

SEQ ID NO: 8033159 - DNA, 22 bp, Homo sapiens
tcctggcctccgttctctgcat

SEQ ID NO: 8033160 - DNA, 20 bp, Homo sapiens
tcctggcctccctggggctc

SEQ ID NO: 8033161 - DNA, 20 bp, Homo sapiens
tcctggcctccctggggctc

SEQ ID NO: 8033162 - DNA, 20 bp, Homo sapiens
tcctggcctccctggggctc

SEQ ID NO: 8033163 - DNA, 22 bp, Homo sapiens
tcctggcctcacagtcctgggt

SEQ ID NO: 8033164 - DNA, 20 bp, Homo sapiens
tcctggcctccctggggctc

SEQ ID NO: 8033165 - DNA, 22 bp, Homo sapiens
tcctggctctaagtcctgagtg

SEQ ID NO: 8033166 - DNA, 22 bp, Homo sapiens
tcctggctcggcttggggactt

SEQ ID NO: 8033167 - DNA, 22 bp, Homo sapiens
tcctggctctaagtcctgagtg

SEQ ID NO: 8033168 - DNA, 22 bp, Homo sapiens
tcctggctctaagtcctgagtg

SEQ ID NO: 8033169 - DNA, 22 bp, Homo sapiens
tcctggctctaagtcctgagtg

SEQ ID NO: 8033170 - DNA, 22 bp, Homo sapiens
tcctggctctaagtcctgagtg

SEQ ID NO: 8033171 - DNA, 22 bp, Homo sapiens
tcctggctctaagtcctgagtg

SEQ ID NO: 8033172 - DNA, 22 bp, Homo sapiens
tcctggctctaagtcctgagtg

SEQ ID NO: 8033173 - DNA, 22 bp, Homo sapiens
tcctggctctaagtcctgagtg

SEQ ID NO: 8033174 - DNA, 22 bp, Homo sapiens
tcctggctcggcttggggactt

SEQ ID NO: 8033175 - DNA, 22 bp, Homo sapiens
tcctggctcggcttggggactt

SEQ ID NO: 8033176 - DNA, 22 bp, Homo sapiens
tcctggctcgattgctaccaat

SEQ ID NO: 8033177 - DNA, 22 bp, Homo sapiens
tcctggctcgattgctaccaat

SEQ ID NO: 8033178 - DNA, 22 bp, Homo sapiens
tcctggctcctggagacctgct

SEQ ID NO: 8033179 - DNA, 22 bp, Homo sapiens
tcctggctcctggagacctgct

SEQ ID NO: 8033180 - DNA, 22 bp, Homo sapiens
tcctggctctgctgcctcctag

SEQ ID NO: 8033181 - DNA, 22 bp, Homo sapiens
tcctggctctgctgcctcctag

SEQ ID NO: 8033182 - DNA, 17 bp, Homo sapiens
tcctggctctgccactg

SEQ ID NO: 8033183 - DNA, 17 bp, Homo sapiens
tcctggctctgccactg

SEQ ID NO: 8033184 - DNA, 17 bp, Homo sapiens
tcctggctctgccactg

SEQ ID NO: 8033185 - DNA, 22 bp, Homo sapiens
tcctggctctgctgcctcctag

SEQ ID NO: 8033186 - DNA, 22 bp, Homo sapiens
tcctggctctgctgcctcctag

SEQ ID NO: 8033187 - DNA, 17 bp, Homo sapiens
tcctggctctgccactg

SEQ ID NO: 8033188 - DNA, 23 bp, Homo sapiens
tcctggctctgcacttgctaatg

SEQ ID NO: 8033189 - DNA, 23 bp, Homo sapiens
tcctggctctgcacttgctaatg

SEQ ID NO: 8033190 - DNA, 22 bp, Homo sapiens
tcctggctctctacaaaccaga

SEQ ID NO: 8033191 - DNA, 22 bp, Homo sapiens
tcctggctctctacaaaccaga

SEQ ID NO: 8033192 - DNA, 22 bp, Homo sapiens
tcctggctctaagtcctgagtg

SEQ ID NO: 8033193 - DNA, 22 bp, Homo sapiens
tcctggctctaagtcctgagtg

SEQ ID NO: 8033194 - DNA, 21 bp, Homo sapiens
tcctggcccactctatcccca

SEQ ID NO: 8033195 - DNA, 22 bp, Homo sapiens
tcctggcccactcctagcttct

SEQ ID NO: 8033196 - DNA, 21 bp, Homo sapiens
tcctggcccactctatcccca

SEQ ID NO: 8033197 - DNA, 22 bp, Homo sapiens
tcctggcccactatgccagcat

SEQ ID NO: 8033198 - DNA, 22 bp, Homo sapiens
tcctggcccactcctagcttct

SEQ ID NO: 8033199 - DNA, 22 bp, Homo sapiens
tcctggcccactcctagcttct

SEQ ID NO: 8033200 - DNA, 22 bp, Homo sapiens
tcctggcccactcctagcttct

SEQ ID NO: 8033201 - DNA, 22 bp, Homo sapiens
tcctggcccactatgccagcat

SEQ ID NO: 8033202 - DNA, 22 bp, Homo sapiens
tcctggcccactatgccagcat

SEQ ID NO: 8033203 - DNA, 22 bp, Homo sapiens
tcctggcccactatgccagcat

SEQ ID NO: 8033204 - DNA, 22 bp, Homo sapiens
tcctggcccactatgccagcat

SEQ ID NO: 8033205 - DNA, 22 bp, Homo sapiens
tcctggcccactatgccagcat

SEQ ID NO: 8033206 - DNA, 22 bp, Homo sapiens
tcctggcccactatgccagcat

SEQ ID NO: 8033207 - DNA, 16 bp, Homo sapiens
tcctggcccctatgga

SEQ ID NO: 8033208 - DNA, 16 bp, Homo sapiens
tcctggcccctatgga

SEQ ID NO: 8033209 - DNA, 22 bp, Homo sapiens
tcctggcccgatccctgtgaag

SEQ ID NO: 8033210 - DNA, 22 bp, Homo sapiens
tcctggcccgatccctgtgaag

SEQ ID NO: 8033211 - DNA, 22 bp, Homo sapiens
tcctggcccgatccctgtgaag

SEQ ID NO: 8033212 - DNA, 22 bp, Homo sapiens
tcctggcccggccgggcctgct

SEQ ID NO: 8033213 - DNA, 22 bp, Homo sapiens
tcctggccctctgcaaacgcca

SEQ ID NO: 8033214 - DNA, 22 bp, Homo sapiens
tcctggcccgatccctgtgaag

SEQ ID NO: 8033215 - DNA, 22 bp, Homo sapiens
tcctggcccggccgggcctgct

SEQ ID NO: 8033216 - DNA, 22 bp, Homo sapiens
tcctggcccggccgggcctgct

SEQ ID NO: 8033217 - DNA, 22 bp, Homo sapiens
tcctggccctgtggcctgcagt

SEQ ID NO: 8033218 - DNA, 22 bp, Homo sapiens
tcctggccctctgcaaacgcca

SEQ ID NO: 8033219 - DNA, 22 bp, Homo sapiens
tcctggccctgtggcctgcagt

SEQ ID NO: 8033220 - DNA, 22 bp, Homo sapiens
tcctggccctgtggcctgcagt

SEQ ID NO: 8033221 - DNA, 22 bp, Homo sapiens
tcctggccctgtggcctgcagt

SEQ ID NO: 8033222 - DNA, 22 bp, Homo sapiens
tcctggccgccgcgtggggccg

SEQ ID NO: 8033223 - DNA, 22 bp, Homo sapiens
tcctggccgctggcccctgaga

SEQ ID NO: 8033224 - DNA, 22 bp, Homo sapiens
tcctggccctgtggcctgcagt

SEQ ID NO: 8033225 - DNA, 22 bp, Homo sapiens
tcctggccgccgcgtggggccg

SEQ ID NO: 8033226 - DNA, 22 bp, Homo sapiens
tcctggccgccgcgtggggccg

SEQ ID NO: 8033227 - DNA, 22 bp, Homo sapiens
tcctggcctagagtttgtgttc

SEQ ID NO: 8033228 - DNA, 22 bp, Homo sapiens
tcctggcctagagtttgtgttc

SEQ ID NO: 8033229 - DNA, 22 bp, Homo sapiens
tcctggcctagctcaccctgga

SEQ ID NO: 8033230 - DNA, 22 bp, Homo sapiens
tcctggcctagctcaccctgga

SEQ ID NO: 8033231 - DNA, 22 bp, Homo sapiens
tcctggccgctggcccctgaga

SEQ ID NO: 8033232 - DNA, 22 bp, Homo sapiens
tcctggccgctggcccctgaga

SEQ ID NO: 8033233 - DNA, 22 bp, Homo sapiens
tcctggccgctggcccctgaga

SEQ ID NO: 8033234 - DNA, 22 bp, Homo sapiens
tcctggcctcacagtcctgggt

SEQ ID NO: 8033235 - DNA, 22 bp, Homo sapiens
tcctggcctcacagtcctgggt

SEQ ID NO: 8033236 - DNA, 22 bp, Homo sapiens
tcctggcctcacagtcctgggt

SEQ ID NO: 8033237 - DNA, 22 bp, Homo sapiens
tcctggcctagctcaccctgga

SEQ ID NO: 8033238 - DNA, 22 bp, Homo sapiens
tcctggcctagctcaccctgga

SEQ ID NO: 8033239 - DNA, 22 bp, Homo sapiens
tcctggagtggagtctgttgtt

SEQ ID NO: 8033240 - DNA, 22 bp, Homo sapiens
tcctggagttgtctgtactcat

SEQ ID NO: 8033241 - DNA, 22 bp, Homo sapiens
tcctggagtatttctgtggtgt

SEQ ID NO: 8033242 - DNA, 22 bp, Homo sapiens
tcctggagtatttctgtggtgt

SEQ ID NO: 8033243 - DNA, 20 bp, Homo sapiens
tcctggagtctggtttggct

SEQ ID NO: 8033244 - DNA, 20 bp, Homo sapiens
tcctggagtctggtttggct

SEQ ID NO: 8033245 - DNA, 22 bp, Homo sapiens
tcctggagttgtgcagtgcaca

SEQ ID NO: 8033246 - DNA, 22 bp, Homo sapiens
tcctggagttgtgcagtgcaca

SEQ ID NO: 8033247 - DNA, 22 bp, Homo sapiens
tcctggagttgtctgtactcat

SEQ ID NO: 8033248 - DNA, 22 bp, Homo sapiens
tcctggagttgtgcagtgcaca

SEQ ID NO: 8033249 - DNA, 22 bp, Homo sapiens
tcctggagtttgtaaggtgagc

SEQ ID NO: 8033250 - DNA, 22 bp, Homo sapiens
tcctggagtttgtaaggtgagc

SEQ ID NO: 8033251 - DNA, 22 bp, Homo sapiens
tcctggagtttgtaaggtgagc

SEQ ID NO: 8033252 - DNA, 22 bp, Homo sapiens
tcctggagtttgtggtgatatg

SEQ ID NO: 8033253 - DNA, 22 bp, Homo sapiens
tcctggagtttgtggtgatatg

SEQ ID NO: 8033254 - DNA, 17 bp, Homo sapiens
tcctggatccatggtgg

SEQ ID NO: 8033255 - DNA, 22 bp, Homo sapiens
tcctggatcagcgggggcaggc

SEQ ID NO: 8033256 - DNA, 22 bp, Homo sapiens
tcctggatcagcgggggcaggc

SEQ ID NO: 8033257 - DNA, 22 bp, Homo sapiens
tcctggattaatagggagctgt

SEQ ID NO: 8033258 - DNA, 22 bp, Homo sapiens
tcctggatggcctgcaggcggt

SEQ ID NO: 8033259 - DNA, 22 bp, Homo sapiens
tcctggatggagctgccctcgc

SEQ ID NO: 8033260 - DNA, 22 bp, Homo sapiens
tcctggattaatagggagctgt

SEQ ID NO: 8033261 - DNA, 20 bp, Homo sapiens
tcctggcaagccgtacctcc

SEQ ID NO: 8033262 - DNA, 22 bp, Homo sapiens
tcctggatttaaccctggctct

SEQ ID NO: 8033263 - DNA, 22 bp, Homo sapiens
tcctggattctgccctgaaggc

SEQ ID NO: 8033264 - DNA, 22 bp, Homo sapiens
tcctggcacaaccctttaccag

SEQ ID NO: 8033265 - DNA, 22 bp, Homo sapiens
tcctggcacaaccctttaccag

SEQ ID NO: 8033266 - DNA, 22 bp, Homo sapiens
tcctggcacattgcaggggctc

SEQ ID NO: 8033267 - DNA, 22 bp, Homo sapiens
tcctggcatccgtgggtctgtg

SEQ ID NO: 8033268 - DNA, 22 bp, Homo sapiens
tcctggcatccgtgggtctgtg

SEQ ID NO: 8033269 - DNA, 22 bp, Homo sapiens
tcctggcagttcagccccctaa

SEQ ID NO: 8033270 - DNA, 22 bp, Homo sapiens
tcctggcataatggctttgctc

SEQ ID NO: 8033271 - DNA, 22 bp, Homo sapiens
tcctggcagttcagccccctaa

SEQ ID NO: 8033272 - DNA, 22 bp, Homo sapiens
tcctggcataatggctttgctc

SEQ ID NO: 8033273 - DNA, 22 bp, Homo sapiens
tcctggcatccgtgggtctgtg

SEQ ID NO: 8033274 - DNA, 17 bp, Homo sapiens
tcctggcagtcccctgg

SEQ ID NO: 8033275 - DNA, 22 bp, Homo sapiens
tcctggcacccttgggttggag

SEQ ID NO: 8033276 - DNA, 22 bp, Homo sapiens
tcctggcacattgcaggggctc

SEQ ID NO: 8033277 - DNA, 17 bp, Homo sapiens
tcctggcagtcccctgg

SEQ ID NO: 8033278 - DNA, 17 bp, Homo sapiens
tcctggcagtcccctgg

SEQ ID NO: 8033279 - DNA, 22 bp, Homo sapiens
tcctggccacacattaatagtg

SEQ ID NO: 8033280 - DNA, 22 bp, Homo sapiens
tcctggccacacattaatagtg

SEQ ID NO: 8033281 - DNA, 22 bp, Homo sapiens
tcctggccaagttactctctgc

SEQ ID NO: 8033282 - DNA, 22 bp, Homo sapiens
tcctggccaagttactctctgc

SEQ ID NO: 8033283 - DNA, 22 bp, Homo sapiens
tcctggccaagttactctctgc

SEQ ID NO: 8033284 - DNA, 22 bp, Homo sapiens
tcctggccaagttactctctgc

SEQ ID NO: 8033285 - DNA, 22 bp, Homo sapiens
tcctggcatttacaaacccacc

SEQ ID NO: 8033286 - DNA, 22 bp, Homo sapiens
tcctggccaagtagatgtggcg

SEQ ID NO: 8033287 - DNA, 22 bp, Homo sapiens
tcctggccaagtagatgtggcg

SEQ ID NO: 8033288 - DNA, 22 bp, Homo sapiens
tcctggccaagtagatgtggcg

SEQ ID NO: 8033289 - DNA, 22 bp, Homo sapiens
tcctggccaagtagatgtggcg

SEQ ID NO: 8033290 - DNA, 22 bp, Homo sapiens
tcctggccaagtagatgtggcg

SEQ ID NO: 8033291 - DNA, 21 bp, Homo sapiens
tcctggccagggcactaggca

SEQ ID NO: 8033292 - DNA, 21 bp, Homo sapiens
tcctggccagggcactaggca

SEQ ID NO: 8033293 - DNA, 21 bp, Homo sapiens
tcctggccagggcactaggca

SEQ ID NO: 8033294 - DNA, 22 bp, Homo sapiens
tcctggccataggctatttcag

SEQ ID NO: 8033295 - DNA, 22 bp, Homo sapiens
tcctggccataggctatttcag

SEQ ID NO: 8033296 - DNA, 22 bp, Homo sapiens
tcctggcccaatctgcccatga

SEQ ID NO: 8033297 - DNA, 22 bp, Homo sapiens
tcctggcccaatctgcccatga

SEQ ID NO: 8033298 - DNA, 22 bp, Homo sapiens
tcctggccatgcaagatgagga

SEQ ID NO: 8033299 - DNA, 22 bp, Homo sapiens
tcctggccatgcaagatgagga

SEQ ID NO: 8033300 - DNA, 22 bp, Homo sapiens
tcctggccatgcaagatgagga

SEQ ID NO: 8033301 - DNA, 22 bp, Homo sapiens
tcctggccagaggacaaagctg

SEQ ID NO: 8033302 - DNA, 22 bp, Homo sapiens
tcctggccagaggacaaagctg

SEQ ID NO: 8033303 - DNA, 22 bp, Homo sapiens
tcctggccaggatgacctaaca

SEQ ID NO: 8033304 - DNA, 22 bp, Homo sapiens
tcctggccaggatgacctaaca

SEQ ID NO: 8033305 - DNA, 18 bp, Homo sapiens
tcctggccacactacctt

SEQ ID NO: 8033306 - DNA, 18 bp, Homo sapiens
tcctggccacactacctt

SEQ ID NO: 8033307 - DNA, 22 bp, Homo sapiens
tcctggccacccgacagaagtc

SEQ ID NO: 8033308 - DNA, 22 bp, Homo sapiens
tcctggccacccgacagaagtc

SEQ ID NO: 8033309 - DNA, 22 bp, Homo sapiens
tcctggccacccgacagaagtc

SEQ ID NO: 8033310 - DNA, 22 bp, Homo sapiens
tcctggagaagaggggcttgga

SEQ ID NO: 8033311 - DNA, 22 bp, Homo sapiens
tcctggagaatcctgccacctg

SEQ ID NO: 8033312 - DNA, 22 bp, Homo sapiens
tcctggagaatggacaatgcac

SEQ ID NO: 8033313 - DNA, 22 bp, Homo sapiens
tcctggagagtgggcgagcaca

SEQ ID NO: 8033314 - DNA, 22 bp, Homo sapiens
tcctggagagtgggcgagcaca

SEQ ID NO: 8033315 - DNA, 22 bp, Homo sapiens
tcctggagagaggcctggaaga

SEQ ID NO: 8033316 - DNA, 22 bp, Homo sapiens
tcctggagagaggcctggaaga

SEQ ID NO: 8033317 - DNA, 22 bp, Homo sapiens
tcctggagagtgggcgagcaca

SEQ ID NO: 8033318 - DNA, 22 bp, Homo sapiens
tcctggagagtgggcgagcaca

SEQ ID NO: 8033319 - DNA, 22 bp, Homo sapiens
tcctggagataattgcagtgaa

SEQ ID NO: 8033320 - DNA, 22 bp, Homo sapiens
tcctggagataattgcagtgaa

SEQ ID NO: 8033321 - DNA, 22 bp, Homo sapiens
tcctggagccaatgtgctgctg

SEQ ID NO: 8033322 - DNA, 22 bp, Homo sapiens
tcctggagataattgcagtgaa

SEQ ID NO: 8033323 - DNA, 22 bp, Homo sapiens
tcctggagataattgcagtgaa

SEQ ID NO: 8033324 - DNA, 22 bp, Homo sapiens
tcctggacagatccccatcatc

SEQ ID NO: 8033325 - DNA, 22 bp, Homo sapiens
tcctggacaagcccttcaccct

SEQ ID NO: 8033326 - DNA, 22 bp, Homo sapiens
tcctggaagtgcttggtgaggg

SEQ ID NO: 8033327 - DNA, 22 bp, Homo sapiens
tcctggaagtgcttggtgaggg

SEQ ID NO: 8033328 - DNA, 22 bp, Homo sapiens
tcctggaagatctctgtgagat

SEQ ID NO: 8033329 - DNA, 22 bp, Homo sapiens
tcctggaacatggataaagaat

SEQ ID NO: 8033330 - DNA, 22 bp, Homo sapiens
tcctggaagccagagttgagga

SEQ ID NO: 8033331 - DNA, 22 bp, Homo sapiens
tcctggaagccagagttgagga

SEQ ID NO: 8033332 - DNA, 22 bp, Homo sapiens
tcctggaagatctctgtgagat

SEQ ID NO: 8033333 - DNA, 22 bp, Homo sapiens
tcctggaacatggataaagaat

SEQ ID NO: 8033334 - DNA, 19 bp, Homo sapiens
tcctgctttctactctgct

SEQ ID NO: 8033335 - DNA, 22 bp, Homo sapiens
tcctgctttgtgcctcacactt

SEQ ID NO: 8033336 - DNA, 22 bp, Homo sapiens
tcctgcttgaaactctgccttc

SEQ ID NO: 8033337 - DNA, 19 bp, Homo sapiens
tcctgctttctactctgct

SEQ ID NO: 8033338 - DNA, 19 bp, Homo sapiens
tcctgctttctactctgct

SEQ ID NO: 8033339 - DNA, 22 bp, Homo sapiens
tcctggagaaactcagagatct

SEQ ID NO: 8033340 - DNA, 22 bp, Homo sapiens
tcctggagaaactcagagatct

SEQ ID NO: 8033341 - DNA, 22 bp, Homo sapiens
tcctggagaaactcagagatct

SEQ ID NO: 8033342 - DNA, 22 bp, Homo sapiens
tcctggagaaactcagagatct

SEQ ID NO: 8033343 - DNA, 22 bp, Homo sapiens
tcctggagaaactcagagatct

SEQ ID NO: 8033344 - DNA, 22 bp, Homo sapiens
tcctggagaaactcagagatct

SEQ ID NO: 8033345 - DNA, 22 bp, Homo sapiens
tcctggagaaactcagagatct

SEQ ID NO: 8033346 - DNA, 22 bp, Homo sapiens
tcctggagaaactcagagatct

SEQ ID NO: 8033347 - DNA, 22 bp, Homo sapiens
tcctggagaagaggggcttgga

SEQ ID NO: 8033348 - DNA, 22 bp, Homo sapiens
tcctggagaagaggggcttgga

SEQ ID NO: 8033349 - DNA, 22 bp, Homo sapiens
tcctggagaagaggggcttgga

SEQ ID NO: 8033350 - DNA, 20 bp, Homo sapiens
tcctggaggcttcatccata

SEQ ID NO: 8033351 - DNA, 20 bp, Homo sapiens
tcctggaggcttcatccata

SEQ ID NO: 8033352 - DNA, 22 bp, Homo sapiens
tcctggaggcactcgctggggc

SEQ ID NO: 8033353 - DNA, 20 bp, Homo sapiens
tcctggaggcttcatccata

SEQ ID NO: 8033354 - DNA, 22 bp, Homo sapiens
tcctggagggaggcggtgctac

SEQ ID NO: 8033355 - DNA, 22 bp, Homo sapiens
tcctggagggaggcggtgctac

SEQ ID NO: 8033356 - DNA, 22 bp, Homo sapiens
tcctggagggaggcggtgctac

SEQ ID NO: 8033357 - DNA, 22 bp, Homo sapiens
tcctggagggaggcggtgctac

SEQ ID NO: 8033358 - DNA, 22 bp, Homo sapiens
tcctggaggcactcgctggggc

SEQ ID NO: 8033359 - DNA, 22 bp, Homo sapiens
tcctggaggcaaatgagcacat

SEQ ID NO: 8033360 - DNA, 22 bp, Homo sapiens
tcctggaggcactcgctggggc

SEQ ID NO: 8033361 - DNA, 22 bp, Homo sapiens
tcctggaggcaaatgagcacat

SEQ ID NO: 8033362 - DNA, 22 bp, Homo sapiens
tcctggagccaatgtgctgctg

SEQ ID NO: 8033363 - DNA, 22 bp, Homo sapiens
tcctggagccaatgtgctgctg

SEQ ID NO: 8033364 - DNA, 22 bp, Homo sapiens
tcctggagccaatgtgctgctg

SEQ ID NO: 8033365 - DNA, 22 bp, Homo sapiens
tcctggagccaatgtgctgctg

SEQ ID NO: 8033366 - DNA, 22 bp, Homo sapiens
tcctggaggagatccaatctga

SEQ ID NO: 8033367 - DNA, 22 bp, Homo sapiens
tcctggaggcaaatgaagactc

SEQ ID NO: 8033368 - DNA, 22 bp, Homo sapiens
tcctggaggcaaatgaagactc

SEQ ID NO: 8033369 - DNA, 22 bp, Homo sapiens
tcctggaggcaaatgaagactc

SEQ ID NO: 8033370 - DNA, 22 bp, Homo sapiens
tcctggaggcaaatgagcacat

SEQ ID NO: 8033371 - DNA, 22 bp, Homo sapiens
tcctggaggggacagcatgggc

SEQ ID NO: 8033372 - DNA, 22 bp, Homo sapiens
tcctggaggggacagcatgggc

SEQ ID NO: 8033373 - DNA, 22 bp, Homo sapiens
tcctggaggggacagcatgggc

SEQ ID NO: 8033374 - DNA, 22 bp, Homo sapiens
tcctggaggggacagcatgggc

SEQ ID NO: 8033375 - DNA, 22 bp, Homo sapiens
tcctggaggggacagcatgggc

SEQ ID NO: 8033376 - DNA, 22 bp, Homo sapiens
tcctggaggggacagcatgggc

SEQ ID NO: 8033377 - DNA, 22 bp, Homo sapiens
tcctggagggaggcggtgctac

SEQ ID NO: 8033378 - DNA, 22 bp, Homo sapiens
tcctggagggctcacaggcggc

SEQ ID NO: 8033379 - DNA, 22 bp, Homo sapiens
tcctggagggctcacaggcggc

SEQ ID NO: 8033380 - DNA, 22 bp, Homo sapiens
tcctggagggctcacaggcggc

SEQ ID NO: 8033381 - DNA, 22 bp, Homo sapiens
tcctggagggctcacaggcggc

SEQ ID NO: 8033382 - DNA, 22 bp, Homo sapiens
tcctggagggctcacaggcggc

SEQ ID NO: 8033383 - DNA, 22 bp, Homo sapiens
tcctggaggggacagcatgggc

SEQ ID NO: 8033384 - DNA, 22 bp, Homo sapiens
tcctggaggggacagcatgggc

SEQ ID NO: 8033385 - DNA, 22 bp, Homo sapiens
tcctggagtaggccttagccat

SEQ ID NO: 8033386 - DNA, 22 bp, Homo sapiens
tcctggagtaggccttagccat

SEQ ID NO: 8033387 - DNA, 20 bp, Homo sapiens
tcctggagtattccatgctt

SEQ ID NO: 8033388 - DNA, 22 bp, Homo sapiens
tcctggagtaggccttagccat

SEQ ID NO: 8033389 - DNA, 20 bp, Homo sapiens
tcctggagtattccatgctt

SEQ ID NO: 8033390 - DNA, 20 bp, Homo sapiens
tcctggagtattccatgctt

SEQ ID NO: 8033391 - DNA, 20 bp, Homo sapiens
tcctggagtattccatgctt

SEQ ID NO: 8033392 - DNA, 22 bp, Homo sapiens
tcctggagtatttctgtggtgt

SEQ ID NO: 8033393 - DNA, 22 bp, Homo sapiens
tcctggagtatttctgtggtgt

SEQ ID NO: 8033394 - DNA, 22 bp, Homo sapiens
tcctggagtatttctgtggtgt

SEQ ID NO: 8033395 - DNA, 22 bp, Homo sapiens
taagaatacctctcagctcttt

SEQ ID NO: 8033396 - DNA, 22 bp, Homo sapiens
taagaatacctctcagctcttt

SEQ ID NO: 8033397 - DNA, 22 bp, Homo sapiens
taagaatagtccctagatgtgt

SEQ ID NO: 8033398 - DNA, 22 bp, Homo sapiens
taagaatagtccctagatgtgt

SEQ ID NO: 8033399 - DNA, 22 bp, Homo sapiens
taagaatagtccctagatgtgt

SEQ ID NO: 8033400 - DNA, 22 bp, Homo sapiens
taagaatagtccctagatgtgt

SEQ ID NO: 8033401 - DNA, 22 bp, Homo sapiens
taagaagtgttgcctaatgcaa

SEQ ID NO: 8033402 - DNA, 22 bp, Homo sapiens
taagaactttgtagcctgttct

SEQ ID NO: 8033403 - DNA, 22 bp, Homo sapiens
taagaactttgtagcctgttct

SEQ ID NO: 8033404 - DNA, 22 bp, Homo sapiens
taagaacttggcagcaagaaat

SEQ ID NO: 8033405 - DNA, 22 bp, Homo sapiens
taagaagcttctgctaatgcct

SEQ ID NO: 8033406 - DNA, 22 bp, Homo sapiens
taagaagggtacaataaggcat

SEQ ID NO: 8033407 - DNA, 22 bp, Homo sapiens
taagaagcagttcacaagtaaa

SEQ ID NO: 8033408 - DNA, 22 bp, Homo sapiens
taagaacttggcagcaagaaat

SEQ ID NO: 8033409 - DNA, 22 bp, Homo sapiens
taagaacttcggacatgttatc

SEQ ID NO: 8033410 - DNA, 22 bp, Homo sapiens
taagaacattttcggaaagata

SEQ ID NO: 8033411 - DNA, 22 bp, Homo sapiens
taagaacattttcggaaagata

SEQ ID NO: 8033412 - DNA, 22 bp, Homo sapiens
taagaacattttcggaaagata

SEQ ID NO: 8033413 - DNA, 21 bp, Homo sapiens
taagaacattatcttcttcct

SEQ ID NO: 8033414 - DNA, 22 bp, Homo sapiens
taagaacagataaagtttcccc

SEQ ID NO: 8033415 - DNA, 23 bp, Homo sapiens
taagaacagacaagcatttacat

SEQ ID NO: 8033416 - DNA, 23 bp, Homo sapiens
taagaacagacaagcatttacat

SEQ ID NO: 8033417 - DNA, 23 bp, Homo sapiens
taagaacagacaagcatttacat

SEQ ID NO: 8033418 - DNA, 22 bp, Homo sapiens
taagaacagtagaacagtaggt

SEQ ID NO: 8033419 - DNA, 22 bp, Homo sapiens
taagaacagtgacagccaacat

SEQ ID NO: 8033420 - DNA, 22 bp, Homo sapiens
taagaacagtgacagccaacat

SEQ ID NO: 8033421 - DNA, 22 bp, Homo sapiens
taagaacagataaagtttcccc

SEQ ID NO: 8033422 - DNA, 22 bp, Homo sapiens
taagaacagtagaacagtaggt

SEQ ID NO: 8033423 - DNA, 22 bp, Homo sapiens
taagaacagtgtctgtctcaca

SEQ ID NO: 8033424 - DNA, 22 bp, Homo sapiens
taagaacagtgtctgtctcaca

SEQ ID NO: 8033425 - DNA, 22 bp, Homo sapiens
taagaacagtgtctgtctcaca

SEQ ID NO: 8033426 - DNA, 22 bp, Homo sapiens
taagaacagtgtctgtctcaca

SEQ ID NO: 8033427 - DNA, 22 bp, Homo sapiens
taagaacagtgtctgtctcaca

SEQ ID NO: 8033428 - DNA, 22 bp, Homo sapiens
taagaacagtgtctgtctcaca

SEQ ID NO: 8033429 - DNA, 22 bp, Homo sapiens
taagaacataaattcatacggg

SEQ ID NO: 8033430 - DNA, 22 bp, Homo sapiens
taagaacagtgtttcatctcta

SEQ ID NO: 8033431 - DNA, 22 bp, Homo sapiens
tcctgcttgaaactctgccttc

SEQ ID NO: 8033432 - DNA, 22 bp, Homo sapiens
tcctgcttgaaactctgccttc

SEQ ID NO: 8033433 - DNA, 22 bp, Homo sapiens
tcctgcttccttgtctttagac

SEQ ID NO: 8033434 - DNA, 22 bp, Homo sapiens
tcctgcttcttcgagcttctgg

SEQ ID NO: 8033435 - DNA, 20 bp, Homo sapiens
tcctgcttccaccagagcac

SEQ ID NO: 8033436 - DNA, 20 bp, Homo sapiens
tcctgcttccaccagagcac

SEQ ID NO: 8033437 - DNA, 22 bp, Homo sapiens
tcctgctgtttacctacaatgg

SEQ ID NO: 8033438 - DNA, 22 bp, Homo sapiens
tcctgctgtttacctacaatgg

SEQ ID NO: 8033439 - DNA, 22 bp, Homo sapiens
tcctgctgttttctggcccaca

SEQ ID NO: 8033440 - DNA, 22 bp, Homo sapiens
tcctgctgttttctggcccaca

SEQ ID NO: 8033441 - DNA, 22 bp, Homo sapiens
tcctgcttaacatatggtcaag

SEQ ID NO: 8033442 - DNA, 22 bp, Homo sapiens
tcctgcttaacatatggtcaag

SEQ ID NO: 8033443 - DNA, 22 bp, Homo sapiens
tcctgctgttttctggcccaca

SEQ ID NO: 8033444 - DNA, 19 bp, Homo sapiens
tcctgctgtgtgaagggga

SEQ ID NO: 8033445 - DNA, 19 bp, Homo sapiens
tcctgctgtgtgaagggga

SEQ ID NO: 8033446 - DNA, 19 bp, Homo sapiens
tcctgctgtgtgaagggga

SEQ ID NO: 8033447 - DNA, 22 bp, Homo sapiens
tcctgctgtgtctagctggttc

SEQ ID NO: 8033448 - DNA, 22 bp, Homo sapiens
tcctgctgggtctaactctggt

SEQ ID NO: 8033449 - DNA, 22 bp, Homo sapiens
tcctgctgtgtctagctggttc

SEQ ID NO: 8033450 - DNA, 22 bp, Homo sapiens
tcctgctgtgtctagctggttc

SEQ ID NO: 8033451 - DNA, 22 bp, Homo sapiens
tcctgctgtgtctagctggttc

SEQ ID NO: 8033452 - DNA, 22 bp, Homo sapiens
tcctgctggcaaggaagggact

SEQ ID NO: 8033453 - DNA, 22 bp, Homo sapiens
tcctgctggattgtgtctggtg

SEQ ID NO: 8033454 - DNA, 22 bp, Homo sapiens
tcctgctggcaaggaagggact

SEQ ID NO: 8033455 - DNA, 22 bp, Homo sapiens
tcctgctggcaaggaagggact

SEQ ID NO: 8033456 - DNA, 22 bp, Homo sapiens
tcctgctgggcctgctttagga

SEQ ID NO: 8033457 - DNA, 22 bp, Homo sapiens
tcctgctggattgtgtctggtg

SEQ ID NO: 8033458 - DNA, 22 bp, Homo sapiens
taagacaaatactatttcaaga

SEQ ID NO: 8033459 - DNA, 22 bp, Homo sapiens
taagaattatctcatggataat

SEQ ID NO: 8033460 - DNA, 22 bp, Homo sapiens
taagaatgactaccaaactgga

SEQ ID NO: 8033461 - DNA, 22 bp, Homo sapiens
taagaatgacaaccataccatt

SEQ ID NO: 8033462 - DNA, 22 bp, Homo sapiens
taagaattatctcatggataat

SEQ ID NO: 8033463 - DNA, 22 bp, Homo sapiens
taagaatattgggaatggatgg

SEQ ID NO: 8033464 - DNA, 22 bp, Homo sapiens
taagaatattgggaatggatgg

SEQ ID NO: 8033465 - DNA, 22 bp, Homo sapiens
taagaatagtgtttgcctttgg

SEQ ID NO: 8033466 - DNA, 22 bp, Homo sapiens
taagaatagtgtttgcctttgg

SEQ ID NO: 8033467 - DNA, 22 bp, Homo sapiens
taagaatagtgtttgcctttgg

SEQ ID NO: 8033468 - DNA, 22 bp, Homo sapiens
taagaatattgggaatggatgg

SEQ ID NO: 8033469 - DNA, 22 bp, Homo sapiens
taagaatcgatgtttatttaga

SEQ ID NO: 8033470 - DNA, 22 bp, Homo sapiens
taagaatcgatgtttatttaga

SEQ ID NO: 8033471 - DNA, 22 bp, Homo sapiens
taagaatcagtagatatagatt

SEQ ID NO: 8033472 - DNA, 22 bp, Homo sapiens
taagaatctgcattttaacaag

SEQ ID NO: 8033473 - DNA, 22 bp, Homo sapiens
taagaatctgcattttaacaag

SEQ ID NO: 8033474 - DNA, 22 bp, Homo sapiens
taagaatctgcattttaacaag

SEQ ID NO: 8033475 - DNA, 22 bp, Homo sapiens
taagaatctattaggaatatgt

SEQ ID NO: 8033476 - DNA, 22 bp, Homo sapiens
taagaatctattaggaatatgt

SEQ ID NO: 8033477 - DNA, 22 bp, Homo sapiens
taagaatcggtcgcaacagagg

SEQ ID NO: 8033478 - DNA, 22 bp, Homo sapiens
taagaatcggtcgcaacagagg

SEQ ID NO: 8033479 - DNA, 22 bp, Homo sapiens
taagaatcggtcgcaacagagg

SEQ ID NO: 8033480 - DNA, 21 bp, Homo sapiens
tcctggctttatgctacctct

SEQ ID NO: 8033481 - DNA, 21 bp, Homo sapiens
tcctggctttatgctacctct

SEQ ID NO: 8033482 - DNA, 21 bp, Homo sapiens
tcctggctttatgctacctct

SEQ ID NO: 8033483 - DNA, 21 bp, Homo sapiens
tcctggctttatgctacctct

SEQ ID NO: 8033484 - DNA, 21 bp, Homo sapiens
tcctggctttatgctacctct

SEQ ID NO: 8033485 - DNA, 22 bp, Homo sapiens
tcctggcttctgtctccttatt

SEQ ID NO: 8033486 - DNA, 22 bp, Homo sapiens
tcctggcttgtcacatctacgt

SEQ ID NO: 8033487 - DNA, 22 bp, Homo sapiens
tcctggcttgtcacatctacgt

SEQ ID NO: 8033488 - DNA, 22 bp, Homo sapiens
tcctggcttgtcacatctacgt

SEQ ID NO: 8033489 - DNA, 18 bp, Homo sapiens
tcctgggaaaggcataca

SEQ ID NO: 8033490 - DNA, 18 bp, Homo sapiens
tcctgggaaaggcataca

SEQ ID NO: 8033491 - DNA, 22 bp, Homo sapiens
tcctggcttttcttggctcatc

SEQ ID NO: 8033492 - DNA, 22 bp, Homo sapiens
tcctggcttttcttggctcatc

SEQ ID NO: 8033493 - DNA, 22 bp, Homo sapiens
tcctgggaagagacctgagcat

SEQ ID NO: 8033494 - DNA, 18 bp, Homo sapiens
tcctgggaacttgctagc

SEQ ID NO: 8033495 - DNA, 22 bp, Homo sapiens
tcctgggaactcggaaagctct

SEQ ID NO: 8033496 - DNA, 18 bp, Homo sapiens
tcctgggaaaggcataca

SEQ ID NO: 8033497 - DNA, 22 bp, Homo sapiens
tcctgggaactcggaaagctct

SEQ ID NO: 8033498 - DNA, 22 bp, Homo sapiens
tcctggcttaggtttccagaac

SEQ ID NO: 8033499 - DNA, 22 bp, Homo sapiens
tcctggcttaggtttccagaac

SEQ ID NO: 8033500 - DNA, 22 bp, Homo sapiens
tcctggcttaggtttccagaac

SEQ ID NO: 8033501 - DNA, 22 bp, Homo sapiens
tcctggctgttagagaggcaag

SEQ ID NO: 8033502 - DNA, 22 bp, Homo sapiens
tcctggctgttagagaggcaag

SEQ ID NO: 8033503 - DNA, 22 bp, Homo sapiens
tcctggcttaggtttccagaac

SEQ ID NO: 8033504 - DNA, 22 bp, Homo sapiens
tcctggcttccacacctgtcat

SEQ ID NO: 8033505 - DNA, 22 bp, Homo sapiens
tcctggcttccacacctgtcat

SEQ ID NO: 8033506 - DNA, 22 bp, Homo sapiens
tcctggcttcctgctcttgtca

SEQ ID NO: 8033507 - DNA, 22 bp, Homo sapiens
tcctggcttcctgctcttgtca

SEQ ID NO: 8033508 - DNA, 22 bp, Homo sapiens
tcctggcttccactcctctgtt

SEQ ID NO: 8033509 - DNA, 22 bp, Homo sapiens
tcctggcttctgtctccttatt

SEQ ID NO: 8033510 - DNA, 22 bp, Homo sapiens
tcctggcttctgtctccttatt

SEQ ID NO: 8033511 - DNA, 22 bp, Homo sapiens
tcctggcttccactcctctgtt

SEQ ID NO: 8033512 - DNA, 22 bp, Homo sapiens
tcctggcttccactcctctgtt

SEQ ID NO: 8033513 - DNA, 22 bp, Homo sapiens
tcctggcttccactcctctgtt

SEQ ID NO: 8033514 - DNA, 22 bp, Homo sapiens
tcctggcttccactcctctgtt

SEQ ID NO: 8033515 - DNA, 22 bp, Homo sapiens
tcctggcttccactcctctgtt

SEQ ID NO: 8033516 - DNA, 22 bp, Homo sapiens
tcctggctgagttcccaagtcg

SEQ ID NO: 8033517 - DNA, 22 bp, Homo sapiens
tcctggctcttctgagttttct

SEQ ID NO: 8033518 - DNA, 22 bp, Homo sapiens
tcctggctgagttcccaagtcg

SEQ ID NO: 8033519 - DNA, 22 bp, Homo sapiens
tcctggctgagttcccaagtcg

SEQ ID NO: 8033520 - DNA, 22 bp, Homo sapiens
tcctggctgccgtcgtcctgcg

SEQ ID NO: 8033521 - DNA, 22 bp, Homo sapiens
tcctggctgccgtcgtcctgcg

SEQ ID NO: 8033522 - DNA, 22 bp, Homo sapiens
tcctggctgcaccagtgaccct

SEQ ID NO: 8033523 - DNA, 22 bp, Homo sapiens
tcctggctgcaccagtgaccct

SEQ ID NO: 8033524 - DNA, 22 bp, Homo sapiens
tcctggctgtcactcgggttga

SEQ ID NO: 8033525 - DNA, 22 bp, Homo sapiens
tcctggctggaatttctcactc

SEQ ID NO: 8033526 - DNA, 22 bp, Homo sapiens
tcctggctgccgtcgtcctgcg

SEQ ID NO: 8033527 - DNA, 22 bp, Homo sapiens
tcctggctgccgtcgtcctgcg

SEQ ID NO: 8033528 - DNA, 22 bp, Homo sapiens
tcctggctggaatttctcactc

SEQ ID NO: 8033529 - DNA, 22 bp, Homo sapiens
tcctggctggaatttctcactc

SEQ ID NO: 8033530 - DNA, 22 bp, Homo sapiens
tcctgggaccaggcacctactg

SEQ ID NO: 8033531 - DNA, 22 bp, Homo sapiens
tcctgggaccctgggtgcagag

SEQ ID NO: 8033532 - DNA, 22 bp, Homo sapiens
tcctgggaccgagggaagagct

SEQ ID NO: 8033533 - DNA, 22 bp, Homo sapiens
tcctgggaccgagggaagagct

SEQ ID NO: 8033534 - DNA, 22 bp, Homo sapiens
tcctgggactctgcctcaggct

SEQ ID NO: 8033535 - DNA, 22 bp, Homo sapiens
tcctgggactctgcctcaggct

SEQ ID NO: 8033536 - DNA, 22 bp, Homo sapiens
tcctgggactctgcctcaggct

SEQ ID NO: 8033537 - DNA, 22 bp, Homo sapiens
tcctgggactctgcctcaggct

SEQ ID NO: 8033538 - DNA, 22 bp, Homo sapiens
tcctgggactcaacttagaagg

SEQ ID NO: 8033539 - DNA, 22 bp, Homo sapiens
tcctgggactcaacttagaagg

SEQ ID NO: 8033540 - DNA, 22 bp, Homo sapiens
tcctgggactcaacttagaagg

SEQ ID NO: 8033541 - DNA, 22 bp, Homo sapiens
tcctgggaggctgtgcctggct

SEQ ID NO: 8033542 - DNA, 22 bp, Homo sapiens
tcctgggaggctgtgcctggct

SEQ ID NO: 8033543 - DNA, 22 bp, Homo sapiens
tcctgggaggctgtgcctggct

SEQ ID NO: 8033544 - DNA, 22 bp, Homo sapiens
tcctgggaggcaggaccccttt

SEQ ID NO: 8033545 - DNA, 22 bp, Homo sapiens
tcctgggaggaacatttaccta

SEQ ID NO: 8033546 - DNA, 22 bp, Homo sapiens
tcctgggaggaacatttaccta

SEQ ID NO: 8033547 - DNA, 22 bp, Homo sapiens
tcctgggacaagccgtggaagt

SEQ ID NO: 8033548 - DNA, 22 bp, Homo sapiens
tcctgggacaagccgtggaagt

SEQ ID NO: 8033549 - DNA, 22 bp, Homo sapiens
tcctgggacaagccgtggaagt

SEQ ID NO: 8033550 - DNA, 22 bp, Homo sapiens
tcctgggacaccccaatatgag

SEQ ID NO: 8033551 - DNA, 22 bp, Homo sapiens
tcctgggacaccccaatatgag

SEQ ID NO: 8033552 - DNA, 22 bp, Homo sapiens
tcctgggaagttgcatcaccgt

SEQ ID NO: 8033553 - DNA, 22 bp, Homo sapiens
tcctgggaagttgcatcaccgt

SEQ ID NO: 8033554 - DNA, 22 bp, Homo sapiens
tcctgggaagtggctggctgag

SEQ ID NO: 8033555 - DNA, 22 bp, Homo sapiens
tcctgggaagtggctggctgag

SEQ ID NO: 8033556 - DNA, 21 bp, Homo sapiens
tcctgggaagcactggggtgg

SEQ ID NO: 8033557 - DNA, 22 bp, Homo sapiens
tcctgggaagagacctgagcat

SEQ ID NO: 8033558 - DNA, 22 bp, Homo sapiens
tcctgggaagagacctgagcat

SEQ ID NO: 8033559 - DNA, 22 bp, Homo sapiens
tcctgggaagtggctggctgag

SEQ ID NO: 8033560 - DNA, 22 bp, Homo sapiens
tcctgggcaaagaggggcagtg

SEQ ID NO: 8033561 - DNA, 22 bp, Homo sapiens
tcctgggcaaagaggggcagtg

SEQ ID NO: 8033562 - DNA, 22 bp, Homo sapiens
tcctgggattctgcatttctaa

SEQ ID NO: 8033563 - DNA, 22 bp, Homo sapiens
tcctgggatttgcccttttctc

SEQ ID NO: 8033564 - DNA, 22 bp, Homo sapiens
tcctgggattctgcatttctaa

SEQ ID NO: 8033565 - DNA, 22 bp, Homo sapiens
tcctgggattctgcatttctaa

SEQ ID NO: 8033566 - DNA, 22 bp, Homo sapiens
tcctgggattaaggtggtgatt

SEQ ID NO: 8033567 - DNA, 22 bp, Homo sapiens
tcctgggatgcataaaatatgt

SEQ ID NO: 8033568 - DNA, 22 bp, Homo sapiens
tcctgggattaaggtggtgatt

SEQ ID NO: 8033569 - DNA, 22 bp, Homo sapiens
tcctgggcacaagtgagtctcc

SEQ ID NO: 8033570 - DNA, 22 bp, Homo sapiens
tcctgggcacaagtgagtctcc

SEQ ID NO: 8033571 - DNA, 22 bp, Homo sapiens
tcctgggcacaagtgagtctcc

SEQ ID NO: 8033572 - DNA, 22 bp, Homo sapiens
tcctgggcagaatgggatggct

SEQ ID NO: 8033573 - DNA, 22 bp, Homo sapiens
tcctgggcagaatgggatggct

SEQ ID NO: 8033574 - DNA, 22 bp, Homo sapiens
tcctgggcagaatgggatggct

SEQ ID NO: 8033575 - DNA, 22 bp, Homo sapiens
tcctgggcagcctctctggaag

SEQ ID NO: 8033576 - DNA, 22 bp, Homo sapiens
tcctgggcagcctctctggaag

SEQ ID NO: 8033577 - DNA, 22 bp, Homo sapiens
tcctgggcagcctctctggaag

SEQ ID NO: 8033578 - DNA, 22 bp, Homo sapiens
tcctgggcagcgggacgctcag

SEQ ID NO: 8033579 - DNA, 22 bp, Homo sapiens
tcctgggcagcctctctggaag

SEQ ID NO: 8033580 - DNA, 22 bp, Homo sapiens
tcctgggcagcctctctggaag

SEQ ID NO: 8033581 - DNA, 22 bp, Homo sapiens
tcctgggcagaatgggatggct

SEQ ID NO: 8033582 - DNA, 22 bp, Homo sapiens
tcctgggatgcataaaatatgt

SEQ ID NO: 8033583 - DNA, 22 bp, Homo sapiens
tcctgggatgaggaaacaagga

SEQ ID NO: 8033584 - DNA, 22 bp, Homo sapiens
tcctgggatgaggaaacaagga

SEQ ID NO: 8033585 - DNA, 22 bp, Homo sapiens
tcctgggatcaagtgatcctcc

SEQ ID NO: 8033586 - DNA, 22 bp, Homo sapiens
tcctgggatgacttttgaaatg

SEQ ID NO: 8033587 - DNA, 22 bp, Homo sapiens
tcctgggatcaagtgatcctcc

SEQ ID NO: 8033588 - DNA, 22 bp, Homo sapiens
tcctgggatcaagtgatcctcc

SEQ ID NO: 8033589 - DNA, 22 bp, Homo sapiens
tcctgggagtggccatgtaatg

SEQ ID NO: 8033590 - DNA, 22 bp, Homo sapiens
tcctgggagtggccatgtaatg

SEQ ID NO: 8033591 - DNA, 22 bp, Homo sapiens
tcctgggagtggccatgtaatg

SEQ ID NO: 8033592 - DNA, 21 bp, Homo sapiens
tcctgggagtctgagatcctg

SEQ ID NO: 8033593 - DNA, 22 bp, Homo sapiens
tcctgggagtaattgagtcatg

SEQ ID NO: 8033594 - DNA, 22 bp, Homo sapiens
tcctgggagtaattgagtcatg

SEQ ID NO: 8033595 - DNA, 21 bp, Homo sapiens
tcctgggagtctgagatcctg

SEQ ID NO: 8033596 - DNA, 22 bp, Homo sapiens
tcctgggagtaattgagtcatg

SEQ ID NO: 8033597 - DNA, 22 bp, Homo sapiens
tcctgggagtaattgagtcatg

SEQ ID NO: 8033598 - DNA, 22 bp, Homo sapiens
tcctgggaggtaaaccagcatc

SEQ ID NO: 8033599 - DNA, 22 bp, Homo sapiens
tcctgggaggtaaaccagcatc

SEQ ID NO: 8033600 - DNA, 22 bp, Homo sapiens
tcctgggagtaattgagtcatg

SEQ ID NO: 8033601 - DNA, 22 bp, Homo sapiens
tcctgggagtaaaagctgccct

SEQ ID NO: 8033602 - DNA, 22 bp, Homo sapiens
tcctgggcccaggctgccaggg

SEQ ID NO: 8033603 - DNA, 22 bp, Homo sapiens
tcctgggcccaggctgccaggg

SEQ ID NO: 8033604 - DNA, 22 bp, Homo sapiens
tcctgggcccaggctgccaggg

SEQ ID NO: 8033605 - DNA, 22 bp, Homo sapiens
tcctgggcccaggctgccaggg

SEQ ID NO: 8033606 - DNA, 22 bp, Homo sapiens
tcctgggcccaggctgccaggg

SEQ ID NO: 8033607 - DNA, 22 bp, Homo sapiens
tcctgggcccaggctgccaggg

SEQ ID NO: 8033608 - DNA, 22 bp, Homo sapiens
tcctgggcccaggctgccaggg

SEQ ID NO: 8033609 - DNA, 22 bp, Homo sapiens
tcctgggcccaggctgccaggg

SEQ ID NO: 8033610 - DNA, 22 bp, Homo sapiens
tcctgggccaagggctgtgagg

SEQ ID NO: 8033611 - DNA, 22 bp, Homo sapiens
tcctgggccaagggctgtgagg

SEQ ID NO: 8033612 - DNA, 22 bp, Homo sapiens
tcctgggcagcgggacgctcag

SEQ ID NO: 8033613 - DNA, 22 bp, Homo sapiens
tcctgggccaagggctgtgagg

SEQ ID NO: 8033614 - DNA, 22 bp, Homo sapiens
tcctgggcagcgggacgctcag

SEQ ID NO: 8033615 - DNA, 22 bp, Homo sapiens
tcctgggcagcgggacgctcag

SEQ ID NO: 8033616 - DNA, 22 bp, Homo sapiens
tcctgggcctgtactccatccg

SEQ ID NO: 8033617 - DNA, 22 bp, Homo sapiens
tcctgggcctgtactccatccg

SEQ ID NO: 8033618 - DNA, 22 bp, Homo sapiens
tcctgggccctccggatcaggt

SEQ ID NO: 8033619 - DNA, 22 bp, Homo sapiens
tcctgggccctccggatcaggt

SEQ ID NO: 8033620 - DNA, 22 bp, Homo sapiens
tcctgggccctccggatcaggt

SEQ ID NO: 8033621 - DNA, 22 bp, Homo sapiens
tcctgggcgaggtactggggct

SEQ ID NO: 8033622 - DNA, 22 bp, Homo sapiens
tcctgggcgaggtactggggct

SEQ ID NO: 8033623 - DNA, 22 bp, Homo sapiens
tcctgggcctgtactccatccg

SEQ ID NO: 8033624 - DNA, 22 bp, Homo sapiens
tcctgggcctgtactccatccg

SEQ ID NO: 8033625 - DNA, 19 bp, Homo sapiens
tcctgggctgggccaggtc

SEQ ID NO: 8033626 - DNA, 19 bp, Homo sapiens
tcctgggctgggccaggtc

SEQ ID NO: 8033627 - DNA, 19 bp, Homo sapiens
tcctgggctgggccaggtc

SEQ ID NO: 8033628 - DNA, 22 bp, Homo sapiens
tcctgggctgtggccccgggca

SEQ ID NO: 8033629 - DNA, 22 bp, Homo sapiens
tcctgggctgtggccccgggca

SEQ ID NO: 8033630 - DNA, 22 bp, Homo sapiens
tcctgggctgtgtgccactctg

SEQ ID NO: 8033631 - DNA, 22 bp, Homo sapiens
tcctgggctgtggccccgggca

SEQ ID NO: 8033632 - DNA, 22 bp, Homo sapiens
tcctggggaggtcgaggctgag

SEQ ID NO: 8033633 - DNA, 22 bp, Homo sapiens
tcctggggaggtcgaggctgag

SEQ ID NO: 8033634 - DNA, 22 bp, Homo sapiens
tcctgggctgtgtgccactctg

SEQ ID NO: 8033635 - DNA, 22 bp, Homo sapiens
tcctgggctgtgtgccactctg

SEQ ID NO: 8033636 - DNA, 22 bp, Homo sapiens
tcctggggagggttctggctcc

SEQ ID NO: 8033637 - DNA, 19 bp, Homo sapiens
tcctgggctgcgtcttgcc

SEQ ID NO: 8033638 - DNA, 19 bp, Homo sapiens
tcctgggctgcgtcttgcc

SEQ ID NO: 8033639 - DNA, 22 bp, Homo sapiens
tcctgggctgcagggaagagca

SEQ ID NO: 8033640 - DNA, 22 bp, Homo sapiens
tcctgggctgcagggaagagca

SEQ ID NO: 8033641 - DNA, 19 bp, Homo sapiens
tcctgggctgggccaggtc

SEQ ID NO: 8033642 - DNA, 19 bp, Homo sapiens
tcctgggctgcgtcttgcc

SEQ ID NO: 8033643 - DNA, 19 bp, Homo sapiens
tcctgggctgcgtcttgcc

SEQ ID NO: 8033644 - DNA, 22 bp, Homo sapiens
tcctgggcgattttctgaatat

SEQ ID NO: 8033645 - DNA, 19 bp, Homo sapiens
tcctgggcgttgactttgg

SEQ ID NO: 8033646 - DNA, 19 bp, Homo sapiens
tcctgggcgttgactttgg

SEQ ID NO: 8033647 - DNA, 22 bp, Homo sapiens
tcctgggtagagacctgatgaa

SEQ ID NO: 8033648 - DNA, 22 bp, Homo sapiens
tcctgggtaaacactgaccttt

SEQ ID NO: 8033649 - DNA, 22 bp, Homo sapiens
tcctgggtaaacactgaccttt

SEQ ID NO: 8033650 - DNA, 22 bp, Homo sapiens
tcctgggtagcctgtccaagat

SEQ ID NO: 8033651 - DNA, 22 bp, Homo sapiens
tcctggggttttggccgcagct

SEQ ID NO: 8033652 - DNA, 22 bp, Homo sapiens
tcctggggttttggccgcagct

SEQ ID NO: 8033653 - DNA, 22 bp, Homo sapiens
tcctggggtttagagggaagtg

SEQ ID NO: 8033654 - DNA, 22 bp, Homo sapiens
tcctggggttttggccgcagct

SEQ ID NO: 8033655 - DNA, 22 bp, Homo sapiens
tcctggggttttggccgcagct

SEQ ID NO: 8033656 - DNA, 22 bp, Homo sapiens
tcctggggtttagagggaagtg

SEQ ID NO: 8033657 - DNA, 22 bp, Homo sapiens
tcctggggtttagagggaagtg

SEQ ID NO: 8033658 - DNA, 22 bp, Homo sapiens
tcctggggtgtgttttgctgct

SEQ ID NO: 8033659 - DNA, 22 bp, Homo sapiens
tcctggggtgtgttttgctgct

SEQ ID NO: 8033660 - DNA, 20 bp, Homo sapiens
tcctggggtaagccatggtc

SEQ ID NO: 8033661 - DNA, 20 bp, Homo sapiens
tcctggggtaagccatggtc

SEQ ID NO: 8033662 - DNA, 22 bp, Homo sapiens
tcctggggtcctgactgcttcc

SEQ ID NO: 8033663 - DNA, 22 bp, Homo sapiens
tcctggggtcctgactgcttcc

SEQ ID NO: 8033664 - DNA, 22 bp, Homo sapiens
tcctgggtgtgatattcataga

SEQ ID NO: 8033665 - DNA, 22 bp, Homo sapiens
tcctgggtgtgatattcataga

SEQ ID NO: 8033666 - DNA, 22 bp, Homo sapiens
tcctgggttcatgtcctggtgc

SEQ ID NO: 8033667 - DNA, 22 bp, Homo sapiens
tcctgggttcatgtcctggtgc

SEQ ID NO: 8033668 - DNA, 23 bp, Homo sapiens
tcctgggtttgaattctagtctt

SEQ ID NO: 8033669 - DNA, 23 bp, Homo sapiens
tcctgggtttgaattctagtctt

SEQ ID NO: 8033670 - DNA, 22 bp, Homo sapiens
tcctggtggcagattttaggtc

SEQ ID NO: 8033671 - DNA, 22 bp, Homo sapiens
tcctggtggcagattttaggtc

SEQ ID NO: 8033672 - DNA, 22 bp, Homo sapiens
tcctggtggctctttgggaagg

SEQ ID NO: 8033673 - DNA, 22 bp, Homo sapiens
tcctggtggctctttgggaagg

SEQ ID NO: 8033674 - DNA, 22 bp, Homo sapiens
tcctggtggctctttgggaagg

SEQ ID NO: 8033675 - DNA, 22 bp, Homo sapiens
tcctggtggctctttgggaagg

SEQ ID NO: 8033676 - DNA, 22 bp, Homo sapiens
tcctggtggcagattttaggtc

SEQ ID NO: 8033677 - DNA, 22 bp, Homo sapiens
tcctggtggctttccctgcctt

SEQ ID NO: 8033678 - DNA, 22 bp, Homo sapiens
tcctgggtcccgcacatctgtc

SEQ ID NO: 8033679 - DNA, 22 bp, Homo sapiens
tcctgggtctgggtgtctgagg

SEQ ID NO: 8033680 - DNA, 22 bp, Homo sapiens
tcctgggtctcttccttagttc

SEQ ID NO: 8033681 - DNA, 22 bp, Homo sapiens
tcctgggtggctctgcccggct

SEQ ID NO: 8033682 - DNA, 22 bp, Homo sapiens
tcctgggtggtggtaggagcag

SEQ ID NO: 8033683 - DNA, 22 bp, Homo sapiens
tcctgggtggtggtaggagcag

SEQ ID NO: 8033684 - DNA, 22 bp, Homo sapiens
tcctgggtgaaagaacaggcag

SEQ ID NO: 8033685 - DNA, 22 bp, Homo sapiens
tcctggggctcatgggatttgt

SEQ ID NO: 8033686 - DNA, 22 bp, Homo sapiens
tcctggggctcatgggatttgt

SEQ ID NO: 8033687 - DNA, 22 bp, Homo sapiens
tcctggggctctgagcgagaca

SEQ ID NO: 8033688 - DNA, 22 bp, Homo sapiens
tcctggggccaggcacctctgg

SEQ ID NO: 8033689 - DNA, 22 bp, Homo sapiens
tcctggggccagcactggtgga

SEQ ID NO: 8033690 - DNA, 22 bp, Homo sapiens
tcctggggccagcactggtgga

SEQ ID NO: 8033691 - DNA, 22 bp, Homo sapiens
tcctggggccagcactggtgga

SEQ ID NO: 8033692 - DNA, 22 bp, Homo sapiens
tcctggggccaggcacctctgg

SEQ ID NO: 8033693 - DNA, 22 bp, Homo sapiens
tcctggggccagcactggtgga

SEQ ID NO: 8033694 - DNA, 22 bp, Homo sapiens
tcctggggaggtcgaggctgag

SEQ ID NO: 8033695 - DNA, 22 bp, Homo sapiens
tcctggggaggtcgaggctgag

SEQ ID NO: 8033696 - DNA, 16 bp, Homo sapiens
tcctggggatactgga

SEQ ID NO: 8033697 - DNA, 16 bp, Homo sapiens
tcctggggatactgga

SEQ ID NO: 8033698 - DNA, 19 bp, Homo sapiens
tcctggggatgtggtcacc

SEQ ID NO: 8033699 - DNA, 22 bp, Homo sapiens
tcctggggccagcactggtgga

SEQ ID NO: 8033700 - DNA, 19 bp, Homo sapiens
tcctggggatgtggtcacc

SEQ ID NO: 8033701 - DNA, 21 bp, Homo sapiens
tcctggggggtaggtgagttt

SEQ ID NO: 8033702 - DNA, 20 bp, Homo sapiens
tcctggggtaagccatggtc

SEQ ID NO: 8033703 - DNA, 20 bp, Homo sapiens
tcctggggtaagccatggtc

SEQ ID NO: 8033704 - DNA, 21 bp, Homo sapiens
tcctggggggtaggtgagttt

SEQ ID NO: 8033705 - DNA, 21 bp, Homo sapiens
tcctggggggtaggtgagttt

SEQ ID NO: 8033706 - DNA, 21 bp, Homo sapiens
tcctggggggtaggtgagttt

SEQ ID NO: 8033707 - DNA, 22 bp, Homo sapiens
tcctggggctgcaaggcctgtc

SEQ ID NO: 8033708 - DNA, 22 bp, Homo sapiens
tcctggggctgcaaggcctgtc

SEQ ID NO: 8033709 - DNA, 22 bp, Homo sapiens
tcctggggctgcaaggcctgtc

SEQ ID NO: 8033710 - DNA, 22 bp, Homo sapiens
tcctggggctgcaaggcctgtc

SEQ ID NO: 8033711 - DNA, 22 bp, Homo sapiens
tcctggggctctttgatgtgat

SEQ ID NO: 8033712 - DNA, 22 bp, Homo sapiens
tcctggggctctttgatgtgat

SEQ ID NO: 8033713 - DNA, 22 bp, Homo sapiens
tcctggggctctgagcgagaca

SEQ ID NO: 8033714 - DNA, 22 bp, Homo sapiens
tcctggggctctgagcgagaca

SEQ ID NO: 8033715 - DNA, 22 bp, Homo sapiens
tcctggggctctgagcgagaca

SEQ ID NO: 8033716 - DNA, 22 bp, Homo sapiens
tcctggtggctttccctgcctt

SEQ ID NO: 8033717 - DNA, 22 bp, Homo sapiens
tcctggtgggacagaaaacctc

SEQ ID NO: 8033718 - DNA, 22 bp, Homo sapiens
tcctggtgggacagaaaacctc

SEQ ID NO: 8033719 - DNA, 22 bp, Homo sapiens
tcctggtggtctgtgcttcttc

SEQ ID NO: 8033720 - DNA, 22 bp, Homo sapiens
tcctggtggtgccagctgcagg

SEQ ID NO: 8033721 - DNA, 22 bp, Homo sapiens
tcctggtggtctgtgcttcttc

SEQ ID NO: 8033722 - DNA, 22 bp, Homo sapiens
tcctggtggtctgtgcttcttc

SEQ ID NO: 8033723 - DNA, 22 bp, Homo sapiens
tcctggtggtctgtgcttcttc

SEQ ID NO: 8033724 - DNA, 22 bp, Homo sapiens
tcctggtgtaatggtaagcatg

SEQ ID NO: 8033725 - DNA, 22 bp, Homo sapiens
tcctggtgtaatggtaagcatg

SEQ ID NO: 8033726 - DNA, 22 bp, Homo sapiens
tcctggtgtaatggtaagcatg

SEQ ID NO: 8033727 - DNA, 22 bp, Homo sapiens
tcctggtggtttgaaaactgaa

SEQ ID NO: 8033728 - DNA, 22 bp, Homo sapiens
tcctggtggtttgaaaactgaa

SEQ ID NO: 8033729 - DNA, 22 bp, Homo sapiens
tcctggtggtttgaaaactgaa

SEQ ID NO: 8033730 - DNA, 22 bp, Homo sapiens
tcctggtgtaatggtaagcatg

SEQ ID NO: 8033731 - DNA, 22 bp, Homo sapiens
tcctggtggtgccagctgcagg

SEQ ID NO: 8033732 - DNA, 22 bp, Homo sapiens
tcctggtggtctgtgcttcttc

SEQ ID NO: 8033733 - DNA, 22 bp, Homo sapiens
tcctggtggtgccagctgcagg

SEQ ID NO: 8033734 - DNA, 22 bp, Homo sapiens
tcctggtggtttgaaaactgaa

SEQ ID NO: 8033735 - DNA, 22 bp, Homo sapiens
tcctggtggtgccggtgcccgg

SEQ ID NO: 8033736 - DNA, 22 bp, Homo sapiens
tcctggtggtgccggtgcccgg

SEQ ID NO: 8033737 - DNA, 22 bp, Homo sapiens
tcctggtgttactaaattgaaa

SEQ ID NO: 8033738 - DNA, 22 bp, Homo sapiens
tcctggtgttactaaattgaaa

SEQ ID NO: 8033739 - DNA, 22 bp, Homo sapiens
tcctggtgttactaaattgaaa

SEQ ID NO: 8033740 - DNA, 22 bp, Homo sapiens
tcctggtgtttatgtcacatag

SEQ ID NO: 8033741 - DNA, 22 bp, Homo sapiens
tcctggtgtttatgtcacatag

SEQ ID NO: 8033742 - DNA, 22 bp, Homo sapiens
tcctggtgtttatgtcacatag

SEQ ID NO: 8033743 - DNA, 22 bp, Homo sapiens
tcctggttaccaagcagctctc

SEQ ID NO: 8033744 - DNA, 22 bp, Homo sapiens
tcctggttcctaccttcagctg

SEQ ID NO: 8033745 - DNA, 22 bp, Homo sapiens
tcctggttcctaccttcagctg

SEQ ID NO: 8033746 - DNA, 22 bp, Homo sapiens
tcctggttctggaatgtttaag

SEQ ID NO: 8033747 - DNA, 22 bp, Homo sapiens
tcctggtgtcgcctggtcagtt

SEQ ID NO: 8033748 - DNA, 22 bp, Homo sapiens
tcctggtgtcgcctggtcagtt

SEQ ID NO: 8033749 - DNA, 22 bp, Homo sapiens
tcctggtgtcgcctggtcagtt

SEQ ID NO: 8033750 - DNA, 22 bp, Homo sapiens
tcctggtgtcgcctggtcagtt

SEQ ID NO: 8033751 - DNA, 22 bp, Homo sapiens
tcctggtgtcgcctggtcagtt

SEQ ID NO: 8033752 - DNA, 22 bp, Homo sapiens
tcctggtgtcgcctggtcagtt

SEQ ID NO: 8033753 - DNA, 22 bp, Homo sapiens
tcctggtgtcctggtctgctag

SEQ ID NO: 8033754 - DNA, 22 bp, Homo sapiens
tcctggtgtaatggtaagcatg

SEQ ID NO: 8033755 - DNA, 22 bp, Homo sapiens
tcctggtgtcgcctggtcagtt

SEQ ID NO: 8033756 - DNA, 22 bp, Homo sapiens
tcctggtgtcctggtctgctag

SEQ ID NO: 8033757 - DNA, 22 bp, Homo sapiens
tcctggtgtcctggtctgctag

SEQ ID NO: 8033758 - DNA, 22 bp, Homo sapiens
tcctgtccacagccctgacctc

SEQ ID NO: 8033759 - DNA, 22 bp, Homo sapiens
tcctgtccacagccctgacctc

SEQ ID NO: 8033760 - DNA, 22 bp, Homo sapiens
tcctgtccacagccctgacctc

SEQ ID NO: 8033761 - DNA, 22 bp, Homo sapiens
tcctgtcctctgggtgccccat

SEQ ID NO: 8033762 - DNA, 20 bp, Homo sapiens
tcctgtccgcgccttgcgtc

SEQ ID NO: 8033763 - DNA, 20 bp, Homo sapiens
tcctgtccgcgccttgcgtc

SEQ ID NO: 8033764 - DNA, 22 bp, Homo sapiens
tcctgtcctctgggtgccccat

SEQ ID NO: 8033765 - DNA, 22 bp, Homo sapiens
tcctgtctaaagacctgcaggc

SEQ ID NO: 8033766 - DNA, 22 bp, Homo sapiens
tcctgtcctgaggctccaggcc

SEQ ID NO: 8033767 - DNA, 22 bp, Homo sapiens
tcctgtctaaagacctgcaggc

SEQ ID NO: 8033768 - DNA, 22 bp, Homo sapiens
tcctgtctaaagacctgcaggc

SEQ ID NO: 8033769 - DNA, 22 bp, Homo sapiens
tcctgtcctgaggctccaggcc

SEQ ID NO: 8033770 - DNA, 21 bp, Homo sapiens
tcctgtaagcttgggtggctc

SEQ ID NO: 8033771 - DNA, 22 bp, Homo sapiens
tcctgtagttgctaagtttgtt

SEQ ID NO: 8033772 - DNA, 21 bp, Homo sapiens
tcctgtaagcttgggtggctc

SEQ ID NO: 8033773 - DNA, 22 bp, Homo sapiens
tcctgtatcctgatacaataag

SEQ ID NO: 8033774 - DNA, 22 bp, Homo sapiens
tcctgtatttgttcatctgtac

SEQ ID NO: 8033775 - DNA, 22 bp, Homo sapiens
tcctggtttatagactgatggc

SEQ ID NO: 8033776 - DNA, 22 bp, Homo sapiens
tcctggtttacagagtaaacca

SEQ ID NO: 8033777 - DNA, 22 bp, Homo sapiens
tcctggttgttgttatagtata

SEQ ID NO: 8033778 - DNA, 18 bp, Homo sapiens
tcctggttctgtggccac

SEQ ID NO: 8033779 - DNA, 21 bp, Homo sapiens
tcctgtaagcttgggtggctc

SEQ ID NO: 8033780 - DNA, 21 bp, Homo sapiens
tcctgtaagcttgggtggctc

SEQ ID NO: 8033781 - DNA, 22 bp, Homo sapiens
tcctgtcttaatgatctcgtgc

SEQ ID NO: 8033782 - DNA, 22 bp, Homo sapiens
tcctgtgaagaatagcactcaa

SEQ ID NO: 8033783 - DNA, 23 bp, Homo sapiens
tcctgtgaagccatgtttgttgt

SEQ ID NO: 8033784 - DNA, 22 bp, Homo sapiens
tcctgtgaccagcttccatgct

SEQ ID NO: 8033785 - DNA, 22 bp, Homo sapiens
tcctgtgacggagcgccagagg

SEQ ID NO: 8033786 - DNA, 22 bp, Homo sapiens
tcctgtgagacttgtccattat

SEQ ID NO: 8033787 - DNA, 22 bp, Homo sapiens
tcctgtgacggagcgccagagg

SEQ ID NO: 8033788 - DNA, 22 bp, Homo sapiens
tcctgtgagcagcacagagaca

SEQ ID NO: 8033789 - DNA, 21 bp, Homo sapiens
tcctgtgaggacctgtcagtg

SEQ ID NO: 8033790 - DNA, 22 bp, Homo sapiens
tcctgtgccatctctagagact

SEQ ID NO: 8033791 - DNA, 22 bp, Homo sapiens
tcctgtgccatctctagagact

SEQ ID NO: 8033792 - DNA, 22 bp, Homo sapiens
tcctgtgcctccacctgctccg

SEQ ID NO: 8033793 - DNA, 22 bp, Homo sapiens
tcctgtgcaggctggttgtaga

SEQ ID NO: 8033794 - DNA, 22 bp, Homo sapiens
tcctgtgatggcttgcgatgtg

SEQ ID NO: 8033795 - DNA, 22 bp, Homo sapiens
tcctgtgatggcttgcgatgtg

SEQ ID NO: 8033796 - DNA, 21 bp, Homo sapiens
tcctgtgaggacctgtcagtg

SEQ ID NO: 8033797 - DNA, 22 bp, Homo sapiens
tcctgtgagtagatagtattgt

SEQ ID NO: 8033798 - DNA, 22 bp, Homo sapiens
tcctgtgatattgtttgttata

SEQ ID NO: 8033799 - DNA, 22 bp, Homo sapiens
tcctgtctaaagacctgcaggc

SEQ ID NO: 8033800 - DNA, 22 bp, Homo sapiens
tcctgtctaaagacctgcaggc

SEQ ID NO: 8033801 - DNA, 22 bp, Homo sapiens
tcctgtctcagtgtatttgcag

SEQ ID NO: 8033802 - DNA, 22 bp, Homo sapiens
tcctgtctcagtgtatttgcag

SEQ ID NO: 8033803 - DNA, 22 bp, Homo sapiens
tcctgtctgctcacagagctgg

SEQ ID NO: 8033804 - DNA, 22 bp, Homo sapiens
tcctgtctgctcacagagctgg

SEQ ID NO: 8033805 - DNA, 22 bp, Homo sapiens
tcctgtcttaatgatctcgtgc

SEQ ID NO: 8033806 - DNA, 22 bp, Homo sapiens
tcctgtctgtctttggtccctt

SEQ ID NO: 8033807 - DNA, 22 bp, Homo sapiens
tcctgtctgctcacagagctgg

SEQ ID NO: 8033808 - DNA, 22 bp, Homo sapiens
tcctgtctgtctttggtccctt

SEQ ID NO: 8033809 - DNA, 22 bp, Homo sapiens
tcctgtctgtctttggtccctt

SEQ ID NO: 8033810 - DNA, 22 bp, Homo sapiens
tccttaaatatttactgttaac

SEQ ID NO: 8033811 - DNA, 22 bp, Homo sapiens
tcctgtggtatgggagtgatgt

SEQ ID NO: 8033812 - DNA, 22 bp, Homo sapiens
tcctgtggtatgggagtgatgt

SEQ ID NO: 8033813 - DNA, 17 bp, Homo sapiens
tcctgtgggtgcagcag

SEQ ID NO: 8033814 - DNA, 22 bp, Homo sapiens
tcctgtgggctctcggcctcca

SEQ ID NO: 8033815 - DNA, 22 bp, Homo sapiens
tcctgtggcgttatcatgtgat

SEQ ID NO: 8033816 - DNA, 22 bp, Homo sapiens
tcctgtggctctgtggaacctt

SEQ ID NO: 8033817 - DNA, 18 bp, Homo sapiens
tcctgtggcccagagttt

SEQ ID NO: 8033818 - DNA, 22 bp, Homo sapiens
tcctgtggcgttatcatgtgat

SEQ ID NO: 8033819 - DNA, 22 bp, Homo sapiens
tcctgtggcgttatcatgtgat

SEQ ID NO: 8033820 - DNA, 22 bp, Homo sapiens
tcctgtggagaggactggaggt

SEQ ID NO: 8033821 - DNA, 22 bp, Homo sapiens
tcctgtggagaggactggaggt

SEQ ID NO: 8033822 - DNA, 22 bp, Homo sapiens
tcctgtggagaggactggaggt

SEQ ID NO: 8033823 - DNA, 20 bp, Homo sapiens
tcctgtggacattgctggcc

SEQ ID NO: 8033824 - DNA, 20 bp, Homo sapiens
tcctgtggacattgctggcc

SEQ ID NO: 8033825 - DNA, 22 bp, Homo sapiens
tcctgtggaagacagtgttggg

SEQ ID NO: 8033826 - DNA, 22 bp, Homo sapiens
tcctgtgctttggaggatgttc

SEQ ID NO: 8033827 - DNA, 22 bp, Homo sapiens
tcctgtgctgttaatagtgata

SEQ ID NO: 8033828 - DNA, 22 bp, Homo sapiens
tcgtcctgtgcacctgcctgca

SEQ ID NO: 8033829 - DNA, 22 bp, Homo sapiens
tcgtctgtgaaattgggataag

SEQ ID NO: 8033830 - DNA, 20 bp, Homo sapiens
tcgtagggtcagctcaccat

SEQ ID NO: 8033831 - DNA, 22 bp, Homo sapiens
tcgtcatctgaaggctgtcaat

SEQ ID NO: 8033832 - DNA, 22 bp, Homo sapiens
tcgtctgtgaaattgggataag

SEQ ID NO: 8033833 - DNA, 22 bp, Homo sapiens
tcgcccaggctggaagtgcagt

SEQ ID NO: 8033834 - DNA, 22 bp, Homo sapiens
tcgcccaggctggaagtgcagt

SEQ ID NO: 8033835 - DNA, 22 bp, Homo sapiens
tcgcccaggctggaagtgcagt

SEQ ID NO: 8033836 - DNA, 22 bp, Homo sapiens
tcgcccaggctggaagtgcagt

SEQ ID NO: 8033837 - DNA, 22 bp, Homo sapiens
tcgcccaggctggaagtgcagt

SEQ ID NO: 8033838 - DNA, 22 bp, Homo sapiens
tcgcccaggctggaagtgcagt

SEQ ID NO: 8033839 - DNA, 22 bp, Homo sapiens
tcgcccaggctggaagtgcagt

SEQ ID NO: 8033840 - DNA, 22 bp, Homo sapiens
tcgcccaggctggaagtgcagt

SEQ ID NO: 8033841 - DNA, 22 bp, Homo sapiens
tcgcccaggctggaagtgcagt

SEQ ID NO: 8033842 - DNA, 22 bp, Homo sapiens
tcgcccaggctggaagtgcagt

SEQ ID NO: 8033843 - DNA, 22 bp, Homo sapiens
tcgcccaggctggaagtgcagt

SEQ ID NO: 8033844 - DNA, 22 bp, Homo sapiens
tcgcccaggctggaagtgcagt

SEQ ID NO: 8033845 - DNA, 22 bp, Homo sapiens
tcgcccaggctggaagtgcagt

SEQ ID NO: 8033846 - DNA, 22 bp, Homo sapiens
tcgcccagctcatctcccacaa

SEQ ID NO: 8033847 - DNA, 22 bp, Homo sapiens
tcgcatttgggcaggagatgct

SEQ ID NO: 8033848 - DNA, 22 bp, Homo sapiens
tcgcagaggcacgagtgcagaa

SEQ ID NO: 8033849 - DNA, 22 bp, Homo sapiens
tcgccagggatgctgtaaggaa

SEQ ID NO: 8033850 - DNA, 22 bp, Homo sapiens
tcgcaccattgcactccagcca

SEQ ID NO: 8033851 - DNA, 22 bp, Homo sapiens
tcgcaccattgcactccagcca

SEQ ID NO: 8033852 - DNA, 22 bp, Homo sapiens
tcgcagaggcacgagtgcagaa

SEQ ID NO: 8033853 - DNA, 22 bp, Homo sapiens
tcgcagcactagccctgcattg

SEQ ID NO: 8033854 - DNA, 19 bp, Homo sapiens
tcgcagacctgagttctaa

SEQ ID NO: 8033855 - DNA, 21 bp, Homo sapiens
tcgtgcagcagctgaggcttg

SEQ ID NO: 8033856 - DNA, 21 bp, Homo sapiens
tcgtgcagcagctgaggcttg

SEQ ID NO: 8033857 - DNA, 22 bp, Homo sapiens
tcgtgctggatatagggctcta

SEQ ID NO: 8033858 - DNA, 21 bp, Homo sapiens
tcgtgcagcagctgaggcttg

SEQ ID NO: 8033859 - DNA, 21 bp, Homo sapiens
tcgtgcagcagctgaggcttg

SEQ ID NO: 8033860 - DNA, 22 bp, Homo sapiens
tcgtggaggcaccgtgagcttt

SEQ ID NO: 8033861 - DNA, 22 bp, Homo sapiens
tcgtggagaggccatgtggagg

SEQ ID NO: 8033862 - DNA, 22 bp, Homo sapiens
tcgtggagaggccatgtggagg

SEQ ID NO: 8033863 - DNA, 22 bp, Homo sapiens
tcgtgctcctggtgaggctctg

SEQ ID NO: 8033864 - DNA, 22 bp, Homo sapiens
tcgtgctggatatagggctcta

SEQ ID NO: 8033865 - DNA, 22 bp, Homo sapiens
tcgtgatctgtccacctcggcc

SEQ ID NO: 8033866 - DNA, 22 bp, Homo sapiens
tcgtgagggccctggaggtgct

SEQ ID NO: 8033867 - DNA, 21 bp, Homo sapiens
tcgtgcagcagctgaggcttg

SEQ ID NO: 8033868 - DNA, 22 bp, Homo sapiens
tcgtgatctgtccacctcggcc

SEQ ID NO: 8033869 - DNA, 22 bp, Homo sapiens
tcgtgaggctctgcatcgcaca

SEQ ID NO: 8033870 - DNA, 22 bp, Homo sapiens
tcgtgatctgtccacctcggcc

SEQ ID NO: 8033871 - DNA, 22 bp, Homo sapiens
tcgttcttgtcagtttataaag

SEQ ID NO: 8033872 - DNA, 23 bp, Homo sapiens
tcgttgaatagcaatagcacaac

SEQ ID NO: 8033873 - DNA, 23 bp, Homo sapiens
tcgttgaatagcaatagcacaac

SEQ ID NO: 8033874 - DNA, 23 bp, Homo sapiens
tcgttgaatagcaatagcacaac

SEQ ID NO: 8033875 - DNA, 23 bp, Homo sapiens
tcgttgaatagcaatagcacaac

SEQ ID NO: 8033876 - DNA, 20 bp, Homo sapiens
tcgtttatttgaaattgctc

SEQ ID NO: 8033877 - DNA, 22 bp, Homo sapiens
tcgttttaccaaattgaatgtt

SEQ ID NO: 8033878 - DNA, 22 bp, Homo sapiens
tcgttttaggtggacattgtgt

SEQ ID NO: 8033879 - DNA, 22 bp, Homo sapiens
tcgttttaggtggacattgtgt

SEQ ID NO: 8033880 - DNA, 22 bp, Homo sapiens
tcgttttaggtggacattgtgt

SEQ ID NO: 8033881 - DNA, 19 bp, Homo sapiens
tcgtggggaggtgggcagc

SEQ ID NO: 8033882 - DNA, 19 bp, Homo sapiens
tcgtggggaggtgggcagc

SEQ ID NO: 8033883 - DNA, 22 bp, Homo sapiens
tcgtgtgtattccctctccttc

SEQ ID NO: 8033884 - DNA, 22 bp, Homo sapiens
tcgtgtgtattccctctccttc

SEQ ID NO: 8033885 - DNA, 22 bp, Homo sapiens
tcgttaaatgctaaaactgaca

SEQ ID NO: 8033886 - DNA, 22 bp, Homo sapiens
tcgttaaatgctaaaactgaca

SEQ ID NO: 8033887 - DNA, 22 bp, Homo sapiens
tctaaagatgtttattgacata

SEQ ID NO: 8033888 - DNA, 22 bp, Homo sapiens
tctaaagatgtttattgacata

SEQ ID NO: 8033889 - DNA, 22 bp, Homo sapiens
tctaaagagaaccttttctcat

SEQ ID NO: 8033890 - DNA, 22 bp, Homo sapiens
tctaaagacactttttacaggg

SEQ ID NO: 8033891 - DNA, 22 bp, Homo sapiens
tctaaagagagtgggtacatgt

SEQ ID NO: 8033892 - DNA, 22 bp, Homo sapiens
tctaaagagagtgggtacatgt

SEQ ID NO: 8033893 - DNA, 22 bp, Homo sapiens
tctaaagtatgctaatatgtga

SEQ ID NO: 8033894 - DNA, 22 bp, Homo sapiens
tctaaagatttggattcatttg

SEQ ID NO: 8033895 - DNA, 22 bp, Homo sapiens
tctaaagatttggattcatttg

SEQ ID NO: 8033896 - DNA, 22 bp, Homo sapiens
tctaaacttcactttaagtgct

SEQ ID NO: 8033897 - DNA, 22 bp, Homo sapiens
tctaaactgcgagcatgccccc

SEQ ID NO: 8033898 - DNA, 22 bp, Homo sapiens
tctaaacattatgatagtagag

SEQ ID NO: 8033899 - DNA, 22 bp, Homo sapiens
tctaaaatgcagatctactggt

SEQ ID NO: 8033900 - DNA, 19 bp, Homo sapiens
tctaaacacagggacaagc

SEQ ID NO: 8033901 - DNA, 23 bp, Homo sapiens
tctaaaattcatcatttacgttc

SEQ ID NO: 8033902 - DNA, 23 bp, Homo sapiens
tctaaaattcatcatttacgttc

SEQ ID NO: 8033903 - DNA, 22 bp, Homo sapiens
tctaaaaaagtctgttcacttg

SEQ ID NO: 8033904 - DNA, 22 bp, Homo sapiens
tcgttttaggtggacattgtgt

SEQ ID NO: 8033905 - DNA, 22 bp, Homo sapiens
tctaaaatgcagatctactggt

SEQ ID NO: 8033906 - DNA, 22 bp, Homo sapiens
tctaaaacctgaacccatgatt

SEQ ID NO: 8033907 - DNA, 22 bp, Homo sapiens
tctaaaatgcagatctactggt

SEQ ID NO: 8033908 - DNA, 22 bp, Homo sapiens
tctaaaatgcagatctactggt

SEQ ID NO: 8033909 - DNA, 22 bp, Homo sapiens
tctaaaatgcagatctactggt

SEQ ID NO: 8033910 - DNA, 22 bp, Homo sapiens
tctaaaagagggaggagagcct

SEQ ID NO: 8033911 - DNA, 22 bp, Homo sapiens
tcgcaccattgcactccagcca

SEQ ID NO: 8033912 - DNA, 22 bp, Homo sapiens
tcgcaccattgcactccagcca

SEQ ID NO: 8033913 - DNA, 22 bp, Homo sapiens
tcgcaccattgcactccagcca

SEQ ID NO: 8033914 - DNA, 22 bp, Homo sapiens
tcgataatatcttacatgtgct

SEQ ID NO: 8033915 - DNA, 22 bp, Homo sapiens
tcgatttgtattacatctacat

SEQ ID NO: 8033916 - DNA, 22 bp, Homo sapiens
tcgatttgtttgggggagaagt

SEQ ID NO: 8033917 - DNA, 22 bp, Homo sapiens
tcgagctctggagccaaggatg

SEQ ID NO: 8033918 - DNA, 22 bp, Homo sapiens
tcgaatggcaaggaaagaggct

SEQ ID NO: 8033919 - DNA, 22 bp, Homo sapiens
tcgaaggaggcactcagacatg

SEQ ID NO: 8033920 - DNA, 22 bp, Homo sapiens
tcgagctctggagccaaggatg

SEQ ID NO: 8033921 - DNA, 22 bp, Homo sapiens
tcctttttatagttagagaaac

SEQ ID NO: 8033922 - DNA, 22 bp, Homo sapiens
tcctttttatagttagagaaac

SEQ ID NO: 8033923 - DNA, 22 bp, Homo sapiens
tcctttttatagttagagaaac

SEQ ID NO: 8033924 - DNA, 22 bp, Homo sapiens
tcctttttaagtcgttgtggta

SEQ ID NO: 8033925 - DNA, 22 bp, Homo sapiens
tcctttttctcacacaacgaac

SEQ ID NO: 8033926 - DNA, 22 bp, Homo sapiens
tcctttttctcacacaacgaac

SEQ ID NO: 8033927 - DNA, 22 bp, Homo sapiens
tcctttttctcacacaacgaac

SEQ ID NO: 8033928 - DNA, 22 bp, Homo sapiens
tcctttttctcacacaacgaac

SEQ ID NO: 8033929 - DNA, 22 bp, Homo sapiens
tcgaaatactgtttccccttta

SEQ ID NO: 8033930 - DNA, 22 bp, Homo sapiens
tccttttttatgaagctttgag

SEQ ID NO: 8033931 - DNA, 22 bp, Homo sapiens
tcctttttggtccaaggtgacc

SEQ ID NO: 8033932 - DNA, 22 bp, Homo sapiens
tcctttttggtccaaggtgacc

SEQ ID NO: 8033933 - DNA, 22 bp, Homo sapiens
tcctttttggtccaaggtgacc

SEQ ID NO: 8033934 - DNA, 22 bp, Homo sapiens
tcgaaaatgaagagtcaattaa

SEQ ID NO: 8033935 - DNA, 22 bp, Homo sapiens
tccttttttatgaagctttgag

SEQ ID NO: 8033936 - DNA, 22 bp, Homo sapiens
tccttttttatgaagctttgag

SEQ ID NO: 8033937 - DNA, 22 bp, Homo sapiens
tcgaaataatttagaatataga

SEQ ID NO: 8033938 - DNA, 22 bp, Homo sapiens
tcctttgcttctgtcattctcc

SEQ ID NO: 8033939 - DNA, 22 bp, Homo sapiens
tcctttgcttctgtcattctcc

SEQ ID NO: 8033940 - DNA, 22 bp, Homo sapiens
tcctttgcttctgtcattctcc

SEQ ID NO: 8033941 - DNA, 22 bp, Homo sapiens
tcctttgcttctgtcattctcc

SEQ ID NO: 8033942 - DNA, 22 bp, Homo sapiens
tcctttgcttctgtcattctcc

SEQ ID NO: 8033943 - DNA, 22 bp, Homo sapiens
tcctttgacttcttgcagtcca

SEQ ID NO: 8033944 - DNA, 23 bp, Homo sapiens
tcctttgacaagagacagatgtt

SEQ ID NO: 8033945 - DNA, 23 bp, Homo sapiens
tcctttgacaagagacagatgtt

SEQ ID NO: 8033946 - DNA, 22 bp, Homo sapiens
tcctttgcttctgtcattctcc

SEQ ID NO: 8033947 - DNA, 22 bp, Homo sapiens
tcctttggtagttttcttaaag

SEQ ID NO: 8033948 - DNA, 22 bp, Homo sapiens
tcctttggcaagctctgctctt

SEQ ID NO: 8033949 - DNA, 22 bp, Homo sapiens
tcctttgttaaggaggtttgtt

SEQ ID NO: 8033950 - DNA, 23 bp, Homo sapiens
tcctttgtctttgcatagatggt

SEQ ID NO: 8033951 - DNA, 22 bp, Homo sapiens
tcctttgttgtacaattatttt

SEQ ID NO: 8033952 - DNA, 21 bp, Homo sapiens
tccttttcaatcgggcccttt

SEQ ID NO: 8033953 - DNA, 21 bp, Homo sapiens
tccttttcaatcgggcccttt

SEQ ID NO: 8033954 - DNA, 22 bp, Homo sapiens
tccttttccctgaaggtattta

SEQ ID NO: 8033955 - DNA, 21 bp, Homo sapiens
tccttttcaatcgggcccttt

SEQ ID NO: 8033956 - DNA, 22 bp, Homo sapiens
tccttttctctagtaagcttta

SEQ ID NO: 8033957 - DNA, 18 bp, Homo sapiens
tccttttctcccacccac

SEQ ID NO: 8033958 - DNA, 18 bp, Homo sapiens
tccttttctcccacccac

SEQ ID NO: 8033959 - DNA, 22 bp, Homo sapiens
tccttttccctgaaggtattta

SEQ ID NO: 8033960 - DNA, 22 bp, Homo sapiens
tccttttccctgaaggtattta

SEQ ID NO: 8033961 - DNA, 18 bp, Homo sapiens
tccttttctcccacccac

SEQ ID NO: 8033962 - DNA, 18 bp, Homo sapiens
tccttttctcccacccac

SEQ ID NO: 8033963 - DNA, 22 bp, Homo sapiens
tccttttctcttccccagagta

SEQ ID NO: 8033964 - DNA, 22 bp, Homo sapiens
tccttttctcttccccagagta

SEQ ID NO: 8033965 - DNA, 22 bp, Homo sapiens
tccttttgctgggatcatcagg

SEQ ID NO: 8033966 - DNA, 22 bp, Homo sapiens
tccttttctctagtaagcttta

SEQ ID NO: 8033967 - DNA, 22 bp, Homo sapiens
tccttttctctagtaagcttta

SEQ ID NO: 8033968 - DNA, 22 bp, Homo sapiens
tccttttctctagtaagcttta

SEQ ID NO: 8033969 - DNA, 22 bp, Homo sapiens
tccttttctcttccccagagta

SEQ ID NO: 8033970 - DNA, 22 bp, Homo sapiens
tccttggctagtactggccagc

SEQ ID NO: 8033971 - DNA, 22 bp, Homo sapiens
tccttggctagtactggccagc

SEQ ID NO: 8033972 - DNA, 22 bp, Homo sapiens
tccttgggaaacatcatgtaat

SEQ ID NO: 8033973 - DNA, 22 bp, Homo sapiens
tccttgggaaacatcatgtaat

SEQ ID NO: 8033974 - DNA, 23 bp, Homo sapiens
tccttgggcctgcccagagtggt

SEQ ID NO: 8033975 - DNA, 22 bp, Homo sapiens
tcctttccatgcttctagaggc

SEQ ID NO: 8033976 - DNA, 23 bp, Homo sapiens
tccttgggcctgcccagagtggt

SEQ ID NO: 8033977 - DNA, 22 bp, Homo sapiens
tcctttccatgcttctagaggc

SEQ ID NO: 8033978 - DNA, 22 bp, Homo sapiens
tcctttccatgcttctagaggc

SEQ ID NO: 8033979 - DNA, 22 bp, Homo sapiens
tcctttccctttccatcctggc

SEQ ID NO: 8033980 - DNA, 22 bp, Homo sapiens
tcctttccctttccatcctggc

SEQ ID NO: 8033981 - DNA, 22 bp, Homo sapiens
tcctttccatgcttctagaggc

SEQ ID NO: 8033982 - DNA, 20 bp, Homo sapiens
tcctttcctccttctaaatg

SEQ ID NO: 8033983 - DNA, 20 bp, Homo sapiens
tcctttcctccttctaaatg

SEQ ID NO: 8033984 - DNA, 22 bp, Homo sapiens
tcctttccctttccatcctggc

SEQ ID NO: 8033985 - DNA, 18 bp, Homo sapiens
tcctttctccctcatctt

SEQ ID NO: 8033986 - DNA, 22 bp, Homo sapiens
tcctttctcccaggttagttgt

SEQ ID NO: 8033987 - DNA, 22 bp, Homo sapiens
tcctttctccagctggcattgt

SEQ ID NO: 8033988 - DNA, 22 bp, Homo sapiens
tcctttctatcttgggtatcta

SEQ ID NO: 8033989 - DNA, 22 bp, Homo sapiens
tcctttctccagctggcattgt

SEQ ID NO: 8033990 - DNA, 20 bp, Homo sapiens
tcctttcctccttctaaatg

SEQ ID NO: 8033991 - DNA, 22 bp, Homo sapiens
tcctttctatcttgggtatcta

SEQ ID NO: 8033992 - DNA, 22 bp, Homo sapiens
tcctttctcccaggttagttgt

SEQ ID NO: 8033993 - DNA, 18 bp, Homo sapiens
tcctttctccctcatctt

SEQ ID NO: 8033994 - DNA, 18 bp, Homo sapiens
tcctttctccctcatctt

SEQ ID NO: 8033995 - DNA, 18 bp, Homo sapiens
tcctttctccctcatctt

SEQ ID NO: 8033996 - DNA, 22 bp, Homo sapiens
tcctttctccgggggactgttg

SEQ ID NO: 8033997 - DNA, 22 bp, Homo sapiens
tcctttctccgggggactgttg

SEQ ID NO: 8033998 - DNA, 22 bp, Homo sapiens
tcctttctccttccgacttcat

SEQ ID NO: 8033999 - DNA, 22 bp, Homo sapiens
tcctttctgtctttactctgga

SEQ ID NO: 8034000 - DNA, 22 bp, Homo sapiens
tcctttctgtctttactctgga

SEQ ID NO: 8034001 - DNA, 22 bp, Homo sapiens
tcctttctgtctttactctgga

SEQ ID NO: 8034002 - DNA, 19 bp, Homo sapiens
tcctttctgttcctgagat

SEQ ID NO: 8034003 - DNA, 22 bp, Homo sapiens
tcctttctgtgctgtcaggtcc

SEQ ID NO: 8034004 - DNA, 22 bp, Homo sapiens
tcctttctgggcctcagtgact

SEQ ID NO: 8034005 - DNA, 22 bp, Homo sapiens
tcctttctgtctttactctgga

SEQ ID NO: 8034006 - DNA, 17 bp, Homo sapiens
tcctttctttacctgtt

SEQ ID NO: 8034007 - DNA, 22 bp, Homo sapiens
tcctttcttcttctgcccatgg

SEQ ID NO: 8034008 - DNA, 19 bp, Homo sapiens
tcctttgaatatcagttga

SEQ ID NO: 8034009 - DNA, 19 bp, Homo sapiens
tcctttgaatatcagttga

SEQ ID NO: 8034010 - DNA, 22 bp, Homo sapiens
tcctttcttttctatgggccca

SEQ ID NO: 8034011 - DNA, 22 bp, Homo sapiens
tcctttcttttctatgggccca

SEQ ID NO: 8034012 - DNA, 22 bp, Homo sapiens
tcctttcttttctatgggccca

SEQ ID NO: 8034013 - DNA, 19 bp, Homo sapiens
tcctttctgttcctgagat

SEQ ID NO: 8034014 - DNA, 22 bp, Homo sapiens
tcctttcttcttctgcccatgg

SEQ ID NO: 8034015 - DNA, 19 bp, Homo sapiens
tcctttctgttcctgagat

SEQ ID NO: 8034016 - DNA, 22 bp, Homo sapiens
tcctttcttcttctgcccatgg

SEQ ID NO: 8034017 - DNA, 22 bp, Homo sapiens
tcctttcttcttctgcccatgg

SEQ ID NO: 8034018 - DNA, 19 bp, Homo sapiens
tcctttctgttcctgagat

SEQ ID NO: 8034019 - DNA, 22 bp, Homo sapiens
tcctttcttcttctgcccatgg

SEQ ID NO: 8034020 - DNA, 22 bp, Homo sapiens
tccttcaactttttacttgccc

SEQ ID NO: 8034021 - DNA, 22 bp, Homo sapiens
tccttcaagatgccacagcttt

SEQ ID NO: 8034022 - DNA, 22 bp, Homo sapiens
tccttcaaagctcctagtgagc

SEQ ID NO: 8034023 - DNA, 22 bp, Homo sapiens
tccttcaagatgccacagcttt

SEQ ID NO: 8034024 - DNA, 22 bp, Homo sapiens
tccttcaagtgcagtacctgag

SEQ ID NO: 8034025 - DNA, 22 bp, Homo sapiens
tccttcaaaagttgagagagcc

SEQ ID NO: 8034026 - DNA, 22 bp, Homo sapiens
tccttcaaaagttgagagagcc

SEQ ID NO: 8034027 - DNA, 22 bp, Homo sapiens
tccttcaaagctcctagtgagc

SEQ ID NO: 8034028 - DNA, 22 bp, Homo sapiens
tccttatatggcagacagcaga

SEQ ID NO: 8034029 - DNA, 22 bp, Homo sapiens
tccttatatcttcagagaagca

SEQ ID NO: 8034030 - DNA, 22 bp, Homo sapiens
tccttataacaacaggagtgga

SEQ ID NO: 8034031 - DNA, 22 bp, Homo sapiens
tccttatagcccaagtgatgga

SEQ ID NO: 8034032 - DNA, 22 bp, Homo sapiens
tccttaggaaaatgatgagggg

SEQ ID NO: 8034033 - DNA, 22 bp, Homo sapiens
tccttaggcaatttgggagagt

SEQ ID NO: 8034034 - DNA, 22 bp, Homo sapiens
tccttaggcaatttgggagagt

SEQ ID NO: 8034035 - DNA, 22 bp, Homo sapiens
tccttaggtatttagcatgaat

SEQ ID NO: 8034036 - DNA, 22 bp, Homo sapiens
tccttagggatttttccagtca

SEQ ID NO: 8034037 - DNA, 22 bp, Homo sapiens
tccttaggcaatttgggagagt

SEQ ID NO: 8034038 - DNA, 22 bp, Homo sapiens
tccttaggcaatttgggagagt

SEQ ID NO: 8034039 - DNA, 22 bp, Homo sapiens
tccttaaatgaactctgcatga

SEQ ID NO: 8034040 - DNA, 22 bp, Homo sapiens
tccttaaatgaactctgcatga

SEQ ID NO: 8034041 - DNA, 22 bp, Homo sapiens
tccttaaatccttcagagatta

SEQ ID NO: 8034042 - DNA, 22 bp, Homo sapiens
tccttaaatgtgatctagattt

SEQ ID NO: 8034043 - DNA, 22 bp, Homo sapiens
tccttaaatgtgatctagattt

SEQ ID NO: 8034044 - DNA, 22 bp, Homo sapiens
tccttaaatgtgatctagattt

SEQ ID NO: 8034045 - DNA, 22 bp, Homo sapiens
tccttacaacttgttatttttc

SEQ ID NO: 8034046 - DNA, 22 bp, Homo sapiens
tccttacaacttgttatttttc

SEQ ID NO: 8034047 - DNA, 22 bp, Homo sapiens
tccttaatatggaagagttctc

SEQ ID NO: 8034048 - DNA, 20 bp, Homo sapiens
tccttaagtacctaagagtg

SEQ ID NO: 8034049 - DNA, 22 bp, Homo sapiens
tccttaagttctccaaggccag

SEQ ID NO: 8034050 - DNA, 22 bp, Homo sapiens
tccttacagaaagcagtagaca

SEQ ID NO: 8034051 - DNA, 22 bp, Homo sapiens
tccttacagaaagcagtagaca

SEQ ID NO: 8034052 - DNA, 22 bp, Homo sapiens
tccttacaggttacagaaagca

SEQ ID NO: 8034053 - DNA, 22 bp, Homo sapiens
tccttacaggttacagaaagca

SEQ ID NO: 8034054 - DNA, 22 bp, Homo sapiens
tccttacaggttacagaaagca

SEQ ID NO: 8034055 - DNA, 22 bp, Homo sapiens
tccttacactggggaaggtgta

SEQ ID NO: 8034056 - DNA, 22 bp, Homo sapiens
tccttagagtggttgtgctatg

SEQ ID NO: 8034057 - DNA, 22 bp, Homo sapiens
tccttagagtggttgtgctatg

SEQ ID NO: 8034058 - DNA, 22 bp, Homo sapiens
tccttagagatactgtcttgaa

SEQ ID NO: 8034059 - DNA, 22 bp, Homo sapiens
tccttagagatactgtcttgaa

SEQ ID NO: 8034060 - DNA, 22 bp, Homo sapiens
tccttagagacaagaccagttt

SEQ ID NO: 8034061 - DNA, 22 bp, Homo sapiens
tccttagacaaagagtgggctt

SEQ ID NO: 8034062 - DNA, 22 bp, Homo sapiens
tccttagacctggcaaatgggg

SEQ ID NO: 8034063 - DNA, 22 bp, Homo sapiens
tccttagacctggcaaatgggg

SEQ ID NO: 8034064 - DNA, 22 bp, Homo sapiens
tccttagagacaagaccagttt

SEQ ID NO: 8034065 - DNA, 22 bp, Homo sapiens
tccttacctcaagcttgtggtc

SEQ ID NO: 8034066 - DNA, 22 bp, Homo sapiens
tccttagacaaagagtgggctt

SEQ ID NO: 8034067 - DNA, 22 bp, Homo sapiens
tccttagacaaagagtgggctt

SEQ ID NO: 8034068 - DNA, 22 bp, Homo sapiens
tccttagacaaagagtgggctt

SEQ ID NO: 8034069 - DNA, 22 bp, Homo sapiens
tccttagacaaagagtgggctt

SEQ ID NO: 8034070 - DNA, 22 bp, Homo sapiens
tccttacatagtgctgaaatat

SEQ ID NO: 8034071 - DNA, 22 bp, Homo sapiens
tccttacatgcttccttataca

SEQ ID NO: 8034072 - DNA, 22 bp, Homo sapiens
tccttacatagtgctgaaatat

SEQ ID NO: 8034073 - DNA, 22 bp, Homo sapiens
tccttacatgcttccttataca

SEQ ID NO: 8034074 - DNA, 22 bp, Homo sapiens
tccttacagaaagcagtagaca

SEQ ID NO: 8034075 - DNA, 22 bp, Homo sapiens
tccttacagttaaaatgggagt

SEQ ID NO: 8034076 - DNA, 22 bp, Homo sapiens
tccttcaatcacccagtgggga

SEQ ID NO: 8034077 - DNA, 22 bp, Homo sapiens
tccttcaatcacccagtgggga

SEQ ID NO: 8034078 - DNA, 18 bp, Homo sapiens
tccttcacagcaggaagg

SEQ ID NO: 8034079 - DNA, 22 bp, Homo sapiens
tccttcaatcacccagtgggga

SEQ ID NO: 8034080 - DNA, 18 bp, Homo sapiens
tccttcacagcaggaagg

SEQ ID NO: 8034081 - DNA, 22 bp, Homo sapiens
tccttcaagtgcagtacctgag

SEQ ID NO: 8034082 - DNA, 23 bp, Homo sapiens
tccttcaagttaggaagtgaaca

SEQ ID NO: 8034083 - DNA, 23 bp, Homo sapiens
tccttcaagttaggaagtgaaca

SEQ ID NO: 8034084 - DNA, 22 bp, Homo sapiens
tccttcagaacctgtgatggaa

SEQ ID NO: 8034085 - DNA, 22 bp, Homo sapiens
tccttcagaaaacctcagtctt

SEQ ID NO: 8034086 - DNA, 22 bp, Homo sapiens
tccttcaccttagccctcctag

SEQ ID NO: 8034087 - DNA, 23 bp, Homo sapiens
tccttcagagcctccctccaagc

SEQ ID NO: 8034088 - DNA, 20 bp, Homo sapiens
tccttcagactttggagttg

SEQ ID NO: 8034089 - DNA, 20 bp, Homo sapiens
tccttcagacgacaagcaag

SEQ ID NO: 8034090 - DNA, 20 bp, Homo sapiens
tccttcagacgacaagcaag

SEQ ID NO: 8034091 - DNA, 22 bp, Homo sapiens
tccttcagattcctgcttctgg

SEQ ID NO: 8034092 - DNA, 22 bp, Homo sapiens
tccttcagattcctgcttctgg

SEQ ID NO: 8034093 - DNA, 22 bp, Homo sapiens
tccttcagaggataaggaagaa

SEQ ID NO: 8034094 - DNA, 22 bp, Homo sapiens
tccttcagaggacggcagccag

SEQ ID NO: 8034095 - DNA, 22 bp, Homo sapiens
tccttcagaggataaggaagaa

SEQ ID NO: 8034096 - DNA, 22 bp, Homo sapiens
tccttcagcctcccagctcaaa

SEQ ID NO: 8034097 - DNA, 22 bp, Homo sapiens
tccttcagccatgggctctcca

SEQ ID NO: 8034098 - DNA, 22 bp, Homo sapiens
tccttcagctactcagtttcca

SEQ ID NO: 8034099 - DNA, 22 bp, Homo sapiens
tccttcagctctctatttagat

SEQ ID NO: 8034100 - DNA, 22 bp, Homo sapiens
tccttcagctgctaggaaatga

SEQ ID NO: 8034101 - DNA, 22 bp, Homo sapiens
tccttcagctgctaggaaatga

SEQ ID NO: 8034102 - DNA, 22 bp, Homo sapiens
tccttcagcttgttagagtgac

SEQ ID NO: 8034103 - DNA, 22 bp, Homo sapiens
tccttcagcttgttagagtgac

SEQ ID NO: 8034104 - DNA, 22 bp, Homo sapiens
tccttcagcttatttcttagga

SEQ ID NO: 8034105 - DNA, 22 bp, Homo sapiens
tccttcagcttgttagagtgac

SEQ ID NO: 8034106 - DNA, 22 bp, Homo sapiens
tccttcagggctgaccacaggc

SEQ ID NO: 8034107 - DNA, 22 bp, Homo sapiens
tccttcagggggccgcctgcac

SEQ ID NO: 8034108 - DNA, 23 bp, Homo sapiens
tccttcaggctcttcccctggac

SEQ ID NO: 8034109 - DNA, 22 bp, Homo sapiens
tccttcaggcctcattctcata

SEQ ID NO: 8034110 - DNA, 22 bp, Homo sapiens
tccttcaggcctcattctcata

SEQ ID NO: 8034111 - DNA, 20 bp, Homo sapiens
tccttcaggcagggcctagt

SEQ ID NO: 8034112 - DNA, 22 bp, Homo sapiens
tccttcaggcctcattctcata

SEQ ID NO: 8034113 - DNA, 22 bp, Homo sapiens
tccttctacactgcctctgaga

SEQ ID NO: 8034114 - DNA, 23 bp, Homo sapiens
tccttcctttgagaggctccatc

SEQ ID NO: 8034115 - DNA, 23 bp, Homo sapiens
tccttcctttgagaggctccatc

SEQ ID NO: 8034116 - DNA, 23 bp, Homo sapiens
tccttcctttgagaggctccatc

SEQ ID NO: 8034117 - DNA, 23 bp, Homo sapiens
tccttcctttgagaggctccatc

SEQ ID NO: 8034118 - DNA, 22 bp, Homo sapiens
tccttcctggggtctctgctgc

SEQ ID NO: 8034119 - DNA, 22 bp, Homo sapiens
tccttccttcctgaaattttag

SEQ ID NO: 8034120 - DNA, 21 bp, Homo sapiens
tccttccttgaggtcctttcc

SEQ ID NO: 8034121 - DNA, 22 bp, Homo sapiens
tccttccttcctgaaattttag

SEQ ID NO: 8034122 - DNA, 22 bp, Homo sapiens
tccttccttcctgaaattttag

SEQ ID NO: 8034123 - DNA, 21 bp, Homo sapiens
tccttccttgaggtcctttcc

SEQ ID NO: 8034124 - DNA, 22 bp, Homo sapiens
tccttcctggggtctctgctgc

SEQ ID NO: 8034125 - DNA, 22 bp, Homo sapiens
tccttcctggggtctctgctgc

SEQ ID NO: 8034126 - DNA, 22 bp, Homo sapiens
tccttcctggggtctctgctgc

SEQ ID NO: 8034127 - DNA, 22 bp, Homo sapiens
tccttcctggggtctctgctgc

SEQ ID NO: 8034128 - DNA, 19 bp, Homo sapiens
tccttcagtcagatctggg

SEQ ID NO: 8034129 - DNA, 19 bp, Homo sapiens
tccttcagtcagatctggg

SEQ ID NO: 8034130 - DNA, 19 bp, Homo sapiens
tccttcagtcagatctggg

SEQ ID NO: 8034131 - DNA, 22 bp, Homo sapiens
tccttcagggggccgcctgcac

SEQ ID NO: 8034132 - DNA, 22 bp, Homo sapiens
tccttcagggggccgcctgcac

SEQ ID NO: 8034133 - DNA, 22 bp, Homo sapiens
tccttcagggttgaggccgact

SEQ ID NO: 8034134 - DNA, 20 bp, Homo sapiens
tccttctgaggtgaggagga

SEQ ID NO: 8034135 - DNA, 20 bp, Homo sapiens
tccttctgaggtgaggagga

SEQ ID NO: 8034136 - DNA, 22 bp, Homo sapiens
tccttctggaggctctaagggg

SEQ ID NO: 8034137 - DNA, 20 bp, Homo sapiens
tccttctgaggtgaggagga

SEQ ID NO: 8034138 - DNA, 20 bp, Homo sapiens
tccttctgaggtgaggagga

SEQ ID NO: 8034139 - DNA, 22 bp, Homo sapiens
tccttctgaaaaatgcacacga

SEQ ID NO: 8034140 - DNA, 22 bp, Homo sapiens
tccttctgaaaaatgcacacga

SEQ ID NO: 8034141 - DNA, 22 bp, Homo sapiens
tccttctgaaaaatgcacacga

SEQ ID NO: 8034142 - DNA, 22 bp, Homo sapiens
tccttctgaaaaatgcacacga

SEQ ID NO: 8034143 - DNA, 22 bp, Homo sapiens
tccttctgtagtccctgtccct

SEQ ID NO: 8034144 - DNA, 22 bp, Homo sapiens
tccttctgtagtccctgtccct

SEQ ID NO: 8034145 - DNA, 22 bp, Homo sapiens
tccttctgtagtccctgtccct

SEQ ID NO: 8034146 - DNA, 22 bp, Homo sapiens
tccttctgtagtccctgtccct

SEQ ID NO: 8034147 - DNA, 22 bp, Homo sapiens
tccttctgtagtccctgtccct

SEQ ID NO: 8034148 - DNA, 22 bp, Homo sapiens
tccttctgtagtccctgtccct

SEQ ID NO: 8034149 - DNA, 22 bp, Homo sapiens
tccttctcctccttgagtgaca

SEQ ID NO: 8034150 - DNA, 21 bp, Homo sapiens
tccttctctatgattgtctga

SEQ ID NO: 8034151 - DNA, 22 bp, Homo sapiens
tccttctcctccttgagtgaca

SEQ ID NO: 8034152 - DNA, 19 bp, Homo sapiens
tccttctccggccaccccg

SEQ ID NO: 8034153 - DNA, 22 bp, Homo sapiens
tccttctatttgtttatgtggc

SEQ ID NO: 8034154 - DNA, 22 bp, Homo sapiens
tccttgcaaatagctttctgag

SEQ ID NO: 8034155 - DNA, 23 bp, Homo sapiens
tccttgagtgtcccccaagagtc

SEQ ID NO: 8034156 - DNA, 21 bp, Homo sapiens
tccttgctattttcctcagct

SEQ ID NO: 8034157 - DNA, 22 bp, Homo sapiens
tccttgcatatctgaaaatgtt

SEQ ID NO: 8034158 - DNA, 22 bp, Homo sapiens
tccttgcagggtttgataaaga

SEQ ID NO: 8034159 - DNA, 22 bp, Homo sapiens
tccttggaaatttcatcagaca

SEQ ID NO: 8034160 - DNA, 22 bp, Homo sapiens
tccttggaaatttcatcagaca

SEQ ID NO: 8034161 - DNA, 22 bp, Homo sapiens
tccttggaaatttcatcagaca

SEQ ID NO: 8034162 - DNA, 22 bp, Homo sapiens
tccttggaagagcattcccagg

SEQ ID NO: 8034163 - DNA, 22 bp, Homo sapiens
tccttggaacattgatccaaac

SEQ ID NO: 8034164 - DNA, 22 bp, Homo sapiens
tccttggaacattgatccaaac

SEQ ID NO: 8034165 - DNA, 22 bp, Homo sapiens
tccttggaagagcattcccagg

SEQ ID NO: 8034166 - DNA, 22 bp, Homo sapiens
tccttggcaagctgcaatggga

SEQ ID NO: 8034167 - DNA, 22 bp, Homo sapiens
tccttggcacactcggatctga

SEQ ID NO: 8034168 - DNA, 22 bp, Homo sapiens
tccttggcaagctgcaatggga

SEQ ID NO: 8034169 - DNA, 22 bp, Homo sapiens
tccttggaggtgttcatctgcc

SEQ ID NO: 8034170 - DNA, 22 bp, Homo sapiens
tccttggagctctccaagggat

SEQ ID NO: 8034171 - DNA, 22 bp, Homo sapiens
tccttggagctctccaagggat

SEQ ID NO: 8034172 - DNA, 22 bp, Homo sapiens
tccttggatctttcctatgatt

SEQ ID NO: 8034173 - DNA, 22 bp, Homo sapiens
tccttggagtcatgatggaggt

SEQ ID NO: 8034174 - DNA, 22 bp, Homo sapiens
tccttgagaggacagagccata

SEQ ID NO: 8034175 - DNA, 22 bp, Homo sapiens
tccttgagaggacagagccata

SEQ ID NO: 8034176 - DNA, 22 bp, Homo sapiens
tccttgagccgtggccagggcc

SEQ ID NO: 8034177 - DNA, 22 bp, Homo sapiens
tccttgagccgtggccagggcc

SEQ ID NO: 8034178 - DNA, 22 bp, Homo sapiens
tccttgagaggacagagccata

SEQ ID NO: 8034179 - DNA, 22 bp, Homo sapiens
tccttgaggaggtgacactgga

SEQ ID NO: 8034180 - DNA, 22 bp, Homo sapiens
tccttgagcctcccagactcag

SEQ ID NO: 8034181 - DNA, 22 bp, Homo sapiens
tccttgaatgaagagaggtgac

SEQ ID NO: 8034182 - DNA, 22 bp, Homo sapiens
tccttgaagcaacgtgcagaca

SEQ ID NO: 8034183 - DNA, 22 bp, Homo sapiens
tccttgaatgaagagaggtgac

SEQ ID NO: 8034184 - DNA, 22 bp, Homo sapiens
tccttgaagcttgtatctaata

SEQ ID NO: 8034185 - DNA, 22 bp, Homo sapiens
tccttgaagcttgtatctaata

SEQ ID NO: 8034186 - DNA, 22 bp, Homo sapiens
tccttgaatataataacagtag

SEQ ID NO: 8034187 - DNA, 19 bp, Homo sapiens
tccttgactgtattcagag

SEQ ID NO: 8034188 - DNA, 22 bp, Homo sapiens
tccttgactgtgaggaactagc

SEQ ID NO: 8034189 - DNA, 22 bp, Homo sapiens
tccttgactgtgaggaactagc

SEQ ID NO: 8034190 - DNA, 22 bp, Homo sapiens
tccttgagagccactgtcttgg

SEQ ID NO: 8034191 - DNA, 22 bp, Homo sapiens
tccttctttcacctcatagtca

SEQ ID NO: 8034192 - DNA, 22 bp, Homo sapiens
tccttgaagcaacgtgcagaca

SEQ ID NO: 8034193 - DNA, 22 bp, Homo sapiens
tccttgaaaggggctgcagggc

SEQ ID NO: 8034194 - DNA, 21 bp, Homo sapiens
tctacatatcaatatgtaatt

SEQ ID NO: 8034195 - DNA, 21 bp, Homo sapiens
tctacatatcaatatgtaatt

SEQ ID NO: 8034196 - DNA, 22 bp, Homo sapiens
tctacatatgtgatttctaagt

SEQ ID NO: 8034197 - DNA, 22 bp, Homo sapiens
tctacatgcagcgaggggactt

SEQ ID NO: 8034198 - DNA, 22 bp, Homo sapiens
tctacatgcagcgaggggactt

SEQ ID NO: 8034199 - DNA, 22 bp, Homo sapiens
tctacattccttttataatatc

SEQ ID NO: 8034200 - DNA, 22 bp, Homo sapiens
tctacattttctttatgtacat

SEQ ID NO: 8034201 - DNA, 22 bp, Homo sapiens
tctacattttaacaagatgccc

SEQ ID NO: 8034202 - DNA, 22 bp, Homo sapiens
tctacattttcacaaggtctcc

SEQ ID NO: 8034203 - DNA, 22 bp, Homo sapiens
tctacagggtcagagtttcatg

SEQ ID NO: 8034204 - DNA, 22 bp, Homo sapiens
tctacagccattttgagcagtg

SEQ ID NO: 8034205 - DNA, 22 bp, Homo sapiens
tctacagtgtcaatgtgtcttg

SEQ ID NO: 8034206 - DNA, 22 bp, Homo sapiens
tctacataaaaattcagaaggc

SEQ ID NO: 8034207 - DNA, 22 bp, Homo sapiens
tctacaggtggggcctggcaat

SEQ ID NO: 8034208 - DNA, 22 bp, Homo sapiens
tctacaggtggggcctggcaat

SEQ ID NO: 8034209 - DNA, 22 bp, Homo sapiens
tctacagtcaagttatattgct

SEQ ID NO: 8034210 - DNA, 22 bp, Homo sapiens
tctacaggtggggcctggcaat

SEQ ID NO: 8034211 - DNA, 22 bp, Homo sapiens
tctacactccagagtctcatca

SEQ ID NO: 8034212 - DNA, 22 bp, Homo sapiens
tctacactccagagtctcatca

SEQ ID NO: 8034213 - DNA, 22 bp, Homo sapiens
tctacacaagtgagtggcacaa

SEQ ID NO: 8034214 - DNA, 22 bp, Homo sapiens
tctacacaagtgagtggcacaa

SEQ ID NO: 8034215 - DNA, 22 bp, Homo sapiens
tctacacatttgtaaaggcatt

SEQ ID NO: 8034216 - DNA, 22 bp, Homo sapiens
tctacacatttgtaaaggcatt

SEQ ID NO: 8034217 - DNA, 22 bp, Homo sapiens
tctacacaagtgagtggcacaa

SEQ ID NO: 8034218 - DNA, 22 bp, Homo sapiens
tctacagaaactggctactctc

SEQ ID NO: 8034219 - DNA, 22 bp, Homo sapiens
tctacagaaactggctactctc

SEQ ID NO: 8034220 - DNA, 22 bp, Homo sapiens
tctacagaaactggctactctc

SEQ ID NO: 8034221 - DNA, 22 bp, Homo sapiens
tctacagacagagcaggtggga

SEQ ID NO: 8034222 - DNA, 22 bp, Homo sapiens
tctacagactcctatgtaacac

SEQ ID NO: 8034223 - DNA, 22 bp, Homo sapiens
tctacagactcctatgtaacac

SEQ ID NO: 8034224 - DNA, 22 bp, Homo sapiens
tctacagagagtcatagactca

SEQ ID NO: 8034225 - DNA, 22 bp, Homo sapiens
tctacagccattttgagcagtg

SEQ ID NO: 8034226 - DNA, 22 bp, Homo sapiens
tctacagagagtcatagactca

SEQ ID NO: 8034227 - DNA, 22 bp, Homo sapiens
tctacagagagcaaacattcta

SEQ ID NO: 8034228 - DNA, 22 bp, Homo sapiens
tctacagagagcaaacattcta

SEQ ID NO: 8034229 - DNA, 22 bp, Homo sapiens
tctacagagagtcatagactca

SEQ ID NO: 8034230 - DNA, 22 bp, Homo sapiens
tctacaaaggttgaggtgccct

SEQ ID NO: 8034231 - DNA, 22 bp, Homo sapiens
tctacaaaggttgaggtgccct

SEQ ID NO: 8034232 - DNA, 19 bp, Homo sapiens
tctacaaagtggcatcagg

SEQ ID NO: 8034233 - DNA, 19 bp, Homo sapiens
tctacaaagtggcatcagg

SEQ ID NO: 8034234 - DNA, 22 bp, Homo sapiens
tctacaaataaattactatgta

SEQ ID NO: 8034235 - DNA, 22 bp, Homo sapiens
tctacaaataaattactatgta

SEQ ID NO: 8034236 - DNA, 22 bp, Homo sapiens
tctacaaataaattactatgta

SEQ ID NO: 8034237 - DNA, 19 bp, Homo sapiens
tctacaaagtggcatcagg

SEQ ID NO: 8034238 - DNA, 22 bp, Homo sapiens
tctacaagtttaattccactta

SEQ ID NO: 8034239 - DNA, 22 bp, Homo sapiens
tctacaagttgtgacttgatac

SEQ ID NO: 8034240 - DNA, 22 bp, Homo sapiens
tctacaaataaattactatgta

SEQ ID NO: 8034241 - DNA, 22 bp, Homo sapiens
tctaacttgtatgtatagtttt

SEQ ID NO: 8034242 - DNA, 22 bp, Homo sapiens
tctaagaaagattaagaaattt

SEQ ID NO: 8034243 - DNA, 22 bp, Homo sapiens
tctaagaaagattaagaaattt

SEQ ID NO: 8034244 - DNA, 22 bp, Homo sapiens
tctaagaaagattaagaaattt

SEQ ID NO: 8034245 - DNA, 22 bp, Homo sapiens
tctaattttaggcatttgttca

SEQ ID NO: 8034246 - DNA, 22 bp, Homo sapiens
tctaatgggtaaatatttttat

SEQ ID NO: 8034247 - DNA, 22 bp, Homo sapiens
tctaagaaatcagatgatgagg

SEQ ID NO: 8034248 - DNA, 22 bp, Homo sapiens
tctacaaagaagaattaatgtc

SEQ ID NO: 8034249 - DNA, 22 bp, Homo sapiens
tctacaaagccattcaggatct

SEQ ID NO: 8034250 - DNA, 22 bp, Homo sapiens
tctacaaagccattcaggatct

SEQ ID NO: 8034251 - DNA, 23 bp, Homo sapiens
tctacaaagctgtgtcaggaccc

SEQ ID NO: 8034252 - DNA, 22 bp, Homo sapiens
tctacaaagccattcaggatct

SEQ ID NO: 8034253 - DNA, 23 bp, Homo sapiens
tctacaaagctgtgtcaggaccc

SEQ ID NO: 8034254 - DNA, 22 bp, Homo sapiens
tctaacttgaactcatgactgt

SEQ ID NO: 8034255 - DNA, 22 bp, Homo sapiens
tctaactctgccaggacacaga

SEQ ID NO: 8034256 - DNA, 22 bp, Homo sapiens
tctaacattgtttttcacagat

SEQ ID NO: 8034257 - DNA, 19 bp, Homo sapiens
tctaacagctttcattcta

SEQ ID NO: 8034258 - DNA, 19 bp, Homo sapiens
tctaacagctttcattcta

SEQ ID NO: 8034259 - DNA, 19 bp, Homo sapiens
tctaacctccccttcagtt

SEQ ID NO: 8034260 - DNA, 20 bp, Homo sapiens
tctaaccacctagccctgat

SEQ ID NO: 8034261 - DNA, 20 bp, Homo sapiens
tctaaccacctagccctgat

SEQ ID NO: 8034262 - DNA, 22 bp, Homo sapiens
tctaaatggaaagaaaatacct

SEQ ID NO: 8034263 - DNA, 22 bp, Homo sapiens
tctaaatgtggtagtcataaga

SEQ ID NO: 8034264 - DNA, 22 bp, Homo sapiens
tctaaattactttgggcagtat

SEQ ID NO: 8034265 - DNA, 22 bp, Homo sapiens
tctaaattactttgggcagtat

SEQ ID NO: 8034266 - DNA, 22 bp, Homo sapiens
tctaacagaaattctgacaaaa

SEQ ID NO: 8034267 - DNA, 19 bp, Homo sapiens
tctaacagaagtgtcgtcc

SEQ ID NO: 8034268 - DNA, 22 bp, Homo sapiens
tctaacagaaattctgacaaaa

SEQ ID NO: 8034269 - DNA, 22 bp, Homo sapiens
tctactgccacttaagacattt

SEQ ID NO: 8034270 - DNA, 22 bp, Homo sapiens
tctactgtggtccttgtaacca

SEQ ID NO: 8034271 - DNA, 22 bp, Homo sapiens
tctactgtggaggcaaatcctt

SEQ ID NO: 8034272 - DNA, 17 bp, Homo sapiens
tctactcctgaaggaag

SEQ ID NO: 8034273 - DNA, 17 bp, Homo sapiens
tctactcctgaaggaag

SEQ ID NO: 8034274 - DNA, 22 bp, Homo sapiens
tctactctactgtctgtgccta

SEQ ID NO: 8034275 - DNA, 22 bp, Homo sapiens
tctacctggagtccgttgttaa

SEQ ID NO: 8034276 - DNA, 22 bp, Homo sapiens
tctacctggagtccgttgttaa

SEQ ID NO: 8034277 - DNA, 22 bp, Homo sapiens
tctacctggagtccgttgttaa

SEQ ID NO: 8034278 - DNA, 22 bp, Homo sapiens
tctaccctgcggtcttggggca

SEQ ID NO: 8034279 - DNA, 22 bp, Homo sapiens
tctactatgtttcttaaataga

SEQ ID NO: 8034280 - DNA, 22 bp, Homo sapiens
tctactatgtttcttaaataga

SEQ ID NO: 8034281 - DNA, 22 bp, Homo sapiens
tctacgaagccaccatggagac

SEQ ID NO: 8034282 - DNA, 22 bp, Homo sapiens
tctacgaagccaccatggagac

SEQ ID NO: 8034283 - DNA, 22 bp, Homo sapiens
tctactaggtgtactactgcag

SEQ ID NO: 8034284 - DNA, 22 bp, Homo sapiens
tctactaggtgtactactgcag

SEQ ID NO: 8034285 - DNA, 22 bp, Homo sapiens
tctacgaatggtccccggtgtg

SEQ ID NO: 8034286 - DNA, 23 bp, Homo sapiens
tctaccagctagtctccccagca

SEQ ID NO: 8034287 - DNA, 23 bp, Homo sapiens
tctacccacactgctctagaagg

SEQ ID NO: 8034288 - DNA, 22 bp, Homo sapiens
tctacccagagctatgacctga

SEQ ID NO: 8034289 - DNA, 18 bp, Homo sapiens
tctaccctctcagagtct

SEQ ID NO: 8034290 - DNA, 22 bp, Homo sapiens
tctaccctgcggtcttggggca

SEQ ID NO: 8034291 - DNA, 22 bp, Homo sapiens
tctaccagggtcacagaggccc

SEQ ID NO: 8034292 - DNA, 22 bp, Homo sapiens
tctaccagagcctagcaggccg

SEQ ID NO: 8034293 - DNA, 22 bp, Homo sapiens
tctagaaaaacaaagtatctga

SEQ ID NO: 8034294 - DNA, 22 bp, Homo sapiens
tctagaaaaacaaagtatctga

SEQ ID NO: 8034295 - DNA, 22 bp, Homo sapiens
tctagaaaaacaaagtatctga

SEQ ID NO: 8034296 - DNA, 22 bp, Homo sapiens
tctacttttccctatacagttt

SEQ ID NO: 8034297 - DNA, 22 bp, Homo sapiens
tctacttttccctatacagttt

SEQ ID NO: 8034298 - DNA, 22 bp, Homo sapiens
tctacttgtcagtcttcaaatc

SEQ ID NO: 8034299 - DNA, 22 bp, Homo sapiens
tctactttataagtatataagt

SEQ ID NO: 8034300 - DNA, 22 bp, Homo sapiens
tctagaaaaccaatattacatg

SEQ ID NO: 8034301 - DNA, 22 bp, Homo sapiens
tctagaaaaccaatattacatg

SEQ ID NO: 8034302 - DNA, 22 bp, Homo sapiens
tctagaaaaccaatattacatg

SEQ ID NO: 8034303 - DNA, 23 bp, Homo sapiens
tctagaaaatgaaagaatgcagt

SEQ ID NO: 8034304 - DNA, 23 bp, Homo sapiens
tctagaaaatgaaagaatgcagt

SEQ ID NO: 8034305 - DNA, 19 bp, Homo sapiens
tctagacaccaaagttgtc

SEQ ID NO: 8034306 - DNA, 22 bp, Homo sapiens
tctagacaatgcactgtaagga

SEQ ID NO: 8034307 - DNA, 22 bp, Homo sapiens
tctagacaatgcactgtaagga

SEQ ID NO: 8034308 - DNA, 19 bp, Homo sapiens
tctagacaccaaagttgtc

SEQ ID NO: 8034309 - DNA, 22 bp, Homo sapiens
tctagaaacaggtttctagaaa

SEQ ID NO: 8034310 - DNA, 22 bp, Homo sapiens
tctagaattttgccatatagct

SEQ ID NO: 8034311 - DNA, 22 bp, Homo sapiens
tctagaattttgccatatagct

SEQ ID NO: 8034312 - DNA, 22 bp, Homo sapiens
tctagaatttgcgtaggttaga

SEQ ID NO: 8034313 - DNA, 17 bp, Homo sapiens
tctaggagagcagagct

SEQ ID NO: 8034314 - DNA, 22 bp, Homo sapiens
tctaggaatgttcttagggatt

SEQ ID NO: 8034315 - DNA, 22 bp, Homo sapiens
tctaggaatgttcttagggatt

SEQ ID NO: 8034316 - DNA, 22 bp, Homo sapiens
tctaggaatttcatctagttct

SEQ ID NO: 8034317 - DNA, 22 bp, Homo sapiens
tctaggaagtaaggagggacta

SEQ ID NO: 8034318 - DNA, 22 bp, Homo sapiens
tctaggaacctgacatctctca

SEQ ID NO: 8034319 - DNA, 22 bp, Homo sapiens
tctaggagttgataaaagggct

SEQ ID NO: 8034320 - DNA, 20 bp, Homo sapiens
tctaggcaggcaggctcgtg

SEQ ID NO: 8034321 - DNA, 20 bp, Homo sapiens
tctaggcaggcaggctcgtg

SEQ ID NO: 8034322 - DNA, 22 bp, Homo sapiens
tctaggagttgataaaagggct

SEQ ID NO: 8034323 - DNA, 22 bp, Homo sapiens
tctaggaggcggagattgcagt

SEQ ID NO: 8034324 - DNA, 22 bp, Homo sapiens
tctaggagcttaaaggaggcca

SEQ ID NO: 8034325 - DNA, 22 bp, Homo sapiens
tctaggaggcacacaagtagtt

SEQ ID NO: 8034326 - DNA, 22 bp, Homo sapiens
tctaggagctgagagtgtgtac

SEQ ID NO: 8034327 - DNA, 22 bp, Homo sapiens
tctaggagcttaaaggaggcca

SEQ ID NO: 8034328 - DNA, 22 bp, Homo sapiens
tctaggagctgagagtgtgtac

SEQ ID NO: 8034329 - DNA, 22 bp, Homo sapiens
tctaggagcatgaagggaaggc

SEQ ID NO: 8034330 - DNA, 22 bp, Homo sapiens
tctaggagcatgaagggaaggc

SEQ ID NO: 8034331 - DNA, 22 bp, Homo sapiens
tctagctctgcttatcatggct

SEQ ID NO: 8034332 - DNA, 22 bp, Homo sapiens
tctagctctgcttatcatggct

SEQ ID NO: 8034333 - DNA, 22 bp, Homo sapiens
tctagctgacaacccacagcct

SEQ ID NO: 8034334 - DNA, 22 bp, Homo sapiens
tctaggaaagcctttcacaact

SEQ ID NO: 8034335 - DNA, 22 bp, Homo sapiens
tctagctttgagatcagtagcc

SEQ ID NO: 8034336 - DNA, 22 bp, Homo sapiens
tctagctgtggtcgagtgagga

SEQ ID NO: 8034337 - DNA, 22 bp, Homo sapiens
tctaggaaagcctttcacaact

SEQ ID NO: 8034338 - DNA, 22 bp, Homo sapiens
tctaggaaagcctttcacaact

SEQ ID NO: 8034339 - DNA, 22 bp, Homo sapiens
tctaggaaataatgactcatcc

SEQ ID NO: 8034340 - DNA, 22 bp, Homo sapiens
tctaggaaattgttactatatt

SEQ ID NO: 8034341 - DNA, 22 bp, Homo sapiens
tctagatttttgtgcacctttg

SEQ ID NO: 8034342 - DNA, 19 bp, Homo sapiens
tctagcaacccactgcatg

SEQ ID NO: 8034343 - DNA, 22 bp, Homo sapiens
tctagatctgcactgttggaca

SEQ ID NO: 8034344 - DNA, 22 bp, Homo sapiens
tctagatgtactgctgaagagt

SEQ ID NO: 8034345 - DNA, 22 bp, Homo sapiens
tctagattcctcctgcatcctg

SEQ ID NO: 8034346 - DNA, 22 bp, Homo sapiens
tctagatttggggcatgaagtt

SEQ ID NO: 8034347 - DNA, 22 bp, Homo sapiens
tctagatttggggcatgaagtt

SEQ ID NO: 8034348 - DNA, 22 bp, Homo sapiens
tctagcatgggaaaatcacagc

SEQ ID NO: 8034349 - DNA, 22 bp, Homo sapiens
tctagcagtagcccaaatccag

SEQ ID NO: 8034350 - DNA, 22 bp, Homo sapiens
tctagcaggtggcggccagcga

SEQ ID NO: 8034351 - DNA, 22 bp, Homo sapiens
tctagcagggaaagcagagaat

SEQ ID NO: 8034352 - DNA, 22 bp, Homo sapiens
tctagcagggaaagcagagaat

SEQ ID NO: 8034353 - DNA, 22 bp, Homo sapiens
tctagatttttgtgcacctttg

SEQ ID NO: 8034354 - DNA, 22 bp, Homo sapiens
tctagcagagggaagaggcttt

SEQ ID NO: 8034355 - DNA, 22 bp, Homo sapiens
tctagagacaaaggaaggaggg

SEQ ID NO: 8034356 - DNA, 22 bp, Homo sapiens
tctagagacaaaggaaggaggg

SEQ ID NO: 8034357 - DNA, 22 bp, Homo sapiens
tctagagactataatgtgtcct

SEQ ID NO: 8034358 - DNA, 22 bp, Homo sapiens
tctagagaaaaaactcaagtga

SEQ ID NO: 8034359 - DNA, 22 bp, Homo sapiens
tctagagaagtttccttttgaa

SEQ ID NO: 8034360 - DNA, 22 bp, Homo sapiens
tctagagaaaaaactcaagtga

SEQ ID NO: 8034361 - DNA, 22 bp, Homo sapiens
tctagacatcttggctgcaatt

SEQ ID NO: 8034362 - DNA, 22 bp, Homo sapiens
tctagacctggcactgccctgt

SEQ ID NO: 8034363 - DNA, 22 bp, Homo sapiens
tctagagattggacttcctaga

SEQ ID NO: 8034364 - DNA, 22 bp, Homo sapiens
tctagagattggacttcctaga

SEQ ID NO: 8034365 - DNA, 22 bp, Homo sapiens
tctagagatacattggtcattt

SEQ ID NO: 8034366 - DNA, 17 bp, Homo sapiens
tctagagcactttgaga

SEQ ID NO: 8034367 - DNA, 22 bp, Homo sapiens
tctagagccaaagtcttggggg

SEQ ID NO: 8034368 - DNA, 22 bp, Homo sapiens
tctagagctggagtagaatgtg

SEQ ID NO: 8034369 - DNA, 22 bp, Homo sapiens
tctagatcagtgcctgaaggaa

SEQ ID NO: 8034370 - DNA, 22 bp, Homo sapiens
tctagatcatgtctgtggtcaa

SEQ ID NO: 8034371 - DNA, 22 bp, Homo sapiens
tctagatctgcactgttggaca

SEQ ID NO: 8034372 - DNA, 22 bp, Homo sapiens
tctagatcagtgcctgaaggaa

SEQ ID NO: 8034373 - DNA, 22 bp, Homo sapiens
tctagagctggagtagaatgtg

SEQ ID NO: 8034374 - DNA, 22 bp, Homo sapiens
tctagagctttttcctcttgta

SEQ ID NO: 8034375 - DNA, 22 bp, Homo sapiens
tctattttatactcaaatcttc

SEQ ID NO: 8034376 - DNA, 22 bp, Homo sapiens
tctattttatactcaaatcttc

SEQ ID NO: 8034377 - DNA, 22 bp, Homo sapiens
tctatttgttctcaggatcatc

SEQ ID NO: 8034378 - DNA, 22 bp, Homo sapiens
tctattttatactcaaatcttc

SEQ ID NO: 8034379 - DNA, 22 bp, Homo sapiens
tctattttcttgccaaaactgc

SEQ ID NO: 8034380 - DNA, 22 bp, Homo sapiens
tctattttcttgccaaaactgc

SEQ ID NO: 8034381 - DNA, 22 bp, Homo sapiens
tctattttatactcaaatcttc

SEQ ID NO: 8034382 - DNA, 22 bp, Homo sapiens
tctattttatactcaaatcttc

SEQ ID NO: 8034383 - DNA, 22 bp, Homo sapiens
tctattcattcaatttagctct

SEQ ID NO: 8034384 - DNA, 22 bp, Homo sapiens
tctattctgataaatgcatgga

SEQ ID NO: 8034385 - DNA, 22 bp, Homo sapiens
tctattgggactctgcggtgag

SEQ ID NO: 8034386 - DNA, 22 bp, Homo sapiens
tctattggtaggggctgaggca

SEQ ID NO: 8034387 - DNA, 22 bp, Homo sapiens
tctattgggactctgcggtgag

SEQ ID NO: 8034388 - DNA, 21 bp, Homo sapiens
tctattcattacagttatttg

SEQ ID NO: 8034389 - DNA, 22 bp, Homo sapiens
tctattcaggcagagtgcagca

SEQ ID NO: 8034390 - DNA, 22 bp, Homo sapiens
tctattcattcaatttagctct

SEQ ID NO: 8034391 - DNA, 22 bp, Homo sapiens
tctattcattcaatttagctct

SEQ ID NO: 8034392 - DNA, 22 bp, Homo sapiens
tctattggtaggggctgaggca

SEQ ID NO: 8034393 - DNA, 22 bp, Homo sapiens
tctattgtgctaccagaattac

SEQ ID NO: 8034394 - DNA, 22 bp, Homo sapiens
tctatttaccaaatgtagttcc

SEQ ID NO: 8034395 - DNA, 22 bp, Homo sapiens
tctattttgtttccagctctac

SEQ ID NO: 8034396 - DNA, 22 bp, Homo sapiens
tctattttgtttccagctctac

SEQ ID NO: 8034397 - DNA, 22 bp, Homo sapiens
tctattttgtttccagctctac

SEQ ID NO: 8034398 - DNA, 22 bp, Homo sapiens
tctattttgtttccagctctac

SEQ ID NO: 8034399 - DNA, 22 bp, Homo sapiens
tctattttgtttccagctctac

SEQ ID NO: 8034400 - DNA, 22 bp, Homo sapiens
tctattttgtttccagctctac

SEQ ID NO: 8034401 - DNA, 22 bp, Homo sapiens
tctattttcttgccaaaactgc

SEQ ID NO: 8034402 - DNA, 22 bp, Homo sapiens
tctatttttatagttgaagtgc

SEQ ID NO: 8034403 - DNA, 22 bp, Homo sapiens
tctatttttatagttgaagtgc

SEQ ID NO: 8034404 - DNA, 22 bp, Homo sapiens
tctatttttatagttgaagtgc

SEQ ID NO: 8034405 - DNA, 22 bp, Homo sapiens
tctatttttatagttgaagtgc

SEQ ID NO: 8034406 - DNA, 22 bp, Homo sapiens
tctatttttatagttgaagtgc

SEQ ID NO: 8034407 - DNA, 22 bp, Homo sapiens
tctatttttatagttgaagtgc

SEQ ID NO: 8034408 - DNA, 18 bp, Homo sapiens
tctcaaaaataatggctt

SEQ ID NO: 8034409 - DNA, 22 bp, Homo sapiens
tctatttttatagttgaagtgc

SEQ ID NO: 8034410 - DNA, 22 bp, Homo sapiens
tctatttttatagttgaagtgc

SEQ ID NO: 8034411 - DNA, 22 bp, Homo sapiens
tctcaaactaacaatgattata

SEQ ID NO: 8034412 - DNA, 22 bp, Homo sapiens
tctcaaactaacaatgattata

SEQ ID NO: 8034413 - DNA, 23 bp, Homo sapiens
tctcaaatatgatctgggtcatc

SEQ ID NO: 8034414 - DNA, 23 bp, Homo sapiens
tctcaaatatgatctgggtcatc

SEQ ID NO: 8034415 - DNA, 22 bp, Homo sapiens
tctcaaataggccttggtcctg

SEQ ID NO: 8034416 - DNA, 22 bp, Homo sapiens
tctcaaatatttggagagagga

SEQ ID NO: 8034417 - DNA, 22 bp, Homo sapiens
tctcaaatatttggagagagga

SEQ ID NO: 8034418 - DNA, 19 bp, Homo sapiens
tctcacaagactgctgctc

SEQ ID NO: 8034419 - DNA, 22 bp, Homo sapiens
tctcaatttgattacattcata

SEQ ID NO: 8034420 - DNA, 22 bp, Homo sapiens
tctcaattgtgggtgaggagca

SEQ ID NO: 8034421 - DNA, 19 bp, Homo sapiens
tctcaattctccccactgc

SEQ ID NO: 8034422 - DNA, 19 bp, Homo sapiens
tctcaatgttcagaaagct

SEQ ID NO: 8034423 - DNA, 19 bp, Homo sapiens
tctcaattctccccactgc

SEQ ID NO: 8034424 - DNA, 19 bp, Homo sapiens
tctcaattctccccactgc

SEQ ID NO: 8034425 - DNA, 22 bp, Homo sapiens
tctcaattcatgaagttggaat

SEQ ID NO: 8034426 - DNA, 19 bp, Homo sapiens
tctcaattcagactgagag

SEQ ID NO: 8034427 - DNA, 22 bp, Homo sapiens
tctcaaatggacaatattgtgg

SEQ ID NO: 8034428 - DNA, 22 bp, Homo sapiens
tctcaaatggacaatattgtgg

SEQ ID NO: 8034429 - DNA, 22 bp, Homo sapiens
tctcaaatggacaatattgtgg

SEQ ID NO: 8034430 - DNA, 23 bp, Homo sapiens
tctcaaatctttgcgttgtatct

SEQ ID NO: 8034431 - DNA, 23 bp, Homo sapiens
tctcaaatctttgcgttgtatct

SEQ ID NO: 8034432 - DNA, 22 bp, Homo sapiens
tctcaaatcaaactttgagctt

SEQ ID NO: 8034433 - DNA, 22 bp, Homo sapiens
tctcaaatcaaactttgagctt

SEQ ID NO: 8034434 - DNA, 22 bp, Homo sapiens
tctcaatattatatgtcataaa

SEQ ID NO: 8034435 - DNA, 22 bp, Homo sapiens
tctcaaggactttgggcactaa

SEQ ID NO: 8034436 - DNA, 22 bp, Homo sapiens
tctcaagttatgtaacagctgt

SEQ ID NO: 8034437 - DNA, 22 bp, Homo sapiens
tctcaaggactttgggcactaa

SEQ ID NO: 8034438 - DNA, 22 bp, Homo sapiens
tctcaaggactttgggcactaa

SEQ ID NO: 8034439 - DNA, 22 bp, Homo sapiens
tctcaaatggcaaatgtgggtc

SEQ ID NO: 8034440 - DNA, 22 bp, Homo sapiens
tctcaaatggcaaatgtgggtc

SEQ ID NO: 8034441 - DNA, 23 bp, Homo sapiens
tctcacagcgatctaggaagagg

SEQ ID NO: 8034442 - DNA, 23 bp, Homo sapiens
tctcacagcgatctaggaagagg

SEQ ID NO: 8034443 - DNA, 19 bp, Homo sapiens
tctcacagctctactatgt

SEQ ID NO: 8034444 - DNA, 23 bp, Homo sapiens
tctcacagcgatctaggaagagg

SEQ ID NO: 8034445 - DNA, 19 bp, Homo sapiens
tctcacagctctactatgt

SEQ ID NO: 8034446 - DNA, 22 bp, Homo sapiens
tctcacagggctaggccctgcc

SEQ ID NO: 8034447 - DNA, 22 bp, Homo sapiens
tctcacagggctaggccctgcc

SEQ ID NO: 8034448 - DNA, 22 bp, Homo sapiens
tctcacagctctgctgcatgct

SEQ ID NO: 8034449 - DNA, 22 bp, Homo sapiens
tctcacagctctgctgcatgct

SEQ ID NO: 8034450 - DNA, 22 bp, Homo sapiens
tctcacagctctgctgcatgct

SEQ ID NO: 8034451 - DNA, 22 bp, Homo sapiens
tctcacagccatttctccctct

SEQ ID NO: 8034452 - DNA, 22 bp, Homo sapiens
tctcacagcattatccagggca

SEQ ID NO: 8034453 - DNA, 22 bp, Homo sapiens
tctcacagcaggggccaggtct

SEQ ID NO: 8034454 - DNA, 22 bp, Homo sapiens
tctcacagcaggggccaggtct

SEQ ID NO: 8034455 - DNA, 22 bp, Homo sapiens
tctcacagcaggggccaggtct

SEQ ID NO: 8034456 - DNA, 22 bp, Homo sapiens
tctcacagcatcattgctcatg

SEQ ID NO: 8034457 - DNA, 22 bp, Homo sapiens
tctcacagcaggggccaggtct

SEQ ID NO: 8034458 - DNA, 22 bp, Homo sapiens
tctcacagcagagaagggacat

SEQ ID NO: 8034459 - DNA, 22 bp, Homo sapiens
tctcacagatcagcagggggct

SEQ ID NO: 8034460 - DNA, 22 bp, Homo sapiens
tctcacagaggcttgggctcat

SEQ ID NO: 8034461 - DNA, 22 bp, Homo sapiens
tctcacacttctgtgttgcaca

SEQ ID NO: 8034462 - DNA, 20 bp, Homo sapiens
tctcacagacatcgtctcat

SEQ ID NO: 8034463 - DNA, 22 bp, Homo sapiens
tctcacactatttattctgctt

SEQ ID NO: 8034464 - DNA, 22 bp, Homo sapiens
tctcacaccgtccctaaaccat

SEQ ID NO: 8034465 - DNA, 22 bp, Homo sapiens
tctcacaccgtccctaaaccat

SEQ ID NO: 8034466 - DNA, 22 bp, Homo sapiens
tctatgttgtgtgtcacacaga

SEQ ID NO: 8034467 - DNA, 22 bp, Homo sapiens
tctattacttaccactaattca

SEQ ID NO: 8034468 - DNA, 22 bp, Homo sapiens
tctattactcttttaaggaaaa

SEQ ID NO: 8034469 - DNA, 22 bp, Homo sapiens
tctattaatgattcaatagtgt

SEQ ID NO: 8034470 - DNA, 22 bp, Homo sapiens
tctattaatgattcaatagtgt

SEQ ID NO: 8034471 - DNA, 19 bp, Homo sapiens
tctatgtggcagtgatggc

SEQ ID NO: 8034472 - DNA, 22 bp, Homo sapiens
tctatgtgccctttgtgtgatg

SEQ ID NO: 8034473 - DNA, 22 bp, Homo sapiens
tctatgttgtgtgtcacacaga

SEQ ID NO: 8034474 - DNA, 22 bp, Homo sapiens
tctattatggtacttatcatga

SEQ ID NO: 8034475 - DNA, 22 bp, Homo sapiens
tctattatggtacttatcatga

SEQ ID NO: 8034476 - DNA, 22 bp, Homo sapiens
tctattagaatgttctttttca

SEQ ID NO: 8034477 - DNA, 22 bp, Homo sapiens
tctattagattattctcaagga

SEQ ID NO: 8034478 - DNA, 22 bp, Homo sapiens
tctatgtctccaccttcgcaga

SEQ ID NO: 8034479 - DNA, 22 bp, Homo sapiens
tctatgtatggaccttttctgt

SEQ ID NO: 8034480 - DNA, 22 bp, Homo sapiens
tctatgtcagcatctttctacc

SEQ ID NO: 8034481 - DNA, 22 bp, Homo sapiens
tctatgtcctttctcccattcc

SEQ ID NO: 8034482 - DNA, 21 bp, Homo sapiens
tctatgtacgcatctatgcct

SEQ ID NO: 8034483 - DNA, 22 bp, Homo sapiens
tctatgtaaagccatattgata

SEQ ID NO: 8034484 - DNA, 22 bp, Homo sapiens
tctatggggcctcacaggcact

SEQ ID NO: 8034485 - DNA, 22 bp, Homo sapiens
tctatggggcctcacaggcact

SEQ ID NO: 8034486 - DNA, 19 bp, Homo sapiens
tctatgggctttttgtagt

SEQ ID NO: 8034487 - DNA, 22 bp, Homo sapiens
tctatgtagtgccagctagtat

SEQ ID NO: 8034488 - DNA, 22 bp, Homo sapiens
tctataaatgcagatatgtgtg

SEQ ID NO: 8034489 - DNA, 22 bp, Homo sapiens
tctataaatgcagatatgtgtg

SEQ ID NO: 8034490 - DNA, 22 bp, Homo sapiens
tctataaatgcagatatgtgtg

SEQ ID NO: 8034491 - DNA, 22 bp, Homo sapiens
tctatattttgaaaggtattta

SEQ ID NO: 8034492 - DNA, 22 bp, Homo sapiens
tctataaagggccagatagtag

SEQ ID NO: 8034493 - DNA, 22 bp, Homo sapiens
tctataaagggccagatagtag

SEQ ID NO: 8034494 - DNA, 22 bp, Homo sapiens
tctataaagggccagatagtag

SEQ ID NO: 8034495 - DNA, 22 bp, Homo sapiens
tctatcctgcttagaagtatgt

SEQ ID NO: 8034496 - DNA, 22 bp, Homo sapiens
tctatctcccttattcctggcc

SEQ ID NO: 8034497 - DNA, 21 bp, Homo sapiens
tctatctctagtccgctgcac

SEQ ID NO: 8034498 - DNA, 21 bp, Homo sapiens
tctatctctagtccgctgcac

SEQ ID NO: 8034499 - DNA, 22 bp, Homo sapiens
tctatctggccccttttatata

SEQ ID NO: 8034500 - DNA, 22 bp, Homo sapiens
tctatctgaggaggtgacattt

SEQ ID NO: 8034501 - DNA, 22 bp, Homo sapiens
tctatctggccccttttatata

SEQ ID NO: 8034502 - DNA, 22 bp, Homo sapiens
tctatgaaaaactgttaagctc

SEQ ID NO: 8034503 - DNA, 22 bp, Homo sapiens
tctatgaacaaagtggtttata

SEQ ID NO: 8034504 - DNA, 21 bp, Homo sapiens
tctatgaacatggagaagggc

SEQ ID NO: 8034505 - DNA, 22 bp, Homo sapiens
tctatgaagtgcgaagaggcac

SEQ ID NO: 8034506 - DNA, 22 bp, Homo sapiens
tctatgaacctctgcaatgaca

SEQ ID NO: 8034507 - DNA, 22 bp, Homo sapiens
tctatgaagtgcgaagaggcac

SEQ ID NO: 8034508 - DNA, 22 bp, Homo sapiens
tctatgaatgacacagataata

SEQ ID NO: 8034509 - DNA, 21 bp, Homo sapiens
tctatgcaagaccctagtcct

SEQ ID NO: 8034510 - DNA, 22 bp, Homo sapiens
tctatgaatgacacagataata

SEQ ID NO: 8034511 - DNA, 22 bp, Homo sapiens
tctataaaactcaagagcaatt

SEQ ID NO: 8034512 - DNA, 22 bp, Homo sapiens
tctataaaactcaagagcaatt

SEQ ID NO: 8034513 - DNA, 22 bp, Homo sapiens
tctataaaactcaagagcaatt

SEQ ID NO: 8034514 - DNA, 22 bp, Homo sapiens
tctataaaactcaagagcaatt

SEQ ID NO: 8034515 - DNA, 22 bp, Homo sapiens
tctataaaactcaagagcaatt

SEQ ID NO: 8034516 - DNA, 22 bp, Homo sapiens
tctataaagggccagatagtag

SEQ ID NO: 8034517 - DNA, 22 bp, Homo sapiens
tctataaagggccagatagtag

SEQ ID NO: 8034518 - DNA, 22 bp, Homo sapiens
tctataaaactcaagagcaatt

SEQ ID NO: 8034519 - DNA, 22 bp, Homo sapiens
tctataaaactcaagagcaatt

SEQ ID NO: 8034520 - DNA, 22 bp, Homo sapiens
tctataaagggccagatagtag

SEQ ID NO: 8034521 - DNA, 22 bp, Homo sapiens
tctataaagggccagatagtag

SEQ ID NO: 8034522 - DNA, 22 bp, Homo sapiens
tctagttctagatccctgagga

SEQ ID NO: 8034523 - DNA, 22 bp, Homo sapiens
tctagttctagatccctgagga

SEQ ID NO: 8034524 - DNA, 22 bp, Homo sapiens
tctagttctagatccctgagga

SEQ ID NO: 8034525 - DNA, 22 bp, Homo sapiens
tctagtgttaaggcaaagtaaa

SEQ ID NO: 8034526 - DNA, 19 bp, Homo sapiens
tctagtgtgaccaccagat

SEQ ID NO: 8034527 - DNA, 22 bp, Homo sapiens
tctagtgttttggaacatggaa

SEQ ID NO: 8034528 - DNA, 22 bp, Homo sapiens
tctagtgttttggaacatggaa

SEQ ID NO: 8034529 - DNA, 22 bp, Homo sapiens
tctagttgtgagaaagcaatgt

SEQ ID NO: 8034530 - DNA, 22 bp, Homo sapiens
tctagtttaagatctgttagtc

SEQ ID NO: 8034531 - DNA, 22 bp, Homo sapiens
tctagttttagcttgagttgca

SEQ ID NO: 8034532 - DNA, 22 bp, Homo sapiens
tctagttttctcaaatgacttg

SEQ ID NO: 8034533 - DNA, 22 bp, Homo sapiens
tctagttttctcaaatgacttg

SEQ ID NO: 8034534 - DNA, 22 bp, Homo sapiens
tctagttttggtatgagatgca

SEQ ID NO: 8034535 - DNA, 22 bp, Homo sapiens
tctagttttggtatgagatgca

SEQ ID NO: 8034536 - DNA, 19 bp, Homo sapiens
tctagttttgagagacttc

SEQ ID NO: 8034537 - DNA, 19 bp, Homo sapiens
tctagttttgagagacttc

SEQ ID NO: 8034538 - DNA, 15 bp, Homo sapiens
tctagttttgaagac

SEQ ID NO: 8034539 - DNA, 20 bp, Homo sapiens
tctaggctagattttgtcat

SEQ ID NO: 8034540 - DNA, 22 bp, Homo sapiens
tctagggaacatgggtcaagct

SEQ ID NO: 8034541 - DNA, 22 bp, Homo sapiens
tctagggaacctatcctatgat

SEQ ID NO: 8034542 - DNA, 22 bp, Homo sapiens
tctaggcattgttattacaact

SEQ ID NO: 8034543 - DNA, 22 bp, Homo sapiens
tctaggaacctgacatctctca

SEQ ID NO: 8034544 - DNA, 22 bp, Homo sapiens
tctaggccgtaggatacagagc

SEQ ID NO: 8034545 - DNA, 22 bp, Homo sapiens
tctaggcccaggcctgcggctg

SEQ ID NO: 8034546 - DNA, 22 bp, Homo sapiens
tctagggagaagctctgtctgt

SEQ ID NO: 8034547 - DNA, 22 bp, Homo sapiens
tctagggaatagtagagtttct

SEQ ID NO: 8034548 - DNA, 22 bp, Homo sapiens
tctagggaattgtggttttctt

SEQ ID NO: 8034549 - DNA, 22 bp, Homo sapiens
tctagggagaagctctgtctgt

SEQ ID NO: 8034550 - DNA, 22 bp, Homo sapiens
tctagggagaagctctgtctgt

SEQ ID NO: 8034551 - DNA, 22 bp, Homo sapiens
tctagggagctctagcagtggt

SEQ ID NO: 8034552 - DNA, 22 bp, Homo sapiens
tctagggtccacagggtcagcc

SEQ ID NO: 8034553 - DNA, 22 bp, Homo sapiens
tctagggtccacagggtcagcc

SEQ ID NO: 8034554 - DNA, 22 bp, Homo sapiens
tctagggagagttgttatgggt

SEQ ID NO: 8034555 - DNA, 20 bp, Homo sapiens
tctagggatggcatatgtct

SEQ ID NO: 8034556 - DNA, 22 bp, Homo sapiens
tctagggaggcaatagcaatgt

SEQ ID NO: 8034557 - DNA, 22 bp, Homo sapiens
tctaggtggatgaggaacatag

SEQ ID NO: 8034558 - DNA, 22 bp, Homo sapiens
tctaggtagcgatacagcagca

SEQ ID NO: 8034559 - DNA, 22 bp, Homo sapiens
tctagtcaatagaggtcacact

SEQ ID NO: 8034560 - DNA, 22 bp, Homo sapiens
tctaggttagaacccagaaaag

SEQ ID NO: 8034561 - DNA, 22 bp, Homo sapiens
tctagtctcagccttcacctaa

SEQ ID NO: 8034562 - DNA, 22 bp, Homo sapiens
tctagtcctaggagaggagtca

SEQ ID NO: 8034563 - DNA, 22 bp, Homo sapiens
tctagtcatattttttcagtat

SEQ ID NO: 8034564 - DNA, 22 bp, Homo sapiens
tctagggttgaggccacaggga

SEQ ID NO: 8034565 - DNA, 22 bp, Homo sapiens
tctagggtgtgcggcagggcta

SEQ ID NO: 8034566 - DNA, 22 bp, Homo sapiens
tctagggtgtgcggcagggcta

SEQ ID NO: 8034567 - DNA, 22 bp, Homo sapiens
tctagggtgttacatacctgct

SEQ ID NO: 8034568 - DNA, 22 bp, Homo sapiens
tctagggtggagctgggaatcc

SEQ ID NO: 8034569 - DNA, 20 bp, Homo sapiens
tctagggtggctgtagcagc

SEQ ID NO: 8034570 - DNA, 22 bp, Homo sapiens
tctaggggtgcagaagggatcc

SEQ ID NO: 8034571 - DNA, 22 bp, Homo sapiens
tctagggtgtataaggaagcct

SEQ ID NO: 8034572 - DNA, 22 bp, Homo sapiens
tctctggaagcgcagatctgtt

SEQ ID NO: 8034573 - DNA, 22 bp, Homo sapiens
tctctggaagcgcagatctgtt

SEQ ID NO: 8034574 - DNA, 22 bp, Homo sapiens
tctctgcttggtgtatgtgagt

SEQ ID NO: 8034575 - DNA, 21 bp, Homo sapiens
tctctggaattagaccatgtt

SEQ ID NO: 8034576 - DNA, 21 bp, Homo sapiens
tctctggaattagaccatgtt

SEQ ID NO: 8034577 - DNA, 22 bp, Homo sapiens
tctctggaattggctgaggcaa

SEQ ID NO: 8034578 - DNA, 22 bp, Homo sapiens
tctctggaattggctgaggcaa

SEQ ID NO: 8034579 - DNA, 21 bp, Homo sapiens
tctctggagttagcagagaga

SEQ ID NO: 8034580 - DNA, 21 bp, Homo sapiens
tctctggagttagcagagaga

SEQ ID NO: 8034581 - DNA, 22 bp, Homo sapiens
tctctggagtataaccagggat

SEQ ID NO: 8034582 - DNA, 22 bp, Homo sapiens
tctctggagggctccaggcggg

SEQ ID NO: 8034583 - DNA, 22 bp, Homo sapiens
tctctggaattttgagagtgac

SEQ ID NO: 8034584 - DNA, 22 bp, Homo sapiens
tctctggacttccacctctatt

SEQ ID NO: 8034585 - DNA, 22 bp, Homo sapiens
tctctggactcgagcttactca

SEQ ID NO: 8034586 - DNA, 22 bp, Homo sapiens
tctctggagggctccaggcggg

SEQ ID NO: 8034587 - DNA, 22 bp, Homo sapiens
tctctggacttccacctctatt

SEQ ID NO: 8034588 - DNA, 22 bp, Homo sapiens
tctctggagctgcagatccagg

SEQ ID NO: 8034589 - DNA, 22 bp, Homo sapiens
tctctgctaagattgtgtctag

SEQ ID NO: 8034590 - DNA, 22 bp, Homo sapiens
tctctgctaagattgtgtctag

SEQ ID NO: 8034591 - DNA, 22 bp, Homo sapiens
tctctgctctgtgcctcagttt

SEQ ID NO: 8034592 - DNA, 22 bp, Homo sapiens
tctctgctcaggcaccagccct

SEQ ID NO: 8034593 - DNA, 22 bp, Homo sapiens
tctctgctcaggcaccagccct

SEQ ID NO: 8034594 - DNA, 22 bp, Homo sapiens
tctctgctcaggcaccagccct

SEQ ID NO: 8034595 - DNA, 22 bp, Homo sapiens
tctctgagttctcctccagccc

SEQ ID NO: 8034596 - DNA, 22 bp, Homo sapiens
tctctgagttctcctccagccc

SEQ ID NO: 8034597 - DNA, 19 bp, Homo sapiens
tctctgccgatcagggccc

SEQ ID NO: 8034598 - DNA, 19 bp, Homo sapiens
tctctgccgatcagggccc

SEQ ID NO: 8034599 - DNA, 22 bp, Homo sapiens
tctctgctctgtgcctcagttt

SEQ ID NO: 8034600 - DNA, 22 bp, Homo sapiens
tctctgctctgtgcctcagttt

SEQ ID NO: 8034601 - DNA, 22 bp, Homo sapiens
tctctgctctgtgcctcagttt

SEQ ID NO: 8034602 - DNA, 22 bp, Homo sapiens
tctctgctctgtgcctcagttt

SEQ ID NO: 8034603 - DNA, 19 bp, Homo sapiens
tctctgcttctcttggcat

SEQ ID NO: 8034604 - DNA, 20 bp, Homo sapiens
tctctgctgtccacatttgc

SEQ ID NO: 8034605 - DNA, 19 bp, Homo sapiens
tctctgcttctcttggcat

SEQ ID NO: 8034606 - DNA, 19 bp, Homo sapiens
tctctgcttctcttggcat

SEQ ID NO: 8034607 - DNA, 22 bp, Homo sapiens
tctctggcagacacctccctga

SEQ ID NO: 8034608 - DNA, 22 bp, Homo sapiens
tctctggcagacacctccctga

SEQ ID NO: 8034609 - DNA, 22 bp, Homo sapiens
tctctggcactcccttatggct

SEQ ID NO: 8034610 - DNA, 22 bp, Homo sapiens
tctctggcagacacctccctga

SEQ ID NO: 8034611 - DNA, 22 bp, Homo sapiens
tctctggcagacacctccctga

SEQ ID NO: 8034612 - DNA, 22 bp, Homo sapiens
tctctggcacataataaggtct

SEQ ID NO: 8034613 - DNA, 22 bp, Homo sapiens
tctctggcactcccttatggct

SEQ ID NO: 8034614 - DNA, 22 bp, Homo sapiens
tctctggcacataataaggtct

SEQ ID NO: 8034615 - DNA, 22 bp, Homo sapiens
tctctggcactcccttatggct

SEQ ID NO: 8034616 - DNA, 22 bp, Homo sapiens
tctctggcacataataaggtct

SEQ ID NO: 8034617 - DNA, 20 bp, Homo sapiens
tctctggcaagaagctgcag

SEQ ID NO: 8034618 - DNA, 22 bp, Homo sapiens
tctctggcacataataaggtct

SEQ ID NO: 8034619 - DNA, 20 bp, Homo sapiens
tctctggcaagaagctgcag

SEQ ID NO: 8034620 - DNA, 20 bp, Homo sapiens
tctctggcaagaagctgcag

SEQ ID NO: 8034621 - DNA, 20 bp, Homo sapiens
tctctggcaagaagctgcag

SEQ ID NO: 8034622 - DNA, 20 bp, Homo sapiens
tctctggcaagaagctgcag

SEQ ID NO: 8034623 - DNA, 21 bp, Homo sapiens
tctctggagttagcagagaga

SEQ ID NO: 8034624 - DNA, 19 bp, Homo sapiens
tctctggatgacagacact

SEQ ID NO: 8034625 - DNA, 22 bp, Homo sapiens
tctctggcagaggccctatccc

SEQ ID NO: 8034626 - DNA, 22 bp, Homo sapiens
tctctggcagaggccctatccc

SEQ ID NO: 8034627 - DNA, 22 bp, Homo sapiens
tctctggcagaggccctatccc

SEQ ID NO: 8034628 - DNA, 22 bp, Homo sapiens
tctctggcagaggccctatccc

SEQ ID NO: 8034629 - DNA, 22 bp, Homo sapiens
tctctggcagactggctgggct

SEQ ID NO: 8034630 - DNA, 22 bp, Homo sapiens
tctctggcagactggctgggct

SEQ ID NO: 8034631 - DNA, 22 bp, Homo sapiens
tctctggcagactggctgggct

SEQ ID NO: 8034632 - DNA, 22 bp, Homo sapiens
tctctggcagactggctgggct

SEQ ID NO: 8034633 - DNA, 19 bp, Homo sapiens
tctctggcagttcagagca

SEQ ID NO: 8034634 - DNA, 19 bp, Homo sapiens
tctctggcagttcagagca

SEQ ID NO: 8034635 - DNA, 22 bp, Homo sapiens
tctctggcagggatatctggct

SEQ ID NO: 8034636 - DNA, 22 bp, Homo sapiens
tctctggcagggatatctggct

SEQ ID NO: 8034637 - DNA, 22 bp, Homo sapiens
tctctggcagggatatctggct

SEQ ID NO: 8034638 - DNA, 22 bp, Homo sapiens
tctctggcagggatatctggct

SEQ ID NO: 8034639 - DNA, 22 bp, Homo sapiens
tctctggcagcttgtgctgttg

SEQ ID NO: 8034640 - DNA, 22 bp, Homo sapiens
tctctggcagcttgtgctgttg

SEQ ID NO: 8034641 - DNA, 22 bp, Homo sapiens
tctctggcagcttgtgctgttg

SEQ ID NO: 8034642 - DNA, 22 bp, Homo sapiens
tctctggcagaggccctatccc

SEQ ID NO: 8034643 - DNA, 20 bp, Homo sapiens
tctctggccagaaacaacag

SEQ ID NO: 8034644 - DNA, 22 bp, Homo sapiens
tctctggccccatggctgagct

SEQ ID NO: 8034645 - DNA, 22 bp, Homo sapiens
tctctggccccatggctgagct

SEQ ID NO: 8034646 - DNA, 22 bp, Homo sapiens
tctctggccccatggctgagct

SEQ ID NO: 8034647 - DNA, 22 bp, Homo sapiens
tctctggccccatggctgagct

SEQ ID NO: 8034648 - DNA, 22 bp, Homo sapiens
tctctggccccatggctgagct

SEQ ID NO: 8034649 - DNA, 22 bp, Homo sapiens
tctctggccctgttttctatct

SEQ ID NO: 8034650 - DNA, 22 bp, Homo sapiens
tctctggccctgttttctatct

SEQ ID NO: 8034651 - DNA, 22 bp, Homo sapiens
tctctggccccatggctgagct

SEQ ID NO: 8034652 - DNA, 19 bp, Homo sapiens
tctctggcagttcagagca

SEQ ID NO: 8034653 - DNA, 19 bp, Homo sapiens
tctctggcatagactcaat

SEQ ID NO: 8034654 - DNA, 19 bp, Homo sapiens
tctctggcagttcagagca

SEQ ID NO: 8034655 - DNA, 19 bp, Homo sapiens
tctctggcagttcagagca

SEQ ID NO: 8034656 - DNA, 20 bp, Homo sapiens
tctctggccagaaacaacag

SEQ ID NO: 8034657 - DNA, 20 bp, Homo sapiens
tctctggccagaaacaacag

SEQ ID NO: 8034658 - DNA, 20 bp, Homo sapiens
tctctggccagaaacaacag

SEQ ID NO: 8034659 - DNA, 19 bp, Homo sapiens
tctctggcatagactcaat

SEQ ID NO: 8034660 - DNA, 19 bp, Homo sapiens
tctctggcatagactcaat

SEQ ID NO: 8034661 - DNA, 19 bp, Homo sapiens
tctctggcatagactcaat

SEQ ID NO: 8034662 - DNA, 22 bp, Homo sapiens
tctctggctgatattcctctgc

SEQ ID NO: 8034663 - DNA, 22 bp, Homo sapiens
tctctggctggcaccccaggga

SEQ ID NO: 8034664 - DNA, 22 bp, Homo sapiens
tctctggctggcaccccaggga

SEQ ID NO: 8034665 - DNA, 22 bp, Homo sapiens
tctctggctggcaccccaggga

SEQ ID NO: 8034666 - DNA, 22 bp, Homo sapiens
tctctggctgatattcctctgc

SEQ ID NO: 8034667 - DNA, 22 bp, Homo sapiens
tctctggctcctgccgggtcca

SEQ ID NO: 8034668 - DNA, 22 bp, Homo sapiens
tctctggctcctgccgggtcca

SEQ ID NO: 8034669 - DNA, 22 bp, Homo sapiens
tctctggctcctgccgggtcca

SEQ ID NO: 8034670 - DNA, 22 bp, Homo sapiens
tctctggctgatattcctctgc

SEQ ID NO: 8034671 - DNA, 22 bp, Homo sapiens
tctctggctgatattcctctgc

SEQ ID NO: 8034672 - DNA, 22 bp, Homo sapiens
tctctggctgatattcctctgc

SEQ ID NO: 8034673 - DNA, 21 bp, Homo sapiens
tctctggcggtgtttggctcc

SEQ ID NO: 8034674 - DNA, 22 bp, Homo sapiens
tctctggctcctgccgggtcca

SEQ ID NO: 8034675 - DNA, 21 bp, Homo sapiens
tctctggcggtgtttggctcc

SEQ ID NO: 8034676 - DNA, 21 bp, Homo sapiens
tctctggcggtgtttggctcc

SEQ ID NO: 8034677 - DNA, 23 bp, Homo sapiens
tctctggcctttgatcaggttga

SEQ ID NO: 8034678 - DNA, 23 bp, Homo sapiens
tctctggcctttgatcaggttga

SEQ ID NO: 8034679 - DNA, 23 bp, Homo sapiens
tctctggcctttgatcaggttga

SEQ ID NO: 8034680 - DNA, 23 bp, Homo sapiens
tctctggcctttgatcaggttga

SEQ ID NO: 8034681 - DNA, 22 bp, Homo sapiens
tctctggccgagagtccctggg

SEQ ID NO: 8034682 - DNA, 22 bp, Homo sapiens
tctctggccctgttttctatct

SEQ ID NO: 8034683 - DNA, 22 bp, Homo sapiens
tctctggccgagagtccctggg

SEQ ID NO: 8034684 - DNA, 22 bp, Homo sapiens
tctctggccgagagtccctggg

SEQ ID NO: 8034685 - DNA, 23 bp, Homo sapiens
tctctggcctttgatcaggttga

SEQ ID NO: 8034686 - DNA, 22 bp, Homo sapiens
tctctggggcctttctacatca

SEQ ID NO: 8034687 - DNA, 22 bp, Homo sapiens
tctctggggatggacctgggag

SEQ ID NO: 8034688 - DNA, 22 bp, Homo sapiens
tctctggggatggacctgggag

SEQ ID NO: 8034689 - DNA, 22 bp, Homo sapiens
tctctggggatggacctgggag

SEQ ID NO: 8034690 - DNA, 22 bp, Homo sapiens
tctctgggggtagaactcaggc

SEQ ID NO: 8034691 - DNA, 22 bp, Homo sapiens
tctctggggcctttctacatca

SEQ ID NO: 8034692 - DNA, 22 bp, Homo sapiens
tctctggggcctttctacatca

SEQ ID NO: 8034693 - DNA, 22 bp, Homo sapiens
tctctgggggtagaactcaggc

SEQ ID NO: 8034694 - DNA, 22 bp, Homo sapiens
tctctggggtagggcccaggac

SEQ ID NO: 8034695 - DNA, 22 bp, Homo sapiens
tctctgggtaaagttctctcat

SEQ ID NO: 8034696 - DNA, 22 bp, Homo sapiens
tctctgggtaaagttctctcat

SEQ ID NO: 8034697 - DNA, 22 bp, Homo sapiens
tctctggggtagggcccaggac

SEQ ID NO: 8034698 - DNA, 22 bp, Homo sapiens
tctctggggtagggcccaggac

SEQ ID NO: 8034699 - DNA, 22 bp, Homo sapiens
tctctgggtatggtaacgttgg

SEQ ID NO: 8034700 - DNA, 22 bp, Homo sapiens
tctctgggtattcactgccttc

SEQ ID NO: 8034701 - DNA, 22 bp, Homo sapiens
tctctgggtattcactgccttc

SEQ ID NO: 8034702 - DNA, 22 bp, Homo sapiens
tctctgggtcctggcaagctca

SEQ ID NO: 8034703 - DNA, 22 bp, Homo sapiens
tctctgggtcctggcaagctca

SEQ ID NO: 8034704 - DNA, 22 bp, Homo sapiens
tctctgggtattcactgccttc

SEQ ID NO: 8034705 - DNA, 20 bp, Homo sapiens
tctctgggttctcactcagc

SEQ ID NO: 8034706 - DNA, 23 bp, Homo sapiens
tctctgggtgggctgtgtctata

SEQ ID NO: 8034707 - DNA, 20 bp, Homo sapiens
tctctgggttctcactcagc

SEQ ID NO: 8034708 - DNA, 22 bp, Homo sapiens
tctctgggttctcactcagcac

SEQ ID NO: 8034709 - DNA, 22 bp, Homo sapiens
tctctgggttctcactcagcac

SEQ ID NO: 8034710 - DNA, 22 bp, Homo sapiens
tctctgggttctcactcagcac

SEQ ID NO: 8034711 - DNA, 22 bp, Homo sapiens
tctctgggttgagaactaggac

SEQ ID NO: 8034712 - DNA, 16 bp, Homo sapiens
tctctgggttgcacag

SEQ ID NO: 8034713 - DNA, 22 bp, Homo sapiens
tctctgggttctcactcagcac

SEQ ID NO: 8034714 - DNA, 22 bp, Homo sapiens
tctctgggttgagaactaggac

SEQ ID NO: 8034715 - DNA, 22 bp, Homo sapiens
tctctgggttgagaactaggac

SEQ ID NO: 8034716 - DNA, 22 bp, Homo sapiens
tctctgggttgagaactaggac

SEQ ID NO: 8034717 - DNA, 23 bp, Homo sapiens
tctctgggtgggctgtgtctata

SEQ ID NO: 8034718 - DNA, 22 bp, Homo sapiens
tctctgggtgatggcagggcac

SEQ ID NO: 8034719 - DNA, 22 bp, Homo sapiens
tctctgggtgatggcagggcac

SEQ ID NO: 8034720 - DNA, 22 bp, Homo sapiens
tctctgggtgatggcagggcac

SEQ ID NO: 8034721 - DNA, 22 bp, Homo sapiens
tctctgggtgatggcagggcac

SEQ ID NO: 8034722 - DNA, 22 bp, Homo sapiens
tctctgggtctcagtttgtaca

SEQ ID NO: 8034723 - DNA, 22 bp, Homo sapiens
tctctgggtcctggcaagctca

SEQ ID NO: 8034724 - DNA, 22 bp, Homo sapiens
tctctgggtcctggcaagctca

SEQ ID NO: 8034725 - DNA, 22 bp, Homo sapiens
tctctgggtctcagtttgtaca

SEQ ID NO: 8034726 - DNA, 22 bp, Homo sapiens
tctctgggtcctggcaagctca

SEQ ID NO: 8034727 - DNA, 22 bp, Homo sapiens
tctctgggtgatggcagggcac

SEQ ID NO: 8034728 - DNA, 22 bp, Homo sapiens
tctctgggtgatggcagggcac

SEQ ID NO: 8034729 - DNA, 22 bp, Homo sapiens
tctctgggtgatggcagggcac

SEQ ID NO: 8034730 - DNA, 22 bp, Homo sapiens
tctctgggctcaggagcccggc

SEQ ID NO: 8034731 - DNA, 22 bp, Homo sapiens
tctctgggctcaggagcccggc

SEQ ID NO: 8034732 - DNA, 22 bp, Homo sapiens
tctctgggctcaggagcccggc

SEQ ID NO: 8034733 - DNA, 22 bp, Homo sapiens
tctctggggaaaaggctgatac

SEQ ID NO: 8034734 - DNA, 22 bp, Homo sapiens
tctctggggaaaaggctgatac

SEQ ID NO: 8034735 - DNA, 22 bp, Homo sapiens
tctctggggaaaaggctgatac

SEQ ID NO: 8034736 - DNA, 19 bp, Homo sapiens
tctctggggacactttcac

SEQ ID NO: 8034737 - DNA, 19 bp, Homo sapiens
tctctggggacactttcac

SEQ ID NO: 8034738 - DNA, 22 bp, Homo sapiens
tctctggggaaaaggctgatac

SEQ ID NO: 8034739 - DNA, 22 bp, Homo sapiens
tctctggggatgcttattcttg

SEQ ID NO: 8034740 - DNA, 22 bp, Homo sapiens
tctctggggatgcttattcttg

SEQ ID NO: 8034741 - DNA, 22 bp, Homo sapiens
tctctgggcctgttttctcatc

SEQ ID NO: 8034742 - DNA, 22 bp, Homo sapiens
tctctgggcctgttttctcatc

SEQ ID NO: 8034743 - DNA, 22 bp, Homo sapiens
tctctgggcctccctttccaag

SEQ ID NO: 8034744 - DNA, 22 bp, Homo sapiens
tctctgggcctccctttccaag

SEQ ID NO: 8034745 - DNA, 22 bp, Homo sapiens
tctctgggcctcagttttctca

SEQ ID NO: 8034746 - DNA, 22 bp, Homo sapiens
tctctgggcctccctttccaag

SEQ ID NO: 8034747 - DNA, 22 bp, Homo sapiens
tctctgggctcaggagcccggc

SEQ ID NO: 8034748 - DNA, 22 bp, Homo sapiens
tctctgggctaaaatcaaggtg

SEQ ID NO: 8034749 - DNA, 22 bp, Homo sapiens
tctctgggctaaaatcaaggtg

SEQ ID NO: 8034750 - DNA, 19 bp, Homo sapiens
tctctggcttgtctgcctg

SEQ ID NO: 8034751 - DNA, 19 bp, Homo sapiens
tctctggcttgtctgcctg

SEQ ID NO: 8034752 - DNA, 22 bp, Homo sapiens
tctctggcttaggttgagtgca

SEQ ID NO: 8034753 - DNA, 22 bp, Homo sapiens
tctctggcttaggttgagtgca

SEQ ID NO: 8034754 - DNA, 19 bp, Homo sapiens
tctctggcttgtctgcctg

SEQ ID NO: 8034755 - DNA, 19 bp, Homo sapiens
tctctggcttgtctgcctg

SEQ ID NO: 8034756 - DNA, 22 bp, Homo sapiens
tctctggctggcaccccaggga

SEQ ID NO: 8034757 - DNA, 22 bp, Homo sapiens
tctctggcttaggttgagtgca

SEQ ID NO: 8034758 - DNA, 22 bp, Homo sapiens
tctctgggatcaggtggcccag

SEQ ID NO: 8034759 - DNA, 22 bp, Homo sapiens
tctctgggaaatggagaatttt

SEQ ID NO: 8034760 - DNA, 19 bp, Homo sapiens
tctctggcttgtctgcctg

SEQ ID NO: 8034761 - DNA, 22 bp, Homo sapiens
tctctgggatcgttttgggctc

SEQ ID NO: 8034762 - DNA, 22 bp, Homo sapiens
tctctgggatcaggtggcccag

SEQ ID NO: 8034763 - DNA, 21 bp, Homo sapiens
tctctgggccctcctgtgggg

SEQ ID NO: 8034764 - DNA, 22 bp, Homo sapiens
tctctgggcccagaccttcctt

SEQ ID NO: 8034765 - DNA, 22 bp, Homo sapiens
tctctgggcccagaccttcctt

SEQ ID NO: 8034766 - DNA, 21 bp, Homo sapiens
tctctgggccctcctgtgggg

SEQ ID NO: 8034767 - DNA, 22 bp, Homo sapiens
tctctgggcctcagttttctca

SEQ ID NO: 8034768 - DNA, 21 bp, Homo sapiens
tctctgggccctcctgtgggg

SEQ ID NO: 8034769 - DNA, 21 bp, Homo sapiens
tctctgggccctcctgtgggg

SEQ ID NO: 8034770 - DNA, 21 bp, Homo sapiens
tctctgggccctcctgtgggg

SEQ ID NO: 8034771 - DNA, 22 bp, Homo sapiens
tctctctgccaactcacagcca

SEQ ID NO: 8034772 - DNA, 18 bp, Homo sapiens
tctctctgataacatttt

SEQ ID NO: 8034773 - DNA, 22 bp, Homo sapiens
tctctctgccaactcacagcca

SEQ ID NO: 8034774 - DNA, 22 bp, Homo sapiens
tctctctgccaactcacagcca

SEQ ID NO: 8034775 - DNA, 22 bp, Homo sapiens
tctctctggagctggggcatga

SEQ ID NO: 8034776 - DNA, 22 bp, Homo sapiens
tctctctgcgaattaggtttgc

SEQ ID NO: 8034777 - DNA, 22 bp, Homo sapiens
tctctctttttaatcatgtaat

SEQ ID NO: 8034778 - DNA, 22 bp, Homo sapiens
tctctctttttaatcatgtaat

SEQ ID NO: 8034779 - DNA, 22 bp, Homo sapiens
tctctctttttaatcatgtaat

SEQ ID NO: 8034780 - DNA, 22 bp, Homo sapiens
tctctctttttaatcatgtaat

SEQ ID NO: 8034781 - DNA, 23 bp, Homo sapiens
tctctctggcaaatttcacatat

SEQ ID NO: 8034782 - DNA, 22 bp, Homo sapiens
tctctctggagctggggcatga

SEQ ID NO: 8034783 - DNA, 20 bp, Homo sapiens
tctctctggttggaggagct

SEQ ID NO: 8034784 - DNA, 22 bp, Homo sapiens
tctctgaagagctcagactagt

SEQ ID NO: 8034785 - DNA, 22 bp, Homo sapiens
tctctgaagagtcagacataac

SEQ ID NO: 8034786 - DNA, 22 bp, Homo sapiens
tctctgaagagtcagacataac

SEQ ID NO: 8034787 - DNA, 22 bp, Homo sapiens
tctctgaagagtcagacataac

SEQ ID NO: 8034788 - DNA, 22 bp, Homo sapiens
tctctgaagagctcagactagt

SEQ ID NO: 8034789 - DNA, 22 bp, Homo sapiens
tctctgaagatatttattatta

SEQ ID NO: 8034790 - DNA, 22 bp, Homo sapiens
tctctgaagctcaattgagata

SEQ ID NO: 8034791 - DNA, 22 bp, Homo sapiens
tctctgaagagtcagacataac

SEQ ID NO: 8034792 - DNA, 22 bp, Homo sapiens
tctctgaagagtcagacataac

SEQ ID NO: 8034793 - DNA, 22 bp, Homo sapiens
tctctgaagatatttattatta

SEQ ID NO: 8034794 - DNA, 22 bp, Homo sapiens
tctctgaagatatttattatta

SEQ ID NO: 8034795 - DNA, 22 bp, Homo sapiens
tctctgaaagcagctgctcatc

SEQ ID NO: 8034796 - DNA, 22 bp, Homo sapiens
tctctgaacttcctggaaaggc

SEQ ID NO: 8034797 - DNA, 22 bp, Homo sapiens
tctctctttttaatcatgtaat

SEQ ID NO: 8034798 - DNA, 22 bp, Homo sapiens
tctctctttttaatcatgtaat

SEQ ID NO: 8034799 - DNA, 22 bp, Homo sapiens
tctctctttttaatcatgtaat

SEQ ID NO: 8034800 - DNA, 22 bp, Homo sapiens
tctctcttttttgaacccgctc

SEQ ID NO: 8034801 - DNA, 22 bp, Homo sapiens
tctctgaagctgttgtagtctc

SEQ ID NO: 8034802 - DNA, 22 bp, Homo sapiens
tctctgaagatatttattatta

SEQ ID NO: 8034803 - DNA, 22 bp, Homo sapiens
tctctgaaggctgtgttgatgg

SEQ ID NO: 8034804 - DNA, 22 bp, Homo sapiens
tctctgaataatgctattcttt

SEQ ID NO: 8034805 - DNA, 18 bp, Homo sapiens
tctctgaatattttatgt

SEQ ID NO: 8034806 - DNA, 22 bp, Homo sapiens
tctctgaaggggagctgtttaa

SEQ ID NO: 8034807 - DNA, 22 bp, Homo sapiens
tctctgaattctgatgcaagtg

SEQ ID NO: 8034808 - DNA, 22 bp, Homo sapiens
tctctgaatgagattactgcct

SEQ ID NO: 8034809 - DNA, 18 bp, Homo sapiens
tctctgaatattttatgt

SEQ ID NO: 8034810 - DNA, 18 bp, Homo sapiens
tctctgaatattttatgt

SEQ ID NO: 8034811 - DNA, 22 bp, Homo sapiens
tctctgaatgagattactgcct

SEQ ID NO: 8034812 - DNA, 22 bp, Homo sapiens
tctctgacatgcctaagacttt

SEQ ID NO: 8034813 - DNA, 22 bp, Homo sapiens
tctctgaattgtttaagttatt

SEQ ID NO: 8034814 - DNA, 22 bp, Homo sapiens
tctctgaattgtttaagttatt

SEQ ID NO: 8034815 - DNA, 22 bp, Homo sapiens
tctctgaattctgatgcaagtg

SEQ ID NO: 8034816 - DNA, 22 bp, Homo sapiens
tctctgactggcctttcacctg

SEQ ID NO: 8034817 - DNA, 22 bp, Homo sapiens
tctctgaccactgagggattta

SEQ ID NO: 8034818 - DNA, 22 bp, Homo sapiens
tctctgacatgcctaagacttt

SEQ ID NO: 8034819 - DNA, 22 bp, Homo sapiens
tctctgaccaagagaattggta

SEQ ID NO: 8034820 - DNA, 22 bp, Homo sapiens
tctctgagaagttcctttgtga

SEQ ID NO: 8034821 - DNA, 22 bp, Homo sapiens
tctctgagaaacatgttcaaag

SEQ ID NO: 8034822 - DNA, 22 bp, Homo sapiens
tctctgagaagctgaggctggg

SEQ ID NO: 8034823 - DNA, 18 bp, Homo sapiens
tctctgagaatattaatg

SEQ ID NO: 8034824 - DNA, 22 bp, Homo sapiens
tctctgagaagttcctttgtga

SEQ ID NO: 8034825 - DNA, 22 bp, Homo sapiens
tctctgagcccaatgtagcaat

SEQ ID NO: 8034826 - DNA, 22 bp, Homo sapiens
tctctgagcccaatgtagcaat

SEQ ID NO: 8034827 - DNA, 22 bp, Homo sapiens
tctctgagcccagtgtccccct

SEQ ID NO: 8034828 - DNA, 21 bp, Homo sapiens
tctctgagcccaccaggatct

SEQ ID NO: 8034829 - DNA, 22 bp, Homo sapiens
tctctgagcgcattcctccggc

SEQ ID NO: 8034830 - DNA, 22 bp, Homo sapiens
tctctgagcgcattcctccggc

SEQ ID NO: 8034831 - DNA, 22 bp, Homo sapiens
tctctgagcgcattcctccggc

SEQ ID NO: 8034832 - DNA, 22 bp, Homo sapiens
tctctgagctcaggagctgcag

SEQ ID NO: 8034833 - DNA, 22 bp, Homo sapiens
tctctgagctcaggagctgcag

SEQ ID NO: 8034834 - DNA, 22 bp, Homo sapiens
tctctgagcccctgcctctttc

SEQ ID NO: 8034835 - DNA, 23 bp, Homo sapiens
tctctgagccatagcagtcccaa

SEQ ID NO: 8034836 - DNA, 22 bp, Homo sapiens
tctctgagacagtagcctctgc

SEQ ID NO: 8034837 - DNA, 22 bp, Homo sapiens
tctctgagacagtagcctctgc

SEQ ID NO: 8034838 - DNA, 22 bp, Homo sapiens
tctctgagacagtagcctctgc

SEQ ID NO: 8034839 - DNA, 22 bp, Homo sapiens
tctctgagcatgccatattgct

SEQ ID NO: 8034840 - DNA, 22 bp, Homo sapiens
tctctgagcacctaagatatat

SEQ ID NO: 8034841 - DNA, 22 bp, Homo sapiens
tctctgagcatgccatattgct

SEQ ID NO: 8034842 - DNA, 22 bp, Homo sapiens
tctctgagcaccagtgtattcg

SEQ ID NO: 8034843 - DNA, 22 bp, Homo sapiens
tctctgagatcagccactgact

SEQ ID NO: 8034844 - DNA, 22 bp, Homo sapiens
tctctgagggagatggcctgcc

SEQ ID NO: 8034845 - DNA, 22 bp, Homo sapiens
tctctgagggagatggcctgcc

SEQ ID NO: 8034846 - DNA, 22 bp, Homo sapiens
tctctgagtaagtgacagttca

SEQ ID NO: 8034847 - DNA, 22 bp, Homo sapiens
tctctgaggttgtttccagcac

SEQ ID NO: 8034848 - DNA, 22 bp, Homo sapiens
tctctgaggttgtttccagcac

SEQ ID NO: 8034849 - DNA, 22 bp, Homo sapiens
tctctgagtatcctgaactgcc

SEQ ID NO: 8034850 - DNA, 22 bp, Homo sapiens
tctctgagtaagtgacagttca

SEQ ID NO: 8034851 - DNA, 22 bp, Homo sapiens
tctctgagtatcctgaactgcc

SEQ ID NO: 8034852 - DNA, 22 bp, Homo sapiens
tctctgagtcaccgtggagacg

SEQ ID NO: 8034853 - DNA, 22 bp, Homo sapiens
tctctgagtatcctgaactgcc

SEQ ID NO: 8034854 - DNA, 22 bp, Homo sapiens
tctctgagtcaccgtggagacg

SEQ ID NO: 8034855 - DNA, 22 bp, Homo sapiens
tctctgagtcaccgtggagacg

SEQ ID NO: 8034856 - DNA, 22 bp, Homo sapiens
tctctgagttctcctccagccc

SEQ ID NO: 8034857 - DNA, 22 bp, Homo sapiens
tctctgagttcctgtggatttt

SEQ ID NO: 8034858 - DNA, 22 bp, Homo sapiens
tctctgagctcaggagctgcag

SEQ ID NO: 8034859 - DNA, 22 bp, Homo sapiens
tctctgagctgcttcttgcata

SEQ ID NO: 8034860 - DNA, 22 bp, Homo sapiens
tctctgagcttaaggtgtttca

SEQ ID NO: 8034861 - DNA, 22 bp, Homo sapiens
tctctgagctgcttcttgcata

SEQ ID NO: 8034862 - DNA, 22 bp, Homo sapiens
tctctgagctgcttcttgcata

SEQ ID NO: 8034863 - DNA, 20 bp, Homo sapiens
tctctgagcttctcttgggg

SEQ ID NO: 8034864 - DNA, 22 bp, Homo sapiens
tctctgagcttaaggtgtttca

SEQ ID NO: 8034865 - DNA, 20 bp, Homo sapiens
tctctgagcttctcttgggg

SEQ ID NO: 8034866 - DNA, 22 bp, Homo sapiens
tctctgaggaagaggctgtaat

SEQ ID NO: 8034867 - DNA, 22 bp, Homo sapiens
tctctgagggagatggcctgcc

SEQ ID NO: 8034868 - DNA, 22 bp, Homo sapiens
tctctcagggggaaggctgaag

SEQ ID NO: 8034869 - DNA, 22 bp, Homo sapiens
tctctcagggggaaggctgaag

SEQ ID NO: 8034870 - DNA, 18 bp, Homo sapiens
tctctcagggaaacagaa

SEQ ID NO: 8034871 - DNA, 18 bp, Homo sapiens
tctctcagggaaacagaa

SEQ ID NO: 8034872 - DNA, 22 bp, Homo sapiens
tctctcaggctggagtgcagtg

SEQ ID NO: 8034873 - DNA, 22 bp, Homo sapiens
tctctcatagagaaaaatatat

SEQ ID NO: 8034874 - DNA, 22 bp, Homo sapiens
tctctcagaggaagaggcagtg

SEQ ID NO: 8034875 - DNA, 22 bp, Homo sapiens
tctctcagaggccagggtcctg

SEQ ID NO: 8034876 - DNA, 22 bp, Homo sapiens
tctctcagaggccagggtcctg

SEQ ID NO: 8034877 - DNA, 22 bp, Homo sapiens
tctctcagatggggcactagta

SEQ ID NO: 8034878 - DNA, 22 bp, Homo sapiens
tctctcagatggggcactagta

SEQ ID NO: 8034879 - DNA, 22 bp, Homo sapiens
tctctcagcattactcttacta

SEQ ID NO: 8034880 - DNA, 22 bp, Homo sapiens
tctctcagatggggcactagta

SEQ ID NO: 8034881 - DNA, 22 bp, Homo sapiens
tctctcagatggggcactagta

SEQ ID NO: 8034882 - DNA, 22 bp, Homo sapiens
tctctcaggctggagtgcagtg

SEQ ID NO: 8034883 - DNA, 22 bp, Homo sapiens
tctctcaggctggagtgcagtg

SEQ ID NO: 8034884 - DNA, 22 bp, Homo sapiens
tctctcaggctggagtgcagtg

SEQ ID NO: 8034885 - DNA, 22 bp, Homo sapiens
tctctcaggaggcaggttccta

SEQ ID NO: 8034886 - DNA, 22 bp, Homo sapiens
tctctcagctttgagacctgct

SEQ ID NO: 8034887 - DNA, 22 bp, Homo sapiens
tctctcagaaagcccatgtctg

SEQ ID NO: 8034888 - DNA, 22 bp, Homo sapiens
tctctcagaaagcccatgtctg

SEQ ID NO: 8034889 - DNA, 22 bp, Homo sapiens
tctctcagaaagcccatgtctg

SEQ ID NO: 8034890 - DNA, 22 bp, Homo sapiens
tctctcactggtgcctctgttg

SEQ ID NO: 8034891 - DNA, 22 bp, Homo sapiens
tctctcagactccccatggttt

SEQ ID NO: 8034892 - DNA, 22 bp, Homo sapiens
tctctcagaggaagaggcagtg

SEQ ID NO: 8034893 - DNA, 22 bp, Homo sapiens
tctctcagaactgcagctgcag

SEQ ID NO: 8034894 - DNA, 22 bp, Homo sapiens
tctctcagaactgcagctgcag

SEQ ID NO: 8034895 - DNA, 22 bp, Homo sapiens
tctctcagaaagcccatgtctg

SEQ ID NO: 8034896 - DNA, 22 bp, Homo sapiens
tctctcagaactgcagctgcag

SEQ ID NO: 8034897 - DNA, 22 bp, Homo sapiens
tctctcagaggaagaggcagtg

SEQ ID NO: 8034898 - DNA, 22 bp, Homo sapiens
tctctcagaggaagaggcagtg

SEQ ID NO: 8034899 - DNA, 22 bp, Homo sapiens
tctctcagaggaagaggcagtg

SEQ ID NO: 8034900 - DNA, 22 bp, Homo sapiens
tctctagttgaggactgagcag

SEQ ID NO: 8034901 - DNA, 22 bp, Homo sapiens
tctctatagactgtggataaaa

SEQ ID NO: 8034902 - DNA, 20 bp, Homo sapiens
tctctatgaagtcaacagga

SEQ ID NO: 8034903 - DNA, 22 bp, Homo sapiens
tctctattaattgacaatggct

SEQ ID NO: 8034904 - DNA, 22 bp, Homo sapiens
tctctatttgcctaggcttgtg

SEQ ID NO: 8034905 - DNA, 22 bp, Homo sapiens
tctctcaacctcggcactattg

SEQ ID NO: 8034906 - DNA, 19 bp, Homo sapiens
tctctcaattgcttcaatt

SEQ ID NO: 8034907 - DNA, 22 bp, Homo sapiens
tctctcaagcactatccaccca

SEQ ID NO: 8034908 - DNA, 22 bp, Homo sapiens
tctctcaaatatctaacacctc

SEQ ID NO: 8034909 - DNA, 22 bp, Homo sapiens
tctctcaaatatctaacacctc

SEQ ID NO: 8034910 - DNA, 22 bp, Homo sapiens
tctctcactggtgcctctgttg

SEQ ID NO: 8034911 - DNA, 22 bp, Homo sapiens
tctctcactggtgcctctgttg

SEQ ID NO: 8034912 - DNA, 22 bp, Homo sapiens
tctctcaccctggaaaagccaa

SEQ ID NO: 8034913 - DNA, 20 bp, Homo sapiens
tctctcacgggttggtttct

SEQ ID NO: 8034914 - DNA, 22 bp, Homo sapiens
tctctcctctagtcagggtggt

SEQ ID NO: 8034915 - DNA, 22 bp, Homo sapiens
tctctcctctagtcagggtggt

SEQ ID NO: 8034916 - DNA, 22 bp, Homo sapiens
tctctcctgcactgaattatgt

SEQ ID NO: 8034917 - DNA, 22 bp, Homo sapiens
tctctcctgcactgaattatgt

SEQ ID NO: 8034918 - DNA, 22 bp, Homo sapiens
tctctcctgtgttctgatgttt

SEQ ID NO: 8034919 - DNA, 22 bp, Homo sapiens
tctctcctgtgttctgatgttt

SEQ ID NO: 8034920 - DNA, 21 bp, Homo sapiens
tctctcctcaagctcgacccc

SEQ ID NO: 8034921 - DNA, 21 bp, Homo sapiens
tctctcctcaagctcgacccc

SEQ ID NO: 8034922 - DNA, 21 bp, Homo sapiens
tctctcctcaagctcgacccc

SEQ ID NO: 8034923 - DNA, 22 bp, Homo sapiens
tctctccctttccttatcagtt

SEQ ID NO: 8034924 - DNA, 22 bp, Homo sapiens
tctctccctttccttatcagtt

SEQ ID NO: 8034925 - DNA, 22 bp, Homo sapiens
tctctcctaatttcaggtgctt

SEQ ID NO: 8034926 - DNA, 22 bp, Homo sapiens
tctctcctaatttcaggtgctt

SEQ ID NO: 8034927 - DNA, 22 bp, Homo sapiens
tctctcccaaatctgcagatag

SEQ ID NO: 8034928 - DNA, 22 bp, Homo sapiens
tctctcccaaatctgcagatag

SEQ ID NO: 8034929 - DNA, 22 bp, Homo sapiens
tctctcccaaatctgcagatag

SEQ ID NO: 8034930 - DNA, 22 bp, Homo sapiens
tctctcccaaatctgcagatag

SEQ ID NO: 8034931 - DNA, 22 bp, Homo sapiens
tctctcccaaatctgcagatag

SEQ ID NO: 8034932 - DNA, 22 bp, Homo sapiens
tctctcccaaatctgcagatag

SEQ ID NO: 8034933 - DNA, 22 bp, Homo sapiens
tctctcccctggccgctacgcg

SEQ ID NO: 8034934 - DNA, 18 bp, Homo sapiens
tctctctgaagagttccc

SEQ ID NO: 8034935 - DNA, 18 bp, Homo sapiens
tctctctgaagagttccc

SEQ ID NO: 8034936 - DNA, 18 bp, Homo sapiens
tctctctgaagagttccc

SEQ ID NO: 8034937 - DNA, 22 bp, Homo sapiens
tctctctcctagtttttagtgg

SEQ ID NO: 8034938 - DNA, 18 bp, Homo sapiens
tctctctgaagagttccc

SEQ ID NO: 8034939 - DNA, 22 bp, Homo sapiens
tctctctgagccctgctttttc

SEQ ID NO: 8034940 - DNA, 22 bp, Homo sapiens
tctctctgcagcccgggacact

SEQ ID NO: 8034941 - DNA, 18 bp, Homo sapiens
tctctctgataacatttt

SEQ ID NO: 8034942 - DNA, 22 bp, Homo sapiens
tctctctgagttgagcaggagt

SEQ ID NO: 8034943 - DNA, 22 bp, Homo sapiens
tctctcctgtgttctgatgttt

SEQ ID NO: 8034944 - DNA, 22 bp, Homo sapiens
tctctcctgtgttctgatgttt

SEQ ID NO: 8034945 - DNA, 22 bp, Homo sapiens
tctctccttatcattgtgttta

SEQ ID NO: 8034946 - DNA, 22 bp, Homo sapiens
tctctccttatcattgtgttta

SEQ ID NO: 8034947 - DNA, 22 bp, Homo sapiens
tctctctcagccattacagaac

SEQ ID NO: 8034948 - DNA, 22 bp, Homo sapiens
tctctctcagccattacagaac

SEQ ID NO: 8034949 - DNA, 22 bp, Homo sapiens
tctctctcagccattacagaac

SEQ ID NO: 8034950 - DNA, 22 bp, Homo sapiens
tctctctatttatttgtcttgt

SEQ ID NO: 8034951 - DNA, 22 bp, Homo sapiens
tctctggttatgtcattaagca

SEQ ID NO: 8034952 - DNA, 22 bp, Homo sapiens
tctctgggtttttgtcctgtac

SEQ ID NO: 8034953 - DNA, 22 bp, Homo sapiens
tctctggttattaactaactcc

SEQ ID NO: 8034954 - DNA, 23 bp, Homo sapiens
tctctggttaggggagattggtg

SEQ ID NO: 8034955 - DNA, 22 bp, Homo sapiens
tctctgggtttttgtcctgtac

SEQ ID NO: 8034956 - DNA, 22 bp, Homo sapiens
tctctgggtttttgtcctgtac

SEQ ID NO: 8034957 - DNA, 22 bp, Homo sapiens
tctctgggtttttgtcctgtac

SEQ ID NO: 8034958 - DNA, 22 bp, Homo sapiens
tctctgggtttttgtcctgtac

SEQ ID NO: 8034959 - DNA, 22 bp, Homo sapiens
tctctgtctttgttgtcttcac

SEQ ID NO: 8034960 - DNA, 22 bp, Homo sapiens
tctctgtctgagcctggcagac

SEQ ID NO: 8034961 - DNA, 22 bp, Homo sapiens
tctctgtctgagcctggcagac

SEQ ID NO: 8034962 - DNA, 22 bp, Homo sapiens
tctctgtctgagcctggcagac

SEQ ID NO: 8034963 - DNA, 22 bp, Homo sapiens
tctctgtctcccgtgtgtccgg

SEQ ID NO: 8034964 - DNA, 22 bp, Homo sapiens
tctctgtgcaggatgctgagtt

SEQ ID NO: 8034965 - DNA, 22 bp, Homo sapiens
tctctgtgcaggatgctgagtt

SEQ ID NO: 8034966 - DNA, 22 bp, Homo sapiens
tctctgtgagtggaaggcaccc

SEQ ID NO: 8034967 - DNA, 22 bp, Homo sapiens
tctctgtgcaggatgctgagtt

SEQ ID NO: 8034968 - DNA, 22 bp, Homo sapiens
tctctgtgagccaggtcctagt

SEQ ID NO: 8034969 - DNA, 22 bp, Homo sapiens
tctctgtgagatttgtattaag

SEQ ID NO: 8034970 - DNA, 22 bp, Homo sapiens
tctctgtgagatgccttcctga

SEQ ID NO: 8034971 - DNA, 22 bp, Homo sapiens
tctctgtgagatttgtattaag

SEQ ID NO: 8034972 - DNA, 22 bp, Homo sapiens
tctctgtgacatttctgagcct

SEQ ID NO: 8034973 - DNA, 22 bp, Homo sapiens
tctctgtgagatgccttcctga

SEQ ID NO: 8034974 - DNA, 22 bp, Homo sapiens
tctctgtgacagctgggtatgt

SEQ ID NO: 8034975 - DNA, 22 bp, Homo sapiens
tctctgtgacagctgggtatgt

SEQ ID NO: 8034976 - DNA, 22 bp, Homo sapiens
tctctgtgaatggcgtcacctg

SEQ ID NO: 8034977 - DNA, 22 bp, Homo sapiens
tctctgtgaagctcccgttagg

SEQ ID NO: 8034978 - DNA, 22 bp, Homo sapiens
tctctgtggcatccactcaact

SEQ ID NO: 8034979 - DNA, 21 bp, Homo sapiens
tctctgtggcctaccctctac

SEQ ID NO: 8034980 - DNA, 22 bp, Homo sapiens
tctctgtgggctttggacttga

SEQ ID NO: 8034981 - DNA, 22 bp, Homo sapiens
tctctgtgggctttggacttga

SEQ ID NO: 8034982 - DNA, 21 bp, Homo sapiens
tctctgtggcctaccctctac

SEQ ID NO: 8034983 - DNA, 22 bp, Homo sapiens
tctctgtggcaagcatgctgct

SEQ ID NO: 8034984 - DNA, 22 bp, Homo sapiens
tctctgtggcaagcatgctgct

SEQ ID NO: 8034985 - DNA, 22 bp, Homo sapiens
tctctgtggcaagcatgctgct

SEQ ID NO: 8034986 - DNA, 22 bp, Homo sapiens
tctctgtggcaagcatgctgct

SEQ ID NO: 8034987 - DNA, 22 bp, Homo sapiens
tctctgtggcaactacttagct

SEQ ID NO: 8034988 - DNA, 22 bp, Homo sapiens
tctctgtggagcagtgtgttca

SEQ ID NO: 8034989 - DNA, 22 bp, Homo sapiens
tctctgtggagcagtgtgttca

SEQ ID NO: 8034990 - DNA, 22 bp, Homo sapiens
tctctgtggcaactacttagct

SEQ ID NO: 8034991 - DNA, 22 bp, Homo sapiens
tctctgtggcaacaattcacta

SEQ ID NO: 8034992 - DNA, 22 bp, Homo sapiens
tctctgtgcccagtagttctct

SEQ ID NO: 8034993 - DNA, 22 bp, Homo sapiens
tctctgtgcccagtagttctct

SEQ ID NO: 8034994 - DNA, 22 bp, Homo sapiens
tctctgtgcaggatgctgagtt

SEQ ID NO: 8034995 - DNA, 22 bp, Homo sapiens
tctctgtgcttgactttcccat

SEQ ID NO: 8034996 - DNA, 22 bp, Homo sapiens
tctctgtggagcagtgtgttca

SEQ ID NO: 8034997 - DNA, 21 bp, Homo sapiens
tctctgtgtacagtctcaccc

SEQ ID NO: 8034998 - DNA, 21 bp, Homo sapiens
tctctgtgtacagtctcaccc

SEQ ID NO: 8034999 - DNA, 22 bp, Homo sapiens
tctctgtggtttgagagccggg

SEQ ID NO: 8035000 - DNA, 22 bp, Homo sapiens
tctctgtgtctcatgttcctat

SEQ ID NO: 8035001 - DNA, 22 bp, Homo sapiens
tctctgtgtctcatgttcctat

SEQ ID NO: 8035002 - DNA, 22 bp, Homo sapiens
tctctgtgtcttagtgaaggga

SEQ ID NO: 8035003 - DNA, 22 bp, Homo sapiens
tctctgtgggtttcaccagcgc

SEQ ID NO: 8035004 - DNA, 22 bp, Homo sapiens
tctctgtggtactgagagtcta

SEQ ID NO: 8035005 - DNA, 22 bp, Homo sapiens
tctctgtggtatgtcatagcaa

SEQ ID NO: 8035006 - DNA, 21 bp, Homo sapiens
tctctgtggtccaatcccagc

SEQ ID NO: 8035007 - DNA, 22 bp, Homo sapiens
tctctgtggtgggaggctgagt

SEQ ID NO: 8035008 - DNA, 22 bp, Homo sapiens
tctctgtggtgggaggctgagt

SEQ ID NO: 8035009 - DNA, 22 bp, Homo sapiens
tctcttcacatgcttgctccaa

SEQ ID NO: 8035010 - DNA, 22 bp, Homo sapiens
tctcttcacatgcttgctccaa

SEQ ID NO: 8035011 - DNA, 22 bp, Homo sapiens
tctcttcacattcctggcaaac

SEQ ID NO: 8035012 - DNA, 22 bp, Homo sapiens
tctcttcacatgcttgctccaa

SEQ ID NO: 8035013 - DNA, 22 bp, Homo sapiens
tctcttcacatgcttgctccaa

SEQ ID NO: 8035014 - DNA, 22 bp, Homo sapiens
tctcttattttgcctttgacaa

SEQ ID NO: 8035015 - DNA, 22 bp, Homo sapiens
tctcttcatttgctatgggtca

SEQ ID NO: 8035016 - DNA, 20 bp, Homo sapiens
tctcttcaggaggtccatgt

SEQ ID NO: 8035017 - DNA, 20 bp, Homo sapiens
tctcttcaggaggtccatgt

SEQ ID NO: 8035018 - DNA, 20 bp, Homo sapiens
tctcttcaggaggtccatgt

SEQ ID NO: 8035019 - DNA, 22 bp, Homo sapiens
tctcttcagcccattataaggg

SEQ ID NO: 8035020 - DNA, 22 bp, Homo sapiens
tctcttcagcccattataaggg

SEQ ID NO: 8035021 - DNA, 22 bp, Homo sapiens
tctcttcagcccattataaggg

SEQ ID NO: 8035022 - DNA, 22 bp, Homo sapiens
tctcttcagcccattataaggg

SEQ ID NO: 8035023 - DNA, 23 bp, Homo sapiens
tctcttacctgagacatttccta

SEQ ID NO: 8035024 - DNA, 22 bp, Homo sapiens
tctcttaggagaaattcataaa

SEQ ID NO: 8035025 - DNA, 22 bp, Homo sapiens
tctcttagtcttatatgtaaaa

SEQ ID NO: 8035026 - DNA, 22 bp, Homo sapiens
tctcttaattcagaggcagtta

SEQ ID NO: 8035027 - DNA, 22 bp, Homo sapiens
tctcttaattcagaggcagtta

SEQ ID NO: 8035028 - DNA, 22 bp, Homo sapiens
tctcttaattttggaatagtgt

SEQ ID NO: 8035029 - DNA, 22 bp, Homo sapiens
tctcttaattttggaatagtgt

SEQ ID NO: 8035030 - DNA, 23 bp, Homo sapiens
tctctgtgtgcctcagtttcttc

SEQ ID NO: 8035031 - DNA, 21 bp, Homo sapiens
tctctgtgtctttaagctgga

SEQ ID NO: 8035032 - DNA, 23 bp, Homo sapiens
tctctgtgtgcctcagtttcttc

SEQ ID NO: 8035033 - DNA, 22 bp, Homo sapiens
tctcttaatccggtgctttctg

SEQ ID NO: 8035034 - DNA, 21 bp, Homo sapiens
tctctgtgtctttaagctgga

SEQ ID NO: 8035035 - DNA, 22 bp, Homo sapiens
tctcttccttgacctattgtaa

SEQ ID NO: 8035036 - DNA, 22 bp, Homo sapiens
tctcttctaacactagaaattc

SEQ ID NO: 8035037 - DNA, 22 bp, Homo sapiens
tctcttctaacactagaaattc

SEQ ID NO: 8035038 - DNA, 22 bp, Homo sapiens
tctcttctaacactagaaattc

SEQ ID NO: 8035039 - DNA, 22 bp, Homo sapiens
tctcttctaacactagaaattc

SEQ ID NO: 8035040 - DNA, 22 bp, Homo sapiens
tctcttctaacactagaaattc

SEQ ID NO: 8035041 - DNA, 21 bp, Homo sapiens
tctcttcctccgcgccgccgc

SEQ ID NO: 8035042 - DNA, 21 bp, Homo sapiens
tctcttcctccgcgccgccgc

SEQ ID NO: 8035043 - DNA, 22 bp, Homo sapiens
tctcttcctcagcctggggcct

SEQ ID NO: 8035044 - DNA, 21 bp, Homo sapiens
tctcttcctccgcgccgccgc

SEQ ID NO: 8035045 - DNA, 22 bp, Homo sapiens
tctcttcctagtgatgggcttt

SEQ ID NO: 8035046 - DNA, 22 bp, Homo sapiens
tctcttcctagtgatgggcttt

SEQ ID NO: 8035047 - DNA, 22 bp, Homo sapiens
tctcttcccggataaagtaagt

SEQ ID NO: 8035048 - DNA, 22 bp, Homo sapiens
tctcttcctcagcctggggcct

SEQ ID NO: 8035049 - DNA, 22 bp, Homo sapiens
tctcttcctcagcctggggcct

SEQ ID NO: 8035050 - DNA, 22 bp, Homo sapiens
tctcttcctagtgatgggcttt

SEQ ID NO: 8035051 - DNA, 22 bp, Homo sapiens
tctcttcctagtgatgggcttt

SEQ ID NO: 8035052 - DNA, 22 bp, Homo sapiens
tctcttccagtggctttgattt

SEQ ID NO: 8035053 - DNA, 22 bp, Homo sapiens
tctcttccagtggctttgattt

SEQ ID NO: 8035054 - DNA, 22 bp, Homo sapiens
tctcttccagtaagagtcttta

SEQ ID NO: 8035055 - DNA, 22 bp, Homo sapiens
tctcttccagtaagagtcttta

SEQ ID NO: 8035056 - DNA, 22 bp, Homo sapiens
tctcttccatgtttcagcccca

SEQ ID NO: 8035057 - DNA, 22 bp, Homo sapiens
tctcttccatgtttcagcccca

SEQ ID NO: 8035058 - DNA, 22 bp, Homo sapiens
tctcttccatgtttcagcccca

SEQ ID NO: 8035059 - DNA, 22 bp, Homo sapiens
tctcttccctttatggtatgtg

SEQ ID NO: 8035060 - DNA, 22 bp, Homo sapiens
tctcttccctttatggtatgtg

SEQ ID NO: 8035061 - DNA, 22 bp, Homo sapiens
tctcttcccggataaagtaagt

SEQ ID NO: 8035062 - DNA, 22 bp, Homo sapiens
tctcttcccggataaagtaagt

SEQ ID NO: 8035063 - DNA, 22 bp, Homo sapiens
tctcttcccctttcctttaaca

SEQ ID NO: 8035064 - DNA, 22 bp, Homo sapiens
tctcttcccctttcctttaaca

SEQ ID NO: 8035065 - DNA, 22 bp, Homo sapiens
tctcttcccctttcctttaaca

SEQ ID NO: 8035066 - DNA, 21 bp, Homo sapiens
tctcttcccatcaggacacta

SEQ ID NO: 8035067 - DNA, 22 bp, Homo sapiens
tctcttctgaaacctgtcttta

SEQ ID NO: 8035068 - DNA, 22 bp, Homo sapiens
tctcttctgaaacctgtcttta

SEQ ID NO: 8035069 - DNA, 22 bp, Homo sapiens
tctcttctgaaacctgtcttta

SEQ ID NO: 8035070 - DNA, 22 bp, Homo sapiens
tctcttctgaaacctgtcttta

SEQ ID NO: 8035071 - DNA, 22 bp, Homo sapiens
tctcttctgacctagccttgga

SEQ ID NO: 8035072 - DNA, 20 bp, Homo sapiens
tctcttctggggagataaaa

SEQ ID NO: 8035073 - DNA, 20 bp, Homo sapiens
tctcttctggggagataaaa

SEQ ID NO: 8035074 - DNA, 22 bp, Homo sapiens
tctcttcttgtgttttcctgcc

SEQ ID NO: 8035075 - DNA, 18 bp, Homo sapiens
tctcttcttggcagtcaa

SEQ ID NO: 8035076 - DNA, 18 bp, Homo sapiens
tctcttcttggcagtcaa

SEQ ID NO: 8035077 - DNA, 18 bp, Homo sapiens
tctcttcttggcagtcaa

SEQ ID NO: 8035078 - DNA, 22 bp, Homo sapiens
tctcttcttgattttcactgga

SEQ ID NO: 8035079 - DNA, 22 bp, Homo sapiens
tctcttcttgattttcactgga

SEQ ID NO: 8035080 - DNA, 22 bp, Homo sapiens
tctcttcttgattttcactgga

SEQ ID NO: 8035081 - DNA, 22 bp, Homo sapiens
tctcttctatttgagactattt

SEQ ID NO: 8035082 - DNA, 22 bp, Homo sapiens
tctcttctatttgagactattt

SEQ ID NO: 8035083 - DNA, 22 bp, Homo sapiens
tctcttctatttgagactattt

SEQ ID NO: 8035084 - DNA, 19 bp, Homo sapiens
tctcttctccctggtttta

SEQ ID NO: 8035085 - DNA, 22 bp, Homo sapiens
tctcttctctagtgagcaactg

SEQ ID NO: 8035086 - DNA, 22 bp, Homo sapiens
tctcttctgaaacctgtcttta

SEQ ID NO: 8035087 - DNA, 22 bp, Homo sapiens
tctcttctctagtgagcaactg

SEQ ID NO: 8035088 - DNA, 22 bp, Homo sapiens
tctcttctaattagggtccatg

SEQ ID NO: 8035089 - DNA, 22 bp, Homo sapiens
tctcttctatttgagactattt

SEQ ID NO: 8035090 - DNA, 22 bp, Homo sapiens
tctcttctagcttcttgtggtt

SEQ ID NO: 8035091 - DNA, 22 bp, Homo sapiens
tctcttctatttgagactattt

SEQ ID NO: 8035092 - DNA, 22 bp, Homo sapiens
tctcttctagcttcttgtggtt

SEQ ID NO: 8035093 - DNA, 22 bp, Homo sapiens
tctcttctatttgagactattt

SEQ ID NO: 8035094 - DNA, 22 bp, Homo sapiens
tctcttctaattagggtccatg

SEQ ID NO: 8035095 - DNA, 22 bp, Homo sapiens
tctcttctaattttcccgagta

SEQ ID NO: 8035096 - DNA, 22 bp, Homo sapiens
tctctttaagtataatcttata

SEQ ID NO: 8035097 - DNA, 22 bp, Homo sapiens
tctctttaagtataatcttata

SEQ ID NO: 8035098 - DNA, 22 bp, Homo sapiens
tctctttaagtataatcttata

SEQ ID NO: 8035099 - DNA, 22 bp, Homo sapiens
tctctttaagtataatcttata

SEQ ID NO: 8035100 - DNA, 22 bp, Homo sapiens
tctctttaaagactcagagatt

SEQ ID NO: 8035101 - DNA, 22 bp, Homo sapiens
tctctttaaagactcagagatt

SEQ ID NO: 8035102 - DNA, 23 bp, Homo sapiens
tctctttcaagagcttaatgtgc

SEQ ID NO: 8035103 - DNA, 23 bp, Homo sapiens
tctctttcaagagcttaatgtgc

SEQ ID NO: 8035104 - DNA, 22 bp, Homo sapiens
tctctttactttcaccaatttg

SEQ ID NO: 8035105 - DNA, 22 bp, Homo sapiens
tctcttcttgtgttttcctgcc

SEQ ID NO: 8035106 - DNA, 22 bp, Homo sapiens
tctcttcttgtgttttcctgcc

SEQ ID NO: 8035107 - DNA, 22 bp, Homo sapiens
tctcttctttggggtgggctca

SEQ ID NO: 8035108 - DNA, 22 bp, Homo sapiens
tctcttctttggggtgggctca

SEQ ID NO: 8035109 - DNA, 17 bp, Homo sapiens
tctcttgttcactgctg

SEQ ID NO: 8035110 - DNA, 22 bp, Homo sapiens
tctctttaaaaatagtgaaata

SEQ ID NO: 8035111 - DNA, 22 bp, Homo sapiens
tctctttaaaaatagtgaaata

SEQ ID NO: 8035112 - DNA, 22 bp, Homo sapiens
tctctttaaaaatagtgaaata

SEQ ID NO: 8035113 - DNA, 22 bp, Homo sapiens
tctctttaaagactcagagatt

SEQ ID NO: 8035114 - DNA, 21 bp, Homo sapiens
tctctttctggaagcttccct

SEQ ID NO: 8035115 - DNA, 22 bp, Homo sapiens
tctctttctcagatggtggaga

SEQ ID NO: 8035116 - DNA, 22 bp, Homo sapiens
tctctttctcaaaatgtaagca

SEQ ID NO: 8035117 - DNA, 22 bp, Homo sapiens
tctctttctcaaaatgtaagca

SEQ ID NO: 8035118 - DNA, 21 bp, Homo sapiens
tctctttctggaagcttccct

SEQ ID NO: 8035119 - DNA, 22 bp, Homo sapiens
tctctttctttgtatgtctatt

SEQ ID NO: 8035120 - DNA, 22 bp, Homo sapiens
tctctttctttgtatgtctatt

SEQ ID NO: 8035121 - DNA, 22 bp, Homo sapiens
tctctttctttgtatgtctatt

SEQ ID NO: 8035122 - DNA, 22 bp, Homo sapiens
tctctttctttgtatgtctatt

SEQ ID NO: 8035123 - DNA, 22 bp, Homo sapiens
tctctttgaccctttagctcca

SEQ ID NO: 8035124 - DNA, 22 bp, Homo sapiens
tctctttgcctgctgccatcca

SEQ ID NO: 8035125 - DNA, 19 bp, Homo sapiens
tctctttcatggggctagt

SEQ ID NO: 8035126 - DNA, 17 bp, Homo sapiens
tctctttccctttctgc

SEQ ID NO: 8035127 - DNA, 22 bp, Homo sapiens
tctctttctattgcaccatgct

SEQ ID NO: 8035128 - DNA, 22 bp, Homo sapiens
tctctttctattgcaccatgct

SEQ ID NO: 8035129 - DNA, 22 bp, Homo sapiens
tctctttctattgcaccatgct

SEQ ID NO: 8035130 - DNA, 18 bp, Homo sapiens
tctctttcctcagtggag

SEQ ID NO: 8035131 - DNA, 18 bp, Homo sapiens
tctctttcctcagtggag

SEQ ID NO: 8035132 - DNA, 18 bp, Homo sapiens
tctctttcctcagtggag

SEQ ID NO: 8035133 - DNA, 22 bp, Homo sapiens
tctctttctatatgtgagtctt

SEQ ID NO: 8035134 - DNA, 22 bp, Homo sapiens
tctgaaataaatgcactgttag

SEQ ID NO: 8035135 - DNA, 22 bp, Homo sapiens
tctgaaataaatgcactgttag

SEQ ID NO: 8035136 - DNA, 22 bp, Homo sapiens
tctgaaataaatgcactgttag

SEQ ID NO: 8035137 - DNA, 22 bp, Homo sapiens
tctgaaataactgatgccagat

SEQ ID NO: 8035138 - DNA, 22 bp, Homo sapiens
tctgaaataactgatgccagat

SEQ ID NO: 8035139 - DNA, 22 bp, Homo sapiens
tctgaaataagggagaagggaa

SEQ ID NO: 8035140 - DNA, 22 bp, Homo sapiens
tctgaaataagggagaagggaa

SEQ ID NO: 8035141 - DNA, 22 bp, Homo sapiens
tctgaaataagggagaagggaa

SEQ ID NO: 8035142 - DNA, 22 bp, Homo sapiens
tctgaaatactgcaggttctct

SEQ ID NO: 8035143 - DNA, 22 bp, Homo sapiens
tctgaaatagaagtgtctttct

SEQ ID NO: 8035144 - DNA, 22 bp, Homo sapiens
tctgaaatagaagtgtctttct

SEQ ID NO: 8035145 - DNA, 22 bp, Homo sapiens
tctgaaatagaagtgtctttct

SEQ ID NO: 8035146 - DNA, 22 bp, Homo sapiens
tctgaaatactgcaggttctct

SEQ ID NO: 8035147 - DNA, 22 bp, Homo sapiens
tctgaaagccctagtttgtaat

SEQ ID NO: 8035148 - DNA, 22 bp, Homo sapiens
tctgaaagccctagtttgtaat

SEQ ID NO: 8035149 - DNA, 22 bp, Homo sapiens
tctgaaagtatctggatctttt

SEQ ID NO: 8035150 - DNA, 22 bp, Homo sapiens
tctgaaagggctaaataatttg

SEQ ID NO: 8035151 - DNA, 22 bp, Homo sapiens
tctgaaagctagaaaatgctct

SEQ ID NO: 8035152 - DNA, 22 bp, Homo sapiens
tctgaaagctagaaaatgctct

SEQ ID NO: 8035153 - DNA, 22 bp, Homo sapiens
tctgaaagtctgaaacagtgtc

SEQ ID NO: 8035154 - DNA, 22 bp, Homo sapiens
tctgaaagtatctggatctttt

SEQ ID NO: 8035155 - DNA, 22 bp, Homo sapiens
tctgaaagtctgaaacagtgtc

SEQ ID NO: 8035156 - DNA, 22 bp, Homo sapiens
tctgaaagaaagattttgtttc

SEQ ID NO: 8035157 - DNA, 22 bp, Homo sapiens
tctgaaagaaagattttgtttc

SEQ ID NO: 8035158 - DNA, 22 bp, Homo sapiens
tctgaaagagagtacatacagt

SEQ ID NO: 8035159 - DNA, 22 bp, Homo sapiens
tctcttttctttctggataaaa

SEQ ID NO: 8035160 - DNA, 22 bp, Homo sapiens
tctgaaaatgttgactttgttt

SEQ ID NO: 8035161 - DNA, 20 bp, Homo sapiens
tctcttttagcttacagctg

SEQ ID NO: 8035162 - DNA, 20 bp, Homo sapiens
tctcttttagcttacagctg

SEQ ID NO: 8035163 - DNA, 20 bp, Homo sapiens
tctcttttagcttacagctg

SEQ ID NO: 8035164 - DNA, 20 bp, Homo sapiens
tctcttttagcttacagctg

SEQ ID NO: 8035165 - DNA, 18 bp, Homo sapiens
tctcttttcccctcattg

SEQ ID NO: 8035166 - DNA, 22 bp, Homo sapiens
tctcttttatgtacaccctgac

SEQ ID NO: 8035167 - DNA, 22 bp, Homo sapiens
tctctttgtctgctcttagttg

SEQ ID NO: 8035168 - DNA, 22 bp, Homo sapiens
tctctttgtctgctcttagttg

SEQ ID NO: 8035169 - DNA, 22 bp, Homo sapiens
tctctttgtctgctcttagttg

SEQ ID NO: 8035170 - DNA, 22 bp, Homo sapiens
tctctttgtggccaggagagga

SEQ ID NO: 8035171 - DNA, 22 bp, Homo sapiens
tctctttgtggccaggagagga

SEQ ID NO: 8035172 - DNA, 22 bp, Homo sapiens
tctctttgtggccaggagagga

SEQ ID NO: 8035173 - DNA, 22 bp, Homo sapiens
tctctttgtctgctcttagttg

SEQ ID NO: 8035174 - DNA, 22 bp, Homo sapiens
tctgaaatgttctcttgttttg

SEQ ID NO: 8035175 - DNA, 22 bp, Homo sapiens
tctgaaatggcgatggccgttg

SEQ ID NO: 8035176 - DNA, 22 bp, Homo sapiens
tctgaaatggggctgaagcact

SEQ ID NO: 8035177 - DNA, 22 bp, Homo sapiens
tctgaaattcacagttgagtca

SEQ ID NO: 8035178 - DNA, 22 bp, Homo sapiens
tctgaaattcacagttgagtca

SEQ ID NO: 8035179 - DNA, 22 bp, Homo sapiens
tctgaaattcacagttgagtca

SEQ ID NO: 8035180 - DNA, 22 bp, Homo sapiens
tctgaaatgttctcttgttttg

SEQ ID NO: 8035181 - DNA, 22 bp, Homo sapiens
tctgaaatgttctcttgttttg

SEQ ID NO: 8035182 - DNA, 22 bp, Homo sapiens
tctgaaatgttctcttgttttg

SEQ ID NO: 8035183 - DNA, 22 bp, Homo sapiens
tctgaaattttagttatagaaa

SEQ ID NO: 8035184 - DNA, 22 bp, Homo sapiens
tctgaaattttagttatagaaa

SEQ ID NO: 8035185 - DNA, 22 bp, Homo sapiens
tctgaaattgttagtaaaaatg

SEQ ID NO: 8035186 - DNA, 22 bp, Homo sapiens
tctgaaattgttagtaaaaatg

SEQ ID NO: 8035187 - DNA, 22 bp, Homo sapiens
tctgaaattgttagtaaaaatg

SEQ ID NO: 8035188 - DNA, 22 bp, Homo sapiens
tctgaaattccttccagacttt

SEQ ID NO: 8035189 - DNA, 22 bp, Homo sapiens
tctgaaatggggctgaagcact

SEQ ID NO: 8035190 - DNA, 22 bp, Homo sapiens
tctgaaattgttagtaaaaatg

SEQ ID NO: 8035191 - DNA, 22 bp, Homo sapiens
tctgaaattccttccagacttt

SEQ ID NO: 8035192 - DNA, 22 bp, Homo sapiens
tctgaaatggggctgaagcact

SEQ ID NO: 8035193 - DNA, 22 bp, Homo sapiens
tctgaaatggggctgaagcact

SEQ ID NO: 8035194 - DNA, 22 bp, Homo sapiens
tctgaaatggcgatggccgttg

SEQ ID NO: 8035195 - DNA, 22 bp, Homo sapiens
tctgaaatggcagcgggaatga

SEQ ID NO: 8035196 - DNA, 22 bp, Homo sapiens
tctgaaatgcaggcaatttgct

SEQ ID NO: 8035197 - DNA, 22 bp, Homo sapiens
tctgaaatggcagcgggaatga

SEQ ID NO: 8035198 - DNA, 22 bp, Homo sapiens
tctgaaatgcaggcaatttgct

SEQ ID NO: 8035199 - DNA, 22 bp, Homo sapiens
tctgaaatgcaaatttgactga

SEQ ID NO: 8035200 - DNA, 22 bp, Homo sapiens
tctgaaatgcaaatttgactga

SEQ ID NO: 8035201 - DNA, 22 bp, Homo sapiens
tctgaaatagaagtgtctttct

SEQ ID NO: 8035202 - DNA, 22 bp, Homo sapiens
tctgaaatagaagtgtctttct

SEQ ID NO: 8035203 - DNA, 19 bp, Homo sapiens
tctgaagaattagagagca

SEQ ID NO: 8035204 - DNA, 22 bp, Homo sapiens
tctgaagaactgtctagagaac

SEQ ID NO: 8035205 - DNA, 22 bp, Homo sapiens
tctgaagaagggtgccaggctg

SEQ ID NO: 8035206 - DNA, 22 bp, Homo sapiens
tctgaagaactgtctagagaac

SEQ ID NO: 8035207 - DNA, 22 bp, Homo sapiens
tctgaagaactgtctagagaac

SEQ ID NO: 8035208 - DNA, 22 bp, Homo sapiens
tctgaagaactgtctagagaac

SEQ ID NO: 8035209 - DNA, 22 bp, Homo sapiens
tctgaagaactgtctagagaac

SEQ ID NO: 8035210 - DNA, 20 bp, Homo sapiens
tctgaagaaagacagggact

SEQ ID NO: 8035211 - DNA, 22 bp, Homo sapiens
tctgaagaaatacagctggggt

SEQ ID NO: 8035212 - DNA, 20 bp, Homo sapiens
tctgaagaaagacagggact

SEQ ID NO: 8035213 - DNA, 22 bp, Homo sapiens
tctgaactccagccctgctctc

SEQ ID NO: 8035214 - DNA, 22 bp, Homo sapiens
tctgaagaactgagtaaacatg

SEQ ID NO: 8035215 - DNA, 22 bp, Homo sapiens
tctgaagaaatacagctggggt

SEQ ID NO: 8035216 - DNA, 22 bp, Homo sapiens
tctgaagaaatacagctggggt

SEQ ID NO: 8035217 - DNA, 22 bp, Homo sapiens
tctgaacagcatggaatcattt

SEQ ID NO: 8035218 - DNA, 22 bp, Homo sapiens
tctgaacatccagcaatgcaca

SEQ ID NO: 8035219 - DNA, 22 bp, Homo sapiens
tctgaacagcatggaatcattt

SEQ ID NO: 8035220 - DNA, 22 bp, Homo sapiens
tctgaacagcatggaatcattt

SEQ ID NO: 8035221 - DNA, 22 bp, Homo sapiens
tctgaacagaaaagatgcacaa

SEQ ID NO: 8035222 - DNA, 22 bp, Homo sapiens
tctgaacagaaaagatgcacaa

SEQ ID NO: 8035223 - DNA, 22 bp, Homo sapiens
tctgaacagaaaagatgcacaa

SEQ ID NO: 8035224 - DNA, 22 bp, Homo sapiens
tctgaacatcctacaacatttt

SEQ ID NO: 8035225 - DNA, 22 bp, Homo sapiens
tctgaacatcctacaacatttt

SEQ ID NO: 8035226 - DNA, 22 bp, Homo sapiens
tctgaacaagggcaccttccag

SEQ ID NO: 8035227 - DNA, 21 bp, Homo sapiens
tctgaacaacatacgaatctt

SEQ ID NO: 8035228 - DNA, 22 bp, Homo sapiens
tctgaacactgagtgtcatcac

SEQ ID NO: 8035229 - DNA, 22 bp, Homo sapiens
tctgaaattttagttatagaaa

SEQ ID NO: 8035230 - DNA, 22 bp, Homo sapiens
tctgaaattttagttatagaaa

SEQ ID NO: 8035231 - DNA, 22 bp, Homo sapiens
tctgaagacatatgatatggtg

SEQ ID NO: 8035232 - DNA, 22 bp, Homo sapiens
tctgaagacatatgatatggtg

SEQ ID NO: 8035233 - DNA, 22 bp, Homo sapiens
tctgaagagaatgctgctgaac

SEQ ID NO: 8035234 - DNA, 22 bp, Homo sapiens
tctgaagagaatgctgctgaac

SEQ ID NO: 8035235 - DNA, 19 bp, Homo sapiens
tctgaagaattagagagca

SEQ ID NO: 8035236 - DNA, 19 bp, Homo sapiens
tctgaagaattagagagca

SEQ ID NO: 8035237 - DNA, 19 bp, Homo sapiens
tctgaagaattagagagca

SEQ ID NO: 8035238 - DNA, 19 bp, Homo sapiens
tctgaagaattagagagca

SEQ ID NO: 8035239 - DNA, 19 bp, Homo sapiens
tctgaagaattagagagca

SEQ ID NO: 8035240 - DNA, 22 bp, Homo sapiens
tctgaagagctttggaagtatg

SEQ ID NO: 8035241 - DNA, 22 bp, Homo sapiens
tctgaagagctttggaagtatg

SEQ ID NO: 8035242 - DNA, 22 bp, Homo sapiens
tctgaagagaacaccagtagtt

SEQ ID NO: 8035243 - DNA, 22 bp, Homo sapiens
tctgaagagctttggaagtatg

SEQ ID NO: 8035244 - DNA, 22 bp, Homo sapiens
tctgaagagtcttgcaagaaag

SEQ ID NO: 8035245 - DNA, 22 bp, Homo sapiens
tctgaagagtcatctttgggtg

SEQ ID NO: 8035246 - DNA, 22 bp, Homo sapiens
tctgaagagtcttgcaagaaag

SEQ ID NO: 8035247 - DNA, 22 bp, Homo sapiens
tctgaagagtcttgcaagaaag

SEQ ID NO: 8035248 - DNA, 22 bp, Homo sapiens
tctgaagagtcttgcaagaaag

SEQ ID NO: 8035249 - DNA, 22 bp, Homo sapiens
tctgaagattctttccactatt

SEQ ID NO: 8035250 - DNA, 22 bp, Homo sapiens
tctgaagattctttccactatt

SEQ ID NO: 8035251 - DNA, 22 bp, Homo sapiens
tctgaagattaccagctaaatg

SEQ ID NO: 8035252 - DNA, 22 bp, Homo sapiens
tctgaagattaccagctaaatg

SEQ ID NO: 8035253 - DNA, 22 bp, Homo sapiens
tctgaagcacagcaggaagggt

SEQ ID NO: 8035254 - DNA, 22 bp, Homo sapiens
tctgaagcacagcaggaagggt

SEQ ID NO: 8035255 - DNA, 22 bp, Homo sapiens
tctgaagcactgcaatgcttta

SEQ ID NO: 8035256 - DNA, 22 bp, Homo sapiens
tctgaagcacagcaggaagggt

SEQ ID NO: 8035257 - DNA, 22 bp, Homo sapiens
tctgaagagtcttgcaagaaag

SEQ ID NO: 8035258 - DNA, 22 bp, Homo sapiens
tctgaagagtcttgcaagaaag

SEQ ID NO: 8035259 - DNA, 22 bp, Homo sapiens
tctgaagattaccagctaaatg

SEQ ID NO: 8035260 - DNA, 22 bp, Homo sapiens
tctgaagattaccagctaaatg

SEQ ID NO: 8035261 - DNA, 22 bp, Homo sapiens
tctgaagattaccagctaaatg

SEQ ID NO: 8035262 - DNA, 22 bp, Homo sapiens
tctgaagattaccagctaaatg

SEQ ID NO: 8035263 - DNA, 23 bp, Homo sapiens
tctgaagatgctgtttccagtga

SEQ ID NO: 8035264 - DNA, 22 bp, Homo sapiens
tctgaagatggaggaacttaga

SEQ ID NO: 8035265 - DNA, 22 bp, Homo sapiens
tctgaagatggaggaacttaga

SEQ ID NO: 8035266 - DNA, 22 bp, Homo sapiens
tctgaaggaaaagggtagatat

SEQ ID NO: 8035267 - DNA, 22 bp, Homo sapiens
tctgaagctggaggaagctttg

SEQ ID NO: 8035268 - DNA, 17 bp, Homo sapiens
tctgaagccagtctgct

SEQ ID NO: 8035269 - DNA, 17 bp, Homo sapiens
tctgaagccagtctgct

SEQ ID NO: 8035270 - DNA, 22 bp, Homo sapiens
tctgaagccacctctgcttgtc

SEQ ID NO: 8035271 - DNA, 22 bp, Homo sapiens
tctgaagcctttgtacaggcct

SEQ ID NO: 8035272 - DNA, 22 bp, Homo sapiens
tctgaagcctttgtacaggcct

SEQ ID NO: 8035273 - DNA, 17 bp, Homo sapiens
tctgaagccagtctgct

SEQ ID NO: 8035274 - DNA, 17 bp, Homo sapiens
tctgaagccagtctgct

SEQ ID NO: 8035275 - DNA, 22 bp, Homo sapiens
tctgaaggcctggagggtccca

SEQ ID NO: 8035276 - DNA, 22 bp, Homo sapiens
tctgaaggcctggagggtccca

SEQ ID NO: 8035277 - DNA, 22 bp, Homo sapiens
tctgaaggcctggagggtccca

SEQ ID NO: 8035278 - DNA, 22 bp, Homo sapiens
tctgaaggcctggagggtccca

SEQ ID NO: 8035279 - DNA, 21 bp, Homo sapiens
tctgaaggcattttccaaggt

SEQ ID NO: 8035280 - DNA, 21 bp, Homo sapiens
tctgaaggcattttccaaggt

SEQ ID NO: 8035281 - DNA, 21 bp, Homo sapiens
tctgaaggcattttccaaggt

SEQ ID NO: 8035282 - DNA, 22 bp, Homo sapiens
tctgaaggcatcctcactgcaa

SEQ ID NO: 8035283 - DNA, 18 bp, Homo sapiens
tctgaaggaatgattcca

SEQ ID NO: 8035284 - DNA, 22 bp, Homo sapiens
tctgaaggaaaagggtagatat

SEQ ID NO: 8035285 - DNA, 18 bp, Homo sapiens
tctgaaggaatgattcca

SEQ ID NO: 8035286 - DNA, 18 bp, Homo sapiens
tctgaaggaatgattcca

SEQ ID NO: 8035287 - DNA, 22 bp, Homo sapiens
tctgaaggattttgtactcaaa

SEQ ID NO: 8035288 - DNA, 22 bp, Homo sapiens
tctgaagggctgagtggaggag

SEQ ID NO: 8035289 - DNA, 22 bp, Homo sapiens
tctgaagggctgagtggaggag

SEQ ID NO: 8035290 - DNA, 22 bp, Homo sapiens
tctgaaggtctgagaaccagga

SEQ ID NO: 8035291 - DNA, 21 bp, Homo sapiens
tctgaaggcttgactggggct

SEQ ID NO: 8035292 - DNA, 22 bp, Homo sapiens
tctgaagggctgagtggaggag

SEQ ID NO: 8035293 - DNA, 22 bp, Homo sapiens
tctgaaggtgctagagaaagct

SEQ ID NO: 8035294 - DNA, 22 bp, Homo sapiens
tctgaaggtctgagaaccagga

SEQ ID NO: 8035295 - DNA, 22 bp, Homo sapiens
tctgaaggtctgagctagaggt

SEQ ID NO: 8035296 - DNA, 22 bp, Homo sapiens
tctgaaggtctgagaaccagga

SEQ ID NO: 8035297 - DNA, 22 bp, Homo sapiens
tctgaaggttgagaagggctga

SEQ ID NO: 8035298 - DNA, 22 bp, Homo sapiens
tctgaaggttgagaagggctga

SEQ ID NO: 8035299 - DNA, 22 bp, Homo sapiens
tctgaaggttacttctgctcag

SEQ ID NO: 8035300 - DNA, 22 bp, Homo sapiens
tctgaaggttacttctgctcag

SEQ ID NO: 8035301 - DNA, 22 bp, Homo sapiens
tctgaaggtgctagagaaagct

SEQ ID NO: 8035302 - DNA, 22 bp, Homo sapiens
tctgaaggtgctagagaaagct

SEQ ID NO: 8035303 - DNA, 22 bp, Homo sapiens
tctgaaggttgagaagggctga

SEQ ID NO: 8035304 - DNA, 22 bp, Homo sapiens
tctgaatttgcattttaacaag

SEQ ID NO: 8035305 - DNA, 22 bp, Homo sapiens
tctgaattttccacagatttgg

SEQ ID NO: 8035306 - DNA, 22 bp, Homo sapiens
tctgaattttaactacacaaag

SEQ ID NO: 8035307 - DNA, 22 bp, Homo sapiens
tctcgctctgtcgcccaggctg

SEQ ID NO: 8035308 - DNA, 22 bp, Homo sapiens
tctcgctctgtcgcccaggctg

SEQ ID NO: 8035309 - DNA, 22 bp, Homo sapiens
tctcgctctgtcgcccaggctg

SEQ ID NO: 8035310 - DNA, 22 bp, Homo sapiens
tctcgctctgtcgcccaggctg

SEQ ID NO: 8035311 - DNA, 20 bp, Homo sapiens
tctcgcactcggagcagccg

SEQ ID NO: 8035312 - DNA, 22 bp, Homo sapiens
tctcgatctcctgaccttgtga

SEQ ID NO: 8035313 - DNA, 22 bp, Homo sapiens
tctcgatctcctgaccttgtga

SEQ ID NO: 8035314 - DNA, 22 bp, Homo sapiens
tctcgatctcctgaccttgtga

SEQ ID NO: 8035315 - DNA, 22 bp, Homo sapiens
tctcgatctcctgaccttgtga

SEQ ID NO: 8035316 - DNA, 22 bp, Homo sapiens
tctcgacagcctggcacagtgg

SEQ ID NO: 8035317 - DNA, 22 bp, Homo sapiens
tctcctttcttttaaaatgtca

SEQ ID NO: 8035318 - DNA, 22 bp, Homo sapiens
tctcctttcttttaaaatgtca

SEQ ID NO: 8035319 - DNA, 22 bp, Homo sapiens
tctccttcgaggcccagctccc

SEQ ID NO: 8035320 - DNA, 22 bp, Homo sapiens
tctccttcgaggcccagctccc

SEQ ID NO: 8035321 - DNA, 22 bp, Homo sapiens
tctccttcgaggcccagctccc

SEQ ID NO: 8035322 - DNA, 22 bp, Homo sapiens
tctccttgacaggcaggcagac

SEQ ID NO: 8035323 - DNA, 22 bp, Homo sapiens
tctccttcgaggcccagctccc

SEQ ID NO: 8035324 - DNA, 22 bp, Homo sapiens
tctccttgctacccagtatgtc

SEQ ID NO: 8035325 - DNA, 22 bp, Homo sapiens
tctccttgctacccagtatgtc

SEQ ID NO: 8035326 - DNA, 22 bp, Homo sapiens
tctcctttaagatttcctcagg

SEQ ID NO: 8035327 - DNA, 22 bp, Homo sapiens
tctcctttaagatttcctcagg

SEQ ID NO: 8035328 - DNA, 22 bp, Homo sapiens
tctcctttaagatttcctcagg

SEQ ID NO: 8035329 - DNA, 22 bp, Homo sapiens
tctcctttaagatttcctcagg

SEQ ID NO: 8035330 - DNA, 22 bp, Homo sapiens
tctcgctctgtcgcccaggctg

SEQ ID NO: 8035331 - DNA, 22 bp, Homo sapiens
tctcgctctgtcgcccaggctg

SEQ ID NO: 8035332 - DNA, 22 bp, Homo sapiens
tctcgctctgtcgcccaggctg

SEQ ID NO: 8035333 - DNA, 22 bp, Homo sapiens
tctcgctctgtcgcccaggctg

SEQ ID NO: 8035334 - DNA, 22 bp, Homo sapiens
tctcgctctgtcgcccaggctg

SEQ ID NO: 8035335 - DNA, 22 bp, Homo sapiens
tctcgctctgtcgcccaggctg

SEQ ID NO: 8035336 - DNA, 22 bp, Homo sapiens
tctcgctctgtcgcccaggctg

SEQ ID NO: 8035337 - DNA, 22 bp, Homo sapiens
tctcgctctgtcgcccaggctg

SEQ ID NO: 8035338 - DNA, 22 bp, Homo sapiens
tctcgctctgtcgcccaggctg

SEQ ID NO: 8035339 - DNA, 22 bp, Homo sapiens
tctctagtctcctttaacctga

SEQ ID NO: 8035340 - DNA, 22 bp, Homo sapiens
tctctagtctcctttaacctga

SEQ ID NO: 8035341 - DNA, 22 bp, Homo sapiens
tctctagttgaggactgagcag

SEQ ID NO: 8035342 - DNA, 22 bp, Homo sapiens
tctctagtctcctttaacctga

SEQ ID NO: 8035343 - DNA, 22 bp, Homo sapiens
tctctagtctcctttaacctga

SEQ ID NO: 8035344 - DNA, 22 bp, Homo sapiens
tctctaaacttatatgaactat

SEQ ID NO: 8035345 - DNA, 22 bp, Homo sapiens
tctcgtgcaggccttgctcgga

SEQ ID NO: 8035346 - DNA, 22 bp, Homo sapiens
tctctaaacttatatgaactat

SEQ ID NO: 8035347 - DNA, 22 bp, Homo sapiens
tctctaaacttatatgaactat

SEQ ID NO: 8035348 - DNA, 22 bp, Homo sapiens
tctctaaacttatatgaactat

SEQ ID NO: 8035349 - DNA, 22 bp, Homo sapiens
tctcctggtatgtatgcacctg

SEQ ID NO: 8035350 - DNA, 22 bp, Homo sapiens
tctcctggtatgtatgcacctg

SEQ ID NO: 8035351 - DNA, 22 bp, Homo sapiens
tctcctggtacccttcctagca

SEQ ID NO: 8035352 - DNA, 22 bp, Homo sapiens
tctcctgggtgctttatcagaa

SEQ ID NO: 8035353 - DNA, 22 bp, Homo sapiens
tctcctgggtgctttatcagaa

SEQ ID NO: 8035354 - DNA, 21 bp, Homo sapiens
tctcctgggtccaacccatgc

SEQ ID NO: 8035355 - DNA, 22 bp, Homo sapiens
tctcctggtacccttcctagca

SEQ ID NO: 8035356 - DNA, 22 bp, Homo sapiens
tctcctggtacccttcctagca

SEQ ID NO: 8035357 - DNA, 22 bp, Homo sapiens
tctcctggtacccttcctagca

SEQ ID NO: 8035358 - DNA, 22 bp, Homo sapiens
tctcctggtacccttcctagca

SEQ ID NO: 8035359 - DNA, 21 bp, Homo sapiens
tctcctgggtccaacccatgc

SEQ ID NO: 8035360 - DNA, 18 bp, Homo sapiens
tctcctgggtaggggcct

SEQ ID NO: 8035361 - DNA, 22 bp, Homo sapiens
tctcctgggtaaaagggttgat

SEQ ID NO: 8035362 - DNA, 18 bp, Homo sapiens
tctcctgggtaggggcct

SEQ ID NO: 8035363 - DNA, 18 bp, Homo sapiens
tctcctgggtaggggcct

SEQ ID NO: 8035364 - DNA, 22 bp, Homo sapiens
tctcctgggcttggttgaagtt

SEQ ID NO: 8035365 - DNA, 22 bp, Homo sapiens
tctcctgggcttggttgaagtt

SEQ ID NO: 8035366 - DNA, 22 bp, Homo sapiens
tctcctggccctgtcgccatct

SEQ ID NO: 8035367 - DNA, 22 bp, Homo sapiens
tctcctgggtaaaagggttgat

SEQ ID NO: 8035368 - DNA, 22 bp, Homo sapiens
tctcctgggcttggttgaagtt

SEQ ID NO: 8035369 - DNA, 22 bp, Homo sapiens
tctcctgggtaaaagggttgat

SEQ ID NO: 8035370 - DNA, 22 bp, Homo sapiens
tctcctggtttgttaaataatt

SEQ ID NO: 8035371 - DNA, 22 bp, Homo sapiens
tctcctggtttgttaaataatt

SEQ ID NO: 8035372 - DNA, 20 bp, Homo sapiens
tctcctggtgacagtaccca

SEQ ID NO: 8035373 - DNA, 20 bp, Homo sapiens
tctcctggtgacagtaccca

SEQ ID NO: 8035374 - DNA, 20 bp, Homo sapiens
tctcctggtctggtccgtgc

SEQ ID NO: 8035375 - DNA, 20 bp, Homo sapiens
tctcctggtctggtccgtgc

SEQ ID NO: 8035376 - DNA, 22 bp, Homo sapiens
tctcctggtcacctcagaagtc

SEQ ID NO: 8035377 - DNA, 22 bp, Homo sapiens
tctcctggtcacctcagaagtc

SEQ ID NO: 8035378 - DNA, 22 bp, Homo sapiens
tctcctggtcacctcagaagtc

SEQ ID NO: 8035379 - DNA, 22 bp, Homo sapiens
tctcctggtcacctcagaagtc

SEQ ID NO: 8035380 - DNA, 20 bp, Homo sapiens
tctcctggtctggtccgtgc

SEQ ID NO: 8035381 - DNA, 20 bp, Homo sapiens
tctcctggtctggtccgtgc

SEQ ID NO: 8035382 - DNA, 22 bp, Homo sapiens
tctcctggtcacctcagaagtc

SEQ ID NO: 8035383 - DNA, 23 bp, Homo sapiens
tctcctgtcctaattaccacccc

SEQ ID NO: 8035384 - DNA, 22 bp, Homo sapiens
tctcctgtatgggactggcgag

SEQ ID NO: 8035385 - DNA, 22 bp, Homo sapiens
tctcctgtgcaccctccctgtg

SEQ ID NO: 8035386 - DNA, 22 bp, Homo sapiens
tctcctgtcttctcagcacccc

SEQ ID NO: 8035387 - DNA, 22 bp, Homo sapiens
tctcctgtgcaccctccctgtg

SEQ ID NO: 8035388 - DNA, 18 bp, Homo sapiens
tctccttccaaatcttca

SEQ ID NO: 8035389 - DNA, 18 bp, Homo sapiens
tctccttccaaatcttca

SEQ ID NO: 8035390 - DNA, 18 bp, Homo sapiens
tctccttccaaatcttca

SEQ ID NO: 8035391 - DNA, 18 bp, Homo sapiens
tctccttccaaatcttca

SEQ ID NO: 8035392 - DNA, 18 bp, Homo sapiens
tctccttccaaatcttca

SEQ ID NO: 8035393 - DNA, 22 bp, Homo sapiens
tctccttcgaggcccagctccc

SEQ ID NO: 8035394 - DNA, 22 bp, Homo sapiens
tctcctggagcaggaaggtggg

SEQ ID NO: 8035395 - DNA, 22 bp, Homo sapiens
tctcctggagcaggaaggtggg

SEQ ID NO: 8035396 - DNA, 22 bp, Homo sapiens
tctcctggagcccagatgctgg

SEQ ID NO: 8035397 - DNA, 22 bp, Homo sapiens
tctcctggagcaggaaggtggg

SEQ ID NO: 8035398 - DNA, 22 bp, Homo sapiens
tctcctggagcaggaaggtggg

SEQ ID NO: 8035399 - DNA, 22 bp, Homo sapiens
tctcctggagcaggaaggtggg

SEQ ID NO: 8035400 - DNA, 22 bp, Homo sapiens
tctcctggagcaggaaggtggg

SEQ ID NO: 8035401 - DNA, 22 bp, Homo sapiens
tctcctggagcccagatgctgg

SEQ ID NO: 8035402 - DNA, 22 bp, Homo sapiens
tctcctggagcccagatgctgg

SEQ ID NO: 8035403 - DNA, 22 bp, Homo sapiens
tctcctggagcccagatgctgg

SEQ ID NO: 8035404 - DNA, 22 bp, Homo sapiens
tctcctggatagatactatcca

SEQ ID NO: 8035405 - DNA, 22 bp, Homo sapiens
tctcctggatagatactatcca

SEQ ID NO: 8035406 - DNA, 22 bp, Homo sapiens
tctcctggcatgtgggtcatct

SEQ ID NO: 8035407 - DNA, 22 bp, Homo sapiens
tctcctggcatgtgggtcatct

SEQ ID NO: 8035408 - DNA, 22 bp, Homo sapiens
tctcctggcatttggttgagta

SEQ ID NO: 8035409 - DNA, 22 bp, Homo sapiens
tctcctggcatgtgggtcatct

SEQ ID NO: 8035410 - DNA, 22 bp, Homo sapiens
tctcctggcatttggttgagta

SEQ ID NO: 8035411 - DNA, 22 bp, Homo sapiens
tctcctggcatttggttgagta

SEQ ID NO: 8035412 - DNA, 22 bp, Homo sapiens
tctcctggcatttggttgagta

SEQ ID NO: 8035413 - DNA, 22 bp, Homo sapiens
tctcctggatggaccttctctt

SEQ ID NO: 8035414 - DNA, 22 bp, Homo sapiens
tctcctggatagatactatcca

SEQ ID NO: 8035415 - DNA, 22 bp, Homo sapiens
tctcctggatagatactatcca

SEQ ID NO: 8035416 - DNA, 22 bp, Homo sapiens
tctcctggatggaccttctctt

SEQ ID NO: 8035417 - DNA, 22 bp, Homo sapiens
tctcctggatggaccttctctt

SEQ ID NO: 8035418 - DNA, 22 bp, Homo sapiens
tctcctgctcagaacagcctca

SEQ ID NO: 8035419 - DNA, 22 bp, Homo sapiens
tctcctgctcagaacagcctca

SEQ ID NO: 8035420 - DNA, 22 bp, Homo sapiens
tctcctgctcagaacagcctca

SEQ ID NO: 8035421 - DNA, 22 bp, Homo sapiens
tctcctgctcagaacagcctca

SEQ ID NO: 8035422 - DNA, 22 bp, Homo sapiens
tctcctgctcagaacagcctca

SEQ ID NO: 8035423 - DNA, 22 bp, Homo sapiens
tctcctgccactgcttcccatt

SEQ ID NO: 8035424 - DNA, 22 bp, Homo sapiens
tctcctgccactgcttcccatt

SEQ ID NO: 8035425 - DNA, 22 bp, Homo sapiens
tctcctgcagtcagcagtctca

SEQ ID NO: 8035426 - DNA, 22 bp, Homo sapiens
tctcctgcagtcagcagtctca

SEQ ID NO: 8035427 - DNA, 22 bp, Homo sapiens
tctcctgccactgcttcccatt

SEQ ID NO: 8035428 - DNA, 22 bp, Homo sapiens
tctcctgcagcgagcccgacac

SEQ ID NO: 8035429 - DNA, 22 bp, Homo sapiens
tctcctgatgatggtactggca

SEQ ID NO: 8035430 - DNA, 22 bp, Homo sapiens
tctcctgcagcgagcccgacac

SEQ ID NO: 8035431 - DNA, 22 bp, Homo sapiens
tctcctggaagtgattcccctg

SEQ ID NO: 8035432 - DNA, 22 bp, Homo sapiens
tctcctggaagtgattcccctg

SEQ ID NO: 8035433 - DNA, 22 bp, Homo sapiens
tctcctggaagaataccacact

SEQ ID NO: 8035434 - DNA, 22 bp, Homo sapiens
tctcctggaagaataccacact

SEQ ID NO: 8035435 - DNA, 22 bp, Homo sapiens
tctcctgcttcaactgatggac

SEQ ID NO: 8035436 - DNA, 22 bp, Homo sapiens
tctcctgcttcaactgatggac

SEQ ID NO: 8035437 - DNA, 22 bp, Homo sapiens
tctcctgctcccaactgctgca

SEQ ID NO: 8035438 - DNA, 22 bp, Homo sapiens
tctcctgctcccaactgctgca

SEQ ID NO: 8035439 - DNA, 22 bp, Homo sapiens
tctcctaattaaatgctcttat

SEQ ID NO: 8035440 - DNA, 22 bp, Homo sapiens
tctcctcaccaccagcagcaga

SEQ ID NO: 8035441 - DNA, 22 bp, Homo sapiens
tctcctcaccaccagcagcaga

SEQ ID NO: 8035442 - DNA, 22 bp, Homo sapiens
tctcctccagaggctgtgggga

SEQ ID NO: 8035443 - DNA, 22 bp, Homo sapiens
tctcctccagaggctgtgggga

SEQ ID NO: 8035444 - DNA, 22 bp, Homo sapiens
tctcctactcactcaaggcttg

SEQ ID NO: 8035445 - DNA, 22 bp, Homo sapiens
tctcctactcactcaaggcttg

SEQ ID NO: 8035446 - DNA, 22 bp, Homo sapiens
tctcctactcactcaaggcttg

SEQ ID NO: 8035447 - DNA, 22 bp, Homo sapiens
tctcctcaccaccagcagcaga

SEQ ID NO: 8035448 - DNA, 22 bp, Homo sapiens
tctcctcccaggctcttccagg

SEQ ID NO: 8035449 - DNA, 22 bp, Homo sapiens
tctcctcccaggctcttccagg

SEQ ID NO: 8035450 - DNA, 22 bp, Homo sapiens
tctcctcccaggctcttccagg

SEQ ID NO: 8035451 - DNA, 22 bp, Homo sapiens
tctcctcccaggctcttccagg

SEQ ID NO: 8035452 - DNA, 22 bp, Homo sapiens
tctcctcccaggctcttccagg

SEQ ID NO: 8035453 - DNA, 22 bp, Homo sapiens
tctcctccagaggctgtgggga

SEQ ID NO: 8035454 - DNA, 22 bp, Homo sapiens
tctcctccagaggctgtgggga

SEQ ID NO: 8035455 - DNA, 22 bp, Homo sapiens
tctcctccagaggctgtgggga

SEQ ID NO: 8035456 - DNA, 22 bp, Homo sapiens
tctcctcccaggctcttccagg

SEQ ID NO: 8035457 - DNA, 23 bp, Homo sapiens
tctcctcctagatacagtcatgg

SEQ ID NO: 8035458 - DNA, 22 bp, Homo sapiens
tctcctcccaggctcttccagg

SEQ ID NO: 8035459 - DNA, 23 bp, Homo sapiens
tctcctcctagatacagtcatgg

SEQ ID NO: 8035460 - DNA, 23 bp, Homo sapiens
tctcctcctagatacagtcatgg

SEQ ID NO: 8035461 - DNA, 23 bp, Homo sapiens
tctcctcctagatacagtcatgg

SEQ ID NO: 8035462 - DNA, 22 bp, Homo sapiens
tctcctccttttttcaacatag

SEQ ID NO: 8035463 - DNA, 22 bp, Homo sapiens
tctcctccttttttcaacatag

SEQ ID NO: 8035464 - DNA, 23 bp, Homo sapiens
tctcctcctagatacagtcatgg

SEQ ID NO: 8035465 - DNA, 22 bp, Homo sapiens
tctcctccttttttcaacatag

SEQ ID NO: 8035466 - DNA, 23 bp, Homo sapiens
tctcctcctagatacagtcatgg

SEQ ID NO: 8035467 - DNA, 22 bp, Homo sapiens
tctcctctactgggtctgcaga

SEQ ID NO: 8035468 - DNA, 22 bp, Homo sapiens
tctcctctactgggtctgcaga

SEQ ID NO: 8035469 - DNA, 22 bp, Homo sapiens
tctcctctactgggtctgcaga

SEQ ID NO: 8035470 - DNA, 22 bp, Homo sapiens
tctcctgatgatggtactggca

SEQ ID NO: 8035471 - DNA, 22 bp, Homo sapiens
tctcctgatgatggtactggca

SEQ ID NO: 8035472 - DNA, 22 bp, Homo sapiens
tctcctgatatctgcagaccta

SEQ ID NO: 8035473 - DNA, 22 bp, Homo sapiens
tctcctgacatgtctggaggaa

SEQ ID NO: 8035474 - DNA, 22 bp, Homo sapiens
tctcctgatatctgcagaccta

SEQ ID NO: 8035475 - DNA, 22 bp, Homo sapiens
tctcctctgtgccacagcttgg

SEQ ID NO: 8035476 - DNA, 22 bp, Homo sapiens
tctcctgaagaccatgtgcact

SEQ ID NO: 8035477 - DNA, 22 bp, Homo sapiens
tctcctgaagtttatgaaaact

SEQ ID NO: 8035478 - DNA, 22 bp, Homo sapiens
tctcctgaagaccatgtgcact

SEQ ID NO: 8035479 - DNA, 22 bp, Homo sapiens
tctcctctactgggtctgcaga

SEQ ID NO: 8035480 - DNA, 22 bp, Homo sapiens
tctcctctatttctgtatgtat

SEQ ID NO: 8035481 - DNA, 22 bp, Homo sapiens
tctcctctatttctgtatgtat

SEQ ID NO: 8035482 - DNA, 22 bp, Homo sapiens
tctcctctactgggtctgcaga

SEQ ID NO: 8035483 - DNA, 22 bp, Homo sapiens
tctcctctcctttcatgttgtt

SEQ ID NO: 8035484 - DNA, 22 bp, Homo sapiens
tctcctctcctttcatgttgtt

SEQ ID NO: 8035485 - DNA, 22 bp, Homo sapiens
tctcctctcctttcatgttgtt

SEQ ID NO: 8035486 - DNA, 22 bp, Homo sapiens
tctcctctcttacctggtacaa

SEQ ID NO: 8035487 - DNA, 22 bp, Homo sapiens
tctcctctgcgcggcagtgccc

SEQ ID NO: 8035488 - DNA, 22 bp, Homo sapiens
tctcctctgcgcggcagtgccc

SEQ ID NO: 8035489 - DNA, 21 bp, Homo sapiens
tctccagtatccttctctgag

SEQ ID NO: 8035490 - DNA, 22 bp, Homo sapiens
tctccaggttcagtcgatggaa

SEQ ID NO: 8035491 - DNA, 22 bp, Homo sapiens
tctccaggttcagtcgatggaa

SEQ ID NO: 8035492 - DNA, 22 bp, Homo sapiens
tctcccactgcaagcccaggct

SEQ ID NO: 8035493 - DNA, 22 bp, Homo sapiens
tctccaggtggcttgggcttct

SEQ ID NO: 8035494 - DNA, 22 bp, Homo sapiens
tctccaggtggggtcacctttt

SEQ ID NO: 8035495 - DNA, 22 bp, Homo sapiens
tctccaggtggggtcacctttt

SEQ ID NO: 8035496 - DNA, 22 bp, Homo sapiens
tctccaggttcagtcgatggaa

SEQ ID NO: 8035497 - DNA, 22 bp, Homo sapiens
tctcccactgcaagcccaggct

SEQ ID NO: 8035498 - DNA, 22 bp, Homo sapiens
tctcccagaagtcctcagtaca

SEQ ID NO: 8035499 - DNA, 22 bp, Homo sapiens
tctcccagaagtcctcagtaca

SEQ ID NO: 8035500 - DNA, 22 bp, Homo sapiens
tctcccagaggatcccagtgga

SEQ ID NO: 8035501 - DNA, 22 bp, Homo sapiens
tctcccagaggatcccagtgga

SEQ ID NO: 8035502 - DNA, 22 bp, Homo sapiens
tctcccagaggatcccagtgga

SEQ ID NO: 8035503 - DNA, 22 bp, Homo sapiens
tctcccagaggatcccagtgga

SEQ ID NO: 8035504 - DNA, 22 bp, Homo sapiens
tctcccagaggatcccagtgga

SEQ ID NO: 8035505 - DNA, 22 bp, Homo sapiens
tctccaggtagatatgtcagga

SEQ ID NO: 8035506 - DNA, 22 bp, Homo sapiens
tctccaggtaaatggcatcctg

SEQ ID NO: 8035507 - DNA, 22 bp, Homo sapiens
tctccaggtagatatgtcagga

SEQ ID NO: 8035508 - DNA, 22 bp, Homo sapiens
tctccaggtgaaacttgcaggg

SEQ ID NO: 8035509 - DNA, 22 bp, Homo sapiens
tctccaggtagatatgtcagga

SEQ ID NO: 8035510 - DNA, 22 bp, Homo sapiens
tctccaggtagatatgtcagga

SEQ ID NO: 8035511 - DNA, 22 bp, Homo sapiens
tctccaggtgactctgatgtat

SEQ ID NO: 8035512 - DNA, 22 bp, Homo sapiens
tctccaggtgactctgatgtat

SEQ ID NO: 8035513 - DNA, 22 bp, Homo sapiens
tctccaggtgactctgatgtat

SEQ ID NO: 8035514 - DNA, 22 bp, Homo sapiens
tctccaggtgaaacttgcaggg

SEQ ID NO: 8035515 - DNA, 22 bp, Homo sapiens
tctccaggtgaaacttgcaggg

SEQ ID NO: 8035516 - DNA, 22 bp, Homo sapiens
tctccaggtgaaacttgcaggg

SEQ ID NO: 8035517 - DNA, 22 bp, Homo sapiens
tctccaggtgaaacttgcaggg

SEQ ID NO: 8035518 - DNA, 22 bp, Homo sapiens
tctccaggtgctaagtgtgcct

SEQ ID NO: 8035519 - DNA, 22 bp, Homo sapiens
tctccaggtgctaagtgtgcct

SEQ ID NO: 8035520 - DNA, 22 bp, Homo sapiens
tctccaggtggcttgggcttct

SEQ ID NO: 8035521 - DNA, 22 bp, Homo sapiens
tctccaggtggcttgggcttct

SEQ ID NO: 8035522 - DNA, 22 bp, Homo sapiens
tctccaggtggcttgggcttct

SEQ ID NO: 8035523 - DNA, 22 bp, Homo sapiens
tctccaggtgctaagtgtgcct

SEQ ID NO: 8035524 - DNA, 22 bp, Homo sapiens
tctccaggtggcttgggcttct

SEQ ID NO: 8035525 - DNA, 22 bp, Homo sapiens
tctccaggtgctaagtgtgcct

SEQ ID NO: 8035526 - DNA, 19 bp, Homo sapiens
tctccaggtgccccaaaca

SEQ ID NO: 8035527 - DNA, 22 bp, Homo sapiens
tctccaggtgagggtggttaga

SEQ ID NO: 8035528 - DNA, 19 bp, Homo sapiens
tctccaggtgccccaaaca

SEQ ID NO: 8035529 - DNA, 22 bp, Homo sapiens
tctccaggtgagggtggttaga

SEQ ID NO: 8035530 - DNA, 22 bp, Homo sapiens
tctccaggcttaatctcagctt

SEQ ID NO: 8035531 - DNA, 22 bp, Homo sapiens
tctccaggcttaatctcagctt

SEQ ID NO: 8035532 - DNA, 22 bp, Homo sapiens
tctccaggcttaatctcagctt

SEQ ID NO: 8035533 - DNA, 22 bp, Homo sapiens
tctccaggcttaatctcagctt

SEQ ID NO: 8035534 - DNA, 22 bp, Homo sapiens
tctccaggcttaatctcagctt

SEQ ID NO: 8035535 - DNA, 22 bp, Homo sapiens
tctccaggcttaatctcagctt

SEQ ID NO: 8035536 - DNA, 22 bp, Homo sapiens
tctccaggcctttcccatctta

SEQ ID NO: 8035537 - DNA, 22 bp, Homo sapiens
tctccaggcctttcccatctta

SEQ ID NO: 8035538 - DNA, 22 bp, Homo sapiens
tctccaggcctttcccatctta

SEQ ID NO: 8035539 - DNA, 23 bp, Homo sapiens
tctccaggccttactccaggcct

SEQ ID NO: 8035540 - DNA, 23 bp, Homo sapiens
tctccaggccttactccaggcct

SEQ ID NO: 8035541 - DNA, 23 bp, Homo sapiens
tctccaggccttactccaggcct

SEQ ID NO: 8035542 - DNA, 22 bp, Homo sapiens
tctccagggactgaggctggag

SEQ ID NO: 8035543 - DNA, 22 bp, Homo sapiens
tctccagggactgaggctggag

SEQ ID NO: 8035544 - DNA, 22 bp, Homo sapiens
tctccagggactgaggctggag

SEQ ID NO: 8035545 - DNA, 22 bp, Homo sapiens
tctccagggactgaggctggag

SEQ ID NO: 8035546 - DNA, 22 bp, Homo sapiens
tctccagggactgaggctggag

SEQ ID NO: 8035547 - DNA, 22 bp, Homo sapiens
tctccagggacatgtttctgga

SEQ ID NO: 8035548 - DNA, 22 bp, Homo sapiens
tctccagggacatgtttctgga

SEQ ID NO: 8035549 - DNA, 22 bp, Homo sapiens
tctccagggactgaggctggag

SEQ ID NO: 8035550 - DNA, 22 bp, Homo sapiens
tctccagggacatgtttctgga

SEQ ID NO: 8035551 - DNA, 22 bp, Homo sapiens
tctccaggctttttgtgaattg

SEQ ID NO: 8035552 - DNA, 22 bp, Homo sapiens
tctccaggctttttgtgaattg

SEQ ID NO: 8035553 - DNA, 22 bp, Homo sapiens
tctccagggacatgtttctgga

SEQ ID NO: 8035554 - DNA, 22 bp, Homo sapiens
tctccaggctttttgtgaattg

SEQ ID NO: 8035555 - DNA, 22 bp, Homo sapiens
tctccaggctttttgtgaattg

SEQ ID NO: 8035556 - DNA, 22 bp, Homo sapiens
tctccagggaggtagcccagtg

SEQ ID NO: 8035557 - DNA, 22 bp, Homo sapiens
tctccagggaggtagcccagtg

SEQ ID NO: 8035558 - DNA, 22 bp, Homo sapiens
tctccagggaggtagcccagtg

SEQ ID NO: 8035559 - DNA, 22 bp, Homo sapiens
tctccagggaggtagcccagtg

SEQ ID NO: 8035560 - DNA, 22 bp, Homo sapiens
tctccagggcagagaatagcaa

SEQ ID NO: 8035561 - DNA, 22 bp, Homo sapiens
tctccagggcagagaatagcaa

SEQ ID NO: 8035562 - DNA, 22 bp, Homo sapiens
tctccagggcagagaatagcaa

SEQ ID NO: 8035563 - DNA, 22 bp, Homo sapiens
tctccagggcagagaatagcaa

SEQ ID NO: 8035564 - DNA, 22 bp, Homo sapiens
tctccaggggcagggtctggag

SEQ ID NO: 8035565 - DNA, 22 bp, Homo sapiens
tctccaggggctgctgtgccac

SEQ ID NO: 8035566 - DNA, 22 bp, Homo sapiens
tctccaggggcagggtctggag

SEQ ID NO: 8035567 - DNA, 22 bp, Homo sapiens
tctccagggcccccgagcgttg

SEQ ID NO: 8035568 - DNA, 22 bp, Homo sapiens
tctccagggcccccgagcgttg

SEQ ID NO: 8035569 - DNA, 22 bp, Homo sapiens
tctccaggggcagggtctggag

SEQ ID NO: 8035570 - DNA, 22 bp, Homo sapiens
tctccagggcccccgagcgttg

SEQ ID NO: 8035571 - DNA, 22 bp, Homo sapiens
tctccagggtgagctaggccag

SEQ ID NO: 8035572 - DNA, 22 bp, Homo sapiens
tctccagggtgagctaggccag

SEQ ID NO: 8035573 - DNA, 22 bp, Homo sapiens
tctccaggtaaatggcatcctg

SEQ ID NO: 8035574 - DNA, 22 bp, Homo sapiens
tctccaggtaaatggcatcctg

SEQ ID NO: 8035575 - DNA, 22 bp, Homo sapiens
tctccaggtaaatggcatcctg

SEQ ID NO: 8035576 - DNA, 22 bp, Homo sapiens
tctccaggtaaatggcatcctg

SEQ ID NO: 8035577 - DNA, 22 bp, Homo sapiens
tctccagggtgagctaggccag

SEQ ID NO: 8035578 - DNA, 22 bp, Homo sapiens
tctccagggtgagctaggccag

SEQ ID NO: 8035579 - DNA, 22 bp, Homo sapiens
tctccagggtgagctaggccag

SEQ ID NO: 8035580 - DNA, 22 bp, Homo sapiens
tctccaggggctgctgtgccac

SEQ ID NO: 8035581 - DNA, 22 bp, Homo sapiens
tctccaggggctgctgtgccac

SEQ ID NO: 8035582 - DNA, 22 bp, Homo sapiens
tctccaggggctgctgtgccac

SEQ ID NO: 8035583 - DNA, 22 bp, Homo sapiens
tctccaggggctgctgtgccac

SEQ ID NO: 8035584 - DNA, 22 bp, Homo sapiens
tctccaggggctgctgtgccac

SEQ ID NO: 8035585 - DNA, 22 bp, Homo sapiens
tctccccaaaggactcactctc

SEQ ID NO: 8035586 - DNA, 22 bp, Homo sapiens
tctcccagtgtctggcagtcag

SEQ ID NO: 8035587 - DNA, 22 bp, Homo sapiens
tctcccagtgtctggcagtcag

SEQ ID NO: 8035588 - DNA, 22 bp, Homo sapiens
tctcccagtggtgcagaaagca

SEQ ID NO: 8035589 - DNA, 22 bp, Homo sapiens
tctccccaaccatggcactcac

SEQ ID NO: 8035590 - DNA, 22 bp, Homo sapiens
tctccccaaccatggcactcac

SEQ ID NO: 8035591 - DNA, 22 bp, Homo sapiens
tctccccaaccatggcactcac

SEQ ID NO: 8035592 - DNA, 22 bp, Homo sapiens
tctccccagaccctggacataa

SEQ ID NO: 8035593 - DNA, 22 bp, Homo sapiens
tctccccaaccatggcactcac

SEQ ID NO: 8035594 - DNA, 22 bp, Homo sapiens
tctccccaaccatggcactcac

SEQ ID NO: 8035595 - DNA, 22 bp, Homo sapiens
tctccccaaaggactcactctc

SEQ ID NO: 8035596 - DNA, 22 bp, Homo sapiens
tctccccaaaggactcactctc

SEQ ID NO: 8035597 - DNA, 22 bp, Homo sapiens
tctccccaaaggactcactctc

SEQ ID NO: 8035598 - DNA, 22 bp, Homo sapiens
tctccccagctgagctgccctt

SEQ ID NO: 8035599 - DNA, 22 bp, Homo sapiens
tctccccagctgagctgccctt

SEQ ID NO: 8035600 - DNA, 22 bp, Homo sapiens
tctccccagaccctggacataa

SEQ ID NO: 8035601 - DNA, 22 bp, Homo sapiens
tctccccagaccctggacataa

SEQ ID NO: 8035602 - DNA, 22 bp, Homo sapiens
tctccccagctgagctgccctt

SEQ ID NO: 8035603 - DNA, 22 bp, Homo sapiens
tctccccaggggtatgggtatt

SEQ ID NO: 8035604 - DNA, 22 bp, Homo sapiens
tctccccagctgagctgccctt

SEQ ID NO: 8035605 - DNA, 22 bp, Homo sapiens
tctccccagctgagctgccctt

SEQ ID NO: 8035606 - DNA, 21 bp, Homo sapiens
tctccccattcttattcccat

SEQ ID NO: 8035607 - DNA, 21 bp, Homo sapiens
tctccccattcttattcccat

SEQ ID NO: 8035608 - DNA, 22 bp, Homo sapiens
tctccccagtatggattctctg

SEQ ID NO: 8035609 - DNA, 21 bp, Homo sapiens
tctccccattcttattcccat

SEQ ID NO: 8035610 - DNA, 22 bp, Homo sapiens
tctccccagtatggattctctg

SEQ ID NO: 8035611 - DNA, 22 bp, Homo sapiens
tctccccaggggtatgggtatt

SEQ ID NO: 8035612 - DNA, 22 bp, Homo sapiens
tctccccaggggtatgggtatt

SEQ ID NO: 8035613 - DNA, 22 bp, Homo sapiens
tctccccagtatggattctctg

SEQ ID NO: 8035614 - DNA, 22 bp, Homo sapiens
tctcccccagtctctacagcag

SEQ ID NO: 8035615 - DNA, 22 bp, Homo sapiens
tctcccccagtctctacagcag

SEQ ID NO: 8035616 - DNA, 22 bp, Homo sapiens
tctcccctccctggaccagtgc

SEQ ID NO: 8035617 - DNA, 22 bp, Homo sapiens
tctcccctgttggccaggtttt

SEQ ID NO: 8035618 - DNA, 22 bp, Homo sapiens
tctcccctgttggccaggtttt

SEQ ID NO: 8035619 - DNA, 22 bp, Homo sapiens
tctccctcattcctgcttccat

SEQ ID NO: 8035620 - DNA, 22 bp, Homo sapiens
tctccctcattcctgcttccat

SEQ ID NO: 8035621 - DNA, 22 bp, Homo sapiens
tctccctcattcctgcttccat

SEQ ID NO: 8035622 - DNA, 22 bp, Homo sapiens
tctccctcattcctgcttccat

SEQ ID NO: 8035623 - DNA, 22 bp, Homo sapiens
tctccctactgactccaggacc

SEQ ID NO: 8035624 - DNA, 22 bp, Homo sapiens
tctccctactgactccaggacc

SEQ ID NO: 8035625 - DNA, 19 bp, Homo sapiens
tctcccggcactcctgccc

SEQ ID NO: 8035626 - DNA, 23 bp, Homo sapiens
tctccctcatgcctaggcctggg

SEQ ID NO: 8035627 - DNA, 23 bp, Homo sapiens
tctccctcatgcctaggcctggg

SEQ ID NO: 8035628 - DNA, 23 bp, Homo sapiens
tctccctcatgcctaggcctggg

SEQ ID NO: 8035629 - DNA, 20 bp, Homo sapiens
tctcccaggctcagggaaga

SEQ ID NO: 8035630 - DNA, 20 bp, Homo sapiens
tctcccaggctcagggaaga

SEQ ID NO: 8035631 - DNA, 20 bp, Homo sapiens
tctcccaggctcagggaaga

SEQ ID NO: 8035632 - DNA, 22 bp, Homo sapiens
tctcccaggctgccctgtggac

SEQ ID NO: 8035633 - DNA, 22 bp, Homo sapiens
tctcccaggctgccctgtggac

SEQ ID NO: 8035634 - DNA, 22 bp, Homo sapiens
tctcccaggctgccctgtggac

SEQ ID NO: 8035635 - DNA, 22 bp, Homo sapiens
tctcccaggctgccctgtggac

SEQ ID NO: 8035636 - DNA, 22 bp, Homo sapiens
tctcccaggctgccctgtggac

SEQ ID NO: 8035637 - DNA, 22 bp, Homo sapiens
tctcccaggctgccctgtggac

SEQ ID NO: 8035638 - DNA, 22 bp, Homo sapiens
tctcccaggctgccctgtggac

SEQ ID NO: 8035639 - DNA, 22 bp, Homo sapiens
tctcccaggctgccctgtggac

SEQ ID NO: 8035640 - DNA, 22 bp, Homo sapiens
tctcccaggctggagtgcagtg

SEQ ID NO: 8035641 - DNA, 19 bp, Homo sapiens
tctcccagctgagaagggc

SEQ ID NO: 8035642 - DNA, 22 bp, Homo sapiens
tctcccaggcaggagtgcagtg

SEQ ID NO: 8035643 - DNA, 19 bp, Homo sapiens
tctcccagctgagaagggc

SEQ ID NO: 8035644 - DNA, 22 bp, Homo sapiens
tctcccagaggatcccagtgga

SEQ ID NO: 8035645 - DNA, 19 bp, Homo sapiens
tctcccagctgagaagggc

SEQ ID NO: 8035646 - DNA, 20 bp, Homo sapiens
tctcccaggctcagggaaga

SEQ ID NO: 8035647 - DNA, 22 bp, Homo sapiens
tctcccaggcaggagtgcagtg

SEQ ID NO: 8035648 - DNA, 22 bp, Homo sapiens
tctcccaggcaggagtgcagtg

SEQ ID NO: 8035649 - DNA, 22 bp, Homo sapiens
tctcccaggcaggagtgcagtg

SEQ ID NO: 8035650 - DNA, 22 bp, Homo sapiens
tctcccaggcaggagtgcagtg

SEQ ID NO: 8035651 - DNA, 22 bp, Homo sapiens
tctcccaggtgggtgcctggag

SEQ ID NO: 8035652 - DNA, 22 bp, Homo sapiens
tctcccaggtgggtgcctggag

SEQ ID NO: 8035653 - DNA, 22 bp, Homo sapiens
tctcccaggtgggtgcctggag

SEQ ID NO: 8035654 - DNA, 22 bp, Homo sapiens
tctcccaggtcatacacagaga

SEQ ID NO: 8035655 - DNA, 22 bp, Homo sapiens
tctcccaggtcatacacagaga

SEQ ID NO: 8035656 - DNA, 22 bp, Homo sapiens
tctcccaggctggagtgcagtg

SEQ ID NO: 8035657 - DNA, 22 bp, Homo sapiens
tctcccaggctggagtgcagtg

SEQ ID NO: 8035658 - DNA, 22 bp, Homo sapiens
tctcccaggctggagtgcagtg

SEQ ID NO: 8035659 - DNA, 22 bp, Homo sapiens
tctcccaggctggagtgcagtg

SEQ ID NO: 8035660 - DNA, 22 bp, Homo sapiens
tctcccaggtcatacacagaga

SEQ ID NO: 8035661 - DNA, 22 bp, Homo sapiens
tctcccaggtgggtgcctggag

SEQ ID NO: 8035662 - DNA, 22 bp, Homo sapiens
tctcccaggtgggtgcctggag

SEQ ID NO: 8035663 - DNA, 22 bp, Homo sapiens
tctcccaggtgggtgcctggag

SEQ ID NO: 8035664 - DNA, 22 bp, Homo sapiens
tctcccagtggtgcagaaagca

SEQ ID NO: 8035665 - DNA, 22 bp, Homo sapiens
tctcccagtggtgcagaaagca

SEQ ID NO: 8035666 - DNA, 22 bp, Homo sapiens
tctcccagtcctctgtgcttac

SEQ ID NO: 8035667 - DNA, 22 bp, Homo sapiens
tctcccagtggtgcagaaagca

SEQ ID NO: 8035668 - DNA, 22 bp, Homo sapiens
tctcccagtggtgcagaaagca

SEQ ID NO: 8035669 - DNA, 22 bp, Homo sapiens
tctcagcagccagatccagagc

SEQ ID NO: 8035670 - DNA, 18 bp, Homo sapiens
tctcagcccagctccggc

SEQ ID NO: 8035671 - DNA, 22 bp, Homo sapiens
tctcagcaaggaaagaggcagg

SEQ ID NO: 8035672 - DNA, 22 bp, Homo sapiens
tctcagcaaggaaagaggcagg

SEQ ID NO: 8035673 - DNA, 22 bp, Homo sapiens
tctcagcaaggaaagaggcagg

SEQ ID NO: 8035674 - DNA, 22 bp, Homo sapiens
tctcagcaaggaaagaggcagg

SEQ ID NO: 8035675 - DNA, 22 bp, Homo sapiens
tctcagcaaggaaagaggcagg

SEQ ID NO: 8035676 - DNA, 22 bp, Homo sapiens
tctcagatggcatcagctagag

SEQ ID NO: 8035677 - DNA, 22 bp, Homo sapiens
tctcagagtttttttccaggac

SEQ ID NO: 8035678 - DNA, 22 bp, Homo sapiens
tctcagatggcatcagctagag

SEQ ID NO: 8035679 - DNA, 22 bp, Homo sapiens
tctcagatggcatcagctagag

SEQ ID NO: 8035680 - DNA, 23 bp, Homo sapiens
tctcagattcagagatccctaaa

SEQ ID NO: 8035681 - DNA, 22 bp, Homo sapiens
tctcagagtttagagctgagcc

SEQ ID NO: 8035682 - DNA, 22 bp, Homo sapiens
tctcagagtttagagctgagcc

SEQ ID NO: 8035683 - DNA, 22 bp, Homo sapiens
tctcagagtttagagctgagcc

SEQ ID NO: 8035684 - DNA, 22 bp, Homo sapiens
tctcagagtttacggggctgaa

SEQ ID NO: 8035685 - DNA, 22 bp, Homo sapiens
tctcagagtttagagctgagcc

SEQ ID NO: 8035686 - DNA, 22 bp, Homo sapiens
tctcagagtttagagctgagcc

SEQ ID NO: 8035687 - DNA, 22 bp, Homo sapiens
tctcagagtttagagctgagcc

SEQ ID NO: 8035688 - DNA, 22 bp, Homo sapiens
tctcagagtttagagctgagcc

SEQ ID NO: 8035689 - DNA, 22 bp, Homo sapiens
tctcagagtttgaatctggagt

SEQ ID NO: 8035690 - DNA, 22 bp, Homo sapiens
tctcagagtttgaatctggagt

SEQ ID NO: 8035691 - DNA, 22 bp, Homo sapiens
tctcagagtttttttccaggac

SEQ ID NO: 8035692 - DNA, 22 bp, Homo sapiens
tctcagagtttttttccaggac

SEQ ID NO: 8035693 - DNA, 22 bp, Homo sapiens
tctcagaggcccgacgttctcc

SEQ ID NO: 8035694 - DNA, 22 bp, Homo sapiens
tctcagagggaaacatgagtga

SEQ ID NO: 8035695 - DNA, 22 bp, Homo sapiens
tctcagagggaaacatgagtga

SEQ ID NO: 8035696 - DNA, 22 bp, Homo sapiens
tctcagagggaaacatgagtga

SEQ ID NO: 8035697 - DNA, 22 bp, Homo sapiens
tctcagagggaaacatgagtga

SEQ ID NO: 8035698 - DNA, 22 bp, Homo sapiens
tctcagagggaaacatgagtga

SEQ ID NO: 8035699 - DNA, 22 bp, Homo sapiens
tctcagagggaggattactgcc

SEQ ID NO: 8035700 - DNA, 22 bp, Homo sapiens
tctcagaggtgccctggcatct

SEQ ID NO: 8035701 - DNA, 22 bp, Homo sapiens
tctcagagtaattctttaaggt

SEQ ID NO: 8035702 - DNA, 22 bp, Homo sapiens
tctcagagtgacaatgagaatt

SEQ ID NO: 8035703 - DNA, 22 bp, Homo sapiens
tctcagagtgacaatgagaatt

SEQ ID NO: 8035704 - DNA, 22 bp, Homo sapiens
tctcagagtgacaatgagaatt

SEQ ID NO: 8035705 - DNA, 22 bp, Homo sapiens
tctcagagtaattctttaaggt

SEQ ID NO: 8035706 - DNA, 22 bp, Homo sapiens
tctcagagttcctctggagtcc

SEQ ID NO: 8035707 - DNA, 22 bp, Homo sapiens
tctcagagttcctctggagtcc

SEQ ID NO: 8035708 - DNA, 22 bp, Homo sapiens
tctcagagtggtggtccctctg

SEQ ID NO: 8035709 - DNA, 22 bp, Homo sapiens
tctcagctcttttttcacagaa

SEQ ID NO: 8035710 - DNA, 22 bp, Homo sapiens
tctcagctcttttttcacagaa

SEQ ID NO: 8035711 - DNA, 22 bp, Homo sapiens
tctcagctcttttttcacagaa

SEQ ID NO: 8035712 - DNA, 22 bp, Homo sapiens
tctcagctcttttttcacagaa

SEQ ID NO: 8035713 - DNA, 22 bp, Homo sapiens
tctcagctgactgctttcctcg

SEQ ID NO: 8035714 - DNA, 22 bp, Homo sapiens
tctcagctgcctgccctgctcc

SEQ ID NO: 8035715 - DNA, 22 bp, Homo sapiens
tctcagctgcctgccctgctcc

SEQ ID NO: 8035716 - DNA, 22 bp, Homo sapiens
tctcagcctcacctctatggag

SEQ ID NO: 8035717 - DNA, 22 bp, Homo sapiens
tctcagctcagcttccacagag

SEQ ID NO: 8035718 - DNA, 22 bp, Homo sapiens
tctcagcctcacctctatggag

SEQ ID NO: 8035719 - DNA, 18 bp, Homo sapiens
tctcagcccagctccggc

SEQ ID NO: 8035720 - DNA, 22 bp, Homo sapiens
tctcagctcagcttccacagag

SEQ ID NO: 8035721 - DNA, 20 bp, Homo sapiens
tctcaggccccctccttgct

SEQ ID NO: 8035722 - DNA, 20 bp, Homo sapiens
tctcaggccccctccttgct

SEQ ID NO: 8035723 - DNA, 22 bp, Homo sapiens
tctcaggcccctgagtttctct

SEQ ID NO: 8035724 - DNA, 20 bp, Homo sapiens
tctcaggccccctccttgct

SEQ ID NO: 8035725 - DNA, 21 bp, Homo sapiens
tctcaggcgagaattctttta

SEQ ID NO: 8035726 - DNA, 21 bp, Homo sapiens
tctcaggcgagaattctttta

SEQ ID NO: 8035727 - DNA, 22 bp, Homo sapiens
tctcaggcccctgagtttctct

SEQ ID NO: 8035728 - DNA, 22 bp, Homo sapiens
tctcaggctaccttgcacaagg

SEQ ID NO: 8035729 - DNA, 22 bp, Homo sapiens
tctcaggctagtaaaagatggg

SEQ ID NO: 8035730 - DNA, 22 bp, Homo sapiens
tctcaggctaccttgcacaagg

SEQ ID NO: 8035731 - DNA, 22 bp, Homo sapiens
tctcaggctaccttgcacaagg

SEQ ID NO: 8035732 - DNA, 21 bp, Homo sapiens
tctcaggcgagaattctttta

SEQ ID NO: 8035733 - DNA, 22 bp, Homo sapiens
tctcaggctaccttgcacaagg

SEQ ID NO: 8035734 - DNA, 22 bp, Homo sapiens
tctcaggctagtaaaagatggg

SEQ ID NO: 8035735 - DNA, 22 bp, Homo sapiens
tctcaggctcctgacatatatg

SEQ ID NO: 8035736 - DNA, 22 bp, Homo sapiens
tctcaggctcctgacatatatg

SEQ ID NO: 8035737 - DNA, 22 bp, Homo sapiens
tctcagggagttgaggctgcct

SEQ ID NO: 8035738 - DNA, 22 bp, Homo sapiens
tctcagggagttgaggctgcct

SEQ ID NO: 8035739 - DNA, 22 bp, Homo sapiens
tctcagggagttgaggctgcct

SEQ ID NO: 8035740 - DNA, 22 bp, Homo sapiens
tctcagggagttgaggctgcct

SEQ ID NO: 8035741 - DNA, 22 bp, Homo sapiens
tctcagggagttgaggctgcct

SEQ ID NO: 8035742 - DNA, 22 bp, Homo sapiens
tctcagggcagcaaggaagcat

SEQ ID NO: 8035743 - DNA, 22 bp, Homo sapiens
tctcagggccccaaaggctagt

SEQ ID NO: 8035744 - DNA, 22 bp, Homo sapiens
tctcagggcgcagtgaggcagt

SEQ ID NO: 8035745 - DNA, 22 bp, Homo sapiens
tctcaggcttcctggtgctgtg

SEQ ID NO: 8035746 - DNA, 22 bp, Homo sapiens
tctcagggagagctgctggcat

SEQ ID NO: 8035747 - DNA, 22 bp, Homo sapiens
tctcagggaccatgatgatgac

SEQ ID NO: 8035748 - DNA, 22 bp, Homo sapiens
tctcaggctcttggaacctgtt

SEQ ID NO: 8035749 - DNA, 22 bp, Homo sapiens
tctcaggctgacattgggactc

SEQ ID NO: 8035750 - DNA, 19 bp, Homo sapiens
tctcaggctgggcggctgc

SEQ ID NO: 8035751 - DNA, 22 bp, Homo sapiens
tctcaggctcttggaacctgtt

SEQ ID NO: 8035752 - DNA, 22 bp, Homo sapiens
tctcaggctgtgtgtggaggac

SEQ ID NO: 8035753 - DNA, 22 bp, Homo sapiens
tctcaggctgtgtgtggaggac

SEQ ID NO: 8035754 - DNA, 22 bp, Homo sapiens
tctcagagcttcagttattttc

SEQ ID NO: 8035755 - DNA, 22 bp, Homo sapiens
tctcagagcttcagaaagcacc

SEQ ID NO: 8035756 - DNA, 22 bp, Homo sapiens
tctcagagcttcagaaagcacc

SEQ ID NO: 8035757 - DNA, 22 bp, Homo sapiens
tctcagagcttcagaaagcacc

SEQ ID NO: 8035758 - DNA, 19 bp, Homo sapiens
tctcagagccctagaggcc

SEQ ID NO: 8035759 - DNA, 22 bp, Homo sapiens
tctcagagcctaactaacctaa

SEQ ID NO: 8035760 - DNA, 23 bp, Homo sapiens
tctcagaggattcctgggccttg

SEQ ID NO: 8035761 - DNA, 19 bp, Homo sapiens
tctcagaggaaaaattgct

SEQ ID NO: 8035762 - DNA, 23 bp, Homo sapiens
tctcagaggattcctgggccttg

SEQ ID NO: 8035763 - DNA, 23 bp, Homo sapiens
tctcagaggattcctgggccttg

SEQ ID NO: 8035764 - DNA, 23 bp, Homo sapiens
tctcagaggattcctgggccttg

SEQ ID NO: 8035765 - DNA, 19 bp, Homo sapiens
tctcagagccctagaggcc

SEQ ID NO: 8035766 - DNA, 19 bp, Homo sapiens
tctcagagccctagaggcc

SEQ ID NO: 8035767 - DNA, 19 bp, Homo sapiens
tctcagagccctagaggcc

SEQ ID NO: 8035768 - DNA, 19 bp, Homo sapiens
tctcagagccctagaggcc

SEQ ID NO: 8035769 - DNA, 19 bp, Homo sapiens
tctcagagccctagaggcc

SEQ ID NO: 8035770 - DNA, 22 bp, Homo sapiens
tctcagagatttatggaaaact

SEQ ID NO: 8035771 - DNA, 22 bp, Homo sapiens
tctcagagcatcattttcttag

SEQ ID NO: 8035772 - DNA, 22 bp, Homo sapiens
tctcagagatttatggaaaact

SEQ ID NO: 8035773 - DNA, 22 bp, Homo sapiens
tctcagagatttatggaaaact

SEQ ID NO: 8035774 - DNA, 22 bp, Homo sapiens
tctcagaaatgacaggaggtac

SEQ ID NO: 8035775 - DNA, 22 bp, Homo sapiens
tctcagaaatgacaggaggtac

SEQ ID NO: 8035776 - DNA, 22 bp, Homo sapiens
tctcagaaatactatgttgtca

SEQ ID NO: 8035777 - DNA, 22 bp, Homo sapiens
tctcagaaatactatgttgtca

SEQ ID NO: 8035778 - DNA, 22 bp, Homo sapiens
tctcagaaatactatgttgtca

SEQ ID NO: 8035779 - DNA, 22 bp, Homo sapiens
tctcagaaatactatgttgtca

SEQ ID NO: 8035780 - DNA, 22 bp, Homo sapiens
tctcagaaatactatgttgtca

SEQ ID NO: 8035781 - DNA, 23 bp, Homo sapiens
tctcagaaaggagaagtaatttg

SEQ ID NO: 8035782 - DNA, 23 bp, Homo sapiens
tctcagaaaggagaagtaatttg

SEQ ID NO: 8035783 - DNA, 22 bp, Homo sapiens
tctcagaacctcagtttgctct

SEQ ID NO: 8035784 - DNA, 22 bp, Homo sapiens
tctcagaacacccttctatggt

SEQ ID NO: 8035785 - DNA, 22 bp, Homo sapiens
tctcagaacacccttctatggt

SEQ ID NO: 8035786 - DNA, 22 bp, Homo sapiens
tctcagaacacccttctatggt

SEQ ID NO: 8035787 - DNA, 22 bp, Homo sapiens
tctcagaacacccttctatggt

SEQ ID NO: 8035788 - DNA, 22 bp, Homo sapiens
tctcagaaggcaagggctgggg

SEQ ID NO: 8035789 - DNA, 22 bp, Homo sapiens
tctcagaactttatatgtatca

SEQ ID NO: 8035790 - DNA, 22 bp, Homo sapiens
tctcagaactttatatgtatca

SEQ ID NO: 8035791 - DNA, 22 bp, Homo sapiens
tctcagaactttatatgtatca

SEQ ID NO: 8035792 - DNA, 22 bp, Homo sapiens
tctcagagatgtcaagagtcta

SEQ ID NO: 8035793 - DNA, 22 bp, Homo sapiens
tctcagagatgtcaagagtcta

SEQ ID NO: 8035794 - DNA, 22 bp, Homo sapiens
tctcagagatgtcaagagtcta

SEQ ID NO: 8035795 - DNA, 22 bp, Homo sapiens
tctcagagatgttagggaagag

SEQ ID NO: 8035796 - DNA, 22 bp, Homo sapiens
tctcagagatgttagggaagag

SEQ ID NO: 8035797 - DNA, 22 bp, Homo sapiens
tctcagagatgttagggaagag

SEQ ID NO: 8035798 - DNA, 22 bp, Homo sapiens
tctcagagatctttctgcatgt

SEQ ID NO: 8035799 - DNA, 22 bp, Homo sapiens
tctcagagatctttctgcatgt

SEQ ID NO: 8035800 - DNA, 22 bp, Homo sapiens
tctcagagatctttctgcatgt

SEQ ID NO: 8035801 - DNA, 22 bp, Homo sapiens
tctcagagatctttctgcatgt

SEQ ID NO: 8035802 - DNA, 22 bp, Homo sapiens
tctcagagagatgaaacttcca

SEQ ID NO: 8035803 - DNA, 22 bp, Homo sapiens
tctcagagagatgaaacttcca

SEQ ID NO: 8035804 - DNA, 22 bp, Homo sapiens
tctcagagagctgtgttttcct

SEQ ID NO: 8035805 - DNA, 22 bp, Homo sapiens
tctcaccccgttttctgtgtga

SEQ ID NO: 8035806 - DNA, 22 bp, Homo sapiens
tctcaccccgttttctgtgtga

SEQ ID NO: 8035807 - DNA, 22 bp, Homo sapiens
tctcacccaacgtgcaatgagt

SEQ ID NO: 8035808 - DNA, 22 bp, Homo sapiens
tctcacccaacgtgcaatgagt

SEQ ID NO: 8035809 - DNA, 22 bp, Homo sapiens
tctcacccaacgtgcaatgagt

SEQ ID NO: 8035810 - DNA, 22 bp, Homo sapiens
tctcaccaaagccttgaccata

SEQ ID NO: 8035811 - DNA, 22 bp, Homo sapiens
tctcaccatcttgaatccctta

SEQ ID NO: 8035812 - DNA, 22 bp, Homo sapiens
tctcaccaaagccttgaccata

SEQ ID NO: 8035813 - DNA, 22 bp, Homo sapiens
tctcaccatcttgaatccctta

SEQ ID NO: 8035814 - DNA, 22 bp, Homo sapiens
tctcacatgcaaacagtccaca

SEQ ID NO: 8035815 - DNA, 22 bp, Homo sapiens
tctcacatcttcttggctttat

SEQ ID NO: 8035816 - DNA, 22 bp, Homo sapiens
tctcacattttaaaaggacata

SEQ ID NO: 8035817 - DNA, 22 bp, Homo sapiens
tctcacattttaaaaggacata

SEQ ID NO: 8035818 - DNA, 19 bp, Homo sapiens
tctcacagtttccttgcct

SEQ ID NO: 8035819 - DNA, 22 bp, Homo sapiens
tctcacagtgcaggtctgtctc

SEQ ID NO: 8035820 - DNA, 22 bp, Homo sapiens
tctcacagtgagcctgaggtcg

SEQ ID NO: 8035821 - DNA, 22 bp, Homo sapiens
tctcacagttgtccactgaaaa

SEQ ID NO: 8035822 - DNA, 22 bp, Homo sapiens
tctcacagttgtccactgaaaa

SEQ ID NO: 8035823 - DNA, 22 bp, Homo sapiens
tctcacagtgcaggtctgtctc

SEQ ID NO: 8035824 - DNA, 22 bp, Homo sapiens
tctcacagttgtcccttgtgag

SEQ ID NO: 8035825 - DNA, 22 bp, Homo sapiens
tctcacagttgtccactgaaaa

SEQ ID NO: 8035826 - DNA, 22 bp, Homo sapiens
tctcacaggtgcacgtggctgt

SEQ ID NO: 8035827 - DNA, 22 bp, Homo sapiens
tctcacagtatgaattgttcac

SEQ ID NO: 8035828 - DNA, 22 bp, Homo sapiens
tctcacagtgagcctgaggtcg

SEQ ID NO: 8035829 - DNA, 22 bp, Homo sapiens
tctcacagtatgaattgttcac

SEQ ID NO: 8035830 - DNA, 22 bp, Homo sapiens
tctcacagtgagcctgaggtcg

SEQ ID NO: 8035831 - DNA, 22 bp, Homo sapiens
tctcagaaaagagcttcagaaa

SEQ ID NO: 8035832 - DNA, 22 bp, Homo sapiens
tctcagaaaaaggagaaactgg

SEQ ID NO: 8035833 - DNA, 22 bp, Homo sapiens
tctcagaaaaaggagaaactgg

SEQ ID NO: 8035834 - DNA, 22 bp, Homo sapiens
tctcagaaaagagcttcagaaa

SEQ ID NO: 8035835 - DNA, 22 bp, Homo sapiens
tctcagaaaagagcttcagaaa

SEQ ID NO: 8035836 - DNA, 22 bp, Homo sapiens
tctcagaaaaaggagaaactgg

SEQ ID NO: 8035837 - DNA, 22 bp, Homo sapiens
tctcagaaaaaggagaaactgg

SEQ ID NO: 8035838 - DNA, 22 bp, Homo sapiens
tctcagaaaaaggagaaactgg

SEQ ID NO: 8035839 - DNA, 22 bp, Homo sapiens
tctcagaaaaactttgagggta

SEQ ID NO: 8035840 - DNA, 22 bp, Homo sapiens
tctcagaaaaactttgagggta

SEQ ID NO: 8035841 - DNA, 22 bp, Homo sapiens
tctcactttccagacttttcaa

SEQ ID NO: 8035842 - DNA, 22 bp, Homo sapiens
tctcactgggtcacagcagagg

SEQ ID NO: 8035843 - DNA, 22 bp, Homo sapiens
tctcactgggtataaatgagta

SEQ ID NO: 8035844 - DNA, 22 bp, Homo sapiens
tctcactgggtataaatgagta

SEQ ID NO: 8035845 - DNA, 22 bp, Homo sapiens
tctcactcatttcctaggtctt

SEQ ID NO: 8035846 - DNA, 22 bp, Homo sapiens
tctcactgatttgagaccaagg

SEQ ID NO: 8035847 - DNA, 22 bp, Homo sapiens
tctccacaagctgatgctagga

SEQ ID NO: 8035848 - DNA, 22 bp, Homo sapiens
tctccaaggagctcctgtgccg

SEQ ID NO: 8035849 - DNA, 22 bp, Homo sapiens
tctccaaggccctactctattt

SEQ ID NO: 8035850 - DNA, 22 bp, Homo sapiens
tctccaggaagccctccctgac

SEQ ID NO: 8035851 - DNA, 22 bp, Homo sapiens
tctccacaagctttctcctttt

SEQ ID NO: 8035852 - DNA, 22 bp, Homo sapiens
tctccaagaaaagatctcagct

SEQ ID NO: 8035853 - DNA, 22 bp, Homo sapiens
tctccaagaaaagatctcagct

SEQ ID NO: 8035854 - DNA, 22 bp, Homo sapiens
tctccaagaaaagatctcagct

SEQ ID NO: 8035855 - DNA, 22 bp, Homo sapiens
tctccaagcagggctgcaaggc

SEQ ID NO: 8035856 - DNA, 22 bp, Homo sapiens
tctccaaggagctcctgtgccg

SEQ ID NO: 8035857 - DNA, 22 bp, Homo sapiens
tctccaagcagggctgcaaggc

SEQ ID NO: 8035858 - DNA, 22 bp, Homo sapiens
tctccaggactgagctccagcc

SEQ ID NO: 8035859 - DNA, 22 bp, Homo sapiens
tctccaggactgagctccagcc

SEQ ID NO: 8035860 - DNA, 22 bp, Homo sapiens
tctccaggactgagctccagcc

SEQ ID NO: 8035861 - DNA, 22 bp, Homo sapiens
tctccaggactgagctccagcc

SEQ ID NO: 8035862 - DNA, 22 bp, Homo sapiens
tctccaggactgagctccagcc

SEQ ID NO: 8035863 - DNA, 17 bp, Homo sapiens
tctccaggacgagctca

SEQ ID NO: 8035864 - DNA, 17 bp, Homo sapiens
tctccaggacgagctca

SEQ ID NO: 8035865 - DNA, 17 bp, Homo sapiens
tctccaggacgagctca

SEQ ID NO: 8035866 - DNA, 17 bp, Homo sapiens
tctccaggacgagctca

SEQ ID NO: 8035867 - DNA, 22 bp, Homo sapiens
tctccacaagctgatgctagga

SEQ ID NO: 8035868 - DNA, 22 bp, Homo sapiens
tctccaggaagccctccctgac

SEQ ID NO: 8035869 - DNA, 22 bp, Homo sapiens
tctccaggaagccctccctgac

SEQ ID NO: 8035870 - DNA, 22 bp, Homo sapiens
tctccaggcactacctgggtaa

SEQ ID NO: 8035871 - DNA, 22 bp, Homo sapiens
tctccaggcactacctgggtaa

SEQ ID NO: 8035872 - DNA, 22 bp, Homo sapiens
tctccaggcactacctgggtaa

SEQ ID NO: 8035873 - DNA, 22 bp, Homo sapiens
tctccaggcacttggctgctac

SEQ ID NO: 8035874 - DNA, 22 bp, Homo sapiens
tctccaggcactacctgggtaa

SEQ ID NO: 8035875 - DNA, 22 bp, Homo sapiens
tctccaggcacttggctgctac

SEQ ID NO: 8035876 - DNA, 22 bp, Homo sapiens
tctccaggagcaagtcacccag

SEQ ID NO: 8035877 - DNA, 22 bp, Homo sapiens
tctccaggagcaagtcacccag

SEQ ID NO: 8035878 - DNA, 22 bp, Homo sapiens
tctccaggagaaatatgaagga

SEQ ID NO: 8035879 - DNA, 19 bp, Homo sapiens
tctccaggcaggtgagcga

SEQ ID NO: 8035880 - DNA, 19 bp, Homo sapiens
tctccaggcaggtgagcga

SEQ ID NO: 8035881 - DNA, 19 bp, Homo sapiens
tctccaggcaggtgagcga

SEQ ID NO: 8035882 - DNA, 22 bp, Homo sapiens
tctccaggcacttggctgctac

SEQ ID NO: 8035883 - DNA, 22 bp, Homo sapiens
tctccaggcacttggctgctac

SEQ ID NO: 8035884 - DNA, 22 bp, Homo sapiens
tctccaggcacttggctgctac

SEQ ID NO: 8035885 - DNA, 22 bp, Homo sapiens
tctccaggcacttggctgctac

SEQ ID NO: 8035886 - DNA, 23 bp, Homo sapiens
tctccaggccttactccaggcct

SEQ ID NO: 8035887 - DNA, 23 bp, Homo sapiens
tctccaggccttactccaggcct

SEQ ID NO: 8035888 - DNA, 23 bp, Homo sapiens
tctccaggccttactccaggcct

SEQ ID NO: 8035889 - DNA, 19 bp, Homo sapiens
tctccaggcaggtgagcga

SEQ ID NO: 8035890 - DNA, 22 bp, Homo sapiens
tctccaggcccactgatttata

SEQ ID NO: 8035891 - DNA, 22 bp, Homo sapiens
tctcatttgcctcatctataaa

SEQ ID NO: 8035892 - DNA, 22 bp, Homo sapiens
tctcatttgcctcatctataaa

SEQ ID NO: 8035893 - DNA, 22 bp, Homo sapiens
tctcatttggctttgttttaaa

SEQ ID NO: 8035894 - DNA, 22 bp, Homo sapiens
tctcatttggctttgttttaaa

SEQ ID NO: 8035895 - DNA, 22 bp, Homo sapiens
tctcatttggctttgttttaaa

SEQ ID NO: 8035896 - DNA, 22 bp, Homo sapiens
tctcatttggctttgttttaaa

SEQ ID NO: 8035897 - DNA, 22 bp, Homo sapiens
tctcatttgcctcatctataaa

SEQ ID NO: 8035898 - DNA, 22 bp, Homo sapiens
tctcatttgcctcatctataaa

SEQ ID NO: 8035899 - DNA, 22 bp, Homo sapiens
tctcatttgcctcatctataaa

SEQ ID NO: 8035900 - DNA, 22 bp, Homo sapiens
tctcatttgcctcatctataaa

SEQ ID NO: 8035901 - DNA, 22 bp, Homo sapiens
tctcatttggctttgttttaaa

SEQ ID NO: 8035902 - DNA, 22 bp, Homo sapiens
tctcatttgtgtgcaattcaga

SEQ ID NO: 8035903 - DNA, 22 bp, Homo sapiens
tctcatttgtgtgcaattcaga

SEQ ID NO: 8035904 - DNA, 22 bp, Homo sapiens
tctcatttgtgtgcaattcaga

SEQ ID NO: 8035905 - DNA, 22 bp, Homo sapiens
tctcattttgagtcagacacta

SEQ ID NO: 8035906 - DNA, 22 bp, Homo sapiens
tctccaaatagttatatttaga

SEQ ID NO: 8035907 - DNA, 19 bp, Homo sapiens
tctccaaaaccaatcacta

SEQ ID NO: 8035908 - DNA, 22 bp, Homo sapiens
tctccaaatagttatatttaga

SEQ ID NO: 8035909 - DNA, 22 bp, Homo sapiens
tctccaaatcaatcaatatgaa

SEQ ID NO: 8035910 - DNA, 19 bp, Homo sapiens
tctccaaaaccaatcacta

SEQ ID NO: 8035911 - DNA, 19 bp, Homo sapiens
tctccaaaaccaatcacta

SEQ ID NO: 8035912 - DNA, 19 bp, Homo sapiens
tctccaaaaccaatcacta

SEQ ID NO: 8035913 - DNA, 18 bp, Homo sapiens
tctcattacaatctttgt

SEQ ID NO: 8035914 - DNA, 18 bp, Homo sapiens
tctcattacaatctttgt

SEQ ID NO: 8035915 - DNA, 22 bp, Homo sapiens
tctcatgttttacctgtcctca

SEQ ID NO: 8035916 - DNA, 22 bp, Homo sapiens
tctcattatccatcactgcact

SEQ ID NO: 8035917 - DNA, 22 bp, Homo sapiens
tctcattatccatcactgcact

SEQ ID NO: 8035918 - DNA, 20 bp, Homo sapiens
tctcattatatccaagaggc

SEQ ID NO: 8035919 - DNA, 22 bp, Homo sapiens
tctcatgttttacctgtcctca

SEQ ID NO: 8035920 - DNA, 22 bp, Homo sapiens
tctcatgtgattcccgtgcatg

SEQ ID NO: 8035921 - DNA, 22 bp, Homo sapiens
tctcatgtattgccctggtgtg

SEQ ID NO: 8035922 - DNA, 22 bp, Homo sapiens
tctcatggtttgtgattcaaat

SEQ ID NO: 8035923 - DNA, 22 bp, Homo sapiens
tctcattcataccctacatgct

SEQ ID NO: 8035924 - DNA, 22 bp, Homo sapiens
tctcattcatccaaggatttat

SEQ ID NO: 8035925 - DNA, 22 bp, Homo sapiens
tctcattcataccctacatgct

SEQ ID NO: 8035926 - DNA, 22 bp, Homo sapiens
tctcattcatccaaggatttat

SEQ ID NO: 8035927 - DNA, 22 bp, Homo sapiens
tctcattgcacaatgcagagtg

SEQ ID NO: 8035928 - DNA, 22 bp, Homo sapiens
tctcattgccttcactcttcag

SEQ ID NO: 8035929 - DNA, 23 bp, Homo sapiens
tctcatttcccttgatctatctt

SEQ ID NO: 8035930 - DNA, 22 bp, Homo sapiens
tctcatttacttccacaggctg

SEQ ID NO: 8035931 - DNA, 22 bp, Homo sapiens
tctcatttacttccacaggctg

SEQ ID NO: 8035932 - DNA, 22 bp, Homo sapiens
tctcattgttagtgtgggagca

SEQ ID NO: 8035933 - DNA, 22 bp, Homo sapiens
tctcattgtccaattgaattta

SEQ ID NO: 8035934 - DNA, 22 bp, Homo sapiens
tctcattggtatgatgtgtaga

SEQ ID NO: 8035935 - DNA, 22 bp, Homo sapiens
tctcataatagcatttctcacc

SEQ ID NO: 8035936 - DNA, 22 bp, Homo sapiens
tctcagttttttcaaccataat

SEQ ID NO: 8035937 - DNA, 22 bp, Homo sapiens
tctcatacgtttccaggtgtca

SEQ ID NO: 8035938 - DNA, 22 bp, Homo sapiens
tctcatcacacagccagtatgt

SEQ ID NO: 8035939 - DNA, 22 bp, Homo sapiens
tctcatcacacagccagtatgt

SEQ ID NO: 8035940 - DNA, 22 bp, Homo sapiens
tctcatacatgtttgcagaaag

SEQ ID NO: 8035941 - DNA, 22 bp, Homo sapiens
tctcataattaggtaagtcaga

SEQ ID NO: 8035942 - DNA, 22 bp, Homo sapiens
tctcagtggacgtgtctgtctt

SEQ ID NO: 8035943 - DNA, 22 bp, Homo sapiens
tctcagttttttcaaccataat

SEQ ID NO: 8035944 - DNA, 22 bp, Homo sapiens
tctcagtggacgtgtctgtctt

SEQ ID NO: 8035945 - DNA, 22 bp, Homo sapiens
tctcagtggacgtgtctgtctt

SEQ ID NO: 8035946 - DNA, 23 bp, Homo sapiens
tctcagtgccgattgcatacaca

SEQ ID NO: 8035947 - DNA, 23 bp, Homo sapiens
tctcagtgccgattgcatacaca

SEQ ID NO: 8035948 - DNA, 22 bp, Homo sapiens
tctcagtgcagcttgacagaga

SEQ ID NO: 8035949 - DNA, 19 bp, Homo sapiens
tctcagtgccgctgaccgc

SEQ ID NO: 8035950 - DNA, 19 bp, Homo sapiens
tctcagtgccgctgaccgc

SEQ ID NO: 8035951 - DNA, 22 bp, Homo sapiens
tctcagtgctatccatattcca

SEQ ID NO: 8035952 - DNA, 22 bp, Homo sapiens
tctcatctagactctgcccttg

SEQ ID NO: 8035953 - DNA, 19 bp, Homo sapiens
tctcatccagcattcaaga

SEQ ID NO: 8035954 - DNA, 22 bp, Homo sapiens
tctcatcacttaacatctgctt

SEQ ID NO: 8035955 - DNA, 22 bp, Homo sapiens
tctcatcacacagccagtatgt

SEQ ID NO: 8035956 - DNA, 22 bp, Homo sapiens
tctcatcagcccaaacatgaca

SEQ ID NO: 8035957 - DNA, 22 bp, Homo sapiens
tctcatcagcccaaacatgaca

SEQ ID NO: 8035958 - DNA, 22 bp, Homo sapiens
tctcatcagcccaaacatgaca

SEQ ID NO: 8035959 - DNA, 22 bp, Homo sapiens
tctcatcagcccaaacatgaca

SEQ ID NO: 8035960 - DNA, 22 bp, Homo sapiens
tctcatcagcccaaacatgaca

SEQ ID NO: 8035961 - DNA, 22 bp, Homo sapiens
tctcatctattcacattaactg

SEQ ID NO: 8035962 - DNA, 22 bp, Homo sapiens
tctcatctagactctgcccttg

SEQ ID NO: 8035963 - DNA, 22 bp, Homo sapiens
tctcatctcaaattgtaatccc

SEQ ID NO: 8035964 - DNA, 22 bp, Homo sapiens
tctcatctccattatagcatca

SEQ ID NO: 8035965 - DNA, 22 bp, Homo sapiens
tctcatctttaaatgaaaattt

SEQ ID NO: 8035966 - DNA, 22 bp, Homo sapiens
tctcatcttgttcatctaccct

SEQ ID NO: 8035967 - DNA, 22 bp, Homo sapiens
tctcatggagtcaggagcagaa

SEQ ID NO: 8035968 - DNA, 22 bp, Homo sapiens
tctcatggagtcaggagcagaa

SEQ ID NO: 8035969 - DNA, 22 bp, Homo sapiens
tctcatggagtcaggagcagaa

SEQ ID NO: 8035970 - DNA, 22 bp, Homo sapiens
tctcatgctgtagtgcactaac

SEQ ID NO: 8035971 - DNA, 22 bp, Homo sapiens
tctcatgctgtagtgcactaac

SEQ ID NO: 8035972 - DNA, 22 bp, Homo sapiens
tctcatcttcattgtctcccat

SEQ ID NO: 8035973 - DNA, 22 bp, Homo sapiens
tctcatcttcatatctgaaaga

SEQ ID NO: 8035974 - DNA, 22 bp, Homo sapiens
tctcatctgcgagctctgccag

SEQ ID NO: 8035975 - DNA, 22 bp, Homo sapiens
tctcatctgcgagctctgccag

SEQ ID NO: 8035976 - DNA, 22 bp, Homo sapiens
tctcatctgccatttgcaggag

SEQ ID NO: 8035977 - DNA, 22 bp, Homo sapiens
tctcatctcggatcagaagtga

SEQ ID NO: 8035978 - DNA, 22 bp, Homo sapiens
tctcatctgccatttgcaggag

SEQ ID NO: 8035979 - DNA, 22 bp, Homo sapiens
tctcatctcggatcagaagtga

SEQ ID NO: 8035980 - DNA, 22 bp, Homo sapiens
tctcatctcggatcagaagtga

SEQ ID NO: 8035981 - DNA, 21 bp, Homo sapiens
tctcatctcctgacctgtgcc

SEQ ID NO: 8035982 - DNA, 21 bp, Homo sapiens
tctcatctcctgacctgtgcc

SEQ ID NO: 8035983 - DNA, 22 bp, Homo sapiens
tctcaggtctcatgccaggcct

SEQ ID NO: 8035984 - DNA, 22 bp, Homo sapiens
tctcaggtaagcttctttgatg

SEQ ID NO: 8035985 - DNA, 22 bp, Homo sapiens
tctcagggtttgtacaagtgta

SEQ ID NO: 8035986 - DNA, 22 bp, Homo sapiens
tctcagggtttcctgggggctg

SEQ ID NO: 8035987 - DNA, 20 bp, Homo sapiens
tctcagggttcagcaaagta

SEQ ID NO: 8035988 - DNA, 23 bp, Homo sapiens
tctcagggtggctgggcccatcc

SEQ ID NO: 8035989 - DNA, 20 bp, Homo sapiens
tctcagggtcttagatggaa

SEQ ID NO: 8035990 - DNA, 22 bp, Homo sapiens
tctcagggtgaggaaagaattt

SEQ ID NO: 8035991 - DNA, 20 bp, Homo sapiens
tctcagggttcagcaaagta

SEQ ID NO: 8035992 - DNA, 22 bp, Homo sapiens
tctcagggcgcagtgaggcagt

SEQ ID NO: 8035993 - DNA, 22 bp, Homo sapiens
tctcagggctcagagctcaggc

SEQ ID NO: 8035994 - DNA, 22 bp, Homo sapiens
tctcagggctcagagctcaggc

SEQ ID NO: 8035995 - DNA, 22 bp, Homo sapiens
tctcaggggcagtgatcctaag

SEQ ID NO: 8035996 - DNA, 22 bp, Homo sapiens
tctcaggggattcactggcacc

SEQ ID NO: 8035997 - DNA, 17 bp, Homo sapiens
tctcaggggctagccct

SEQ ID NO: 8035998 - DNA, 17 bp, Homo sapiens
tctcaggggctagccct

SEQ ID NO: 8035999 - DNA, 23 bp, Homo sapiens
tctcagtgcacgcaccatgcctg

SEQ ID NO: 8036000 - DNA, 22 bp, Homo sapiens
tctcagtgcagagaggctatct

SEQ ID NO: 8036001 - DNA, 22 bp, Homo sapiens
tctcagtgcagcaaggaattta

SEQ ID NO: 8036002 - DNA, 22 bp, Homo sapiens
tctcagtgcagcaaggaattta

SEQ ID NO: 8036003 - DNA, 22 bp, Homo sapiens
tctcagtgcagagaggctatct

SEQ ID NO: 8036004 - DNA, 22 bp, Homo sapiens
tctcagtgcagcaaggaattta

SEQ ID NO: 8036005 - DNA, 22 bp, Homo sapiens
tctcagtgcagcttgacagaga

SEQ ID NO: 8036006 - DNA, 22 bp, Homo sapiens
tctcagtgcagcttgacagaga

SEQ ID NO: 8036007 - DNA, 22 bp, Homo sapiens
tctcagtgcagcaaggaattta

SEQ ID NO: 8036008 - DNA, 22 bp, Homo sapiens
tctcagtgcagcttgacagaga

SEQ ID NO: 8036009 - DNA, 23 bp, Homo sapiens
tctcagtgcacgcaccatgcctg

SEQ ID NO: 8036010 - DNA, 22 bp, Homo sapiens
tctcagtgatggcccatttgga

SEQ ID NO: 8036011 - DNA, 22 bp, Homo sapiens
tctcagtgagcttttctatgtt

SEQ ID NO: 8036012 - DNA, 22 bp, Homo sapiens
tctcagtgatggcccatttgga

SEQ ID NO: 8036013 - DNA, 17 bp, Homo sapiens
tctcagtgactgatagc

SEQ ID NO: 8036014 - DNA, 22 bp, Homo sapiens
tctcagtgactgctgggtcccc

SEQ ID NO: 8036015 - DNA, 22 bp, Homo sapiens
tctcagtgactgctgggtcccc

SEQ ID NO: 8036016 - DNA, 23 bp, Homo sapiens
tctcagtgaatctcagaattcgc

SEQ ID NO: 8036017 - DNA, 23 bp, Homo sapiens
tctcagtgaatctcagaattcgc

SEQ ID NO: 8036018 - DNA, 22 bp, Homo sapiens
tctcagtgaagagtataacaaa

SEQ ID NO: 8036019 - DNA, 22 bp, Homo sapiens
tctcagtgacactcttcataca

SEQ ID NO: 8036020 - DNA, 17 bp, Homo sapiens
tctcagtgactgatagc

SEQ ID NO: 8036021 - DNA, 23 bp, Homo sapiens
tctcagtgaatctcagaattcgc

SEQ ID NO: 8036022 - DNA, 23 bp, Homo sapiens
tctcagtgaatctcagaattcgc

SEQ ID NO: 8036023 - DNA, 22 bp, Homo sapiens
tctcagtccaaatgagaggttg

SEQ ID NO: 8036024 - DNA, 22 bp, Homo sapiens
tctcagtcccattgaagaggtg

SEQ ID NO: 8036025 - DNA, 22 bp, Homo sapiens
tctcagtcccattgaagaggtg

SEQ ID NO: 8036026 - DNA, 22 bp, Homo sapiens
tctcagtcagtttggactgtgt

SEQ ID NO: 8036027 - DNA, 22 bp, Homo sapiens
tctcagtcagccttgatgtccc

SEQ ID NO: 8036028 - DNA, 22 bp, Homo sapiens
tctcagtaagtggcactctgtc

SEQ ID NO: 8036029 - DNA, 22 bp, Homo sapiens
tctcagtaattaatgttatgga

SEQ ID NO: 8036030 - DNA, 19 bp, Homo sapiens
tctcagtagactgtatgtt

SEQ ID NO: 8036031 - DNA, 22 bp, Homo sapiens
tctcagtcagccttgatgtccc

SEQ ID NO: 8036032 - DNA, 22 bp, Homo sapiens
tctcagtatgcttgattggatt

SEQ ID NO: 8036033 - DNA, 19 bp, Homo sapiens
tctcagtagactgtatgtt

SEQ ID NO: 8036034 - DNA, 22 bp, Homo sapiens
tctgcaacagtgccctgtaaat

SEQ ID NO: 8036035 - DNA, 22 bp, Homo sapiens
tctgcaaatattagcttagaca

SEQ ID NO: 8036036 - DNA, 22 bp, Homo sapiens
tctgcaacagtgccctgtaaat

SEQ ID NO: 8036037 - DNA, 22 bp, Homo sapiens
tctgcaaacttaagttgaaata

SEQ ID NO: 8036038 - DNA, 22 bp, Homo sapiens
tctgatttatatatgcagatac

SEQ ID NO: 8036039 - DNA, 22 bp, Homo sapiens
tctgatttctcttgtggatgct

SEQ ID NO: 8036040 - DNA, 20 bp, Homo sapiens
tctgcaaacaagttttagac

SEQ ID NO: 8036041 - DNA, 20 bp, Homo sapiens
tctgcaaacaagttttagac

SEQ ID NO: 8036042 - DNA, 22 bp, Homo sapiens
tctgcaaaagtgttcataaaga

SEQ ID NO: 8036043 - DNA, 22 bp, Homo sapiens
tctgcaaaagtgttcataaaga

SEQ ID NO: 8036044 - DNA, 22 bp, Homo sapiens
tctgcaagatggtcttagaggt

SEQ ID NO: 8036045 - DNA, 22 bp, Homo sapiens
tctgcaagcgtcacatgattct

SEQ ID NO: 8036046 - DNA, 22 bp, Homo sapiens
tctgcaacattcctctccccac

SEQ ID NO: 8036047 - DNA, 22 bp, Homo sapiens
tctgcaacagtgccctgtaaat

SEQ ID NO: 8036048 - DNA, 22 bp, Homo sapiens
tctgcaacattcctctccccac

SEQ ID NO: 8036049 - DNA, 22 bp, Homo sapiens
tctgcaacattcctctccccac

SEQ ID NO: 8036050 - DNA, 22 bp, Homo sapiens
tctgcaagatcattaaagcaga

SEQ ID NO: 8036051 - DNA, 23 bp, Homo sapiens
tctgcaagataatgaagatgata

SEQ ID NO: 8036052 - DNA, 22 bp, Homo sapiens
tctgattagagcattcttgagt

SEQ ID NO: 8036053 - DNA, 22 bp, Homo sapiens
tctgattagcagtttagggaaa

SEQ ID NO: 8036054 - DNA, 22 bp, Homo sapiens
tctgattagcagtttagggaaa

SEQ ID NO: 8036055 - DNA, 22 bp, Homo sapiens
tctgattacttgagttatttag

SEQ ID NO: 8036056 - DNA, 22 bp, Homo sapiens
tctgattagagcattcttgagt

SEQ ID NO: 8036057 - DNA, 22 bp, Homo sapiens
tctgatgttgcttctgcagaac

SEQ ID NO: 8036058 - DNA, 22 bp, Homo sapiens
tctgatgttgtgacatcacttc

SEQ ID NO: 8036059 - DNA, 22 bp, Homo sapiens
tctgattacttgagttatttag

SEQ ID NO: 8036060 - DNA, 22 bp, Homo sapiens
tctgatgttgtgacatcacttc

SEQ ID NO: 8036061 - DNA, 22 bp, Homo sapiens
tctgattcattcatgtgcacca

SEQ ID NO: 8036062 - DNA, 22 bp, Homo sapiens
tctgattagctccatttgctaa

SEQ ID NO: 8036063 - DNA, 22 bp, Homo sapiens
tctgattcattcatgtgcacca

SEQ ID NO: 8036064 - DNA, 22 bp, Homo sapiens
tctgattgatgcagaccatatt

SEQ ID NO: 8036065 - DNA, 22 bp, Homo sapiens
tctgatttactggaaaaaagga

SEQ ID NO: 8036066 - DNA, 22 bp, Homo sapiens
tctgattccagtgaccctagga

SEQ ID NO: 8036067 - DNA, 22 bp, Homo sapiens
tctgatgtggcagctgcatcta

SEQ ID NO: 8036068 - DNA, 22 bp, Homo sapiens
tctgatgtcccacatcctacag

SEQ ID NO: 8036069 - DNA, 22 bp, Homo sapiens
tctgatgtggagacactgtttt

SEQ ID NO: 8036070 - DNA, 22 bp, Homo sapiens
tctgatgtgtttaagaaagaag

SEQ ID NO: 8036071 - DNA, 21 bp, Homo sapiens
tctgatgtgtttaatggtggg

SEQ ID NO: 8036072 - DNA, 22 bp, Homo sapiens
tctgatgtgtatcttagggccc

SEQ ID NO: 8036073 - DNA, 22 bp, Homo sapiens
tctgatgtctgaaatgctcttg

SEQ ID NO: 8036074 - DNA, 22 bp, Homo sapiens
tctgatgtctgaaatgctcttg

SEQ ID NO: 8036075 - DNA, 22 bp, Homo sapiens
tctgatgtctgaaatgctcttg

SEQ ID NO: 8036076 - DNA, 22 bp, Homo sapiens
tctgatgtggcagctgcatcta

SEQ ID NO: 8036077 - DNA, 22 bp, Homo sapiens
tctgatgtggagacactgtttt

SEQ ID NO: 8036078 - DNA, 22 bp, Homo sapiens
tctgatgttgtgacatcacttc

SEQ ID NO: 8036079 - DNA, 22 bp, Homo sapiens
tctgatgttgatgcttctgcct

SEQ ID NO: 8036080 - DNA, 22 bp, Homo sapiens
tctgatgttgcttctgcagaac

SEQ ID NO: 8036081 - DNA, 22 bp, Homo sapiens
tctgatgttgatgcttctgcct

SEQ ID NO: 8036082 - DNA, 22 bp, Homo sapiens
tctgatgttgatgcttctgcct

SEQ ID NO: 8036083 - DNA, 23 bp, Homo sapiens
tctgatgttctcttatgctgtag

SEQ ID NO: 8036084 - DNA, 23 bp, Homo sapiens
tctgatgttctcttatgctgtag

SEQ ID NO: 8036085 - DNA, 22 bp, Homo sapiens
tctgatgttcctcagttctctt

SEQ ID NO: 8036086 - DNA, 23 bp, Homo sapiens
tctgatgttctcttatgctgtag

SEQ ID NO: 8036087 - DNA, 22 bp, Homo sapiens
tctgatgtgtttaagaaagaag

SEQ ID NO: 8036088 - DNA, 21 bp, Homo sapiens
tctgatgttcacaccctgtat

SEQ ID NO: 8036089 - DNA, 22 bp, Homo sapiens
tctgaggtcagtgctgcagtta

SEQ ID NO: 8036090 - DNA, 22 bp, Homo sapiens
tctgaggtcagtgctgcagtta

SEQ ID NO: 8036091 - DNA, 22 bp, Homo sapiens
tctgaggtcataaagcaacttt

SEQ ID NO: 8036092 - DNA, 22 bp, Homo sapiens
tctgaggtcagtgctgcagtta

SEQ ID NO: 8036093 - DNA, 23 bp, Homo sapiens
tctgaggtccaccagtttgcaga

SEQ ID NO: 8036094 - DNA, 22 bp, Homo sapiens
tctgaggtcattccaaggacat

SEQ ID NO: 8036095 - DNA, 22 bp, Homo sapiens
tctgaggtcattccaaggacat

SEQ ID NO: 8036096 - DNA, 22 bp, Homo sapiens
tctgaggtcattccaaggacat

SEQ ID NO: 8036097 - DNA, 22 bp, Homo sapiens
tctgaggtcataaagcaacttt

SEQ ID NO: 8036098 - DNA, 23 bp, Homo sapiens
tctgaggtccaccagtttgcaga

SEQ ID NO: 8036099 - DNA, 22 bp, Homo sapiens
tctgaggtcctgtgatttctct

SEQ ID NO: 8036100 - DNA, 22 bp, Homo sapiens
tctgaggtcctactataagtgg

SEQ ID NO: 8036101 - DNA, 22 bp, Homo sapiens
tctgaggtctcatgacttgcat

SEQ ID NO: 8036102 - DNA, 22 bp, Homo sapiens
tctgaggtctatgactttgctt

SEQ ID NO: 8036103 - DNA, 22 bp, Homo sapiens
tctgaggtctcatgacttgcat

SEQ ID NO: 8036104 - DNA, 22 bp, Homo sapiens
tctgaggtctatgactttgctt

SEQ ID NO: 8036105 - DNA, 22 bp, Homo sapiens
tctgaggtcctgtgatttctct

SEQ ID NO: 8036106 - DNA, 18 bp, Homo sapiens
tctgaggtggacgaggag

SEQ ID NO: 8036107 - DNA, 18 bp, Homo sapiens
tctgaggtggacgaggag

SEQ ID NO: 8036108 - DNA, 19 bp, Homo sapiens
tctgaggtggaactggggg

SEQ ID NO: 8036109 - DNA, 22 bp, Homo sapiens
tctgaggtggacgatggagcct

SEQ ID NO: 8036110 - DNA, 18 bp, Homo sapiens
tctgaggtggacgaggag

SEQ ID NO: 8036111 - DNA, 19 bp, Homo sapiens
tctgaggtggaactggggg

SEQ ID NO: 8036112 - DNA, 19 bp, Homo sapiens
tctgaggtggaactggggg

SEQ ID NO: 8036113 - DNA, 17 bp, Homo sapiens
tctgaggtgaggatgca

SEQ ID NO: 8036114 - DNA, 17 bp, Homo sapiens
tctgaggtgaggatgca

SEQ ID NO: 8036115 - DNA, 22 bp, Homo sapiens
tctgaggtggggctggagcatt

SEQ ID NO: 8036116 - DNA, 22 bp, Homo sapiens
tctgaggtggggctggagcatt

SEQ ID NO: 8036117 - DNA, 22 bp, Homo sapiens
tctgaggtgtagctgggcttca

SEQ ID NO: 8036118 - DNA, 22 bp, Homo sapiens
tctgaggtggacgatggagcct

SEQ ID NO: 8036119 - DNA, 22 bp, Homo sapiens
tctgaggtggacgatggagcct

SEQ ID NO: 8036120 - DNA, 22 bp, Homo sapiens
tctgaggtggacgatggagcct

SEQ ID NO: 8036121 - DNA, 23 bp, Homo sapiens
tctgaggtggctcttgctttgaa

SEQ ID NO: 8036122 - DNA, 23 bp, Homo sapiens
tctgaggtggctcttgctttgaa

SEQ ID NO: 8036123 - DNA, 22 bp, Homo sapiens
tctgaggtgtcacaaggccagg

SEQ ID NO: 8036124 - DNA, 22 bp, Homo sapiens
tctgaggttaatcctgctgcat

SEQ ID NO: 8036125 - DNA, 22 bp, Homo sapiens
tctgaggtgtcacaaggccagg

SEQ ID NO: 8036126 - DNA, 22 bp, Homo sapiens
tctgaggttaatcctgctgcat

SEQ ID NO: 8036127 - DNA, 22 bp, Homo sapiens
tctgaggttattgtctgccatt

SEQ ID NO: 8036128 - DNA, 22 bp, Homo sapiens
tctgaggttactgctttgtaga

SEQ ID NO: 8036129 - DNA, 22 bp, Homo sapiens
tctgaggttccctcaactacct

SEQ ID NO: 8036130 - DNA, 22 bp, Homo sapiens
tctgatattggggtcagagtag

SEQ ID NO: 8036131 - DNA, 22 bp, Homo sapiens
tctgaggttattgtctgccatt

SEQ ID NO: 8036132 - DNA, 22 bp, Homo sapiens
tctgatcagaagtacttggttc

SEQ ID NO: 8036133 - DNA, 22 bp, Homo sapiens
tctgatatttgaagaccattag

SEQ ID NO: 8036134 - DNA, 17 bp, Homo sapiens
tctgatgactagaggaa

SEQ ID NO: 8036135 - DNA, 21 bp, Homo sapiens
tctgatggtagatgagatgtg

SEQ ID NO: 8036136 - DNA, 21 bp, Homo sapiens
tctgatggtagatgagatgtg

SEQ ID NO: 8036137 - DNA, 23 bp, Homo sapiens
tctgatgtctctggaagctcatg

SEQ ID NO: 8036138 - DNA, 22 bp, Homo sapiens
tctgatgtatcctaagaatcta

SEQ ID NO: 8036139 - DNA, 22 bp, Homo sapiens
tctgatgtcccacatcctacag

SEQ ID NO: 8036140 - DNA, 22 bp, Homo sapiens
tctgatgtaggcttttctggga

SEQ ID NO: 8036141 - DNA, 22 bp, Homo sapiens
tctgatgtaagttcttccagag

SEQ ID NO: 8036142 - DNA, 22 bp, Homo sapiens
tctgatgtaagttcttccagag

SEQ ID NO: 8036143 - DNA, 22 bp, Homo sapiens
tctgatgtaagttcttccagag

SEQ ID NO: 8036144 - DNA, 21 bp, Homo sapiens
tctgatggtagatgagatgtg

SEQ ID NO: 8036145 - DNA, 22 bp, Homo sapiens
tctgatgataaagcatccttta

SEQ ID NO: 8036146 - DNA, 21 bp, Homo sapiens
tctgatggtagatgagatgtg

SEQ ID NO: 8036147 - DNA, 21 bp, Homo sapiens
tctgatggtagatgagatgtg

SEQ ID NO: 8036148 - DNA, 21 bp, Homo sapiens
tctgatggtagatgagatgtg

SEQ ID NO: 8036149 - DNA, 22 bp, Homo sapiens
tctgaggctgcatctatgtgac

SEQ ID NO: 8036150 - DNA, 22 bp, Homo sapiens
tctgaggctgcatctatgtgac

SEQ ID NO: 8036151 - DNA, 22 bp, Homo sapiens
tctgaggctgtctctgggctcc

SEQ ID NO: 8036152 - DNA, 22 bp, Homo sapiens
tctgaggctgtctctgggctcc

SEQ ID NO: 8036153 - DNA, 22 bp, Homo sapiens
tctgaggctgtctctgggctcc

SEQ ID NO: 8036154 - DNA, 22 bp, Homo sapiens
tctgaggcttcagactgtactg

SEQ ID NO: 8036155 - DNA, 22 bp, Homo sapiens
tctgaggcttcagactgtactg

SEQ ID NO: 8036156 - DNA, 19 bp, Homo sapiens
tctgaggcttctccccttg

SEQ ID NO: 8036157 - DNA, 19 bp, Homo sapiens
tctgaggcttctccccttg

SEQ ID NO: 8036158 - DNA, 19 bp, Homo sapiens
tctgaggcttctccccttg

SEQ ID NO: 8036159 - DNA, 22 bp, Homo sapiens
tctgagggaatagctattgtag

SEQ ID NO: 8036160 - DNA, 22 bp, Homo sapiens
tctgagggaatagctattgtag

SEQ ID NO: 8036161 - DNA, 22 bp, Homo sapiens
tctgagggacaattttgatggt

SEQ ID NO: 8036162 - DNA, 23 bp, Homo sapiens
tctgagggagtgggcagtggcac

SEQ ID NO: 8036163 - DNA, 22 bp, Homo sapiens
tctgaggctgaatggactccgt

SEQ ID NO: 8036164 - DNA, 22 bp, Homo sapiens
tctgaggctgaatggactccgt

SEQ ID NO: 8036165 - DNA, 20 bp, Homo sapiens
tctgaggctgagcccagcgt

SEQ ID NO: 8036166 - DNA, 22 bp, Homo sapiens
tctgaggctatgttcaggctaa

SEQ ID NO: 8036167 - DNA, 22 bp, Homo sapiens
tctgaggctatgttcaggctaa

SEQ ID NO: 8036168 - DNA, 22 bp, Homo sapiens
tctgaggctatgttcaggctaa

SEQ ID NO: 8036169 - DNA, 22 bp, Homo sapiens
tctgaggctgaatggactccgt

SEQ ID NO: 8036170 - DNA, 20 bp, Homo sapiens
tctgaggctgagcccagcgt

SEQ ID NO: 8036171 - DNA, 20 bp, Homo sapiens
tctgaggctgagcccagcgt

SEQ ID NO: 8036172 - DNA, 22 bp, Homo sapiens
tctgaggctgcatctatgtgac

SEQ ID NO: 8036173 - DNA, 20 bp, Homo sapiens
tctgaggctgagctctactt

SEQ ID NO: 8036174 - DNA, 20 bp, Homo sapiens
tctgaggctgagctctactt

SEQ ID NO: 8036175 - DNA, 22 bp, Homo sapiens
tctgaggctgcatctatgtgac

SEQ ID NO: 8036176 - DNA, 22 bp, Homo sapiens
tctgagggtgggagaaggagct

SEQ ID NO: 8036177 - DNA, 22 bp, Homo sapiens
tctgagggtgggagaaggagct

SEQ ID NO: 8036178 - DNA, 22 bp, Homo sapiens
tctgagggttcttggtagttgg

SEQ ID NO: 8036179 - DNA, 22 bp, Homo sapiens
tctgagggttggctggctgtag

SEQ ID NO: 8036180 - DNA, 22 bp, Homo sapiens
tctgagggttggctggctgtag

SEQ ID NO: 8036181 - DNA, 22 bp, Homo sapiens
tctgagggttgtagagagggac

SEQ ID NO: 8036182 - DNA, 22 bp, Homo sapiens
tctgaggtcacagatttcaaga

SEQ ID NO: 8036183 - DNA, 20 bp, Homo sapiens
tctgaggtatgatagggtct

SEQ ID NO: 8036184 - DNA, 20 bp, Homo sapiens
tctgaggtatgatagggtct

SEQ ID NO: 8036185 - DNA, 22 bp, Homo sapiens
tctgaggtcacagatttcaaga

SEQ ID NO: 8036186 - DNA, 22 bp, Homo sapiens
tctgaggtaccagctggtttat

SEQ ID NO: 8036187 - DNA, 22 bp, Homo sapiens
tctgagggttgtagagagggac

SEQ ID NO: 8036188 - DNA, 22 bp, Homo sapiens
tctgagggcttgaggggaagta

SEQ ID NO: 8036189 - DNA, 22 bp, Homo sapiens
tctgagggcttgaggggaagta

SEQ ID NO: 8036190 - DNA, 22 bp, Homo sapiens
tctgaggggccagggatctggg

SEQ ID NO: 8036191 - DNA, 23 bp, Homo sapiens
tctgagggagtgggcagtggcac

SEQ ID NO: 8036192 - DNA, 23 bp, Homo sapiens
tctgagggagtgggcagtggcac

SEQ ID NO: 8036193 - DNA, 22 bp, Homo sapiens
tctgagggatttgtcccttatc

SEQ ID NO: 8036194 - DNA, 19 bp, Homo sapiens
tctgagggtccagatgcat

SEQ ID NO: 8036195 - DNA, 22 bp, Homo sapiens
tctgagggtgggagaaggagct

SEQ ID NO: 8036196 - DNA, 19 bp, Homo sapiens
tctgagggtccagatgcat

SEQ ID NO: 8036197 - DNA, 19 bp, Homo sapiens
tctgagggtccagatgcat

SEQ ID NO: 8036198 - DNA, 22 bp, Homo sapiens
tctgaggaatcttgacacattt

SEQ ID NO: 8036199 - DNA, 22 bp, Homo sapiens
tctgaggaataagaaggaagtg

SEQ ID NO: 8036200 - DNA, 18 bp, Homo sapiens
tctgaggaatggaagagc

SEQ ID NO: 8036201 - DNA, 18 bp, Homo sapiens
tctgaggaatggaagagc

SEQ ID NO: 8036202 - DNA, 18 bp, Homo sapiens
tctgaggaatggaagagc

SEQ ID NO: 8036203 - DNA, 22 bp, Homo sapiens
tctgaggccctaccctgagcct

SEQ ID NO: 8036204 - DNA, 22 bp, Homo sapiens
tctgaggccctaccctgagcct

SEQ ID NO: 8036205 - DNA, 22 bp, Homo sapiens
tctgaggaattctgcagtgaga

SEQ ID NO: 8036206 - DNA, 22 bp, Homo sapiens
tctgaggacaaactgcatgctg

SEQ ID NO: 8036207 - DNA, 22 bp, Homo sapiens
tctgaggaattctgcagtgaga

SEQ ID NO: 8036208 - DNA, 22 bp, Homo sapiens
tctgaggccctaccctgagcct

SEQ ID NO: 8036209 - DNA, 22 bp, Homo sapiens
tctgaggccctgcaggcagtgt

SEQ ID NO: 8036210 - DNA, 22 bp, Homo sapiens
tctgaggaagcagcaggaagtg

SEQ ID NO: 8036211 - DNA, 22 bp, Homo sapiens
tctgaggaaagagagtgggatg

SEQ ID NO: 8036212 - DNA, 22 bp, Homo sapiens
tctgaggaaagagagtgggatg

SEQ ID NO: 8036213 - DNA, 22 bp, Homo sapiens
tctgaggaaaagaggaggtagc

SEQ ID NO: 8036214 - DNA, 22 bp, Homo sapiens
tctgagcttttattatcaacct

SEQ ID NO: 8036215 - DNA, 22 bp, Homo sapiens
tctgaggaaaagaggaggtagc

SEQ ID NO: 8036216 - DNA, 22 bp, Homo sapiens
tctgagctttagctgggatttt

SEQ ID NO: 8036217 - DNA, 22 bp, Homo sapiens
tctgagcttctgcctgctgcaa

SEQ ID NO: 8036218 - DNA, 22 bp, Homo sapiens
tctgagcttctgcctgctgcaa

SEQ ID NO: 8036219 - DNA, 22 bp, Homo sapiens
tctgagctttagctgggatttt

SEQ ID NO: 8036220 - DNA, 22 bp, Homo sapiens
tctgagctttagctgggatttt

SEQ ID NO: 8036221 - DNA, 22 bp, Homo sapiens
tctgagctttcttgtgctcaag

SEQ ID NO: 8036222 - DNA, 22 bp, Homo sapiens
tctgagctttcttgtgctcaag

SEQ ID NO: 8036223 - DNA, 22 bp, Homo sapiens
tctgagctttcttgtgctcaag

SEQ ID NO: 8036224 - DNA, 22 bp, Homo sapiens
tctgagcttttattatcaacct

SEQ ID NO: 8036225 - DNA, 22 bp, Homo sapiens
tctgagctttcttgtgctcaag

SEQ ID NO: 8036226 - DNA, 22 bp, Homo sapiens
tctgagcttttattatcaacct

SEQ ID NO: 8036227 - DNA, 17 bp, Homo sapiens
tctgaggcctctaggag

SEQ ID NO: 8036228 - DNA, 22 bp, Homo sapiens
tctgaggcctgaagcagcagag

SEQ ID NO: 8036229 - DNA, 22 bp, Homo sapiens
tctgaggcctgaagcagcagag

SEQ ID NO: 8036230 - DNA, 17 bp, Homo sapiens
tctgaggcctctaggag

SEQ ID NO: 8036231 - DNA, 22 bp, Homo sapiens
tctgaggcctgaagcagcagag

SEQ ID NO: 8036232 - DNA, 22 bp, Homo sapiens
tctgaggccttcagcatgaatc

SEQ ID NO: 8036233 - DNA, 22 bp, Homo sapiens
tctgaggccttcagcatgaatc

SEQ ID NO: 8036234 - DNA, 22 bp, Homo sapiens
tctgaggccttcagcatgaatc

SEQ ID NO: 8036235 - DNA, 22 bp, Homo sapiens
tctgaggccctgcaggcagtgt

SEQ ID NO: 8036236 - DNA, 22 bp, Homo sapiens
tctgaggccctgcaggcagtgt

SEQ ID NO: 8036237 - DNA, 17 bp, Homo sapiens
tctgaggcctctaggag

SEQ ID NO: 8036238 - DNA, 17 bp, Homo sapiens
tctgaggcctctaggag

SEQ ID NO: 8036239 - DNA, 22 bp, Homo sapiens
tctgaggcctagagaggggctt

SEQ ID NO: 8036240 - DNA, 22 bp, Homo sapiens
tctgaggcctagagaggggctt

SEQ ID NO: 8036241 - DNA, 22 bp, Homo sapiens
tctgaggcctagagaggggctt

SEQ ID NO: 8036242 - DNA, 22 bp, Homo sapiens
tctgaggccttgggacagaagt

SEQ ID NO: 8036243 - DNA, 22 bp, Homo sapiens
tctgaggccttgggacagaagt

SEQ ID NO: 8036244 - DNA, 22 bp, Homo sapiens
tctgaggccttgggacagaagt

SEQ ID NO: 8036245 - DNA, 22 bp, Homo sapiens
tctgaggccttgggacagaagt

SEQ ID NO: 8036246 - DNA, 22 bp, Homo sapiens
tctgaggccttgggacagaagt

SEQ ID NO: 8036247 - DNA, 22 bp, Homo sapiens
tctgaggccttcagcatgaatc

SEQ ID NO: 8036248 - DNA, 22 bp, Homo sapiens
tctgaggccttggcagctaagg

SEQ ID NO: 8036249 - DNA, 22 bp, Homo sapiens
tctgaggctatgttcaggctaa

SEQ ID NO: 8036250 - DNA, 22 bp, Homo sapiens
tctgaggctaagagacagaggc

SEQ ID NO: 8036251 - DNA, 22 bp, Homo sapiens
tctgaggctaagagacagaggc

SEQ ID NO: 8036252 - DNA, 22 bp, Homo sapiens
tctgaggctaagagacagaggc

SEQ ID NO: 8036253 - DNA, 22 bp, Homo sapiens
tctgaggctaagagacagaggc

SEQ ID NO: 8036254 - DNA, 22 bp, Homo sapiens
tctgaggctaagagacagaggc

SEQ ID NO: 8036255 - DNA, 19 bp, Homo sapiens
tctgagctgatatgacatt

SEQ ID NO: 8036256 - DNA, 19 bp, Homo sapiens
tctgagctgatatgacatt

SEQ ID NO: 8036257 - DNA, 21 bp, Homo sapiens
tctgagctgagtcctctaggt

SEQ ID NO: 8036258 - DNA, 21 bp, Homo sapiens
tctgagctgagtcctctaggt

SEQ ID NO: 8036259 - DNA, 22 bp, Homo sapiens
tctgagctgcagagtggggtgg

SEQ ID NO: 8036260 - DNA, 19 bp, Homo sapiens
tctgagctgatatgacatt

SEQ ID NO: 8036261 - DNA, 22 bp, Homo sapiens
tctgagctgcagagtggggtgg

SEQ ID NO: 8036262 - DNA, 22 bp, Homo sapiens
tctgagctgcccctttactttg

SEQ ID NO: 8036263 - DNA, 22 bp, Homo sapiens
tctgagctgcccctttactttg

SEQ ID NO: 8036264 - DNA, 22 bp, Homo sapiens
tctgagctcaagtgacagttag

SEQ ID NO: 8036265 - DNA, 22 bp, Homo sapiens
tctgagctcaagtgacagttag

SEQ ID NO: 8036266 - DNA, 22 bp, Homo sapiens
tctgagctcaagtgacagttag

SEQ ID NO: 8036267 - DNA, 22 bp, Homo sapiens
tctgagctcaagtgacagttag

SEQ ID NO: 8036268 - DNA, 21 bp, Homo sapiens
tctgagctgagtcctctaggt

SEQ ID NO: 8036269 - DNA, 21 bp, Homo sapiens
tctgagctgagtcctctaggt

SEQ ID NO: 8036270 - DNA, 21 bp, Homo sapiens
tctgagctgagtcctctaggt

SEQ ID NO: 8036271 - DNA, 22 bp, Homo sapiens
tctgagctctatctgtgggaat

SEQ ID NO: 8036272 - DNA, 22 bp, Homo sapiens
tctgagctaatcctgttgccga

SEQ ID NO: 8036273 - DNA, 22 bp, Homo sapiens
tctgagctaatcctgttgccga

SEQ ID NO: 8036274 - DNA, 22 bp, Homo sapiens
tctgagccgtatggcttggcta

SEQ ID NO: 8036275 - DNA, 22 bp, Homo sapiens
tctgagcccagtgagtctcgca

SEQ ID NO: 8036276 - DNA, 22 bp, Homo sapiens
tctgagccctgctgtttattga

SEQ ID NO: 8036277 - DNA, 22 bp, Homo sapiens
tctgagctacgatgcctgtcac

SEQ ID NO: 8036278 - DNA, 22 bp, Homo sapiens
tctgagctacgatgcctgtcac

SEQ ID NO: 8036279 - DNA, 22 bp, Homo sapiens
tctgagctaatcctgttgccga

SEQ ID NO: 8036280 - DNA, 22 bp, Homo sapiens
tctgagctatgtaagacttgga

SEQ ID NO: 8036281 - DNA, 22 bp, Homo sapiens
tctgagctatgtaagacttgga

SEQ ID NO: 8036282 - DNA, 22 bp, Homo sapiens
tctgagctatgtaagacttgga

SEQ ID NO: 8036283 - DNA, 22 bp, Homo sapiens
tctgagctatccagatagtatt

SEQ ID NO: 8036284 - DNA, 22 bp, Homo sapiens
tctgagctatccagatagtatt

SEQ ID NO: 8036285 - DNA, 22 bp, Homo sapiens
tctgagctagtgatttataaga

SEQ ID NO: 8036286 - DNA, 22 bp, Homo sapiens
tctgagctagtgatttataaga

SEQ ID NO: 8036287 - DNA, 22 bp, Homo sapiens
tctgagctagaaagtatgccct

SEQ ID NO: 8036288 - DNA, 22 bp, Homo sapiens
tctgagctagaaagtatgccct

SEQ ID NO: 8036289 - DNA, 22 bp, Homo sapiens
tctgagctgctaggtatgcatt

SEQ ID NO: 8036290 - DNA, 22 bp, Homo sapiens
tctgagctgctaggtatgcatt

SEQ ID NO: 8036291 - DNA, 22 bp, Homo sapiens
tctgagctggagcccatcacct

SEQ ID NO: 8036292 - DNA, 22 bp, Homo sapiens
tctgagctgctaggtatgcatt

SEQ ID NO: 8036293 - DNA, 22 bp, Homo sapiens
tctgagctggagcccatcacct

SEQ ID NO: 8036294 - DNA, 22 bp, Homo sapiens
tctgagctggagcccatcacct

SEQ ID NO: 8036295 - DNA, 22 bp, Homo sapiens
tctgagctggagcccatcacct

SEQ ID NO: 8036296 - DNA, 22 bp, Homo sapiens
tctgagctgtaagtagacaagg

SEQ ID NO: 8036297 - DNA, 22 bp, Homo sapiens
tctgagctgtaagtagacaagg

SEQ ID NO: 8036298 - DNA, 22 bp, Homo sapiens
tctgagctgtaagtagacaagg

SEQ ID NO: 8036299 - DNA, 22 bp, Homo sapiens
tctgagctgggtcttgacagct

SEQ ID NO: 8036300 - DNA, 22 bp, Homo sapiens
tctgagctgggtcttgacagct

SEQ ID NO: 8036301 - DNA, 22 bp, Homo sapiens
tctgagctgggtcttgacagct

SEQ ID NO: 8036302 - DNA, 22 bp, Homo sapiens
tctgagctgggcacagaaggcg

SEQ ID NO: 8036303 - DNA, 22 bp, Homo sapiens
tctgagctgggcacagaaggcg

SEQ ID NO: 8036304 - DNA, 22 bp, Homo sapiens
tctgagctgggggcctggcatg

SEQ ID NO: 8036305 - DNA, 22 bp, Homo sapiens
tctgagctgggggcctggcatg

SEQ ID NO: 8036306 - DNA, 22 bp, Homo sapiens
tctgagcttactcagggataca

SEQ ID NO: 8036307 - DNA, 22 bp, Homo sapiens
tctgagcttactcagggataca

SEQ ID NO: 8036308 - DNA, 22 bp, Homo sapiens
tctgagcttccctctgaggcag

SEQ ID NO: 8036309 - DNA, 22 bp, Homo sapiens
tctgagcttccctctgaggcag

SEQ ID NO: 8036310 - DNA, 22 bp, Homo sapiens
tctgagcttccctctgaggcag

SEQ ID NO: 8036311 - DNA, 22 bp, Homo sapiens
tctgagcttctgcctgctgcaa

SEQ ID NO: 8036312 - DNA, 22 bp, Homo sapiens
tctgagcttctgcatttccaac

SEQ ID NO: 8036313 - DNA, 22 bp, Homo sapiens
tctgagcttctgcatttccaac

SEQ ID NO: 8036314 - DNA, 22 bp, Homo sapiens
tctgagcttccctctgaggcag

SEQ ID NO: 8036315 - DNA, 22 bp, Homo sapiens
tctgagcttctgcatttccaac

SEQ ID NO: 8036316 - DNA, 22 bp, Homo sapiens
tctgagcttctgcatttccaac

SEQ ID NO: 8036317 - DNA, 22 bp, Homo sapiens
tctgagctgtggccattcttcc

SEQ ID NO: 8036318 - DNA, 22 bp, Homo sapiens
tctgagctgtggccattcttcc

SEQ ID NO: 8036319 - DNA, 22 bp, Homo sapiens
tctgagctgtgagttgcttagg

SEQ ID NO: 8036320 - DNA, 22 bp, Homo sapiens
tctgagctgtggccattcttcc

SEQ ID NO: 8036321 - DNA, 22 bp, Homo sapiens
tctgagctgtaagtagacaagg

SEQ ID NO: 8036322 - DNA, 23 bp, Homo sapiens
tctgagctgtcttttcagcagaa

SEQ ID NO: 8036323 - DNA, 23 bp, Homo sapiens
tctgagctgtcttttcagcagaa

SEQ ID NO: 8036324 - DNA, 22 bp, Homo sapiens
tctgagctgtgagttgcttagg

SEQ ID NO: 8036325 - DNA, 22 bp, Homo sapiens
tctgagcactgggcagtcggtg

SEQ ID NO: 8036326 - DNA, 22 bp, Homo sapiens
tctgagcacatcacacagctca

SEQ ID NO: 8036327 - DNA, 22 bp, Homo sapiens
tctgagcagctttgttttgtgt

SEQ ID NO: 8036328 - DNA, 22 bp, Homo sapiens
tctgagcagatgctcgctctcc

SEQ ID NO: 8036329 - DNA, 22 bp, Homo sapiens
tctgagcagagcatcatttcag

SEQ ID NO: 8036330 - DNA, 22 bp, Homo sapiens
tctgagcagagcatcatttcag

SEQ ID NO: 8036331 - DNA, 22 bp, Homo sapiens
tctgagcagatgctcgctctcc

SEQ ID NO: 8036332 - DNA, 22 bp, Homo sapiens
tctgagagatacaaggaggcaa

SEQ ID NO: 8036333 - DNA, 22 bp, Homo sapiens
tctgagcacaattacttacatc

SEQ ID NO: 8036334 - DNA, 22 bp, Homo sapiens
tctgagagagggtcagatgcta

SEQ ID NO: 8036335 - DNA, 22 bp, Homo sapiens
tctgagcacatcacacagctca

SEQ ID NO: 8036336 - DNA, 22 bp, Homo sapiens
tctgagcacatcacacagctca

SEQ ID NO: 8036337 - DNA, 22 bp, Homo sapiens
tctgagagatacaaggaggcaa

SEQ ID NO: 8036338 - DNA, 22 bp, Homo sapiens
tctgagagagggtcagatgcta

SEQ ID NO: 8036339 - DNA, 22 bp, Homo sapiens
tctgagagagggtcagatgcta

SEQ ID NO: 8036340 - DNA, 22 bp, Homo sapiens
tctgagagagggtcagatgcta

SEQ ID NO: 8036341 - DNA, 21 bp, Homo sapiens
tctgagactgggttagaatgt

SEQ ID NO: 8036342 - DNA, 22 bp, Homo sapiens
tctgagactgcagtgagccgct

SEQ ID NO: 8036343 - DNA, 21 bp, Homo sapiens
tctgagactgggttagaatgt

SEQ ID NO: 8036344 - DNA, 20 bp, Homo sapiens
tctgagacttgtagtgtgga

SEQ ID NO: 8036345 - DNA, 22 bp, Homo sapiens
tctgagacttctgaagctagaa

SEQ ID NO: 8036346 - DNA, 22 bp, Homo sapiens
tctgagagagcacctatccact

SEQ ID NO: 8036347 - DNA, 22 bp, Homo sapiens
tctgagagagcacctatccact

SEQ ID NO: 8036348 - DNA, 22 bp, Homo sapiens
tctgagagagcacctatccact

SEQ ID NO: 8036349 - DNA, 23 bp, Homo sapiens
tctgagagaacaatgcctcctat

SEQ ID NO: 8036350 - DNA, 22 bp, Homo sapiens
tctgagactttaacctggggcc

SEQ ID NO: 8036351 - DNA, 23 bp, Homo sapiens
tctgagagaacaatgcctcctat

SEQ ID NO: 8036352 - DNA, 22 bp, Homo sapiens
tctgagacaggaagtggagggt

SEQ ID NO: 8036353 - DNA, 22 bp, Homo sapiens
tctgagacaacttagccctcga

SEQ ID NO: 8036354 - DNA, 22 bp, Homo sapiens
tctgagacaacttagccctcga

SEQ ID NO: 8036355 - DNA, 22 bp, Homo sapiens
tctgagaatggtggatgtggtg

SEQ ID NO: 8036356 - DNA, 22 bp, Homo sapiens
tctgagaatagtgccactgtgg

SEQ ID NO: 8036357 - DNA, 22 bp, Homo sapiens
tctgagaatggtggatgtggtg

SEQ ID NO: 8036358 - DNA, 22 bp, Homo sapiens
tctgagactccataagttgaaa

SEQ ID NO: 8036359 - DNA, 20 bp, Homo sapiens
tctgagacctttccacaccc

SEQ ID NO: 8036360 - DNA, 22 bp, Homo sapiens
tctgagacccatacaggcccac

SEQ ID NO: 8036361 - DNA, 22 bp, Homo sapiens
tctgagacccatacaggcccac

SEQ ID NO: 8036362 - DNA, 22 bp, Homo sapiens
tctgagacaggaagtggagggt

SEQ ID NO: 8036363 - DNA, 22 bp, Homo sapiens
tctgagacaggaagtggagggt

SEQ ID NO: 8036364 - DNA, 22 bp, Homo sapiens
tctgagcccctagaactgagcg

SEQ ID NO: 8036365 - DNA, 22 bp, Homo sapiens
tctgagcccagtgagtctcgca

SEQ ID NO: 8036366 - DNA, 22 bp, Homo sapiens
tctgagcccagtgagtctcgca

SEQ ID NO: 8036367 - DNA, 22 bp, Homo sapiens
tctgagccagggtctcctccct

SEQ ID NO: 8036368 - DNA, 22 bp, Homo sapiens
tctgagccagacaagacagcca

SEQ ID NO: 8036369 - DNA, 22 bp, Homo sapiens
tctgagccacctgccagtgctg

SEQ ID NO: 8036370 - DNA, 22 bp, Homo sapiens
tctgagccagacaagacagcca

SEQ ID NO: 8036371 - DNA, 22 bp, Homo sapiens
tctgagcatatgcagcacctgg

SEQ ID NO: 8036372 - DNA, 22 bp, Homo sapiens
tctgagcagggcagtgtccatg

SEQ ID NO: 8036373 - DNA, 22 bp, Homo sapiens
tctgagcatatgcagcacctgg

SEQ ID NO: 8036374 - DNA, 22 bp, Homo sapiens
tctgagcatatgcagcacctgg

SEQ ID NO: 8036375 - DNA, 22 bp, Homo sapiens
tctgagcattttaggtggtatc

SEQ ID NO: 8036376 - DNA, 22 bp, Homo sapiens
tctgagcattttaggtggtatc

SEQ ID NO: 8036377 - DNA, 22 bp, Homo sapiens
tctgagcattgagctctccaaa

SEQ ID NO: 8036378 - DNA, 22 bp, Homo sapiens
tctgagccaatttctgtgtcca

SEQ ID NO: 8036379 - DNA, 22 bp, Homo sapiens
tctgagccaatttctgtgtcca

SEQ ID NO: 8036380 - DNA, 22 bp, Homo sapiens
tctgagccaatttctgtgtcca

SEQ ID NO: 8036381 - DNA, 22 bp, Homo sapiens
tctgagccacagatgtcctgtt

SEQ ID NO: 8036382 - DNA, 22 bp, Homo sapiens
tctgagccacagatgtcctgtt

SEQ ID NO: 8036383 - DNA, 22 bp, Homo sapiens
tctgagccacctgagcccatgg

SEQ ID NO: 8036384 - DNA, 22 bp, Homo sapiens
tctgagccacctgagcccatgg

SEQ ID NO: 8036385 - DNA, 22 bp, Homo sapiens
tctgactcccatattccacttc

SEQ ID NO: 8036386 - DNA, 23 bp, Homo sapiens
tctgacctcgtttgctgtgttct

SEQ ID NO: 8036387 - DNA, 22 bp, Homo sapiens
tctgacttatttgtccttggtg

SEQ ID NO: 8036388 - DNA, 22 bp, Homo sapiens
tctgacttatttgtccttggtg

SEQ ID NO: 8036389 - DNA, 22 bp, Homo sapiens
tctgacttatttgtccttggtg

SEQ ID NO: 8036390 - DNA, 22 bp, Homo sapiens
tctgacttcctccacatctgtt

SEQ ID NO: 8036391 - DNA, 22 bp, Homo sapiens
tctgacttcctccacatctgtt

SEQ ID NO: 8036392 - DNA, 22 bp, Homo sapiens
tctgacttcctccacatctgtt

SEQ ID NO: 8036393 - DNA, 22 bp, Homo sapiens
tctgacttcttcatccttgcca

SEQ ID NO: 8036394 - DNA, 22 bp, Homo sapiens
tctgacttccttttctgatcca

SEQ ID NO: 8036395 - DNA, 21 bp, Homo sapiens
tctgacttgatctattctccc

SEQ ID NO: 8036396 - DNA, 21 bp, Homo sapiens
tctgacttgatctattctccc

SEQ ID NO: 8036397 - DNA, 21 bp, Homo sapiens
tctgacttgatctattctccc

SEQ ID NO: 8036398 - DNA, 23 bp, Homo sapiens
tctgacctcgtttgctgtgttct

SEQ ID NO: 8036399 - DNA, 22 bp, Homo sapiens
tctgacttggcgctcttgtctt

SEQ ID NO: 8036400 - DNA, 22 bp, Homo sapiens
tctgacttggcgctcttgtctt

SEQ ID NO: 8036401 - DNA, 22 bp, Homo sapiens
tctgacttggtgctaccagcca

SEQ ID NO: 8036402 - DNA, 22 bp, Homo sapiens
tctgacttggcgctcttgtctt

SEQ ID NO: 8036403 - DNA, 22 bp, Homo sapiens
tctgacattttgagaatgacat

SEQ ID NO: 8036404 - DNA, 22 bp, Homo sapiens
tctgaccacagacaacctgcta

SEQ ID NO: 8036405 - DNA, 23 bp, Homo sapiens
tctgaccaagttttgcatgccac

SEQ ID NO: 8036406 - DNA, 22 bp, Homo sapiens
tctgaccacagacaacctgcta

SEQ ID NO: 8036407 - DNA, 22 bp, Homo sapiens
tctgaccacagacaacctgcta

SEQ ID NO: 8036408 - DNA, 22 bp, Homo sapiens
tctgaccacagacaacctgcta

SEQ ID NO: 8036409 - DNA, 22 bp, Homo sapiens
tctgaccaggctggctcagggc

SEQ ID NO: 8036410 - DNA, 22 bp, Homo sapiens
tctgaccaggctggctcagggc

SEQ ID NO: 8036411 - DNA, 22 bp, Homo sapiens
tctgaccaggctcagccaaggc

SEQ ID NO: 8036412 - DNA, 22 bp, Homo sapiens
tctgaccaggctggctcagggc

SEQ ID NO: 8036413 - DNA, 23 bp, Homo sapiens
tctgaccatttgacaacatcctg

SEQ ID NO: 8036414 - DNA, 22 bp, Homo sapiens
tctgaccagtgagctctgaaat

SEQ ID NO: 8036415 - DNA, 23 bp, Homo sapiens
tctgaccatttgacaacatcctg

SEQ ID NO: 8036416 - DNA, 22 bp, Homo sapiens
tctgaattttgaaatcatggag

SEQ ID NO: 8036417 - DNA, 22 bp, Homo sapiens
tctgaattttgaaatcatggag

SEQ ID NO: 8036418 - DNA, 22 bp, Homo sapiens
tctgaattttgatgtgcattga

SEQ ID NO: 8036419 - DNA, 21 bp, Homo sapiens
tctgacaatctcatttcaaac

SEQ ID NO: 8036420 - DNA, 22 bp, Homo sapiens
tctgacaataactgagtttaac

SEQ ID NO: 8036421 - DNA, 21 bp, Homo sapiens
tctgacaatctcatttcaaac

SEQ ID NO: 8036422 - DNA, 22 bp, Homo sapiens
tctgacaatgaacaatctatag

SEQ ID NO: 8036423 - DNA, 22 bp, Homo sapiens
tctgacaatgaacaatctatag

SEQ ID NO: 8036424 - DNA, 22 bp, Homo sapiens
tctgacaattagcctagtcctg

SEQ ID NO: 8036425 - DNA, 19 bp, Homo sapiens
tctgacagccccagtcaac

SEQ ID NO: 8036426 - DNA, 22 bp, Homo sapiens
tctgacagaggtggtagataca

SEQ ID NO: 8036427 - DNA, 19 bp, Homo sapiens
tctgacagccccagtcaac

SEQ ID NO: 8036428 - DNA, 22 bp, Homo sapiens
tctgacagctccaggcagcaat

SEQ ID NO: 8036429 - DNA, 22 bp, Homo sapiens
tctgacagctccaggcagcaat

SEQ ID NO: 8036430 - DNA, 22 bp, Homo sapiens
tctgacattagattaattggaa

SEQ ID NO: 8036431 - DNA, 22 bp, Homo sapiens
tctgacattagattaattggaa

SEQ ID NO: 8036432 - DNA, 22 bp, Homo sapiens
tctgacatgagggctgtggaga

SEQ ID NO: 8036433 - DNA, 22 bp, Homo sapiens
tctgacattagattaattggaa

SEQ ID NO: 8036434 - DNA, 22 bp, Homo sapiens
tctgacagtgtgaatattgact

SEQ ID NO: 8036435 - DNA, 22 bp, Homo sapiens
tctgacagttatataagcacca

SEQ ID NO: 8036436 - DNA, 22 bp, Homo sapiens
tctgacaggttgggatatggaa

SEQ ID NO: 8036437 - DNA, 22 bp, Homo sapiens
tctgacagtcacagtggaggat

SEQ ID NO: 8036438 - DNA, 22 bp, Homo sapiens
tctgacagtcacagtggaggat

SEQ ID NO: 8036439 - DNA, 22 bp, Homo sapiens
tctgacagtcacagtggaggat

SEQ ID NO: 8036440 - DNA, 22 bp, Homo sapiens
tctgacaggtgttcttccaggc

SEQ ID NO: 8036441 - DNA, 22 bp, Homo sapiens
tctgacaggtcattttctatag

SEQ ID NO: 8036442 - DNA, 22 bp, Homo sapiens
tctgacaggtcattttctatag

SEQ ID NO: 8036443 - DNA, 22 bp, Homo sapiens
tctgacagggccaaacatgaca

SEQ ID NO: 8036444 - DNA, 22 bp, Homo sapiens
tctgacagggccaaacatgaca

SEQ ID NO: 8036445 - DNA, 22 bp, Homo sapiens
tctgagaaaataggaaacttga

SEQ ID NO: 8036446 - DNA, 17 bp, Homo sapiens
tctgagaaaggagaatc

SEQ ID NO: 8036447 - DNA, 22 bp, Homo sapiens
tctgagaaaataggaaacttga

SEQ ID NO: 8036448 - DNA, 22 bp, Homo sapiens
tctgagaaagtactgtatgttc

SEQ ID NO: 8036449 - DNA, 17 bp, Homo sapiens
tctgagaaaggagaatc

SEQ ID NO: 8036450 - DNA, 17 bp, Homo sapiens
tctgagaaaggagaatc

SEQ ID NO: 8036451 - DNA, 17 bp, Homo sapiens
tctgagaaaggagaatc

SEQ ID NO: 8036452 - DNA, 22 bp, Homo sapiens
tctgagaaatcagtggtgaata

SEQ ID NO: 8036453 - DNA, 22 bp, Homo sapiens
tctgagaaatcagtggtgaata

SEQ ID NO: 8036454 - DNA, 22 bp, Homo sapiens
tctgagaaatcagtggtgaata

SEQ ID NO: 8036455 - DNA, 22 bp, Homo sapiens
tctgagaaatcagtggtgaata

SEQ ID NO: 8036456 - DNA, 22 bp, Homo sapiens
tctgagaaatttctttgtgatg

SEQ ID NO: 8036457 - DNA, 21 bp, Homo sapiens
tctgagaacttctgctgcagc

SEQ ID NO: 8036458 - DNA, 21 bp, Homo sapiens
tctgagaacttctgctgcagc

SEQ ID NO: 8036459 - DNA, 21 bp, Homo sapiens
tctgagaacttctgctgcagc

SEQ ID NO: 8036460 - DNA, 21 bp, Homo sapiens
tctgagaacttctgctgcagc

SEQ ID NO: 8036461 - DNA, 21 bp, Homo sapiens
tctgagaacttctgctgcagc

SEQ ID NO: 8036462 - DNA, 22 bp, Homo sapiens
tctgagaactccgggttagatc

SEQ ID NO: 8036463 - DNA, 22 bp, Homo sapiens
tctgagaacatgctttgatcat

SEQ ID NO: 8036464 - DNA, 22 bp, Homo sapiens
tctgagaacatgctttgatcat

SEQ ID NO: 8036465 - DNA, 17 bp, Homo sapiens
tctgagaacttgaagca

SEQ ID NO: 8036466 - DNA, 20 bp, Homo sapiens
tctgagaagcaaacaatgtt

SEQ ID NO: 8036467 - DNA, 21 bp, Homo sapiens
tctgagaacttctgctgcagc

SEQ ID NO: 8036468 - DNA, 17 bp, Homo sapiens
tctgagaacttgaagca

SEQ ID NO: 8036469 - DNA, 22 bp, Homo sapiens
tctgagaagcaccttctggaca

SEQ ID NO: 8036470 - DNA, 22 bp, Homo sapiens
tctgagaagcaccttctggaca

SEQ ID NO: 8036471 - DNA, 22 bp, Homo sapiens
tctgagaagcaccttctggaca

SEQ ID NO: 8036472 - DNA, 20 bp, Homo sapiens
tctgagaagcaaacaatgtt

SEQ ID NO: 8036473 - DNA, 20 bp, Homo sapiens
tctgagaagcaaacaatgtt

SEQ ID NO: 8036474 - DNA, 22 bp, Homo sapiens
tctgagaatagtgccactgtgg

SEQ ID NO: 8036475 - DNA, 22 bp, Homo sapiens
tctgagaataaaaattgcattt

SEQ ID NO: 8036476 - DNA, 22 bp, Homo sapiens
tctgagaagggtaggctccatt

SEQ ID NO: 8036477 - DNA, 22 bp, Homo sapiens
tctgagaaggtgcatcagctgc

SEQ ID NO: 8036478 - DNA, 23 bp, Homo sapiens
tctgagaaggtttcagccagact

SEQ ID NO: 8036479 - DNA, 23 bp, Homo sapiens
tctgagaaggtttcagccagact

SEQ ID NO: 8036480 - DNA, 23 bp, Homo sapiens
tctgagaaggtttcagccagact

SEQ ID NO: 8036481 - DNA, 23 bp, Homo sapiens
tctgagaaggtttcagccagact

SEQ ID NO: 8036482 - DNA, 22 bp, Homo sapiens
tctgagaatgagtgttttctta

SEQ ID NO: 8036483 - DNA, 17 bp, Homo sapiens
tctgagaatgctggagg

SEQ ID NO: 8036484 - DNA, 17 bp, Homo sapiens
tctgagaatgctggagg

SEQ ID NO: 8036485 - DNA, 17 bp, Homo sapiens
tctgagaatgctggagg

SEQ ID NO: 8036486 - DNA, 22 bp, Homo sapiens
tctgagaatggagctaaaaatc

SEQ ID NO: 8036487 - DNA, 22 bp, Homo sapiens
tctgagaatggagctaaaaatc

SEQ ID NO: 8036488 - DNA, 22 bp, Homo sapiens
tctgagaatggagctaaaaatc

SEQ ID NO: 8036489 - DNA, 20 bp, Homo sapiens
tctgagaagccactgtccaa

SEQ ID NO: 8036490 - DNA, 20 bp, Homo sapiens
tctgagaagccactgtccaa

SEQ ID NO: 8036491 - DNA, 22 bp, Homo sapiens
tctgagaagcaccttctggaca

SEQ ID NO: 8036492 - DNA, 22 bp, Homo sapiens
tctgagaagcgggagcctgtga

SEQ ID NO: 8036493 - DNA, 22 bp, Homo sapiens
tctgagaagccctgtggggagg

SEQ ID NO: 8036494 - DNA, 22 bp, Homo sapiens
tctgagaagccctgtggggagg

SEQ ID NO: 8036495 - DNA, 22 bp, Homo sapiens
tctgagaagcgtgtctctgttt

SEQ ID NO: 8036496 - DNA, 22 bp, Homo sapiens
tctgagaagcgggagcctgtga

SEQ ID NO: 8036497 - DNA, 22 bp, Homo sapiens
tctgagaagctagaggacaaag

SEQ ID NO: 8036498 - DNA, 22 bp, Homo sapiens
tctgagaagggtaggctccatt

SEQ ID NO: 8036499 - DNA, 22 bp, Homo sapiens
tctgagaaggaagctctgtgta

SEQ ID NO: 8036500 - DNA, 22 bp, Homo sapiens
tctgagaaggaagctctgtgta

SEQ ID NO: 8036501 - DNA, 22 bp, Homo sapiens
tctgagaagctagaggacaaag

SEQ ID NO: 8036502 - DNA, 22 bp, Homo sapiens
tctgagaaggaagctctgtgta

SEQ ID NO: 8036503 - DNA, 22 bp, Homo sapiens
tctgagaaggaagctctgtgta

SEQ ID NO: 8036504 - DNA, 22 bp, Homo sapiens
tctgagaagctagaggacaaag

SEQ ID NO: 8036505 - DNA, 22 bp, Homo sapiens
tctgagaagctagaggacaaag

SEQ ID NO: 8036506 - DNA, 22 bp, Homo sapiens
tctgagaagctagaggacaaag

SEQ ID NO: 8036507 - DNA, 21 bp, Homo sapiens
tctgcccacactggccactgc

SEQ ID NO: 8036508 - DNA, 21 bp, Homo sapiens
tctgcccacactggccactgc

SEQ ID NO: 8036509 - DNA, 22 bp, Homo sapiens
tctgcccacagcctcctgtcca

SEQ ID NO: 8036510 - DNA, 21 bp, Homo sapiens
tctgcccacactggccactgc

SEQ ID NO: 8036511 - DNA, 19 bp, Homo sapiens
tctgcccacaagaaaggga

SEQ ID NO: 8036512 - DNA, 22 bp, Homo sapiens
tctgcccaaggctgtcactaga

SEQ ID NO: 8036513 - DNA, 22 bp, Homo sapiens
tctgcccaaggctgtcactaga

SEQ ID NO: 8036514 - DNA, 18 bp, Homo sapiens
tctgccatgtgaggacac

SEQ ID NO: 8036515 - DNA, 22 bp, Homo sapiens
tctgcccaaggctgtcactaga

SEQ ID NO: 8036516 - DNA, 22 bp, Homo sapiens
tctgccatgctaacttcagtat

SEQ ID NO: 8036517 - DNA, 22 bp, Homo sapiens
tctgccagtttatagacaagcc

SEQ ID NO: 8036518 - DNA, 22 bp, Homo sapiens
tctgccagtttatagacaagcc

SEQ ID NO: 8036519 - DNA, 22 bp, Homo sapiens
tctgccagtttatagacaagcc

SEQ ID NO: 8036520 - DNA, 23 bp, Homo sapiens
tctgccagtgtgtgccaggagcc

SEQ ID NO: 8036521 - DNA, 22 bp, Homo sapiens
tctgccagttagaaactggtta

SEQ ID NO: 8036522 - DNA, 23 bp, Homo sapiens
tctgccagtgtgtgccaggagcc

SEQ ID NO: 8036523 - DNA, 22 bp, Homo sapiens
tctgccagttagaaactggtta

SEQ ID NO: 8036524 - DNA, 23 bp, Homo sapiens
tctgccagttccttgatcatgga

SEQ ID NO: 8036525 - DNA, 23 bp, Homo sapiens
tctgccagtgtgtgccaggagcc

SEQ ID NO: 8036526 - DNA, 23 bp, Homo sapiens
tctgccagtgtgtgccaggagcc

SEQ ID NO: 8036527 - DNA, 23 bp, Homo sapiens
tctgccagtgtgtgccaggagcc

SEQ ID NO: 8036528 - DNA, 22 bp, Homo sapiens
tctgccaggtggggagaggcca

SEQ ID NO: 8036529 - DNA, 22 bp, Homo sapiens
tctgccaggtggggagaggcca

SEQ ID NO: 8036530 - DNA, 22 bp, Homo sapiens
tctgccaggtggggagaggcca

SEQ ID NO: 8036531 - DNA, 22 bp, Homo sapiens
tctgccagtattcacggcccgt

SEQ ID NO: 8036532 - DNA, 22 bp, Homo sapiens
tctgccagtattcacggcccgt

SEQ ID NO: 8036533 - DNA, 22 bp, Homo sapiens
tctgccagtattcacggcccgt

SEQ ID NO: 8036534 - DNA, 21 bp, Homo sapiens
tctgccaggttagattgacta

SEQ ID NO: 8036535 - DNA, 21 bp, Homo sapiens
tctgccaggttagattgacta

SEQ ID NO: 8036536 - DNA, 22 bp, Homo sapiens
tctgccagtgccagagtacata

SEQ ID NO: 8036537 - DNA, 22 bp, Homo sapiens
tctgccagtgccagagtacata

SEQ ID NO: 8036538 - DNA, 22 bp, Homo sapiens
tctgccagtattcacggcccgt

SEQ ID NO: 8036539 - DNA, 22 bp, Homo sapiens
tctgccagtggtttggccctga

SEQ ID NO: 8036540 - DNA, 22 bp, Homo sapiens
tctgccagtggtttggccctga

SEQ ID NO: 8036541 - DNA, 23 bp, Homo sapiens
tctgccagtgtgtgccaggagcc

SEQ ID NO: 8036542 - DNA, 22 bp, Homo sapiens
tctgccagtggtttggccctga

SEQ ID NO: 8036543 - DNA, 22 bp, Homo sapiens
tctgccaggccacacagggcac

SEQ ID NO: 8036544 - DNA, 22 bp, Homo sapiens
tctgccaggccacacagggcac

SEQ ID NO: 8036545 - DNA, 22 bp, Homo sapiens
tctgccaggccacacagggcac

SEQ ID NO: 8036546 - DNA, 22 bp, Homo sapiens
tctgccacactggttcagtgga

SEQ ID NO: 8036547 - DNA, 22 bp, Homo sapiens
tctgccacatgagggcacagca

SEQ ID NO: 8036548 - DNA, 22 bp, Homo sapiens
tctgccacatgagggcacagca

SEQ ID NO: 8036549 - DNA, 22 bp, Homo sapiens
tctgccaccaactgtcactaca

SEQ ID NO: 8036550 - DNA, 22 bp, Homo sapiens
tctgccaggcttggtgctagat

SEQ ID NO: 8036551 - DNA, 22 bp, Homo sapiens
tctgccaggcttggtgctagat

SEQ ID NO: 8036552 - DNA, 22 bp, Homo sapiens
tctgccaggcctgcttccgggg

SEQ ID NO: 8036553 - DNA, 22 bp, Homo sapiens
tctgccaggtggggagaggcca

SEQ ID NO: 8036554 - DNA, 22 bp, Homo sapiens
tctgccaggtggggagaggcca

SEQ ID NO: 8036555 - DNA, 22 bp, Homo sapiens
tctgccaggggcacttgcggct

SEQ ID NO: 8036556 - DNA, 22 bp, Homo sapiens
tctgccaggggcacttgcggct

SEQ ID NO: 8036557 - DNA, 22 bp, Homo sapiens
tctgcatattgttaatggaatg

SEQ ID NO: 8036558 - DNA, 22 bp, Homo sapiens
tctgcatatttatcatgagtct

SEQ ID NO: 8036559 - DNA, 22 bp, Homo sapiens
tctgcatatttatcatgagtct

SEQ ID NO: 8036560 - DNA, 22 bp, Homo sapiens
tctgcatattgttaatggaatg

SEQ ID NO: 8036561 - DNA, 22 bp, Homo sapiens
tctgcatattgttaatggaatg

SEQ ID NO: 8036562 - DNA, 22 bp, Homo sapiens
tctgcaggtgttggaagggtca

SEQ ID NO: 8036563 - DNA, 22 bp, Homo sapiens
tctgcaggtgttggaagggtca

SEQ ID NO: 8036564 - DNA, 22 bp, Homo sapiens
tctgcaggtcacgctccagcct

SEQ ID NO: 8036565 - DNA, 22 bp, Homo sapiens
tctgcatggagaggagatgcta

SEQ ID NO: 8036566 - DNA, 19 bp, Homo sapiens
tctgcatggcaggaagaga

SEQ ID NO: 8036567 - DNA, 22 bp, Homo sapiens
tctgcattgtcccagaagtgac

SEQ ID NO: 8036568 - DNA, 19 bp, Homo sapiens
tctgcatggcaggaagaga

SEQ ID NO: 8036569 - DNA, 21 bp, Homo sapiens
tctgcattttagcaagatctc

SEQ ID NO: 8036570 - DNA, 22 bp, Homo sapiens
tctgcatttggatcttgagctg

SEQ ID NO: 8036571 - DNA, 22 bp, Homo sapiens
tctgcatttggatcttgagctg

SEQ ID NO: 8036572 - DNA, 21 bp, Homo sapiens
tctgcattttagcaagatctc

SEQ ID NO: 8036573 - DNA, 22 bp, Homo sapiens
tctgcatttttaacaagatccc

SEQ ID NO: 8036574 - DNA, 22 bp, Homo sapiens
tctgccaacccgtattggtgcc

SEQ ID NO: 8036575 - DNA, 22 bp, Homo sapiens
tctgcatttttaacaagatccc

SEQ ID NO: 8036576 - DNA, 22 bp, Homo sapiens
tctgcatcatgatgtttgcaag

SEQ ID NO: 8036577 - DNA, 22 bp, Homo sapiens
tctgcatcaggagaggcgggca

SEQ ID NO: 8036578 - DNA, 22 bp, Homo sapiens
tctgcatcatttttcagagccg

SEQ ID NO: 8036579 - DNA, 22 bp, Homo sapiens
tctgcatccctcattgaacggc

SEQ ID NO: 8036580 - DNA, 22 bp, Homo sapiens
tctgcatcatttttcagagccg

SEQ ID NO: 8036581 - DNA, 22 bp, Homo sapiens
tctgcatccgaacccgccaccg

SEQ ID NO: 8036582 - DNA, 22 bp, Homo sapiens
tctgcatctcaggattcccttc

SEQ ID NO: 8036583 - DNA, 22 bp, Homo sapiens
tctgcatcgaagggcttttggt

SEQ ID NO: 8036584 - DNA, 22 bp, Homo sapiens
tctgcatcttctgcacatgcca

SEQ ID NO: 8036585 - DNA, 22 bp, Homo sapiens
tctgcatctcttataaatgatg

SEQ ID NO: 8036586 - DNA, 22 bp, Homo sapiens
tctgcatctgtgttgagtgccc

SEQ ID NO: 8036587 - DNA, 22 bp, Homo sapiens
tctgcatctgtgttgagtgccc

SEQ ID NO: 8036588 - DNA, 22 bp, Homo sapiens
tctgcatcttcaatagccttcc

SEQ ID NO: 8036589 - DNA, 22 bp, Homo sapiens
tctgcatgatgaacaaatgagc

SEQ ID NO: 8036590 - DNA, 22 bp, Homo sapiens
tctgcagggatgtgaggggtga

SEQ ID NO: 8036591 - DNA, 22 bp, Homo sapiens
tctgcaggcttggagtggcagc

SEQ ID NO: 8036592 - DNA, 22 bp, Homo sapiens
tctgcaggcttggagtggcagc

SEQ ID NO: 8036593 - DNA, 22 bp, Homo sapiens
tctgcaggcttggagtggcagc

SEQ ID NO: 8036594 - DNA, 22 bp, Homo sapiens
tctgcaggcttataggatgggt

SEQ ID NO: 8036595 - DNA, 22 bp, Homo sapiens
tctgcaggcttggagtggcagc

SEQ ID NO: 8036596 - DNA, 22 bp, Homo sapiens
tctgcaggcttataggatgggt

SEQ ID NO: 8036597 - DNA, 22 bp, Homo sapiens
tctgcaggctgtacaggaagca

SEQ ID NO: 8036598 - DNA, 22 bp, Homo sapiens
tctgcaggctctagatgaggtt

SEQ ID NO: 8036599 - DNA, 22 bp, Homo sapiens
tctgcaggctctagatgaggtt

SEQ ID NO: 8036600 - DNA, 22 bp, Homo sapiens
tctgcaggtagagctcaggaat

SEQ ID NO: 8036601 - DNA, 22 bp, Homo sapiens
tctgcaggtaagcgttcttgga

SEQ ID NO: 8036602 - DNA, 17 bp, Homo sapiens
tctgcagggggccgtgt

SEQ ID NO: 8036603 - DNA, 22 bp, Homo sapiens
tctgcaggtaagcgttcttgga

SEQ ID NO: 8036604 - DNA, 17 bp, Homo sapiens
tctgcagggggccgtgt

SEQ ID NO: 8036605 - DNA, 22 bp, Homo sapiens
tctgcagggcccttggctcctg

SEQ ID NO: 8036606 - DNA, 22 bp, Homo sapiens
tctgcagggcccttggctcctg

SEQ ID NO: 8036607 - DNA, 22 bp, Homo sapiens
tctgcaaggggttctttaggcc

SEQ ID NO: 8036608 - DNA, 22 bp, Homo sapiens
tctgcaagtgacccgggcccag

SEQ ID NO: 8036609 - DNA, 19 bp, Homo sapiens
tctgcaagtgtcagaggcg

SEQ ID NO: 8036610 - DNA, 22 bp, Homo sapiens
tctgcaagtttatcacttggga

SEQ ID NO: 8036611 - DNA, 22 bp, Homo sapiens
tctgcacaccgccaggctgact

SEQ ID NO: 8036612 - DNA, 22 bp, Homo sapiens
tctgcacacaatttatctttct

SEQ ID NO: 8036613 - DNA, 22 bp, Homo sapiens
tctgcacaaaactgtcgcagaa

SEQ ID NO: 8036614 - DNA, 22 bp, Homo sapiens
tctgcaatgttttcccatcctg

SEQ ID NO: 8036615 - DNA, 21 bp, Homo sapiens
tctgcacagccccgcaggagg

SEQ ID NO: 8036616 - DNA, 22 bp, Homo sapiens
tctgcacaggagggccgtggtg

SEQ ID NO: 8036617 - DNA, 22 bp, Homo sapiens
tctgcacataggtaggctggaa

SEQ ID NO: 8036618 - DNA, 22 bp, Homo sapiens
tctgcacatcccccaaagtatt

SEQ ID NO: 8036619 - DNA, 22 bp, Homo sapiens
tctgcacatgtagtaaatatta

SEQ ID NO: 8036620 - DNA, 22 bp, Homo sapiens
tctgcacatgtagtaaatatta

SEQ ID NO: 8036621 - DNA, 22 bp, Homo sapiens
tctgcacatcccccaaagtatt

SEQ ID NO: 8036622 - DNA, 22 bp, Homo sapiens
tctgcacattttaccaatactc

SEQ ID NO: 8036623 - DNA, 22 bp, Homo sapiens
tctgcaccatcgtatgcttaat

SEQ ID NO: 8036624 - DNA, 22 bp, Homo sapiens
tctgcaccctgtggtcctctag

SEQ ID NO: 8036625 - DNA, 22 bp, Homo sapiens
tctgcacccttctgggttggaa

SEQ ID NO: 8036626 - DNA, 22 bp, Homo sapiens
tctgcaccccgcagggtcaggt

SEQ ID NO: 8036627 - DNA, 21 bp, Homo sapiens
tctgcaccccagcctgagtga

SEQ ID NO: 8036628 - DNA, 18 bp, Homo sapiens
tctgcactcctgagagag

SEQ ID NO: 8036629 - DNA, 18 bp, Homo sapiens
tctgcactcctgagagag

SEQ ID NO: 8036630 - DNA, 22 bp, Homo sapiens
tctgcacctctgaaattggtca

SEQ ID NO: 8036631 - DNA, 18 bp, Homo sapiens
tctgcactcctgagagag

SEQ ID NO: 8036632 - DNA, 22 bp, Homo sapiens
tctgcacctcctgcttgctaga

SEQ ID NO: 8036633 - DNA, 18 bp, Homo sapiens
tctgcactcctgagagag

SEQ ID NO: 8036634 - DNA, 18 bp, Homo sapiens
tctgcactcctgagagag

SEQ ID NO: 8036635 - DNA, 20 bp, Homo sapiens
tctgcactcctgcatgtgcc

SEQ ID NO: 8036636 - DNA, 20 bp, Homo sapiens
tctgcactcctgcatgtgcc

SEQ ID NO: 8036637 - DNA, 22 bp, Homo sapiens
tctgcactgggagcatgtctgg

SEQ ID NO: 8036638 - DNA, 22 bp, Homo sapiens
tctgcactgggagcatgtctgg

SEQ ID NO: 8036639 - DNA, 22 bp, Homo sapiens
tctgcactcctgtttcacctgg

SEQ ID NO: 8036640 - DNA, 22 bp, Homo sapiens
tctgcagaaactgtgactatgt

SEQ ID NO: 8036641 - DNA, 22 bp, Homo sapiens
tctgcactgggagcatgtctgg

SEQ ID NO: 8036642 - DNA, 22 bp, Homo sapiens
tctgcagaaactgtgactatgt

SEQ ID NO: 8036643 - DNA, 22 bp, Homo sapiens
tctgcagcacttaatgtttcgt

SEQ ID NO: 8036644 - DNA, 20 bp, Homo sapiens
tctgcagcacttgacaatgt

SEQ ID NO: 8036645 - DNA, 22 bp, Homo sapiens
tctgcagcaacctttcacctcc

SEQ ID NO: 8036646 - DNA, 22 bp, Homo sapiens
tctgcagatttatcagcagctg

SEQ ID NO: 8036647 - DNA, 22 bp, Homo sapiens
tctgcagatttatcagcagctg

SEQ ID NO: 8036648 - DNA, 22 bp, Homo sapiens
tctgcagcccaaagtctcttag

SEQ ID NO: 8036649 - DNA, 22 bp, Homo sapiens
tctgcagcccaaagtctcttag

SEQ ID NO: 8036650 - DNA, 22 bp, Homo sapiens
tctgcagcgtgcaggctggtgc

SEQ ID NO: 8036651 - DNA, 22 bp, Homo sapiens
tctgcagcgtgcaggctggtgc

SEQ ID NO: 8036652 - DNA, 22 bp, Homo sapiens
tctgcagcgtgcaggctggtgc

SEQ ID NO: 8036653 - DNA, 22 bp, Homo sapiens
tctgcagaactttatgagcaaa

SEQ ID NO: 8036654 - DNA, 22 bp, Homo sapiens
tctgcagaagaattaaggacag

SEQ ID NO: 8036655 - DNA, 22 bp, Homo sapiens
tctgcagaaagtggctcagtgg

SEQ ID NO: 8036656 - DNA, 22 bp, Homo sapiens
tctgcagaaagtggctcagtgg

SEQ ID NO: 8036657 - DNA, 22 bp, Homo sapiens
tctgcagaaagtggctcagtgg

SEQ ID NO: 8036658 - DNA, 22 bp, Homo sapiens
tctgcagaactttatgagcaaa

SEQ ID NO: 8036659 - DNA, 22 bp, Homo sapiens
tctgcagaactttatgagcaaa

SEQ ID NO: 8036660 - DNA, 22 bp, Homo sapiens
tctgcaggagcagggcgtggag

SEQ ID NO: 8036661 - DNA, 22 bp, Homo sapiens
tctgcaggagagtgccctagag

SEQ ID NO: 8036662 - DNA, 22 bp, Homo sapiens
tctgcaggaggctggctgcagg

SEQ ID NO: 8036663 - DNA, 22 bp, Homo sapiens
tctgcaggaggctggctgcagg

SEQ ID NO: 8036664 - DNA, 22 bp, Homo sapiens
tctgcaggatcagagccagagg

SEQ ID NO: 8036665 - DNA, 22 bp, Homo sapiens
tctgcaggatcagagccagagg

SEQ ID NO: 8036666 - DNA, 22 bp, Homo sapiens
tctgcaggatcagagccagagg

SEQ ID NO: 8036667 - DNA, 22 bp, Homo sapiens
tctgcaggaggctggctgcagg

SEQ ID NO: 8036668 - DNA, 22 bp, Homo sapiens
tctgcaggaggctggctgcagg

SEQ ID NO: 8036669 - DNA, 22 bp, Homo sapiens
tctgcaggcatttttggttgtc

SEQ ID NO: 8036670 - DNA, 22 bp, Homo sapiens
tctgcaggatggatgctcagaa

SEQ ID NO: 8036671 - DNA, 22 bp, Homo sapiens
tctgcaggatggatgctcagaa

SEQ ID NO: 8036672 - DNA, 22 bp, Homo sapiens
tctgcaggatggatgctcagaa

SEQ ID NO: 8036673 - DNA, 22 bp, Homo sapiens
tctgcaggatggatgctcagaa

SEQ ID NO: 8036674 - DNA, 22 bp, Homo sapiens
tctgcaggatgcaaagtgtaca

SEQ ID NO: 8036675 - DNA, 22 bp, Homo sapiens
tctgcaggatggatgctcagaa

SEQ ID NO: 8036676 - DNA, 22 bp, Homo sapiens
tctgcaggatggatgctcagaa

SEQ ID NO: 8036677 - DNA, 22 bp, Homo sapiens
tctgcaggctctagatgaggtt

SEQ ID NO: 8036678 - DNA, 22 bp, Homo sapiens
tctgcaggctctagatgaggtt

SEQ ID NO: 8036679 - DNA, 22 bp, Homo sapiens
tctgcaggctctagatgaggtt

SEQ ID NO: 8036680 - DNA, 22 bp, Homo sapiens
tctgcaggcctcgacaaggcca

SEQ ID NO: 8036681 - DNA, 22 bp, Homo sapiens
tctgcagcttcttgccagagag

SEQ ID NO: 8036682 - DNA, 22 bp, Homo sapiens
tctgcagcttactttcacatga

SEQ ID NO: 8036683 - DNA, 22 bp, Homo sapiens
tctgcagcttactttcacatga

SEQ ID NO: 8036684 - DNA, 22 bp, Homo sapiens
tctgcagcttactttcacatga

SEQ ID NO: 8036685 - DNA, 22 bp, Homo sapiens
tctgcagcttactttcacatga

SEQ ID NO: 8036686 - DNA, 22 bp, Homo sapiens
tctgcagcttcttgccagagag

SEQ ID NO: 8036687 - DNA, 22 bp, Homo sapiens
tctgcagctttcccctgattta

SEQ ID NO: 8036688 - DNA, 22 bp, Homo sapiens
tctgcagcttgcacaggcaggc

SEQ ID NO: 8036689 - DNA, 22 bp, Homo sapiens
tctgcagctttttggtggggtg

SEQ ID NO: 8036690 - DNA, 22 bp, Homo sapiens
tctgcaggaaaaaagtgcctgg

SEQ ID NO: 8036691 - DNA, 22 bp, Homo sapiens
tctgcaggaaaaaagtgcctgg

SEQ ID NO: 8036692 - DNA, 22 bp, Homo sapiens
tctgcaggaaaaaagtgcctgg

SEQ ID NO: 8036693 - DNA, 18 bp, Homo sapiens
tctgcaggacctcagggc

SEQ ID NO: 8036694 - DNA, 18 bp, Homo sapiens
tctgcaggacctcagggc

SEQ ID NO: 8036695 - DNA, 22 bp, Homo sapiens
tctgcaggagagtgccctagag

SEQ ID NO: 8036696 - DNA, 22 bp, Homo sapiens
tctgcaggactgaggcctgttt

SEQ ID NO: 8036697 - DNA, 22 bp, Homo sapiens
tctgcccagtttgtgctcaggt

SEQ ID NO: 8036698 - DNA, 22 bp, Homo sapiens
tctgcccattcttagagtctag

SEQ ID NO: 8036699 - DNA, 18 bp, Homo sapiens
tctgccccagccgcactg

SEQ ID NO: 8036700 - DNA, 22 bp, Homo sapiens
tctgccctaattcagtgcttag

SEQ ID NO: 8036701 - DNA, 22 bp, Homo sapiens
tctgccctaattcagtgcttag

SEQ ID NO: 8036702 - DNA, 22 bp, Homo sapiens
tctgccctaattcagtgcttag

SEQ ID NO: 8036703 - DNA, 22 bp, Homo sapiens
tctgcccgttcaaatccttgtt

SEQ ID NO: 8036704 - DNA, 22 bp, Homo sapiens
tctgccctaattcagtgcttag

SEQ ID NO: 8036705 - DNA, 22 bp, Homo sapiens
tctgccctaattcagtgcttag

SEQ ID NO: 8036706 - DNA, 22 bp, Homo sapiens
tctgcccctgctgggcacagag

SEQ ID NO: 8036707 - DNA, 18 bp, Homo sapiens
tctgccccagccgcactg

SEQ ID NO: 8036708 - DNA, 18 bp, Homo sapiens
tctgccccagccgcactg

SEQ ID NO: 8036709 - DNA, 22 bp, Homo sapiens
tctgcccctgctgggcacagag

SEQ ID NO: 8036710 - DNA, 22 bp, Homo sapiens
tctgcccctgctgggcacagag

SEQ ID NO: 8036711 - DNA, 22 bp, Homo sapiens
tctgccctcgaggagcttgtgt

SEQ ID NO: 8036712 - DNA, 23 bp, Homo sapiens
tctgccctctgcctgtttttgta

SEQ ID NO: 8036713 - DNA, 22 bp, Homo sapiens
tctgccctcgaggagcttgtgt

SEQ ID NO: 8036714 - DNA, 21 bp, Homo sapiens
tctgccctccaggagctcata

SEQ ID NO: 8036715 - DNA, 21 bp, Homo sapiens
tctgccctccaggagctcata

SEQ ID NO: 8036716 - DNA, 22 bp, Homo sapiens
tctgccctcattgctgcctgga

SEQ ID NO: 8036717 - DNA, 21 bp, Homo sapiens
tctgccctccaggagctcata

SEQ ID NO: 8036718 - DNA, 21 bp, Homo sapiens
tctgccctccaggagctcata

SEQ ID NO: 8036719 - DNA, 22 bp, Homo sapiens
tctgccctcattgctgcctgga

SEQ ID NO: 8036720 - DNA, 22 bp, Homo sapiens
tctgccctcattgctgcctgga

SEQ ID NO: 8036721 - DNA, 22 bp, Homo sapiens
tctgccctcattgctgcctgga

SEQ ID NO: 8036722 - DNA, 22 bp, Homo sapiens
tctgccctcagggtaatgatca

SEQ ID NO: 8036723 - DNA, 22 bp, Homo sapiens
tctgccctcattgctgcctgga

SEQ ID NO: 8036724 - DNA, 22 bp, Homo sapiens
tctgccctcattgctgcctgga

SEQ ID NO: 8036725 - DNA, 22 bp, Homo sapiens
tctgccctcattgctgcctgga

SEQ ID NO: 8036726 - DNA, 22 bp, Homo sapiens
tctgcccacagcctcctgtcca

SEQ ID NO: 8036727 - DNA, 22 bp, Homo sapiens
tctgcccacagcctcctgtcca

SEQ ID NO: 8036728 - DNA, 22 bp, Homo sapiens
tctgcccacagtccaatagttg

SEQ ID NO: 8036729 - DNA, 22 bp, Homo sapiens
tctgcccactgctctgctgccc

SEQ ID NO: 8036730 - DNA, 22 bp, Homo sapiens
tctgcccactgctctgctgccc

SEQ ID NO: 8036731 - DNA, 22 bp, Homo sapiens
tctgcccagccagacccaaggt

SEQ ID NO: 8036732 - DNA, 22 bp, Homo sapiens
tctgcccagccagacccaaggt

SEQ ID NO: 8036733 - DNA, 22 bp, Homo sapiens
tctgcccaggacacctgccact

SEQ ID NO: 8036734 - DNA, 22 bp, Homo sapiens
tctgcccaggaggtcccatggg

SEQ ID NO: 8036735 - DNA, 18 bp, Homo sapiens
tctgcccaggacttggac

SEQ ID NO: 8036736 - DNA, 22 bp, Homo sapiens
tctgcccaggacacctgccact

SEQ ID NO: 8036737 - DNA, 22 bp, Homo sapiens
tctgcccaggacacctgccact

SEQ ID NO: 8036738 - DNA, 22 bp, Homo sapiens
tctgcccaggaggtcccatggg

SEQ ID NO: 8036739 - DNA, 22 bp, Homo sapiens
tctgcccagggacccacaggga

SEQ ID NO: 8036740 - DNA, 22 bp, Homo sapiens
tctgcccagggacccacaggga

SEQ ID NO: 8036741 - DNA, 22 bp, Homo sapiens
tctgcccagggacccacaggga

SEQ ID NO: 8036742 - DNA, 19 bp, Homo sapiens
tctgcccagttgtctgccc

SEQ ID NO: 8036743 - DNA, 22 bp, Homo sapiens
tctgccctgcagggagcagtaa

SEQ ID NO: 8036744 - DNA, 18 bp, Homo sapiens
tctgccctgccattcact

SEQ ID NO: 8036745 - DNA, 18 bp, Homo sapiens
tctgccctgccattcact

SEQ ID NO: 8036746 - DNA, 22 bp, Homo sapiens
tctgccctggggtcagcctcca

SEQ ID NO: 8036747 - DNA, 22 bp, Homo sapiens
tctgccctgccattcactggaa

SEQ ID NO: 8036748 - DNA, 22 bp, Homo sapiens
tctgccctggggtcagcctcca

SEQ ID NO: 8036749 - DNA, 22 bp, Homo sapiens
tctgccctgccattcactggaa

SEQ ID NO: 8036750 - DNA, 22 bp, Homo sapiens
tctgccctggggtcagcctcca

SEQ ID NO: 8036751 - DNA, 22 bp, Homo sapiens
tctgccctgccattcactggaa

SEQ ID NO: 8036752 - DNA, 22 bp, Homo sapiens
tctgccctggggtcagcctcca

SEQ ID NO: 8036753 - DNA, 22 bp, Homo sapiens
tctgcccttggctctcttgttg

SEQ ID NO: 8036754 - DNA, 22 bp, Homo sapiens
tctgccctggggtcagcctcca

SEQ ID NO: 8036755 - DNA, 22 bp, Homo sapiens
tctgcctgagcagagggaggcc

SEQ ID NO: 8036756 - DNA, 21 bp, Homo sapiens
tctgcctgagactttgctggt

SEQ ID NO: 8036757 - DNA, 22 bp, Homo sapiens
tctgcctgagcagagggaggcc

SEQ ID NO: 8036758 - DNA, 22 bp, Homo sapiens
tctgcccttggctctcttgttg

SEQ ID NO: 8036759 - DNA, 22 bp, Homo sapiens
tctgcccttggctctcttgttg

SEQ ID NO: 8036760 - DNA, 22 bp, Homo sapiens
tctgcccttggctctcttgttg

SEQ ID NO: 8036761 - DNA, 22 bp, Homo sapiens
tctgccgtgcgaggtcccacca

SEQ ID NO: 8036762 - DNA, 22 bp, Homo sapiens
tctgcctaggtttccaatgtgc

SEQ ID NO: 8036763 - DNA, 22 bp, Homo sapiens
tctgccgtgcgaggtcccacca

SEQ ID NO: 8036764 - DNA, 22 bp, Homo sapiens
tctgcctgccagtctggtcctc

SEQ ID NO: 8036765 - DNA, 22 bp, Homo sapiens
tctgcctgccagtctggtcctc

SEQ ID NO: 8036766 - DNA, 22 bp, Homo sapiens
tctgcctgccgagaacacctac

SEQ ID NO: 8036767 - DNA, 22 bp, Homo sapiens
tctgcctgcgctcacggggccg

SEQ ID NO: 8036768 - DNA, 22 bp, Homo sapiens
tctgcctgcgctcacggggccg

SEQ ID NO: 8036769 - DNA, 22 bp, Homo sapiens
tctgcctgcgctcacggggccg

SEQ ID NO: 8036770 - DNA, 22 bp, Homo sapiens
tctgcctgccagtctggtcctc

SEQ ID NO: 8036771 - DNA, 22 bp, Homo sapiens
tctgcctgagggagctgaggaa

SEQ ID NO: 8036772 - DNA, 22 bp, Homo sapiens
tctgcctgagggagctgaggaa

SEQ ID NO: 8036773 - DNA, 22 bp, Homo sapiens
tctgcctgagggagctgaggaa

SEQ ID NO: 8036774 - DNA, 22 bp, Homo sapiens
tctgcctgagggagctgaggaa

SEQ ID NO: 8036775 - DNA, 22 bp, Homo sapiens
tctgcctgagggagctgaggaa

SEQ ID NO: 8036776 - DNA, 22 bp, Homo sapiens
tctgcctgagggagctgaggaa

SEQ ID NO: 8036777 - DNA, 22 bp, Homo sapiens
tctgcctgagggagctgaggaa

SEQ ID NO: 8036778 - DNA, 22 bp, Homo sapiens
tctgcctgagggagctgaggaa

SEQ ID NO: 8036779 - DNA, 22 bp, Homo sapiens
tctgcctgagggagctgaggaa

SEQ ID NO: 8036780 - DNA, 18 bp, Homo sapiens
tctgcctgcagggcatct

SEQ ID NO: 8036781 - DNA, 18 bp, Homo sapiens
tctgcctgcagggcatct

SEQ ID NO: 8036782 - DNA, 18 bp, Homo sapiens
tctgcctgcagggcatct

SEQ ID NO: 8036783 - DNA, 18 bp, Homo sapiens
tctgcctgcagggcatct

SEQ ID NO: 8036784 - DNA, 18 bp, Homo sapiens
tctgcctgcagggcatct

SEQ ID NO: 8036785 - DNA, 22 bp, Homo sapiens
tctgcctggattccattctcca

SEQ ID NO: 8036786 - DNA, 22 bp, Homo sapiens
tctgcctggcctggagggcaca

SEQ ID NO: 8036787 - DNA, 22 bp, Homo sapiens
tctgcctggcctggagggcaca

SEQ ID NO: 8036788 - DNA, 22 bp, Homo sapiens
tctgcctggcctggagggcaca

SEQ ID NO: 8036789 - DNA, 22 bp, Homo sapiens
tctgcctggcctggagggcaca

SEQ ID NO: 8036790 - DNA, 22 bp, Homo sapiens
tctgcctggattttggaaagct

SEQ ID NO: 8036791 - DNA, 22 bp, Homo sapiens
tctgcctggattttggaaagct

SEQ ID NO: 8036792 - DNA, 22 bp, Homo sapiens
tctgcctggcggactcccggaa

SEQ ID NO: 8036793 - DNA, 22 bp, Homo sapiens
tctgcctggctcatggcagtga

SEQ ID NO: 8036794 - DNA, 22 bp, Homo sapiens
tctgcctggctcatggcagtga

SEQ ID NO: 8036795 - DNA, 22 bp, Homo sapiens
tctgcctgggtgtggagcagag

SEQ ID NO: 8036796 - DNA, 22 bp, Homo sapiens
tctgcctgtagtcccacacctc

SEQ ID NO: 8036797 - DNA, 22 bp, Homo sapiens
tctgcctgtaatatttggagaa

SEQ ID NO: 8036798 - DNA, 22 bp, Homo sapiens
tctgcctgtaatatttggagaa

SEQ ID NO: 8036799 - DNA, 22 bp, Homo sapiens
tctgcctgtaatatttggagaa

SEQ ID NO: 8036800 - DNA, 22 bp, Homo sapiens
tctgcctgggtgtggagcagag

SEQ ID NO: 8036801 - DNA, 19 bp, Homo sapiens
tctgcctgcttgtaggggc

SEQ ID NO: 8036802 - DNA, 19 bp, Homo sapiens
tctgcctgcttgtaggggc

SEQ ID NO: 8036803 - DNA, 22 bp, Homo sapiens
tctgcctgctgcctgggggctc

SEQ ID NO: 8036804 - DNA, 22 bp, Homo sapiens
tctgcctgcttcttcatagtct

SEQ ID NO: 8036805 - DNA, 22 bp, Homo sapiens
tctgcctgcttcttcatagtct

SEQ ID NO: 8036806 - DNA, 22 bp, Homo sapiens
tctgcctggagagttcttctct

SEQ ID NO: 8036807 - DNA, 22 bp, Homo sapiens
tctgcctggagagttcttctct

SEQ ID NO: 8036808 - DNA, 22 bp, Homo sapiens
tctgcctggaccctggtgagct

SEQ ID NO: 8036809 - DNA, 22 bp, Homo sapiens
tctgcctggaccctggtgagct

SEQ ID NO: 8036810 - DNA, 22 bp, Homo sapiens
tctgcctggaccctggtgagct

SEQ ID NO: 8036811 - DNA, 22 bp, Homo sapiens
tctgcctggaccctggtgagct

SEQ ID NO: 8036812 - DNA, 22 bp, Homo sapiens
tctgcctgctaactcctgcacc

SEQ ID NO: 8036813 - DNA, 22 bp, Homo sapiens
tctgcctgctaactcctgcacc

SEQ ID NO: 8036814 - DNA, 22 bp, Homo sapiens
tctgcctgctaactcctgcacc

SEQ ID NO: 8036815 - DNA, 22 bp, Homo sapiens
tctgcctgctaactcctgcacc

SEQ ID NO: 8036816 - DNA, 22 bp, Homo sapiens
tctgcctgcggctgcaggtggc

SEQ ID NO: 8036817 - DNA, 22 bp, Homo sapiens
tctgcctgcggctgcaggtggc

SEQ ID NO: 8036818 - DNA, 22 bp, Homo sapiens
tctgcctgcggctgcaggtggc

SEQ ID NO: 8036819 - DNA, 22 bp, Homo sapiens
tctgcctgcgctcacggggccg

SEQ ID NO: 8036820 - DNA, 22 bp, Homo sapiens
tctgcctgcggctgcaggtggc

SEQ ID NO: 8036821 - DNA, 22 bp, Homo sapiens
tctgcctgcggctgcaggtggc

SEQ ID NO: 8036822 - DNA, 22 bp, Homo sapiens
tctgcctgttcaagtcttctag

SEQ ID NO: 8036823 - DNA, 22 bp, Homo sapiens
tctgcctgttcaagtcttctag

SEQ ID NO: 8036824 - DNA, 22 bp, Homo sapiens
tctgcctgttcaagtcttctag

SEQ ID NO: 8036825 - DNA, 22 bp, Homo sapiens
tctgcctgtgctgtgttttcat

SEQ ID NO: 8036826 - DNA, 22 bp, Homo sapiens
tctgcctgtctccttgaattgt

SEQ ID NO: 8036827 - DNA, 22 bp, Homo sapiens
tctgcctgtggatacatgctct

SEQ ID NO: 8036828 - DNA, 22 bp, Homo sapiens
tctgcctgtggtggaggaagtt

SEQ ID NO: 8036829 - DNA, 22 bp, Homo sapiens
tctgcctgtggtggaggaagtt

SEQ ID NO: 8036830 - DNA, 22 bp, Homo sapiens
tctgcctgttgctagaatgtca

SEQ ID NO: 8036831 - DNA, 22 bp, Homo sapiens
tctgcctgttgagcctaaggcc

SEQ ID NO: 8036832 - DNA, 22 bp, Homo sapiens
tctgcctgttcccgattccatg

SEQ ID NO: 8036833 - DNA, 22 bp, Homo sapiens
tctgcctgttcccgattccatg

SEQ ID NO: 8036834 - DNA, 22 bp, Homo sapiens
tctgcctgttcccgattccatg

SEQ ID NO: 8036835 - DNA, 20 bp, Homo sapiens
tctgccttagggggagcctc

SEQ ID NO: 8036836 - DNA, 22 bp, Homo sapiens
tctgccttagcaattgtcaagg

SEQ ID NO: 8036837 - DNA, 22 bp, Homo sapiens
tctgccttccccataatctgat

SEQ ID NO: 8036838 - DNA, 20 bp, Homo sapiens
tctgccttatgaccttcgcc

SEQ ID NO: 8036839 - DNA, 22 bp, Homo sapiens
tctgccttcgctgctccctgaa

SEQ ID NO: 8036840 - DNA, 22 bp, Homo sapiens
tctgccttccccataatctgat

SEQ ID NO: 8036841 - DNA, 22 bp, Homo sapiens
tctgccttcttttagtcatctt

SEQ ID NO: 8036842 - DNA, 22 bp, Homo sapiens
tctgccttctatcttttgtctg

SEQ ID NO: 8036843 - DNA, 22 bp, Homo sapiens
tctgccttgaggtcctcagctc

SEQ ID NO: 8036844 - DNA, 22 bp, Homo sapiens
tctgccttcttttagtcatctt

SEQ ID NO: 8036845 - DNA, 22 bp, Homo sapiens
tctgccttccccataatctgat

SEQ ID NO: 8036846 - DNA, 22 bp, Homo sapiens
tctgccttcgctgctccctgaa

SEQ ID NO: 8036847 - DNA, 22 bp, Homo sapiens
tctgccttctatcttttgtctg

SEQ ID NO: 8036848 - DNA, 22 bp, Homo sapiens
tctgccttcgctgctccctgaa

SEQ ID NO: 8036849 - DNA, 22 bp, Homo sapiens
tctgccttcgctgctccctgaa

SEQ ID NO: 8036850 - DNA, 22 bp, Homo sapiens
tctgccttgaggtcctcagctc

SEQ ID NO: 8036851 - DNA, 22 bp, Homo sapiens
tctgccttgatggcattgagaa

SEQ ID NO: 8036852 - DNA, 22 bp, Homo sapiens
tctgccttgatggcattgagaa

SEQ ID NO: 8036853 - DNA, 20 bp, Homo sapiens
tctgctcagccctcagtggc

SEQ ID NO: 8036854 - DNA, 22 bp, Homo sapiens
tctgctcaggttacctagctag

SEQ ID NO: 8036855 - DNA, 22 bp, Homo sapiens
tctgctcagtgcttatctctaa

SEQ ID NO: 8036856 - DNA, 22 bp, Homo sapiens
tctgctcaggttacctagctag

SEQ ID NO: 8036857 - DNA, 22 bp, Homo sapiens
tctgctctagttgcttcctgcc

SEQ ID NO: 8036858 - DNA, 22 bp, Homo sapiens
tctgctctagttgcttcctgcc

SEQ ID NO: 8036859 - DNA, 22 bp, Homo sapiens
tctgctctagttgcttcctgcc

SEQ ID NO: 8036860 - DNA, 22 bp, Homo sapiens
tctggaccctgggctgtgattt

SEQ ID NO: 8036861 - DNA, 21 bp, Homo sapiens
tctggaccaccttgtaaagct

SEQ ID NO: 8036862 - DNA, 22 bp, Homo sapiens
tctggaccaagtcctgtggtga

SEQ ID NO: 8036863 - DNA, 22 bp, Homo sapiens
tctggacgtgttggtgaggacc

SEQ ID NO: 8036864 - DNA, 22 bp, Homo sapiens
tctggaccctgggctgtgattt

SEQ ID NO: 8036865 - DNA, 22 bp, Homo sapiens
tctggactaacagcagcctcag

SEQ ID NO: 8036866 - DNA, 22 bp, Homo sapiens
tctggacatgcttgaataatat

SEQ ID NO: 8036867 - DNA, 22 bp, Homo sapiens
tctggaccaacatagcttctgg

SEQ ID NO: 8036868 - DNA, 22 bp, Homo sapiens
tctggacatttggtaggataga

SEQ ID NO: 8036869 - DNA, 22 bp, Homo sapiens
tctggacatgcttgaataatat

SEQ ID NO: 8036870 - DNA, 22 bp, Homo sapiens
tctggacatcctggagaatgac

SEQ ID NO: 8036871 - DNA, 22 bp, Homo sapiens
tctggacatcctggagaatgac

SEQ ID NO: 8036872 - DNA, 22 bp, Homo sapiens
tctggactaacagcagcctcag

SEQ ID NO: 8036873 - DNA, 22 bp, Homo sapiens
tctggaattaaactcaggagac

SEQ ID NO: 8036874 - DNA, 22 bp, Homo sapiens
tctggaattaaactcaggagac

SEQ ID NO: 8036875 - DNA, 23 bp, Homo sapiens
tctggaatggtactcactggagt

SEQ ID NO: 8036876 - DNA, 22 bp, Homo sapiens
tctggaattctcaagtcctgga

SEQ ID NO: 8036877 - DNA, 22 bp, Homo sapiens
tctggaattgctgtgtgagttc

SEQ ID NO: 8036878 - DNA, 22 bp, Homo sapiens
tctggaattaaactcaggagac

SEQ ID NO: 8036879 - DNA, 22 bp, Homo sapiens
tctggaattctcaagtcctgga

SEQ ID NO: 8036880 - DNA, 22 bp, Homo sapiens
tctggacaggtcaaagcccatg

SEQ ID NO: 8036881 - DNA, 22 bp, Homo sapiens
tctggacagtagagcaatgatt

SEQ ID NO: 8036882 - DNA, 22 bp, Homo sapiens
tctggacagtagagcaatgatt

SEQ ID NO: 8036883 - DNA, 23 bp, Homo sapiens
tctggacataacggagaagcaaa

SEQ ID NO: 8036884 - DNA, 22 bp, Homo sapiens
tctggacaatcctgagacagac

SEQ ID NO: 8036885 - DNA, 22 bp, Homo sapiens
tctggacaatcctgagacagac

SEQ ID NO: 8036886 - DNA, 22 bp, Homo sapiens
tctggaaggaagagctgagtcc

SEQ ID NO: 8036887 - DNA, 22 bp, Homo sapiens
tctggaaggaacccttagagga

SEQ ID NO: 8036888 - DNA, 22 bp, Homo sapiens
tctggaagtcaccttagttcct

SEQ ID NO: 8036889 - DNA, 22 bp, Homo sapiens
tctggaaggggatctgtggtca

SEQ ID NO: 8036890 - DNA, 22 bp, Homo sapiens
tctggaagacattaatttggtt

SEQ ID NO: 8036891 - DNA, 22 bp, Homo sapiens
tctggaagacattaatttggtt

SEQ ID NO: 8036892 - DNA, 22 bp, Homo sapiens
tctggaagacagtgagcccgct

SEQ ID NO: 8036893 - DNA, 22 bp, Homo sapiens
tctggaagctggagtccaggaa

SEQ ID NO: 8036894 - DNA, 22 bp, Homo sapiens
tctggaagctggagtccaggaa

SEQ ID NO: 8036895 - DNA, 22 bp, Homo sapiens
tctggaagctggagtccaggaa

SEQ ID NO: 8036896 - DNA, 22 bp, Homo sapiens
tctggaagctggagtccaggaa

SEQ ID NO: 8036897 - DNA, 22 bp, Homo sapiens
tctggaaggaacccttagagga

SEQ ID NO: 8036898 - DNA, 22 bp, Homo sapiens
tctggaaggaacccttagagga

SEQ ID NO: 8036899 - DNA, 22 bp, Homo sapiens
tctggaagtgatgttcatagtg

SEQ ID NO: 8036900 - DNA, 22 bp, Homo sapiens
tctggaagttagaggaggaaag

SEQ ID NO: 8036901 - DNA, 22 bp, Homo sapiens
tctggaagttagaggaggaaag

SEQ ID NO: 8036902 - DNA, 19 bp, Homo sapiens
tctggaagtgggggattgc

SEQ ID NO: 8036903 - DNA, 22 bp, Homo sapiens
tctggaataggacaaaaccaaa

SEQ ID NO: 8036904 - DNA, 22 bp, Homo sapiens
tctggaatgaatgaggttctgt

SEQ ID NO: 8036905 - DNA, 23 bp, Homo sapiens
tctggaatcctcccccttggttc

SEQ ID NO: 8036906 - DNA, 22 bp, Homo sapiens
tctggaataggtcctgagtatt

SEQ ID NO: 8036907 - DNA, 22 bp, Homo sapiens
tctggaataggtcctgagtatt

SEQ ID NO: 8036908 - DNA, 22 bp, Homo sapiens
tctggaataggtcctgagtatt

SEQ ID NO: 8036909 - DNA, 22 bp, Homo sapiens
tctggagaaagttgagtttgtg

SEQ ID NO: 8036910 - DNA, 22 bp, Homo sapiens
tctggagaaagttgagtttgtg

SEQ ID NO: 8036911 - DNA, 22 bp, Homo sapiens
tctggagaaagttgagtttgtg

SEQ ID NO: 8036912 - DNA, 22 bp, Homo sapiens
tctggacttgaatcagagtaga

SEQ ID NO: 8036913 - DNA, 22 bp, Homo sapiens
tctggagaagaaacttgctctg

SEQ ID NO: 8036914 - DNA, 22 bp, Homo sapiens
tctggagaacttgcaagaggat

SEQ ID NO: 8036915 - DNA, 22 bp, Homo sapiens
tctggagaagcagtgagagtca

SEQ ID NO: 8036916 - DNA, 22 bp, Homo sapiens
tctggagaagcagtgagagtca

SEQ ID NO: 8036917 - DNA, 22 bp, Homo sapiens
tctggagaatctgtcagtgtgg

SEQ ID NO: 8036918 - DNA, 22 bp, Homo sapiens
tctggagaatctgtcagtgtgg

SEQ ID NO: 8036919 - DNA, 22 bp, Homo sapiens
tctggagaatctgtcagtgtgg

SEQ ID NO: 8036920 - DNA, 22 bp, Homo sapiens
tctggagaaggaagagtctttg

SEQ ID NO: 8036921 - DNA, 22 bp, Homo sapiens
tctggagaaggaagagtctttg

SEQ ID NO: 8036922 - DNA, 22 bp, Homo sapiens
tctggagaaggaagagtctttg

SEQ ID NO: 8036923 - DNA, 22 bp, Homo sapiens
tctggagaagcccagggagctg

SEQ ID NO: 8036924 - DNA, 22 bp, Homo sapiens
tctggagaagcccagggagctg

SEQ ID NO: 8036925 - DNA, 22 bp, Homo sapiens
tctggagaagcccagggagctg

SEQ ID NO: 8036926 - DNA, 22 bp, Homo sapiens
tctggagaagcccagggagctg

SEQ ID NO: 8036927 - DNA, 22 bp, Homo sapiens
tctggagaggaggatgtggaca

SEQ ID NO: 8036928 - DNA, 22 bp, Homo sapiens
tctggagagatcttccacaaca

SEQ ID NO: 8036929 - DNA, 22 bp, Homo sapiens
tctggagaggggcctagaattt

SEQ ID NO: 8036930 - DNA, 22 bp, Homo sapiens
tctggagaggggcctagaattt

SEQ ID NO: 8036931 - DNA, 22 bp, Homo sapiens
tctggagaggggcctagaattt

SEQ ID NO: 8036932 - DNA, 22 bp, Homo sapiens
tctggagaggaggatgtggaca

SEQ ID NO: 8036933 - DNA, 22 bp, Homo sapiens
tctggagaggaggatgtggaca

SEQ ID NO: 8036934 - DNA, 22 bp, Homo sapiens
tctggagaggggcctagaattt

SEQ ID NO: 8036935 - DNA, 22 bp, Homo sapiens
tctggagagtcacagtgccaga

SEQ ID NO: 8036936 - DNA, 22 bp, Homo sapiens
tctggagaggggcctagaattt

SEQ ID NO: 8036937 - DNA, 22 bp, Homo sapiens
tctggagagtcctgctcacgtc

SEQ ID NO: 8036938 - DNA, 22 bp, Homo sapiens
tctggagagtcacagtgccaga

SEQ ID NO: 8036939 - DNA, 22 bp, Homo sapiens
tctggagataagacagacagat

SEQ ID NO: 8036940 - DNA, 22 bp, Homo sapiens
tctggagagtcctgctcacgtc

SEQ ID NO: 8036941 - DNA, 22 bp, Homo sapiens
tctggagataagcagcaatgaa

SEQ ID NO: 8036942 - DNA, 22 bp, Homo sapiens
tctggagataagacagacagat

SEQ ID NO: 8036943 - DNA, 22 bp, Homo sapiens
tctggagataagacagacagat

SEQ ID NO: 8036944 - DNA, 17 bp, Homo sapiens
tctgctctgccaatcca

SEQ ID NO: 8036945 - DNA, 17 bp, Homo sapiens
tctgctctgccaatcca

SEQ ID NO: 8036946 - DNA, 17 bp, Homo sapiens
tctgctctgccaatcca

SEQ ID NO: 8036947 - DNA, 22 bp, Homo sapiens
tctgctctgagagggccatcag

SEQ ID NO: 8036948 - DNA, 22 bp, Homo sapiens
tctgctctgagagggccatcag

SEQ ID NO: 8036949 - DNA, 22 bp, Homo sapiens
tctgctctgtactgcactggcc

SEQ ID NO: 8036950 - DNA, 22 bp, Homo sapiens
tctgctctgtactgcactggcc

SEQ ID NO: 8036951 - DNA, 22 bp, Homo sapiens
tctgctctgggccagctattaa

SEQ ID NO: 8036952 - DNA, 22 bp, Homo sapiens
tctgctctgggccagctattaa

SEQ ID NO: 8036953 - DNA, 22 bp, Homo sapiens
tctgctctgtggcttcagctaa

SEQ ID NO: 8036954 - DNA, 22 bp, Homo sapiens
tctgctctgtggcttcagctaa

SEQ ID NO: 8036955 - DNA, 22 bp, Homo sapiens
tctgctctgtactgcactggcc

SEQ ID NO: 8036956 - DNA, 22 bp, Homo sapiens
tctgctctgtggcttcagctaa

SEQ ID NO: 8036957 - DNA, 22 bp, Homo sapiens
tctgctctgtggcttcagctaa

SEQ ID NO: 8036958 - DNA, 22 bp, Homo sapiens
tctgctctccatacttccgcac

SEQ ID NO: 8036959 - DNA, 22 bp, Homo sapiens
tctgctctccatacttccgcac

SEQ ID NO: 8036960 - DNA, 22 bp, Homo sapiens
tctgctctccatacttccgcac

SEQ ID NO: 8036961 - DNA, 22 bp, Homo sapiens
tctgctctagttgcttcctgcc

SEQ ID NO: 8036962 - DNA, 22 bp, Homo sapiens
tctgctctccatacttccgcac

SEQ ID NO: 8036963 - DNA, 22 bp, Homo sapiens
tctgctctgagagggccatcag

SEQ ID NO: 8036964 - DNA, 22 bp, Homo sapiens
tctgctctgagagggccatcag

SEQ ID NO: 8036965 - DNA, 22 bp, Homo sapiens
tctgctgcacaaattcatctct

SEQ ID NO: 8036966 - DNA, 22 bp, Homo sapiens
tctgctgagtcagacctctggg

SEQ ID NO: 8036967 - DNA, 22 bp, Homo sapiens
tctgctgaggccttcccactcc

SEQ ID NO: 8036968 - DNA, 22 bp, Homo sapiens
tctgctgaggccttcccactcc

SEQ ID NO: 8036969 - DNA, 22 bp, Homo sapiens
tctgctgaggtggttttagaga

SEQ ID NO: 8036970 - DNA, 22 bp, Homo sapiens
tctgctgaatggagccaacctc

SEQ ID NO: 8036971 - DNA, 22 bp, Homo sapiens
tctgctgacctttctctgacac

SEQ ID NO: 8036972 - DNA, 22 bp, Homo sapiens
tctgctgaacttgctgcccaga

SEQ ID NO: 8036973 - DNA, 22 bp, Homo sapiens
tctgctgcagagctgcgggtgc

SEQ ID NO: 8036974 - DNA, 22 bp, Homo sapiens
tctgctgcagcaggattctctg

SEQ ID NO: 8036975 - DNA, 22 bp, Homo sapiens
tctgctgccatgcagagcagta

SEQ ID NO: 8036976 - DNA, 22 bp, Homo sapiens
tctgctgccatgcagagcagta

SEQ ID NO: 8036977 - DNA, 22 bp, Homo sapiens
tctgctgccaccttgtggtgag

SEQ ID NO: 8036978 - DNA, 22 bp, Homo sapiens
tctgctgcctcggtgtgggtac

SEQ ID NO: 8036979 - DNA, 22 bp, Homo sapiens
tctgctgcctgcagggcagaga

SEQ ID NO: 8036980 - DNA, 22 bp, Homo sapiens
tctgctgcctgcagggcagaga

SEQ ID NO: 8036981 - DNA, 22 bp, Homo sapiens
tctgctgctacagactctctag

SEQ ID NO: 8036982 - DNA, 22 bp, Homo sapiens
tctgctgctgcagctacactat

SEQ ID NO: 8036983 - DNA, 22 bp, Homo sapiens
tctgctgctgagcacactccta

SEQ ID NO: 8036984 - DNA, 18 bp, Homo sapiens
tctgctgctgcgtcctgc

SEQ ID NO: 8036985 - DNA, 22 bp, Homo sapiens
tctgctggccttagcaggtcta

SEQ ID NO: 8036986 - DNA, 22 bp, Homo sapiens
tctgctggccttagcaggtcta

SEQ ID NO: 8036987 - DNA, 22 bp, Homo sapiens
tctgctggccttagcaggtcta

SEQ ID NO: 8036988 - DNA, 19 bp, Homo sapiens
tctgctggcagaattccct

SEQ ID NO: 8036989 - DNA, 19 bp, Homo sapiens
tctgctggcagaattccct

SEQ ID NO: 8036990 - DNA, 20 bp, Homo sapiens
tctgctggccaaaacttcac

SEQ ID NO: 8036991 - DNA, 22 bp, Homo sapiens
tctgctggaaaaccagggaatt

SEQ ID NO: 8036992 - DNA, 18 bp, Homo sapiens
tctgctgctgcgtcctgc

SEQ ID NO: 8036993 - DNA, 22 bp, Homo sapiens
tctgctggaaaaccagggaatt

SEQ ID NO: 8036994 - DNA, 22 bp, Homo sapiens
tctgctggtcaaggctgggtcc

SEQ ID NO: 8036995 - DNA, 22 bp, Homo sapiens
tctgctggtcaaggctgggtcc

SEQ ID NO: 8036996 - DNA, 23 bp, Homo sapiens
tctgctggtgacacggtcacatt

SEQ ID NO: 8036997 - DNA, 22 bp, Homo sapiens
tctgctggtcaaggctgggtcc

SEQ ID NO: 8036998 - DNA, 22 bp, Homo sapiens
tctgctggtgatgacctcataa

SEQ ID NO: 8036999 - DNA, 22 bp, Homo sapiens
tctgctggtgatgacctcataa

SEQ ID NO: 8037000 - DNA, 22 bp, Homo sapiens
tctgctggttccgaattaggcc

SEQ ID NO: 8037001 - DNA, 22 bp, Homo sapiens
tctgctggttccgaattaggcc

SEQ ID NO: 8037002 - DNA, 22 bp, Homo sapiens
tctgctggtgatgacctcataa

SEQ ID NO: 8037003 - DNA, 22 bp, Homo sapiens
tctgctggtgatgacctcataa

SEQ ID NO: 8037004 - DNA, 22 bp, Homo sapiens
tctgctgtaaagaatttctgcc

SEQ ID NO: 8037005 - DNA, 22 bp, Homo sapiens
tctgctgtaaccttcagaggta

SEQ ID NO: 8037006 - DNA, 22 bp, Homo sapiens
tctgctgtgttgaatgattggt

SEQ ID NO: 8037007 - DNA, 22 bp, Homo sapiens
tctgctgttcattcttttagct

SEQ ID NO: 8037008 - DNA, 22 bp, Homo sapiens
tctgctgttcattcttttagct

SEQ ID NO: 8037009 - DNA, 22 bp, Homo sapiens
tctgctgtgtcccctgtgcggg

SEQ ID NO: 8037010 - DNA, 22 bp, Homo sapiens
tctgctgtgtccctggtctcct

SEQ ID NO: 8037011 - DNA, 22 bp, Homo sapiens
tctgctgtgtccctggtctcct

SEQ ID NO: 8037012 - DNA, 21 bp, Homo sapiens
tctggaagaaaaaagtattat

SEQ ID NO: 8037013 - DNA, 22 bp, Homo sapiens
tctggaagaacggggcatgctg

SEQ ID NO: 8037014 - DNA, 22 bp, Homo sapiens
tctgctgttctcatgctgattt

SEQ ID NO: 8037015 - DNA, 22 bp, Homo sapiens
tctgctgtcactcatttgcttc

SEQ ID NO: 8037016 - DNA, 22 bp, Homo sapiens
tctgctgtcactcatttgcttc

SEQ ID NO: 8037017 - DNA, 22 bp, Homo sapiens
tctgctgtattaggttgaactg

SEQ ID NO: 8037018 - DNA, 22 bp, Homo sapiens
tctgctgtgatttgctacctgt

SEQ ID NO: 8037019 - DNA, 22 bp, Homo sapiens
tctgctgtgggtctatatttta

SEQ ID NO: 8037020 - DNA, 22 bp, Homo sapiens
tctgctgtgggtctatatttta

SEQ ID NO: 8037021 - DNA, 22 bp, Homo sapiens
tctgctgtgattctactagtgt

SEQ ID NO: 8037022 - DNA, 22 bp, Homo sapiens
tctgctgtgaaaggtgaatatt

SEQ ID NO: 8037023 - DNA, 22 bp, Homo sapiens
tctggcagagatatccatccca

SEQ ID NO: 8037024 - DNA, 22 bp, Homo sapiens
tctggcagaagtgctgtcagta

SEQ ID NO: 8037025 - DNA, 22 bp, Homo sapiens
tctggcagagatatccatccca

SEQ ID NO: 8037026 - DNA, 22 bp, Homo sapiens
tctggcagaggaaggaggcctg

SEQ ID NO: 8037027 - DNA, 22 bp, Homo sapiens
tctggcagaagtgctgtcagta

SEQ ID NO: 8037028 - DNA, 22 bp, Homo sapiens
tctggcagaagtgctgtcagta

SEQ ID NO: 8037029 - DNA, 22 bp, Homo sapiens
tctggcagaagtgctgtcagta

SEQ ID NO: 8037030 - DNA, 22 bp, Homo sapiens
tctggcagagatatccatccca

SEQ ID NO: 8037031 - DNA, 22 bp, Homo sapiens
tctggcagaggaaggaggcctg

SEQ ID NO: 8037032 - DNA, 22 bp, Homo sapiens
tctggcagagtcagtgcacaca

SEQ ID NO: 8037033 - DNA, 22 bp, Homo sapiens
tctggcagagtcagtgcacaca

SEQ ID NO: 8037034 - DNA, 22 bp, Homo sapiens
tctggcagagtgataggataag

SEQ ID NO: 8037035 - DNA, 22 bp, Homo sapiens
tctggcagagtcagtgcacaca

SEQ ID NO: 8037036 - DNA, 22 bp, Homo sapiens
tctggcagagtcagtgcacaca

SEQ ID NO: 8037037 - DNA, 22 bp, Homo sapiens
tctggcagagtcagtgcacaca

SEQ ID NO: 8037038 - DNA, 22 bp, Homo sapiens
tctggcaccactgagtctgcag

SEQ ID NO: 8037039 - DNA, 22 bp, Homo sapiens
tctggcacatagcagggtctct

SEQ ID NO: 8037040 - DNA, 22 bp, Homo sapiens
tctggcacatagcagggtctct

SEQ ID NO: 8037041 - DNA, 20 bp, Homo sapiens
tctggcacactgagaagctc

SEQ ID NO: 8037042 - DNA, 22 bp, Homo sapiens
tctggcaaaggcaaccacagtt

SEQ ID NO: 8037043 - DNA, 22 bp, Homo sapiens
tctggcaaaggcaaccacagtt

SEQ ID NO: 8037044 - DNA, 22 bp, Homo sapiens
tctggcagaagtgctgtcagta

SEQ ID NO: 8037045 - DNA, 22 bp, Homo sapiens
tctggcacttgccagtttctat

SEQ ID NO: 8037046 - DNA, 22 bp, Homo sapiens
tctggcagaaggcagaaattca

SEQ ID NO: 8037047 - DNA, 22 bp, Homo sapiens
tctggcaccctgacttagtgtt

SEQ ID NO: 8037048 - DNA, 22 bp, Homo sapiens
tctggcactgggctgtgtgagc

SEQ ID NO: 8037049 - DNA, 22 bp, Homo sapiens
tctggcaccctgacttagtgtt

SEQ ID NO: 8037050 - DNA, 22 bp, Homo sapiens
tctggcaggtcaatcattcttt

SEQ ID NO: 8037051 - DNA, 20 bp, Homo sapiens
tctggcaggtgaacgagctg

SEQ ID NO: 8037052 - DNA, 20 bp, Homo sapiens
tctggcaggtgaacgagctg

SEQ ID NO: 8037053 - DNA, 22 bp, Homo sapiens
tctggcaggtcaatcattcttt

SEQ ID NO: 8037054 - DNA, 19 bp, Homo sapiens
tctggcaggtaattaggga

SEQ ID NO: 8037055 - DNA, 22 bp, Homo sapiens
tctggcaggtcaatcattcttt

SEQ ID NO: 8037056 - DNA, 22 bp, Homo sapiens
tctggcagatcttcccacgttt

SEQ ID NO: 8037057 - DNA, 22 bp, Homo sapiens
tctggcagcaagataacaatgg

SEQ ID NO: 8037058 - DNA, 22 bp, Homo sapiens
tctggcagggtgtgtatttaca

SEQ ID NO: 8037059 - DNA, 22 bp, Homo sapiens
tctggcagtgagcaacttgaca

SEQ ID NO: 8037060 - DNA, 22 bp, Homo sapiens
tctggcagtgaagtcatgaggt

SEQ ID NO: 8037061 - DNA, 22 bp, Homo sapiens
tctggcagtgaagtcatgaggt

SEQ ID NO: 8037062 - DNA, 22 bp, Homo sapiens
tctggcagtaataggggagaga

SEQ ID NO: 8037063 - DNA, 22 bp, Homo sapiens
tctggcagtaataggggagaga

SEQ ID NO: 8037064 - DNA, 20 bp, Homo sapiens
tctggcaggtgaacgagctg

SEQ ID NO: 8037065 - DNA, 22 bp, Homo sapiens
tctggcaggttcccatgttatg

SEQ ID NO: 8037066 - DNA, 20 bp, Homo sapiens
tctggcaggtgaacgagctg

SEQ ID NO: 8037067 - DNA, 22 bp, Homo sapiens
tctggcagtgatttctgtgatc

SEQ ID NO: 8037068 - DNA, 22 bp, Homo sapiens
tctggcagtggatgagggcagc

SEQ ID NO: 8037069 - DNA, 22 bp, Homo sapiens
tctggcagtgatttctgtgatc

SEQ ID NO: 8037070 - DNA, 22 bp, Homo sapiens
tctggcagtgatttctgtgatc

SEQ ID NO: 8037071 - DNA, 21 bp, Homo sapiens
tctggcagtggtctttcaaat

SEQ ID NO: 8037072 - DNA, 22 bp, Homo sapiens
tctggcagtttgagaaaggcta

SEQ ID NO: 8037073 - DNA, 22 bp, Homo sapiens
tctggcagttgccgcttcagtc

SEQ ID NO: 8037074 - DNA, 22 bp, Homo sapiens
tctggcagttgccgcttcagtc

SEQ ID NO: 8037075 - DNA, 22 bp, Homo sapiens
tctggcagttgccgcttcagtc

SEQ ID NO: 8037076 - DNA, 22 bp, Homo sapiens
tctggcagttccttgttgatat

SEQ ID NO: 8037077 - DNA, 22 bp, Homo sapiens
tctggcagttgccgcttcagtc

SEQ ID NO: 8037078 - DNA, 22 bp, Homo sapiens
tctggcagttgccgcttcagtc

SEQ ID NO: 8037079 - DNA, 22 bp, Homo sapiens
tctggcagtttgagaaaggcta

SEQ ID NO: 8037080 - DNA, 22 bp, Homo sapiens
tctggcatcactcgcaagagca

SEQ ID NO: 8037081 - DNA, 22 bp, Homo sapiens
tctggcatctgttttcatattt

SEQ ID NO: 8037082 - DNA, 22 bp, Homo sapiens
tctggcatggatttgagtgtct

SEQ ID NO: 8037083 - DNA, 22 bp, Homo sapiens
tctggcattttggctgggaaac

SEQ ID NO: 8037084 - DNA, 22 bp, Homo sapiens
tctggccaatgttgtgatcaca

SEQ ID NO: 8037085 - DNA, 22 bp, Homo sapiens
tctggccacccgaggcccctgc

SEQ ID NO: 8037086 - DNA, 22 bp, Homo sapiens
tctggccacccgaggcccctgc

SEQ ID NO: 8037087 - DNA, 22 bp, Homo sapiens
tctggccagtgaaatgcagaat

SEQ ID NO: 8037088 - DNA, 22 bp, Homo sapiens
tctggccaggatggcaagacca

SEQ ID NO: 8037089 - DNA, 22 bp, Homo sapiens
tctggccaggatggcaagacca

SEQ ID NO: 8037090 - DNA, 22 bp, Homo sapiens
tctggcccagcccctgatccca

SEQ ID NO: 8037091 - DNA, 22 bp, Homo sapiens
tctggcccagcccctgatccca

SEQ ID NO: 8037092 - DNA, 22 bp, Homo sapiens
tctggcccagcccctgatccca

SEQ ID NO: 8037093 - DNA, 22 bp, Homo sapiens
tctggcccagcccctgatccca

SEQ ID NO: 8037094 - DNA, 22 bp, Homo sapiens
tctggcccagcccctgatccca

SEQ ID NO: 8037095 - DNA, 22 bp, Homo sapiens
tctggcccatcttctgccacca

SEQ ID NO: 8037096 - DNA, 22 bp, Homo sapiens
tctggcccatcttctgccacca

SEQ ID NO: 8037097 - DNA, 22 bp, Homo sapiens
tctggcccatgatcctgctaac

SEQ ID NO: 8037098 - DNA, 22 bp, Homo sapiens
tctggcccatgatcctgctaac

SEQ ID NO: 8037099 - DNA, 22 bp, Homo sapiens
tctggcccatcttctgccacca

SEQ ID NO: 8037100 - DNA, 22 bp, Homo sapiens
tctggcccagcccctgaggtca

SEQ ID NO: 8037101 - DNA, 22 bp, Homo sapiens
tctggcccagcccctgaggtca

SEQ ID NO: 8037102 - DNA, 22 bp, Homo sapiens
tctggcccagcccctgaggtca

SEQ ID NO: 8037103 - DNA, 22 bp, Homo sapiens
tctggcccagcccctgaggtca

SEQ ID NO: 8037104 - DNA, 22 bp, Homo sapiens
tctggccatggcaagccgagtg

SEQ ID NO: 8037105 - DNA, 22 bp, Homo sapiens
tctggcccaagttttcggtgag

SEQ ID NO: 8037106 - DNA, 22 bp, Homo sapiens
tctggcccaagttttcggtgag

SEQ ID NO: 8037107 - DNA, 22 bp, Homo sapiens
tctggagtatgtccctggtgaa

SEQ ID NO: 8037108 - DNA, 22 bp, Homo sapiens
tctggagtatgtccctggtgaa

SEQ ID NO: 8037109 - DNA, 22 bp, Homo sapiens
tctggagtggacccagagcact

SEQ ID NO: 8037110 - DNA, 22 bp, Homo sapiens
tctggagtctgagatctgagga

SEQ ID NO: 8037111 - DNA, 22 bp, Homo sapiens
tctggaggctctgagggtgagt

SEQ ID NO: 8037112 - DNA, 22 bp, Homo sapiens
tctggagggcccacatccacaa

SEQ ID NO: 8037113 - DNA, 23 bp, Homo sapiens
tctggaggggacactgcagatgc

SEQ ID NO: 8037114 - DNA, 22 bp, Homo sapiens
tctggaggggtttagagggaca

SEQ ID NO: 8037115 - DNA, 22 bp, Homo sapiens
tctggaggggtttagagggaca

SEQ ID NO: 8037116 - DNA, 22 bp, Homo sapiens
tctggagggggatgcctcatcc

SEQ ID NO: 8037117 - DNA, 22 bp, Homo sapiens
tctggagggggatgcctcatcc

SEQ ID NO: 8037118 - DNA, 22 bp, Homo sapiens
tctggaggctctgagggtgagt

SEQ ID NO: 8037119 - DNA, 21 bp, Homo sapiens
tctggagccctaagctgagaa

SEQ ID NO: 8037120 - DNA, 22 bp, Homo sapiens
tctggaggctctgagggtgagt

SEQ ID NO: 8037121 - DNA, 21 bp, Homo sapiens
tctggagccctaagctgagaa

SEQ ID NO: 8037122 - DNA, 21 bp, Homo sapiens
tctggagccctaagctgagaa

SEQ ID NO: 8037123 - DNA, 21 bp, Homo sapiens
tctggagccctaagctgagaa

SEQ ID NO: 8037124 - DNA, 22 bp, Homo sapiens
tctggagccacaaacctcagct

SEQ ID NO: 8037125 - DNA, 22 bp, Homo sapiens
tctggagcaacagagcaggaca

SEQ ID NO: 8037126 - DNA, 22 bp, Homo sapiens
tctggagcaacagagcaggaca

SEQ ID NO: 8037127 - DNA, 22 bp, Homo sapiens
tctggagcaacagagcaggaca

SEQ ID NO: 8037128 - DNA, 22 bp, Homo sapiens
tctggagcaacagagcaggaca

SEQ ID NO: 8037129 - DNA, 22 bp, Homo sapiens
tctggagatcatgtggggtgga

SEQ ID NO: 8037130 - DNA, 22 bp, Homo sapiens
tctggagatcatgtggggtgga

SEQ ID NO: 8037131 - DNA, 22 bp, Homo sapiens
tctggagataagcagcaatgaa

SEQ ID NO: 8037132 - DNA, 22 bp, Homo sapiens
tctggagtgtttctaattactg

SEQ ID NO: 8037133 - DNA, 22 bp, Homo sapiens
tctggagttcctgcaggctgtg

SEQ ID NO: 8037134 - DNA, 22 bp, Homo sapiens
tctggatcgccggcgcctgggc

SEQ ID NO: 8037135 - DNA, 22 bp, Homo sapiens
tctggatcccaccgccacacac

SEQ ID NO: 8037136 - DNA, 22 bp, Homo sapiens
tctggatcctatgcactggact

SEQ ID NO: 8037137 - DNA, 22 bp, Homo sapiens
tctggagttttttctgtctgtg

SEQ ID NO: 8037138 - DNA, 22 bp, Homo sapiens
tctggatcaccacttctgcctc

SEQ ID NO: 8037139 - DNA, 22 bp, Homo sapiens
tctggagttgtgcagtggacct

SEQ ID NO: 8037140 - DNA, 22 bp, Homo sapiens
tctggatgaagacccagaggct

SEQ ID NO: 8037141 - DNA, 22 bp, Homo sapiens
tctggatgacagaatggtcata

SEQ ID NO: 8037142 - DNA, 22 bp, Homo sapiens
tctggatgaagacccagaggct

SEQ ID NO: 8037143 - DNA, 22 bp, Homo sapiens
tctggatctccctcatcctggg

SEQ ID NO: 8037144 - DNA, 22 bp, Homo sapiens
tctggatgaaagggctatatat

SEQ ID NO: 8037145 - DNA, 22 bp, Homo sapiens
tctggatctccagcacttatca

SEQ ID NO: 8037146 - DNA, 22 bp, Homo sapiens
tctggatcgggttcctcaggtc

SEQ ID NO: 8037147 - DNA, 22 bp, Homo sapiens
tctggatctccctcatcctggg

SEQ ID NO: 8037148 - DNA, 22 bp, Homo sapiens
tctggatgatatgtgaacttga

SEQ ID NO: 8037149 - DNA, 22 bp, Homo sapiens
tctggatgatatgtgaacttga

SEQ ID NO: 8037150 - DNA, 22 bp, Homo sapiens
tctggatgagattaatggtgtg

SEQ ID NO: 8037151 - DNA, 22 bp, Homo sapiens
tctggatgacagaatggtcata

SEQ ID NO: 8037152 - DNA, 22 bp, Homo sapiens
tctggatgctctgagcccaagg

SEQ ID NO: 8037153 - DNA, 22 bp, Homo sapiens
tctggatgggatgaggcaacaa

SEQ ID NO: 8037154 - DNA, 22 bp, Homo sapiens
tctggatgctctgagcccaagg

SEQ ID NO: 8037155 - DNA, 22 bp, Homo sapiens
tctggattgcacttgtgggcca

SEQ ID NO: 8037156 - DNA, 22 bp, Homo sapiens
tctggattgtggctattgttct

SEQ ID NO: 8037157 - DNA, 22 bp, Homo sapiens
tctggattgttacacagagggc

SEQ ID NO: 8037158 - DNA, 22 bp, Homo sapiens
tctggatttaaatctcaatgct

SEQ ID NO: 8037159 - DNA, 22 bp, Homo sapiens
tctggatttcaaggatggattg

SEQ ID NO: 8037160 - DNA, 22 bp, Homo sapiens
tctggattctgtactgtaaagt

SEQ ID NO: 8037161 - DNA, 22 bp, Homo sapiens
tctggattctgaggtgggtgca

SEQ ID NO: 8037162 - DNA, 22 bp, Homo sapiens
tctggattcttttggtagttct

SEQ ID NO: 8037163 - DNA, 22 bp, Homo sapiens
tctggattgaggtgcaggcatt

SEQ ID NO: 8037164 - DNA, 22 bp, Homo sapiens
tctggatttgtcatctttaggg

SEQ ID NO: 8037165 - DNA, 22 bp, Homo sapiens
tctggatttcagttctaaatct

SEQ ID NO: 8037166 - DNA, 22 bp, Homo sapiens
tctggatttctgcctctacctc

SEQ ID NO: 8037167 - DNA, 22 bp, Homo sapiens
tctggatttgagctcagttgta

SEQ ID NO: 8037168 - DNA, 22 bp, Homo sapiens
tctggcaaaggcaaccacagtt

SEQ ID NO: 8037169 - DNA, 22 bp, Homo sapiens
tctggatttgtggaaaatctgc

SEQ ID NO: 8037170 - DNA, 22 bp, Homo sapiens
tctggattttcttcgtaaggat

SEQ ID NO: 8037171 - DNA, 22 bp, Homo sapiens
tctggattttggatatcaggct

SEQ ID NO: 8037172 - DNA, 17 bp, Homo sapiens
tctggatgtcatggaag

SEQ ID NO: 8037173 - DNA, 17 bp, Homo sapiens
tctggatgtcatggaag

SEQ ID NO: 8037174 - DNA, 22 bp, Homo sapiens
tctggatggtcagctcttcctg

SEQ ID NO: 8037175 - DNA, 17 bp, Homo sapiens
tctggatgtcatggaag

SEQ ID NO: 8037176 - DNA, 22 bp, Homo sapiens
tctggatgttgcggagtacaga

SEQ ID NO: 8037177 - DNA, 22 bp, Homo sapiens
tctggattaacctgatgtagga

SEQ ID NO: 8037178 - DNA, 22 bp, Homo sapiens
tctggattaactgctgtttatt

SEQ ID NO: 8037179 - DNA, 22 bp, Homo sapiens
tctggattagatgctttcaaga

SEQ ID NO: 8037180 - DNA, 22 bp, Homo sapiens
tctggattcaagtccctgtttt

SEQ ID NO: 8037181 - DNA, 22 bp, Homo sapiens
tctggattcacctttagtacct

SEQ ID NO: 8037182 - DNA, 22 bp, Homo sapiens
tctggattctaaggtgtttact

SEQ ID NO: 8037183 - DNA, 22 bp, Homo sapiens
tctgggctgaaatgaaggcctt

SEQ ID NO: 8037184 - DNA, 22 bp, Homo sapiens
tctgggctgaaatgaaggcctt

SEQ ID NO: 8037185 - DNA, 22 bp, Homo sapiens
tctgggctgaaatgaaggcctt

SEQ ID NO: 8037186 - DNA, 22 bp, Homo sapiens
tctgggctgaaatgaaggcctt

SEQ ID NO: 8037187 - DNA, 22 bp, Homo sapiens
tctgggctcttagtgtaccctc

SEQ ID NO: 8037188 - DNA, 23 bp, Homo sapiens
tctgggctgagacttggaaggtc

SEQ ID NO: 8037189 - DNA, 23 bp, Homo sapiens
tctgggctgagacttggaaggtc

SEQ ID NO: 8037190 - DNA, 23 bp, Homo sapiens
tctgggctgagacttggaaggtc

SEQ ID NO: 8037191 - DNA, 23 bp, Homo sapiens
tctgggctgagacttggaaggtc

SEQ ID NO: 8037192 - DNA, 23 bp, Homo sapiens
tctgggctgagctcgagtgtaga

SEQ ID NO: 8037193 - DNA, 23 bp, Homo sapiens
tctgggctgagacttggaaggtc

SEQ ID NO: 8037194 - DNA, 23 bp, Homo sapiens
tctgggctgagctcgagtgtaga

SEQ ID NO: 8037195 - DNA, 23 bp, Homo sapiens
tctgggctgagctcgagtgtaga

SEQ ID NO: 8037196 - DNA, 22 bp, Homo sapiens
tctgggctgctatgaggcagag

SEQ ID NO: 8037197 - DNA, 22 bp, Homo sapiens
tctgggctgctatgaggcagag

SEQ ID NO: 8037198 - DNA, 22 bp, Homo sapiens
tctgggctgctatgaggcagag

SEQ ID NO: 8037199 - DNA, 23 bp, Homo sapiens
tctgggctgagctcgagtgtaga

SEQ ID NO: 8037200 - DNA, 22 bp, Homo sapiens
tctgggctgctatgaggcagag

SEQ ID NO: 8037201 - DNA, 22 bp, Homo sapiens
tctgggctgctatgaggcagag

SEQ ID NO: 8037202 - DNA, 22 bp, Homo sapiens
tctgggctgctatgaggcagag

SEQ ID NO: 8037203 - DNA, 21 bp, Homo sapiens
tctgggctgctgctgcccatc

SEQ ID NO: 8037204 - DNA, 21 bp, Homo sapiens
tctgggctgctgctgcccatc

SEQ ID NO: 8037205 - DNA, 22 bp, Homo sapiens
tctgggctgctgtgcagtgacc

SEQ ID NO: 8037206 - DNA, 22 bp, Homo sapiens
tctgggctgctgtgcagtgacc

SEQ ID NO: 8037207 - DNA, 22 bp, Homo sapiens
tctgggctgctgtgcagtgacc

SEQ ID NO: 8037208 - DNA, 22 bp, Homo sapiens
tctgggctgctgtgcagtgacc

SEQ ID NO: 8037209 - DNA, 21 bp, Homo sapiens
tctgggctgctgctgcccatc

SEQ ID NO: 8037210 - DNA, 22 bp, Homo sapiens
tctgggctgctgtgcagtgacc

SEQ ID NO: 8037211 - DNA, 23 bp, Homo sapiens
tctgggctgcttaaggatcaagg

SEQ ID NO: 8037212 - DNA, 22 bp, Homo sapiens
tctgggctgctgtgcagtgacc

SEQ ID NO: 8037213 - DNA, 21 bp, Homo sapiens
tctgggcccatgctgcctcac

SEQ ID NO: 8037214 - DNA, 21 bp, Homo sapiens
tctgggcccatgctgcctcac

SEQ ID NO: 8037215 - DNA, 22 bp, Homo sapiens
tctgggccctaaaccagctcta

SEQ ID NO: 8037216 - DNA, 21 bp, Homo sapiens
tctgggcccatgctgcctcac

SEQ ID NO: 8037217 - DNA, 21 bp, Homo sapiens
tctgggcccatgctgcctcac

SEQ ID NO: 8037218 - DNA, 21 bp, Homo sapiens
tctgggcccatgctgcctcac

SEQ ID NO: 8037219 - DNA, 21 bp, Homo sapiens
tctgggcccatgctgcctcac

SEQ ID NO: 8037220 - DNA, 22 bp, Homo sapiens
tctgggcccactcaacttcact

SEQ ID NO: 8037221 - DNA, 22 bp, Homo sapiens
tctgggctcttagtgtaccctc

SEQ ID NO: 8037222 - DNA, 22 bp, Homo sapiens
tctgggccctaaaccagctcta

SEQ ID NO: 8037223 - DNA, 22 bp, Homo sapiens
tctgggctcttagtgtaccctc

SEQ ID NO: 8037224 - DNA, 22 bp, Homo sapiens
tctgggccctaaaccagctcta

SEQ ID NO: 8037225 - DNA, 22 bp, Homo sapiens
tctgggccctaaaccagctcta

SEQ ID NO: 8037226 - DNA, 22 bp, Homo sapiens
tctgggccctaaaccagctcta

SEQ ID NO: 8037227 - DNA, 23 bp, Homo sapiens
tctgggccacttgtctgcacttc

SEQ ID NO: 8037228 - DNA, 23 bp, Homo sapiens
tctgggccacttgtctgcacttc

SEQ ID NO: 8037229 - DNA, 22 bp, Homo sapiens
tctgggccagatctagggatct

SEQ ID NO: 8037230 - DNA, 22 bp, Homo sapiens
tctgggccagatctagggatct

SEQ ID NO: 8037231 - DNA, 22 bp, Homo sapiens
tctgggccagatctagggatct

SEQ ID NO: 8037232 - DNA, 22 bp, Homo sapiens
tctgggccagatctagggatct

SEQ ID NO: 8037233 - DNA, 22 bp, Homo sapiens
tctgggcccactcaacttcact

SEQ ID NO: 8037234 - DNA, 22 bp, Homo sapiens
tctgggcccactcaacttcact

SEQ ID NO: 8037235 - DNA, 22 bp, Homo sapiens
tctgggccagtgatttttccag

SEQ ID NO: 8037236 - DNA, 22 bp, Homo sapiens
tctgggccagtgatttttccag

SEQ ID NO: 8037237 - DNA, 22 bp, Homo sapiens
tctgggccagtgatttttccag

SEQ ID NO: 8037238 - DNA, 23 bp, Homo sapiens
tctgggccacttgtctgcacttc

SEQ ID NO: 8037239 - DNA, 23 bp, Homo sapiens
tctgggccacttgtctgcacttc

SEQ ID NO: 8037240 - DNA, 23 bp, Homo sapiens
tctgggccacttgtctgcacttc

SEQ ID NO: 8037241 - DNA, 23 bp, Homo sapiens
tctgggccacttgtctgcacttc

SEQ ID NO: 8037242 - DNA, 23 bp, Homo sapiens
tctgggccacttgtctgcacttc

SEQ ID NO: 8037243 - DNA, 22 bp, Homo sapiens
tctgggccaacccttccatggg

SEQ ID NO: 8037244 - DNA, 22 bp, Homo sapiens
tctgggccaacccttccatggg

SEQ ID NO: 8037245 - DNA, 22 bp, Homo sapiens
tctgggccaacccttccatggg

SEQ ID NO: 8037246 - DNA, 22 bp, Homo sapiens
tctgggcatgtctgtgaacacg

SEQ ID NO: 8037247 - DNA, 22 bp, Homo sapiens
tctgggccaacccttccatggg

SEQ ID NO: 8037248 - DNA, 22 bp, Homo sapiens
tctgggataagaccacagattt

SEQ ID NO: 8037249 - DNA, 22 bp, Homo sapiens
tctgggagtttctgtgggagct

SEQ ID NO: 8037250 - DNA, 22 bp, Homo sapiens
tctgggagtttctgtgggagct

SEQ ID NO: 8037251 - DNA, 22 bp, Homo sapiens
tctgggatgaagccagaaactt

SEQ ID NO: 8037252 - DNA, 22 bp, Homo sapiens
tctgggatgaagccagaaactt

SEQ ID NO: 8037253 - DNA, 22 bp, Homo sapiens
tctgggatagggccagaacatg

SEQ ID NO: 8037254 - DNA, 22 bp, Homo sapiens
tctgggatagggccagaacatg

SEQ ID NO: 8037255 - DNA, 22 bp, Homo sapiens
tctgggatagggccagaacatg

SEQ ID NO: 8037256 - DNA, 22 bp, Homo sapiens
tctgggataagaccacagattt

SEQ ID NO: 8037257 - DNA, 22 bp, Homo sapiens
tctgggattttatagacatgct

SEQ ID NO: 8037258 - DNA, 22 bp, Homo sapiens
tctgggatgagatcagagacac

SEQ ID NO: 8037259 - DNA, 22 bp, Homo sapiens
tctgggatgagatcagagacac

SEQ ID NO: 8037260 - DNA, 22 bp, Homo sapiens
tctgggatgcaaacagaatctg

SEQ ID NO: 8037261 - DNA, 22 bp, Homo sapiens
tctgggatgcaaacagaatctg

SEQ ID NO: 8037262 - DNA, 22 bp, Homo sapiens
tctgggatgagatcagagacac

SEQ ID NO: 8037263 - DNA, 18 bp, Homo sapiens
tctgggcaatctcagtat

SEQ ID NO: 8037264 - DNA, 18 bp, Homo sapiens
tctgggcaatctcagtat

SEQ ID NO: 8037265 - DNA, 22 bp, Homo sapiens
tctgggcaatggatgcactcac

SEQ ID NO: 8037266 - DNA, 22 bp, Homo sapiens
tctgggcaatggatgcactcac

SEQ ID NO: 8037267 - DNA, 22 bp, Homo sapiens
tctgggcacacaccatgcccac

SEQ ID NO: 8037268 - DNA, 23 bp, Homo sapiens
tctgggcaccttgttgacatgat

SEQ ID NO: 8037269 - DNA, 22 bp, Homo sapiens
tctgggcactgctgagcctgta

SEQ ID NO: 8037270 - DNA, 23 bp, Homo sapiens
tctgggcaccttgttgacatgat

SEQ ID NO: 8037271 - DNA, 23 bp, Homo sapiens
tctgggcaccttgttgacatgat

SEQ ID NO: 8037272 - DNA, 22 bp, Homo sapiens
tctgggcactgctgagcctgta

SEQ ID NO: 8037273 - DNA, 22 bp, Homo sapiens
tctgggcactgctgagcctgta

SEQ ID NO: 8037274 - DNA, 20 bp, Homo sapiens
tctgggcagggcacatggaa

SEQ ID NO: 8037275 - DNA, 22 bp, Homo sapiens
tctgggcagcctcaggccaggg

SEQ ID NO: 8037276 - DNA, 22 bp, Homo sapiens
tctgggcagcctcaggccaggg

SEQ ID NO: 8037277 - DNA, 19 bp, Homo sapiens
tctgggcagggccagcacc

SEQ ID NO: 8037278 - DNA, 19 bp, Homo sapiens
tctgggcagggccagcacc

SEQ ID NO: 8037279 - DNA, 22 bp, Homo sapiens
tctgggcagttcggatcctctg

SEQ ID NO: 8037280 - DNA, 23 bp, Homo sapiens
tctgggcatatctagtcacatcg

SEQ ID NO: 8037281 - DNA, 22 bp, Homo sapiens
tctgggcagccatgtgcctggc

SEQ ID NO: 8037282 - DNA, 22 bp, Homo sapiens
tctgggcagccatgtgcctggc

SEQ ID NO: 8037283 - DNA, 22 bp, Homo sapiens
tctgggcagccatgtgcctggc

SEQ ID NO: 8037284 - DNA, 22 bp, Homo sapiens
tctgggcactgctgagcctgta

SEQ ID NO: 8037285 - DNA, 22 bp, Homo sapiens
tctgggcagagggtcttagtca

SEQ ID NO: 8037286 - DNA, 22 bp, Homo sapiens
tctgggcagcagcagctagtag

SEQ ID NO: 8037287 - DNA, 22 bp, Homo sapiens
tctgggcagagggtcttagtca

SEQ ID NO: 8037288 - DNA, 22 bp, Homo sapiens
tctgggagaagctgatgtgaag

SEQ ID NO: 8037289 - DNA, 22 bp, Homo sapiens
tctgggagaagctgatgtgaag

SEQ ID NO: 8037290 - DNA, 21 bp, Homo sapiens
tctgggacagggcctgaggag

SEQ ID NO: 8037291 - DNA, 22 bp, Homo sapiens
tctgggagaagctgatgtgaag

SEQ ID NO: 8037292 - DNA, 22 bp, Homo sapiens
tctgggagacgtgtgttgtcag

SEQ ID NO: 8037293 - DNA, 22 bp, Homo sapiens
tctgggagaagctgatgtgaag

SEQ ID NO: 8037294 - DNA, 22 bp, Homo sapiens
tctgggagagcacgtggctgac

SEQ ID NO: 8037295 - DNA, 22 bp, Homo sapiens
tctgggagagcacgtggctgac

SEQ ID NO: 8037296 - DNA, 22 bp, Homo sapiens
tctgggagagcacgtggctgac

SEQ ID NO: 8037297 - DNA, 22 bp, Homo sapiens
tctgggagagagttgataaagg

SEQ ID NO: 8037298 - DNA, 22 bp, Homo sapiens
tctgggagacgtgtgttgtcag

SEQ ID NO: 8037299 - DNA, 22 bp, Homo sapiens
tctgggagacgtgtgttgtcag

SEQ ID NO: 8037300 - DNA, 22 bp, Homo sapiens
tctgggagagctgctgtcagag

SEQ ID NO: 8037301 - DNA, 22 bp, Homo sapiens
tctgggagagctgctgtcagag

SEQ ID NO: 8037302 - DNA, 22 bp, Homo sapiens
tctgggagagctgctgtcagag

SEQ ID NO: 8037303 - DNA, 22 bp, Homo sapiens
tctgggagagctgctgtcagag

SEQ ID NO: 8037304 - DNA, 22 bp, Homo sapiens
tctgggagagctgctgtcagag

SEQ ID NO: 8037305 - DNA, 22 bp, Homo sapiens
tctgggagagcacgtggctgac

SEQ ID NO: 8037306 - DNA, 22 bp, Homo sapiens
tctgggagagcacgtggctgac

SEQ ID NO: 8037307 - DNA, 22 bp, Homo sapiens
tctgggagagggaaagaagact

SEQ ID NO: 8037308 - DNA, 22 bp, Homo sapiens
tctgggagagctgctgtcagag

SEQ ID NO: 8037309 - DNA, 22 bp, Homo sapiens
tctgggaatttattggcacttt

SEQ ID NO: 8037310 - DNA, 22 bp, Homo sapiens
tctgggaatttattggcacttt

SEQ ID NO: 8037311 - DNA, 23 bp, Homo sapiens
tctgggaattggctgtccacagg

SEQ ID NO: 8037312 - DNA, 22 bp, Homo sapiens
tctgggaatggttgatccacac

SEQ ID NO: 8037313 - DNA, 22 bp, Homo sapiens
tctgggaatgaggcccagcgat

SEQ ID NO: 8037314 - DNA, 22 bp, Homo sapiens
tctgggaatgaggcttgggcaa

SEQ ID NO: 8037315 - DNA, 22 bp, Homo sapiens
tctgggaatgaggcttgggcaa

SEQ ID NO: 8037316 - DNA, 19 bp, Homo sapiens
tctgggaatgatgccagca

SEQ ID NO: 8037317 - DNA, 19 bp, Homo sapiens
tctgggaatgatgccagca

SEQ ID NO: 8037318 - DNA, 23 bp, Homo sapiens
tctgggaattggctgtccacagg

SEQ ID NO: 8037319 - DNA, 22 bp, Homo sapiens
tctgggaaggctctgcagatat

SEQ ID NO: 8037320 - DNA, 22 bp, Homo sapiens
tctgggaagtcctctgtcatgc

SEQ ID NO: 8037321 - DNA, 22 bp, Homo sapiens
tctgggaagtcctctgtcatgc

SEQ ID NO: 8037322 - DNA, 22 bp, Homo sapiens
tctgggaagtcctctgtcatgc

SEQ ID NO: 8037323 - DNA, 22 bp, Homo sapiens
tctgggaagtgagatgctgtgt

SEQ ID NO: 8037324 - DNA, 22 bp, Homo sapiens
tctgggaagtcctctgtcatgc

SEQ ID NO: 8037325 - DNA, 22 bp, Homo sapiens
tctgggaagttggcagccagct

SEQ ID NO: 8037326 - DNA, 22 bp, Homo sapiens
tctgggaagtgagatgctgtgt

SEQ ID NO: 8037327 - DNA, 22 bp, Homo sapiens
tctgggaatacacactgattta

SEQ ID NO: 8037328 - DNA, 22 bp, Homo sapiens
tctgggaatacacactgattta

SEQ ID NO: 8037329 - DNA, 22 bp, Homo sapiens
tctgggaatacacactgattta

SEQ ID NO: 8037330 - DNA, 22 bp, Homo sapiens
tctgggaatacacactgattta

SEQ ID NO: 8037331 - DNA, 22 bp, Homo sapiens
tctgggaataaaactagggact

SEQ ID NO: 8037332 - DNA, 22 bp, Homo sapiens
tctgggaataaaactagggact

SEQ ID NO: 8037333 - DNA, 22 bp, Homo sapiens
tctgggaagttggcagccagct

SEQ ID NO: 8037334 - DNA, 22 bp, Homo sapiens
tctgggaagtcctctgtcatgc

SEQ ID NO: 8037335 - DNA, 22 bp, Homo sapiens
tctgggaagttggcagccagct

SEQ ID NO: 8037336 - DNA, 22 bp, Homo sapiens
tctgggaagtgagatgctgtgt

SEQ ID NO: 8037337 - DNA, 22 bp, Homo sapiens
tctgggaggtaaccatgctgat

SEQ ID NO: 8037338 - DNA, 22 bp, Homo sapiens
tctgggaggtaaccatgctgat

SEQ ID NO: 8037339 - DNA, 22 bp, Homo sapiens
tctgggaggtaaccatgctgat

SEQ ID NO: 8037340 - DNA, 22 bp, Homo sapiens
tctgggaggtcacattggtctt

SEQ ID NO: 8037341 - DNA, 22 bp, Homo sapiens
tctgggaggtggcagggtgcat

SEQ ID NO: 8037342 - DNA, 22 bp, Homo sapiens
tctgggaggtactgggaggtgt

SEQ ID NO: 8037343 - DNA, 22 bp, Homo sapiens
tctgggaggtactgggaggtgt

SEQ ID NO: 8037344 - DNA, 22 bp, Homo sapiens
tctgggaggtactgggaggtgt

SEQ ID NO: 8037345 - DNA, 22 bp, Homo sapiens
tctgggaggtcacattggtctt

SEQ ID NO: 8037346 - DNA, 22 bp, Homo sapiens
tctgggagagtcacaggcattg

SEQ ID NO: 8037347 - DNA, 22 bp, Homo sapiens
tctgggagagtcacaggcattg

SEQ ID NO: 8037348 - DNA, 22 bp, Homo sapiens
tctgggagagtcacaggcattg

SEQ ID NO: 8037349 - DNA, 22 bp, Homo sapiens
tctgggagggctggttcagtat

SEQ ID NO: 8037350 - DNA, 22 bp, Homo sapiens
tctgggaggggctgccattgct

SEQ ID NO: 8037351 - DNA, 22 bp, Homo sapiens
tctgggaggggctgccattgct

SEQ ID NO: 8037352 - DNA, 22 bp, Homo sapiens
tctgggaggggctgccattgct

SEQ ID NO: 8037353 - DNA, 22 bp, Homo sapiens
tctgggaggtggcagggtgcat

SEQ ID NO: 8037354 - DNA, 22 bp, Homo sapiens
tctgggaggtggcagggtgcat

SEQ ID NO: 8037355 - DNA, 22 bp, Homo sapiens
tctgggaggtggcagggtgcat

SEQ ID NO: 8037356 - DNA, 22 bp, Homo sapiens
tctgggaggtggcagggtgcat

SEQ ID NO: 8037357 - DNA, 22 bp, Homo sapiens
tctgggagtaaggcctaggcat

SEQ ID NO: 8037358 - DNA, 22 bp, Homo sapiens
tctgggagtaaggcctaggcat

SEQ ID NO: 8037359 - DNA, 22 bp, Homo sapiens
tctgggagtaaggcctaggcat

SEQ ID NO: 8037360 - DNA, 22 bp, Homo sapiens
tctgggagtaaggcctaggcat

SEQ ID NO: 8037361 - DNA, 22 bp, Homo sapiens
tctgggaggtgttttgagaact

SEQ ID NO: 8037362 - DNA, 22 bp, Homo sapiens
tctgggagtaaggcctaggcat

SEQ ID NO: 8037363 - DNA, 22 bp, Homo sapiens
tctgggagttagaatacatggg

SEQ ID NO: 8037364 - DNA, 22 bp, Homo sapiens
tctgggagtttctgtgggagct

SEQ ID NO: 8037365 - DNA, 22 bp, Homo sapiens
tctgggagttgtagtccggtgg

SEQ ID NO: 8037366 - DNA, 22 bp, Homo sapiens
tctgggagttagaatacatggg

SEQ ID NO: 8037367 - DNA, 22 bp, Homo sapiens
tctgggagtgggtccaaggaat

SEQ ID NO: 8037368 - DNA, 22 bp, Homo sapiens
tctgggagtgggtccaaggaat

SEQ ID NO: 8037369 - DNA, 22 bp, Homo sapiens
tctgggagtgtgtctggccatc

SEQ ID NO: 8037370 - DNA, 22 bp, Homo sapiens
tctgggagtgtgtctggccatc

SEQ ID NO: 8037371 - DNA, 22 bp, Homo sapiens
tctggccctatggcatgtacct

SEQ ID NO: 8037372 - DNA, 22 bp, Homo sapiens
tctggccctatggcatgtacct

SEQ ID NO: 8037373 - DNA, 22 bp, Homo sapiens
tctggccctatggcatgtacct

SEQ ID NO: 8037374 - DNA, 22 bp, Homo sapiens
tctggccctatggcatgtacct

SEQ ID NO: 8037375 - DNA, 21 bp, Homo sapiens
tctggccctaggttgggcctc

SEQ ID NO: 8037376 - DNA, 21 bp, Homo sapiens
tctggccctaggttgggcctc

SEQ ID NO: 8037377 - DNA, 20 bp, Homo sapiens
tctggccccttcctgtcctg

SEQ ID NO: 8037378 - DNA, 20 bp, Homo sapiens
tctggccccttcctgtcctg

SEQ ID NO: 8037379 - DNA, 22 bp, Homo sapiens
tctggcccctggtctctggtgt

SEQ ID NO: 8037380 - DNA, 22 bp, Homo sapiens
tctggcccctggtctctggtgt

SEQ ID NO: 8037381 - DNA, 20 bp, Homo sapiens
tctggccccttcctgtcctg

SEQ ID NO: 8037382 - DNA, 22 bp, Homo sapiens
tctggcccctggtctctggtgt

SEQ ID NO: 8037383 - DNA, 22 bp, Homo sapiens
tctggcccctggcagtcctgga

SEQ ID NO: 8037384 - DNA, 22 bp, Homo sapiens
tctggcccctatggcggtggag

SEQ ID NO: 8037385 - DNA, 22 bp, Homo sapiens
tctggcccctggcagtcctgga

SEQ ID NO: 8037386 - DNA, 22 bp, Homo sapiens
tctggcccctggtctctggtgt

SEQ ID NO: 8037387 - DNA, 22 bp, Homo sapiens
tctggcccctggtctctggtgt

SEQ ID NO: 8037388 - DNA, 22 bp, Homo sapiens
tctggccccgcatgcactttat

SEQ ID NO: 8037389 - DNA, 22 bp, Homo sapiens
tctggccccgcatgcactttat

SEQ ID NO: 8037390 - DNA, 22 bp, Homo sapiens
tctggccccgcatgcactttat

SEQ ID NO: 8037391 - DNA, 22 bp, Homo sapiens
tctggcccatgatcctgctaac

SEQ ID NO: 8037392 - DNA, 22 bp, Homo sapiens
tctggccccatacagagggtct

SEQ ID NO: 8037393 - DNA, 23 bp, Homo sapiens
tctggccccattctttcccatgt

SEQ ID NO: 8037394 - DNA, 23 bp, Homo sapiens
tctggccccattctttcccatgt

SEQ ID NO: 8037395 - DNA, 22 bp, Homo sapiens
tctggccccggtcttcacagct

SEQ ID NO: 8037396 - DNA, 22 bp, Homo sapiens
tctggccccggtcttcacagct

SEQ ID NO: 8037397 - DNA, 22 bp, Homo sapiens
tctggccccggtcttcacagct

SEQ ID NO: 8037398 - DNA, 22 bp, Homo sapiens
tctggccccggtcttcacagct

SEQ ID NO: 8037399 - DNA, 22 bp, Homo sapiens
tctggccccggtcttcacagct

SEQ ID NO: 8037400 - DNA, 22 bp, Homo sapiens
tctggcccctatggcggtggag

SEQ ID NO: 8037401 - DNA, 22 bp, Homo sapiens
tctggcccctggcagtcctgga

SEQ ID NO: 8037402 - DNA, 22 bp, Homo sapiens
tctggcccctggcagtcctgga

SEQ ID NO: 8037403 - DNA, 22 bp, Homo sapiens
tctggctccctggagctccaca

SEQ ID NO: 8037404 - DNA, 19 bp, Homo sapiens
tctggctccgcctcttagt

SEQ ID NO: 8037405 - DNA, 22 bp, Homo sapiens
tctggctccctggagctccaca

SEQ ID NO: 8037406 - DNA, 22 bp, Homo sapiens
tctggctccgtgtccgctccca

SEQ ID NO: 8037407 - DNA, 22 bp, Homo sapiens
tctggctccgtgtccgctccca

SEQ ID NO: 8037408 - DNA, 19 bp, Homo sapiens
tctggctccgcctcttagt

SEQ ID NO: 8037409 - DNA, 22 bp, Homo sapiens
tctggctcctgagtccatgctc

SEQ ID NO: 8037410 - DNA, 22 bp, Homo sapiens
tctggctcctgagtccatgctc

SEQ ID NO: 8037411 - DNA, 22 bp, Homo sapiens
tctggctcctgagtccatgctc

SEQ ID NO: 8037412 - DNA, 23 bp, Homo sapiens
tctggctccatccttggggatcc

SEQ ID NO: 8037413 - DNA, 23 bp, Homo sapiens
tctggctccatccttggggatcc

SEQ ID NO: 8037414 - DNA, 22 bp, Homo sapiens
tctggctccaggaccgggcaca

SEQ ID NO: 8037415 - DNA, 22 bp, Homo sapiens
tctggctcccagcctgctctca

SEQ ID NO: 8037416 - DNA, 22 bp, Homo sapiens
tctggctcccagcctgctctca

SEQ ID NO: 8037417 - DNA, 23 bp, Homo sapiens
tctggctccatccttggggatcc

SEQ ID NO: 8037418 - DNA, 22 bp, Homo sapiens
tctggctccctggagctccaca

SEQ ID NO: 8037419 - DNA, 22 bp, Homo sapiens
tctggctccctggagctccaca

SEQ ID NO: 8037420 - DNA, 22 bp, Homo sapiens
tctggctccctggagctccaca

SEQ ID NO: 8037421 - DNA, 22 bp, Homo sapiens
tctggctccactctgtgcatgc

SEQ ID NO: 8037422 - DNA, 22 bp, Homo sapiens
tctggctccactttcttcattt

SEQ ID NO: 8037423 - DNA, 22 bp, Homo sapiens
tctggctccactttcttcattt

SEQ ID NO: 8037424 - DNA, 22 bp, Homo sapiens
tctggctccaggaccgggcaca

SEQ ID NO: 8037425 - DNA, 22 bp, Homo sapiens
tctggctccactctgtgcatgc

SEQ ID NO: 8037426 - DNA, 22 bp, Homo sapiens
tctggctccactctgtgcatgc

SEQ ID NO: 8037427 - DNA, 22 bp, Homo sapiens
tctggctccactctgtgcatgc

SEQ ID NO: 8037428 - DNA, 22 bp, Homo sapiens
tctggctccactctgtgcatgc

SEQ ID NO: 8037429 - DNA, 22 bp, Homo sapiens
tctggctccacctcctttacta

SEQ ID NO: 8037430 - DNA, 22 bp, Homo sapiens
tctggctccacacctcactgca

SEQ ID NO: 8037431 - DNA, 22 bp, Homo sapiens
tctggctccacacctcactgca

SEQ ID NO: 8037432 - DNA, 22 bp, Homo sapiens
tctggccctgctgctgtgagca

SEQ ID NO: 8037433 - DNA, 22 bp, Homo sapiens
tctggccctatggcatgtacct

SEQ ID NO: 8037434 - DNA, 21 bp, Homo sapiens
tctggccctcacagtcacacc

SEQ ID NO: 8037435 - DNA, 21 bp, Homo sapiens
tctggccctcacagtcacacc

SEQ ID NO: 8037436 - DNA, 21 bp, Homo sapiens
tctggccctcacagtcacacc

SEQ ID NO: 8037437 - DNA, 22 bp, Homo sapiens
tctggctctataactcctagct

SEQ ID NO: 8037438 - DNA, 23 bp, Homo sapiens
tctggctctatgtgacagctctc

SEQ ID NO: 8037439 - DNA, 22 bp, Homo sapiens
tctggctctaactaggcatcag

SEQ ID NO: 8037440 - DNA, 22 bp, Homo sapiens
tctggctctaactaggcatcag

SEQ ID NO: 8037441 - DNA, 22 bp, Homo sapiens
tctggctctaactaggcatcag

SEQ ID NO: 8037442 - DNA, 22 bp, Homo sapiens
tctggctctataactcctagct

SEQ ID NO: 8037443 - DNA, 22 bp, Homo sapiens
tctggctctataactcctagct

SEQ ID NO: 8037444 - DNA, 22 bp, Homo sapiens
tctggctctataactcctagct

SEQ ID NO: 8037445 - DNA, 22 bp, Homo sapiens
tctggctctcatactcgccagt

SEQ ID NO: 8037446 - DNA, 22 bp, Homo sapiens
tctggctctccagtgctcttag

SEQ ID NO: 8037447 - DNA, 22 bp, Homo sapiens
tctggctctccagtgctcttag

SEQ ID NO: 8037448 - DNA, 22 bp, Homo sapiens
tctggctctcatactcgccagt

SEQ ID NO: 8037449 - DNA, 22 bp, Homo sapiens
tctggctctcaacaaatattta

SEQ ID NO: 8037450 - DNA, 23 bp, Homo sapiens
tctggctctatgtgacagctctc

SEQ ID NO: 8037451 - DNA, 23 bp, Homo sapiens
tctggctctatgtgacagctctc

SEQ ID NO: 8037452 - DNA, 22 bp, Homo sapiens
tctggctctcaacaaatattta

SEQ ID NO: 8037453 - DNA, 22 bp, Homo sapiens
tctggctcctggctccactgcc

SEQ ID NO: 8037454 - DNA, 22 bp, Homo sapiens
tctggctcctggctccactgcc

SEQ ID NO: 8037455 - DNA, 22 bp, Homo sapiens
tctggctcctggctccactgcc

SEQ ID NO: 8037456 - DNA, 22 bp, Homo sapiens
tctggctcctggctccactgcc

SEQ ID NO: 8037457 - DNA, 22 bp, Homo sapiens
tctggctcctggctccactgcc

SEQ ID NO: 8037458 - DNA, 22 bp, Homo sapiens
tctggctcctggctccactgcc

SEQ ID NO: 8037459 - DNA, 19 bp, Homo sapiens
tctggctcctgccaggctg

SEQ ID NO: 8037460 - DNA, 19 bp, Homo sapiens
tctggctcctgccaggctg

SEQ ID NO: 8037461 - DNA, 22 bp, Homo sapiens
tctggctcggatttgtctagca

SEQ ID NO: 8037462 - DNA, 22 bp, Homo sapiens
tctggctctaactaggcatcag

SEQ ID NO: 8037463 - DNA, 22 bp, Homo sapiens
tctggctcggatttgtctagca

SEQ ID NO: 8037464 - DNA, 22 bp, Homo sapiens
tctggctctaactaggcatcag

SEQ ID NO: 8037465 - DNA, 22 bp, Homo sapiens
tctggctctaactaggcatcag

SEQ ID NO: 8037466 - DNA, 22 bp, Homo sapiens
tctggctcggatttgtctagca

SEQ ID NO: 8037467 - DNA, 22 bp, Homo sapiens
tctggctcggatttgtctagca

SEQ ID NO: 8037468 - DNA, 22 bp, Homo sapiens
tctggctcggatttgtctagca

SEQ ID NO: 8037469 - DNA, 22 bp, Homo sapiens
tctggctcggatttgtctagca

SEQ ID NO: 8037470 - DNA, 22 bp, Homo sapiens
tctggctcggatttgtctagca

SEQ ID NO: 8037471 - DNA, 22 bp, Homo sapiens
tctggctgaaattagaaggttc

SEQ ID NO: 8037472 - DNA, 22 bp, Homo sapiens
tctggctgaagcttttgcagct

SEQ ID NO: 8037473 - DNA, 22 bp, Homo sapiens
tctggctgaagcttttgcagct

SEQ ID NO: 8037474 - DNA, 22 bp, Homo sapiens
tctggctgaattagccttgggt

SEQ ID NO: 8037475 - DNA, 22 bp, Homo sapiens
tctggctgaaaggggctgtgcc

SEQ ID NO: 8037476 - DNA, 22 bp, Homo sapiens
tctggctgaaaggggctgtgcc

SEQ ID NO: 8037477 - DNA, 22 bp, Homo sapiens
tctggctctttgggtgattgta

SEQ ID NO: 8037478 - DNA, 22 bp, Homo sapiens
tctggctgaaaggggctgtgcc

SEQ ID NO: 8037479 - DNA, 22 bp, Homo sapiens
tctggctgaaaggggctgtgcc

SEQ ID NO: 8037480 - DNA, 22 bp, Homo sapiens
tctggctctttgggtgattgta

SEQ ID NO: 8037481 - DNA, 20 bp, Homo sapiens
tctggctctttgctcctccc

SEQ ID NO: 8037482 - DNA, 22 bp, Homo sapiens
tctggctctttgggtgattgta

SEQ ID NO: 8037483 - DNA, 20 bp, Homo sapiens
tctggctctttgctcctccc

SEQ ID NO: 8037484 - DNA, 20 bp, Homo sapiens
tctggctctttgctcctccc

SEQ ID NO: 8037485 - DNA, 20 bp, Homo sapiens
tctggctctttgctcctccc

SEQ ID NO: 8037486 - DNA, 22 bp, Homo sapiens
tctggctctgtgtcctcaccca

SEQ ID NO: 8037487 - DNA, 22 bp, Homo sapiens
tctggctctggagtccacctgc

SEQ ID NO: 8037488 - DNA, 22 bp, Homo sapiens
tctggctctggagtccacctgc

SEQ ID NO: 8037489 - DNA, 22 bp, Homo sapiens
tctggctctgacactactgtta

SEQ ID NO: 8037490 - DNA, 22 bp, Homo sapiens
tctggctctgacactactgtta

SEQ ID NO: 8037491 - DNA, 22 bp, Homo sapiens
tctggctctctcatcacccaat

SEQ ID NO: 8037492 - DNA, 22 bp, Homo sapiens
tctggctctctcatcacccaat

SEQ ID NO: 8037493 - DNA, 22 bp, Homo sapiens
tctggcttttctcttggatggt

SEQ ID NO: 8037494 - DNA, 22 bp, Homo sapiens
tctgggaaacactgcatcccca

SEQ ID NO: 8037495 - DNA, 22 bp, Homo sapiens
tctgggaaacactgcatcccca

SEQ ID NO: 8037496 - DNA, 22 bp, Homo sapiens
tctgggaaacactgcatcccca

SEQ ID NO: 8037497 - DNA, 22 bp, Homo sapiens
tctgggaaatggctacttgtca

SEQ ID NO: 8037498 - DNA, 22 bp, Homo sapiens
tctgggaaatagaggaccctag

SEQ ID NO: 8037499 - DNA, 22 bp, Homo sapiens
tctgggaaatgctgttccttgt

SEQ ID NO: 8037500 - DNA, 18 bp, Homo sapiens
tctggctttgttccttgt

SEQ ID NO: 8037501 - DNA, 22 bp, Homo sapiens
tctggcttttatgggatgagag

SEQ ID NO: 8037502 - DNA, 22 bp, Homo sapiens
tctggcttttattcagttggca

SEQ ID NO: 8037503 - DNA, 22 bp, Homo sapiens
tctggctttggatttgaagggt

SEQ ID NO: 8037504 - DNA, 23 bp, Homo sapiens
tctggctttgctggaagttttga

SEQ ID NO: 8037505 - DNA, 22 bp, Homo sapiens
tctggctttctgactctacaac

SEQ ID NO: 8037506 - DNA, 22 bp, Homo sapiens
tctgggaacagcctggctgtgt

SEQ ID NO: 8037507 - DNA, 22 bp, Homo sapiens
tctgggaacagcttagctccag

SEQ ID NO: 8037508 - DNA, 22 bp, Homo sapiens
tctgggaacacacgtcacttca

SEQ ID NO: 8037509 - DNA, 22 bp, Homo sapiens
tctgggaacactttgtgagctc

SEQ ID NO: 8037510 - DNA, 22 bp, Homo sapiens
tctgggaacactttgtgagctc

SEQ ID NO: 8037511 - DNA, 22 bp, Homo sapiens
tctgggaacactttgtgagctc

SEQ ID NO: 8037512 - DNA, 22 bp, Homo sapiens
tctgggaacagcctggctgtgt

SEQ ID NO: 8037513 - DNA, 22 bp, Homo sapiens
tctgggaaatggctacttgtca

SEQ ID NO: 8037514 - DNA, 22 bp, Homo sapiens
tctgggaaatgggcagcttcgc

SEQ ID NO: 8037515 - DNA, 22 bp, Homo sapiens
tctgggaaatggctacttgtca

SEQ ID NO: 8037516 - DNA, 22 bp, Homo sapiens
tctgggaaatggctacttgtca

SEQ ID NO: 8037517 - DNA, 21 bp, Homo sapiens
tctgggaaattgggaaagaag

SEQ ID NO: 8037518 - DNA, 21 bp, Homo sapiens
tctgggaaattgggaaagaag

SEQ ID NO: 8037519 - DNA, 22 bp, Homo sapiens
tctgggaacacacgtcacttca

SEQ ID NO: 8037520 - DNA, 22 bp, Homo sapiens
tctgggaacacacgtcacttca

SEQ ID NO: 8037521 - DNA, 22 bp, Homo sapiens
tctgggaactatatctggtggt

SEQ ID NO: 8037522 - DNA, 22 bp, Homo sapiens
tctgggaactctgtcatttccc

SEQ ID NO: 8037523 - DNA, 22 bp, Homo sapiens
tctgggaactgagctcccctag

SEQ ID NO: 8037524 - DNA, 22 bp, Homo sapiens
tctgggaactgagctcccctag

SEQ ID NO: 8037525 - DNA, 22 bp, Homo sapiens
tctgggaactatatctggtggt

SEQ ID NO: 8037526 - DNA, 22 bp, Homo sapiens
tctgggaactctgtcatttccc

SEQ ID NO: 8037527 - DNA, 22 bp, Homo sapiens
tctgggaactatatctggtggt

SEQ ID NO: 8037528 - DNA, 22 bp, Homo sapiens
tctgggaacgaaggctaatatg

SEQ ID NO: 8037529 - DNA, 22 bp, Homo sapiens
tctgggaaccattggtggggat

SEQ ID NO: 8037530 - DNA, 22 bp, Homo sapiens
tctgggaacactttgtgagctc

SEQ ID NO: 8037531 - DNA, 22 bp, Homo sapiens
tctgggaaccaaagggtgctta

SEQ ID NO: 8037532 - DNA, 22 bp, Homo sapiens
tctgggaaccagtgcggctggg

SEQ ID NO: 8037533 - DNA, 22 bp, Homo sapiens
tctgggaacatggcttggaatc

SEQ ID NO: 8037534 - DNA, 22 bp, Homo sapiens
tctgggaagctgcgtgcctgtt

SEQ ID NO: 8037535 - DNA, 22 bp, Homo sapiens
tctgggaaggagcctgagaatt

SEQ ID NO: 8037536 - DNA, 22 bp, Homo sapiens
tctgggaagctgcgtgcctgtt

SEQ ID NO: 8037537 - DNA, 22 bp, Homo sapiens
tctgggaaggctctgcagatat

SEQ ID NO: 8037538 - DNA, 22 bp, Homo sapiens
tctgggaaggagcctgagaatt

SEQ ID NO: 8037539 - DNA, 22 bp, Homo sapiens
tctgggaaggctctgcagatat

SEQ ID NO: 8037540 - DNA, 22 bp, Homo sapiens
tctgggaaggctctgcagatat

SEQ ID NO: 8037541 - DNA, 22 bp, Homo sapiens
tctgggaaggctctgcagatat

SEQ ID NO: 8037542 - DNA, 19 bp, Homo sapiens
tctgggaagccgggctcca

SEQ ID NO: 8037543 - DNA, 22 bp, Homo sapiens
tctgggaagacggatggaccct

SEQ ID NO: 8037544 - DNA, 22 bp, Homo sapiens
tctgggaagacggatggaccct

SEQ ID NO: 8037545 - DNA, 22 bp, Homo sapiens
tctgggaagatgtttcaaaggt

SEQ ID NO: 8037546 - DNA, 22 bp, Homo sapiens
tctgggaagcctgtatgcagaa

SEQ ID NO: 8037547 - DNA, 22 bp, Homo sapiens
tctgggaagcctgtatgcagaa

SEQ ID NO: 8037548 - DNA, 22 bp, Homo sapiens
tctggctgcgtggcctttagca

SEQ ID NO: 8037549 - DNA, 22 bp, Homo sapiens
tctggctgccaccatcctcccc

SEQ ID NO: 8037550 - DNA, 22 bp, Homo sapiens
tctggctgccaccatcctcccc

SEQ ID NO: 8037551 - DNA, 22 bp, Homo sapiens
tctggctgattccctgggactg

SEQ ID NO: 8037552 - DNA, 22 bp, Homo sapiens
tctggctgattccctgggactg

SEQ ID NO: 8037553 - DNA, 19 bp, Homo sapiens
tctggctgccaaggattga

SEQ ID NO: 8037554 - DNA, 22 bp, Homo sapiens
tctggctgattccctgggactg

SEQ ID NO: 8037555 - DNA, 22 bp, Homo sapiens
tctggctgattccctgggactg

SEQ ID NO: 8037556 - DNA, 22 bp, Homo sapiens
tctggctgattccctgggactg

SEQ ID NO: 8037557 - DNA, 22 bp, Homo sapiens
tctggctgacatcctgtatgag

SEQ ID NO: 8037558 - DNA, 22 bp, Homo sapiens
tctggctgacatcctgtatgag

SEQ ID NO: 8037559 - DNA, 22 bp, Homo sapiens
tctggctggctcggccgggagt

SEQ ID NO: 8037560 - DNA, 22 bp, Homo sapiens
tctggctgggaagggggcccga

SEQ ID NO: 8037561 - DNA, 22 bp, Homo sapiens
tctggctggcagtgatggtgtg

SEQ ID NO: 8037562 - DNA, 22 bp, Homo sapiens
tctggctggcagtgatggtgtg

SEQ ID NO: 8037563 - DNA, 22 bp, Homo sapiens
tctggctgctgcgtgagtgctt

SEQ ID NO: 8037564 - DNA, 22 bp, Homo sapiens
tctggctgctgcgtgagtgctt

SEQ ID NO: 8037565 - DNA, 22 bp, Homo sapiens
tctggctgctgcgtgagtgctt

SEQ ID NO: 8037566 - DNA, 22 bp, Homo sapiens
tctggctgctgcgtgagtgctt

SEQ ID NO: 8037567 - DNA, 23 bp, Homo sapiens
tctggctgctcctttcaatgctc

SEQ ID NO: 8037568 - DNA, 23 bp, Homo sapiens
tctggctgctcctttcaatgctc

SEQ ID NO: 8037569 - DNA, 23 bp, Homo sapiens
tctggctgctcctttcaatgctc

SEQ ID NO: 8037570 - DNA, 23 bp, Homo sapiens
tctggctgctcctttcaatgctc

SEQ ID NO: 8037571 - DNA, 22 bp, Homo sapiens
tctggctgtcattggaggcccc

SEQ ID NO: 8037572 - DNA, 22 bp, Homo sapiens
tctggctgtcattggaggcccc

SEQ ID NO: 8037573 - DNA, 22 bp, Homo sapiens
tctggctgtcattggaggcccc

SEQ ID NO: 8037574 - DNA, 22 bp, Homo sapiens
tctggctgtgtaaggtagcacc

SEQ ID NO: 8037575 - DNA, 22 bp, Homo sapiens
tctggctgggtgagagcttctc

SEQ ID NO: 8037576 - DNA, 22 bp, Homo sapiens
tctggctgggtgagagcttctc

SEQ ID NO: 8037577 - DNA, 22 bp, Homo sapiens
tctggctgggaagggggcccga

SEQ ID NO: 8037578 - DNA, 22 bp, Homo sapiens
tctggctttctcagcatggcat

SEQ ID NO: 8037579 - DNA, 22 bp, Homo sapiens
tctggctttcctggagcaagaa

SEQ ID NO: 8037580 - DNA, 22 bp, Homo sapiens
tctggctttctcagcatggcat

SEQ ID NO: 8037581 - DNA, 22 bp, Homo sapiens
tctggctttctgactctacaac

SEQ ID NO: 8037582 - DNA, 22 bp, Homo sapiens
tctggctttcatttgtttaaag

SEQ ID NO: 8037583 - DNA, 22 bp, Homo sapiens
tctggctttcctggagcaagaa

SEQ ID NO: 8037584 - DNA, 22 bp, Homo sapiens
tctggctgttaggcctgacctt

SEQ ID NO: 8037585 - DNA, 22 bp, Homo sapiens
tctggctgttaggcctgacctt

SEQ ID NO: 8037586 - DNA, 23 bp, Homo sapiens
tctggctttcacgggtattctta

SEQ ID NO: 8037587 - DNA, 21 bp, Homo sapiens
tctggctttcattccccttct

SEQ ID NO: 8037588 - DNA, 22 bp, Homo sapiens
tctggctgtgtatgagagtttt

SEQ ID NO: 8037589 - DNA, 22 bp, Homo sapiens
tctggctgttaggcctgacctt

SEQ ID NO: 8037590 - DNA, 22 bp, Homo sapiens
tctgtgtgggatagtttgagga

SEQ ID NO: 8037591 - DNA, 22 bp, Homo sapiens
tctgtgtggtagtttcagtgaa

SEQ ID NO: 8037592 - DNA, 22 bp, Homo sapiens
tctgtgtgttgtcaggaggatt

SEQ ID NO: 8037593 - DNA, 22 bp, Homo sapiens
tctgtgtgtgcctgttaatatt

SEQ ID NO: 8037594 - DNA, 22 bp, Homo sapiens
tctgtgtgtgcctgttaatatt

SEQ ID NO: 8037595 - DNA, 22 bp, Homo sapiens
tctgtgtgccctaaagcctgct

SEQ ID NO: 8037596 - DNA, 22 bp, Homo sapiens
tctgtgtgccctaaagcctgct

SEQ ID NO: 8037597 - DNA, 22 bp, Homo sapiens
tctgtgtgggatagtttgagga

SEQ ID NO: 8037598 - DNA, 22 bp, Homo sapiens
tctgtgtgggatagtttgagga

SEQ ID NO: 8037599 - DNA, 22 bp, Homo sapiens
tctgtgtgggatagtttgagga

SEQ ID NO: 8037600 - DNA, 22 bp, Homo sapiens
tctgtgtgggatagtttgagga

SEQ ID NO: 8037601 - DNA, 22 bp, Homo sapiens
tctgtgtgaccataagccagct

SEQ ID NO: 8037602 - DNA, 22 bp, Homo sapiens
tctgtgtgaccataagccagct

SEQ ID NO: 8037603 - DNA, 22 bp, Homo sapiens
tctgtgtctgttacttcactgc

SEQ ID NO: 8037604 - DNA, 22 bp, Homo sapiens
tctgtgtgaccataagccagct

SEQ ID NO: 8037605 - DNA, 22 bp, Homo sapiens
tctgtgtgatttcagggaagtc

SEQ ID NO: 8037606 - DNA, 22 bp, Homo sapiens
tctgtgtgaccataagccagct

SEQ ID NO: 8037607 - DNA, 20 bp, Homo sapiens
tctgtgtgccatcacctaac

SEQ ID NO: 8037608 - DNA, 22 bp, Homo sapiens
tctgtgtgcccacctgacacct

SEQ ID NO: 8037609 - DNA, 22 bp, Homo sapiens
tctgtgtgcccacctgacacct

SEQ ID NO: 8037610 - DNA, 22 bp, Homo sapiens
tctgtgttttaaacagtagaaa

SEQ ID NO: 8037611 - DNA, 22 bp, Homo sapiens
tctgtgttttaaacagtagaaa

SEQ ID NO: 8037612 - DNA, 22 bp, Homo sapiens
tctgtgttttgtgcctactgct

SEQ ID NO: 8037613 - DNA, 22 bp, Homo sapiens
tctgtgttttgtgcctactgct

SEQ ID NO: 8037614 - DNA, 22 bp, Homo sapiens
tctgtgtttaaaagatatgtcc

SEQ ID NO: 8037615 - DNA, 22 bp, Homo sapiens
tctgtgtttaaaagatatgtcc

SEQ ID NO: 8037616 - DNA, 22 bp, Homo sapiens
tctgtgttgataattttggaga

SEQ ID NO: 8037617 - DNA, 22 bp, Homo sapiens
tctgtgttgataattttggaga

SEQ ID NO: 8037618 - DNA, 18 bp, Homo sapiens
tctgtgttctgtcattgc

SEQ ID NO: 8037619 - DNA, 22 bp, Homo sapiens
tctgtgtgttgtcaggaggatt

SEQ ID NO: 8037620 - DNA, 22 bp, Homo sapiens
tctgttaaaagtggaataatag

SEQ ID NO: 8037621 - DNA, 22 bp, Homo sapiens
tctgttagagaggtagttcttg

SEQ ID NO: 8037622 - DNA, 22 bp, Homo sapiens
tctgttataaatcacactgcat

SEQ ID NO: 8037623 - DNA, 22 bp, Homo sapiens
tctgttagctgtcaaagtgttt

SEQ ID NO: 8037624 - DNA, 22 bp, Homo sapiens
tctgttagagaggtagttcttg

SEQ ID NO: 8037625 - DNA, 22 bp, Homo sapiens
tctgttatctcaagtcacaaga

SEQ ID NO: 8037626 - DNA, 22 bp, Homo sapiens
tctgttatatgttttttctaaa

SEQ ID NO: 8037627 - DNA, 22 bp, Homo sapiens
tctgttatatgttttttctaaa

SEQ ID NO: 8037628 - DNA, 22 bp, Homo sapiens
tctgttatatagataatgtgtg

SEQ ID NO: 8037629 - DNA, 22 bp, Homo sapiens
tctgttataaatcacactgcat

SEQ ID NO: 8037630 - DNA, 22 bp, Homo sapiens
tctgttgactcctagcagccat

SEQ ID NO: 8037631 - DNA, 22 bp, Homo sapiens
tctgttgaccaagtcttcttcc

SEQ ID NO: 8037632 - DNA, 22 bp, Homo sapiens
tctgttctttccaacaagacag

SEQ ID NO: 8037633 - DNA, 22 bp, Homo sapiens
tctgttgactcctagcagccat

SEQ ID NO: 8037634 - DNA, 22 bp, Homo sapiens
tctgttgactcctagcagccat

SEQ ID NO: 8037635 - DNA, 22 bp, Homo sapiens
tctgttgactcctagcagccat

SEQ ID NO: 8037636 - DNA, 22 bp, Homo sapiens
tctgttgactcctagcagccat

SEQ ID NO: 8037637 - DNA, 18 bp, Homo sapiens
tctgttgagcagagaggc

SEQ ID NO: 8037638 - DNA, 22 bp, Homo sapiens
tctgttgcaatgtgcatggtga

SEQ ID NO: 8037639 - DNA, 22 bp, Homo sapiens
tctgttgcaatgtgcatggtga

SEQ ID NO: 8037640 - DNA, 22 bp, Homo sapiens
tctgttgcaatgtgcatggtga

SEQ ID NO: 8037641 - DNA, 22 bp, Homo sapiens
tctgttgcaatgtgcatggtga

SEQ ID NO: 8037642 - DNA, 22 bp, Homo sapiens
tctgttatgcataagcatcagt

SEQ ID NO: 8037643 - DNA, 22 bp, Homo sapiens
tctgttatggaagtttcctttt

SEQ ID NO: 8037644 - DNA, 22 bp, Homo sapiens
tctgttatggaagtttcctttt

SEQ ID NO: 8037645 - DNA, 20 bp, Homo sapiens
tctgttattattacattgcc

SEQ ID NO: 8037646 - DNA, 22 bp, Homo sapiens
tctgttcttggtgcagctggga

SEQ ID NO: 8037647 - DNA, 22 bp, Homo sapiens
tctgttctttagcctgcttgag

SEQ ID NO: 8037648 - DNA, 22 bp, Homo sapiens
tctgttcttgtccccacttcag

SEQ ID NO: 8037649 - DNA, 22 bp, Homo sapiens
tctgttcttgtccccacttcag

SEQ ID NO: 8037650 - DNA, 22 bp, Homo sapiens
tctgttcttggtgcagctggga

SEQ ID NO: 8037651 - DNA, 22 bp, Homo sapiens
tctgttattctgtctattgcca

SEQ ID NO: 8037652 - DNA, 22 bp, Homo sapiens
tctgtttatgtgtctaaataaa

SEQ ID NO: 8037653 - DNA, 22 bp, Homo sapiens
tctgtttaggcaaaatagctac

SEQ ID NO: 8037654 - DNA, 22 bp, Homo sapiens
tctgtttagatgctttatctgt

SEQ ID NO: 8037655 - DNA, 22 bp, Homo sapiens
tctgttggagcctaggatgaca

SEQ ID NO: 8037656 - DNA, 22 bp, Homo sapiens
tctgttggacattcatctgcag

SEQ ID NO: 8037657 - DNA, 22 bp, Homo sapiens
tctgttggcttgagatttaatt

SEQ ID NO: 8037658 - DNA, 22 bp, Homo sapiens
tctgttggcttgagatttaatt

SEQ ID NO: 8037659 - DNA, 22 bp, Homo sapiens
tctgttggttctgtttctctga

SEQ ID NO: 8037660 - DNA, 22 bp, Homo sapiens
tctgtttaatgggaatgatact

SEQ ID NO: 8037661 - DNA, 22 bp, Homo sapiens
tctgtttaatgggaatgatact

SEQ ID NO: 8037662 - DNA, 22 bp, Homo sapiens
tctgttgtctgcaattctggga

SEQ ID NO: 8037663 - DNA, 22 bp, Homo sapiens
tctgtttaatgggaatgatact

SEQ ID NO: 8037664 - DNA, 22 bp, Homo sapiens
tctgttgcatatgctgctgggt

SEQ ID NO: 8037665 - DNA, 22 bp, Homo sapiens
tctgttgctttcttcctgtgtg

SEQ ID NO: 8037666 - DNA, 22 bp, Homo sapiens
tctgttgcaatgtgcatggtga

SEQ ID NO: 8037667 - DNA, 22 bp, Homo sapiens
tctgttgcaatgtgcatggtga

SEQ ID NO: 8037668 - DNA, 22 bp, Homo sapiens
tctgttgcaatgtgcatggtga

SEQ ID NO: 8037669 - DNA, 22 bp, Homo sapiens
tctgttgcaatgtgcatggtga

SEQ ID NO: 8037670 - DNA, 22 bp, Homo sapiens
tctgtttcttcttctgttatat

SEQ ID NO: 8037671 - DNA, 22 bp, Homo sapiens
tctgtttcttcttctgttatat

SEQ ID NO: 8037672 - DNA, 22 bp, Homo sapiens
tctgtttcttcctagccatgct

SEQ ID NO: 8037673 - DNA, 22 bp, Homo sapiens
tctgtttcttcctagccatgct

SEQ ID NO: 8037674 - DNA, 17 bp, Homo sapiens
tctgtttctcctttctt

SEQ ID NO: 8037675 - DNA, 22 bp, Homo sapiens
tctgtttctccaacattgtgag

SEQ ID NO: 8037676 - DNA, 22 bp, Homo sapiens
tctgtttctataaagacaagag

SEQ ID NO: 8037677 - DNA, 22 bp, Homo sapiens
tctgtttctccaacattgtgag

SEQ ID NO: 8037678 - DNA, 22 bp, Homo sapiens
tctgtttatgtgtctaaataaa

SEQ ID NO: 8037679 - DNA, 22 bp, Homo sapiens
tctgtttcaagtagggcttata

SEQ ID NO: 8037680 - DNA, 22 bp, Homo sapiens
tctgtttattcaatttctatat

SEQ ID NO: 8037681 - DNA, 22 bp, Homo sapiens
tctgtttctataaagacaagag

SEQ ID NO: 8037682 - DNA, 22 bp, Homo sapiens
tctgtttcctcttgtgtaaagt

SEQ ID NO: 8037683 - DNA, 22 bp, Homo sapiens
tctgtttcctcttgtgtaaagt

SEQ ID NO: 8037684 - DNA, 22 bp, Homo sapiens
tctgtttcctcttgtgtaaagt

SEQ ID NO: 8037685 - DNA, 22 bp, Homo sapiens
tctgttttagataagaaaggct

SEQ ID NO: 8037686 - DNA, 22 bp, Homo sapiens
tctgttttagataagaaaggct

SEQ ID NO: 8037687 - DNA, 22 bp, Homo sapiens
tctgttttctctgtattttgac

SEQ ID NO: 8037688 - DNA, 22 bp, Homo sapiens
tctgttttagataagaaaggct

SEQ ID NO: 8037689 - DNA, 22 bp, Homo sapiens
tctgttttagataagaaaggct

SEQ ID NO: 8037690 - DNA, 22 bp, Homo sapiens
tctgttttagataagaaaggct

SEQ ID NO: 8037691 - DNA, 22 bp, Homo sapiens
tctgttttagataagaaaggct

SEQ ID NO: 8037692 - DNA, 22 bp, Homo sapiens
tctgttttgcataatgttcttt

SEQ ID NO: 8037693 - DNA, 22 bp, Homo sapiens
tctgttttggtcacctttatat

SEQ ID NO: 8037694 - DNA, 23 bp, Homo sapiens
tctgttttgcaacatgtgacaag

SEQ ID NO: 8037695 - DNA, 23 bp, Homo sapiens
tctgttttgcaacatgtgacaag

SEQ ID NO: 8037696 - DNA, 23 bp, Homo sapiens
tctgttttgcaacatgtgacaag

SEQ ID NO: 8037697 - DNA, 22 bp, Homo sapiens
tctgttttcatttgtcttgaga

SEQ ID NO: 8037698 - DNA, 22 bp, Homo sapiens
tcttaaagcttacttcaattgt

SEQ ID NO: 8037699 - DNA, 22 bp, Homo sapiens
tcttaaaggcacatagtgtcta

SEQ ID NO: 8037700 - DNA, 22 bp, Homo sapiens
tcttaaaggcacatagtgtcta

SEQ ID NO: 8037701 - DNA, 22 bp, Homo sapiens
tcttaaaggcatgttagggtcc

SEQ ID NO: 8037702 - DNA, 22 bp, Homo sapiens
tcttaaagagcgcaatttgagg

SEQ ID NO: 8037703 - DNA, 22 bp, Homo sapiens
tcttaaagccaagcataaacca

SEQ ID NO: 8037704 - DNA, 22 bp, Homo sapiens
tcttaaaagtatgccaattgga

SEQ ID NO: 8037705 - DNA, 22 bp, Homo sapiens
tcttaaaagtatgccaattgga

SEQ ID NO: 8037706 - DNA, 22 bp, Homo sapiens
tcttaaaagtatgccaattgga

SEQ ID NO: 8037707 - DNA, 22 bp, Homo sapiens
tcttaaaagtatgccaattgga

SEQ ID NO: 8037708 - DNA, 22 bp, Homo sapiens
tcttaaagagcgcaatttgagg

SEQ ID NO: 8037709 - DNA, 22 bp, Homo sapiens
tcttaaactttgctgtaattct

SEQ ID NO: 8037710 - DNA, 22 bp, Homo sapiens
tcttaaaccacacatgtgctct

SEQ ID NO: 8037711 - DNA, 22 bp, Homo sapiens
tctgttttgtaccagatacagc

SEQ ID NO: 8037712 - DNA, 22 bp, Homo sapiens
tctgttttgtaccagatacagc

SEQ ID NO: 8037713 - DNA, 22 bp, Homo sapiens
tctgttttgtaccagatacagc

SEQ ID NO: 8037714 - DNA, 22 bp, Homo sapiens
tctgttttgtaccagatacagc

SEQ ID NO: 8037715 - DNA, 22 bp, Homo sapiens
tctgttttgtaccagatacagc

SEQ ID NO: 8037716 - DNA, 22 bp, Homo sapiens
tctgttttgtaccagatacagc

SEQ ID NO: 8037717 - DNA, 22 bp, Homo sapiens
tctgttttgtaccagatacagc

SEQ ID NO: 8037718 - DNA, 22 bp, Homo sapiens
tctgttttgtgtctctctggtg

SEQ ID NO: 8037719 - DNA, 22 bp, Homo sapiens
tctgtttttgaggctatcttct

SEQ ID NO: 8037720 - DNA, 22 bp, Homo sapiens
tctgttttgtgtctctctggtg

SEQ ID NO: 8037721 - DNA, 22 bp, Homo sapiens
tctgtttttgaggctatcttct

SEQ ID NO: 8037722 - DNA, 22 bp, Homo sapiens
tcttaactatcatttgaacacc

SEQ ID NO: 8037723 - DNA, 22 bp, Homo sapiens
tcttaacagtgctacagagcag

SEQ ID NO: 8037724 - DNA, 22 bp, Homo sapiens
tcttaacatattattttagcac

SEQ ID NO: 8037725 - DNA, 22 bp, Homo sapiens
tcttaacaagctcctcagtgct

SEQ ID NO: 8037726 - DNA, 22 bp, Homo sapiens
tcttaacaagctcctcagtgct

SEQ ID NO: 8037727 - DNA, 22 bp, Homo sapiens
tcttaaatgactgataagagga

SEQ ID NO: 8037728 - DNA, 20 bp, Homo sapiens
tcttaaatccccagggccat

SEQ ID NO: 8037729 - DNA, 20 bp, Homo sapiens
tcttaaatccccagggccat

SEQ ID NO: 8037730 - DNA, 20 bp, Homo sapiens
tcttaaatccccagggccat

SEQ ID NO: 8037731 - DNA, 22 bp, Homo sapiens
tcttaaatgactgataagagga

SEQ ID NO: 8037732 - DNA, 22 bp, Homo sapiens
tcttaaatgactgataagagga

SEQ ID NO: 8037733 - DNA, 22 bp, Homo sapiens
tcttaagaaagtgacaaatagg

SEQ ID NO: 8037734 - DNA, 22 bp, Homo sapiens
tcttaagcagagaagaagttga

SEQ ID NO: 8037735 - DNA, 22 bp, Homo sapiens
tcttaagcagagaagaagttga

SEQ ID NO: 8037736 - DNA, 22 bp, Homo sapiens
tcttaagcagagaagaagttga

SEQ ID NO: 8037737 - DNA, 22 bp, Homo sapiens
tcttaagtacctcctttatcac

SEQ ID NO: 8037738 - DNA, 22 bp, Homo sapiens
tcttaagccactgagaaaataa

SEQ ID NO: 8037739 - DNA, 22 bp, Homo sapiens
tcttaatgaaagtgaaatatca

SEQ ID NO: 8037740 - DNA, 22 bp, Homo sapiens
tcttaatgaaagtgaaatatca

SEQ ID NO: 8037741 - DNA, 22 bp, Homo sapiens
tcttagatggcagctagagctc

SEQ ID NO: 8037742 - DNA, 22 bp, Homo sapiens
tcttaagtgcccagaaaccaaa

SEQ ID NO: 8037743 - DNA, 22 bp, Homo sapiens
tcttagaattgaagtcagaggg

SEQ ID NO: 8037744 - DNA, 22 bp, Homo sapiens
tcttagaattgaagtcagaggg

SEQ ID NO: 8037745 - DNA, 22 bp, Homo sapiens
tcttagatgttagctctgtgtg

SEQ ID NO: 8037746 - DNA, 22 bp, Homo sapiens
tcttagcaaatactacttagaa

SEQ ID NO: 8037747 - DNA, 22 bp, Homo sapiens
tcttagcaaattttctttgcct

SEQ ID NO: 8037748 - DNA, 22 bp, Homo sapiens
tcttagcacagctatataagtt

SEQ ID NO: 8037749 - DNA, 22 bp, Homo sapiens
tcttaggagtagaattctcaca

SEQ ID NO: 8037750 - DNA, 22 bp, Homo sapiens
tcttagtcacagaggtgagaaa

SEQ ID NO: 8037751 - DNA, 22 bp, Homo sapiens
tcttataagcaaactgctgaga

SEQ ID NO: 8037752 - DNA, 22 bp, Homo sapiens
tcttataaaaggactcccattt

SEQ ID NO: 8037753 - DNA, 22 bp, Homo sapiens
tcttagttagctcccttcttct

SEQ ID NO: 8037754 - DNA, 22 bp, Homo sapiens
tcttataatctctattttaatg

SEQ ID NO: 8037755 - DNA, 22 bp, Homo sapiens
tcttataatctctattttaatg

SEQ ID NO: 8037756 - DNA, 22 bp, Homo sapiens
tcttataatctctattttaatg

SEQ ID NO: 8037757 - DNA, 20 bp, Homo sapiens
tcttatacagaaaacatttt

SEQ ID NO: 8037758 - DNA, 22 bp, Homo sapiens
tcttataatgttgaagggttgg

SEQ ID NO: 8037759 - DNA, 22 bp, Homo sapiens
tcttatacagaagatgtttaat

SEQ ID NO: 8037760 - DNA, 22 bp, Homo sapiens
tcttatacccctaaactgcagc

SEQ ID NO: 8037761 - DNA, 22 bp, Homo sapiens
tcttatgataatatcactacca

SEQ ID NO: 8037762 - DNA, 22 bp, Homo sapiens
tcttatgaaaagcacttagaac

SEQ ID NO: 8037763 - DNA, 22 bp, Homo sapiens
tcttatgaaaagcacttagaac

SEQ ID NO: 8037764 - DNA, 22 bp, Homo sapiens
tcttatagacagtggcagcagg

SEQ ID NO: 8037765 - DNA, 22 bp, Homo sapiens
tctgtgctcaagttctgcctct

SEQ ID NO: 8037766 - DNA, 22 bp, Homo sapiens
tctgtgctagcacgcagcaagg

SEQ ID NO: 8037767 - DNA, 22 bp, Homo sapiens
tctgtgctcattcagtcattca

SEQ ID NO: 8037768 - DNA, 22 bp, Homo sapiens
tctgtgctcattcagtcattca

SEQ ID NO: 8037769 - DNA, 22 bp, Homo sapiens
tctgtgctaggcagcctggccc

SEQ ID NO: 8037770 - DNA, 22 bp, Homo sapiens
tctgtgctagcacgcagcaagg

SEQ ID NO: 8037771 - DNA, 22 bp, Homo sapiens
tctgtgctagaggagttggcca

SEQ ID NO: 8037772 - DNA, 22 bp, Homo sapiens
tctgtgctagaggagttggcca

SEQ ID NO: 8037773 - DNA, 20 bp, Homo sapiens
tctgtgctacactccagatt

SEQ ID NO: 8037774 - DNA, 22 bp, Homo sapiens
tctgtgctaatttatccttcct

SEQ ID NO: 8037775 - DNA, 20 bp, Homo sapiens
tctgtgctacactccagatt

SEQ ID NO: 8037776 - DNA, 23 bp, Homo sapiens
tctgtgctacaaatcgcgtctgt

SEQ ID NO: 8037777 - DNA, 19 bp, Homo sapiens
tctgtgctgggaggcagca

SEQ ID NO: 8037778 - DNA, 19 bp, Homo sapiens
tctgtgctgggaggcagca

SEQ ID NO: 8037779 - DNA, 21 bp, Homo sapiens
tctgtgctgccgtcaacatcc

SEQ ID NO: 8037780 - DNA, 21 bp, Homo sapiens
tctgtgctgccgtcaacatcc

SEQ ID NO: 8037781 - DNA, 22 bp, Homo sapiens
tctgtgctggactgatttcata

SEQ ID NO: 8037782 - DNA, 22 bp, Homo sapiens
tctgtgctgagctctgagatgt

SEQ ID NO: 8037783 - DNA, 22 bp, Homo sapiens
tctgtgctcattcagtcattca

SEQ ID NO: 8037784 - DNA, 22 bp, Homo sapiens
tctgtgctcttctcagtatcac

SEQ ID NO: 8037785 - DNA, 22 bp, Homo sapiens
tctgtgctgcaggagtctgcat

SEQ ID NO: 8037786 - DNA, 22 bp, Homo sapiens
tctgtgctgcccaacttctcaa

SEQ ID NO: 8037787 - DNA, 22 bp, Homo sapiens
tctgtgctgtctcagagaaagc

SEQ ID NO: 8037788 - DNA, 22 bp, Homo sapiens
tctgtgcttaactactcacccc

SEQ ID NO: 8037789 - DNA, 22 bp, Homo sapiens
tctgtgctgtctcagagaaagc

SEQ ID NO: 8037790 - DNA, 22 bp, Homo sapiens
tctgtggaagattccaggcgtt

SEQ ID NO: 8037791 - DNA, 22 bp, Homo sapiens
tctgtgctttccctgccttctt

SEQ ID NO: 8037792 - DNA, 21 bp, Homo sapiens
tctgtgcttttttggctccta

SEQ ID NO: 8037793 - DNA, 18 bp, Homo sapiens
tctgtggagagggcagtt

SEQ ID NO: 8037794 - DNA, 18 bp, Homo sapiens
tctgtggagagggcagtt

SEQ ID NO: 8037795 - DNA, 22 bp, Homo sapiens
tctgtggactcaagggatcaca

SEQ ID NO: 8037796 - DNA, 22 bp, Homo sapiens
tctgtggaccagggtataagga

SEQ ID NO: 8037797 - DNA, 22 bp, Homo sapiens
tctgtggactcaagggatcaca

SEQ ID NO: 8037798 - DNA, 22 bp, Homo sapiens
tctgtggagttagactggtatc

SEQ ID NO: 8037799 - DNA, 19 bp, Homo sapiens
tctgtggagctcagagtag

SEQ ID NO: 8037800 - DNA, 19 bp, Homo sapiens
tctgtggagctcagagtag

SEQ ID NO: 8037801 - DNA, 23 bp, Homo sapiens
tctgtggctccttcaggctgctg

SEQ ID NO: 8037802 - DNA, 23 bp, Homo sapiens
tctgtggctccttcaggctgctg

SEQ ID NO: 8037803 - DNA, 22 bp, Homo sapiens
tctgtggctggagaacttgtct

SEQ ID NO: 8037804 - DNA, 19 bp, Homo sapiens
tctgtggctgtggggagga

SEQ ID NO: 8037805 - DNA, 19 bp, Homo sapiens
tctgtggctgtggggagga

SEQ ID NO: 8037806 - DNA, 22 bp, Homo sapiens
tctgtggctgtctttccagagg

SEQ ID NO: 8037807 - DNA, 22 bp, Homo sapiens
tctgtgtctgttacttcactgc

SEQ ID NO: 8037808 - DNA, 22 bp, Homo sapiens
tctgtgtctgttacttcactgc

SEQ ID NO: 8037809 - DNA, 22 bp, Homo sapiens
tctgtgtctgttacttcactgc

SEQ ID NO: 8037810 - DNA, 22 bp, Homo sapiens
tctgtgtctggttgggccagta

SEQ ID NO: 8037811 - DNA, 22 bp, Homo sapiens
tctgtgtctggttgggccagta

SEQ ID NO: 8037812 - DNA, 22 bp, Homo sapiens
tctgtgtctggttgggccagta

SEQ ID NO: 8037813 - DNA, 22 bp, Homo sapiens
tctgtgtctgggcctccgcctg

SEQ ID NO: 8037814 - DNA, 22 bp, Homo sapiens
tctgtgtctgcagaagttcagc

SEQ ID NO: 8037815 - DNA, 22 bp, Homo sapiens
tctgtgtctgcagaagttcagc

SEQ ID NO: 8037816 - DNA, 22 bp, Homo sapiens
tctgtgtctgcagaagttcagc

SEQ ID NO: 8037817 - DNA, 22 bp, Homo sapiens
tctgtgtctgcagaagttcagc

SEQ ID NO: 8037818 - DNA, 23 bp, Homo sapiens
tctgtgtctccacccaaatctca

SEQ ID NO: 8037819 - DNA, 23 bp, Homo sapiens
tctgtgtctccacccaaatctca

SEQ ID NO: 8037820 - DNA, 23 bp, Homo sapiens
tctgtgtctccacccaaatctca

SEQ ID NO: 8037821 - DNA, 22 bp, Homo sapiens
tctgtgtcgttctgtgctctgg

SEQ ID NO: 8037822 - DNA, 22 bp, Homo sapiens
tctgtgtcgttctgtgctctgg

SEQ ID NO: 8037823 - DNA, 22 bp, Homo sapiens
tctgtgtctcaatcccatgctg

SEQ ID NO: 8037824 - DNA, 22 bp, Homo sapiens
tctgtgtctcaatcccatgctg

SEQ ID NO: 8037825 - DNA, 22 bp, Homo sapiens
tctgtgtatttgtgacctgtat

SEQ ID NO: 8037826 - DNA, 22 bp, Homo sapiens
tctgtgtcactgaggcctgtgt

SEQ ID NO: 8037827 - DNA, 22 bp, Homo sapiens
tctgtgtcagcagcactcagcc

SEQ ID NO: 8037828 - DNA, 22 bp, Homo sapiens
tctgtgtcagaagatatcatgg

SEQ ID NO: 8037829 - DNA, 22 bp, Homo sapiens
tctgtgtcactgaggcctgtgt

SEQ ID NO: 8037830 - DNA, 22 bp, Homo sapiens
tctgtgtcagaagatatcatgg

SEQ ID NO: 8037831 - DNA, 22 bp, Homo sapiens
tctgtgtcctgctagctgtctt

SEQ ID NO: 8037832 - DNA, 22 bp, Homo sapiens
tctgtgtcctgctagctgtctt

SEQ ID NO: 8037833 - DNA, 22 bp, Homo sapiens
tctgtgtcctgctagctgtctt

SEQ ID NO: 8037834 - DNA, 22 bp, Homo sapiens
tctgtgtcctgctagctgtctt

SEQ ID NO: 8037835 - DNA, 23 bp, Homo sapiens
tctgtgtcctcctggaccacaga

SEQ ID NO: 8037836 - DNA, 23 bp, Homo sapiens
tctgtgtcctcctggaccacaga

SEQ ID NO: 8037837 - DNA, 22 bp, Homo sapiens
tctgtgtcccttctaatttcag

SEQ ID NO: 8037838 - DNA, 22 bp, Homo sapiens
tctgtgtcccttctaatttcag

SEQ ID NO: 8037839 - DNA, 21 bp, Homo sapiens
tctgtggtatggccatcttcc

SEQ ID NO: 8037840 - DNA, 22 bp, Homo sapiens
tctgtggtggagtgggcatgag

SEQ ID NO: 8037841 - DNA, 22 bp, Homo sapiens
tctgtgtacgcaggcgtgcgcg

SEQ ID NO: 8037842 - DNA, 22 bp, Homo sapiens
tctgtgggtttcagggggctgt

SEQ ID NO: 8037843 - DNA, 22 bp, Homo sapiens
tctgtgggttttgcagagttgc

SEQ ID NO: 8037844 - DNA, 22 bp, Homo sapiens
tctgtgggtgcctccagcagtg

SEQ ID NO: 8037845 - DNA, 22 bp, Homo sapiens
tctgtgggtagagtgagtactt

SEQ ID NO: 8037846 - DNA, 22 bp, Homo sapiens
tctgtgggtgcctccagcagtg

SEQ ID NO: 8037847 - DNA, 22 bp, Homo sapiens
tctgtgggtagagtgagtactt

SEQ ID NO: 8037848 - DNA, 22 bp, Homo sapiens
tctgtggggagcaggagccggg

SEQ ID NO: 8037849 - DNA, 22 bp, Homo sapiens
tctgtggggagcaggagccggg

SEQ ID NO: 8037850 - DNA, 22 bp, Homo sapiens
tctgtgggggtgtcttaaccta

SEQ ID NO: 8037851 - DNA, 18 bp, Homo sapiens
tctgtgggatcagtgagg

SEQ ID NO: 8037852 - DNA, 22 bp, Homo sapiens
tctgtgggcatttataatctgg

SEQ ID NO: 8037853 - DNA, 22 bp, Homo sapiens
tctgtggcttgggcctgcctgt

SEQ ID NO: 8037854 - DNA, 22 bp, Homo sapiens
tctgtggcttgggcctgcctgt

SEQ ID NO: 8037855 - DNA, 22 bp, Homo sapiens
tctgtggcttgggcctgcctgt

SEQ ID NO: 8037856 - DNA, 22 bp, Homo sapiens
tctgtggcttgggcctgcctgt

SEQ ID NO: 8037857 - DNA, 22 bp, Homo sapiens
tctgtctttgtcaggaccagag

SEQ ID NO: 8037858 - DNA, 22 bp, Homo sapiens
tctgtctttgtcaggaccagag

SEQ ID NO: 8037859 - DNA, 22 bp, Homo sapiens
tctgtctttgtcaggaccagag

SEQ ID NO: 8037860 - DNA, 22 bp, Homo sapiens
tctgtctttgagatctcagcct

SEQ ID NO: 8037861 - DNA, 22 bp, Homo sapiens
tctgtctttgagatctcagcct

SEQ ID NO: 8037862 - DNA, 22 bp, Homo sapiens
tctgtctttgagatctcagcct

SEQ ID NO: 8037863 - DNA, 22 bp, Homo sapiens
tctgtctttgagatctcagcct

SEQ ID NO: 8037864 - DNA, 22 bp, Homo sapiens
tctgtctgcgcttgccctggtg

SEQ ID NO: 8037865 - DNA, 22 bp, Homo sapiens
tctgtctgctcatttacctcag

SEQ ID NO: 8037866 - DNA, 22 bp, Homo sapiens
tctgtctgcttcacttgcattt

SEQ ID NO: 8037867 - DNA, 22 bp, Homo sapiens
tctgtctgcttcacttgcattt

SEQ ID NO: 8037868 - DNA, 22 bp, Homo sapiens
tctgtctgcttcacttgcattt

SEQ ID NO: 8037869 - DNA, 22 bp, Homo sapiens
tctgtctttagaggcctgtgct

SEQ ID NO: 8037870 - DNA, 22 bp, Homo sapiens
tctgtctttgagatctcagcct

SEQ ID NO: 8037871 - DNA, 22 bp, Homo sapiens
tctgtctttagaggcctgtgct

SEQ ID NO: 8037872 - DNA, 22 bp, Homo sapiens
tctgtctgcacctaagcacagt

SEQ ID NO: 8037873 - DNA, 22 bp, Homo sapiens
tctgtctgagtggtgttagagt

SEQ ID NO: 8037874 - DNA, 22 bp, Homo sapiens
tctgtctgcacctaagcacagt

SEQ ID NO: 8037875 - DNA, 22 bp, Homo sapiens
tctgtctgaggagtttttgacc

SEQ ID NO: 8037876 - DNA, 22 bp, Homo sapiens
tctgtctgagggagtgacattt

SEQ ID NO: 8037877 - DNA, 22 bp, Homo sapiens
tctgtctgagggagtgacattt

SEQ ID NO: 8037878 - DNA, 22 bp, Homo sapiens
tctgtctgagggagtgacattt

SEQ ID NO: 8037879 - DNA, 22 bp, Homo sapiens
tctgtctgccttgtgagggcac

SEQ ID NO: 8037880 - DNA, 22 bp, Homo sapiens
tctgtctgccttgtgagggcac

SEQ ID NO: 8037881 - DNA, 22 bp, Homo sapiens
tctgtctgccttgtgagggcac

SEQ ID NO: 8037882 - DNA, 22 bp, Homo sapiens
tctgtctgccccagcaagtcac

SEQ ID NO: 8037883 - DNA, 22 bp, Homo sapiens
tctgtctgccccagcaagtcac

SEQ ID NO: 8037884 - DNA, 22 bp, Homo sapiens
tctgtgatagtttttcagctat

SEQ ID NO: 8037885 - DNA, 22 bp, Homo sapiens
tctgtgatagtttttcagctat

SEQ ID NO: 8037886 - DNA, 22 bp, Homo sapiens
tctgtgcaagtatttgacattt

SEQ ID NO: 8037887 - DNA, 22 bp, Homo sapiens
tctgtgcaatagtttgttttac

SEQ ID NO: 8037888 - DNA, 22 bp, Homo sapiens
tctgtgcaagaccaactttcaa

SEQ ID NO: 8037889 - DNA, 20 bp, Homo sapiens
tctgtgcacctgctacaagg

SEQ ID NO: 8037890 - DNA, 22 bp, Homo sapiens
tctgtgcaccttctaatgagta

SEQ ID NO: 8037891 - DNA, 22 bp, Homo sapiens
tctgtgcaccagaatgatattt

SEQ ID NO: 8037892 - DNA, 22 bp, Homo sapiens
tctgtgcacaataggcattttt

SEQ ID NO: 8037893 - DNA, 22 bp, Homo sapiens
tctgtgcaccagaatgatattt

SEQ ID NO: 8037894 - DNA, 22 bp, Homo sapiens
tctgtgaatgatgtttctttct

SEQ ID NO: 8037895 - DNA, 22 bp, Homo sapiens
tctgtgaagctctgaacagcag

SEQ ID NO: 8037896 - DNA, 22 bp, Homo sapiens
tctgtgaagctctgaacagcag

SEQ ID NO: 8037897 - DNA, 22 bp, Homo sapiens
tctgtgaaatcacccaggttta

SEQ ID NO: 8037898 - DNA, 22 bp, Homo sapiens
tctgtgaaaggaaagaactgac

SEQ ID NO: 8037899 - DNA, 22 bp, Homo sapiens
tctgtgaaaggaaagaactgac

SEQ ID NO: 8037900 - DNA, 22 bp, Homo sapiens
tctgtgataggaaaataaatgg

SEQ ID NO: 8037901 - DNA, 22 bp, Homo sapiens
tctgtgagtactttaacgagag

SEQ ID NO: 8037902 - DNA, 22 bp, Homo sapiens
tctgtgagaaccagtgccaggg

SEQ ID NO: 8037903 - DNA, 22 bp, Homo sapiens
tctgtgacttgcgggaggagaa

SEQ ID NO: 8037904 - DNA, 22 bp, Homo sapiens
tctgtgacttacaagaagggac

SEQ ID NO: 8037905 - DNA, 22 bp, Homo sapiens
tctgtgaatgatgtttctttct

SEQ ID NO: 8037906 - DNA, 22 bp, Homo sapiens
tctgtgccttctcccagactta

SEQ ID NO: 8037907 - DNA, 22 bp, Homo sapiens
tctgtgcctgcttccccaccca

SEQ ID NO: 8037908 - DNA, 22 bp, Homo sapiens
tctgtgcctccgtaacacacca

SEQ ID NO: 8037909 - DNA, 21 bp, Homo sapiens
tctgtgcctcaaccctcatct

SEQ ID NO: 8037910 - DNA, 22 bp, Homo sapiens
tctgtgcctcatctggttcagg

SEQ ID NO: 8037911 - DNA, 22 bp, Homo sapiens
tctgtgcctcatctggttcagg

SEQ ID NO: 8037912 - DNA, 22 bp, Homo sapiens
tctgtgctaatgcttcacaata

SEQ ID NO: 8037913 - DNA, 22 bp, Homo sapiens
tctgtgctaatgcttcacaata

SEQ ID NO: 8037914 - DNA, 22 bp, Homo sapiens
tctgtgctaatgcttcacaata

SEQ ID NO: 8037915 - DNA, 23 bp, Homo sapiens
tctgtgctacaaatcgcgtctgt

SEQ ID NO: 8037916 - DNA, 22 bp, Homo sapiens
tctgtgctaatttatccttcct

SEQ ID NO: 8037917 - DNA, 22 bp, Homo sapiens
tctgtgcctttaagaagctcat

SEQ ID NO: 8037918 - DNA, 22 bp, Homo sapiens
tctgtgcctttaagaagctcat

SEQ ID NO: 8037919 - DNA, 22 bp, Homo sapiens
tctgtgcctttaagaagctcat

SEQ ID NO: 8037920 - DNA, 22 bp, Homo sapiens
tctgtgcggtctgtgttatgaa

SEQ ID NO: 8037921 - DNA, 23 bp, Homo sapiens
tctgtgccagtttccatgtctgt

SEQ ID NO: 8037922 - DNA, 23 bp, Homo sapiens
tctgtgccagtttccatgtctgt

SEQ ID NO: 8037923 - DNA, 23 bp, Homo sapiens
tctgtgccagtttccatgtctgt

SEQ ID NO: 8037924 - DNA, 23 bp, Homo sapiens
tctgtgccagtttccatgtctgt

SEQ ID NO: 8037925 - DNA, 22 bp, Homo sapiens
tctgtgccacctctccagtgtc

SEQ ID NO: 8037926 - DNA, 22 bp, Homo sapiens
tctgtgccaagcttatatctgt

SEQ ID NO: 8037927 - DNA, 22 bp, Homo sapiens
tctgtgccagcagcctcctgga

SEQ ID NO: 8037928 - DNA, 22 bp, Homo sapiens
tctgtgccctcggtgctgggcc

SEQ ID NO: 8037929 - DNA, 22 bp, Homo sapiens
tctgtgccctcggtgctgggcc

SEQ ID NO: 8037930 - DNA, 22 bp, Homo sapiens
tctgtgccgcgccggagaccct

SEQ ID NO: 8037931 - DNA, 22 bp, Homo sapiens
tctgtgccctcggtgctgggcc

SEQ ID NO: 8037932 - DNA, 22 bp, Homo sapiens
tctgtgccatcagtctccagag

SEQ ID NO: 8037933 - DNA, 22 bp, Homo sapiens
tctgtgccatgcccgtctacca

SEQ ID NO: 8037934 - DNA, 22 bp, Homo sapiens
tctgtgcactaacattcctggt

SEQ ID NO: 8037935 - DNA, 22 bp, Homo sapiens
tctgtgcactaacattcctggt

SEQ ID NO: 8037936 - DNA, 22 bp, Homo sapiens
tctgtgcactgtgtcattaggt

SEQ ID NO: 8037937 - DNA, 22 bp, Homo sapiens
tctgtgcagaatcaaggagctt

SEQ ID NO: 8037938 - DNA, 22 bp, Homo sapiens
tctgtgcagaactcacagaagg

SEQ ID NO: 8037939 - DNA, 22 bp, Homo sapiens
tctgtgcagaactcacagaagg

SEQ ID NO: 8037940 - DNA, 22 bp, Homo sapiens
tctgtgcagacatggggaagcc

SEQ ID NO: 8037941 - DNA, 22 bp, Homo sapiens
tctgtgcagatgtagaccagtt

SEQ ID NO: 8037942 - DNA, 20 bp, Homo sapiens
tctgtgcacctgctacaagg

SEQ ID NO: 8037943 - DNA, 15 bp, Homo sapiens
tctgtgcagcaaggg

SEQ ID NO: 8037944 - DNA, 22 bp, Homo sapiens
tctgtgcaggatttgaggaacc

SEQ ID NO: 8037945 - DNA, 22 bp, Homo sapiens
tctgtgcaggaagtcattatga

SEQ ID NO: 8037946 - DNA, 22 bp, Homo sapiens
tctgtgcagtcagggctcagtc

SEQ ID NO: 8037947 - DNA, 22 bp, Homo sapiens
tctgtgcagtcagggctcagtc

SEQ ID NO: 8037948 - DNA, 22 bp, Homo sapiens
tctgtgcagggaccccaagagt

SEQ ID NO: 8037949 - DNA, 22 bp, Homo sapiens
tctgtgcaggatttgaggaacc

SEQ ID NO: 8037950 - DNA, 22 bp, Homo sapiens
tctgtgcagttcttgtcttgac

SEQ ID NO: 8037951 - DNA, 22 bp, Homo sapiens
tctgtgcagttcttgtcttgac

SEQ ID NO: 8037952 - DNA, 20 bp, Homo sapiens
tctgtgcagtggaggggcag

SEQ ID NO: 8037953 - DNA, 20 bp, Homo sapiens
tctgtgcattgcctgctggt

SEQ ID NO: 8037954 - DNA, 22 bp, Homo sapiens
tctgtgcattgtaacaactaaa

SEQ ID NO: 8037955 - DNA, 22 bp, Homo sapiens
tctgtgcattgtaacaactaaa

SEQ ID NO: 8037956 - DNA, 22 bp, Homo sapiens
tctgtgcatttcaggacctgaa

SEQ ID NO: 8037957 - DNA, 20 bp, Homo sapiens
tctgtgcagtttaggaaggc

SEQ ID NO: 8037958 - DNA, 20 bp, Homo sapiens
tctgtgcattgcctgctggt

SEQ ID NO: 8037959 - DNA, 22 bp, Homo sapiens
tctgtgcatccttaacgcctgc

SEQ ID NO: 8037960 - DNA, 22 bp, Homo sapiens
tctgtcaacatgtcaaagggct

SEQ ID NO: 8037961 - DNA, 22 bp, Homo sapiens
tctgtcaaaagttttcaataaa

SEQ ID NO: 8037962 - DNA, 22 bp, Homo sapiens
tctgtcaaatgagcaagtaact

SEQ ID NO: 8037963 - DNA, 22 bp, Homo sapiens
tctgtcaatatatgtgctgcag

SEQ ID NO: 8037964 - DNA, 22 bp, Homo sapiens
tctgtcacccaggctggagtgc

SEQ ID NO: 8037965 - DNA, 22 bp, Homo sapiens
tctgtcacccagagtgcagtgg

SEQ ID NO: 8037966 - DNA, 22 bp, Homo sapiens
tctgtattctatggcagttggt

SEQ ID NO: 8037967 - DNA, 22 bp, Homo sapiens
tctgtattgagaaagccggaca

SEQ ID NO: 8037968 - DNA, 22 bp, Homo sapiens
tctgtattgagaaagccggaca

SEQ ID NO: 8037969 - DNA, 22 bp, Homo sapiens
tctgtattgagaaagccggaca

SEQ ID NO: 8037970 - DNA, 22 bp, Homo sapiens
tctgtatatattaatgaaattc

SEQ ID NO: 8037971 - DNA, 22 bp, Homo sapiens
tctgtagtctctgatatatctg

SEQ ID NO: 8037972 - DNA, 22 bp, Homo sapiens
tctgtagtctgtgccatagctg

SEQ ID NO: 8037973 - DNA, 22 bp, Homo sapiens
tctgtataaggacaaacattta

SEQ ID NO: 8037974 - DNA, 22 bp, Homo sapiens
tctgtagtctgtgccatagctg

SEQ ID NO: 8037975 - DNA, 20 bp, Homo sapiens
tctgtagtctgtggcaagac

SEQ ID NO: 8037976 - DNA, 22 bp, Homo sapiens
tctgtacatttgtgttgtgaat

SEQ ID NO: 8037977 - DNA, 22 bp, Homo sapiens
tctgtacatgagttgagaatca

SEQ ID NO: 8037978 - DNA, 22 bp, Homo sapiens
tctgtacttttattttggcact

SEQ ID NO: 8037979 - DNA, 23 bp, Homo sapiens
tctgtacttagactggggcagaa

SEQ ID NO: 8037980 - DNA, 22 bp, Homo sapiens
tctgtacttgttagtcttcatg

SEQ ID NO: 8037981 - DNA, 22 bp, Homo sapiens
tctgtactttacatgcagtgct

SEQ ID NO: 8037982 - DNA, 22 bp, Homo sapiens
tctgtaggacagagaaatgggg

SEQ ID NO: 8037983 - DNA, 22 bp, Homo sapiens
tctgtagagacgaatgtgttat

SEQ ID NO: 8037984 - DNA, 22 bp, Homo sapiens
tctgtaggacagagaaatgggg

SEQ ID NO: 8037985 - DNA, 22 bp, Homo sapiens
tctgtaggacagagaaatgggg

SEQ ID NO: 8037986 - DNA, 20 bp, Homo sapiens
tctgtaggcaagttagcagg

SEQ ID NO: 8037987 - DNA, 22 bp, Homo sapiens
tctgtaggttaaaagtagacaa

SEQ ID NO: 8037988 - DNA, 22 bp, Homo sapiens
tctgtagggtagtagtggagat

SEQ ID NO: 8037989 - DNA, 22 bp, Homo sapiens
tctgtagtaggttgtagttctt

SEQ ID NO: 8037990 - DNA, 22 bp, Homo sapiens
tctgtagtaggttgtagttctt

SEQ ID NO: 8037991 - DNA, 22 bp, Homo sapiens
tctgtagtaggttgtagttctt

SEQ ID NO: 8037992 - DNA, 22 bp, Homo sapiens
tctgtagtaggttgtagttctt

SEQ ID NO: 8037993 - DNA, 21 bp, Homo sapiens
tctgtacatcattgagtcccc

SEQ ID NO: 8037994 - DNA, 22 bp, Homo sapiens
tctgtacagtaccagatagtaa

SEQ ID NO: 8037995 - DNA, 22 bp, Homo sapiens
tctgtacatgagttgagaatca

SEQ ID NO: 8037996 - DNA, 22 bp, Homo sapiens
tctgtacagtaccagatagtaa

SEQ ID NO: 8037997 - DNA, 22 bp, Homo sapiens
tctgtacagtaccagatagtaa

SEQ ID NO: 8037998 - DNA, 22 bp, Homo sapiens
tctgtacacttcagcatgcatc

SEQ ID NO: 8037999 - DNA, 22 bp, Homo sapiens
tctgtacagtaccagatagtaa

SEQ ID NO: 8038000 - DNA, 20 bp, Homo sapiens
tctgtacactcatcttctgc

SEQ ID NO: 8038001 - DNA, 22 bp, Homo sapiens
tctgtacagtaccagatagtaa

SEQ ID NO: 8038002 - DNA, 22 bp, Homo sapiens
tctgtacagtaccagatagtaa

SEQ ID NO: 8038003 - DNA, 23 bp, Homo sapiens
tctgtacaattgagaagagaaca

SEQ ID NO: 8038004 - DNA, 23 bp, Homo sapiens
tctgtacaattgagaagagaaca

SEQ ID NO: 8038005 - DNA, 23 bp, Homo sapiens
tctgtacacatcagcatctccca

SEQ ID NO: 8038006 - DNA, 22 bp, Homo sapiens
tctgtaaagactccaaaagcca

SEQ ID NO: 8038007 - DNA, 22 bp, Homo sapiens
tctgtaaagtctgtgtaaagtc

SEQ ID NO: 8038008 - DNA, 22 bp, Homo sapiens
tctgtaaagccctggtacctgg

SEQ ID NO: 8038009 - DNA, 22 bp, Homo sapiens
tctgtaagggaaggtgatttgc

SEQ ID NO: 8038010 - DNA, 22 bp, Homo sapiens
tctgtaaatcctgctcagcaac

SEQ ID NO: 8038011 - DNA, 22 bp, Homo sapiens
tctgtaatcagagtagcagata

SEQ ID NO: 8038012 - DNA, 22 bp, Homo sapiens
tctgtaatcaagatatttgaga

SEQ ID NO: 8038013 - DNA, 18 bp, Homo sapiens
tctgtaatttttccttga

SEQ ID NO: 8038014 - DNA, 22 bp, Homo sapiens
tctgtcatctctaaaatagaaa

SEQ ID NO: 8038015 - DNA, 22 bp, Homo sapiens
tctgtcatctctaaaatagaaa

SEQ ID NO: 8038016 - DNA, 22 bp, Homo sapiens
tctgtcatctctaaaatagaaa

SEQ ID NO: 8038017 - DNA, 22 bp, Homo sapiens
tctgtcatctgtaacaggaggg

SEQ ID NO: 8038018 - DNA, 22 bp, Homo sapiens
tctgtcattttgtatctacatg

SEQ ID NO: 8038019 - DNA, 21 bp, Homo sapiens
tctgtcattctatttcatata

SEQ ID NO: 8038020 - DNA, 23 bp, Homo sapiens
tctgtccaccgcatgcagcggcc

SEQ ID NO: 8038021 - DNA, 20 bp, Homo sapiens
tctgtccaccagcctcgcct

SEQ ID NO: 8038022 - DNA, 22 bp, Homo sapiens
tctgtccacaagcacaggctct

SEQ ID NO: 8038023 - DNA, 22 bp, Homo sapiens
tctgtccagaggtcctggagac

SEQ ID NO: 8038024 - DNA, 22 bp, Homo sapiens
tctgtccagaggtcctggagac

SEQ ID NO: 8038025 - DNA, 22 bp, Homo sapiens
tctgtccagctctcaggagaca

SEQ ID NO: 8038026 - DNA, 22 bp, Homo sapiens
tctgtccagaacgtacatcttg

SEQ ID NO: 8038027 - DNA, 22 bp, Homo sapiens
tctgtccagaacgtacatcttg

SEQ ID NO: 8038028 - DNA, 22 bp, Homo sapiens
tctgtccagaacgtacatcttg

SEQ ID NO: 8038029 - DNA, 22 bp, Homo sapiens
tctgtcctccggagctcccagt

SEQ ID NO: 8038030 - DNA, 22 bp, Homo sapiens
tctgtcctctccctgaccacaa

SEQ ID NO: 8038031 - DNA, 22 bp, Homo sapiens
tctgtcctccggagctcccagt

SEQ ID NO: 8038032 - DNA, 22 bp, Homo sapiens
tctgtcctccggagctcccagt

SEQ ID NO: 8038033 - DNA, 22 bp, Homo sapiens
tctgtcctccggagctcccagt

SEQ ID NO: 8038034 - DNA, 22 bp, Homo sapiens
tctgtcctccggagctcccagt

SEQ ID NO: 8038035 - DNA, 22 bp, Homo sapiens
tctgtcctccggagctcccagt

SEQ ID NO: 8038036 - DNA, 22 bp, Homo sapiens
tctgtcctccggagctcccagt

SEQ ID NO: 8038037 - DNA, 22 bp, Homo sapiens
tctgtcctccggagctcccagt

SEQ ID NO: 8038038 - DNA, 22 bp, Homo sapiens
tctgtcctccacactgtaagtt

SEQ ID NO: 8038039 - DNA, 22 bp, Homo sapiens
tctgtccggcaggcaggcaagt

SEQ ID NO: 8038040 - DNA, 22 bp, Homo sapiens
tctgtccctgagagctcaggag

SEQ ID NO: 8038041 - DNA, 22 bp, Homo sapiens
tctgtccaggcttactatatat

SEQ ID NO: 8038042 - DNA, 17 bp, Homo sapiens
tctgtccagggagtgtg

SEQ ID NO: 8038043 - DNA, 17 bp, Homo sapiens
tctgtccagggagtgtg

SEQ ID NO: 8038044 - DNA, 22 bp, Homo sapiens
tctgtccagtggctctcaggga

SEQ ID NO: 8038045 - DNA, 22 bp, Homo sapiens
tctgtccagtggctctcaggga

SEQ ID NO: 8038046 - DNA, 22 bp, Homo sapiens
tctgtccatgcctggaggagag

SEQ ID NO: 8038047 - DNA, 22 bp, Homo sapiens
tctgtccatctcttgggagtga

SEQ ID NO: 8038048 - DNA, 22 bp, Homo sapiens
tctgtccattcagccatccatc

SEQ ID NO: 8038049 - DNA, 22 bp, Homo sapiens
tctgtccatgtgaggttctctg

SEQ ID NO: 8038050 - DNA, 23 bp, Homo sapiens
tctgtctgaataatttactcttt

SEQ ID NO: 8038051 - DNA, 22 bp, Homo sapiens
tctgtctgacagggtatgaact

SEQ ID NO: 8038052 - DNA, 22 bp, Homo sapiens
tctgtctgactaccatgaggca

SEQ ID NO: 8038053 - DNA, 22 bp, Homo sapiens
tctgtctgactaccatgaggca

SEQ ID NO: 8038054 - DNA, 18 bp, Homo sapiens
tctgtctctgtccttgct

SEQ ID NO: 8038055 - DNA, 20 bp, Homo sapiens
tctgtctctgagctagactt

SEQ ID NO: 8038056 - DNA, 21 bp, Homo sapiens
tctgtctctccactgccctgc

SEQ ID NO: 8038057 - DNA, 21 bp, Homo sapiens
tctgtctctccactgccctgc

SEQ ID NO: 8038058 - DNA, 22 bp, Homo sapiens
tctgtctctcaagggccgtcct

SEQ ID NO: 8038059 - DNA, 22 bp, Homo sapiens
tctgtctctcaagggccgtcct

SEQ ID NO: 8038060 - DNA, 21 bp, Homo sapiens
tctgtctctccactgccctgc

SEQ ID NO: 8038061 - DNA, 21 bp, Homo sapiens
tctgtctctccactgccctgc

SEQ ID NO: 8038062 - DNA, 22 bp, Homo sapiens
tctgtctcctgccagtgcctct

SEQ ID NO: 8038063 - DNA, 22 bp, Homo sapiens
tctgtctcctgccagtgcctct

SEQ ID NO: 8038064 - DNA, 22 bp, Homo sapiens
tctgtctcctctgaggtgccag

SEQ ID NO: 8038065 - DNA, 22 bp, Homo sapiens
tctgtctcaagttcttgcactc

SEQ ID NO: 8038066 - DNA, 22 bp, Homo sapiens
tctgtctcaagttcttgcactc

SEQ ID NO: 8038067 - DNA, 22 bp, Homo sapiens
tctgtctacagggagaatgata

SEQ ID NO: 8038068 - DNA, 22 bp, Homo sapiens
tctgtctcaagttcttgcactc

SEQ ID NO: 8038069 - DNA, 22 bp, Homo sapiens
tctgtctcaagttcttgcactc

SEQ ID NO: 8038070 - DNA, 22 bp, Homo sapiens
tctgtctcctctgaggtgccag

SEQ ID NO: 8038071 - DNA, 22 bp, Homo sapiens
tctgtctcctcagatgactcca

SEQ ID NO: 8038072 - DNA, 22 bp, Homo sapiens
tctgtcctgtttcctcctgaca

SEQ ID NO: 8038073 - DNA, 22 bp, Homo sapiens
tctgtcctgtttcctcctgaca

SEQ ID NO: 8038074 - DNA, 22 bp, Homo sapiens
tctgtcctgtttcctcctgaca

SEQ ID NO: 8038075 - DNA, 22 bp, Homo sapiens
tctgtcctctccctgaccacaa

SEQ ID NO: 8038076 - DNA, 22 bp, Homo sapiens
tctgtcctgtttcctcctgaca

SEQ ID NO: 8038077 - DNA, 22 bp, Homo sapiens
tctgtcctgtttcctcctgaca

SEQ ID NO: 8038078 - DNA, 22 bp, Homo sapiens
tctgtcctgtttcctcctgaca

SEQ ID NO: 8038079 - DNA, 18 bp, Homo sapiens
tctgtccttccattcttc

SEQ ID NO: 8038080 - DNA, 18 bp, Homo sapiens
tctgtccttccattcttc

SEQ ID NO: 8038081 - DNA, 18 bp, Homo sapiens
tctgtccttccattcttc

SEQ ID NO: 8038082 - DNA, 20 bp, Homo sapiens
tctgtcctttctgctaaggc

SEQ ID NO: 8038083 - DNA, 20 bp, Homo sapiens
tctgtcctttctgctaaggc

SEQ ID NO: 8038084 - DNA, 22 bp, Homo sapiens
tctgtcgtagttaggcaacaac

SEQ ID NO: 8038085 - DNA, 22 bp, Homo sapiens
tctgggcttggattggctctgc

SEQ ID NO: 8038086 - DNA, 22 bp, Homo sapiens
tctgggcttggattggctctgc

SEQ ID NO: 8038087 - DNA, 22 bp, Homo sapiens
tctgggcttgggtagaaatcac

SEQ ID NO: 8038088 - DNA, 22 bp, Homo sapiens
tctgggcttggattggctctgc

SEQ ID NO: 8038089 - DNA, 22 bp, Homo sapiens
tctgggcttggttagggctgtt

SEQ ID NO: 8038090 - DNA, 22 bp, Homo sapiens
tctgggcttgggtagaaatcac

SEQ ID NO: 8038091 - DNA, 22 bp, Homo sapiens
tctgggcttggttagggctgtt

SEQ ID NO: 8038092 - DNA, 22 bp, Homo sapiens
tctgggctttaagaactctgtt

SEQ ID NO: 8038093 - DNA, 22 bp, Homo sapiens
tctgggctttaagaactctgtt

SEQ ID NO: 8038094 - DNA, 22 bp, Homo sapiens
tctgggcttggttagggctgtt

SEQ ID NO: 8038095 - DNA, 22 bp, Homo sapiens
tctgggctttaagaactctgtt

SEQ ID NO: 8038096 - DNA, 22 bp, Homo sapiens
tctgggcttggttagggctgtt

SEQ ID NO: 8038097 - DNA, 22 bp, Homo sapiens
tctgggcttggttagggctgtt

SEQ ID NO: 8038098 - DNA, 22 bp, Homo sapiens
tctgggctttaagaactctgtt

SEQ ID NO: 8038099 - DNA, 22 bp, Homo sapiens
tctgggctttacactgtgctta

SEQ ID NO: 8038100 - DNA, 22 bp, Homo sapiens
tctgggctttagtttgttatct

SEQ ID NO: 8038101 - DNA, 22 bp, Homo sapiens
tctgggctttacactgtgctta

SEQ ID NO: 8038102 - DNA, 22 bp, Homo sapiens
tctgggctttacactgtgctta

SEQ ID NO: 8038103 - DNA, 22 bp, Homo sapiens
tctgggctttacactgtgctta

SEQ ID NO: 8038104 - DNA, 22 bp, Homo sapiens
tctgggctttacactgtgctta

SEQ ID NO: 8038105 - DNA, 22 bp, Homo sapiens
tctgggctttacactgtgctta

SEQ ID NO: 8038106 - DNA, 21 bp, Homo sapiens
tctgggctttcttataaggca

SEQ ID NO: 8038107 - DNA, 21 bp, Homo sapiens
tctgggctttcttataaggca

SEQ ID NO: 8038108 - DNA, 22 bp, Homo sapiens
tctgggctttgtaatgggaggt

SEQ ID NO: 8038109 - DNA, 22 bp, Homo sapiens
tctgggctttgtaatgggaggt

SEQ ID NO: 8038110 - DNA, 22 bp, Homo sapiens
tctgggctttgtaatgggaggt

SEQ ID NO: 8038111 - DNA, 22 bp, Homo sapiens
tctgggctttgtaatgggaggt

SEQ ID NO: 8038112 - DNA, 22 bp, Homo sapiens
tctgggctttgtaatgggaggt

SEQ ID NO: 8038113 - DNA, 21 bp, Homo sapiens
tctgggggtgagcctagaaat

SEQ ID NO: 8038114 - DNA, 22 bp, Homo sapiens
tctgggggcgaccagggactgc

SEQ ID NO: 8038115 - DNA, 22 bp, Homo sapiens
tctgggggcgaccagggactgc

SEQ ID NO: 8038116 - DNA, 22 bp, Homo sapiens
tctgggggcgaccagggactgc

SEQ ID NO: 8038117 - DNA, 22 bp, Homo sapiens
tctgggggcgaccagggactgc

SEQ ID NO: 8038118 - DNA, 22 bp, Homo sapiens
tctgggggaggaggcatggccc

SEQ ID NO: 8038119 - DNA, 22 bp, Homo sapiens
tctgggggaggaggcatggccc

SEQ ID NO: 8038120 - DNA, 22 bp, Homo sapiens
tctgggggaggaggcatggccc

SEQ ID NO: 8038121 - DNA, 22 bp, Homo sapiens
tctgggggaggaggcatggccc

SEQ ID NO: 8038122 - DNA, 22 bp, Homo sapiens
tctgggggaggaggcatggccc

SEQ ID NO: 8038123 - DNA, 22 bp, Homo sapiens
tctgggcttttccatgcctgtg

SEQ ID NO: 8038124 - DNA, 22 bp, Homo sapiens
tctgggcttttccatgcctgtg

SEQ ID NO: 8038125 - DNA, 22 bp, Homo sapiens
tctgggctttgtaatgggaggt

SEQ ID NO: 8038126 - DNA, 20 bp, Homo sapiens
tctggggatgaggtctagga

SEQ ID NO: 8038127 - DNA, 22 bp, Homo sapiens
tctggggatgagtgatgtcgta

SEQ ID NO: 8038128 - DNA, 20 bp, Homo sapiens
tctggggatgaggtctagga

SEQ ID NO: 8038129 - DNA, 22 bp, Homo sapiens
tctggggatggtctactttctg

SEQ ID NO: 8038130 - DNA, 22 bp, Homo sapiens
tctggggcagttactggggcct

SEQ ID NO: 8038131 - DNA, 22 bp, Homo sapiens
tctggggatgagtgatgtcgta

SEQ ID NO: 8038132 - DNA, 22 bp, Homo sapiens
tctgggctgtctacaggttggc

SEQ ID NO: 8038133 - DNA, 22 bp, Homo sapiens
tctgggctgtctacaggttggc

SEQ ID NO: 8038134 - DNA, 22 bp, Homo sapiens
tctgggctgtctacaggttggc

SEQ ID NO: 8038135 - DNA, 22 bp, Homo sapiens
tctgggctgtctacaggttggc

SEQ ID NO: 8038136 - DNA, 22 bp, Homo sapiens
tctgggctgtctacaggttggc

SEQ ID NO: 8038137 - DNA, 15 bp, Homo sapiens
tctgggctgtgagca

SEQ ID NO: 8038138 - DNA, 22 bp, Homo sapiens
tctgggctgtgccaaagctctt

SEQ ID NO: 8038139 - DNA, 15 bp, Homo sapiens
tctgggctgtgagca

SEQ ID NO: 8038140 - DNA, 15 bp, Homo sapiens
tctgggctgtgagca

SEQ ID NO: 8038141 - DNA, 22 bp, Homo sapiens
tctgggctgtctacaggttggc

SEQ ID NO: 8038142 - DNA, 22 bp, Homo sapiens
tctgggctggttgtgcttgctt

SEQ ID NO: 8038143 - DNA, 22 bp, Homo sapiens
tctgggctggtgctcatgaatt

SEQ ID NO: 8038144 - DNA, 22 bp, Homo sapiens
tctgggctggttgtgcttgctt

SEQ ID NO: 8038145 - DNA, 22 bp, Homo sapiens
tctgggctggttgtgcttgctt

SEQ ID NO: 8038146 - DNA, 22 bp, Homo sapiens
tctgggctggtgctcatgaatt

SEQ ID NO: 8038147 - DNA, 22 bp, Homo sapiens
tctgggctggtgctcatgaatt

SEQ ID NO: 8038148 - DNA, 22 bp, Homo sapiens
tctgggctggtgctcatgaatt

SEQ ID NO: 8038149 - DNA, 22 bp, Homo sapiens
tctgggctgggcttaggaaccc

SEQ ID NO: 8038150 - DNA, 22 bp, Homo sapiens
tctgggctgggcttaggaaccc

SEQ ID NO: 8038151 - DNA, 22 bp, Homo sapiens
tctgggctgggcttaggaaccc

SEQ ID NO: 8038152 - DNA, 22 bp, Homo sapiens
tctgggctgggcttaggaaccc

SEQ ID NO: 8038153 - DNA, 22 bp, Homo sapiens
tctgggctgggagcgtgtggac

SEQ ID NO: 8038154 - DNA, 22 bp, Homo sapiens
tctgggctgggagcgtgtggac

SEQ ID NO: 8038155 - DNA, 22 bp, Homo sapiens
tctgggctgggagcgtgtggac

SEQ ID NO: 8038156 - DNA, 22 bp, Homo sapiens
tctgggctgcttcagccttcgc

SEQ ID NO: 8038157 - DNA, 22 bp, Homo sapiens
tctgggctgcttcagccttcgc

SEQ ID NO: 8038158 - DNA, 23 bp, Homo sapiens
tctgggctgcttaaggatcaagg

SEQ ID NO: 8038159 - DNA, 22 bp, Homo sapiens
tctgggctgcttcagccttcgc

SEQ ID NO: 8038160 - DNA, 22 bp, Homo sapiens
tctgggctggctttatgctgac

SEQ ID NO: 8038161 - DNA, 22 bp, Homo sapiens
tctgggctggctttatgctgac

SEQ ID NO: 8038162 - DNA, 22 bp, Homo sapiens
tctgggctggctttatgctgac

SEQ ID NO: 8038163 - DNA, 17 bp, Homo sapiens
tctgggcttcagtggtc

SEQ ID NO: 8038164 - DNA, 22 bp, Homo sapiens
tctgggctgtggttccactccg

SEQ ID NO: 8038165 - DNA, 22 bp, Homo sapiens
tctgggctgtggttccactccg

SEQ ID NO: 8038166 - DNA, 22 bp, Homo sapiens
tctgggctgtgggaattcaaca

SEQ ID NO: 8038167 - DNA, 22 bp, Homo sapiens
tctgggctgtgccaaagctctt

SEQ ID NO: 8038168 - DNA, 22 bp, Homo sapiens
tctgggctgtgccaaagctctt

SEQ ID NO: 8038169 - DNA, 17 bp, Homo sapiens
tctgggcttcagtggtc

SEQ ID NO: 8038170 - DNA, 17 bp, Homo sapiens
tctgggcttcagtggtc

SEQ ID NO: 8038171 - DNA, 17 bp, Homo sapiens
tctgggcttcagtggtc

SEQ ID NO: 8038172 - DNA, 17 bp, Homo sapiens
tctgggcttcagtggtc

SEQ ID NO: 8038173 - DNA, 17 bp, Homo sapiens
tctgggcttcagtggtc

SEQ ID NO: 8038174 - DNA, 20 bp, Homo sapiens
tctgggcttcccccagctcc

SEQ ID NO: 8038175 - DNA, 20 bp, Homo sapiens
tctgggcttcccccagctcc

SEQ ID NO: 8038176 - DNA, 20 bp, Homo sapiens
tctgggcttcccccagctcc

SEQ ID NO: 8038177 - DNA, 20 bp, Homo sapiens
tctgggcttcccccagctcc

SEQ ID NO: 8038178 - DNA, 18 bp, Homo sapiens
tctgggcttcccgaggct

SEQ ID NO: 8038179 - DNA, 20 bp, Homo sapiens
tctgggcttcccccagctcc

SEQ ID NO: 8038180 - DNA, 20 bp, Homo sapiens
tctgggcttcccccagctcc

SEQ ID NO: 8038181 - DNA, 22 bp, Homo sapiens
tctgggcttgcctggttgtgca

SEQ ID NO: 8038182 - DNA, 22 bp, Homo sapiens
tctgggcttgcctggttgtgca

SEQ ID NO: 8038183 - DNA, 22 bp, Homo sapiens
tctgggcttgcctggttgtgca

SEQ ID NO: 8038184 - DNA, 18 bp, Homo sapiens
tctgggcttcccgaggct

SEQ ID NO: 8038185 - DNA, 22 bp, Homo sapiens
tctgggcttgcctggttgtgca

SEQ ID NO: 8038186 - DNA, 22 bp, Homo sapiens
tctgggcttggattggctctgc

SEQ ID NO: 8038187 - DNA, 22 bp, Homo sapiens
tctgggcttggattggctctgc

SEQ ID NO: 8038188 - DNA, 22 bp, Homo sapiens
tctgggcttggattggctctgc

SEQ ID NO: 8038189 - DNA, 22 bp, Homo sapiens
tctgggcttggattggctctgc

SEQ ID NO: 8038190 - DNA, 22 bp, Homo sapiens
tctgggcttggattggctctgc

SEQ ID NO: 8038191 - DNA, 22 bp, Homo sapiens
tctgggttcaaggggagtctgc

SEQ ID NO: 8038192 - DNA, 22 bp, Homo sapiens
tctgggtgtagggcctggcaac

SEQ ID NO: 8038193 - DNA, 22 bp, Homo sapiens
tctgggtgtagggcctggcaac

SEQ ID NO: 8038194 - DNA, 22 bp, Homo sapiens
tctgggtgtggtatcttagcca

SEQ ID NO: 8038195 - DNA, 22 bp, Homo sapiens
tctgggtgtggtatcttagcca

SEQ ID NO: 8038196 - DNA, 22 bp, Homo sapiens
tctgggtgtcactcctgcctgc

SEQ ID NO: 8038197 - DNA, 22 bp, Homo sapiens
tctgtaaaacttctttgtaaat

SEQ ID NO: 8038198 - DNA, 22 bp, Homo sapiens
tctgtaaaacttctttgtaaat

SEQ ID NO: 8038199 - DNA, 22 bp, Homo sapiens
tctgtaaaacttctttgtaaat

SEQ ID NO: 8038200 - DNA, 22 bp, Homo sapiens
tctgtaaacaccatgttagagt

SEQ ID NO: 8038201 - DNA, 22 bp, Homo sapiens
tctgtaaacaccatgttagagt

SEQ ID NO: 8038202 - DNA, 22 bp, Homo sapiens
tctgtaaaattagtataattgt

SEQ ID NO: 8038203 - DNA, 18 bp, Homo sapiens
tctggtttctaggggagt

SEQ ID NO: 8038204 - DNA, 22 bp, Homo sapiens
tctgtaaaacaatattgtattc

SEQ ID NO: 8038205 - DNA, 22 bp, Homo sapiens
tctgtaaaacttctttgtaaat

SEQ ID NO: 8038206 - DNA, 22 bp, Homo sapiens
tctgtaaaacttctttgtaaat

SEQ ID NO: 8038207 - DNA, 22 bp, Homo sapiens
tctgtaaaacttctttgtaaat

SEQ ID NO: 8038208 - DNA, 22 bp, Homo sapiens
tctgggtgaccctgggcaaggc

SEQ ID NO: 8038209 - DNA, 22 bp, Homo sapiens
tctgggtgaccctgggcaaggc

SEQ ID NO: 8038210 - DNA, 22 bp, Homo sapiens
tctgggtgagctgcctcgggtc

SEQ ID NO: 8038211 - DNA, 22 bp, Homo sapiens
tctgggtgatgaaatgcactgt

SEQ ID NO: 8038212 - DNA, 22 bp, Homo sapiens
tctgggtgatgaaatgcactgt

SEQ ID NO: 8038213 - DNA, 22 bp, Homo sapiens
tctgggtgccctttgctctgtt

SEQ ID NO: 8038214 - DNA, 22 bp, Homo sapiens
tctgggtgccactgtctgtaca

SEQ ID NO: 8038215 - DNA, 22 bp, Homo sapiens
tctgggtgccactgtctgtaca

SEQ ID NO: 8038216 - DNA, 22 bp, Homo sapiens
tctgggtgctacaaacagtatt

SEQ ID NO: 8038217 - DNA, 21 bp, Homo sapiens
tctgggtgctagtgtttgctt

SEQ ID NO: 8038218 - DNA, 22 bp, Homo sapiens
tctgggtgctacaaacagtatt

SEQ ID NO: 8038219 - DNA, 21 bp, Homo sapiens
tctgggtgctagtgtttgctt

SEQ ID NO: 8038220 - DNA, 22 bp, Homo sapiens
tctgggtggctgccaatctgcc

SEQ ID NO: 8038221 - DNA, 22 bp, Homo sapiens
tctgggtggcagtgatggcgtg

SEQ ID NO: 8038222 - DNA, 22 bp, Homo sapiens
tctgggtggcagtgatggcgtg

SEQ ID NO: 8038223 - DNA, 22 bp, Homo sapiens
tctgggtggcttcagaggccac

SEQ ID NO: 8038224 - DNA, 22 bp, Homo sapiens
tctgggtggcttcagaggccac

SEQ ID NO: 8038225 - DNA, 22 bp, Homo sapiens
tctgggtggcttcagaggccac

SEQ ID NO: 8038226 - DNA, 22 bp, Homo sapiens
tctgggtgggcccgagaaatct

SEQ ID NO: 8038227 - DNA, 21 bp, Homo sapiens
tctgggtgtaaatcttatttg

SEQ ID NO: 8038228 - DNA, 22 bp, Homo sapiens
tctgggtggtgtcttccaagac

SEQ ID NO: 8038229 - DNA, 22 bp, Homo sapiens
tctgggtgggcccgagaaatct

SEQ ID NO: 8038230 - DNA, 19 bp, Homo sapiens
tctggggtgtggcctggca

SEQ ID NO: 8038231 - DNA, 19 bp, Homo sapiens
tctggggtgtggcctggca

SEQ ID NO: 8038232 - DNA, 18 bp, Homo sapiens
tctggggtgtgctgtgta

SEQ ID NO: 8038233 - DNA, 22 bp, Homo sapiens
tctggggtgtgacctgagcatg

SEQ ID NO: 8038234 - DNA, 22 bp, Homo sapiens
tctggggtggagccctggagtc

SEQ ID NO: 8038235 - DNA, 22 bp, Homo sapiens
tctggggtggagccctggagtc

SEQ ID NO: 8038236 - DNA, 22 bp, Homo sapiens
tctggggtgcagcctggacata

SEQ ID NO: 8038237 - DNA, 22 bp, Homo sapiens
tctggggtgtgacctgagcatg

SEQ ID NO: 8038238 - DNA, 22 bp, Homo sapiens
tctggggtggagccctggagtc

SEQ ID NO: 8038239 - DNA, 22 bp, Homo sapiens
tctggggtgcagcctggacata

SEQ ID NO: 8038240 - DNA, 22 bp, Homo sapiens
tctggggtggagccctggagtc

SEQ ID NO: 8038241 - DNA, 20 bp, Homo sapiens
tctggggtgaagcccaggaa

SEQ ID NO: 8038242 - DNA, 20 bp, Homo sapiens
tctggggtgaagcccaggaa

SEQ ID NO: 8038243 - DNA, 22 bp, Homo sapiens
tctggggtgaggcctggttatc

SEQ ID NO: 8038244 - DNA, 22 bp, Homo sapiens
tctggggtgcagcctaggcatc

SEQ ID NO: 8038245 - DNA, 22 bp, Homo sapiens
tctggggtgcagcctaggcatc

SEQ ID NO: 8038246 - DNA, 22 bp, Homo sapiens
tctgggggttaagtgaggacaa

SEQ ID NO: 8038247 - DNA, 22 bp, Homo sapiens
tctgggggttaagtgaggacaa

SEQ ID NO: 8038248 - DNA, 22 bp, Homo sapiens
tctgggggttaagtgaggacaa

SEQ ID NO: 8038249 - DNA, 22 bp, Homo sapiens
tctgggggttaagtgaggacaa

SEQ ID NO: 8038250 - DNA, 22 bp, Homo sapiens
tctgggggttaagtgaggacaa

SEQ ID NO: 8038251 - DNA, 22 bp, Homo sapiens
tctggggtcacctggggtgctt

SEQ ID NO: 8038252 - DNA, 22 bp, Homo sapiens
tctgggtctggctgctggtgca

SEQ ID NO: 8038253 - DNA, 22 bp, Homo sapiens
tctgggtctttacccatggaat

SEQ ID NO: 8038254 - DNA, 22 bp, Homo sapiens
tctgggtgaccctgggcaaggc

SEQ ID NO: 8038255 - DNA, 22 bp, Homo sapiens
tctgggtctcagagtgaccatg

SEQ ID NO: 8038256 - DNA, 22 bp, Homo sapiens
tctgggtctcagagtgaccatg

SEQ ID NO: 8038257 - DNA, 22 bp, Homo sapiens
tctgggtctggctgctggtgca

SEQ ID NO: 8038258 - DNA, 22 bp, Homo sapiens
tctgggtctggctgctggtgca

SEQ ID NO: 8038259 - DNA, 22 bp, Homo sapiens
tctgggtctggctgctggtgca

SEQ ID NO: 8038260 - DNA, 22 bp, Homo sapiens
tctgggtctattcctactgtga

SEQ ID NO: 8038261 - DNA, 22 bp, Homo sapiens
tctgggtctattcctactgtga

SEQ ID NO: 8038262 - DNA, 22 bp, Homo sapiens
tctgggtctatgatctcacttc

SEQ ID NO: 8038263 - DNA, 22 bp, Homo sapiens
tctgggtccgggactgtggatg

SEQ ID NO: 8038264 - DNA, 22 bp, Homo sapiens
tctgggtccgggactgtggatg

SEQ ID NO: 8038265 - DNA, 22 bp, Homo sapiens
tctgggtcggaagccccaggga

SEQ ID NO: 8038266 - DNA, 22 bp, Homo sapiens
tctgggtctatcccatgccttt

SEQ ID NO: 8038267 - DNA, 22 bp, Homo sapiens
tctgggtctatcccatgccttt

SEQ ID NO: 8038268 - DNA, 22 bp, Homo sapiens
tctgggtccccgaggaaggaga

SEQ ID NO: 8038269 - DNA, 22 bp, Homo sapiens
tctgggtcatgactcagcgtga

SEQ ID NO: 8038270 - DNA, 22 bp, Homo sapiens
tctgggtcatgactcagcgtga

SEQ ID NO: 8038271 - DNA, 22 bp, Homo sapiens
tctgggtcactgtgggagggca

SEQ ID NO: 8038272 - DNA, 19 bp, Homo sapiens
tctgggtatttggaagatg

SEQ ID NO: 8038273 - DNA, 22 bp, Homo sapiens
tctgggtatgacctatttttcc

SEQ ID NO: 8038274 - DNA, 22 bp, Homo sapiens
tctgggtaataggaagtgcagt

SEQ ID NO: 8038275 - DNA, 22 bp, Homo sapiens
tctggggttttcacgctgtctc

SEQ ID NO: 8038276 - DNA, 22 bp, Homo sapiens
tctggggttggtgcttacacca

SEQ ID NO: 8038277 - DNA, 22 bp, Homo sapiens
tctggggtttgtggttcttctg

SEQ ID NO: 8038278 - DNA, 22 bp, Homo sapiens
tctggggttgagtctgggtcag

SEQ ID NO: 8038279 - DNA, 22 bp, Homo sapiens
tctggggttaagcccaggaatg

SEQ ID NO: 8038280 - DNA, 22 bp, Homo sapiens
tctggggttgagtctgggtcag

SEQ ID NO: 8038281 - DNA, 22 bp, Homo sapiens
tcttccaaatgcagctaaagct

SEQ ID NO: 8038282 - DNA, 22 bp, Homo sapiens
tcttccaaatgaatatggtttt

SEQ ID NO: 8038283 - DNA, 18 bp, Homo sapiens
tcttccaacactgacacc

SEQ ID NO: 8038284 - DNA, 22 bp, Homo sapiens
tcttccaaatgcagctaaagct

SEQ ID NO: 8038285 - DNA, 18 bp, Homo sapiens
tcttccaacactgacacc

SEQ ID NO: 8038286 - DNA, 22 bp, Homo sapiens
tcttccaaatgaatatggtttt

SEQ ID NO: 8038287 - DNA, 22 bp, Homo sapiens
tcttccaaaattagtctcagtt

SEQ ID NO: 8038288 - DNA, 22 bp, Homo sapiens
tcttccaaaattagtctcagtt

SEQ ID NO: 8038289 - DNA, 22 bp, Homo sapiens
tcttcattctcgcctttgtcgt

SEQ ID NO: 8038290 - DNA, 22 bp, Homo sapiens
tcttcattccgtagatatttat

SEQ ID NO: 8038291 - DNA, 22 bp, Homo sapiens
tcttcattctcgcctttgtcgt

SEQ ID NO: 8038292 - DNA, 22 bp, Homo sapiens
tcttcattccgtagatatttat

SEQ ID NO: 8038293 - DNA, 22 bp, Homo sapiens
tcttcatgttgcttattctggg

SEQ ID NO: 8038294 - DNA, 22 bp, Homo sapiens
tcttcatgttgcttattctggg

SEQ ID NO: 8038295 - DNA, 22 bp, Homo sapiens
tcttccaaggttgcacactatc

SEQ ID NO: 8038296 - DNA, 22 bp, Homo sapiens
tcttccaaggttgcacactatc

SEQ ID NO: 8038297 - DNA, 22 bp, Homo sapiens
tcttccaaggtgcagatcttct

SEQ ID NO: 8038298 - DNA, 21 bp, Homo sapiens
tcttccaagggctgctgagac

SEQ ID NO: 8038299 - DNA, 18 bp, Homo sapiens
tcttccaacactgacacc

SEQ ID NO: 8038300 - DNA, 18 bp, Homo sapiens
tcttccaacactgacacc

SEQ ID NO: 8038301 - DNA, 22 bp, Homo sapiens
tcttccaattagaatatttggg

SEQ ID NO: 8038302 - DNA, 22 bp, Homo sapiens
tcttccaatggtttctagattt

SEQ ID NO: 8038303 - DNA, 22 bp, Homo sapiens
tcttccaatggtttctagattt

SEQ ID NO: 8038304 - DNA, 22 bp, Homo sapiens
tcttccaatggtttctagattt

SEQ ID NO: 8038305 - DNA, 22 bp, Homo sapiens
tcttccaatacctagattttgg

SEQ ID NO: 8038306 - DNA, 22 bp, Homo sapiens
tcttccagctccccacggtgtc

SEQ ID NO: 8038307 - DNA, 22 bp, Homo sapiens
tcttccagctccccacggtgtc

SEQ ID NO: 8038308 - DNA, 22 bp, Homo sapiens
tcttccagctccccacggtgtc

SEQ ID NO: 8038309 - DNA, 22 bp, Homo sapiens
tcttccagctccccacggtgtc

SEQ ID NO: 8038310 - DNA, 22 bp, Homo sapiens
tcttccagctcatattctatca

SEQ ID NO: 8038311 - DNA, 22 bp, Homo sapiens
tcttccagctcatattctatca

SEQ ID NO: 8038312 - DNA, 22 bp, Homo sapiens
tcttccagccaatagcgtcctt

SEQ ID NO: 8038313 - DNA, 22 bp, Homo sapiens
tcttccagccaatagcgtcctt

SEQ ID NO: 8038314 - DNA, 22 bp, Homo sapiens
tcttccagccaatagcgtcctt

SEQ ID NO: 8038315 - DNA, 22 bp, Homo sapiens
tcttccagccaatagcgtcctt

SEQ ID NO: 8038316 - DNA, 22 bp, Homo sapiens
tcttccagccaatagcgtcctt

SEQ ID NO: 8038317 - DNA, 22 bp, Homo sapiens
tcttccagcccttctaatggta

SEQ ID NO: 8038318 - DNA, 22 bp, Homo sapiens
tcttccagcccttctaatggta

SEQ ID NO: 8038319 - DNA, 22 bp, Homo sapiens
tcttccagcccttctaatggta

SEQ ID NO: 8038320 - DNA, 22 bp, Homo sapiens
tcttccagcccttctaatggta

SEQ ID NO: 8038321 - DNA, 22 bp, Homo sapiens
tcttccagcccttctaatggta

SEQ ID NO: 8038322 - DNA, 22 bp, Homo sapiens
tcttccagcaatgtgaaatcac

SEQ ID NO: 8038323 - DNA, 22 bp, Homo sapiens
tcttccagcaatgtgaaatcac

SEQ ID NO: 8038324 - DNA, 22 bp, Homo sapiens
tcttccagcaatgtgaaatcac

SEQ ID NO: 8038325 - DNA, 22 bp, Homo sapiens
tcttccagcaatgtgaaatcac

SEQ ID NO: 8038326 - DNA, 22 bp, Homo sapiens
tcttccagatggttctttagct

SEQ ID NO: 8038327 - DNA, 22 bp, Homo sapiens
tcttccagatggttctttagct

SEQ ID NO: 8038328 - DNA, 19 bp, Homo sapiens
tcttccagcatctgggggc

SEQ ID NO: 8038329 - DNA, 19 bp, Homo sapiens
tcttccagcatctgggggc

SEQ ID NO: 8038330 - DNA, 22 bp, Homo sapiens
tcttccagccaatagcgtcctt

SEQ ID NO: 8038331 - DNA, 22 bp, Homo sapiens
tcttccagccaatagcgtcctt

SEQ ID NO: 8038332 - DNA, 19 bp, Homo sapiens
tcttccagcatctgggggc

SEQ ID NO: 8038333 - DNA, 22 bp, Homo sapiens
tcttccagagcctccatcccta

SEQ ID NO: 8038334 - DNA, 22 bp, Homo sapiens
tcttccagatacttcctgactt

SEQ ID NO: 8038335 - DNA, 22 bp, Homo sapiens
tcttccagatacttcctgactt

SEQ ID NO: 8038336 - DNA, 22 bp, Homo sapiens
tcttccagagcctccatcccta

SEQ ID NO: 8038337 - DNA, 22 bp, Homo sapiens
tcttccagagcctccatcccta

SEQ ID NO: 8038338 - DNA, 20 bp, Homo sapiens
tcttccagagacattttccc

SEQ ID NO: 8038339 - DNA, 20 bp, Homo sapiens
tcttccagagacattttccc

SEQ ID NO: 8038340 - DNA, 22 bp, Homo sapiens
tcttccagatgcagatgcttct

SEQ ID NO: 8038341 - DNA, 22 bp, Homo sapiens
tcttccagatgcagatgcttct

SEQ ID NO: 8038342 - DNA, 22 bp, Homo sapiens
tcttccagatacttcctgactt

SEQ ID NO: 8038343 - DNA, 22 bp, Homo sapiens
tcttccagaagtgttttcagaa

SEQ ID NO: 8038344 - DNA, 22 bp, Homo sapiens
tcttccagaagtgttttcagaa

SEQ ID NO: 8038345 - DNA, 22 bp, Homo sapiens
tcttccagaatctcagagggct

SEQ ID NO: 8038346 - DNA, 22 bp, Homo sapiens
tcttccagaatctcagagggct

SEQ ID NO: 8038347 - DNA, 22 bp, Homo sapiens
tcttccagaagtgttttcagaa

SEQ ID NO: 8038348 - DNA, 22 bp, Homo sapiens
tcttccagaatgcattctcttt

SEQ ID NO: 8038349 - DNA, 22 bp, Homo sapiens
tcttccagaatgcattctcttt

SEQ ID NO: 8038350 - DNA, 22 bp, Homo sapiens
tcttccagaatgcattctcttt

SEQ ID NO: 8038351 - DNA, 22 bp, Homo sapiens
tcttccagaatgcattctcttt

SEQ ID NO: 8038352 - DNA, 22 bp, Homo sapiens
tcttccagaatgcattctcttt

SEQ ID NO: 8038353 - DNA, 22 bp, Homo sapiens
tcttcatatataaagtggaata

SEQ ID NO: 8038354 - DNA, 22 bp, Homo sapiens
tcttcatctcagattaacagga

SEQ ID NO: 8038355 - DNA, 22 bp, Homo sapiens
tcttcatacaatttcagacatc

SEQ ID NO: 8038356 - DNA, 22 bp, Homo sapiens
tcttcatacaatttcagacatc

SEQ ID NO: 8038357 - DNA, 18 bp, Homo sapiens
tcttcatctcctgagctg

SEQ ID NO: 8038358 - DNA, 22 bp, Homo sapiens
tcttcatctcagattaacagga

SEQ ID NO: 8038359 - DNA, 22 bp, Homo sapiens
tcttcatctcagattaacagga

SEQ ID NO: 8038360 - DNA, 22 bp, Homo sapiens
tcttcatgcacctcacagctag

SEQ ID NO: 8038361 - DNA, 22 bp, Homo sapiens
tcttcatgaatgaatctttgac

SEQ ID NO: 8038362 - DNA, 22 bp, Homo sapiens
tcttcatgaaattgattgctta

SEQ ID NO: 8038363 - DNA, 22 bp, Homo sapiens
tcttcatgataccctaagccac

SEQ ID NO: 8038364 - DNA, 23 bp, Homo sapiens
tcttcatgcccaggccttggtgc

SEQ ID NO: 8038365 - DNA, 23 bp, Homo sapiens
tcttcatggccatctggttcttc

SEQ ID NO: 8038366 - DNA, 22 bp, Homo sapiens
tcttcatggtctggttctccag

SEQ ID NO: 8038367 - DNA, 22 bp, Homo sapiens
tcttcatgccaaatgagttttg

SEQ ID NO: 8038368 - DNA, 22 bp, Homo sapiens
tcttcatgcacctcacagctag

SEQ ID NO: 8038369 - DNA, 22 bp, Homo sapiens
tcttcatgtctctgcttgagtc

SEQ ID NO: 8038370 - DNA, 22 bp, Homo sapiens
tcttcagtgcacctgatgtctt

SEQ ID NO: 8038371 - DNA, 22 bp, Homo sapiens
tcttcagtgcacctgatgtctt

SEQ ID NO: 8038372 - DNA, 22 bp, Homo sapiens
tcttcagtgcatgttacctata

SEQ ID NO: 8038373 - DNA, 22 bp, Homo sapiens
tcttcagtgcatgccctcaggc

SEQ ID NO: 8038374 - DNA, 22 bp, Homo sapiens
tcttcagtgcatgttacctata

SEQ ID NO: 8038375 - DNA, 22 bp, Homo sapiens
tcttcagtgcatgttacctata

SEQ ID NO: 8038376 - DNA, 22 bp, Homo sapiens
tcttcagttgtcatactgcctt

SEQ ID NO: 8038377 - DNA, 22 bp, Homo sapiens
tcttcagttgtcatactgcctt

SEQ ID NO: 8038378 - DNA, 22 bp, Homo sapiens
tcttcagtatttggataacatt

SEQ ID NO: 8038379 - DNA, 22 bp, Homo sapiens
tcttcagtcaatccagatgttt

SEQ ID NO: 8038380 - DNA, 22 bp, Homo sapiens
tcttcagtatttggataacatt

SEQ ID NO: 8038381 - DNA, 22 bp, Homo sapiens
tcttcagtaggtcctcagaatc

SEQ ID NO: 8038382 - DNA, 22 bp, Homo sapiens
tcttcagtgaatggcaagatct

SEQ ID NO: 8038383 - DNA, 22 bp, Homo sapiens
tcttcagtgaatggcaagatct

SEQ ID NO: 8038384 - DNA, 22 bp, Homo sapiens
tcttcagtgcacctgatgtctt

SEQ ID NO: 8038385 - DNA, 22 bp, Homo sapiens
tcttcagtcaatccagatgttt

SEQ ID NO: 8038386 - DNA, 22 bp, Homo sapiens
tcttcagtcaatccagatgttt

SEQ ID NO: 8038387 - DNA, 22 bp, Homo sapiens
tcttcaggaagggaaatcatcc

SEQ ID NO: 8038388 - DNA, 22 bp, Homo sapiens
tcttcaggaagggaaatcatcc

SEQ ID NO: 8038389 - DNA, 22 bp, Homo sapiens
tcttcaggaagggaaatcatcc

SEQ ID NO: 8038390 - DNA, 22 bp, Homo sapiens
tcttcaggctctggctgccttt

SEQ ID NO: 8038391 - DNA, 21 bp, Homo sapiens
tcttcagtacacttgcacgcc

SEQ ID NO: 8038392 - DNA, 21 bp, Homo sapiens
tcttcagcagtggtgaggtgg

SEQ ID NO: 8038393 - DNA, 22 bp, Homo sapiens
tcttcagcagggcctctctgag

SEQ ID NO: 8038394 - DNA, 22 bp, Homo sapiens
tcttcagcagagaattatgatg

SEQ ID NO: 8038395 - DNA, 22 bp, Homo sapiens
tcttcagcagggcctctctgag

SEQ ID NO: 8038396 - DNA, 22 bp, Homo sapiens
tcttcagcagggcctctctgag

SEQ ID NO: 8038397 - DNA, 22 bp, Homo sapiens
tcttatgtcaagaatgaatatt

SEQ ID NO: 8038398 - DNA, 22 bp, Homo sapiens
tcttattcagtgggctctgcca

SEQ ID NO: 8038399 - DNA, 22 bp, Homo sapiens
tcttattggtaatgatggcatt

SEQ ID NO: 8038400 - DNA, 20 bp, Homo sapiens
tcttattgtcttgaggagtt

SEQ ID NO: 8038401 - DNA, 22 bp, Homo sapiens
tcttattgtctagattgagatg

SEQ ID NO: 8038402 - DNA, 19 bp, Homo sapiens
tcttattgagcagctgagg

SEQ ID NO: 8038403 - DNA, 19 bp, Homo sapiens
tcttattgagcagctgagg

SEQ ID NO: 8038404 - DNA, 19 bp, Homo sapiens
tcttattgagcagctgagg

SEQ ID NO: 8038405 - DNA, 22 bp, Homo sapiens
tcttattggataaaaggaaacc

SEQ ID NO: 8038406 - DNA, 22 bp, Homo sapiens
tcttatttgcaactggctcaga

SEQ ID NO: 8038407 - DNA, 22 bp, Homo sapiens
tcttattttagagccccgagcc

SEQ ID NO: 8038408 - DNA, 22 bp, Homo sapiens
tcttattttgttagatgctgta

SEQ ID NO: 8038409 - DNA, 22 bp, Homo sapiens
tcttattttgttagatgctgta

SEQ ID NO: 8038410 - DNA, 22 bp, Homo sapiens
tcttattttgttagatgctgta

SEQ ID NO: 8038411 - DNA, 22 bp, Homo sapiens
tcttattttgttagatgctgta

SEQ ID NO: 8038412 - DNA, 22 bp, Homo sapiens
tcttattttttaatgacagaga

SEQ ID NO: 8038413 - DNA, 22 bp, Homo sapiens
tcttattttttaatgacagaga

SEQ ID NO: 8038414 - DNA, 22 bp, Homo sapiens
tcttattttttaatgacagaga

SEQ ID NO: 8038415 - DNA, 22 bp, Homo sapiens
tcttatttagagaggactagag

SEQ ID NO: 8038416 - DNA, 22 bp, Homo sapiens
tcttattgtttaaaagtacaca

SEQ ID NO: 8038417 - DNA, 22 bp, Homo sapiens
tcttatttagagaggactagag

SEQ ID NO: 8038418 - DNA, 22 bp, Homo sapiens
tcttatttagagaggactagag

SEQ ID NO: 8038419 - DNA, 22 bp, Homo sapiens
tcttatttgcaactggctcaga

SEQ ID NO: 8038420 - DNA, 22 bp, Homo sapiens
tcttatttagagaggactagag

SEQ ID NO: 8038421 - DNA, 22 bp, Homo sapiens
tcttatttgcaactggctcaga

SEQ ID NO: 8038422 - DNA, 22 bp, Homo sapiens
tcttatttgcaactggctcaga

SEQ ID NO: 8038423 - DNA, 22 bp, Homo sapiens
tcttattgtttaaaagtacaca

SEQ ID NO: 8038424 - DNA, 22 bp, Homo sapiens
tcttattgtttaaaagtacaca

SEQ ID NO: 8038425 - DNA, 22 bp, Homo sapiens
tcttattgtttaaaagtacaca

SEQ ID NO: 8038426 - DNA, 22 bp, Homo sapiens
tcttattgtgatgatgaagaac

SEQ ID NO: 8038427 - DNA, 22 bp, Homo sapiens
tcttattgtgatgatgaagaac

SEQ ID NO: 8038428 - DNA, 20 bp, Homo sapiens
tcttattgtcttgaggagtt

SEQ ID NO: 8038429 - DNA, 22 bp, Homo sapiens
tcttcaaagaattttagtaatt

SEQ ID NO: 8038430 - DNA, 22 bp, Homo sapiens
tcttcaaagaattttagtaatt

SEQ ID NO: 8038431 - DNA, 22 bp, Homo sapiens
tcttcaaagcatatgcaggcat

SEQ ID NO: 8038432 - DNA, 22 bp, Homo sapiens
tcttcaaatacagtcatattga

SEQ ID NO: 8038433 - DNA, 22 bp, Homo sapiens
tcttcaaagaagccttggatta

SEQ ID NO: 8038434 - DNA, 22 bp, Homo sapiens
tcttcaaagaattttagtaatt

SEQ ID NO: 8038435 - DNA, 22 bp, Homo sapiens
tcttcaaagaagccttggatta

SEQ ID NO: 8038436 - DNA, 22 bp, Homo sapiens
tcttcaaagaagccttggatta

SEQ ID NO: 8038437 - DNA, 22 bp, Homo sapiens
tcttcaaactgaaaatttagaa

SEQ ID NO: 8038438 - DNA, 22 bp, Homo sapiens
tcttattttttaatgacagaga

SEQ ID NO: 8038439 - DNA, 22 bp, Homo sapiens
tcttattttttaatgacagaga

SEQ ID NO: 8038440 - DNA, 22 bp, Homo sapiens
tcttattttttaatgacagaga

SEQ ID NO: 8038441 - DNA, 22 bp, Homo sapiens
tcttcaaaaaatatccatcagt

SEQ ID NO: 8038442 - DNA, 22 bp, Homo sapiens
tcttcaaaaactgcaccttgct

SEQ ID NO: 8038443 - DNA, 22 bp, Homo sapiens
tcttcaaaaactgcaccttgct

SEQ ID NO: 8038444 - DNA, 22 bp, Homo sapiens
tcttcaaaattgattggagaag

SEQ ID NO: 8038445 - DNA, 22 bp, Homo sapiens
tcttcaaactgaaaatttagaa

SEQ ID NO: 8038446 - DNA, 22 bp, Homo sapiens
tcttcaaatgctagtaatatca

SEQ ID NO: 8038447 - DNA, 22 bp, Homo sapiens
tcttcaagaatatattgctgtc

SEQ ID NO: 8038448 - DNA, 22 bp, Homo sapiens
tcttcaaccttgttactatagc

SEQ ID NO: 8038449 - DNA, 22 bp, Homo sapiens
tcttcaaccttgttactatagc

SEQ ID NO: 8038450 - DNA, 22 bp, Homo sapiens
tcttcaaatgctagtaatatca

SEQ ID NO: 8038451 - DNA, 22 bp, Homo sapiens
tcttcaaatacagtcatattga

SEQ ID NO: 8038452 - DNA, 22 bp, Homo sapiens
tcttcaaatacagtcatattga

SEQ ID NO: 8038453 - DNA, 22 bp, Homo sapiens
tcttcaaatacagtcatattga

SEQ ID NO: 8038454 - DNA, 22 bp, Homo sapiens
tcttcaaatcctacagtgtctg

SEQ ID NO: 8038455 - DNA, 22 bp, Homo sapiens
tcttcaaatcctacagtgtctg

SEQ ID NO: 8038456 - DNA, 22 bp, Homo sapiens
tcttcacaccgggcagcaggaa

SEQ ID NO: 8038457 - DNA, 22 bp, Homo sapiens
tcttcacaccgggcagcaggaa

SEQ ID NO: 8038458 - DNA, 22 bp, Homo sapiens
tcttcacagatgcatatacttc

SEQ ID NO: 8038459 - DNA, 22 bp, Homo sapiens
tcttcacacacagtcctctttc

SEQ ID NO: 8038460 - DNA, 22 bp, Homo sapiens
tcttcaattagatttaccaatt

SEQ ID NO: 8038461 - DNA, 22 bp, Homo sapiens
tcttcaattagatttaccaatt

SEQ ID NO: 8038462 - DNA, 22 bp, Homo sapiens
tcttcacaggagcctgcctgcc

SEQ ID NO: 8038463 - DNA, 22 bp, Homo sapiens
tcttcacagctttgtccagaag

SEQ ID NO: 8038464 - DNA, 22 bp, Homo sapiens
tcttcacagctttgtccagaag

SEQ ID NO: 8038465 - DNA, 22 bp, Homo sapiens
tcttcacagatgcatatacttc

SEQ ID NO: 8038466 - DNA, 23 bp, Homo sapiens
tcttcacagggcttcccatgtgc

SEQ ID NO: 8038467 - DNA, 22 bp, Homo sapiens
tcttcacaggagcctgcctgcc

SEQ ID NO: 8038468 - DNA, 22 bp, Homo sapiens
tcttcacatattccttgagcta

SEQ ID NO: 8038469 - DNA, 22 bp, Homo sapiens
tcttcacatgaccttcatgtct

SEQ ID NO: 8038470 - DNA, 22 bp, Homo sapiens
tcttcacatgaccttcatgtct

SEQ ID NO: 8038471 - DNA, 22 bp, Homo sapiens
tcttcacatggaacatgaagct

SEQ ID NO: 8038472 - DNA, 22 bp, Homo sapiens
tcttcacatggaacatgaagct

SEQ ID NO: 8038473 - DNA, 22 bp, Homo sapiens
tcttcacatggaacatgaagct

SEQ ID NO: 8038474 - DNA, 22 bp, Homo sapiens
tcttcagcaactccccaatctg

SEQ ID NO: 8038475 - DNA, 22 bp, Homo sapiens
tcttcagattgcactgagcaag

SEQ ID NO: 8038476 - DNA, 22 bp, Homo sapiens
tcttcagatggccagttgtccc

SEQ ID NO: 8038477 - DNA, 20 bp, Homo sapiens
tcttcagatgcttttggagt

SEQ ID NO: 8038478 - DNA, 21 bp, Homo sapiens
tcttgaaaagttagattctct

SEQ ID NO: 8038479 - DNA, 21 bp, Homo sapiens
tcttgaaaagttagattctct

SEQ ID NO: 8038480 - DNA, 21 bp, Homo sapiens
tcttgaaaattgtagcagttt

SEQ ID NO: 8038481 - DNA, 21 bp, Homo sapiens
tcttgaaaagttagattctct

SEQ ID NO: 8038482 - DNA, 23 bp, Homo sapiens
tcttgaaaagcctacagcagttc

SEQ ID NO: 8038483 - DNA, 23 bp, Homo sapiens
tcttgaaaagcctacagcagttc

SEQ ID NO: 8038484 - DNA, 21 bp, Homo sapiens
tcttgaaaagttagattctct

SEQ ID NO: 8038485 - DNA, 22 bp, Homo sapiens
tcttgaaagcatgagatggaca

SEQ ID NO: 8038486 - DNA, 22 bp, Homo sapiens
tcttgaaacatatgagtaagtg

SEQ ID NO: 8038487 - DNA, 21 bp, Homo sapiens
tcttgaaaattgtagcagttt

SEQ ID NO: 8038488 - DNA, 22 bp, Homo sapiens
tcttgaaacatatgagtaagtg

SEQ ID NO: 8038489 - DNA, 22 bp, Homo sapiens
tcttgaaagcatgagatggaca

SEQ ID NO: 8038490 - DNA, 22 bp, Homo sapiens
tcttgaaagcattttcttcatc

SEQ ID NO: 8038491 - DNA, 22 bp, Homo sapiens
tcttgaaagcattttcttcatc

SEQ ID NO: 8038492 - DNA, 22 bp, Homo sapiens
tcttctttggatgaaagaatat

SEQ ID NO: 8038493 - DNA, 22 bp, Homo sapiens
tcttctttggatgaaagaatat

SEQ ID NO: 8038494 - DNA, 22 bp, Homo sapiens
tcttctttggatgaaagaatat

SEQ ID NO: 8038495 - DNA, 22 bp, Homo sapiens
tcttctttgaatcatagtgacc

SEQ ID NO: 8038496 - DNA, 22 bp, Homo sapiens
tcttctttggatgaaagaatat

SEQ ID NO: 8038497 - DNA, 22 bp, Homo sapiens
tcttcttttatttcaagggtgt

SEQ ID NO: 8038498 - DNA, 22 bp, Homo sapiens
tcttcttttatttcaagggtgt

SEQ ID NO: 8038499 - DNA, 22 bp, Homo sapiens
tcttcttttatttcaagggtgt

SEQ ID NO: 8038500 - DNA, 22 bp, Homo sapiens
tcttctttttgtcccacagaat

SEQ ID NO: 8038501 - DNA, 22 bp, Homo sapiens
tcttctttttgtcccacagaat

SEQ ID NO: 8038502 - DNA, 22 bp, Homo sapiens
tcttctttttgtcccacagaat

SEQ ID NO: 8038503 - DNA, 20 bp, Homo sapiens
tcttctgttgccttgttctg

SEQ ID NO: 8038504 - DNA, 22 bp, Homo sapiens
tcttctgttaccacagcgatga

SEQ ID NO: 8038505 - DNA, 20 bp, Homo sapiens
tcttctgttgccttgttctg

SEQ ID NO: 8038506 - DNA, 20 bp, Homo sapiens
tcttctgttgccttgttctg

SEQ ID NO: 8038507 - DNA, 22 bp, Homo sapiens
tcttcttatgtgccattatctc

SEQ ID NO: 8038508 - DNA, 22 bp, Homo sapiens
tcttcttaaagtatgttctctt

SEQ ID NO: 8038509 - DNA, 22 bp, Homo sapiens
tcttctgttttagattgcatac

SEQ ID NO: 8038510 - DNA, 22 bp, Homo sapiens
tcttcttcctcatttatacata

SEQ ID NO: 8038511 - DNA, 22 bp, Homo sapiens
tcttcttccagcaggtgaggag

SEQ ID NO: 8038512 - DNA, 22 bp, Homo sapiens
tcttcttcccatccctcaaatg

SEQ ID NO: 8038513 - DNA, 22 bp, Homo sapiens
tcttcttatgtgccattatctc

SEQ ID NO: 8038514 - DNA, 22 bp, Homo sapiens
tcttcttatgtgccattatctc

SEQ ID NO: 8038515 - DNA, 22 bp, Homo sapiens
tcttcttccagcaggtgaggag

SEQ ID NO: 8038516 - DNA, 22 bp, Homo sapiens
tcttcttatgtgccattatctc

SEQ ID NO: 8038517 - DNA, 22 bp, Homo sapiens
tcttctttgaatcatagtgacc

SEQ ID NO: 8038518 - DNA, 22 bp, Homo sapiens
tcttcttcctccacagggccca

SEQ ID NO: 8038519 - DNA, 22 bp, Homo sapiens
tcttctttatgtcatatgccag

SEQ ID NO: 8038520 - DNA, 22 bp, Homo sapiens
tcttcttcctcatttatacata

SEQ ID NO: 8038521 - DNA, 22 bp, Homo sapiens
tcttctgtgagaattcaagcaa

SEQ ID NO: 8038522 - DNA, 22 bp, Homo sapiens
tcttctgtgagaattcaagcaa

SEQ ID NO: 8038523 - DNA, 22 bp, Homo sapiens
tcttctgtgagaattcaagcaa

SEQ ID NO: 8038524 - DNA, 22 bp, Homo sapiens
tcttctgtattgttaactcagg

SEQ ID NO: 8038525 - DNA, 22 bp, Homo sapiens
tcttctgtcctaagtcaaagca

SEQ ID NO: 8038526 - DNA, 22 bp, Homo sapiens
tcttctgttaccacagcgatga

SEQ ID NO: 8038527 - DNA, 22 bp, Homo sapiens
tcttctgttaccacagcgatga

SEQ ID NO: 8038528 - DNA, 22 bp, Homo sapiens
tcttctgtggctctcaccaccc

SEQ ID NO: 8038529 - DNA, 22 bp, Homo sapiens
tcttctgtggctctcaccaccc

SEQ ID NO: 8038530 - DNA, 22 bp, Homo sapiens
tcttctgtgagaattcaagcaa

SEQ ID NO: 8038531 - DNA, 22 bp, Homo sapiens
tcttctgtgatctatgtgtttt

SEQ ID NO: 8038532 - DNA, 22 bp, Homo sapiens
tcttctgtgatctatgtgtttt

SEQ ID NO: 8038533 - DNA, 22 bp, Homo sapiens
tcttctctcatgtaggagggaa

SEQ ID NO: 8038534 - DNA, 22 bp, Homo sapiens
tcttctctcatgtaggagggaa

SEQ ID NO: 8038535 - DNA, 22 bp, Homo sapiens
tcttctggatgagagcggaggc

SEQ ID NO: 8038536 - DNA, 22 bp, Homo sapiens
tcttctcctttgccatgtgttt

SEQ ID NO: 8038537 - DNA, 22 bp, Homo sapiens
tcttctctacaccagcagcccc

SEQ ID NO: 8038538 - DNA, 22 bp, Homo sapiens
tcttctctacaccagcagcccc

SEQ ID NO: 8038539 - DNA, 22 bp, Homo sapiens
tcttctcccatctccaggcagg

SEQ ID NO: 8038540 - DNA, 22 bp, Homo sapiens
tcttctcctttgccatgtgttt

SEQ ID NO: 8038541 - DNA, 22 bp, Homo sapiens
tcttctcctttgccatgtgttt

SEQ ID NO: 8038542 - DNA, 22 bp, Homo sapiens
tcttctcctttgccatgtgttt

SEQ ID NO: 8038543 - DNA, 22 bp, Homo sapiens
tcttctccagttcatcctacca

SEQ ID NO: 8038544 - DNA, 22 bp, Homo sapiens
tcttctccagtgcttctgcaca

SEQ ID NO: 8038545 - DNA, 22 bp, Homo sapiens
tcttctccagttcatcctacca

SEQ ID NO: 8038546 - DNA, 22 bp, Homo sapiens
tcttctccagttcatcctacca

SEQ ID NO: 8038547 - DNA, 22 bp, Homo sapiens
tcttctccataatcaacactct

SEQ ID NO: 8038548 - DNA, 22 bp, Homo sapiens
tcttctcatagctagttcttcc

SEQ ID NO: 8038549 - DNA, 22 bp, Homo sapiens
tcttctccagtgcttctgcaca

SEQ ID NO: 8038550 - DNA, 22 bp, Homo sapiens
tcttctcagtttctctaggatg

SEQ ID NO: 8038551 - DNA, 22 bp, Homo sapiens
tcttctcaaaaaatgtaggtgg

SEQ ID NO: 8038552 - DNA, 22 bp, Homo sapiens
tcttctccagtgcttctgcaca

SEQ ID NO: 8038553 - DNA, 22 bp, Homo sapiens
tcttctccagtgcttctgcaca

SEQ ID NO: 8038554 - DNA, 22 bp, Homo sapiens
tcttctccagtgcttctgcaca

SEQ ID NO: 8038555 - DNA, 22 bp, Homo sapiens
tcttctccagtgcttctgcaca

SEQ ID NO: 8038556 - DNA, 22 bp, Homo sapiens
tcttctcccatcggccgcaggg

SEQ ID NO: 8038557 - DNA, 22 bp, Homo sapiens
tcttctcccatcggccgcaggg

SEQ ID NO: 8038558 - DNA, 22 bp, Homo sapiens
tcttctcccatctccaggcagg

SEQ ID NO: 8038559 - DNA, 22 bp, Homo sapiens
tcttctcccatcggccgcaggg

SEQ ID NO: 8038560 - DNA, 22 bp, Homo sapiens
tcttctcccatctccaggcagg

SEQ ID NO: 8038561 - DNA, 22 bp, Homo sapiens
tcttctcccatctccaggcagg

SEQ ID NO: 8038562 - DNA, 22 bp, Homo sapiens
tcttctcccatctccaggcagg

SEQ ID NO: 8038563 - DNA, 22 bp, Homo sapiens
tcttctcccatctccaggcagg

SEQ ID NO: 8038564 - DNA, 22 bp, Homo sapiens
tcttctccataatcaacactct

SEQ ID NO: 8038565 - DNA, 22 bp, Homo sapiens
tcttctccataatcaacactct

SEQ ID NO: 8038566 - DNA, 22 bp, Homo sapiens
tcttctccataatcaacactct

SEQ ID NO: 8038567 - DNA, 22 bp, Homo sapiens
tcttctccagttcatcctacca

SEQ ID NO: 8038568 - DNA, 22 bp, Homo sapiens
tcttctccataatcaacactct

SEQ ID NO: 8038569 - DNA, 22 bp, Homo sapiens
tcttctcccagggtcgcccaag

SEQ ID NO: 8038570 - DNA, 22 bp, Homo sapiens
tcttctcccagggtcgcccaag

SEQ ID NO: 8038571 - DNA, 22 bp, Homo sapiens
tcttctccataatcaacactct

SEQ ID NO: 8038572 - DNA, 22 bp, Homo sapiens
tcttctcccatcggccgcaggg

SEQ ID NO: 8038573 - DNA, 22 bp, Homo sapiens
tcttccttaaatgtttggtaga

SEQ ID NO: 8038574 - DNA, 22 bp, Homo sapiens
tcttcctggtttctgggccatc

SEQ ID NO: 8038575 - DNA, 22 bp, Homo sapiens
tcttcctggtttctgggccatc

SEQ ID NO: 8038576 - DNA, 22 bp, Homo sapiens
tcttcctgtcaatgagaattaa

SEQ ID NO: 8038577 - DNA, 22 bp, Homo sapiens
tcttcctggtttctgggccatc

SEQ ID NO: 8038578 - DNA, 22 bp, Homo sapiens
tcttcctggtttctgggccatc

SEQ ID NO: 8038579 - DNA, 22 bp, Homo sapiens
tcttccttctttgatgacaagg

SEQ ID NO: 8038580 - DNA, 22 bp, Homo sapiens
tcttccttcgcccttgctgttt

SEQ ID NO: 8038581 - DNA, 22 bp, Homo sapiens
tcttccttcgcccttgctgttt

SEQ ID NO: 8038582 - DNA, 22 bp, Homo sapiens
tcttccttctttgatgacaagg

SEQ ID NO: 8038583 - DNA, 22 bp, Homo sapiens
tcttcctgcttggtgtgtctgg

SEQ ID NO: 8038584 - DNA, 22 bp, Homo sapiens
tcttcctgctttggtgaggctt

SEQ ID NO: 8038585 - DNA, 22 bp, Homo sapiens
tcttcctgctttggtgaggctt

SEQ ID NO: 8038586 - DNA, 22 bp, Homo sapiens
tcttcctggatgggggttgatg

SEQ ID NO: 8038587 - DNA, 22 bp, Homo sapiens
tcttcctggatgggggttgatg

SEQ ID NO: 8038588 - DNA, 22 bp, Homo sapiens
tcttcctggcattgatgctgca

SEQ ID NO: 8038589 - DNA, 22 bp, Homo sapiens
tcttcctggcattgatgctgca

SEQ ID NO: 8038590 - DNA, 22 bp, Homo sapiens
tcttcctgctttggtgaggctt

SEQ ID NO: 8038591 - DNA, 21 bp, Homo sapiens
tcttcctgctccacactcccc

SEQ ID NO: 8038592 - DNA, 22 bp, Homo sapiens
tcttccttgctccttgtcactt

SEQ ID NO: 8038593 - DNA, 22 bp, Homo sapiens
tcttccttgctccttgtcactt

SEQ ID NO: 8038594 - DNA, 22 bp, Homo sapiens
tcttccttgccttgcttcatca

SEQ ID NO: 8038595 - DNA, 22 bp, Homo sapiens
tcttccttgccttgcttcatca

SEQ ID NO: 8038596 - DNA, 22 bp, Homo sapiens
tcttccttgccttgcttcatca

SEQ ID NO: 8038597 - DNA, 22 bp, Homo sapiens
tcttccttgccttgcttcatca

SEQ ID NO: 8038598 - DNA, 22 bp, Homo sapiens
tcttccttctttgatgacaagg

SEQ ID NO: 8038599 - DNA, 22 bp, Homo sapiens
tcttccttgctccttgtcactt

SEQ ID NO: 8038600 - DNA, 22 bp, Homo sapiens
tcttcctttcattcatgtgtta

SEQ ID NO: 8038601 - DNA, 22 bp, Homo sapiens
tcttcctttcattcatgtgtta

SEQ ID NO: 8038602 - DNA, 22 bp, Homo sapiens
tcttcctttcattcatgtgtta

SEQ ID NO: 8038603 - DNA, 22 bp, Homo sapiens
tcttcctttcattcatgtgtta

SEQ ID NO: 8038604 - DNA, 22 bp, Homo sapiens
tcttcctttcattcatgtgtta

SEQ ID NO: 8038605 - DNA, 22 bp, Homo sapiens
tcttccttttgtaccttctgaa

SEQ ID NO: 8038606 - DNA, 16 bp, Homo sapiens
tcttccttttgatttt

SEQ ID NO: 8038607 - DNA, 22 bp, Homo sapiens
tcttccttttgtaccttctgaa

SEQ ID NO: 8038608 - DNA, 22 bp, Homo sapiens
tcttctatcctcagcccctgcc

SEQ ID NO: 8038609 - DNA, 22 bp, Homo sapiens
tcttctagtaggccaagaagct

SEQ ID NO: 8038610 - DNA, 22 bp, Homo sapiens
tcttctcaaaaaatgtaggtgg

SEQ ID NO: 8038611 - DNA, 22 bp, Homo sapiens
tcttctcaaaaaatgtaggtgg

SEQ ID NO: 8038612 - DNA, 22 bp, Homo sapiens
tcttctaatggttcagatatat

SEQ ID NO: 8038613 - DNA, 22 bp, Homo sapiens
tcttctaatggttcagatatat

SEQ ID NO: 8038614 - DNA, 22 bp, Homo sapiens
tcttctactataataattttct

SEQ ID NO: 8038615 - DNA, 22 bp, Homo sapiens
tcttctagtaggccaagaagct

SEQ ID NO: 8038616 - DNA, 22 bp, Homo sapiens
tcttctagtaggccaagaagct

SEQ ID NO: 8038617 - DNA, 22 bp, Homo sapiens
tcttcctctagatctgaggccc

SEQ ID NO: 8038618 - DNA, 22 bp, Homo sapiens
tcttcctctagatctgaggccc

SEQ ID NO: 8038619 - DNA, 22 bp, Homo sapiens
tcttcctctctaattgatcaga

SEQ ID NO: 8038620 - DNA, 22 bp, Homo sapiens
tcttcctcttctgctgagaagt

SEQ ID NO: 8038621 - DNA, 22 bp, Homo sapiens
tcttcctctctaattgatcaga

SEQ ID NO: 8038622 - DNA, 22 bp, Homo sapiens
tcttcctctagatctgaggccc

SEQ ID NO: 8038623 - DNA, 22 bp, Homo sapiens
tcttcctctagatctgaggccc

SEQ ID NO: 8038624 - DNA, 22 bp, Homo sapiens
tcttcctctagatctgaggccc

SEQ ID NO: 8038625 - DNA, 22 bp, Homo sapiens
tcttcctctagatctgaggccc

SEQ ID NO: 8038626 - DNA, 22 bp, Homo sapiens
tcttcctctagatctgaggccc

SEQ ID NO: 8038627 - DNA, 22 bp, Homo sapiens
tcttcctccctacagagctcag

SEQ ID NO: 8038628 - DNA, 22 bp, Homo sapiens
tcttcctccctacagagctcag

SEQ ID NO: 8038629 - DNA, 22 bp, Homo sapiens
tcttcctccctacagagctcag

SEQ ID NO: 8038630 - DNA, 22 bp, Homo sapiens
tcttcctccctacagagctcag

SEQ ID NO: 8038631 - DNA, 22 bp, Homo sapiens
tcttcctctagatctgaggccc

SEQ ID NO: 8038632 - DNA, 22 bp, Homo sapiens
tcttcctgaaaccctgttccag

SEQ ID NO: 8038633 - DNA, 22 bp, Homo sapiens
tcttcctgaaaccctgttccag

SEQ ID NO: 8038634 - DNA, 22 bp, Homo sapiens
tcttcctgaaaccctgttccag

SEQ ID NO: 8038635 - DNA, 22 bp, Homo sapiens
tcttcctcttctgctgagaagt

SEQ ID NO: 8038636 - DNA, 23 bp, Homo sapiens
tcttcctgaactatcaggcacat

SEQ ID NO: 8038637 - DNA, 23 bp, Homo sapiens
tcttcctgaactatcaggcacat

SEQ ID NO: 8038638 - DNA, 21 bp, Homo sapiens
tcttcctgacatatgcaaggc

SEQ ID NO: 8038639 - DNA, 21 bp, Homo sapiens
tcttcctgctccacactcccc

SEQ ID NO: 8038640 - DNA, 21 bp, Homo sapiens
tcttcctgctccacactcccc

SEQ ID NO: 8038641 - DNA, 21 bp, Homo sapiens
tcttcctccacagcgtgccac

SEQ ID NO: 8038642 - DNA, 20 bp, Homo sapiens
tcttccaggtacagtctgca

SEQ ID NO: 8038643 - DNA, 20 bp, Homo sapiens
tcttccaggtacagtctgca

SEQ ID NO: 8038644 - DNA, 20 bp, Homo sapiens
tcttccaggtacagtctgca

SEQ ID NO: 8038645 - DNA, 21 bp, Homo sapiens
tcttcctccacagcgtgccac

SEQ ID NO: 8038646 - DNA, 21 bp, Homo sapiens
tcttcctccacagcgtgccac

SEQ ID NO: 8038647 - DNA, 20 bp, Homo sapiens
tcttccaggtacagtctgca

SEQ ID NO: 8038648 - DNA, 22 bp, Homo sapiens
tcttccagggagcctcaaacct

SEQ ID NO: 8038649 - DNA, 22 bp, Homo sapiens
tcttccaggctagagttgttgc

SEQ ID NO: 8038650 - DNA, 22 bp, Homo sapiens
tcttccaggctagagttgttgc

SEQ ID NO: 8038651 - DNA, 22 bp, Homo sapiens
tcttccaggctagagttgttgc

SEQ ID NO: 8038652 - DNA, 22 bp, Homo sapiens
tcttccagggagcctcaaacct

SEQ ID NO: 8038653 - DNA, 22 bp, Homo sapiens
tcttccagggagcctcaaacct

SEQ ID NO: 8038654 - DNA, 22 bp, Homo sapiens
tcttccaggccctgccacagct

SEQ ID NO: 8038655 - DNA, 22 bp, Homo sapiens
tcttccaggccctgccacagct

SEQ ID NO: 8038656 - DNA, 22 bp, Homo sapiens
tcttccaggccctgccacagct

SEQ ID NO: 8038657 - DNA, 22 bp, Homo sapiens
tcttccaggagggtgggcaaac

SEQ ID NO: 8038658 - DNA, 22 bp, Homo sapiens
tcttccaggccctgccacagct

SEQ ID NO: 8038659 - DNA, 22 bp, Homo sapiens
tcttccaggccctgccacagct

SEQ ID NO: 8038660 - DNA, 22 bp, Homo sapiens
tcttccaggagggtgggcaaac

SEQ ID NO: 8038661 - DNA, 22 bp, Homo sapiens
tcttccaggagggtgggcaaac

SEQ ID NO: 8038662 - DNA, 22 bp, Homo sapiens
tcttccaggagggcatttcttt

SEQ ID NO: 8038663 - DNA, 22 bp, Homo sapiens
tcttccagcttctggtggctgc

SEQ ID NO: 8038664 - DNA, 22 bp, Homo sapiens
tcttccagcttctggtggctgc

SEQ ID NO: 8038665 - DNA, 20 bp, Homo sapiens
tcttccagcttctggtagaa

SEQ ID NO: 8038666 - DNA, 20 bp, Homo sapiens
tcttccagcttctggtagaa

SEQ ID NO: 8038667 - DNA, 20 bp, Homo sapiens
tcttccagcttctggtagaa

SEQ ID NO: 8038668 - DNA, 22 bp, Homo sapiens
tcttccaggacctggggctcca

SEQ ID NO: 8038669 - DNA, 22 bp, Homo sapiens
tcttccaggacctggggctcca

SEQ ID NO: 8038670 - DNA, 22 bp, Homo sapiens
tcttccaggacctggggctcca

SEQ ID NO: 8038671 - DNA, 22 bp, Homo sapiens
tcttccaggagggcatttcttt

SEQ ID NO: 8038672 - DNA, 22 bp, Homo sapiens
tcttccaggagggcatttcttt

SEQ ID NO: 8038673 - DNA, 22 bp, Homo sapiens
tcttccaggagggcatttcttt

SEQ ID NO: 8038674 - DNA, 18 bp, Homo sapiens
tcttccagcttctggagg

SEQ ID NO: 8038675 - DNA, 18 bp, Homo sapiens
tcttccagcttctggagg

SEQ ID NO: 8038676 - DNA, 18 bp, Homo sapiens
tcttccagcttctggagg

SEQ ID NO: 8038677 - DNA, 22 bp, Homo sapiens
tcttccagcttctagaggatgc

SEQ ID NO: 8038678 - DNA, 22 bp, Homo sapiens
tcttccagcttctagaggatgc

SEQ ID NO: 8038679 - DNA, 20 bp, Homo sapiens
tcttccagcttctggtagaa

SEQ ID NO: 8038680 - DNA, 18 bp, Homo sapiens
tcttccagcttctggagg

SEQ ID NO: 8038681 - DNA, 22 bp, Homo sapiens
tcttccagctgtaggacctagg

SEQ ID NO: 8038682 - DNA, 22 bp, Homo sapiens
tcttccagctgtaggacctagg

SEQ ID NO: 8038683 - DNA, 22 bp, Homo sapiens
tcttccagctgtaggacctagg

SEQ ID NO: 8038684 - DNA, 22 bp, Homo sapiens
tcttccagcttctagaggatgc

SEQ ID NO: 8038685 - DNA, 22 bp, Homo sapiens
tctttgaatcctttacatctga

SEQ ID NO: 8038686 - DNA, 22 bp, Homo sapiens
tctttgaatacaggaagcatga

SEQ ID NO: 8038687 - DNA, 22 bp, Homo sapiens
tctttgaatacaggaagcatga

SEQ ID NO: 8038688 - DNA, 22 bp, Homo sapiens
tctttgaagtatcttaaatggt

SEQ ID NO: 8038689 - DNA, 22 bp, Homo sapiens
tctttgaagttcccctggaaga

SEQ ID NO: 8038690 - DNA, 22 bp, Homo sapiens
tctttgaatcctttacatctga

SEQ ID NO: 8038691 - DNA, 22 bp, Homo sapiens
tctttgaatcctttacatctga

SEQ ID NO: 8038692 - DNA, 22 bp, Homo sapiens
tctttgaatcctttacatctga

SEQ ID NO: 8038693 - DNA, 22 bp, Homo sapiens
tctttgaatttctgactgtctt

SEQ ID NO: 8038694 - DNA, 22 bp, Homo sapiens
tctttgaattcaaactgttcaa

SEQ ID NO: 8038695 - DNA, 22 bp, Homo sapiens
tctttgaatttctgactgtctt

SEQ ID NO: 8038696 - DNA, 22 bp, Homo sapiens
tctttgaatttctgactgtctt

SEQ ID NO: 8038697 - DNA, 22 bp, Homo sapiens
tctttgaattcaaactgttcaa

SEQ ID NO: 8038698 - DNA, 22 bp, Homo sapiens
tctttgatggagagatagatat

SEQ ID NO: 8038699 - DNA, 21 bp, Homo sapiens
tctttgagaataggtttttca

SEQ ID NO: 8038700 - DNA, 22 bp, Homo sapiens
tctttgaatttctgactgtctt

SEQ ID NO: 8038701 - DNA, 22 bp, Homo sapiens
tctttgatcagcctttcactga

SEQ ID NO: 8038702 - DNA, 22 bp, Homo sapiens
tctttgatttaaaacagtcaaa

SEQ ID NO: 8038703 - DNA, 22 bp, Homo sapiens
tctttgatttaaaacagtcaaa

SEQ ID NO: 8038704 - DNA, 22 bp, Homo sapiens
tctttgatttagaaggaaatga

SEQ ID NO: 8038705 - DNA, 22 bp, Homo sapiens
tctttgatttgacaatatcttg

SEQ ID NO: 8038706 - DNA, 22 bp, Homo sapiens
tctttgatgggagatctgagag

SEQ ID NO: 8038707 - DNA, 22 bp, Homo sapiens
tctttgatgtctcttcctgtaa

SEQ ID NO: 8038708 - DNA, 22 bp, Homo sapiens
tctttgatgtggttaattatga

SEQ ID NO: 8038709 - DNA, 22 bp, Homo sapiens
tctttgatgtggttaattatga

SEQ ID NO: 8038710 - DNA, 21 bp, Homo sapiens
tctttctgaaatctcagtctg

SEQ ID NO: 8038711 - DNA, 21 bp, Homo sapiens
tctttctgaaatctcagtctg

SEQ ID NO: 8038712 - DNA, 22 bp, Homo sapiens
tctttctgaatatttgacctca

SEQ ID NO: 8038713 - DNA, 21 bp, Homo sapiens
tctttctgaaatctcagtctg

SEQ ID NO: 8038714 - DNA, 22 bp, Homo sapiens
tctttctctctaatcaagcaca

SEQ ID NO: 8038715 - DNA, 22 bp, Homo sapiens
tctttctctctaatcaagcaca

SEQ ID NO: 8038716 - DNA, 22 bp, Homo sapiens
tctttctgcagcacaggggcag

SEQ ID NO: 8038717 - DNA, 22 bp, Homo sapiens
tctttctgcacttagtggggct

SEQ ID NO: 8038718 - DNA, 22 bp, Homo sapiens
tctttctgatgggaagggtcaa

SEQ ID NO: 8038719 - DNA, 22 bp, Homo sapiens
tctttctggttatgtatagaga

SEQ ID NO: 8038720 - DNA, 22 bp, Homo sapiens
tctttctggttatgtatagaga

SEQ ID NO: 8038721 - DNA, 22 bp, Homo sapiens
tctttctggtctcgccttattc

SEQ ID NO: 8038722 - DNA, 22 bp, Homo sapiens
tctttctgtaagctccatggaa

SEQ ID NO: 8038723 - DNA, 22 bp, Homo sapiens
tctttctgtaagctccatggaa

SEQ ID NO: 8038724 - DNA, 22 bp, Homo sapiens
tctttctgtaagctccatggaa

SEQ ID NO: 8038725 - DNA, 22 bp, Homo sapiens
tctttctggttatgtatagaga

SEQ ID NO: 8038726 - DNA, 22 bp, Homo sapiens
tctttcttacaaagaaaacggt

SEQ ID NO: 8038727 - DNA, 22 bp, Homo sapiens
tctttcttaaataggtggattg

SEQ ID NO: 8038728 - DNA, 22 bp, Homo sapiens
tctttcttattagccattgttc

SEQ ID NO: 8038729 - DNA, 22 bp, Homo sapiens
tctttcttattagccattgttc

SEQ ID NO: 8038730 - DNA, 22 bp, Homo sapiens
tctttgaactctgtgtattaac

SEQ ID NO: 8038731 - DNA, 22 bp, Homo sapiens
tctttgaactctgtgtattaac

SEQ ID NO: 8038732 - DNA, 22 bp, Homo sapiens
tctttgaacttggctgatctct

SEQ ID NO: 8038733 - DNA, 22 bp, Homo sapiens
tctttgaacttggctgatctct

SEQ ID NO: 8038734 - DNA, 22 bp, Homo sapiens
tctttgaacttggctgatctct

SEQ ID NO: 8038735 - DNA, 22 bp, Homo sapiens
tctttgaacttggctgatctct

SEQ ID NO: 8038736 - DNA, 22 bp, Homo sapiens
tctttgaacttggctgatctct

SEQ ID NO: 8038737 - DNA, 22 bp, Homo sapiens
tctttcctctgagctcctgtag

SEQ ID NO: 8038738 - DNA, 22 bp, Homo sapiens
tctttctacattttatatgctt

SEQ ID NO: 8038739 - DNA, 22 bp, Homo sapiens
tctttcctgtaactgctgttca

SEQ ID NO: 8038740 - DNA, 22 bp, Homo sapiens
tctttcctgtaactgctgttca

SEQ ID NO: 8038741 - DNA, 22 bp, Homo sapiens
tctttcctgtaactgctgttca

SEQ ID NO: 8038742 - DNA, 22 bp, Homo sapiens
tctttcctctgagctcctgtag

SEQ ID NO: 8038743 - DNA, 22 bp, Homo sapiens
tctttcctctgagctcctgtag

SEQ ID NO: 8038744 - DNA, 22 bp, Homo sapiens
tctttcctaggtgatatgcaat

SEQ ID NO: 8038745 - DNA, 22 bp, Homo sapiens
tctttcctctgagctcctgtag

SEQ ID NO: 8038746 - DNA, 22 bp, Homo sapiens
tctttcctctgagctcctgtag

SEQ ID NO: 8038747 - DNA, 17 bp, Homo sapiens
tctttcctgccatgctc

SEQ ID NO: 8038748 - DNA, 17 bp, Homo sapiens
tctttcctgccatgctc

SEQ ID NO: 8038749 - DNA, 21 bp, Homo sapiens
tctttcctgcccagttgccct

SEQ ID NO: 8038750 - DNA, 22 bp, Homo sapiens
tctttccctgtgttagcctgta

SEQ ID NO: 8038751 - DNA, 22 bp, Homo sapiens
tctttccctgtgttagcctgta

SEQ ID NO: 8038752 - DNA, 22 bp, Homo sapiens
tctttccctgtgttagcctgta

SEQ ID NO: 8038753 - DNA, 22 bp, Homo sapiens
tctttccctgtgttagcctgta

SEQ ID NO: 8038754 - DNA, 17 bp, Homo sapiens
tctttccctgggagatg

SEQ ID NO: 8038755 - DNA, 23 bp, Homo sapiens
tctttcctaatgaaacagtgaaa

SEQ ID NO: 8038756 - DNA, 23 bp, Homo sapiens
tctttcctaatgaaacagtgaaa

SEQ ID NO: 8038757 - DNA, 22 bp, Homo sapiens
tctttcctactttattgtgaac

SEQ ID NO: 8038758 - DNA, 23 bp, Homo sapiens
tctttcctaatgaaacagtgaaa

SEQ ID NO: 8038759 - DNA, 22 bp, Homo sapiens
tctttcccttagaacattaaca

SEQ ID NO: 8038760 - DNA, 23 bp, Homo sapiens
tctttcctaatgaaacagtgaaa

SEQ ID NO: 8038761 - DNA, 22 bp, Homo sapiens
tctttcctaggtgatatgcaat

SEQ ID NO: 8038762 - DNA, 22 bp, Homo sapiens
tctttcctaggtgatatgcaat

SEQ ID NO: 8038763 - DNA, 22 bp, Homo sapiens
tctttcctaggtgatatgcaat

SEQ ID NO: 8038764 - DNA, 23 bp, Homo sapiens
tctttcctcagcacacaccaaga

SEQ ID NO: 8038765 - DNA, 22 bp, Homo sapiens
tctttcctagaggctgatgagt

SEQ ID NO: 8038766 - DNA, 22 bp, Homo sapiens
tctttcctagaggctgatgagt

SEQ ID NO: 8038767 - DNA, 22 bp, Homo sapiens
tctttcaatgtgaaaccatgta

SEQ ID NO: 8038768 - DNA, 22 bp, Homo sapiens
tctttcaatgagcattctttcc

SEQ ID NO: 8038769 - DNA, 22 bp, Homo sapiens
tctttcaatgtgaaaccatgta

SEQ ID NO: 8038770 - DNA, 22 bp, Homo sapiens
tctttcaatgtgaaaccatgta

SEQ ID NO: 8038771 - DNA, 22 bp, Homo sapiens
tctttcagccacttacctgtct

SEQ ID NO: 8038772 - DNA, 22 bp, Homo sapiens
tctttcagccacttacctgtct

SEQ ID NO: 8038773 - DNA, 22 bp, Homo sapiens
tctttcatgtatatgcaaccta

SEQ ID NO: 8038774 - DNA, 22 bp, Homo sapiens
tctttcattctagtctgaggtt

SEQ ID NO: 8038775 - DNA, 19 bp, Homo sapiens
tctttcatttctagctctg

SEQ ID NO: 8038776 - DNA, 19 bp, Homo sapiens
tctttcatttctagctctg

SEQ ID NO: 8038777 - DNA, 19 bp, Homo sapiens
tctttcatttctagctctg

SEQ ID NO: 8038778 - DNA, 19 bp, Homo sapiens
tctttcatttctagctctg

SEQ ID NO: 8038779 - DNA, 22 bp, Homo sapiens
tctttccaaggactctgtagca

SEQ ID NO: 8038780 - DNA, 22 bp, Homo sapiens
tctttattgctactggtttgtc

SEQ ID NO: 8038781 - DNA, 22 bp, Homo sapiens
tctttattgctactggtttgtc

SEQ ID NO: 8038782 - DNA, 22 bp, Homo sapiens
tctttattgctactggtttgtc

SEQ ID NO: 8038783 - DNA, 22 bp, Homo sapiens
tctttattgctactggtttgtc

SEQ ID NO: 8038784 - DNA, 22 bp, Homo sapiens
tctttattgctactggtttgtc

SEQ ID NO: 8038785 - DNA, 22 bp, Homo sapiens
tctttattgctactggtttgtc

SEQ ID NO: 8038786 - DNA, 22 bp, Homo sapiens
tctttattgctactggtttgtc

SEQ ID NO: 8038787 - DNA, 22 bp, Homo sapiens
tctttattgctactggtttgtc

SEQ ID NO: 8038788 - DNA, 22 bp, Homo sapiens
tctttattgctactggtttgtc

SEQ ID NO: 8038789 - DNA, 22 bp, Homo sapiens
tctttattgctactggtttgtc

SEQ ID NO: 8038790 - DNA, 22 bp, Homo sapiens
tctttatttaagtctgttgtaa

SEQ ID NO: 8038791 - DNA, 22 bp, Homo sapiens
tctttatttaagtctgttgtaa

SEQ ID NO: 8038792 - DNA, 22 bp, Homo sapiens
tctttcaatgagcattctttcc

SEQ ID NO: 8038793 - DNA, 22 bp, Homo sapiens
tctttcccgccagagcatgagt

SEQ ID NO: 8038794 - DNA, 22 bp, Homo sapiens
tctttcccagtagctctcccag

SEQ ID NO: 8038795 - DNA, 22 bp, Homo sapiens
tctttccatggccacacagtct

SEQ ID NO: 8038796 - DNA, 22 bp, Homo sapiens
tctttccatggccacacagtct

SEQ ID NO: 8038797 - DNA, 22 bp, Homo sapiens
tctttccatggccacacagtct

SEQ ID NO: 8038798 - DNA, 22 bp, Homo sapiens
tctttccagaggaatttttaga

SEQ ID NO: 8038799 - DNA, 22 bp, Homo sapiens
tctttccagaggaatttttaga

SEQ ID NO: 8038800 - DNA, 22 bp, Homo sapiens
tctttccagaggaatttttaga

SEQ ID NO: 8038801 - DNA, 21 bp, Homo sapiens
tctttccaatattcatgtctc

SEQ ID NO: 8038802 - DNA, 22 bp, Homo sapiens
tctttccaagtaatacttccca

SEQ ID NO: 8038803 - DNA, 22 bp, Homo sapiens
tctttccaagtaatacttccca

SEQ ID NO: 8038804 - DNA, 22 bp, Homo sapiens
tctttccaagtaatacttccca

SEQ ID NO: 8038805 - DNA, 21 bp, Homo sapiens
tctttccaatattcatgtctc

SEQ ID NO: 8038806 - DNA, 21 bp, Homo sapiens
tctttccaatattcatgtctc

SEQ ID NO: 8038807 - DNA, 21 bp, Homo sapiens
tctttccaatattcatgtctc

SEQ ID NO: 8038808 - DNA, 22 bp, Homo sapiens
tctttccaaggactctgtagca

SEQ ID NO: 8038809 - DNA, 22 bp, Homo sapiens
tctttccaaggactctgtagca

SEQ ID NO: 8038810 - DNA, 22 bp, Homo sapiens
tctttccaaggactctgtagca

SEQ ID NO: 8038811 - DNA, 22 bp, Homo sapiens
tctttccaagtaatacttccca

SEQ ID NO: 8038812 - DNA, 22 bp, Homo sapiens
tctttccacagcatgtccatgc

SEQ ID NO: 8038813 - DNA, 22 bp, Homo sapiens
tctttccacactgtatgcccat

SEQ ID NO: 8038814 - DNA, 22 bp, Homo sapiens
tctttccacactgtatgcccat

SEQ ID NO: 8038815 - DNA, 22 bp, Homo sapiens
tctttccacattctctgtttag

SEQ ID NO: 8038816 - DNA, 22 bp, Homo sapiens
tctttccacagcatgtccatgc

SEQ ID NO: 8038817 - DNA, 22 bp, Homo sapiens
tctttccacagcatgtccatgc

SEQ ID NO: 8038818 - DNA, 22 bp, Homo sapiens
tctttccacattctctgtttag

SEQ ID NO: 8038819 - DNA, 22 bp, Homo sapiens
tctttccacattctctgtttag

SEQ ID NO: 8038820 - DNA, 22 bp, Homo sapiens
tctttccacattctctgtttag

SEQ ID NO: 8038821 - DNA, 22 bp, Homo sapiens
tctttccacattctctgtttag

SEQ ID NO: 8038822 - DNA, 22 bp, Homo sapiens
tctttccagaggaatttttaga

SEQ ID NO: 8038823 - DNA, 22 bp, Homo sapiens
tctttagatgtttagaggaaga

SEQ ID NO: 8038824 - DNA, 22 bp, Homo sapiens
tctttagatgtttagaggaaga

SEQ ID NO: 8038825 - DNA, 22 bp, Homo sapiens
tctttagatgtttagaggaaga

SEQ ID NO: 8038826 - DNA, 22 bp, Homo sapiens
tctttagatgtttagaggaaga

SEQ ID NO: 8038827 - DNA, 22 bp, Homo sapiens
tctttagatgtttagaggaaga

SEQ ID NO: 8038828 - DNA, 22 bp, Homo sapiens
tctttagagttaacaataatga

SEQ ID NO: 8038829 - DNA, 22 bp, Homo sapiens
tctttagagctcagaaatacag

SEQ ID NO: 8038830 - DNA, 22 bp, Homo sapiens
tctttagagttaacaataatga

SEQ ID NO: 8038831 - DNA, 22 bp, Homo sapiens
tctttagagctcagaaatacag

SEQ ID NO: 8038832 - DNA, 22 bp, Homo sapiens
tctttagagctcagaaatacag

SEQ ID NO: 8038833 - DNA, 22 bp, Homo sapiens
tctttagagctcagaaatacag

SEQ ID NO: 8038834 - DNA, 22 bp, Homo sapiens
tctttagagctcagaaatacag

SEQ ID NO: 8038835 - DNA, 22 bp, Homo sapiens
tctttagagcacgggaaaaaca

SEQ ID NO: 8038836 - DNA, 22 bp, Homo sapiens
tctttagagcacgggaaaaaca

SEQ ID NO: 8038837 - DNA, 22 bp, Homo sapiens
tctttagagcctttcctcccga

SEQ ID NO: 8038838 - DNA, 22 bp, Homo sapiens
tctttagagcacgggaaaaaca

SEQ ID NO: 8038839 - DNA, 22 bp, Homo sapiens
tctttagagcacgggaaaaaca

SEQ ID NO: 8038840 - DNA, 22 bp, Homo sapiens
tctttagagcacgggaaaaaca

SEQ ID NO: 8038841 - DNA, 20 bp, Homo sapiens
tctttagatttatcttatgt

SEQ ID NO: 8038842 - DNA, 22 bp, Homo sapiens
tctttagctagaaatactctaa

SEQ ID NO: 8038843 - DNA, 19 bp, Homo sapiens
tctttagccagagctctgg

SEQ ID NO: 8038844 - DNA, 22 bp, Homo sapiens
tctttagccagtatcataatga

SEQ ID NO: 8038845 - DNA, 22 bp, Homo sapiens
tctttagtattgagttatggta

SEQ ID NO: 8038846 - DNA, 22 bp, Homo sapiens
tctttagtaatgtagcagttta

SEQ ID NO: 8038847 - DNA, 22 bp, Homo sapiens
tctttagtattgagttatggta

SEQ ID NO: 8038848 - DNA, 19 bp, Homo sapiens
tctttagtcacatttttat

SEQ ID NO: 8038849 - DNA, 20 bp, Homo sapiens
tctttagttcctggcccttt

SEQ ID NO: 8038850 - DNA, 22 bp, Homo sapiens
tctttagtgctgcttttggatt

SEQ ID NO: 8038851 - DNA, 22 bp, Homo sapiens
tctttagtgacagttgtgcaag

SEQ ID NO: 8038852 - DNA, 22 bp, Homo sapiens
tctttagtgacagttgtgcaag

SEQ ID NO: 8038853 - DNA, 22 bp, Homo sapiens
tctttagtgaccatctcattct

SEQ ID NO: 8038854 - DNA, 22 bp, Homo sapiens
tctttagtgaccatctcattct

SEQ ID NO: 8038855 - DNA, 22 bp, Homo sapiens
tctttataaaagtcattatgtc

SEQ ID NO: 8038856 - DNA, 22 bp, Homo sapiens
tctttataaaagtcattatgtc

SEQ ID NO: 8038857 - DNA, 22 bp, Homo sapiens
tctttataaaagtcattatgtc

SEQ ID NO: 8038858 - DNA, 22 bp, Homo sapiens
tctttagttggagaacctctga

SEQ ID NO: 8038859 - DNA, 22 bp, Homo sapiens
tctttagttttctaggttctat

SEQ ID NO: 8038860 - DNA, 22 bp, Homo sapiens
tctttagctagaaatactctaa

SEQ ID NO: 8038861 - DNA, 20 bp, Homo sapiens
tctttagttcctggcccttt

SEQ ID NO: 8038862 - DNA, 23 bp, Homo sapiens
tctttagttgaaggcaaggggag

SEQ ID NO: 8038863 - DNA, 22 bp, Homo sapiens
tctttataaaagtcattatgtc

SEQ ID NO: 8038864 - DNA, 22 bp, Homo sapiens
tctttataaaagtcattatgtc

SEQ ID NO: 8038865 - DNA, 22 bp, Homo sapiens
tctttatcaagtctgttctttg

SEQ ID NO: 8038866 - DNA, 22 bp, Homo sapiens
tctttatcaagtctgttctttg

SEQ ID NO: 8038867 - DNA, 22 bp, Homo sapiens
tctttatacaaactgggaaaca

SEQ ID NO: 8038868 - DNA, 22 bp, Homo sapiens
tctttatcaagtctgttctttg

SEQ ID NO: 8038869 - DNA, 22 bp, Homo sapiens
tctttatctggctcagagacac

SEQ ID NO: 8038870 - DNA, 22 bp, Homo sapiens
tctttattgctactggtttgtc

SEQ ID NO: 8038871 - DNA, 22 bp, Homo sapiens
tctttatgcctacctgggaaga

SEQ ID NO: 8038872 - DNA, 22 bp, Homo sapiens
tctttatgagaaaaagattgta

SEQ ID NO: 8038873 - DNA, 22 bp, Homo sapiens
tctttatgagaaaaagattgta

SEQ ID NO: 8038874 - DNA, 23 bp, Homo sapiens
tcttggctggacaagtcactcac

SEQ ID NO: 8038875 - DNA, 23 bp, Homo sapiens
tcttggctggacaagtcactcac

SEQ ID NO: 8038876 - DNA, 22 bp, Homo sapiens
tcttggctggtttcacattacc

SEQ ID NO: 8038877 - DNA, 22 bp, Homo sapiens
tcttggctgtaccattgactag

SEQ ID NO: 8038878 - DNA, 22 bp, Homo sapiens
tcttggctgtaccattgactag

SEQ ID NO: 8038879 - DNA, 22 bp, Homo sapiens
tcttggctgtaccattgactag

SEQ ID NO: 8038880 - DNA, 22 bp, Homo sapiens
tcttggcttctgtatttcctgt

SEQ ID NO: 8038881 - DNA, 22 bp, Homo sapiens
tcttggctttctcctagggatg

SEQ ID NO: 8038882 - DNA, 22 bp, Homo sapiens
tcttggcttctgtatttcctgt

SEQ ID NO: 8038883 - DNA, 22 bp, Homo sapiens
tcttggctgtgcatgcatcttc

SEQ ID NO: 8038884 - DNA, 20 bp, Homo sapiens
tcttggctgtgtgaggacac

SEQ ID NO: 8038885 - DNA, 22 bp, Homo sapiens
tcttggctgtctttgaagttag

SEQ ID NO: 8038886 - DNA, 22 bp, Homo sapiens
tcttggctgtgcatgcatcttc

SEQ ID NO: 8038887 - DNA, 22 bp, Homo sapiens
tcttggctgtctttgaagttag

SEQ ID NO: 8038888 - DNA, 22 bp, Homo sapiens
tcttggctcctgttgtcatcag

SEQ ID NO: 8038889 - DNA, 22 bp, Homo sapiens
tcttggctcctgttgtcatcag

SEQ ID NO: 8038890 - DNA, 22 bp, Homo sapiens
tcttggctcctgttgtcatcag

SEQ ID NO: 8038891 - DNA, 22 bp, Homo sapiens
tcttggctcccttgtaggccct

SEQ ID NO: 8038892 - DNA, 22 bp, Homo sapiens
tcttggctagtaccttcctgcc

SEQ ID NO: 8038893 - DNA, 22 bp, Homo sapiens
tcttggctatccaagttatcca

SEQ ID NO: 8038894 - DNA, 22 bp, Homo sapiens
tcttggctattcttgaattctg

SEQ ID NO: 8038895 - DNA, 21 bp, Homo sapiens
tcttggctctgccacttatta

SEQ ID NO: 8038896 - DNA, 22 bp, Homo sapiens
tcttggctgcagagccggcaag

SEQ ID NO: 8038897 - DNA, 21 bp, Homo sapiens
tcttggctctgccacttatta

SEQ ID NO: 8038898 - DNA, 22 bp, Homo sapiens
tcttggctgcagagccggcaag

SEQ ID NO: 8038899 - DNA, 22 bp, Homo sapiens
tcttggctgcgtcctggctgtg

SEQ ID NO: 8038900 - DNA, 22 bp, Homo sapiens
tcttggctgcgtcctggctgtg

SEQ ID NO: 8038901 - DNA, 22 bp, Homo sapiens
tcttggctgcgtcctggctgtg

SEQ ID NO: 8038902 - DNA, 22 bp, Homo sapiens
tcttggctgctgccaatttact

SEQ ID NO: 8038903 - DNA, 22 bp, Homo sapiens
tcttggctgctgccaatttact

SEQ ID NO: 8038904 - DNA, 22 bp, Homo sapiens
tcttgggcatgtgtttgatttc

SEQ ID NO: 8038905 - DNA, 22 bp, Homo sapiens
tcttgggcatgtgtttgatttc

SEQ ID NO: 8038906 - DNA, 22 bp, Homo sapiens
tcttgggcatgtgtttgatttc

SEQ ID NO: 8038907 - DNA, 22 bp, Homo sapiens
tcttgggccaatattctgggta

SEQ ID NO: 8038908 - DNA, 22 bp, Homo sapiens
tcttgggcatgcacagactgca

SEQ ID NO: 8038909 - DNA, 22 bp, Homo sapiens
tcttgggcatgtgtttgatttc

SEQ ID NO: 8038910 - DNA, 22 bp, Homo sapiens
tcttgggatcacctcctggctt

SEQ ID NO: 8038911 - DNA, 22 bp, Homo sapiens
tcttgggagtcccaggacatag

SEQ ID NO: 8038912 - DNA, 22 bp, Homo sapiens
tcttgggcaatttctctagagg

SEQ ID NO: 8038913 - DNA, 22 bp, Homo sapiens
tcttgggcacgatgggaggctt

SEQ ID NO: 8038914 - DNA, 22 bp, Homo sapiens
tcttgggcacgatgggaggctt

SEQ ID NO: 8038915 - DNA, 22 bp, Homo sapiens
tcttgggcacgatgggaggctt

SEQ ID NO: 8038916 - DNA, 22 bp, Homo sapiens
tcttgggaaataaacagattga

SEQ ID NO: 8038917 - DNA, 22 bp, Homo sapiens
tcttggcttttcccctatggtc

SEQ ID NO: 8038918 - DNA, 22 bp, Homo sapiens
tcttggcttttcccctatggtc

SEQ ID NO: 8038919 - DNA, 19 bp, Homo sapiens
tcttggctttgtctactgt

SEQ ID NO: 8038920 - DNA, 19 bp, Homo sapiens
tcttggctttgtctactgt

SEQ ID NO: 8038921 - DNA, 19 bp, Homo sapiens
tcttggctttgtctactgt

SEQ ID NO: 8038922 - DNA, 22 bp, Homo sapiens
tcttggctttctcctagggatg

SEQ ID NO: 8038923 - DNA, 19 bp, Homo sapiens
tcttggctttgtctactgt

SEQ ID NO: 8038924 - DNA, 22 bp, Homo sapiens
tcttgggaaatgtttgcgagct

SEQ ID NO: 8038925 - DNA, 22 bp, Homo sapiens
tcttgggaccatttacacatac

SEQ ID NO: 8038926 - DNA, 21 bp, Homo sapiens
tcttgggataaacttcaagaa

SEQ ID NO: 8038927 - DNA, 22 bp, Homo sapiens
tcttgggagtcccaggacatag

SEQ ID NO: 8038928 - DNA, 22 bp, Homo sapiens
tcttgggagtcccaggacatag

SEQ ID NO: 8038929 - DNA, 22 bp, Homo sapiens
tcttgggagtcccaggacatag

SEQ ID NO: 8038930 - DNA, 22 bp, Homo sapiens
tcttgggagtcccaggacatag

SEQ ID NO: 8038931 - DNA, 22 bp, Homo sapiens
tctttacatcacaattgtatgg

SEQ ID NO: 8038932 - DNA, 22 bp, Homo sapiens
tctttacatagtgtggactact

SEQ ID NO: 8038933 - DNA, 22 bp, Homo sapiens
tctttacatcacaattgtatgg

SEQ ID NO: 8038934 - DNA, 23 bp, Homo sapiens
tctttacatactgatgagttctc

SEQ ID NO: 8038935 - DNA, 22 bp, Homo sapiens
tctttacacaagacaagaataa

SEQ ID NO: 8038936 - DNA, 22 bp, Homo sapiens
tctttacacaagacaagaataa

SEQ ID NO: 8038937 - DNA, 22 bp, Homo sapiens
tctttacacaagacaagaataa

SEQ ID NO: 8038938 - DNA, 22 bp, Homo sapiens
tctttacagtcctctgtcaatc

SEQ ID NO: 8038939 - DNA, 22 bp, Homo sapiens
tctttacagtcctctgtcaatc

SEQ ID NO: 8038940 - DNA, 22 bp, Homo sapiens
tctttacacaagacaagaataa

SEQ ID NO: 8038941 - DNA, 22 bp, Homo sapiens
tctttagaaacttttcttcatg

SEQ ID NO: 8038942 - DNA, 23 bp, Homo sapiens
tctttagaagaacatcagaaatg

SEQ ID NO: 8038943 - DNA, 22 bp, Homo sapiens
tctttagacatccagtttctct

SEQ ID NO: 8038944 - DNA, 23 bp, Homo sapiens
tctttagaagaacatcagaaatg

SEQ ID NO: 8038945 - DNA, 23 bp, Homo sapiens
tctttagaagaacatcagaaatg

SEQ ID NO: 8038946 - DNA, 22 bp, Homo sapiens
tctttacatcacaattgtatgg

SEQ ID NO: 8038947 - DNA, 22 bp, Homo sapiens
tctttacatcacaattgtatgg

SEQ ID NO: 8038948 - DNA, 22 bp, Homo sapiens
tctttacatcacaattgtatgg

SEQ ID NO: 8038949 - DNA, 22 bp, Homo sapiens
tctttagaaacttttcttcatg

SEQ ID NO: 8038950 - DNA, 22 bp, Homo sapiens
tctttacttgtgtattgtatat

SEQ ID NO: 8038951 - DNA, 22 bp, Homo sapiens
tctttactggaatggaactttc

SEQ ID NO: 8038952 - DNA, 22 bp, Homo sapiens
tctttacaagtcacattttctg

SEQ ID NO: 8038953 - DNA, 22 bp, Homo sapiens
tctttacaagtcacattttctg

SEQ ID NO: 8038954 - DNA, 22 bp, Homo sapiens
tctttacaatctaagcatagtt

SEQ ID NO: 8038955 - DNA, 22 bp, Homo sapiens
tctttacaatctaagcatagtt

SEQ ID NO: 8038956 - DNA, 22 bp, Homo sapiens
tctttacaatctaagcatagtt

SEQ ID NO: 8038957 - DNA, 22 bp, Homo sapiens
tctttacacaagacaagaataa

SEQ ID NO: 8038958 - DNA, 22 bp, Homo sapiens
tctttaatgtgattgtaattat

SEQ ID NO: 8038959 - DNA, 22 bp, Homo sapiens
tctttaattcagcatgatgcgg

SEQ ID NO: 8038960 - DNA, 21 bp, Homo sapiens
tcttggggaggagggctgcac

SEQ ID NO: 8038961 - DNA, 21 bp, Homo sapiens
tcttggggaggagggctgcac

SEQ ID NO: 8038962 - DNA, 22 bp, Homo sapiens
tctttaatgtactttctttcac

SEQ ID NO: 8038963 - DNA, 22 bp, Homo sapiens
tctttaatgtactttctttcac

SEQ ID NO: 8038964 - DNA, 22 bp, Homo sapiens
tcttgggcctcaccccagacat

SEQ ID NO: 8038965 - DNA, 22 bp, Homo sapiens
tcttgggcctcaccccagacat

SEQ ID NO: 8038966 - DNA, 22 bp, Homo sapiens
tcttgggcctttagacatgact

SEQ ID NO: 8038967 - DNA, 22 bp, Homo sapiens
tcttgggctagaatagcaggag

SEQ ID NO: 8038968 - DNA, 22 bp, Homo sapiens
tcttgggctagaatagcaggag

SEQ ID NO: 8038969 - DNA, 22 bp, Homo sapiens
tcttgggctgagagatggggta

SEQ ID NO: 8038970 - DNA, 22 bp, Homo sapiens
tctttaatatctgccccagagc

SEQ ID NO: 8038971 - DNA, 21 bp, Homo sapiens
tcttggggaggagggctgcac

SEQ ID NO: 8038972 - DNA, 21 bp, Homo sapiens
tcttggggaggagggctgcac

SEQ ID NO: 8038973 - DNA, 22 bp, Homo sapiens
tcttggaagtagaacacagtct

SEQ ID NO: 8038974 - DNA, 22 bp, Homo sapiens
tcttggaagtagaacacagtct

SEQ ID NO: 8038975 - DNA, 22 bp, Homo sapiens
tcttggaagtagaacacagtct

SEQ ID NO: 8038976 - DNA, 22 bp, Homo sapiens
tcttggaataccccgaaggtca

SEQ ID NO: 8038977 - DNA, 22 bp, Homo sapiens
tcttggaagtagaacacagtct

SEQ ID NO: 8038978 - DNA, 22 bp, Homo sapiens
tcttggaagtagaacacagtct

SEQ ID NO: 8038979 - DNA, 22 bp, Homo sapiens
tcttggactcaaaattgcctta

SEQ ID NO: 8038980 - DNA, 22 bp, Homo sapiens
tcttggaatctccatagagtga

SEQ ID NO: 8038981 - DNA, 22 bp, Homo sapiens
tcttggactagtcctaaatcca

SEQ ID NO: 8038982 - DNA, 22 bp, Homo sapiens
tcttggactcaaaattgcctta

SEQ ID NO: 8038983 - DNA, 22 bp, Homo sapiens
tcttggagaatggcagagaagc

SEQ ID NO: 8038984 - DNA, 22 bp, Homo sapiens
tcttggagaagggattgtgctc

SEQ ID NO: 8038985 - DNA, 22 bp, Homo sapiens
tcttggattttaatggatcaaa

SEQ ID NO: 8038986 - DNA, 22 bp, Homo sapiens
tcttggattttaatggatcaaa

SEQ ID NO: 8038987 - DNA, 22 bp, Homo sapiens
tcttggattttaatggatcaaa

SEQ ID NO: 8038988 - DNA, 22 bp, Homo sapiens
tcttggattttaatggatcaaa

SEQ ID NO: 8038989 - DNA, 22 bp, Homo sapiens
tcttggagtattgggcctcagg

SEQ ID NO: 8038990 - DNA, 16 bp, Homo sapiens
tcttggagttgttcct

SEQ ID NO: 8038991 - DNA, 16 bp, Homo sapiens
tcttggagttgttcct

SEQ ID NO: 8038992 - DNA, 20 bp, Homo sapiens
tcttggagctctttgtcctc

SEQ ID NO: 8038993 - DNA, 20 bp, Homo sapiens
tcttggagctctttgtcctc

SEQ ID NO: 8038994 - DNA, 22 bp, Homo sapiens
tcttggaggagagtaagtacct

SEQ ID NO: 8038995 - DNA, 22 bp, Homo sapiens
tcttggaggagagtaagtacct

SEQ ID NO: 8038996 - DNA, 18 bp, Homo sapiens
tcttggagtaatgatcaa

SEQ ID NO: 8038997 - DNA, 18 bp, Homo sapiens
tcttggagtaatgatcaa

SEQ ID NO: 8038998 - DNA, 18 bp, Homo sapiens
tcttggagtaatgatcaa

SEQ ID NO: 8038999 - DNA, 22 bp, Homo sapiens
tcttggagagccacccagtggc

SEQ ID NO: 8039000 - DNA, 22 bp, Homo sapiens
tcttggagactcttgtatattt

SEQ ID NO: 8039001 - DNA, 20 bp, Homo sapiens
tcttggagagggtggactta

SEQ ID NO: 8039002 - DNA, 20 bp, Homo sapiens
tcttggagagggtggactta

SEQ ID NO: 8039003 - DNA, 22 bp, Homo sapiens
tcttggagatgaccaggcatgc

SEQ ID NO: 8039004 - DNA, 22 bp, Homo sapiens
tcttggagatgaccaggcatgc

SEQ ID NO: 8039005 - DNA, 22 bp, Homo sapiens
tcttggagatagggtcttaatg

SEQ ID NO: 8039006 - DNA, 22 bp, Homo sapiens
tcttggagatagggtcttaatg

SEQ ID NO: 8039007 - DNA, 22 bp, Homo sapiens
tcttggagactcttgtatattt

SEQ ID NO: 8039008 - DNA, 22 bp, Homo sapiens
tcttggagactcttgtatattt

SEQ ID NO: 8039009 - DNA, 22 bp, Homo sapiens
tcttggagaatggcagagaagc

SEQ ID NO: 8039010 - DNA, 22 bp, Homo sapiens
tcttggagaatggcagagaagc

SEQ ID NO: 8039011 - DNA, 18 bp, Homo sapiens
tcttggcagcatctggca

SEQ ID NO: 8039012 - DNA, 22 bp, Homo sapiens
tcttggcagttcttgtgctttt

SEQ ID NO: 8039013 - DNA, 22 bp, Homo sapiens
tcttggccactaccacctggag

SEQ ID NO: 8039014 - DNA, 18 bp, Homo sapiens
tcttggcagcatctggca

SEQ ID NO: 8039015 - DNA, 18 bp, Homo sapiens
tcttggcagcatctggca

SEQ ID NO: 8039016 - DNA, 22 bp, Homo sapiens
tcttggattttaatggatcaaa

SEQ ID NO: 8039017 - DNA, 20 bp, Homo sapiens
tcttggcaaatgggagtgtc

SEQ ID NO: 8039018 - DNA, 20 bp, Homo sapiens
tcttggcaaatgggagtgtc

SEQ ID NO: 8039019 - DNA, 22 bp, Homo sapiens
tcttggccaggtgtggtgcctc

SEQ ID NO: 8039020 - DNA, 22 bp, Homo sapiens
tcttggccccaaccctctattt

SEQ ID NO: 8039021 - DNA, 22 bp, Homo sapiens
tcttggccaggtgtggtgcctc

SEQ ID NO: 8039022 - DNA, 22 bp, Homo sapiens
tcttggccagatgcacttcctc

SEQ ID NO: 8039023 - DNA, 17 bp, Homo sapiens
tcttggccagcttgctg

SEQ ID NO: 8039024 - DNA, 22 bp, Homo sapiens
tcttggccaggtgtggtgcctc

SEQ ID NO: 8039025 - DNA, 22 bp, Homo sapiens
tcttggctactttcctgtctgc

SEQ ID NO: 8039026 - DNA, 22 bp, Homo sapiens
tcttggctacttaggaggattc

SEQ ID NO: 8039027 - DNA, 22 bp, Homo sapiens
tcttggctactttcctgtctgc

SEQ ID NO: 8039028 - DNA, 22 bp, Homo sapiens
tcttggctagtaccttcctgcc

SEQ ID NO: 8039029 - DNA, 22 bp, Homo sapiens
tcttggctagtaccttcctgcc

SEQ ID NO: 8039030 - DNA, 22 bp, Homo sapiens
tcttggctatccaagttatcca

SEQ ID NO: 8039031 - DNA, 22 bp, Homo sapiens
tcttggctatccaagttatcca

SEQ ID NO: 8039032 - DNA, 22 bp, Homo sapiens
tcttgattaataccttagccct

SEQ ID NO: 8039033 - DNA, 22 bp, Homo sapiens
tcttgattacttattttgtgcc

SEQ ID NO: 8039034 - DNA, 19 bp, Homo sapiens
tcttgatgaggtttctcca

SEQ ID NO: 8039035 - DNA, 22 bp, Homo sapiens
tcttgatgctttttctaaatgt

SEQ ID NO: 8039036 - DNA, 22 bp, Homo sapiens
tcttgattgttttctgacctta

SEQ ID NO: 8039037 - DNA, 22 bp, Homo sapiens
tcttgaggtcatcatctgaaac

SEQ ID NO: 8039038 - DNA, 22 bp, Homo sapiens
tcttgagggatcttcagtgtgt

SEQ ID NO: 8039039 - DNA, 22 bp, Homo sapiens
tcttgaggtcatcatctgaaac

SEQ ID NO: 8039040 - DNA, 22 bp, Homo sapiens
tcttgaggttattaagctgtta

SEQ ID NO: 8039041 - DNA, 22 bp, Homo sapiens
tcttgaggttattaagctgtta

SEQ ID NO: 8039042 - DNA, 22 bp, Homo sapiens
tcttgagtgcgcttgggtgttc

SEQ ID NO: 8039043 - DNA, 22 bp, Homo sapiens
tcttgagatcaagacacaggga

SEQ ID NO: 8039044 - DNA, 19 bp, Homo sapiens
tcttgaggaaagtaaggca

SEQ ID NO: 8039045 - DNA, 22 bp, Homo sapiens
tcttgagagatatactactgaa

SEQ ID NO: 8039046 - DNA, 22 bp, Homo sapiens
tcttgagagatatactactgaa

SEQ ID NO: 8039047 - DNA, 22 bp, Homo sapiens
tcttgagagatatactactgaa

SEQ ID NO: 8039048 - DNA, 22 bp, Homo sapiens
tcttgagaagcggctgtctcag

SEQ ID NO: 8039049 - DNA, 22 bp, Homo sapiens
tcttgctgtgccccagcagggc

SEQ ID NO: 8039050 - DNA, 22 bp, Homo sapiens
tcttgctgtgtattgcatctcc

SEQ ID NO: 8039051 - DNA, 22 bp, Homo sapiens
tcttgctgttacagaattaaca

SEQ ID NO: 8039052 - DNA, 22 bp, Homo sapiens
tcttgcttgatacatggaggaa

SEQ ID NO: 8039053 - DNA, 20 bp, Homo sapiens
tcttggaaaaagttcagaat

SEQ ID NO: 8039054 - DNA, 19 bp, Homo sapiens
tcttgcttcttcatccctc

SEQ ID NO: 8039055 - DNA, 19 bp, Homo sapiens
tcttgcttcttcatccctc

SEQ ID NO: 8039056 - DNA, 19 bp, Homo sapiens
tcttgcttcttcatccctc

SEQ ID NO: 8039057 - DNA, 19 bp, Homo sapiens
tcttgcttcttcatccctc

SEQ ID NO: 8039058 - DNA, 22 bp, Homo sapiens
tcttgctaaagaccaacacatt

SEQ ID NO: 8039059 - DNA, 22 bp, Homo sapiens
tcttgctccacatgctgagatg

SEQ ID NO: 8039060 - DNA, 22 bp, Homo sapiens
tcttgctgaaaacaaatctctt

SEQ ID NO: 8039061 - DNA, 22 bp, Homo sapiens
tcttgctgtacggctacttgca

SEQ ID NO: 8039062 - DNA, 22 bp, Homo sapiens
tcttgctgtgccccagcagggc

SEQ ID NO: 8039063 - DNA, 22 bp, Homo sapiens
tcttgctgtgccccagcagggc

SEQ ID NO: 8039064 - DNA, 22 bp, Homo sapiens
tcttgctgagactggcaagttt

SEQ ID NO: 8039065 - DNA, 22 bp, Homo sapiens
tcttgctgctgtccacacagta

SEQ ID NO: 8039066 - DNA, 22 bp, Homo sapiens
tcttgctgagactggcaagttt

SEQ ID NO: 8039067 - DNA, 22 bp, Homo sapiens
tcttgaaagtatcttattttgt

SEQ ID NO: 8039068 - DNA, 22 bp, Homo sapiens
tcttgaaagtatcttattttgt

SEQ ID NO: 8039069 - DNA, 22 bp, Homo sapiens
tcttgaaagtatcttattttgt

SEQ ID NO: 8039070 - DNA, 22 bp, Homo sapiens
tcttgaaagtatcttattttgt

SEQ ID NO: 8039071 - DNA, 22 bp, Homo sapiens
tcttgaaagtatcttattttgt

SEQ ID NO: 8039072 - DNA, 22 bp, Homo sapiens
tcttgaaaggagattggaggca

SEQ ID NO: 8039073 - DNA, 22 bp, Homo sapiens
tcttgaaaggagattggaggca

SEQ ID NO: 8039074 - DNA, 22 bp, Homo sapiens
tcttgaaaggagattggaggca

SEQ ID NO: 8039075 - DNA, 22 bp, Homo sapiens
tcttgaagaggaagtggagtag

SEQ ID NO: 8039076 - DNA, 22 bp, Homo sapiens
tcttgaaggggggcagtgttga

SEQ ID NO: 8039077 - DNA, 22 bp, Homo sapiens
tcttgaagtcacacagaaagtg

SEQ ID NO: 8039078 - DNA, 22 bp, Homo sapiens
tcttgaagtccttacatttgat

SEQ ID NO: 8039079 - DNA, 22 bp, Homo sapiens
tcttgaataagtttcatgagct

SEQ ID NO: 8039080 - DNA, 22 bp, Homo sapiens
tcttgaagtcttatggtttaaa

SEQ ID NO: 8039081 - DNA, 22 bp, Homo sapiens
tcttgaataagtttcatgagct

SEQ ID NO: 8039082 - DNA, 22 bp, Homo sapiens
tcttgaattgtactcccataag

SEQ ID NO: 8039083 - DNA, 22 bp, Homo sapiens
tcttgaattgtactcccataag

SEQ ID NO: 8039084 - DNA, 22 bp, Homo sapiens
tcttgaattgtactcccataag

SEQ ID NO: 8039085 - DNA, 22 bp, Homo sapiens
tcttgaataagtttcatgagct

SEQ ID NO: 8039086 - DNA, 22 bp, Homo sapiens
tcttgaattgtactcccataag

SEQ ID NO: 8039087 - DNA, 22 bp, Homo sapiens
tcttgaattgtactcccataag

SEQ ID NO: 8039088 - DNA, 22 bp, Homo sapiens
tcttgaattgtactcccataag

SEQ ID NO: 8039089 - DNA, 22 bp, Homo sapiens
tcttgaatctaatgcagtttct

SEQ ID NO: 8039090 - DNA, 22 bp, Homo sapiens
tcttgagaaataattaaacatg

SEQ ID NO: 8039091 - DNA, 20 bp, Homo sapiens
tcttgagaacaatttctggc

SEQ ID NO: 8039092 - DNA, 20 bp, Homo sapiens
tcttgagaacaatttctggc

SEQ ID NO: 8039093 - DNA, 22 bp, Homo sapiens
tcttgagaagcggctgtctcag

SEQ ID NO: 8039094 - DNA, 22 bp, Homo sapiens
ttccaggaacaaactcacctta

SEQ ID NO: 8039095 - DNA, 22 bp, Homo sapiens
ttccaggaacaaactcacctta

SEQ ID NO: 8039096 - DNA, 22 bp, Homo sapiens
ttccaggaacaaactcacctta

SEQ ID NO: 8039097 - DNA, 22 bp, Homo sapiens
ttccaggaacaaactcacctta

SEQ ID NO: 8039098 - DNA, 22 bp, Homo sapiens
ttccaggaaaacagttggaagt

SEQ ID NO: 8039099 - DNA, 22 bp, Homo sapiens
actgttcatttgtcctgtatct

SEQ ID NO: 8039100 - DNA, 22 bp, Homo sapiens
actttcttcttatgcattaagg

SEQ ID NO: 8039101 - DNA, 22 bp, Homo sapiens
actttcttaggctgtataaatg

SEQ ID NO: 8039102 - DNA, 22 bp, Homo sapiens
aatatactatactactttctgg

SEQ ID NO: 8039103 - DNA, 22 bp, Homo sapiens
aatatagaatcactttccttca

SEQ ID NO: 8039104 - DNA, 22 bp, Homo sapiens
aatatagttctagaaatatttt

SEQ ID NO: 8039105 - DNA, 22 bp, Homo sapiens
actgttcatttggatttctctg

SEQ ID NO: 8039106 - DNA, 22 bp, Homo sapiens
agaaattcaattctaattagct

SEQ ID NO: 8039107 - DNA, 22 bp, Homo sapiens
agaaattctaagcatcaatagc

SEQ ID NO: 8039108 - DNA, 22 bp, Homo sapiens
agaacaatgaggtatggatgga

SEQ ID NO: 8039109 - DNA, 22 bp, Homo sapiens
aatgatgagaactggagtaatt

SEQ ID NO: 8039110 - DNA, 22 bp, Homo sapiens
aatgatggttaaacactggagg

SEQ ID NO: 8039111 - DNA, 22 bp, Homo sapiens
aatacatgttttctactattct

SEQ ID NO: 8039112 - DNA, 22 bp, Homo sapiens
actgagactttgttgagttctt

SEQ ID NO: 8039113 - DNA, 22 bp, Homo sapiens
actgcactccagcctgggtaac

SEQ ID NO: 8039114 - DNA, 22 bp, Homo sapiens
actgatacatctgtggaagtgg

SEQ ID NO: 8039115 - DNA, 22 bp, Homo sapiens
actcagagaatatctagaagga

SEQ ID NO: 8039116 - DNA, 23 bp, Homo sapiens
actccccagtctcttcttgccaa

SEQ ID NO: 8039117 - DNA, 22 bp, Homo sapiens
actatacattgaatgttaaggt

SEQ ID NO: 8039118 - DNA, 22 bp, Homo sapiens
aagtcgtggcaggcttgcacga

SEQ ID NO: 8039119 - DNA, 22 bp, Homo sapiens
acatttctgagcagggagctgt

SEQ ID NO: 8039120 - DNA, 22 bp, Homo sapiens
acatttctgcatgtagggtaat

SEQ ID NO: 8039121 - DNA, 22 bp, Homo sapiens
acatttctgtcttagggactgt

SEQ ID NO: 8039122 - DNA, 22 bp, Homo sapiens
acatttctgctagaataggtga

SEQ ID NO: 8039123 - DNA, 22 bp, Homo sapiens
acatttcttccctttagcagaa

SEQ ID NO: 8039124 - DNA, 22 bp, Homo sapiens
acatttcttagcctagttccag

SEQ ID NO: 8039125 - DNA, 22 bp, Homo sapiens
acatttcttccacatgctgctg

SEQ ID NO: 8039126 - DNA, 22 bp, Homo sapiens
acagtcttcagaagggattggg

SEQ ID NO: 8039127 - DNA, 22 bp, Homo sapiens
aagctggaacatcttgaggaag

SEQ ID NO: 8039128 - DNA, 22 bp, Homo sapiens
aagccctgggatgttcagcagt

SEQ ID NO: 8039129 - DNA, 22 bp, Homo sapiens
aagccctggctcagctcaccag

SEQ ID NO: 8039130 - DNA, 22 bp, Homo sapiens
aattgcaaattcagacttaaga

SEQ ID NO: 8039131 - DNA, 20 bp, Homo sapiens
agaggcttccttgggaggag

SEQ ID NO: 8039132 - DNA, 22 bp, Homo sapiens
agaggcttctcggatggggcag

SEQ ID NO: 8039133 - DNA, 22 bp, Homo sapiens
acaagattttatgactcttttt

SEQ ID NO: 8039134 - DNA, 23 bp, Homo sapiens
acaagatagggataaaaagataa

SEQ ID NO: 8039135 - DNA, 22 bp, Homo sapiens
acaacacatgtgtatatgtgtg

SEQ ID NO: 8039136 - DNA, 22 bp, Homo sapiens
acaacacatgtgtatatgtgtg

SEQ ID NO: 8039137 - DNA, 22 bp, Homo sapiens
agataacatttattgaatgtaa

SEQ ID NO: 8039138 - DNA, 22 bp, Homo sapiens
acaagagattatctacagatga

SEQ ID NO: 8039139 - DNA, 22 bp, Homo sapiens
acaagagcattgcaggtgtgtt

SEQ ID NO: 8039140 - DNA, 22 bp, Homo sapiens
aatgtaaaatatcttgtacttg

SEQ ID NO: 8039141 - DNA, 22 bp, Homo sapiens
aatggagacttcaaaatggatt

SEQ ID NO: 8039142 - DNA, 22 bp, Homo sapiens
aatggcaattcagtgaaattat

SEQ ID NO: 8039143 - DNA, 20 bp, Homo sapiens
agacaatgagtgacagagtt

SEQ ID NO: 8039144 - DNA, 22 bp, Homo sapiens
agacaatggagagcagagtact

SEQ ID NO: 8039145 - DNA, 22 bp, Homo sapiens
agagacaggatatctgctcatg

SEQ ID NO: 8039146 - DNA, 22 bp, Homo sapiens
agaccctggtaaacactccagg

SEQ ID NO: 8039147 - DNA, 18 bp, Homo sapiens
agagacagcagcaaaaga

SEQ ID NO: 8039148 - DNA, 22 bp, Homo sapiens
agagacaggaatggcattaaga

SEQ ID NO: 8039149 - DNA, 22 bp, Homo sapiens
agagacaggagttctgtttcca

SEQ ID NO: 8039150 - DNA, 22 bp, Homo sapiens
agagacagatctgagggacctc

SEQ ID NO: 8039151 - DNA, 22 bp, Homo sapiens
acagacaagtagttcagacaag

SEQ ID NO: 8039152 - DNA, 22 bp, Homo sapiens
acagagactgggagcaagaggc

SEQ ID NO: 8039153 - DNA, 22 bp, Homo sapiens
acagactgtttggttcatgtct

SEQ ID NO: 8039154 - DNA, 22 bp, Homo sapiens
agccagggtctctcgctctgtt

SEQ ID NO: 8039155 - DNA, 22 bp, Homo sapiens
acagatgatgtgcacagataga

SEQ ID NO: 8039156 - DNA, 22 bp, Homo sapiens
acagatgatttttatgaaaaca

SEQ ID NO: 8039157 - DNA, 22 bp, Homo sapiens
agcctcctgtagccctcaccca

SEQ ID NO: 8039158 - DNA, 22 bp, Homo sapiens
acagagccactttggtgcctac

SEQ ID NO: 8039159 - DNA, 22 bp, Homo sapiens
agcctctgactgtcagcaaggt

SEQ ID NO: 8039160 - DNA, 22 bp, Homo sapiens
acacagagtccttactgaggta

SEQ ID NO: 8039161 - DNA, 22 bp, Homo sapiens
acactgaatgtttaagaacttg

SEQ ID NO: 8039162 - DNA, 19 bp, Homo sapiens
acactgaatgtagaattgg

SEQ ID NO: 8039163 - DNA, 22 bp, Homo sapiens
acactgaatatacaatgaatat

SEQ ID NO: 8039164 - DNA, 22 bp, Homo sapiens
aaaaactggtaactattcccca

SEQ ID NO: 8039165 - DNA, 18 bp, Homo sapiens
aaaaagtgctcaggccta

SEQ ID NO: 8039166 - DNA, 22 bp, Homo sapiens
aaaaagtctgcaaaggaggttg

SEQ ID NO: 8039167 - DNA, 22 bp, Homo sapiens
aaaactgtatcttcttgggact

SEQ ID NO: 8039168 - DNA, 22 bp, Homo sapiens
aaaactgtaggaattgggtgcc

SEQ ID NO: 8039169 - DNA, 20 bp, Homo sapiens
aaagagcccttggagcaggc

SEQ ID NO: 8039170 - DNA, 21 bp, Homo sapiens
aaagagcccgctgagaggttc

SEQ ID NO: 8039171 - DNA, 22 bp, Homo sapiens
aaaattctgtcattaaattgtg

SEQ ID NO: 8039172 - DNA, 22 bp, Homo sapiens
aaaattcattcctcagactgcc

SEQ ID NO: 8039173 - DNA, 22 bp, Homo sapiens
aaacactagcaggaagcactga

SEQ ID NO: 8039174 - DNA, 22 bp, Homo sapiens
aaacacaagatggcctcttctg

SEQ ID NO: 8039175 - DNA, 22 bp, Homo sapiens
aaacattccatttctatgtaag

SEQ ID NO: 8039176 - DNA, 22 bp, Homo sapiens
aaacattccatatataccttgt

SEQ ID NO: 8039177 - DNA, 20 bp, Homo sapiens
aaacattcatgtacaagtga

SEQ ID NO: 8039178 - DNA, 22 bp, Homo sapiens
aaactgtaggagggaaaggaag

SEQ ID NO: 8039179 - DNA, 22 bp, Homo sapiens
aaactgtaagagaataaactac

SEQ ID NO: 8039180 - DNA, 22 bp, Homo sapiens
aaactgtaaagcaggtgagtag

SEQ ID NO: 8039181 - DNA, 22 bp, Homo sapiens
aaactgtaaatactagtaagtg

SEQ ID NO: 8039182 - DNA, 22 bp, Homo sapiens
aaagacatgacacattggagag

SEQ ID NO: 8039183 - DNA, 22 bp, Homo sapiens
aaagactggtgtgttacatata

SEQ ID NO: 8039184 - DNA, 22 bp, Homo sapiens
aaagactgggactgcagcaggc

SEQ ID NO: 8039185 - DNA, 23 bp, Homo sapiens
aaagactgctgagaattttagga

SEQ ID NO: 8039186 - DNA, 22 bp, Homo sapiens
aaagactgcaaaaacgcacaga

SEQ ID NO: 8039187 - DNA, 22 bp, Homo sapiens
aaagactttcacctagcaaaga

SEQ ID NO: 8039188 - DNA, 22 bp, Homo sapiens
aaagacttgggagcagtatgct

SEQ ID NO: 8039189 - DNA, 22 bp, Homo sapiens
aagcccttggcgcacaccgggc

SEQ ID NO: 8039190 - DNA, 22 bp, Homo sapiens
aagccctgttaggcactgggga

SEQ ID NO: 8039191 - DNA, 22 bp, Homo sapiens
aagccctggggttgcacaaggc

SEQ ID NO: 8039192 - DNA, 22 bp, Homo sapiens
aagatatgaggtcacctgctgg

SEQ ID NO: 8039193 - DNA, 19 bp, Homo sapiens
aagatatgctagcccagag

SEQ ID NO: 8039194 - DNA, 22 bp, Homo sapiens
aagactgtgtctatggctactc

SEQ ID NO: 8039195 - DNA, 22 bp, Homo sapiens
aagactgtctgggacaagatga

SEQ ID NO: 8039196 - DNA, 22 bp, Homo sapiens
aagactgtatgagacaatataa

SEQ ID NO: 8039197 - DNA, 22 bp, Homo sapiens
aagactgtacattttccagtct

SEQ ID NO: 8039198 - DNA, 22 bp, Homo sapiens
aaagcagcaaatacttttgcac

SEQ ID NO: 8039199 - DNA, 22 bp, Homo sapiens
aacactgtggtcttttcagtaa

SEQ ID NO: 8039200 - DNA, 20 bp, Homo sapiens
aacactgtgcgtggtaggtg

SEQ ID NO: 8039201 - DNA, 22 bp, Homo sapiens
aagaacatgagttatgatgatt

SEQ ID NO: 8039202 - DNA, 22 bp, Homo sapiens
aagaacatgaacacaatgttta

SEQ ID NO: 8039203 - DNA, 22 bp, Homo sapiens
aactgtaatttttacatagtaa

SEQ ID NO: 8039204 - DNA, 22 bp, Homo sapiens
aactgtaatgaattgttcatga

SEQ ID NO: 8039205 - DNA, 22 bp, Homo sapiens
aactgtacgataataaatttgt

SEQ ID NO: 8039206 - DNA, 22 bp, Homo sapiens
aactgtaaaggttgagtggtaa

SEQ ID NO: 8039207 - DNA, 22 bp, Homo sapiens
aactgtaagacaaatgacttct

SEQ ID NO: 8039208 - DNA, 22 bp, Homo sapiens
aactgtaaggcttagaacagca

SEQ ID NO: 8039209 - DNA, 22 bp, Homo sapiens
aaccccaggctggaggagtctc

SEQ ID NO: 8039210 - DNA, 21 bp, Homo sapiens
acagcagagatcaagactaag

SEQ ID NO: 8039211 - DNA, 22 bp, Homo sapiens
aagcagaggaccgacggaggga

SEQ ID NO: 8039212 - DNA, 22 bp, Homo sapiens
aagcacctctatgattgctttt

SEQ ID NO: 8039213 - DNA, 22 bp, Homo sapiens
aagagcactaacagagctgata

SEQ ID NO: 8039214 - DNA, 21 bp, Homo sapiens
aagagacatttctcatcagca

SEQ ID NO: 8039215 - DNA, 22 bp, Homo sapiens
aagagactggaaactagggtca

SEQ ID NO: 8039216 - DNA, 22 bp, Homo sapiens
aagagaatacaagcaggcagga

SEQ ID NO: 8039217 - DNA, 22 bp, Homo sapiens
aagaaactgttgcgtgacagcg

SEQ ID NO: 8039218 - DNA, 22 bp, Homo sapiens
aagaaactgaaagtggcttcat

SEQ ID NO: 8039219 - DNA, 22 bp, Homo sapiens
aagaaaatcagttctggtcagt

SEQ ID NO: 8039220 - DNA, 20 bp, Homo sapiens
aagaaacttgaaagtacaag

SEQ ID NO: 8039221 - DNA, 22 bp, Homo sapiens
aattctcaggtaaaagttaagt

SEQ ID NO: 8039222 - DNA, 22 bp, Homo sapiens
aagaaattaatgtgccattact

SEQ ID NO: 8039223 - DNA, 22 bp, Homo sapiens
aacacagggggttacaaattgt

SEQ ID NO: 8039224 - DNA, 22 bp, Homo sapiens
aacagaatagttgatgtacagt

SEQ ID NO: 8039225 - DNA, 22 bp, Homo sapiens
aaattcacaagagcattgcctg

SEQ ID NO: 8039226 - DNA, 21 bp, Homo sapiens
aaattcacctagtaaaacttc

SEQ ID NO: 8039227 - DNA, 22 bp, Homo sapiens
aacatgaaaacctccacagcaa

SEQ ID NO: 8039228 - DNA, 22 bp, Homo sapiens
aacatgtagcagaaacgactaa

SEQ ID NO: 8039229 - DNA, 22 bp, Homo sapiens
aatgaacaaatggtgctgcttg

SEQ ID NO: 8039230 - DNA, 22 bp, Homo sapiens
aggccctgttatgagccactgt

SEQ ID NO: 8039231 - DNA, 22 bp, Homo sapiens
acatggagaccagatggaagta

SEQ ID NO: 8039232 - DNA, 22 bp, Homo sapiens
acatgagaggctgtggagtaca

SEQ ID NO: 8039233 - DNA, 22 bp, Homo sapiens
agggaagaatcactgggatgtt

SEQ ID NO: 8039234 - DNA, 22 bp, Homo sapiens
aggctggatttatggggacttc

SEQ ID NO: 8039235 - DNA, 22 bp, Homo sapiens
acagttattctttatgcaacca

SEQ ID NO: 8039236 - DNA, 22 bp, Homo sapiens
acataaaggtgactaacatctt

SEQ ID NO: 8039237 - DNA, 22 bp, Homo sapiens
acagttttttcaacattggaat

SEQ ID NO: 8039238 - DNA, 20 bp, Homo sapiens
aggaggaaaaaatgacgagc

SEQ ID NO: 8039239 - DNA, 22 bp, Homo sapiens
acaggtggggcacttggagcct

SEQ ID NO: 8039240 - DNA, 22 bp, Homo sapiens
acaggtggtaaaatggactgtc

SEQ ID NO: 8039241 - DNA, 22 bp, Homo sapiens
acaggtggcttattggctgatt

SEQ ID NO: 8039242 - DNA, 22 bp, Homo sapiens
acaggtggccccgagggagtgg

SEQ ID NO: 8039243 - DNA, 22 bp, Homo sapiens
acaggtggtagagtggaaagag

SEQ ID NO: 8039244 - DNA, 22 bp, Homo sapiens
acaggtggaggctttaggaggt

SEQ ID NO: 8039245 - DNA, 18 bp, Homo sapiens
acaggctgtgggaatggt

SEQ ID NO: 8039246 - DNA, 22 bp, Homo sapiens
aggaagggctgtttctccaaga

SEQ ID NO: 8039247 - DNA, 22 bp, Homo sapiens
acaggcctcaagacacccaggt

SEQ ID NO: 8039248 - DNA, 22 bp, Homo sapiens
actgtaaattttggttgcaggt

SEQ ID NO: 8039249 - DNA, 22 bp, Homo sapiens
agtttccttggattcaatttgg

SEQ ID NO: 8039250 - DNA, 22 bp, Homo sapiens
agtttctaacatatagcattgg

SEQ ID NO: 8039251 - DNA, 22 bp, Homo sapiens
agtttccttgggcatttgttta

SEQ ID NO: 8039252 - DNA, 22 bp, Homo sapiens
actgtaaaatgagatatgtata

SEQ ID NO: 8039253 - DNA, 22 bp, Homo sapiens
actgtaaaatacataagtattg

SEQ ID NO: 8039254 - DNA, 19 bp, Homo sapiens
actggcagctgtagtctgt

SEQ ID NO: 8039255 - DNA, 22 bp, Homo sapiens
actggcaggctgctggccggcg

SEQ ID NO: 8039256 - DNA, 20 bp, Homo sapiens
actggcagcctgcctgctgt

SEQ ID NO: 8039257 - DNA, 22 bp, Homo sapiens
actggcagctgtaggatgcatg

SEQ ID NO: 8039258 - DNA, 22 bp, Homo sapiens
actggcagtggcagcagaaaga

SEQ ID NO: 8039259 - DNA, 22 bp, Homo sapiens
actggcagtagagggagcgcat

SEQ ID NO: 8039260 - DNA, 19 bp, Homo sapiens
actggcagggctgcggtgg

SEQ ID NO: 8039261 - DNA, 22 bp, Homo sapiens
actggcagggggagccccgaga

SEQ ID NO: 8039262 - DNA, 22 bp, Homo sapiens
actggcaggtccatcgcccttt

SEQ ID NO: 8039263 - DNA, 22 bp, Homo sapiens
actggcagtttgagaatgcatt

SEQ ID NO: 8039264 - DNA, 22 bp, Homo sapiens
actggcagtttgagaatgcatt

SEQ ID NO: 8039265 - DNA, 22 bp, Homo sapiens
actggcagtgtcgtttacatga

SEQ ID NO: 8039266 - DNA, 22 bp, Homo sapiens
actggcagtggcagcagaaaga

SEQ ID NO: 8039267 - DNA, 22 bp, Homo sapiens
actggcagtgtcgtttacatga

SEQ ID NO: 8039268 - DNA, 19 bp, Homo sapiens
actggcagtttctgcatgg

SEQ ID NO: 8039269 - DNA, 22 bp, Homo sapiens
atataatagtttcataaaggct

SEQ ID NO: 8039270 - DNA, 22 bp, Homo sapiens
atataatagtttcataaaggct

SEQ ID NO: 8039271 - DNA, 22 bp, Homo sapiens
agaaaatttattcatgttagtt

SEQ ID NO: 8039272 - DNA, 22 bp, Homo sapiens
agaaaatttaaagagacacaca

SEQ ID NO: 8039273 - DNA, 22 bp, Homo sapiens
agaaaattagattttactgtgt

SEQ ID NO: 8039274 - DNA, 22 bp, Homo sapiens
actggcagagaccctgatggcc

SEQ ID NO: 8039275 - DNA, 22 bp, Homo sapiens
actggcagaactggtgattgtc

SEQ ID NO: 8039276 - DNA, 22 bp, Homo sapiens
actggcagaattgaatagttgt

SEQ ID NO: 8039277 - DNA, 22 bp, Homo sapiens
actggcagaacgtgatgcgggt

SEQ ID NO: 8039278 - DNA, 22 bp, Homo sapiens
actggcagaggatagcactaat

SEQ ID NO: 8039279 - DNA, 22 bp, Homo sapiens
actggcagaggttggacaccat

SEQ ID NO: 8039280 - DNA, 22 bp, Homo sapiens
actggcagagggaaaaccattc

SEQ ID NO: 8039281 - DNA, 22 bp, Homo sapiens
actggcagcagcagcccttggg

SEQ ID NO: 8039282 - DNA, 22 bp, Homo sapiens
actggcagccacaactggcagg

SEQ ID NO: 8039283 - DNA, 22 bp, Homo sapiens
actaaaaactactgccaatagc

SEQ ID NO: 8039284 - DNA, 22 bp, Homo sapiens
acctgccttctcaaggacatga

SEQ ID NO: 8039285 - DNA, 22 bp, Homo sapiens
agaatgataatgccatgatgga

SEQ ID NO: 8039286 - DNA, 22 bp, Homo sapiens
agaatgtaagaatgcaaagatt

SEQ ID NO: 8039287 - DNA, 22 bp, Homo sapiens
agacacagctgcaggaggtggg

SEQ ID NO: 8039288 - DNA, 22 bp, Homo sapiens
agacacagtctgtctggaggag

SEQ ID NO: 8039289 - DNA, 22 bp, Homo sapiens
agaagaatacttgatgttcatg

SEQ ID NO: 8039290 - DNA, 22 bp, Homo sapiens
agaagaatacttgatgttcatg

SEQ ID NO: 8039291 - DNA, 22 bp, Homo sapiens
agaagaatttctctcatgattt

SEQ ID NO: 8039292 - DNA, 22 bp, Homo sapiens
atggagtggggactgcagtgga

SEQ ID NO: 8039293 - DNA, 22 bp, Homo sapiens
attaaacaatgtaaagttcttg

SEQ ID NO: 8039294 - DNA, 22 bp, Homo sapiens
agagggatcaccctgtttctgg

SEQ ID NO: 8039295 - DNA, 22 bp, Homo sapiens
agagggtgctggagagacattg

SEQ ID NO: 8039296 - DNA, 22 bp, Homo sapiens
agcaaacagtgtgctaagaaat

SEQ ID NO: 8039297 - DNA, 22 bp, Homo sapiens
agatgaatccacacatggcaaa

SEQ ID NO: 8039298 - DNA, 22 bp, Homo sapiens
atttattattgtggttacttct

SEQ ID NO: 8039299 - DNA, 22 bp, Homo sapiens
atttaacaagacagagaactgg

SEQ ID NO: 8039300 - DNA, 18 bp, Homo sapiens
atttaatgaactgaaagc

SEQ ID NO: 8039301 - DNA, 22 bp, Homo sapiens
agcataaaggtcaacgttttag

SEQ ID NO: 8039302 - DNA, 22 bp, Homo sapiens
caccagggccccaggctgtgcc

SEQ ID NO: 8039303 - DNA, 22 bp, Homo sapiens
cacagtccagactcctggagtt

SEQ ID NO: 8039304 - DNA, 22 bp, Homo sapiens
cacaggagggagcgggcagcca

SEQ ID NO: 8039305 - DNA, 22 bp, Homo sapiens
cacagtatcttttgagtaagca

SEQ ID NO: 8039306 - DNA, 22 bp, Homo sapiens
cacagtattcactgggcagatt

SEQ ID NO: 8039307 - DNA, 22 bp, Homo sapiens
caatgacactctgcacagtgct

SEQ ID NO: 8039308 - DNA, 22 bp, Homo sapiens
caatgaacacagcaatttcata

SEQ ID NO: 8039309 - DNA, 22 bp, Homo sapiens
cacaggagctgtggggcagtgt

SEQ ID NO: 8039310 - DNA, 22 bp, Homo sapiens
agcaaacattcagcagattggc

SEQ ID NO: 8039311 - DNA, 22 bp, Homo sapiens
caactgaactgatatcaactat

SEQ ID NO: 8039312 - DNA, 22 bp, Homo sapiens
cagcagagcttattaactaaaa

SEQ ID NO: 8039313 - DNA, 22 bp, Homo sapiens
agccctccaaaggttgggggag

SEQ ID NO: 8039314 - DNA, 22 bp, Homo sapiens
agccctcctcacatcagcgtcc

SEQ ID NO: 8039315 - DNA, 22 bp, Homo sapiens
cagccctgggtccctgccctgg

SEQ ID NO: 8039316 - DNA, 22 bp, Homo sapiens
cagccctggctagggcgagggc

SEQ ID NO: 8039317 - DNA, 22 bp, Homo sapiens
cagccctggcgcccccagatct

SEQ ID NO: 8039318 - DNA, 22 bp, Homo sapiens
agccttctaggatgtcatctgc

SEQ ID NO: 8039319 - DNA, 22 bp, Homo sapiens
cagagaggatggattccatagc

SEQ ID NO: 8039320 - DNA, 22 bp, Homo sapiens
cagagagggcggccctggcttc

SEQ ID NO: 8039321 - DNA, 22 bp, Homo sapiens
cagaagaatggtgtctgagctc

SEQ ID NO: 8039322 - DNA, 22 bp, Homo sapiens
cagacagaaggctccttgaggt

SEQ ID NO: 8039323 - DNA, 22 bp, Homo sapiens
cactgaaaggaaaccagagcat

SEQ ID NO: 8039324 - DNA, 22 bp, Homo sapiens
agctggctgccttctccttagg

SEQ ID NO: 8039325 - DNA, 22 bp, Homo sapiens
agctggcatactttgctaggaa

SEQ ID NO: 8039326 - DNA, 23 bp, Homo sapiens
agctctgctcgggcatgccctgc

SEQ ID NO: 8039327 - DNA, 23 bp, Homo sapiens
agctgggaattttctgaagcttt

SEQ ID NO: 8039328 - DNA, 22 bp, Homo sapiens
aggaaatgctgatgctcctgga

SEQ ID NO: 8039329 - DNA, 22 bp, Homo sapiens
aggaaagatggaaggaggataa

SEQ ID NO: 8039330 - DNA, 22 bp, Homo sapiens
aggaaagatggaaggaggataa

SEQ ID NO: 8039331 - DNA, 18 bp, Homo sapiens
aggaaagacgaagagggc

SEQ ID NO: 8039332 - DNA, 19 bp, Homo sapiens
aggagccttgagcagtgag

SEQ ID NO: 8039333 - DNA, 22 bp, Homo sapiens
cagtctctgtgccagatcctgg

SEQ ID NO: 8039334 - DNA, 22 bp, Homo sapiens
aggcacaggaggtggtaagaag

SEQ ID NO: 8039335 - DNA, 22 bp, Homo sapiens
cattccacactgcaggaaatat

SEQ ID NO: 8039336 - DNA, 22 bp, Homo sapiens
cctccccacagcccaggagact

SEQ ID NO: 8039337 - DNA, 22 bp, Homo sapiens
cctctccttgcacccgtcccgc

SEQ ID NO: 8039338 - DNA, 22 bp, Homo sapiens
cctcagagaaatgtctattcaa

SEQ ID NO: 8039339 - DNA, 22 bp, Homo sapiens
cctcaaaggcctggcaccagaa

SEQ ID NO: 8039340 - DNA, 22 bp, Homo sapiens
cccagcctctgtttgctcctct

SEQ ID NO: 8039341 - DNA, 22 bp, Homo sapiens
agggaagcttgttactgagaag

SEQ ID NO: 8039342 - DNA, 22 bp, Homo sapiens
agggaagaagctggtagtaggt

SEQ ID NO: 8039343 - DNA, 22 bp, Homo sapiens
agggagccaggaacgcaggtcg

SEQ ID NO: 8039344 - DNA, 22 bp, Homo sapiens
aggccccaaagcagtgcaagta

SEQ ID NO: 8039345 - DNA, 22 bp, Homo sapiens
ccactgctctgccaggagctgg

SEQ ID NO: 8039346 - DNA, 22 bp, Homo sapiens
aggcagtggagctggaataggc

SEQ ID NO: 8039347 - DNA, 22 bp, Homo sapiens
ccaggccctgctcctcacacca

SEQ ID NO: 8039348 - DNA, 22 bp, Homo sapiens
aggctccttgctcacaggctca

SEQ ID NO: 8039349 - DNA, 22 bp, Homo sapiens
aggctcccatggtgtggcagga

SEQ ID NO: 8039350 - DNA, 21 bp, Homo sapiens
aggctcccagaaatgggcatc

SEQ ID NO: 8039351 - DNA, 22 bp, Homo sapiens
aggcctccagccacatgccagt

SEQ ID NO: 8039352 - DNA, 22 bp, Homo sapiens
atcacatatttaagaaacatgt

SEQ ID NO: 8039353 - DNA, 22 bp, Homo sapiens
atcatgtaccctaaaaatggaa

SEQ ID NO: 8039354 - DNA, 22 bp, Homo sapiens
atcatgtacttgacaaatatgt

SEQ ID NO: 8039355 - DNA, 22 bp, Homo sapiens
atataatacaacctgctaagtg

SEQ ID NO: 8039356 - DNA, 22 bp, Homo sapiens
atatataacctggataaggctt

SEQ ID NO: 8039357 - DNA, 22 bp, Homo sapiens
atatggcagaccaattagaagc

SEQ ID NO: 8039358 - DNA, 22 bp, Homo sapiens
atatgattgtccttagcaaatt

SEQ ID NO: 8039359 - DNA, 19 bp, Homo sapiens
atatatgtatacaatgtgg

SEQ ID NO: 8039360 - DNA, 22 bp, Homo sapiens
ataatacatggttgatcttttc

SEQ ID NO: 8039361 - DNA, 22 bp, Homo sapiens
ctgcccagaatcactcactcga

SEQ ID NO: 8039362 - DNA, 22 bp, Homo sapiens
ctgcccagaagcttagagctta

SEQ ID NO: 8039363 - DNA, 22 bp, Homo sapiens
atacaagactcagcacagacgg

SEQ ID NO: 8039364 - DNA, 22 bp, Homo sapiens
atacaagatcactccagaaaat

SEQ ID NO: 8039365 - DNA, 22 bp, Homo sapiens
ctggagccccagacagggagag

SEQ ID NO: 8039366 - DNA, 22 bp, Homo sapiens
agttgggagttatagactctat

SEQ ID NO: 8039367 - DNA, 22 bp, Homo sapiens
ataaagtagccactggaaagct

SEQ ID NO: 8039368 - DNA, 20 bp, Homo sapiens
ataaaataactgccacaaga

SEQ ID NO: 8039369 - DNA, 22 bp, Homo sapiens
cctggctggtggcagcgacaag

SEQ ID NO: 8039370 - DNA, 22 bp, Homo sapiens
cctggcagctgtttggcttggc

SEQ ID NO: 8039371 - DNA, 22 bp, Homo sapiens
cctggcagctccgtggccttcc

SEQ ID NO: 8039372 - DNA, 22 bp, Homo sapiens
cctggcagctaagtgctttgag

SEQ ID NO: 8039373 - DNA, 22 bp, Homo sapiens
cctggcagctcctccccggcgg

SEQ ID NO: 8039374 - DNA, 22 bp, Homo sapiens
cctggcagctcctccccggcgg

SEQ ID NO: 8039375 - DNA, 22 bp, Homo sapiens
cctggcagcccagagcgccgct

SEQ ID NO: 8039376 - DNA, 22 bp, Homo sapiens
cctggcagcctcagccaattct

SEQ ID NO: 8039377 - DNA, 22 bp, Homo sapiens
cctggcagcgtgccgagctgcg

SEQ ID NO: 8039378 - DNA, 22 bp, Homo sapiens
cctggcagcgccgaagctggcc

SEQ ID NO: 8039379 - DNA, 22 bp, Homo sapiens
cctctgcacttcaccttagctc

SEQ ID NO: 8039380 - DNA, 22 bp, Homo sapiens
cctgccctatgaccagcttcac

SEQ ID NO: 8039381 - DNA, 22 bp, Homo sapiens
cctgccctagagatgacacaat

SEQ ID NO: 8039382 - DNA, 22 bp, Homo sapiens
cctctgccacctcccacgaggc

SEQ ID NO: 8039383 - DNA, 19 bp, Homo sapiens
ccttgcctgtccctgcagc

SEQ ID NO: 8039384 - DNA, 22 bp, Homo sapiens
ctcctgaggacttctattgggt

SEQ ID NO: 8039385 - DNA, 22 bp, Homo sapiens
ctcctgaggaaaagcttggtca

SEQ ID NO: 8039386 - DNA, 22 bp, Homo sapiens
ctctgctgcaggaaggcgtgca

SEQ ID NO: 8039387 - DNA, 22 bp, Homo sapiens
agtggctttttagtggcagatg

SEQ ID NO: 8039388 - DNA, 22 bp, Homo sapiens
ctcagctccaggtgtgcatctt

SEQ ID NO: 8039389 - DNA, 22 bp, Homo sapiens
ctcagctccagccctcagcagc

SEQ ID NO: 8039390 - DNA, 21 bp, Homo sapiens
agtgacagaggaaggtgcata

SEQ ID NO: 8039391 - DNA, 22 bp, Homo sapiens
ctcagaatctgccaagttcagg

SEQ ID NO: 8039392 - DNA, 22 bp, Homo sapiens
ctcagaggtcaagagcagagct

SEQ ID NO: 8039393 - DNA, 22 bp, Homo sapiens
gggatgagagtagggtgtgaaa

SEQ ID NO: 8039394 - DNA, 22 bp, Homo sapiens
cagacagggacctcgctccaga

SEQ ID NO: 8039395 - DNA, 22 bp, Homo sapiens
cagagcccatcctatactctcc

SEQ ID NO: 8039396 - DNA, 22 bp, Homo sapiens
cagcattgccctttttctcaga

SEQ ID NO: 8039397 - DNA, 22 bp, Homo sapiens
ggttccttctgaggtccctgta

SEQ ID NO: 8039398 - DNA, 22 bp, Homo sapiens
ggttcccggatctccgagtccc

SEQ ID NO: 8039399 - DNA, 22 bp, Homo sapiens
gtatgaaaattgtaaagttctt

SEQ ID NO: 8039400 - DNA, 22 bp, Homo sapiens
caaggacactgatgttcatcct

SEQ ID NO: 8039401 - DNA, 22 bp, Homo sapiens
caagatcaaggtatcagcagat

SEQ ID NO: 8039402 - DNA, 22 bp, Homo sapiens
caagatcaaggtgtcagcaggt

SEQ ID NO: 8039403 - DNA, 22 bp, Homo sapiens
caagatatgtcctgttactaag

SEQ ID NO: 8039404 - DNA, 22 bp, Homo sapiens
caagatatgtgttgttagctct

SEQ ID NO: 8039405 - DNA, 22 bp, Homo sapiens
caagatatatgtatgattccat

SEQ ID NO: 8039406 - DNA, 22 bp, Homo sapiens
gctgcagtgagccaagatcgtg

SEQ ID NO: 8039407 - DNA, 22 bp, Homo sapiens
caacatttcaaggtctttagga

SEQ ID NO: 8039408 - DNA, 22 bp, Homo sapiens
gctgcagatcccacccattccc

SEQ ID NO: 8039409 - DNA, 22 bp, Homo sapiens
cacaatttccaagtcatgttat

SEQ ID NO: 8039410 - DNA, 18 bp, Homo sapiens
cacaatttacagatgaca

SEQ ID NO: 8039411 - DNA, 22 bp, Homo sapiens
cacaatttccttgcttcacttt

SEQ ID NO: 8039412 - DNA, 22 bp, Homo sapiens
cacaatttggacttcactggtt

SEQ ID NO: 8039413 - DNA, 21 bp, Homo sapiens
ggaaaattccatacacccacg

SEQ ID NO: 8039414 - DNA, 22 bp, Homo sapiens
ggaaaattggcgcgtggggctg

SEQ ID NO: 8039415 - DNA, 21 bp, Homo sapiens
ggaaaattcagagtgcaattt

SEQ ID NO: 8039416 - DNA, 22 bp, Homo sapiens
cacaatattggccgggctggtc

SEQ ID NO: 8039417 - DNA, 22 bp, Homo sapiens
caaggattaatagaatgaatca

SEQ ID NO: 8039418 - DNA, 23 bp, Homo sapiens
gctgtacaggaaccagtttggag

SEQ ID NO: 8039419 - DNA, 22 bp, Homo sapiens
gctgtacaaattccacaagaga

SEQ ID NO: 8039420 - DNA, 22 bp, Homo sapiens
gctgtacaaggcctctgccatc

SEQ ID NO: 8039421 - DNA, 22 bp, Homo sapiens
gcttgggaagggccctgtgtac

SEQ ID NO: 8039422 - DNA, 22 bp, Homo sapiens
cacaaaagtaggaggcaggcgg

SEQ ID NO: 8039423 - DNA, 22 bp, Homo sapiens
ggcctctcatgcccagagccaa

SEQ ID NO: 8039424 - DNA, 22 bp, Homo sapiens
ggcctctcagggcagagaccct

SEQ ID NO: 8039425 - DNA, 22 bp, Homo sapiens
cactgagaccagagtccctgac

SEQ ID NO: 8039426 - DNA, 22 bp, Homo sapiens
cactggaatgttgaggagacaa

SEQ ID NO: 8039427 - DNA, 22 bp, Homo sapiens
cactggaaccatccacatagtg

SEQ ID NO: 8039428 - DNA, 22 bp, Homo sapiens
ggcacagggtgatgttgcagtt

SEQ ID NO: 8039429 - DNA, 22 bp, Homo sapiens
ggcacagggggctgaggactag

SEQ ID NO: 8039430 - DNA, 22 bp, Homo sapiens
ggatgtagtgcaaggagtgaat

SEQ ID NO: 8039431 - DNA, 22 bp, Homo sapiens
ggatgtgaatctgggctgagac

SEQ ID NO: 8039432 - DNA, 22 bp, Homo sapiens
gaggagctgcagggggagtcta

SEQ ID NO: 8039433 - DNA, 22 bp, Homo sapiens
gaggagctctgctccatccttc

SEQ ID NO: 8039434 - DNA, 22 bp, Homo sapiens
gaggagctgagccacgtcctgg

SEQ ID NO: 8039435 - DNA, 22 bp, Homo sapiens
atgtagaaagttattgtcactg

SEQ ID NO: 8039436 - DNA, 22 bp, Homo sapiens
gaggagctcatgaaagcggtgt

SEQ ID NO: 8039437 - DNA, 22 bp, Homo sapiens
gaggagctggcagcgtctccgc

SEQ ID NO: 8039438 - DNA, 22 bp, Homo sapiens
gaggagctgggaccctgtcatc

SEQ ID NO: 8039439 - DNA, 22 bp, Homo sapiens
gaggctgcggggaggagcctgc

SEQ ID NO: 8039440 - DNA, 22 bp, Homo sapiens
gagcagtgactggagcatgaga

SEQ ID NO: 8039441 - DNA, 22 bp, Homo sapiens
gacagagttgttgatgtatgct

SEQ ID NO: 8039442 - DNA, 22 bp, Homo sapiens
atggaaaaggctgatttcatta

SEQ ID NO: 8039443 - DNA, 22 bp, Homo sapiens
atggagccattcctgaagactt

SEQ ID NO: 8039444 - DNA, 20 bp, Homo sapiens
atggaggaagggcaagagaa

SEQ ID NO: 8039445 - DNA, 22 bp, Homo sapiens
cttggtcatttggggctgctat

SEQ ID NO: 8039446 - DNA, 22 bp, Homo sapiens
cttggtcatttcttgtcctgtt

SEQ ID NO: 8039447 - DNA, 22 bp, Homo sapiens
cttggcagtttcggaaggatga

SEQ ID NO: 8039448 - DNA, 22 bp, Homo sapiens
cttggcagggtggaggatgcag

SEQ ID NO: 8039449 - DNA, 22 bp, Homo sapiens
cttggcagagggctgggctcag

SEQ ID NO: 8039450 - DNA, 22 bp, Homo sapiens
atctagggtgtaggtcactgat

SEQ ID NO: 8039451 - DNA, 22 bp, Homo sapiens
cttgccttcagtgtccctttgc

SEQ ID NO: 8039452 - DNA, 22 bp, Homo sapiens
cttgcctttgtcttcaaaggct

SEQ ID NO: 8039453 - DNA, 18 bp, Homo sapiens
cttgttcttctcttggcg

SEQ ID NO: 8039454 - DNA, 22 bp, Homo sapiens
atctttttactaacactgctta

SEQ ID NO: 8039455 - DNA, 22 bp, Homo sapiens
atgcattgtctggtttcatttt

SEQ ID NO: 8039456 - DNA, 22 bp, Homo sapiens
gacactgaccccaagctgtcct

SEQ ID NO: 8039457 - DNA, 22 bp, Homo sapiens
atgcattgtcaggcaatttcat

SEQ ID NO: 8039458 - DNA, 22 bp, Homo sapiens
atgcacttaaataacataactt

SEQ ID NO: 8039459 - DNA, 22 bp, Homo sapiens
atgcacagtatgtagggtctat

SEQ ID NO: 8039460 - DNA, 22 bp, Homo sapiens
atgcaaaagtaattgcaatttt

SEQ ID NO: 8039461 - DNA, 22 bp, Homo sapiens
atgcaaagcaccacactaagat

SEQ ID NO: 8039462 - DNA, 22 bp, Homo sapiens
atgaggcaggtggaggctgcca

SEQ ID NO: 8039463 - DNA, 22 bp, Homo sapiens
atgaggcagctgctggagaacg

SEQ ID NO: 8039464 - DNA, 22 bp, Homo sapiens
gatgatgaggccatgaggcagg

SEQ ID NO: 8039465 - DNA, 22 bp, Homo sapiens
gatgatgagataaggataactt

SEQ ID NO: 8039466 - DNA, 18 bp, Homo sapiens
gatgaggctgtctgagaa

SEQ ID NO: 8039467 - DNA, 22 bp, Homo sapiens
attaaaattccaaggtatgcca

SEQ ID NO: 8039468 - DNA, 22 bp, Homo sapiens
atgttttctagagtttaaaatc

SEQ ID NO: 8039469 - DNA, 22 bp, Homo sapiens
attcctcatttgttgagaacca

SEQ ID NO: 8039470 - DNA, 22 bp, Homo sapiens
attcctcaaaggtagcccatta

SEQ ID NO: 8039471 - DNA, 19 bp, Homo sapiens
attcctcaaggacagaaat

SEQ ID NO: 8039472 - DNA, 20 bp, Homo sapiens
attcctcagccccagcctca

SEQ ID NO: 8039473 - DNA, 22 bp, Homo sapiens
attcctcagcaggccttttgtt

SEQ ID NO: 8039474 - DNA, 22 bp, Homo sapiens
attcctcattatttactgagga

SEQ ID NO: 8039475 - DNA, 22 bp, Homo sapiens
attctcagatcttagaggaata

SEQ ID NO: 8039476 - DNA, 20 bp, Homo sapiens
attgaaatttttctgagatt

SEQ ID NO: 8039477 - DNA, 22 bp, Homo sapiens
atttctacagtacacatgcatt

SEQ ID NO: 8039478 - DNA, 18 bp, Homo sapiens
gcctgctctgctctcccc

SEQ ID NO: 8039479 - DNA, 22 bp, Homo sapiens
gcctcctgttatgccatgtgcc

SEQ ID NO: 8039480 - DNA, 22 bp, Homo sapiens
atttctcagtgtacattatgtt

SEQ ID NO: 8039481 - DNA, 22 bp, Homo sapiens
caaaactgtctagagagagaag

SEQ ID NO: 8039482 - DNA, 22 bp, Homo sapiens
gcgagcctctggagtcctctgg

SEQ ID NO: 8039483 - DNA, 22 bp, Homo sapiens
caaaaactgcaattacttttac

SEQ ID NO: 8039484 - DNA, 22 bp, Homo sapiens
caaaaactgcaattacttttac

SEQ ID NO: 8039485 - DNA, 22 bp, Homo sapiens
caaactgttctctgtgggattc

SEQ ID NO: 8039486 - DNA, 22 bp, Homo sapiens
gctcaggagctgacagcctcaa

SEQ ID NO: 8039487 - DNA, 22 bp, Homo sapiens
tcagccctgggcttcctcatgg

SEQ ID NO: 8039488 - DNA, 22 bp, Homo sapiens
tcagctcttaaccctctggcct

SEQ ID NO: 8039489 - DNA, 22 bp, Homo sapiens
tcagaagtcccttgcatcttag

SEQ ID NO: 8039490 - DNA, 22 bp, Homo sapiens
tcagaagtattatgctaaagga

SEQ ID NO: 8039491 - DNA, 22 bp, Homo sapiens
tcagaagtagctccccttcatt

SEQ ID NO: 8039492 - DNA, 22 bp, Homo sapiens
cagtttctgtggtctcttttca

SEQ ID NO: 8039493 - DNA, 22 bp, Homo sapiens
cagtttctctcatacatatttg

SEQ ID NO: 8039494 - DNA, 23 bp, Homo sapiens
catccaggagctgagtctgactg

SEQ ID NO: 8039495 - DNA, 22 bp, Homo sapiens
catataatgtttgaagatgtgg

SEQ ID NO: 8039496 - DNA, 22 bp, Homo sapiens
tcaggaagtggtaaaggatgtt

SEQ ID NO: 8039497 - DNA, 20 bp, Homo sapiens
catatatacctagaagtgga

SEQ ID NO: 8039498 - DNA, 22 bp, Homo sapiens
tccaggcaagggaggagcatgg

SEQ ID NO: 8039499 - DNA, 22 bp, Homo sapiens
tccaggcaaaaaccaactacag

SEQ ID NO: 8039500 - DNA, 22 bp, Homo sapiens
tcattttcacacataaatagca

SEQ ID NO: 8039501 - DNA, 20 bp, Homo sapiens
tcagtttaaatcctggcttt

SEQ ID NO: 8039502 - DNA, 22 bp, Homo sapiens
cagtgcaacgttgtgcattcaa

SEQ ID NO: 8039503 - DNA, 22 bp, Homo sapiens
tcactcaatatcccagtggggc

SEQ ID NO: 8039504 - DNA, 22 bp, Homo sapiens
tatacagtcttttgctatattc

SEQ ID NO: 8039505 - DNA, 22 bp, Homo sapiens
tataatgttttccatggactga

SEQ ID NO: 8039506 - DNA, 22 bp, Homo sapiens
tattggaaggaagcaagagagg

SEQ ID NO: 8039507 - DNA, 22 bp, Homo sapiens
tatggcaagatgacatgttctc

SEQ ID NO: 8039508 - DNA, 22 bp, Homo sapiens
tatggcaagagaatcaactgaa

SEQ ID NO: 8039509 - DNA, 22 bp, Homo sapiens
tatggcaaaactctttatccaa

SEQ ID NO: 8039510 - DNA, 22 bp, Homo sapiens
tatggcaatatgtatcaagatc

SEQ ID NO: 8039511 - DNA, 22 bp, Homo sapiens
tatggcaattgtctaagtttta

SEQ ID NO: 8039512 - DNA, 22 bp, Homo sapiens
tatctgcatctgcatgtgtatt

SEQ ID NO: 8039513 - DNA, 22 bp, Homo sapiens
tatggctactacgaataatgct

SEQ ID NO: 8039514 - DNA, 22 bp, Homo sapiens
ccaggaggatggttgttaggtg

SEQ ID NO: 8039515 - DNA, 23 bp, Homo sapiens
ccaggaagaggccatccacagtc

SEQ ID NO: 8039516 - DNA, 22 bp, Homo sapiens
ccaggaggcggaaggtacagtg

SEQ ID NO: 8039517 - DNA, 22 bp, Homo sapiens
ccaggaggcagaagttgcagtg

SEQ ID NO: 8039518 - DNA, 22 bp, Homo sapiens
ccaggaggcagaggttgtagtg

SEQ ID NO: 8039519 - DNA, 22 bp, Homo sapiens
tctgcctctttcaggcctggca

SEQ ID NO: 8039520 - DNA, 22 bp, Homo sapiens
ccacaaaactgtgtgtcaaaga

SEQ ID NO: 8039521 - DNA, 22 bp, Homo sapiens
tccctgcctgacagcacccacc

SEQ ID NO: 8039522 - DNA, 22 bp, Homo sapiens
catttacttaaatctttacaag

SEQ ID NO: 8039523 - DNA, 17 bp, Homo sapiens
tccaggcagcaactgag

SEQ ID NO: 8039524 - DNA, 22 bp, Homo sapiens
ccagaattcagaaagggcataa

SEQ ID NO: 8039525 - DNA, 22 bp, Homo sapiens
ccagaatttggatcatgatttt

SEQ ID NO: 8039526 - DNA, 22 bp, Homo sapiens
ccagaatttgaactcaggcaat

SEQ ID NO: 8039527 - DNA, 22 bp, Homo sapiens
ccagaggaaaaatatctcccta

SEQ ID NO: 8039528 - DNA, 22 bp, Homo sapiens
tctcctgggaggacaaggaagg

SEQ ID NO: 8039529 - DNA, 22 bp, Homo sapiens
ccagaggagcaggctggctcca

SEQ ID NO: 8039530 - DNA, 22 bp, Homo sapiens
ccagaggagttgaggctttggg

SEQ ID NO: 8039531 - DNA, 22 bp, Homo sapiens
ccagaggagggctctgatgagg

SEQ ID NO: 8039532 - DNA, 22 bp, Homo sapiens
ccagaggagatgcctcctctgt

SEQ ID NO: 8039533 - DNA, 22 bp, Homo sapiens
ccagaggacttgggggctgaat

SEQ ID NO: 8039534 - DNA, 22 bp, Homo sapiens
taattgtaaagtagtagtacag

SEQ ID NO: 8039535 - DNA, 18 bp, Homo sapiens
caggatgagtgatgggga

SEQ ID NO: 8039536 - DNA, 22 bp, Homo sapiens
caggatgaggtagaggcagata

SEQ ID NO: 8039537 - DNA, 22 bp, Homo sapiens
caggatgagaggcccagggaag

SEQ ID NO: 8039538 - DNA, 20 bp, Homo sapiens
caggatgattggacacgatg

SEQ ID NO: 8039539 - DNA, 22 bp, Homo sapiens
caggatggtctcgatctcctga

SEQ ID NO: 8039540 - DNA, 22 bp, Homo sapiens
taacagaaaggggacagaaata

SEQ ID NO: 8039541 - DNA, 22 bp, Homo sapiens
taaatatcagtccagctcttcc

SEQ ID NO: 8039542 - DNA, 22 bp, Homo sapiens
taaatatgcatgtatccttatc

SEQ ID NO: 8039543 - DNA, 22 bp, Homo sapiens
caggagtggtgtgagggactcc

SEQ ID NO: 8039544 - DNA, 22 bp, Homo sapiens
caggagggcccgagactcttcc

SEQ ID NO: 8039545 - DNA, 22 bp, Homo sapiens
taaaaagtagtgagaatggcgc

SEQ ID NO: 8039546 - DNA, 19 bp, Homo sapiens
taaaaactgaaggaagcag

SEQ ID NO: 8039547 - DNA, 18 bp, Homo sapiens
caggaatggatgggattt

SEQ ID NO: 8039548 - DNA, 22 bp, Homo sapiens
caggaatgtttgtgctccttta

SEQ ID NO: 8039549 - DNA, 22 bp, Homo sapiens
caggacaaagccctttgagaaa

SEQ ID NO: 8039550 - DNA, 22 bp, Homo sapiens
caggaatgacccaacagtttca

SEQ ID NO: 8039551 - DNA, 23 bp, Homo sapiens
caggaagcagatggggtagaaga

SEQ ID NO: 8039552 - DNA, 22 bp, Homo sapiens
gtggcagtgaaggtcatagcat

SEQ ID NO: 8039553 - DNA, 22 bp, Homo sapiens
gtggcagtcgctgacagataca

SEQ ID NO: 8039554 - DNA, 22 bp, Homo sapiens
cagctttcttccttctgtctgt

SEQ ID NO: 8039555 - DNA, 22 bp, Homo sapiens
cagctttctttccataaggttt

SEQ ID NO: 8039556 - DNA, 22 bp, Homo sapiens
cagctttccagagacctgcccc

SEQ ID NO: 8039557 - DNA, 22 bp, Homo sapiens
gttacaatgtccttacatgaaa

SEQ ID NO: 8039558 - DNA, 22 bp, Homo sapiens
gtttcctctgctggttttcatt

SEQ ID NO: 8039559 - DNA, 22 bp, Homo sapiens
gttcctcaaaaaggagagcccc

SEQ ID NO: 8039560 - DNA, 22 bp, Homo sapiens
gttcctcacgtggacagatgat

SEQ ID NO: 8039561 - DNA, 22 bp, Homo sapiens
gttcctcagcccttacttagcc

SEQ ID NO: 8039562 - DNA, 22 bp, Homo sapiens
gttcctcagttgtaaaaaatgt

SEQ ID NO: 8039563 - DNA, 22 bp, Homo sapiens
gttcctcatccagtcatgacta

SEQ ID NO: 8039564 - DNA, 22 bp, Homo sapiens
gttcctcatgagtaccccttaa

SEQ ID NO: 8039565 - DNA, 22 bp, Homo sapiens
caggaaaggtgtgtcatgatgg

SEQ ID NO: 8039566 - DNA, 22 bp, Homo sapiens
gttgggaagcagatggatgagc

SEQ ID NO: 8039567 - DNA, 19 bp, Homo sapiens
cctggctctgagcccagcc

SEQ ID NO: 8039568 - DNA, 19 bp, Homo sapiens
tgtctcagtgtcccttcct

SEQ ID NO: 8039569 - DNA, 22 bp, Homo sapiens
tgtctcaggtacatgcgtcctg

SEQ ID NO: 8039570 - DNA, 22 bp, Homo sapiens
tgtctcagagtatccctgaact

SEQ ID NO: 8039571 - DNA, 22 bp, Homo sapiens
cctggctccagctgcctgtcct

SEQ ID NO: 8039572 - DNA, 22 bp, Homo sapiens
cctggctctagaggccactcct

SEQ ID NO: 8039573 - DNA, 22 bp, Homo sapiens
cctggcagttttgcccaggatt

SEQ ID NO: 8039574 - DNA, 22 bp, Homo sapiens
cctggcagttttgcccaggatt

SEQ ID NO: 8039575 - DNA, 22 bp, Homo sapiens
cctggcagtggtgaagaagagg

SEQ ID NO: 8039576 - DNA, 22 bp, Homo sapiens
cctggcagttcatcaaatggca

SEQ ID NO: 8039577 - DNA, 22 bp, Homo sapiens
cctggcaggtggaggttgcagt

SEQ ID NO: 8039578 - DNA, 22 bp, Homo sapiens
cctggcagggctgcagtaatgg

SEQ ID NO: 8039579 - DNA, 22 bp, Homo sapiens
cctggcaggtagcattgaggag

SEQ ID NO: 8039580 - DNA, 22 bp, Homo sapiens
cctggcagtcaggggagtcctt

SEQ ID NO: 8039581 - DNA, 22 bp, Homo sapiens
cctggcagtcaggggagtcctt

SEQ ID NO: 8039582 - DNA, 22 bp, Homo sapiens
cctggcaggttacaaccagtta

SEQ ID NO: 8039583 - DNA, 22 bp, Homo sapiens
cctggcaggtggcgccctcggc

SEQ ID NO: 8039584 - DNA, 22 bp, Homo sapiens
cctggcaggcccctcctggatt

SEQ ID NO: 8039585 - DNA, 22 bp, Homo sapiens
cctggcaggcaagaggaaggga

SEQ ID NO: 8039586 - DNA, 22 bp, Homo sapiens
cctggcaggactgttgtaagaa

SEQ ID NO: 8039587 - DNA, 20 bp, Homo sapiens
cctggcaggcgggttactta

SEQ ID NO: 8039588 - DNA, 22 bp, Homo sapiens
cctggcaggctggggacagtgc

SEQ ID NO: 8039589 - DNA, 22 bp, Homo sapiens
cctggcaggctggggacagtgc

SEQ ID NO: 8039590 - DNA, 22 bp, Homo sapiens
cctggcagcagcacatgccttc

SEQ ID NO: 8039591 - DNA, 23 bp, Homo sapiens
cctggcagcaaacgaggaggtta

SEQ ID NO: 8039592 - DNA, 23 bp, Homo sapiens
cctggcagcaaacgaggaggtta

SEQ ID NO: 8039593 - DNA, 18 bp, Homo sapiens
cctggcagccatgcgcgc

SEQ ID NO: 8039594 - DNA, 22 bp, Homo sapiens
cctggcagcaggtgggcccgtg

SEQ ID NO: 8039595 - DNA, 22 bp, Homo sapiens
cctggcagcattggtagagatt

SEQ ID NO: 8039596 - DNA, 22 bp, Homo sapiens
cctggcagactgtgagggcagg

SEQ ID NO: 8039597 - DNA, 22 bp, Homo sapiens
cctggcagactgtgagggcagg

SEQ ID NO: 8039598 - DNA, 22 bp, Homo sapiens
cctggcagaaagagttacacct

SEQ ID NO: 8039599 - DNA, 21 bp, Homo sapiens
cctggcagaagcctgatatgc

SEQ ID NO: 8039600 - DNA, 22 bp, Homo sapiens
cctggcagaatattaaagtgca

SEQ ID NO: 8039601 - DNA, 22 bp, Homo sapiens
cctggcagacagcactgaagct

SEQ ID NO: 8039602 - DNA, 22 bp, Homo sapiens
cctggcagacagcactgaagct

SEQ ID NO: 8039603 - DNA, 17 bp, Homo sapiens
cctgcccagagacagat

SEQ ID NO: 8039604 - DNA, 17 bp, Homo sapiens
cccagggaccactgctt

SEQ ID NO: 8039605 - DNA, 22 bp, Homo sapiens
cccagggatgtggcagatgtta

SEQ ID NO: 8039606 - DNA, 22 bp, Homo sapiens
cccagggaggtagcaggagaaa

SEQ ID NO: 8039607 - DNA, 22 bp, Homo sapiens
tgctccagtgcctgccccacag

SEQ ID NO: 8039608 - DNA, 22 bp, Homo sapiens
ccctcagggaccactgacttca

SEQ ID NO: 8039609 - DNA, 22 bp, Homo sapiens
cccctcaggtacccgtgcagca

SEQ ID NO: 8039610 - DNA, 22 bp, Homo sapiens
cccaggaggtgtgcccaactcg

SEQ ID NO: 8039611 - DNA, 22 bp, Homo sapiens
cccaggaggtggagttcacagt

SEQ ID NO: 8039612 - DNA, 22 bp, Homo sapiens
cccagcctactctgccatagca

SEQ ID NO: 8039613 - DNA, 22 bp, Homo sapiens
cccagccttccaccctggacta

SEQ ID NO: 8039614 - DNA, 22 bp, Homo sapiens
cccagcctttgcttcctggttc

SEQ ID NO: 8039615 - DNA, 22 bp, Homo sapiens
cccagcctgtgacagccgtcct

SEQ ID NO: 8039616 - DNA, 22 bp, Homo sapiens
cctcctggtccagcatctcttt

SEQ ID NO: 8039617 - DNA, 22 bp, Homo sapiens
cctcccttcagtagagcccaat

SEQ ID NO: 8039618 - DNA, 22 bp, Homo sapiens
cctccagcgcgatccactccgg

SEQ ID NO: 8039619 - DNA, 22 bp, Homo sapiens
cctctgaggtgagcccagctgg

SEQ ID NO: 8039620 - DNA, 22 bp, Homo sapiens
cctctgagaacacctggcgtcc

SEQ ID NO: 8039621 - DNA, 22 bp, Homo sapiens
cctctcagcgattcctcttgga

SEQ ID NO: 8039622 - DNA, 22 bp, Homo sapiens
tggccaggaggctgcttctgac

SEQ ID NO: 8039623 - DNA, 22 bp, Homo sapiens
cctagggagcctgagagcagtg

SEQ ID NO: 8039624 - DNA, 22 bp, Homo sapiens
tggcacaggaatttagatgcag

SEQ ID NO: 8039625 - DNA, 22 bp, Homo sapiens
ccctggagatcgggagaggaag

SEQ ID NO: 8039626 - DNA, 22 bp, Homo sapiens
tggatgagattaaagtgaggtt

SEQ ID NO: 8039627 - DNA, 22 bp, Homo sapiens
tggatgaggctgggttaggcag

SEQ ID NO: 8039628 - DNA, 22 bp, Homo sapiens
tggatgagaaactctggtgact

SEQ ID NO: 8039629 - DNA, 22 bp, Homo sapiens
tggatgagttcaatgaggcaga

SEQ ID NO: 8039630 - DNA, 22 bp, Homo sapiens
tggatgagggctgagcactggg

SEQ ID NO: 8039631 - DNA, 22 bp, Homo sapiens
tggatgagtctgagattgggca

SEQ ID NO: 8039632 - DNA, 22 bp, Homo sapiens
ccctggcaaaatccctggtaca

SEQ ID NO: 8039633 - DNA, 22 bp, Homo sapiens
ccctggctcttcaccacctgcc

SEQ ID NO: 8039634 - DNA, 22 bp, Homo sapiens
ccctggctgccagtcaccagac

SEQ ID NO: 8039635 - DNA, 22 bp, Homo sapiens
ctgcctgctcaccagggctctg

SEQ ID NO: 8039636 - DNA, 22 bp, Homo sapiens
ctggacaggctggggactgcaa

SEQ ID NO: 8039637 - DNA, 22 bp, Homo sapiens
ctggacaaccactcagcctcag

SEQ ID NO: 8039638 - DNA, 22 bp, Homo sapiens
ctggcctctgtgttcaccatag

SEQ ID NO: 8039639 - DNA, 22 bp, Homo sapiens
ctggctcctgaggcttggcccc

SEQ ID NO: 8039640 - DNA, 22 bp, Homo sapiens
ctggcacctccagctcatggcc

SEQ ID NO: 8039641 - DNA, 22 bp, Homo sapiens
ctggcacgcccacgtaggcact

SEQ ID NO: 8039642 - DNA, 22 bp, Homo sapiens
ctggcaagaaatatatatctta

SEQ ID NO: 8039643 - DNA, 22 bp, Homo sapiens
ctggcagtctggtggaaggcct

SEQ ID NO: 8039644 - DNA, 22 bp, Homo sapiens
ctggcagtctggtggaaggcct

SEQ ID NO: 8039645 - DNA, 22 bp, Homo sapiens
ctggcagttggcattggcatct

SEQ ID NO: 8039646 - DNA, 22 bp, Homo sapiens
ctggcagtttgccaggagctcg

SEQ ID NO: 8039647 - DNA, 22 bp, Homo sapiens
ctggcatgaaatggcatctcat

SEQ ID NO: 8039648 - DNA, 22 bp, Homo sapiens
ctggcagcatggagcctgtgct

SEQ ID NO: 8039649 - DNA, 22 bp, Homo sapiens
ctgagaatggacagcagggcag

SEQ ID NO: 8039650 - DNA, 22 bp, Homo sapiens
ctgagaataaagccagcaggag

SEQ ID NO: 8039651 - DNA, 22 bp, Homo sapiens
ctgagaaattctttctttcact

SEQ ID NO: 8039652 - DNA, 22 bp, Homo sapiens
ctgagaaatacccaagtctggt

SEQ ID NO: 8039653 - DNA, 22 bp, Homo sapiens
ctgagaaagtgagggttaaaca

SEQ ID NO: 8039654 - DNA, 22 bp, Homo sapiens
ctgactgttgctgttgatgagg

SEQ ID NO: 8039655 - DNA, 22 bp, Homo sapiens
ctgactgtttgctgaaaggtct

SEQ ID NO: 8039656 - DNA, 22 bp, Homo sapiens
ctgacttcagggataaaaagta

SEQ ID NO: 8039657 - DNA, 22 bp, Homo sapiens
ctgactgtgagagcaggaatgg

SEQ ID NO: 8039658 - DNA, 22 bp, Homo sapiens
ctgaagagaaagggagctcttc

SEQ ID NO: 8039659 - DNA, 22 bp, Homo sapiens
ctctgggctccttcagcccttt

SEQ ID NO: 8039660 - DNA, 22 bp, Homo sapiens
ttttattctcaagacaatggga

SEQ ID NO: 8039661 - DNA, 22 bp, Homo sapiens
ctctgggatgaggcctaggcac

SEQ ID NO: 8039662 - DNA, 22 bp, Homo sapiens
tttgtgaataggttggcttcca

SEQ ID NO: 8039663 - DNA, 22 bp, Homo sapiens
ctgagacacagtggctgaaaag

SEQ ID NO: 8039664 - DNA, 22 bp, Homo sapiens
ctgagacacggagaggctgtgt

SEQ ID NO: 8039665 - DNA, 22 bp, Homo sapiens
ctgagacaggagaatggcgtga

SEQ ID NO: 8039666 - DNA, 22 bp, Homo sapiens
ctgcctcagcgttgtggcccta

SEQ ID NO: 8039667 - DNA, 22 bp, Homo sapiens
ctacaaaagtaattgtggtttt

SEQ ID NO: 8039668 - DNA, 22 bp, Homo sapiens
ctaatgtaaaacagacttgcat

SEQ ID NO: 8039669 - DNA, 22 bp, Homo sapiens
ctaatgtaaagcatttgttcag

SEQ ID NO: 8039670 - DNA, 22 bp, Homo sapiens
ctaatgtaatgatatgttgaat

SEQ ID NO: 8039671 - DNA, 22 bp, Homo sapiens
ctaatgtatcatggctctcagc

SEQ ID NO: 8039672 - DNA, 22 bp, Homo sapiens
ttccctttgttaaattggaaga

SEQ ID NO: 8039673 - DNA, 22 bp, Homo sapiens
ttccctggttaaccattttctg

SEQ ID NO: 8039674 - DNA, 22 bp, Homo sapiens
ttccaaagctgctttatttagt

SEQ ID NO: 8039675 - DNA, 22 bp, Homo sapiens
ttccaaagtcatgttgctgata

SEQ ID NO: 8039676 - DNA, 21 bp, Homo sapiens
cggctcagtgcctgctccttc

SEQ ID NO: 8039677 - DNA, 22 bp, Homo sapiens
ttgacttcagcctgtacttgta

SEQ ID NO: 8039678 - DNA, 22 bp, Homo sapiens
ttgacttcccagacttgtgttt

SEQ ID NO: 8039679 - DNA, 22 bp, Homo sapiens
ttgagaaaatagttcgaatgtt

SEQ ID NO: 8039680 - DNA, 23 bp, Homo sapiens
ctcagaggcctgtccagggtggt

SEQ ID NO: 8039681 - DNA, 22 bp, Homo sapiens
ctattttgcctgcctagaaatc

SEQ ID NO: 8039682 - DNA, 22 bp, Homo sapiens
ctagggaacaagatgcccaggg

SEQ ID NO: 8039683 - DNA, 22 bp, Homo sapiens
ttcctttctctggactgcagcc

SEQ ID NO: 8039684 - DNA, 22 bp, Homo sapiens
ctctcctcagaacaggccctct

SEQ ID NO: 8039685 - DNA, 22 bp, Homo sapiens
ctctccagaatatgccgccgtg

SEQ ID NO: 8039686 - DNA, 22 bp, Homo sapiens
ctctccagcctttagcccacgc

SEQ ID NO: 8039687 - DNA, 22 bp, Homo sapiens
ctccaggcccctggccttctgc

SEQ ID NO: 8039688 - DNA, 22 bp, Homo sapiens
ctcagttttgctagctggagtt

SEQ ID NO: 8039689 - DNA, 22 bp, Homo sapiens
ctcagttttgaaaaggtaagct

SEQ ID NO: 8039690 - DNA, 22 bp, Homo sapiens
ctcagttttcccttgggagcgt

SEQ ID NO: 8039691 - DNA, 22 bp, Homo sapiens
ctcagtttttgtgggcatcagc

SEQ ID NO: 8039692 - DNA, 22 bp, Homo sapiens
ctcagtttctggataagctggg

SEQ ID NO: 8039693 - DNA, 20 bp, Homo sapiens
ctcagtttcctcatggctca

SEQ ID NO: 8039694 - DNA, 22 bp, Homo sapiens
ctcagtttctgaagtggacagg

SEQ ID NO: 8039695 - DNA, 22 bp, Homo sapiens
ctcagtttccccggcctgggcg

SEQ ID NO: 8039696 - DNA, 22 bp, Homo sapiens
ttgggatctcaaatccagctat

SEQ ID NO: 8039697 - DNA, 22 bp, Homo sapiens
ttggccacactcactagagccc

SEQ ID NO: 8039698 - DNA, 19 bp, Homo sapiens
gctcctgggcctcactcat

SEQ ID NO: 8039699 - DNA, 22 bp, Homo sapiens
gctcctggcttcactgacatca

SEQ ID NO: 8039700 - DNA, 22 bp, Homo sapiens
gctcctggctccaggcagccaa

SEQ ID NO: 8039701 - DNA, 22 bp, Homo sapiens
gctccaggagagggaagcagat

SEQ ID NO: 8039702 - DNA, 22 bp, Homo sapiens
gctccaggaggatgaccttcct

SEQ ID NO: 8039703 - DNA, 22 bp, Homo sapiens
gctcagacctgtaatcttagca

SEQ ID NO: 8039704 - DNA, 22 bp, Homo sapiens
gctcagaaaagtgaggctcagt

SEQ ID NO: 8039705 - DNA, 22 bp, Homo sapiens
gctcagagatgttcagtagctt

SEQ ID NO: 8039706 - DNA, 19 bp, Homo sapiens
gctcagagccatgggggct

SEQ ID NO: 8039707 - DNA, 22 bp, Homo sapiens
gctcagagcatcccagtgaatg

SEQ ID NO: 8039708 - DNA, 22 bp, Homo sapiens
gctgctgcaagagccagctctt

SEQ ID NO: 8039709 - DNA, 22 bp, Homo sapiens
gcctggcaggcctgttggggct

SEQ ID NO: 8039710 - DNA, 22 bp, Homo sapiens
gcctggcatatagtagttgtgc

SEQ ID NO: 8039711 - DNA, 22 bp, Homo sapiens
gcctggcaggggcctgggagtg

SEQ ID NO: 8039712 - DNA, 21 bp, Homo sapiens
gccctcaggggaggatggcct

SEQ ID NO: 8039713 - DNA, 22 bp, Homo sapiens
gccctcctttgcttctcctagt

SEQ ID NO: 8039714 - DNA, 22 bp, Homo sapiens
gccctcagagttccccacagtg

SEQ ID NO: 8039715 - DNA, 22 bp, Homo sapiens
gccctcagctcctggacacatg

SEQ ID NO: 8039716 - DNA, 22 bp, Homo sapiens
gccctctgctcagctcctcagc

SEQ ID NO: 8039717 - DNA, 20 bp, Homo sapiens
gccctctgcctccctcagcg

SEQ ID NO: 8039718 - DNA, 22 bp, Homo sapiens
gccctctcttctgcagcctcca

SEQ ID NO: 8039719 - DNA, 22 bp, Homo sapiens
gccctctggcacagagatgcag

SEQ ID NO: 8039720 - DNA, 19 bp, Homo sapiens
gcctctgctggggacaggc

SEQ ID NO: 8039721 - DNA, 22 bp, Homo sapiens
gcctctgctctcaggtagcctc

SEQ ID NO: 8039722 - DNA, 22 bp, Homo sapiens
gcctctgcatgctcagcaccca

SEQ ID NO: 8039723 - DNA, 22 bp, Homo sapiens
gcctctgcatcatcactccagc

SEQ ID NO: 8039724 - DNA, 22 bp, Homo sapiens
gcctcctgttatgccatgtgcc

SEQ ID NO: 8039725 - DNA, 22 bp, Homo sapiens
gccgggaccaaggccacggagc

SEQ ID NO: 8039726 - DNA, 22 bp, Homo sapiens
gatgcctggcacccagcaagga

SEQ ID NO: 8039727 - DNA, 22 bp, Homo sapiens
gatggacacctcctgaggttct

SEQ ID NO: 8039728 - DNA, 22 bp, Homo sapiens
gatggaggaaaagttggaatgc

SEQ ID NO: 8039729 - DNA, 22 bp, Homo sapiens
gatggccttgttttctcccttc

SEQ ID NO: 8039730 - DNA, 22 bp, Homo sapiens
gatggcctgggtccccttccgg

SEQ ID NO: 8039731 - DNA, 22 bp, Homo sapiens
gattcactcatattttacgttt

SEQ ID NO: 8039732 - DNA, 22 bp, Homo sapiens
gcaatataaccagttgtcatgc

SEQ ID NO: 8039733 - DNA, 22 bp, Homo sapiens
gcaatataatttgtgggatatc

SEQ ID NO: 8039734 - DNA, 20 bp, Homo sapiens
gcaatatatgagtgcaataa

SEQ ID NO: 8039735 - DNA, 22 bp, Homo sapiens
gcaatatactttctggcagtga

SEQ ID NO: 8039736 - DNA, 22 bp, Homo sapiens
gatacagtatttaaagagcaac

SEQ ID NO: 8039737 - DNA, 22 bp, Homo sapiens
gatacatttcaaggaggactgg

SEQ ID NO: 8039738 - DNA, 22 bp, Homo sapiens
gatgaaaaattgctgtgtcata

SEQ ID NO: 8039739 - DNA, 22 bp, Homo sapiens
gatgcaaagataaaacagacgc

SEQ ID NO: 8039740 - DNA, 22 bp, Homo sapiens
gatgcaaactgtgacatagagt

SEQ ID NO: 8039741 - DNA, 22 bp, Homo sapiens
gatgatgggttgatgtgaaggg

SEQ ID NO: 8039742 - DNA, 20 bp, Homo sapiens
gatgagacccatgcatgaga

SEQ ID NO: 8039743 - DNA, 20 bp, Homo sapiens
gagtcacagaagaagctgaa

SEQ ID NO: 8039744 - DNA, 22 bp, Homo sapiens
gagtcaggcatgaaggtaatta

SEQ ID NO: 8039745 - DNA, 22 bp, Homo sapiens
gagtcaggctagggtgacaggc

SEQ ID NO: 8039746 - DNA, 22 bp, Homo sapiens
gagggtgtctgcgtaactggca

SEQ ID NO: 8039747 - DNA, 22 bp, Homo sapiens
gagctggccgcagagagggcag

SEQ ID NO: 8039748 - DNA, 21 bp, Homo sapiens
gaggaatggtttgcaaagcac

SEQ ID NO: 8039749 - DNA, 22 bp, Homo sapiens
gaggaatgggtgtctcgtgatt

SEQ ID NO: 8039750 - DNA, 22 bp, Homo sapiens
gaggacagcttagggcttcctg

SEQ ID NO: 8039751 - DNA, 22 bp, Homo sapiens
gaggacagagccgcctggcaag

SEQ ID NO: 8039752 - DNA, 22 bp, Homo sapiens
gaaagttcacacatccacatgg

SEQ ID NO: 8039753 - DNA, 22 bp, Homo sapiens
gaaaagagtcctgtgtgaggag

SEQ ID NO: 8039754 - DNA, 22 bp, Homo sapiens
gaaataatttagaaggtattcc

SEQ ID NO: 8039755 - DNA, 22 bp, Homo sapiens
gaaataattctgtgtctgaaca

SEQ ID NO: 8039756 - DNA, 22 bp, Homo sapiens
gaacactgagaaagtcagcttt

SEQ ID NO: 8039757 - DNA, 22 bp, Homo sapiens
cttgggaatgctaacagatgac

SEQ ID NO: 8039758 - DNA, 22 bp, Homo sapiens
gaattcacttgtcttccatttt

SEQ ID NO: 8039759 - DNA, 22 bp, Homo sapiens
gaagttcaactgccatgcttgg

SEQ ID NO: 8039760 - DNA, 22 bp, Homo sapiens
gaagttcaatgtcagcatctat

SEQ ID NO: 8039761 - DNA, 22 bp, Homo sapiens
gaactgtataggagcagtgttt

SEQ ID NO: 8039762 - DNA, 22 bp, Homo sapiens
gaagtacaaaggacatggaaac

SEQ ID NO: 8039763 - DNA, 22 bp, Homo sapiens
gagacagagtttcactcttgtt

SEQ ID NO: 8039764 - DNA, 22 bp, Homo sapiens
gagacagagatcttgctgagtc

SEQ ID NO: 8039765 - DNA, 22 bp, Homo sapiens
gagagtccttagtttgcaggta

SEQ ID NO: 8039766 - DNA, 22 bp, Homo sapiens
gagaaaatagcatgtgtagtat

SEQ ID NO: 8039767 - DNA, 22 bp, Homo sapiens
gagaaaatcttgggtcaagaat

SEQ ID NO: 8039768 - DNA, 22 bp, Homo sapiens
gagaaaatgtcagacttggtcg

SEQ ID NO: 8039769 - DNA, 22 bp, Homo sapiens
gagacagagaggtactcaacat

SEQ ID NO: 8039770 - DNA, 22 bp, Homo sapiens
gagacactcaacaaagatatga

SEQ ID NO: 8039771 - DNA, 22 bp, Homo sapiens
gagacacaagaagacatgcaca

SEQ ID NO: 8039772 - DNA, 22 bp, Homo sapiens
gagacacacattctggagagaa

SEQ ID NO: 8039773 - DNA, 22 bp, Homo sapiens
gactgtacttgagagaggaact

SEQ ID NO: 8039774 - DNA, 22 bp, Homo sapiens
gactgtacgtcattgaaggcca

SEQ ID NO: 8039775 - DNA, 22 bp, Homo sapiens
gactgtggggggcggacacaag

SEQ ID NO: 8039776 - DNA, 22 bp, Homo sapiens
gggagaaggagctagttcttga

SEQ ID NO: 8039777 - DNA, 22 bp, Homo sapiens
gggatgaggatcaatcagggag

SEQ ID NO: 8039778 - DNA, 20 bp, Homo sapiens
gggatgagagtcctagctct

SEQ ID NO: 8039779 - DNA, 22 bp, Homo sapiens
ggggacagttaaagaccaagac

SEQ ID NO: 8039780 - DNA, 22 bp, Homo sapiens
gggctctgggtcgtgtctccat

SEQ ID NO: 8039781 - DNA, 22 bp, Homo sapiens
ggctcaggtttccttcccagct

SEQ ID NO: 8039782 - DNA, 22 bp, Homo sapiens
ggctgagttgagaggattactt

SEQ ID NO: 8039783 - DNA, 22 bp, Homo sapiens
ggctccttcaagcctgtcactg

SEQ ID NO: 8039784 - DNA, 22 bp, Homo sapiens
ggagggaatgtctagcattctt

SEQ ID NO: 8039785 - DNA, 22 bp, Homo sapiens
ggagctgagttcttcagccggg

SEQ ID NO: 8039786 - DNA, 22 bp, Homo sapiens
ggagctgaggctgaggcctcac

SEQ ID NO: 8039787 - DNA, 22 bp, Homo sapiens
ggagctgaaggggtgggctcag

SEQ ID NO: 8039788 - DNA, 22 bp, Homo sapiens
ggagctgaaccccatcgtgctg

SEQ ID NO: 8039789 - DNA, 22 bp, Homo sapiens
ggaggacaggggctgcagcaca

SEQ ID NO: 8039790 - DNA, 22 bp, Homo sapiens
ggaggacaggggctgcagcaca

SEQ ID NO: 8039791 - DNA, 22 bp, Homo sapiens
ggaggacactggctctgccttc

SEQ ID NO: 8039792 - DNA, 22 bp, Homo sapiens
ggagaagccaggtgataagcaa

SEQ ID NO: 8039793 - DNA, 22 bp, Homo sapiens
ggagaatgattctttgctcact

SEQ ID NO: 8039794 - DNA, 22 bp, Homo sapiens
ggagaaggtggctcagcaaagg

SEQ ID NO: 8039795 - DNA, 22 bp, Homo sapiens
ggagaatgatatatagctcagt

SEQ ID NO: 8039796 - DNA, 22 bp, Homo sapiens
ggagacagcaggaagaaatatc

SEQ ID NO: 8039797 - DNA, 17 bp, Homo sapiens
ggagacagggtctttaa

SEQ ID NO: 8039798 - DNA, 22 bp, Homo sapiens
taacactggttatccctgtgca

SEQ ID NO: 8039799 - DNA, 22 bp, Homo sapiens
taacactggcttttgctgaggc

SEQ ID NO: 8039800 - DNA, 22 bp, Homo sapiens
taaagcaggccacatatgtgat

SEQ ID NO: 8039801 - DNA, 22 bp, Homo sapiens
gttctcagtggggagcagggtt

SEQ ID NO: 8039802 - DNA, 22 bp, Homo sapiens
gtatggcactatcctctctgat

SEQ ID NO: 8039803 - DNA, 21 bp, Homo sapiens
gtatggcattgattagttact

SEQ ID NO: 8039804 - DNA, 22 bp, Homo sapiens
ggtggcagaggtgcatcagccc

SEQ ID NO: 8039805 - DNA, 22 bp, Homo sapiens
ggtgtagctctgtgtcccactg

SEQ ID NO: 8039806 - DNA, 22 bp, Homo sapiens
ggtggcataagaacactaaaga

SEQ ID NO: 8039807 - DNA, 22 bp, Homo sapiens
gtctctgagctctgagctggct

SEQ ID NO: 8039808 - DNA, 22 bp, Homo sapiens
gtcaggactctgacccgtcccg

SEQ ID NO: 8039809 - DNA, 22 bp, Homo sapiens
gtatgtctatttcaaatagctg

SEQ ID NO: 8039810 - DNA, 22 bp, Homo sapiens
gtgacagtcaaagacatgactt

SEQ ID NO: 8039811 - DNA, 22 bp, Homo sapiens
gtggaaggtgctagaacaagga

SEQ ID NO: 8039812 - DNA, 22 bp, Homo sapiens
gtggaaggaattaacagactag

SEQ ID NO: 8039813 - DNA, 20 bp, Homo sapiens
gtggatgatcagtgtagtgg

SEQ ID NO: 8039814 - DNA, 21 bp, Homo sapiens
gtggctctgccaggactgaaa

SEQ ID NO: 8039815 - DNA, 22 bp, Homo sapiens
gtggctctctggtcccctgcca

SEQ ID NO: 8039816 - DNA, 22 bp, Homo sapiens
gtggcctctgtgctcctgccta

SEQ ID NO: 8039817 - DNA, 22 bp, Homo sapiens
gtggcctctgttggctcctagg

SEQ ID NO: 8039818 - DNA, 23 bp, Homo sapiens
gtggcctccccggaatgcctcgc

SEQ ID NO: 8039819 - DNA, 22 bp, Homo sapiens
gtgggagaaattagctctagtt

SEQ ID NO: 8039820 - DNA, 22 bp, Homo sapiens
gtggcagtgggatgctatcagg

SEQ ID NO: 8039821 - DNA, 22 bp, Homo sapiens
gtggcagttttgacatcacaaa

SEQ ID NO: 8039822 - DNA, 22 bp, Homo sapiens
tcttggattttaatggatcaaa

SEQ ID NO: 8039823 - DNA, 22 bp, Homo sapiens
tcttgggatagtgtctcatggc

SEQ ID NO: 8039824 - DNA, 19 bp, Homo sapiens
tctttcatttctagctctg

SEQ ID NO: 8039825 - DNA, 22 bp, Homo sapiens
tcttcaaatacagtcatattga

SEQ ID NO: 8039826 - DNA, 22 bp, Homo sapiens
tcttcaaaaatacaggttttca

SEQ ID NO: 8039827 - DNA, 22 bp, Homo sapiens
tcttattattgttgtaaaagca

SEQ ID NO: 8039828 - DNA, 22 bp, Homo sapiens
tctgtacaacaaagggatgaga

SEQ ID NO: 8039829 - DNA, 22 bp, Homo sapiens
tctgtacaaaggctatttggag

SEQ ID NO: 8039830 - DNA, 23 bp, Homo sapiens
tctgtacacatcagcatctccca

SEQ ID NO: 8039831 - DNA, 23 bp, Homo sapiens
tctgtacaattgagaagagaaca

SEQ ID NO: 8039832 - DNA, 22 bp, Homo sapiens
tctgtacacttcagcatgcatc

SEQ ID NO: 8039833 - DNA, 22 bp, Homo sapiens
tctgtacaccaggggccattct

SEQ ID NO: 8039834 - DNA, 20 bp, Homo sapiens
tctgtacactcatcttctgc

SEQ ID NO: 8039835 - DNA, 22 bp, Homo sapiens
tctgtacagtaccagatagtaa

SEQ ID NO: 8039836 - DNA, 22 bp, Homo sapiens
tctgtacatgagttgagaatca

SEQ ID NO: 8039837 - DNA, 21 bp, Homo sapiens
tctgtacatcattgagtcccc

SEQ ID NO: 8039838 - DNA, 22 bp, Homo sapiens
tctgtacatttggggaccccag

SEQ ID NO: 8039839 - DNA, 22 bp, Homo sapiens
tctgtacatttgtgttgtgaat

SEQ ID NO: 8039840 - DNA, 22 bp, Homo sapiens
tctgggaggtgttttgagaact

SEQ ID NO: 8039841 - DNA, 22 bp, Homo sapiens
tctgggaggggctgccattgct

SEQ ID NO: 8039842 - DNA, 22 bp, Homo sapiens
tctgggaggtaaccatgctgat

SEQ ID NO: 8039843 - DNA, 22 bp, Homo sapiens
tctggcagtttgagaaaggcta

SEQ ID NO: 8039844 - DNA, 22 bp, Homo sapiens
tctggcagttccttgttgatat

SEQ ID NO: 8039845 - DNA, 21 bp, Homo sapiens
tctggcagtggtctttcaaat

SEQ ID NO: 8039846 - DNA, 22 bp, Homo sapiens
tctggcagttccttgttgatat

SEQ ID NO: 8039847 - DNA, 22 bp, Homo sapiens
tctggcagttgccgcttcagtc

SEQ ID NO: 8039848 - DNA, 22 bp, Homo sapiens
tctggcagtggatgagggcagc

SEQ ID NO: 8039849 - DNA, 22 bp, Homo sapiens
tctggcagtgatttctgtgatc

SEQ ID NO: 8039850 - DNA, 20 bp, Homo sapiens
tctggcaggtgaacgagctg

SEQ ID NO: 8039851 - DNA, 22 bp, Homo sapiens
tctggcaggttcccatgttatg

SEQ ID NO: 8039852 - DNA, 20 bp, Homo sapiens
tctggcaggtgaacgagctg

SEQ ID NO: 8039853 - DNA, 22 bp, Homo sapiens
tctggcagtaataggggagaga

SEQ ID NO: 8039854 - DNA, 22 bp, Homo sapiens
tctggcagtgaagtcatgaggt

SEQ ID NO: 8039855 - DNA, 22 bp, Homo sapiens
tctggcagtgagcaacttgaca

SEQ ID NO: 8039856 - DNA, 22 bp, Homo sapiens
tctggcagtgagcaacttgaca

SEQ ID NO: 8039857 - DNA, 22 bp, Homo sapiens
tctggcagggtcagggcccagg

SEQ ID NO: 8039858 - DNA, 22 bp, Homo sapiens
tctggcagcaagataacaatgg

SEQ ID NO: 8039859 - DNA, 22 bp, Homo sapiens
tctggcagatcttcccacgttt

SEQ ID NO: 8039860 - DNA, 22 bp, Homo sapiens
tctggcagagtgataggataag

SEQ ID NO: 8039861 - DNA, 19 bp, Homo sapiens
tctggcaggtaattaggga

SEQ ID NO: 8039862 - DNA, 22 bp, Homo sapiens
tctggcagggtgtgtatttaca

SEQ ID NO: 8039863 - DNA, 22 bp, Homo sapiens
tctggcaggtcaatcattcttt

SEQ ID NO: 8039864 - DNA, 22 bp, Homo sapiens
tctggcagagtcagtgcacaca

SEQ ID NO: 8039865 - DNA, 22 bp, Homo sapiens
tctggcagaggaaggaggcctg

SEQ ID NO: 8039866 - DNA, 22 bp, Homo sapiens
tctggcagaagtgctgtcagta

SEQ ID NO: 8039867 - DNA, 22 bp, Homo sapiens
tctggcagaaggcagaaattca

SEQ ID NO: 8039868 - DNA, 22 bp, Homo sapiens
tctggcagagatatccatccca

SEQ ID NO: 8039869 - DNA, 22 bp, Homo sapiens
tctgctgctgcagctacactat

SEQ ID NO: 8039870 - DNA, 22 bp, Homo sapiens
tctgctgctgaccaacactgtg

SEQ ID NO: 8039871 - DNA, 22 bp, Homo sapiens
tctgctgctacagactctctag

SEQ ID NO: 8039872 - DNA, 22 bp, Homo sapiens
tctggagaagcccagggagctg

SEQ ID NO: 8039873 - DNA, 21 bp, Homo sapiens
tctgccctccaggagctcata

SEQ ID NO: 8039874 - DNA, 21 bp, Homo sapiens
tctgagaacttctgctgcagc

SEQ ID NO: 8039875 - DNA, 22 bp, Homo sapiens
tctcagagaggggccgggcctt

SEQ ID NO: 8039876 - DNA, 22 bp, Homo sapiens
tctcagagagctgtgttttcct

SEQ ID NO: 8039877 - DNA, 22 bp, Homo sapiens
tctcagagatgttagggaagag

SEQ ID NO: 8039878 - DNA, 19 bp, Homo sapiens
tctcagagccctagaggcc

SEQ ID NO: 8039879 - DNA, 22 bp, Homo sapiens
tctcagagcatcattttcttag

SEQ ID NO: 8039880 - DNA, 22 bp, Homo sapiens
tctcagaggtgccctggcatct

SEQ ID NO: 8039881 - DNA, 22 bp, Homo sapiens
tctcagagggaggattactgcc

SEQ ID NO: 8039882 - DNA, 22 bp, Homo sapiens
tctcagagtttgaatctggagt

SEQ ID NO: 8039883 - DNA, 22 bp, Homo sapiens
tctcagagtttagagctgagcc

SEQ ID NO: 8039884 - DNA, 22 bp, Homo sapiens
tctccccaaccatggcactcac

SEQ ID NO: 8039885 - DNA, 22 bp, Homo sapiens
tctcctcaccaccagcagcaga

SEQ ID NO: 8039886 - DNA, 22 bp, Homo sapiens
tctgaaaatgttgactttgttt

SEQ ID NO: 8039887 - DNA, 22 bp, Homo sapiens
tctctatattatatgtagtttg

SEQ ID NO: 8039888 - DNA, 22 bp, Homo sapiens
tctctcagaggaagaggcagtg

SEQ ID NO: 8039889 - DNA, 18 bp, Homo sapiens
tctctcagggaaacagaa

SEQ ID NO: 8039890 - DNA, 23 bp, Homo sapiens
tctctctggcaaatttcacatat

SEQ ID NO: 8039891 - DNA, 22 bp, Homo sapiens
tctctggctggcaccccaggga

SEQ ID NO: 8039892 - DNA, 22 bp, Homo sapiens
tctcaaagtagctcccacagat

SEQ ID NO: 8039893 - DNA, 22 bp, Homo sapiens
tctagagactataatgtgtcct

SEQ ID NO: 8039894 - DNA, 22 bp, Homo sapiens
tctaccactaagtgtgctttga

SEQ ID NO: 8039895 - DNA, 22 bp, Homo sapiens
tctaccacttattagctctgtg

SEQ ID NO: 8039896 - DNA, 22 bp, Homo sapiens
tccttctttgacaagtggcaga

SEQ ID NO: 8039897 - DNA, 22 bp, Homo sapiens
tccttctttcacctcatagtca

SEQ ID NO: 8039898 - DNA, 22 bp, Homo sapiens
tccttcctggggtctctgctgc

SEQ ID NO: 8039899 - DNA, 23 bp, Homo sapiens
tccttcctttgagaggctccatc

SEQ ID NO: 8039900 - DNA, 22 bp, Homo sapiens
tccttaggcaatttgggagagt

SEQ ID NO: 8039901 - DNA, 22 bp, Homo sapiens
tcgcaccattgcactccagcca

SEQ ID NO: 8039902 - DNA, 22 bp, Homo sapiens
tcctgtgccatctctagagact

SEQ ID NO: 8039903 - DNA, 22 bp, Homo sapiens
tcctgggatgacttttgaaatg

SEQ ID NO: 8039904 - DNA, 19 bp, Homo sapiens
tcctgctgtgtgaagggga

SEQ ID NO: 8039905 - DNA, 22 bp, Homo sapiens
tcctggacaagcccttcaccct

SEQ ID NO: 8039906 - DNA, 22 bp, Homo sapiens
tcctggacagatccccatcatc

SEQ ID NO: 8039907 - DNA, 22 bp, Homo sapiens
tcctggactggctcagcaccct

SEQ ID NO: 8039908 - DNA, 19 bp, Homo sapiens
tcctggcatttgtaggaaa

SEQ ID NO: 8039909 - DNA, 22 bp, Homo sapiens
tcctggcattgtgcagggtgtg

SEQ ID NO: 8039910 - DNA, 18 bp, Homo sapiens
tcctggcagtcagagagg

SEQ ID NO: 8039911 - DNA, 17 bp, Homo sapiens
tcctggcagtcccctgg

SEQ ID NO: 8039912 - DNA, 22 bp, Homo sapiens
tcctggcagtgcttgttttgga

SEQ ID NO: 8039913 - DNA, 22 bp, Homo sapiens
tcctggcatccgtgggtctgtg

SEQ ID NO: 8039914 - DNA, 19 bp, Homo sapiens
tcctggcacagtggaacca

SEQ ID NO: 8039915 - DNA, 22 bp, Homo sapiens
tcctggcaaagatgttggtgtt

SEQ ID NO: 8039916 - DNA, 22 bp, Homo sapiens
tgcaaatattgggacagtctag

SEQ ID NO: 8039917 - DNA, 22 bp, Homo sapiens
tgatgaggtggattcaaagcag

SEQ ID NO: 8039918 - DNA, 22 bp, Homo sapiens
tgatcagtgttggttctatcta

SEQ ID NO: 8039919 - DNA, 22 bp, Homo sapiens
tgcaccttccacaagaactacc

SEQ ID NO: 8039920 - DNA, 22 bp, Homo sapiens
tgcacagtaaacatgactggag

SEQ ID NO: 8039921 - DNA, 22 bp, Homo sapiens
tgcacaggaggctgtggagaag

SEQ ID NO: 8039922 - DNA, 20 bp, Homo sapiens
tgcacagggtgggaagcaac

SEQ ID NO: 8039923 - DNA, 22 bp, Homo sapiens
tgcacaggtgagactcaggaag

SEQ ID NO: 8039924 - DNA, 17 bp, Homo sapiens
tgccagcctgtcccagg

SEQ ID NO: 8039925 - DNA, 22 bp, Homo sapiens
tgcccaggatctggcgatgctc

SEQ ID NO: 8039926 - DNA, 22 bp, Homo sapiens
tgcccaggcttcaccctcagag

SEQ ID NO: 8039927 - DNA, 22 bp, Homo sapiens
tgcccaggtttgagtgcccaag

SEQ ID NO: 8039928 - DNA, 19 bp, Homo sapiens
tgcctggcaccagctccac

SEQ ID NO: 8039929 - DNA, 22 bp, Homo sapiens
tgcctgccatgcagaaagctga

SEQ ID NO: 8039930 - DNA, 22 bp, Homo sapiens
tgcctctgtgggcagagctgcc

SEQ ID NO: 8039931 - DNA, 22 bp, Homo sapiens
tgcctctggttatctggtacct

SEQ ID NO: 8039932 - DNA, 22 bp, Homo sapiens
tgcctctgtggaaatggtggtc

SEQ ID NO: 8039933 - DNA, 22 bp, Homo sapiens
tgcctctgtgtgcaggtgagca

SEQ ID NO: 8039934 - DNA, 22 bp, Homo sapiens
tgcctgactgctgccaccacta

SEQ ID NO: 8039935 - DNA, 22 bp, Homo sapiens
tgcctctgctgctgtggcatca

SEQ ID NO: 8039936 - DNA, 22 bp, Homo sapiens
tgcctctgcctccattgttagt

SEQ ID NO: 8039937 - DNA, 22 bp, Homo sapiens
tgcctctctaacccatgcccaa

SEQ ID NO: 8039938 - DNA, 22 bp, Homo sapiens
tgcctcagagtgggcttgctat

SEQ ID NO: 8039939 - DNA, 22 bp, Homo sapiens
tgccctggcacacacacagctg

SEQ ID NO: 8039940 - DNA, 22 bp, Homo sapiens
tgccctggaaccatctacagtc

SEQ ID NO: 8039941 - DNA, 22 bp, Homo sapiens
tgcctcagagacctgacagtac

SEQ ID NO: 8039942 - DNA, 22 bp, Homo sapiens
tgcctaggctggagtgtagtgg

SEQ ID NO: 8039943 - DNA, 22 bp, Homo sapiens
tgcagtaaattcaggtacaact

SEQ ID NO: 8039944 - DNA, 22 bp, Homo sapiens
tgcattggtcttaatcttcagg

SEQ ID NO: 8039945 - DNA, 22 bp, Homo sapiens
tgccagccagggaagctcaccc

SEQ ID NO: 8039946 - DNA, 22 bp, Homo sapiens
tgagagcacacagaaatatttt

SEQ ID NO: 8039947 - DNA, 22 bp, Homo sapiens
tgagaggagtgattgtaaaatt

SEQ ID NO: 8039948 - DNA, 22 bp, Homo sapiens
tgagacagggtcttgctctgtt

SEQ ID NO: 8039949 - DNA, 17 bp, Homo sapiens
tgagacagggcaggccc

SEQ ID NO: 8039950 - DNA, 22 bp, Homo sapiens
tgagacagtcaccaggcaggcc

SEQ ID NO: 8039951 - DNA, 22 bp, Homo sapiens
tgagacagtcccatgatctgca

SEQ ID NO: 8039952 - DNA, 22 bp, Homo sapiens
tgagacagtatcgccccaaggc

SEQ ID NO: 8039953 - DNA, 22 bp, Homo sapiens
tgagacagtaattgtatagttt

SEQ ID NO: 8039954 - DNA, 18 bp, Homo sapiens
tgagacagctaccacttg

SEQ ID NO: 8039955 - DNA, 22 bp, Homo sapiens
tgagacaggagaggcccctcct

SEQ ID NO: 8039956 - DNA, 22 bp, Homo sapiens
tgagacaggcttccttcttggg

SEQ ID NO: 8039957 - DNA, 19 bp, Homo sapiens
tgagacagggattcaggtg

SEQ ID NO: 8039958 - DNA, 22 bp, Homo sapiens
tgagacagcccttctgcacagg

SEQ ID NO: 8039959 - DNA, 22 bp, Homo sapiens
tgagacagcctctgcactcatg

SEQ ID NO: 8039960 - DNA, 22 bp, Homo sapiens
tgagacagcagtcagggaaata

SEQ ID NO: 8039961 - DNA, 22 bp, Homo sapiens
tgagacaatatcctttgtaacc

SEQ ID NO: 8039962 - DNA, 19 bp, Homo sapiens
tgagacagagaccagttct

SEQ ID NO: 8039963 - DNA, 22 bp, Homo sapiens
tgagacagcagattagcaatga

SEQ ID NO: 8039964 - DNA, 19 bp, Homo sapiens
tgagacagaagatgagcct

SEQ ID NO: 8039965 - DNA, 22 bp, Homo sapiens
tgagctggagtctgtggctcct

SEQ ID NO: 8039966 - DNA, 22 bp, Homo sapiens
tgagcccttgacatcgcccact

SEQ ID NO: 8039967 - DNA, 22 bp, Homo sapiens
tgagcaggcgcagcaggaggtc

SEQ ID NO: 8039968 - DNA, 21 bp, Homo sapiens
tgaggatgtgcagcagcagga

SEQ ID NO: 8039969 - DNA, 22 bp, Homo sapiens
tgaggatggggagatggtgtct

SEQ ID NO: 8039970 - DNA, 22 bp, Homo sapiens
tgaggatggtcccgaggacact

SEQ ID NO: 8039971 - DNA, 22 bp, Homo sapiens
tgaggaaggaattgaggtttta

SEQ ID NO: 8039972 - DNA, 22 bp, Homo sapiens
tgaggaagggtgtgacggcacc

SEQ ID NO: 8039973 - DNA, 22 bp, Homo sapiens
tgaggaagtggttgtatggttt

SEQ ID NO: 8039974 - DNA, 22 bp, Homo sapiens
tgaggttatttattatgcatga

SEQ ID NO: 8039975 - DNA, 22 bp, Homo sapiens
tgagggagcacacactgaagtg

SEQ ID NO: 8039976 - DNA, 22 bp, Homo sapiens
tgagggactcccggccctgcca

SEQ ID NO: 8039977 - DNA, 23 bp, Homo sapiens
tgagggacatggtggcttctgag

SEQ ID NO: 8039978 - DNA, 22 bp, Homo sapiens
tgaacatgctgttgatggcctg

SEQ ID NO: 8039979 - DNA, 22 bp, Homo sapiens
tgaaagttaggatgtagtaatt

SEQ ID NO: 8039980 - DNA, 22 bp, Homo sapiens
tgaaagttacaggaaaacagat

SEQ ID NO: 8039981 - DNA, 22 bp, Homo sapiens
tgaaagttattactgatgatgt

SEQ ID NO: 8039982 - DNA, 22 bp, Homo sapiens
tgaaagttattactgatgatgt

SEQ ID NO: 8039983 - DNA, 23 bp, Homo sapiens
tgaaagcaatgggtctatagtat

SEQ ID NO: 8039984 - DNA, 22 bp, Homo sapiens
tgaaataatatctggatcaatc

SEQ ID NO: 8039985 - DNA, 22 bp, Homo sapiens
tgaaatagacttgcactatatg

SEQ ID NO: 8039986 - DNA, 22 bp, Homo sapiens
tgaaacaggcaaaactgcagat

SEQ ID NO: 8039987 - DNA, 19 bp, Homo sapiens
tgaaacaaacttaaaagga

SEQ ID NO: 8039988 - DNA, 22 bp, Homo sapiens
tgaaacaaaccagtaattttgt

SEQ ID NO: 8039989 - DNA, 22 bp, Homo sapiens
tgaaaattctcaggctcacccc

SEQ ID NO: 8039990 - DNA, 22 bp, Homo sapiens
tgaaaattcatctcatagcaga

SEQ ID NO: 8039991 - DNA, 22 bp, Homo sapiens
tgaaaattaagcagatgaatga

SEQ ID NO: 8039992 - DNA, 22 bp, Homo sapiens
tgaaaatttccatcagttatat

SEQ ID NO: 8039993 - DNA, 22 bp, Homo sapiens
tgaaaattgttgtacttgataa

SEQ ID NO: 8039994 - DNA, 22 bp, Homo sapiens
tgaaacaaaagtatgtagcttg

SEQ ID NO: 8039995 - DNA, 22 bp, Homo sapiens
tgaaaaaacaagttggcccatt

SEQ ID NO: 8039996 - DNA, 22 bp, Homo sapiens
tctttttctgcacacgtgtccc

SEQ ID NO: 8039997 - DNA, 22 bp, Homo sapiens
tcttttatctgttgtgtaacaa

SEQ ID NO: 8039998 - DNA, 22 bp, Homo sapiens
tcttttattaggctgaaatggg

SEQ ID NO: 8039999 - DNA, 22 bp, Homo sapiens
tgacaaaactgcaattactttt

SEQ ID NO: 8040000 - DNA, 22 bp, Homo sapiens
tgaatacaggaaaatatactga

SEQ ID NO: 8040001 - DNA, 22 bp, Homo sapiens
tgaatacactaaaaatcacttt

SEQ ID NO: 8040002 - DNA, 22 bp, Homo sapiens
tgaatgtaggtctaatatccca

SEQ ID NO: 8040003 - DNA, 22 bp, Homo sapiens
tgaatgaatgaattaatagagt

SEQ ID NO: 8040004 - DNA, 22 bp, Homo sapiens
tgaatgaatcctaacaaagaca

SEQ ID NO: 8040005 - DNA, 22 bp, Homo sapiens
tgacacagtagaaagatgatga

SEQ ID NO: 8040006 - DNA, 22 bp, Homo sapiens
tgacacagtatcaaacatgatt

SEQ ID NO: 8040007 - DNA, 23 bp, Homo sapiens
tgacacaggtcaaaaataagatg

SEQ ID NO: 8040008 - DNA, 22 bp, Homo sapiens
tgacacagattagagacatacc

SEQ ID NO: 8040009 - DNA, 22 bp, Homo sapiens
tgacaggaggcttgaggccagg

SEQ ID NO: 8040010 - DNA, 22 bp, Homo sapiens
tggctcctcatcacagttggtg

SEQ ID NO: 8040011 - DNA, 22 bp, Homo sapiens
tggctcctgcatttgtgctaac

SEQ ID NO: 8040012 - DNA, 22 bp, Homo sapiens
tggccttcctggtgactcatga

SEQ ID NO: 8040013 - DNA, 21 bp, Homo sapiens
tggctaaaccctagtaaatta

SEQ ID NO: 8040014 - DNA, 22 bp, Homo sapiens
tggctaaacttgggtcagatgt

SEQ ID NO: 8040015 - DNA, 22 bp, Homo sapiens
tggctaaaccctagtaaattaa

SEQ ID NO: 8040016 - DNA, 22 bp, Homo sapiens
tggctgagagcaattgactctg

SEQ ID NO: 8040017 - DNA, 22 bp, Homo sapiens
tggctccttccgcagcatgcct

SEQ ID NO: 8040018 - DNA, 22 bp, Homo sapiens
tggcttcagagacagaatctat

SEQ ID NO: 8040019 - DNA, 22 bp, Homo sapiens
tgggaacaacatgcactgccac

SEQ ID NO: 8040020 - DNA, 22 bp, Homo sapiens
tgggaacacctgctgcccagtg

SEQ ID NO: 8040021 - DNA, 22 bp, Homo sapiens
tgggaaagtgtagcctgcaggc

SEQ ID NO: 8040022 - DNA, 22 bp, Homo sapiens
tgggaagaagcagagaactgga

SEQ ID NO: 8040023 - DNA, 21 bp, Homo sapiens
tggctttgccctgcttgcccc

SEQ ID NO: 8040024 - DNA, 22 bp, Homo sapiens
tgggagaaactgtctctcccac

SEQ ID NO: 8040025 - DNA, 22 bp, Homo sapiens
tgggaagatggagtgacaggca

SEQ ID NO: 8040026 - DNA, 22 bp, Homo sapiens
tgggaatgtgagcattcattca

SEQ ID NO: 8040027 - DNA, 22 bp, Homo sapiens
tgggactcactcttttggccag

SEQ ID NO: 8040028 - DNA, 22 bp, Homo sapiens
tggcactcactctcagagtctg

SEQ ID NO: 8040029 - DNA, 22 bp, Homo sapiens
tggcacagacatttaatagcct

SEQ ID NO: 8040030 - DNA, 22 bp, Homo sapiens
tggcacagacagcacagcaatg

SEQ ID NO: 8040031 - DNA, 22 bp, Homo sapiens
tggattgataaaatgggatgtt

SEQ ID NO: 8040032 - DNA, 22 bp, Homo sapiens
tggattgataagagacaagtga

SEQ ID NO: 8040033 - DNA, 22 bp, Homo sapiens
tggatgtgagaaggatcaggct

SEQ ID NO: 8040034 - DNA, 22 bp, Homo sapiens
tggcaaagtatctgtcccagct

SEQ ID NO: 8040035 - DNA, 22 bp, Homo sapiens
tggcaaaggcgctcacatgcct

SEQ ID NO: 8040036 - DNA, 22 bp, Homo sapiens
tggcagagttcgctgtgccttt

SEQ ID NO: 8040037 - DNA, 22 bp, Homo sapiens
tggcaggaaagtaacagagcac

SEQ ID NO: 8040038 - DNA, 22 bp, Homo sapiens
tggcctctgggaaagcagattc

SEQ ID NO: 8040039 - DNA, 22 bp, Homo sapiens
tggcctcaaccgtcctaagcac

SEQ ID NO: 8040040 - DNA, 20 bp, Homo sapiens
tggcctctgagatgccacgg

SEQ ID NO: 8040041 - DNA, 22 bp, Homo sapiens
tggcctctgtgggagctgagca

SEQ ID NO: 8040042 - DNA, 22 bp, Homo sapiens
tggcctgccactgccacgccac

SEQ ID NO: 8040043 - DNA, 22 bp, Homo sapiens
tggcatctccgacagtcttgat

SEQ ID NO: 8040044 - DNA, 22 bp, Homo sapiens
tggcagtggataggggagcggt

SEQ ID NO: 8040045 - DNA, 22 bp, Homo sapiens
tggcagtggctcagagtgcaga

SEQ ID NO: 8040046 - DNA, 22 bp, Homo sapiens
tggcagtagatccagtctctct

SEQ ID NO: 8040047 - DNA, 21 bp, Homo sapiens
tggcaggttcaaaggcctatc

SEQ ID NO: 8040048 - DNA, 22 bp, Homo sapiens
tggcagggtgccagttgcgagt

SEQ ID NO: 8040049 - DNA, 19 bp, Homo sapiens
tggcaggtagtgagcagtc

SEQ ID NO: 8040050 - DNA, 19 bp, Homo sapiens
tggccaggtactgtctgct

SEQ ID NO: 8040051 - DNA, 22 bp, Homo sapiens
tgcttaaacatccagacagtat

SEQ ID NO: 8040052 - DNA, 22 bp, Homo sapiens
tgctgggtgttccgcacttgac

SEQ ID NO: 8040053 - DNA, 22 bp, Homo sapiens
tgctggcacgtggaccaggaga

SEQ ID NO: 8040054 - DNA, 17 bp, Homo sapiens
tgctggcaacatacaaa

SEQ ID NO: 8040055 - DNA, 20 bp, Homo sapiens
tgcctggcctttctctgccc

SEQ ID NO: 8040056 - DNA, 22 bp, Homo sapiens
tgccttggattgcagggaacct

SEQ ID NO: 8040057 - DNA, 22 bp, Homo sapiens
tgctcagtgagtctgtgacagg

SEQ ID NO: 8040058 - DNA, 22 bp, Homo sapiens
tgctcagttaagcagaggaaat

SEQ ID NO: 8040059 - DNA, 20 bp, Homo sapiens
tgctctgggggtggagagac

SEQ ID NO: 8040060 - DNA, 22 bp, Homo sapiens
tgctgaggcccaggagcacttt

SEQ ID NO: 8040061 - DNA, 22 bp, Homo sapiens
tgctctcctgctcctcagccca

SEQ ID NO: 8040062 - DNA, 22 bp, Homo sapiens
tggagggaacaaaggagtccca

SEQ ID NO: 8040063 - DNA, 22 bp, Homo sapiens
tggagagaagaggcagtgtgct

SEQ ID NO: 8040064 - DNA, 22 bp, Homo sapiens
tggagagaacagtgtctgaaag

SEQ ID NO: 8040065 - DNA, 22 bp, Homo sapiens
tggagagaaagttgaatggagg

SEQ ID NO: 8040066 - DNA, 22 bp, Homo sapiens
tggagcccagggtgagaaggag

SEQ ID NO: 8040067 - DNA, 22 bp, Homo sapiens
tggagcccaggagaggataaac

SEQ ID NO: 8040068 - DNA, 22 bp, Homo sapiens
tggaaggaagccaaggaaggtt

SEQ ID NO: 8040069 - DNA, 22 bp, Homo sapiens
tggaatgacagagagtctgaat

SEQ ID NO: 8040070 - DNA, 22 bp, Homo sapiens
tggaaagaggtagaggatctgg

SEQ ID NO: 8040071 - DNA, 22 bp, Homo sapiens
tggaaagaggtagaggatctgg

SEQ ID NO: 8040072 - DNA, 22 bp, Homo sapiens
tggaaagaggaagtgcccagca

SEQ ID NO: 8040073 - DNA, 22 bp, Homo sapiens
tggaaagagaaactcttgctaa

SEQ ID NO: 8040074 - DNA, 22 bp, Homo sapiens
tggaaatacttgccataaaact

SEQ ID NO: 8040075 - DNA, 22 bp, Homo sapiens
tggaaaggacagttgctgatag

SEQ ID NO: 8040076 - DNA, 22 bp, Homo sapiens
ttagatcttaggcaaatgtgtt

SEQ ID NO: 8040077 - DNA, 22 bp, Homo sapiens
ttagaaatcacctctgaagatc

SEQ ID NO: 8040078 - DNA, 22 bp, Homo sapiens
ttagaaatgtcacagatctgat

SEQ ID NO: 8040079 - DNA, 22 bp, Homo sapiens
ttagggaaggacagtgaagaaa

SEQ ID NO: 8040080 - DNA, 20 bp, Homo sapiens
ttacactttgtagcattttt

SEQ ID NO: 8040081 - DNA, 22 bp, Homo sapiens
ttaatgtatggggttgagatga

SEQ ID NO: 8040082 - DNA, 22 bp, Homo sapiens
ttcacatttctctgctgtttga

SEQ ID NO: 8040083 - DNA, 22 bp, Homo sapiens
ttcacattgttttaatgtgaat

SEQ ID NO: 8040084 - DNA, 22 bp, Homo sapiens
ttcacatttactggtttgtccg

SEQ ID NO: 8040085 - DNA, 22 bp, Homo sapiens
ttcacattggtgatatgtttct

SEQ ID NO: 8040086 - DNA, 22 bp, Homo sapiens
ttcactgccaactaacatggaa

SEQ ID NO: 8040087 - DNA, 22 bp, Homo sapiens
ttcactgcaacctccgcctccc

SEQ ID NO: 8040088 - DNA, 22 bp, Homo sapiens
tgttaaaaattcagctctagat

SEQ ID NO: 8040089 - DNA, 22 bp, Homo sapiens
tgtggggaagagtatgacttgg

SEQ ID NO: 8040090 - DNA, 22 bp, Homo sapiens
ttaaaatgtacaggggaaagtg

SEQ ID NO: 8040091 - DNA, 23 bp, Homo sapiens
tgtttgtttctatgagagatagc

SEQ ID NO: 8040092 - DNA, 22 bp, Homo sapiens
tgtgcacaatgtgcaggtttgt

SEQ ID NO: 8040093 - DNA, 23 bp, Homo sapiens
tgtgcacatctgacgggtgaagg

SEQ ID NO: 8040094 - DNA, 22 bp, Homo sapiens
tgtgcacattctaggactagta

SEQ ID NO: 8040095 - DNA, 22 bp, Homo sapiens
tgggatgataggtaagtaatta

SEQ ID NO: 8040096 - DNA, 19 bp, Homo sapiens
tgggatgatgcagaaggta

SEQ ID NO: 8040097 - DNA, 22 bp, Homo sapiens
tgggatgagctatatagaaagt

SEQ ID NO: 8040098 - DNA, 22 bp, Homo sapiens
tgggctcttcctatagtttata

SEQ ID NO: 8040099 - DNA, 22 bp, Homo sapiens
tgggctctggtttcctggctgg

SEQ ID NO: 8040100 - DNA, 22 bp, Homo sapiens
tgggctctgaagtcagtctgct

SEQ ID NO: 8040101 - DNA, 22 bp, Homo sapiens
tgggcctccgcatggcccagcg

SEQ ID NO: 8040102 - DNA, 22 bp, Homo sapiens
tgggcctcctgccctggcctag

SEQ ID NO: 8040103 - DNA, 22 bp, Homo sapiens
tgggcctcatgcccagccaccc

SEQ ID NO: 8040104 - DNA, 22 bp, Homo sapiens
tgggcctctgtttcctcatctg

SEQ ID NO: 8040105 - DNA, 20 bp, Homo sapiens
tgggcctctggtgcctctgg

SEQ ID NO: 8040106 - DNA, 22 bp, Homo sapiens
tggtaagaacccatcagagaag

SEQ ID NO: 8040107 - DNA, 23 bp, Homo sapiens
tggtataaaaacagtacctacct

SEQ ID NO: 8040108 - DNA, 22 bp, Homo sapiens
tggtataagctgtgtcagagcc

SEQ ID NO: 8040109 - DNA, 22 bp, Homo sapiens
tgtattttctgaagataatcaa

SEQ ID NO: 8040110 - DNA, 22 bp, Homo sapiens
tgtcacagagcaactatttctt

SEQ ID NO: 8040111 - DNA, 22 bp, Homo sapiens
tgtcacagtctcgtgagcatct

SEQ ID NO: 8040112 - DNA, 21 bp, Homo sapiens
tgtcacagattctcagcttgc

SEQ ID NO: 8040113 - DNA, 22 bp, Homo sapiens
tgtccctctgaggcttccctgg

SEQ ID NO: 8040114 - DNA, 22 bp, Homo sapiens
tgtcacttcagttttgaaacaa

SEQ ID NO: 8040115 - DNA, 22 bp, Homo sapiens
tggtctctgcaggccaggctca

SEQ ID NO: 8040116 - DNA, 22 bp, Homo sapiens
tggtcaggattctcagcccttc

SEQ ID NO: 8040117 - DNA, 22 bp, Homo sapiens
tgtacagaggtgtacatatgat

SEQ ID NO: 8040118 - DNA, 22 bp, Homo sapiens
tgtaagaaaacctgtacaaaga

SEQ ID NO: 8040119 - DNA, 22 bp, Homo sapiens
tgtaagaacaactgtcaaatgt

SEQ ID NO: 8040120 - DNA, 22 bp, Homo sapiens
tgtacaaagttaaacctatata

SEQ ID NO: 8040121 - DNA, 22 bp, Homo sapiens
tgtaacaaaataccttggattg

SEQ ID NO: 8040122 - DNA, 22 bp, Homo sapiens
tgtaaataattcctaggctttt

SEQ ID NO: 8040123 - DNA, 20 bp, Homo sapiens
tgtaaataggcattgtagtt

SEQ ID NO: 8040124 - DNA, 22 bp, Homo sapiens
tgtaaatagttagcttgcctct

SEQ ID NO: 8040125 - DNA, 22 bp, Homo sapiens
tgtaaagtccaagatcaaagag

SEQ ID NO: 8040126 - DNA, 22 bp, Homo sapiens
aacaagtaagtttatatatatt

SEQ ID NO: 8040127 - DNA, 22 bp, Homo sapiens
aacaatcaagtttctaaatgac

SEQ ID NO: 8040128 - DNA, 22 bp, Homo sapiens
aagggagcggggagaccctatg

SEQ ID NO: 8040129 - DNA, 22 bp, Homo sapiens
aagtttctgtatgctcttctgt

SEQ ID NO: 8040130 - DNA, 22 bp, Homo sapiens
aagtttctgttcatatctctga

SEQ ID NO: 8040131 - DNA, 22 bp, Homo sapiens
aacactgtactggaagatggac

SEQ ID NO: 8040132 - DNA, 20 bp, Homo sapiens
aagttacattgtattgtacc

SEQ ID NO: 8040133 - DNA, 22 bp, Homo sapiens
aagtattcataaggacatatgt

SEQ ID NO: 8040134 - DNA, 22 bp, Homo sapiens
aacactgagtatcagagttggg

SEQ ID NO: 8040135 - DNA, 22 bp, Homo sapiens
aactcccactcagcttcttaat

SEQ ID NO: 8040136 - DNA, 22 bp, Homo sapiens
aagcacatctcctgtgcagaac

SEQ ID NO: 8040137 - DNA, 22 bp, Homo sapiens
acagatgagaagctgcattcaa

SEQ ID NO: 8040138 - DNA, 22 bp, Homo sapiens
acagatgaaacccagctagttg

SEQ ID NO: 8040139 - DNA, 22 bp, Homo sapiens
acagatcctggttacagccatt

SEQ ID NO: 8040140 - DNA, 22 bp, Homo sapiens
acagaggaagcatatagcacaa

SEQ ID NO: 8040141 - DNA, 22 bp, Homo sapiens
acagaggaaggctgagctgccc

SEQ ID NO: 8040142 - DNA, 22 bp, Homo sapiens
acagaagaccaagaaagcttcc

SEQ ID NO: 8040143 - DNA, 22 bp, Homo sapiens
acagaagacagagtgttcatct

SEQ ID NO: 8040144 - DNA, 22 bp, Homo sapiens
acagaagagctggctctgtgct

SEQ ID NO: 8040145 - DNA, 22 bp, Homo sapiens
aagattttctcaactgtatttg

SEQ ID NO: 8040146 - DNA, 22 bp, Homo sapiens
aagacattttagagatagggaa

SEQ ID NO: 8040147 - DNA, 22 bp, Homo sapiens
aagaggtcataccagataaggg

SEQ ID NO: 8040148 - DNA, 22 bp, Homo sapiens
acacgcatgatgatgcacgtac

SEQ ID NO: 8040149 - DNA, 22 bp, Homo sapiens
acactacaatctcagaactata

SEQ ID NO: 8040150 - DNA, 20 bp, Homo sapiens
aagagtctttactgagctaa

SEQ ID NO: 8040151 - DNA, 22 bp, Homo sapiens
aatgtcaagtagccaatgcttc

SEQ ID NO: 8040152 - DNA, 22 bp, Homo sapiens
aatgttacgatcaacaacacat

SEQ ID NO: 8040153 - DNA, 22 bp, Homo sapiens
aattcaatctaagaaatgatca

SEQ ID NO: 8040154 - DNA, 22 bp, Homo sapiens
aagaattttccagcatgtcagt

SEQ ID NO: 8040155 - DNA, 22 bp, Homo sapiens
aagacattccaaagtggctaat

SEQ ID NO: 8040156 - DNA, 22 bp, Homo sapiens
aagacattcatgaagaagggat

SEQ ID NO: 8040157 - DNA, 22 bp, Homo sapiens
aagacattggcattgactgtaa

SEQ ID NO: 8040158 - DNA, 22 bp, Homo sapiens
aagacattgtggagatgttgct

SEQ ID NO: 8040159 - DNA, 22 bp, Homo sapiens
acaactgtcagtaaagaatatt

SEQ ID NO: 8040160 - DNA, 22 bp, Homo sapiens
aaatatgtaaccaaggtgaagt

SEQ ID NO: 8040161 - DNA, 22 bp, Homo sapiens
aaatatgtaagattagcactag

SEQ ID NO: 8040162 - DNA, 22 bp, Homo sapiens
aaacttgatttagaactaaggc

SEQ ID NO: 8040163 - DNA, 22 bp, Homo sapiens
aaagaacttatcctagaatttg

SEQ ID NO: 8040164 - DNA, 22 bp, Homo sapiens
aaaatagctatggaatgtcact

SEQ ID NO: 8040165 - DNA, 22 bp, Homo sapiens
aaaatagatgaaaggaagtctg

SEQ ID NO: 8040166 - DNA, 22 bp, Homo sapiens
aaaatagattctaggatgtctt

SEQ ID NO: 8040167 - DNA, 22 bp, Homo sapiens
aaacaacttctgcactatgggt

SEQ ID NO: 8040168 - DNA, 22 bp, Homo sapiens
aaacaagagcttacatggctgc

SEQ ID NO: 8040169 - DNA, 22 bp, Homo sapiens
aaaagtctgctctcatttcaga

SEQ ID NO: 8040170 - DNA, 22 bp, Homo sapiens
aaaagtctacaagcttcaacaa

SEQ ID NO: 8040171 - DNA, 22 bp, Homo sapiens
aaaaatgcttggacttaataaa

SEQ ID NO: 8040172 - DNA, 22 bp, Homo sapiens
aaaaactgtaattacttttgca

SEQ ID NO: 8040173 - DNA, 22 bp, Homo sapiens
aaaaagacttccaactcaggag

SEQ ID NO: 8040174 - DNA, 22 bp, Homo sapiens
aacaacttgcgttcagagatgt

SEQ ID NO: 8040175 - DNA, 22 bp, Homo sapiens
aacattaattacagtcaaacat

SEQ ID NO: 8040176 - DNA, 22 bp, Homo sapiens
aagagccagctagtgaagaggc

SEQ ID NO: 8040177 - DNA, 22 bp, Homo sapiens
aagaatgttcattaaactgttg

SEQ ID NO: 8040178 - DNA, 22 bp, Homo sapiens
aagaaagtgggtaatatgattt

SEQ ID NO: 8040179 - DNA, 22 bp, Homo sapiens
aagaaagtgggtaatatgattt

SEQ ID NO: 8040180 - DNA, 22 bp, Homo sapiens
aagcactgggtatagcaatgat

SEQ ID NO: 8040181 - DNA, 22 bp, Homo sapiens
aagcactgagcacagtggctga

SEQ ID NO: 8040182 - DNA, 22 bp, Homo sapiens
aagcacagctggaacagcagga

SEQ ID NO: 8040183 - DNA, 22 bp, Homo sapiens
agatatgtttgtatatatttgt

SEQ ID NO: 8040184 - DNA, 22 bp, Homo sapiens
agatatgttactgcatcatggg

SEQ ID NO: 8040185 - DNA, 22 bp, Homo sapiens
agatatgtgccaattgttataa

SEQ ID NO: 8040186 - DNA, 22 bp, Homo sapiens
agatatgttaggcttgttccct

SEQ ID NO: 8040187 - DNA, 22 bp, Homo sapiens
agatatgttgtttaaggcacca

SEQ ID NO: 8040188 - DNA, 22 bp, Homo sapiens
agatatgtccctgtctaatatt

SEQ ID NO: 8040189 - DNA, 22 bp, Homo sapiens
agatatcttacactttgaagtt

SEQ ID NO: 8040190 - DNA, 22 bp, Homo sapiens
agatataataatttacaagtgt

SEQ ID NO: 8040191 - DNA, 22 bp, Homo sapiens
acaaaaagctccattactgtcc

SEQ ID NO: 8040192 - DNA, 22 bp, Homo sapiens
aattttgtttaagtgatctgct

SEQ ID NO: 8040193 - DNA, 22 bp, Homo sapiens
agaggcttggaggtgcaaggtt

SEQ ID NO: 8040194 - DNA, 22 bp, Homo sapiens
aattcactccacttctgtgtct

SEQ ID NO: 8040195 - DNA, 22 bp, Homo sapiens
aattcacttgtgcacgctatgg

SEQ ID NO: 8040196 - DNA, 22 bp, Homo sapiens
agagacagggttttgccatgtt

SEQ ID NO: 8040197 - DNA, 22 bp, Homo sapiens
aatgtataaccataggaaattt

SEQ ID NO: 8040198 - DNA, 22 bp, Homo sapiens
agacactgatgttcagctcaat

SEQ ID NO: 8040199 - DNA, 17 bp, Homo sapiens
agacactgagccaagta

SEQ ID NO: 8040200 - DNA, 22 bp, Homo sapiens
aatgtacactgaaagcctatca

SEQ ID NO: 8040201 - DNA, 22 bp, Homo sapiens
aatgtacatctcagtgtagtac

SEQ ID NO: 8040202 - DNA, 22 bp, Homo sapiens
aatgtactaataagcaacattt

SEQ ID NO: 8040203 - DNA, 22 bp, Homo sapiens
acagaactgcagacagtgccaa

SEQ ID NO: 8040204 - DNA, 22 bp, Homo sapiens
acagaactgcaggaggaaaagc

SEQ ID NO: 8040205 - DNA, 22 bp, Homo sapiens
agcattgctaaagctaattttt

SEQ ID NO: 8040206 - DNA, 22 bp, Homo sapiens
agcattgcctgcctattgctaa

SEQ ID NO: 8040207 - DNA, 22 bp, Homo sapiens
agcattgaggtgggtttctctt

SEQ ID NO: 8040208 - DNA, 22 bp, Homo sapiens
agccctgcaggatgagggaggt

SEQ ID NO: 8040209 - DNA, 22 bp, Homo sapiens
agccctgcaggaggtgggagag

SEQ ID NO: 8040210 - DNA, 22 bp, Homo sapiens
acatggtgtgctgagaatgaca

SEQ ID NO: 8040211 - DNA, 23 bp, Homo sapiens
acatagaacagaatatatttgtg

SEQ ID NO: 8040212 - DNA, 22 bp, Homo sapiens
acataagtgcacaataaatatt

SEQ ID NO: 8040213 - DNA, 22 bp, Homo sapiens
acataagttatggataaaatgt

SEQ ID NO: 8040214 - DNA, 22 bp, Homo sapiens
acataatgaaatgcagaaatca

SEQ ID NO: 8040215 - DNA, 22 bp, Homo sapiens
acataatggacaataatgcatc

SEQ ID NO: 8040216 - DNA, 22 bp, Homo sapiens
aagccctgagcactgcagagaa

SEQ ID NO: 8040217 - DNA, 22 bp, Homo sapiens
aagccctggcgggtggagggcc

SEQ ID NO: 8040218 - DNA, 22 bp, Homo sapiens
aagccctggattaaagatgcca

SEQ ID NO: 8040219 - DNA, 22 bp, Homo sapiens
aagccctggcaatgtcagatga

SEQ ID NO: 8040220 - DNA, 22 bp, Homo sapiens
acaggtccttataagagcactc

SEQ ID NO: 8040221 - DNA, 20 bp, Homo sapiens
agaaaatgttttcagctgga

SEQ ID NO: 8040222 - DNA, 22 bp, Homo sapiens
agaaaattactccagagacaag

SEQ ID NO: 8040223 - DNA, 22 bp, Homo sapiens
aatatgatccttaaccttcatg

SEQ ID NO: 8040224 - DNA, 21 bp, Homo sapiens
aataaccactaatatagtggc

SEQ ID NO: 8040225 - DNA, 22 bp, Homo sapiens
actgagactgagaatgtttctt

SEQ ID NO: 8040226 - DNA, 22 bp, Homo sapiens
actgagacaactgtgtttctaa

SEQ ID NO: 8040227 - DNA, 22 bp, Homo sapiens
actcatgtcctaggagtaaagc

SEQ ID NO: 8040228 - DNA, 23 bp, Homo sapiens
actcagagaccccgggaagtgac

SEQ ID NO: 8040229 - DNA, 22 bp, Homo sapiens
aagtggctttgagcttctgcca

SEQ ID NO: 8040230 - DNA, 22 bp, Homo sapiens
aagtggctcatgtggcttctgc

SEQ ID NO: 8040231 - DNA, 22 bp, Homo sapiens
cagagacattaagtgccatgat

SEQ ID NO: 8040232 - DNA, 22 bp, Homo sapiens
cagagacatgtggcctgcacgt

SEQ ID NO: 8040233 - DNA, 20 bp, Homo sapiens
agcccatctcccacagctac

SEQ ID NO: 8040234 - DNA, 22 bp, Homo sapiens
agccctgcgtgccaggggactg

SEQ ID NO: 8040235 - DNA, 22 bp, Homo sapiens
agcaggttgtgatacactcaga

SEQ ID NO: 8040236 - DNA, 22 bp, Homo sapiens
agcagaggtttgttggaaacct

SEQ ID NO: 8040237 - DNA, 17 bp, Homo sapiens
agcactaaaatgcttcc

SEQ ID NO: 8040238 - DNA, 22 bp, Homo sapiens
agcactgctttagagcctctgc

SEQ ID NO: 8040239 - DNA, 22 bp, Homo sapiens
agcacctgtcacaagcagaagg

SEQ ID NO: 8040240 - DNA, 22 bp, Homo sapiens
caaagggcattttagtgaactg

SEQ ID NO: 8040241 - DNA, 22 bp, Homo sapiens
caaagggcggctgtcggagggt

SEQ ID NO: 8040242 - DNA, 22 bp, Homo sapiens
caaagggcatggcctgagcact

SEQ ID NO: 8040243 - DNA, 22 bp, Homo sapiens
agagaattctggtgctaacaag

SEQ ID NO: 8040244 - DNA, 22 bp, Homo sapiens
agagaattaacattccatggct

SEQ ID NO: 8040245 - DNA, 22 bp, Homo sapiens
agagaattctggtgctaacaag

SEQ ID NO: 8040246 - DNA, 21 bp, Homo sapiens
agagacagagaaagtaacatt

SEQ ID NO: 8040247 - DNA, 22 bp, Homo sapiens
agagacagacacatcgggctgc

SEQ ID NO: 8040248 - DNA, 22 bp, Homo sapiens
agagaatgcagggcttcggaca

SEQ ID NO: 8040249 - DNA, 18 bp, Homo sapiens
agactttgagttagaggg

SEQ ID NO: 8040250 - DNA, 22 bp, Homo sapiens
agactgtactttctgcagctct

SEQ ID NO: 8040251 - DNA, 22 bp, Homo sapiens
agactgtagggatagaggtctt

SEQ ID NO: 8040252 - DNA, 22 bp, Homo sapiens
agagccctggagggcagtcccg

SEQ ID NO: 8040253 - DNA, 22 bp, Homo sapiens
agagcagatggagctggaagag

SEQ ID NO: 8040254 - DNA, 22 bp, Homo sapiens
agacaaatttcctgcaatgaag

SEQ ID NO: 8040255 - DNA, 22 bp, Homo sapiens
agacaagactaggcagttgttg

SEQ ID NO: 8040256 - DNA, 22 bp, Homo sapiens
agacaagaaactgggagtctct

SEQ ID NO: 8040257 - DNA, 22 bp, Homo sapiens
agacactgttctcacatgcttg

SEQ ID NO: 8040258 - DNA, 23 bp, Homo sapiens
agacactgtaaagaattgcagtt

SEQ ID NO: 8040259 - DNA, 22 bp, Homo sapiens
agactgtaattgacatgtcagc

SEQ ID NO: 8040260 - DNA, 22 bp, Homo sapiens
agactgtaatttgtggcctcct

SEQ ID NO: 8040261 - DNA, 22 bp, Homo sapiens
atgcatatgtacccatgttctg

SEQ ID NO: 8040262 - DNA, 22 bp, Homo sapiens
atgcatattgtcatttagtcct

SEQ ID NO: 8040263 - DNA, 22 bp, Homo sapiens
agagtcagaaagcagacagggg

SEQ ID NO: 8040264 - DNA, 22 bp, Homo sapiens
agagtcagcttatgacacagtc

SEQ ID NO: 8040265 - DNA, 21 bp, Homo sapiens
agagtctgagtgtgcaagggc

SEQ ID NO: 8040266 - DNA, 23 bp, Homo sapiens
agaggccagcctttggagacacc

SEQ ID NO: 8040267 - DNA, 22 bp, Homo sapiens
agatcactggttacttaatgaa

SEQ ID NO: 8040268 - DNA, 23 bp, Homo sapiens
agcttttaggtggaaatggcact

SEQ ID NO: 8040269 - DNA, 22 bp, Homo sapiens
agcttttagtacgttaaaattg

SEQ ID NO: 8040270 - DNA, 22 bp, Homo sapiens
aggaaaaaagtctgtgattata

SEQ ID NO: 8040271 - DNA, 18 bp, Homo sapiens
aggaaagaaaggcaggtg

SEQ ID NO: 8040272 - DNA, 18 bp, Homo sapiens
aggaaagaaaggcaggtg

SEQ ID NO: 8040273 - DNA, 21 bp, Homo sapiens
agctggctctctctggagaga

SEQ ID NO: 8040274 - DNA, 22 bp, Homo sapiens
agctgggatgaggagcatcctt

SEQ ID NO: 8040275 - DNA, 22 bp, Homo sapiens
agctggctatgccctgtgaacc

SEQ ID NO: 8040276 - DNA, 22 bp, Homo sapiens
aggagacatggaatagtgaggc

SEQ ID NO: 8040277 - DNA, 22 bp, Homo sapiens
aggagacataactatgatgaga

SEQ ID NO: 8040278 - DNA, 22 bp, Homo sapiens
aggagacatactataggaatat

SEQ ID NO: 8040279 - DNA, 22 bp, Homo sapiens
acaggggtgcatggtgcatggt

SEQ ID NO: 8040280 - DNA, 20 bp, Homo sapiens
aggagccattgactgcagca

SEQ ID NO: 8040281 - DNA, 22 bp, Homo sapiens
aggagctgcagattctgccttg

SEQ ID NO: 8040282 - DNA, 22 bp, Homo sapiens
aggaggctgtggagcactccat

SEQ ID NO: 8040283 - DNA, 22 bp, Homo sapiens
aggaggcttttgcaggtgccac

SEQ ID NO: 8040284 - DNA, 22 bp, Homo sapiens
acataaatttcactgttccgtg

SEQ ID NO: 8040285 - DNA, 23 bp, Homo sapiens
acatacatggagataaagtgatg

SEQ ID NO: 8040286 - DNA, 22 bp, Homo sapiens
acatacatatgtttaaatgcat

SEQ ID NO: 8040287 - DNA, 22 bp, Homo sapiens
acatacatgggattaaaaaatt

SEQ ID NO: 8040288 - DNA, 22 bp, Homo sapiens
acatgaaaagactatctgatta

SEQ ID NO: 8040289 - DNA, 20 bp, Homo sapiens
acatgaaaggaaacaggaaa

SEQ ID NO: 8040290 - DNA, 18 bp, Homo sapiens
accctctggcttctgagc

SEQ ID NO: 8040291 - DNA, 22 bp, Homo sapiens
accctctgccttgagcagtgcc

SEQ ID NO: 8040292 - DNA, 22 bp, Homo sapiens
acccaccctactagcagtgtcc

SEQ ID NO: 8040293 - DNA, 22 bp, Homo sapiens
agaaagaggatgcagatctcat

SEQ ID NO: 8040294 - DNA, 22 bp, Homo sapiens
atcagtctgtgttagaaaagag

SEQ ID NO: 8040295 - DNA, 22 bp, Homo sapiens
atcagtagtgtgaaaacagact

SEQ ID NO: 8040296 - DNA, 22 bp, Homo sapiens
atattttgtaacttggaatagg

SEQ ID NO: 8040297 - DNA, 21 bp, Homo sapiens
agaaaaacacgatataagccc

SEQ ID NO: 8040298 - DNA, 22 bp, Homo sapiens
acttttcccttggtagagttgc

SEQ ID NO: 8040299 - DNA, 22 bp, Homo sapiens
agtttctagcaaggattgttga

SEQ ID NO: 8040300 - DNA, 22 bp, Homo sapiens
atacaaaatatatactggagac

SEQ ID NO: 8040301 - DNA, 22 bp, Homo sapiens
atacaaaaattagccgggagta

SEQ ID NO: 8040302 - DNA, 22 bp, Homo sapiens
atacatcatgctccatatattt

SEQ ID NO: 8040303 - DNA, 22 bp, Homo sapiens
aggtcttggtaggccagagtct

SEQ ID NO: 8040304 - DNA, 22 bp, Homo sapiens
accttcctctaagacatttagc

SEQ ID NO: 8040305 - DNA, 22 bp, Homo sapiens
actcctgggtgctgaccagcgt

SEQ ID NO: 8040306 - DNA, 22 bp, Homo sapiens
actgcactcctgcctgggtaac

SEQ ID NO: 8040307 - DNA, 18 bp, Homo sapiens
actctgcggaggccccag

SEQ ID NO: 8040308 - DNA, 22 bp, Homo sapiens
actgcctcttggtgctgagaga

SEQ ID NO: 8040309 - DNA, 22 bp, Homo sapiens
agtaacacaagaggtccttgcg

SEQ ID NO: 8040310 - DNA, 22 bp, Homo sapiens
agtaacactattttcatatgta

SEQ ID NO: 8040311 - DNA, 22 bp, Homo sapiens
ccttctctctgaagaccccaaa

SEQ ID NO: 8040312 - DNA, 22 bp, Homo sapiens
agtcacagaaacccaggtgtgg

SEQ ID NO: 8040313 - DNA, 22 bp, Homo sapiens
agtcacagtttccctgagagag

SEQ ID NO: 8040314 - DNA, 22 bp, Homo sapiens
ctaggaaagacacagagagttt

SEQ ID NO: 8040315 - DNA, 22 bp, Homo sapiens
ctatttatctatttctgaatga

SEQ ID NO: 8040316 - DNA, 22 bp, Homo sapiens
agggttttggctgaagttcagc

SEQ ID NO: 8040317 - DNA, 22 bp, Homo sapiens
aggtacaaaagagtatatgaga

SEQ ID NO: 8040318 - DNA, 22 bp, Homo sapiens
agtgacttctcctaatgtcata

SEQ ID NO: 8040319 - DNA, 22 bp, Homo sapiens
agtctagggtggggtccacagg

SEQ ID NO: 8040320 - DNA, 22 bp, Homo sapiens
ctcaccacagagcctgtccagc

SEQ ID NO: 8040321 - DNA, 22 bp, Homo sapiens
ctcacattcacaggacagaagg

SEQ ID NO: 8040322 - DNA, 22 bp, Homo sapiens
ctcacattccacttgtgccaac

SEQ ID NO: 8040323 - DNA, 21 bp, Homo sapiens
agtgccagtaggtatggagga

SEQ ID NO: 8040324 - DNA, 22 bp, Homo sapiens
agtgccccatgggtgcctgggg

SEQ ID NO: 8040325 - DNA, 22 bp, Homo sapiens
agtggaattgctgattgaaata

SEQ ID NO: 8040326 - DNA, 22 bp, Homo sapiens
agttaacacatccagaatagag

SEQ ID NO: 8040327 - DNA, 22 bp, Homo sapiens
agtgtggcaggaatgactagaa

SEQ ID NO: 8040328 - DNA, 22 bp, Homo sapiens
agtgggtgataagaccaaggag

SEQ ID NO: 8040329 - DNA, 21 bp, Homo sapiens
agtgtcatttgatcattgtta

SEQ ID NO: 8040330 - DNA, 22 bp, Homo sapiens
agtgtcctcctctgggagccag

SEQ ID NO: 8040331 - DNA, 22 bp, Homo sapiens
atcagtttcacttgcttgcaaa

SEQ ID NO: 8040332 - DNA, 22 bp, Homo sapiens
ctgtaaataatgacagttgact

SEQ ID NO: 8040333 - DNA, 22 bp, Homo sapiens
ctgtaaatggaactatgtagta

SEQ ID NO: 8040334 - DNA, 22 bp, Homo sapiens
cttcaaattcgaggagtagatg

SEQ ID NO: 8040335 - DNA, 22 bp, Homo sapiens
cttcaagatatttctagaatca

SEQ ID NO: 8040336 - DNA, 22 bp, Homo sapiens
cttcaagagaatgcagggatgt

SEQ ID NO: 8040337 - DNA, 22 bp, Homo sapiens
atctctatctttattgaaatct

SEQ ID NO: 8040338 - DNA, 22 bp, Homo sapiens
ataaaagaagttttggtacttg

SEQ ID NO: 8040339 - DNA, 22 bp, Homo sapiens
ataaaagaagttttggtacttg

SEQ ID NO: 8040340 - DNA, 22 bp, Homo sapiens
ataaaagatcccttctgagctc

SEQ ID NO: 8040341 - DNA, 22 bp, Homo sapiens
ataaactgaagggaacactgag

SEQ ID NO: 8040342 - DNA, 22 bp, Homo sapiens
ctgctcagcggaaggaagagcg

SEQ ID NO: 8040343 - DNA, 19 bp, Homo sapiens
ctgctcagagcagctccag

SEQ ID NO: 8040344 - DNA, 22 bp, Homo sapiens
ctgctcagaggaaggaatgtct

SEQ ID NO: 8040345 - DNA, 22 bp, Homo sapiens
ctgctacaccggaatagtgaca

SEQ ID NO: 8040346 - DNA, 22 bp, Homo sapiens
ctggcaggtggaggttgcagtg

SEQ ID NO: 8040347 - DNA, 22 bp, Homo sapiens
ctggcaggtttggtgtctggtg

SEQ ID NO: 8040348 - DNA, 22 bp, Homo sapiens
ctggcagtattaagagaagtga

SEQ ID NO: 8040349 - DNA, 22 bp, Homo sapiens
ctggcctcatagccaagctgtg

SEQ ID NO: 8040350 - DNA, 22 bp, Homo sapiens
atacatgtgtgagcgaagatgt

SEQ ID NO: 8040351 - DNA, 22 bp, Homo sapiens
atacatgtacataaatgtagca

SEQ ID NO: 8040352 - DNA, 22 bp, Homo sapiens
atacatgtgggtctaaacatat

SEQ ID NO: 8040353 - DNA, 17 bp, Homo sapiens
atacatgtaaagtgctt

SEQ ID NO: 8040354 - DNA, 22 bp, Homo sapiens
atacacatgtgtatgtgcatgc

SEQ ID NO: 8040355 - DNA, 22 bp, Homo sapiens
ctggcctcggcagcaggaacag

SEQ ID NO: 8040356 - DNA, 22 bp, Homo sapiens
catcatgtctgcaggaatgtgt

SEQ ID NO: 8040357 - DNA, 22 bp, Homo sapiens
cagttcctatgggcaaaacaca

SEQ ID NO: 8040358 - DNA, 22 bp, Homo sapiens
aggaggctgggcacagtggcct

SEQ ID NO: 8040359 - DNA, 22 bp, Homo sapiens
aggaggctgcaaccctgaggcc

SEQ ID NO: 8040360 - DNA, 22 bp, Homo sapiens
catcagaaggaaggacgattat

SEQ ID NO: 8040361 - DNA, 22 bp, Homo sapiens
catcagaacaaatcggttaaga

SEQ ID NO: 8040362 - DNA, 22 bp, Homo sapiens
cagtggaagactcagctctccc

SEQ ID NO: 8040363 - DNA, 22 bp, Homo sapiens
aggagccaaattactagctctg

SEQ ID NO: 8040364 - DNA, 22 bp, Homo sapiens
aggatgagaagattggaatctt

SEQ ID NO: 8040365 - DNA, 22 bp, Homo sapiens
agctggaagctgatgagcacag

SEQ ID NO: 8040366 - DNA, 22 bp, Homo sapiens
caggtcctggcatcaggcaggt

SEQ ID NO: 8040367 - DNA, 22 bp, Homo sapiens
caggtcctgcagggagagtaaa

SEQ ID NO: 8040368 - DNA, 22 bp, Homo sapiens
caggtccctgcgccccggcctc

SEQ ID NO: 8040369 - DNA, 22 bp, Homo sapiens
aggccacagtactttgcagacc

SEQ ID NO: 8040370 - DNA, 22 bp, Homo sapiens
aggctgcttcagctgcagggag

SEQ ID NO: 8040371 - DNA, 22 bp, Homo sapiens
ccaggctgggcggggaacctgg

SEQ ID NO: 8040372 - DNA, 22 bp, Homo sapiens
cctcaggccctgtccctgcgcc

SEQ ID NO: 8040373 - DNA, 22 bp, Homo sapiens
agggtagggcccggagacagac

SEQ ID NO: 8040374 - DNA, 22 bp, Homo sapiens
ccctgccctggagacacttaaa

SEQ ID NO: 8040375 - DNA, 22 bp, Homo sapiens
ccctgcccaccacatgctggga

SEQ ID NO: 8040376 - DNA, 22 bp, Homo sapiens
cccaggagatgcactccattgg

SEQ ID NO: 8040377 - DNA, 20 bp, Homo sapiens
cccaggagctgtgccccatc

SEQ ID NO: 8040378 - DNA, 23 bp, Homo sapiens
cccaggagcctgagtcctctctg

SEQ ID NO: 8040379 - DNA, 22 bp, Homo sapiens
cccaggagcttctctctgcctc

SEQ ID NO: 8040380 - DNA, 22 bp, Homo sapiens
cccaggagggtggcctctgccc

SEQ ID NO: 8040381 - DNA, 22 bp, Homo sapiens
cccaggaggtcgaagctgcagt

SEQ ID NO: 8040382 - DNA, 22 bp, Homo sapiens
gcaaaaaccacaattactttta

SEQ ID NO: 8040383 - DNA, 22 bp, Homo sapiens
gcaaaaaccacaattacttttg

SEQ ID NO: 8040384 - DNA, 22 bp, Homo sapiens
gcaaaaactgcaattacttttg

SEQ ID NO: 8040385 - DNA, 22 bp, Homo sapiens
gcaaaattaaacttagcatcat

SEQ ID NO: 8040386 - DNA, 22 bp, Homo sapiens
gcaaaagtacagccggatttct

SEQ ID NO: 8040387 - DNA, 22 bp, Homo sapiens
gcaaatggagtgaagagctgga

SEQ ID NO: 8040388 - DNA, 22 bp, Homo sapiens
gcaaacaaggacatacatcctg

SEQ ID NO: 8040389 - DNA, 22 bp, Homo sapiens
gcacagagctggccctccaggc

SEQ ID NO: 8040390 - DNA, 23 bp, Homo sapiens
gcacagagcagttaggggaagat

SEQ ID NO: 8040391 - DNA, 22 bp, Homo sapiens
attgtaaagtactgtgtacaat

SEQ ID NO: 8040392 - DNA, 22 bp, Homo sapiens
gcattcattcattcattaggta

SEQ ID NO: 8040393 - DNA, 22 bp, Homo sapiens
gcattcatcaaaaatgttcctc

SEQ ID NO: 8040394 - DNA, 22 bp, Homo sapiens
gcattcatcttcctccatgcag

SEQ ID NO: 8040395 - DNA, 22 bp, Homo sapiens
gcattcactgggtgttcatggg

SEQ ID NO: 8040396 - DNA, 19 bp, Homo sapiens
gcccacggccctgctctgc

SEQ ID NO: 8040397 - DNA, 22 bp, Homo sapiens
gccctgcagtgcggaggtggca

SEQ ID NO: 8040398 - DNA, 22 bp, Homo sapiens
attttgaaaagcatttgagtaa

SEQ ID NO: 8040399 - DNA, 22 bp, Homo sapiens
attttgaaaccaagttatttcc

SEQ ID NO: 8040400 - DNA, 18 bp, Homo sapiens
attttgaactgggaatat

SEQ ID NO: 8040401 - DNA, 22 bp, Homo sapiens
attttgaaatacttgaaggaaa

SEQ ID NO: 8040402 - DNA, 22 bp, Homo sapiens
attttgaagggaattgaagttc

SEQ ID NO: 8040403 - DNA, 22 bp, Homo sapiens
caaatagactctagaatttatt

SEQ ID NO: 8040404 - DNA, 22 bp, Homo sapiens
gctcaggggaatgggctgccgt

SEQ ID NO: 8040405 - DNA, 22 bp, Homo sapiens
gctcagggtcccttggtgctgg

SEQ ID NO: 8040406 - DNA, 22 bp, Homo sapiens
gctcagggctaaggctgagggg

SEQ ID NO: 8040407 - DNA, 22 bp, Homo sapiens
gctccaggcagcatagtggatg

SEQ ID NO: 8040408 - DNA, 22 bp, Homo sapiens
gctcaaagaccagacagaggag

SEQ ID NO: 8040409 - DNA, 22 bp, Homo sapiens
gaggctgttaggagggactctg

SEQ ID NO: 8040410 - DNA, 22 bp, Homo sapiens
gaggctgctttgatgacaggag

SEQ ID NO: 8040411 - DNA, 22 bp, Homo sapiens
gagggaagaaagaattgatgcg

SEQ ID NO: 8040412 - DNA, 22 bp, Homo sapiens
gagggatggtgtgagaggctca

SEQ ID NO: 8040413 - DNA, 22 bp, Homo sapiens
gatcgggtgggttctgccatca

SEQ ID NO: 8040414 - DNA, 22 bp, Homo sapiens
atgtaagactttaagaacctaa

SEQ ID NO: 8040415 - DNA, 17 bp, Homo sapiens
atgtaagaagaaagcag

SEQ ID NO: 8040416 - DNA, 22 bp, Homo sapiens
atgtaacaaatggtatacatgt

SEQ ID NO: 8040417 - DNA, 22 bp, Homo sapiens
atgtaacacccacttttatagc

SEQ ID NO: 8040418 - DNA, 22 bp, Homo sapiens
atgtaacaaatggtatacatgt

SEQ ID NO: 8040419 - DNA, 22 bp, Homo sapiens
atgtaacattgaattatatagt

SEQ ID NO: 8040420 - DNA, 22 bp, Homo sapiens
atgtcacagtgttgctggaagt

SEQ ID NO: 8040421 - DNA, 18 bp, Homo sapiens
atgtcacagagggctgaa

SEQ ID NO: 8040422 - DNA, 22 bp, Homo sapiens
gagcagtgaagacagaagtaca

SEQ ID NO: 8040423 - DNA, 21 bp, Homo sapiens
atggaaaaacaggtagagcat

SEQ ID NO: 8040424 - DNA, 22 bp, Homo sapiens
gagaggctggcagtgccaggtt

SEQ ID NO: 8040425 - DNA, 22 bp, Homo sapiens
gagcacagggaatagacagata

SEQ ID NO: 8040426 - DNA, 22 bp, Homo sapiens
gagaggtggaggttgcagtgag

SEQ ID NO: 8040427 - DNA, 22 bp, Homo sapiens
atgccctgtgactctcctggac

SEQ ID NO: 8040428 - DNA, 22 bp, Homo sapiens
atgccctgagcaggccttcaag

SEQ ID NO: 8040429 - DNA, 22 bp, Homo sapiens
atgcatatctcctatctcctca

SEQ ID NO: 8040430 - DNA, 22 bp, Homo sapiens
atgcatatcagtgattgtttgc

SEQ ID NO: 8040431 - DNA, 22 bp, Homo sapiens
atgcatatagaacatttgacat

SEQ ID NO: 8040432 - DNA, 22 bp, Homo sapiens
gaagcagagcctaaggcagaca

SEQ ID NO: 8040433 - DNA, 22 bp, Homo sapiens
gaatgtaatagtcagtagaaca

SEQ ID NO: 8040434 - DNA, 22 bp, Homo sapiens
gaccctctagatggaagcactg

SEQ ID NO: 8040435 - DNA, 22 bp, Homo sapiens
gacataaaccttgagatattaa

SEQ ID NO: 8040436 - DNA, 22 bp, Homo sapiens
gacataaaattcaataatttgt

SEQ ID NO: 8040437 - DNA, 22 bp, Homo sapiens
gaaaatgcctctggcattaaac

SEQ ID NO: 8040438 - DNA, 22 bp, Homo sapiens
atgaggcatgtgaggagaaggg

SEQ ID NO: 8040439 - DNA, 22 bp, Homo sapiens
gaacataactattgtgaatagt

SEQ ID NO: 8040440 - DNA, 22 bp, Homo sapiens
gaacataattaaatgtcctggg

SEQ ID NO: 8040441 - DNA, 22 bp, Homo sapiens
gaactttaccatttaggtaact

SEQ ID NO: 8040442 - DNA, 20 bp, Homo sapiens
gaacatggcaggtggagggg

SEQ ID NO: 8040443 - DNA, 22 bp, Homo sapiens
gaacattcttgggcaagttact

SEQ ID NO: 8040444 - DNA, 19 bp, Homo sapiens
atgaatgagctgtgaggtt

SEQ ID NO: 8040445 - DNA, 22 bp, Homo sapiens
atgaatgtacctgaaatagcct

SEQ ID NO: 8040446 - DNA, 22 bp, Homo sapiens
atgaatggatggggtcaagata

SEQ ID NO: 8040447 - DNA, 22 bp, Homo sapiens
gaaaactgtgattagaatgcct

SEQ ID NO: 8040448 - DNA, 23 bp, Homo sapiens
atgaatgaataaggcaggaaagc

SEQ ID NO: 8040449 - DNA, 22 bp, Homo sapiens
cagagacagtttcacagggtct

SEQ ID NO: 8040450 - DNA, 22 bp, Homo sapiens
cagaggaaagtatttctggaag

SEQ ID NO: 8040451 - DNA, 22 bp, Homo sapiens
cagaggaagagatacaagccct

SEQ ID NO: 8040452 - DNA, 22 bp, Homo sapiens
cagaggaacgtttggattgatt

SEQ ID NO: 8040453 - DNA, 22 bp, Homo sapiens
cagaggaaatgggaaggagata

SEQ ID NO: 8040454 - DNA, 22 bp, Homo sapiens
cagaggaagctgggtgtggagt

SEQ ID NO: 8040455 - DNA, 22 bp, Homo sapiens
cagaggaaggctctgggaatgt

SEQ ID NO: 8040456 - DNA, 22 bp, Homo sapiens
cagaggaagggtgctgcgaaag

SEQ ID NO: 8040457 - DNA, 22 bp, Homo sapiens
cagaggaagttccttgatgaga

SEQ ID NO: 8040458 - DNA, 23 bp, Homo sapiens
cagctccagtgcactcaggtagc

SEQ ID NO: 8040459 - DNA, 22 bp, Homo sapiens
cagctcagcttcctgggtgtgt

SEQ ID NO: 8040460 - DNA, 21 bp, Homo sapiens
cagctccactaaagcagctgt

SEQ ID NO: 8040461 - DNA, 22 bp, Homo sapiens
cagctccagcccaggcagctcc

SEQ ID NO: 8040462 - DNA, 20 bp, Homo sapiens
cagccctttatcctcctatg

SEQ ID NO: 8040463 - DNA, 22 bp, Homo sapiens
cagctcctattagacactgaat

SEQ ID NO: 8040464 - DNA, 22 bp, Homo sapiens
gctggcagcattagaccctggg

SEQ ID NO: 8040465 - DNA, 20 bp, Homo sapiens
gctggcagatgtcttgagat

SEQ ID NO: 8040466 - DNA, 19 bp, Homo sapiens
gctggcagatgtggccgtg

SEQ ID NO: 8040467 - DNA, 19 bp, Homo sapiens
gctggcagatgtggccgtg

SEQ ID NO: 8040468 - DNA, 22 bp, Homo sapiens
gctggcagagctctgggctggg

SEQ ID NO: 8040469 - DNA, 22 bp, Homo sapiens
gctggcagagagctggtgagga

SEQ ID NO: 8040470 - DNA, 22 bp, Homo sapiens
ggaaaatttccttcaaaatgtg

SEQ ID NO: 8040471 - DNA, 22 bp, Homo sapiens
ggaggagacggagtgattagtg

SEQ ID NO: 8040472 - DNA, 22 bp, Homo sapiens
cacagcccccttgacactctgg

SEQ ID NO: 8040473 - DNA, 22 bp, Homo sapiens
cacagcataatgaaatatactt

SEQ ID NO: 8040474 - DNA, 22 bp, Homo sapiens
ggagagtctgccgagccagccc

SEQ ID NO: 8040475 - DNA, 22 bp, Homo sapiens
ggacagcatatcagcagggcag

SEQ ID NO: 8040476 - DNA, 22 bp, Homo sapiens
ggaagagagatcccatagatgt

SEQ ID NO: 8040477 - DNA, 22 bp, Homo sapiens
ggagtctgctcccagacatgat

SEQ ID NO: 8040478 - DNA, 22 bp, Homo sapiens
cacccaggacaggccagatgtg

SEQ ID NO: 8040479 - DNA, 22 bp, Homo sapiens
cactgcccaggacctgccaccc

SEQ ID NO: 8040480 - DNA, 20 bp, Homo sapiens
cactgccctccagcctgagc

SEQ ID NO: 8040481 - DNA, 22 bp, Homo sapiens
tcactgcagcctctgcctcccg

SEQ ID NO: 8040482 - DNA, 22 bp, Homo sapiens
tcactgcacttcaggctttctc

SEQ ID NO: 8040483 - DNA, 22 bp, Homo sapiens
tcactgcagacaacctcagtca

SEQ ID NO: 8040484 - DNA, 22 bp, Homo sapiens
tcactgcacttcagcttgggca

SEQ ID NO: 8040485 - DNA, 22 bp, Homo sapiens
tcactgcagagacctctagtca

SEQ ID NO: 8040486 - DNA, 22 bp, Homo sapiens
tcactgcactccagcctggtga

SEQ ID NO: 8040487 - DNA, 22 bp, Homo sapiens
tcactgcactccagcactcagg

SEQ ID NO: 8040488 - DNA, 22 bp, Homo sapiens
tcactgcactaggtaatgccac

SEQ ID NO: 8040489 - DNA, 21 bp, Homo sapiens
tcactgcaatgctaggagaaa

SEQ ID NO: 8040490 - DNA, 22 bp, Homo sapiens
tcactgcaatctctgccttcca

SEQ ID NO: 8040491 - DNA, 22 bp, Homo sapiens
tcactgcactccagcctgggtg

SEQ ID NO: 8040492 - DNA, 22 bp, Homo sapiens
tcactgcactccagcctgggca

SEQ ID NO: 8040493 - DNA, 22 bp, Homo sapiens
tcactgcaggtttttcaggagg

SEQ ID NO: 8040494 - DNA, 22 bp, Homo sapiens
tcactgcatcccatctccagcc

SEQ ID NO: 8040495 - DNA, 22 bp, Homo sapiens
tcactgcaagctcctcctcctg

SEQ ID NO: 8040496 - DNA, 22 bp, Homo sapiens
tcactgcaagctctgccttccg

SEQ ID NO: 8040497 - DNA, 22 bp, Homo sapiens
tcactgcaatctcagcctcctg

SEQ ID NO: 8040498 - DNA, 22 bp, Homo sapiens
tcactgcaaggaggcttctcaa

SEQ ID NO: 8040499 - DNA, 22 bp, Homo sapiens
tcactgcaagctccgcctcccg

SEQ ID NO: 8040500 - DNA, 22 bp, Homo sapiens
tcactgcaagctccgccttccg

SEQ ID NO: 8040501 - DNA, 22 bp, Homo sapiens
tcactgcaagctccacctcccg

SEQ ID NO: 8040502 - DNA, 22 bp, Homo sapiens
tcactgcaagctcagcctcccg

SEQ ID NO: 8040503 - DNA, 22 bp, Homo sapiens
tcactgcaacctctgcctcttg

SEQ ID NO: 8040504 - DNA, 22 bp, Homo sapiens
tcactgcaacctctgcctgcca

SEQ ID NO: 8040505 - DNA, 22 bp, Homo sapiens
tcactgcaacctctgccttccg

SEQ ID NO: 8040506 - DNA, 22 bp, Homo sapiens
tcactgcaacctctgcctcccg

SEQ ID NO: 8040507 - DNA, 22 bp, Homo sapiens
tcactgcaacctccgcctcccg

SEQ ID NO: 8040508 - DNA, 22 bp, Homo sapiens
tcactgcaacctccgcctgctg

SEQ ID NO: 8040509 - DNA, 22 bp, Homo sapiens
tcaaaggagacacaaggagaaa

SEQ ID NO: 8040510 - DNA, 22 bp, Homo sapiens
tcaaaggaaacacaagcttctg

SEQ ID NO: 8040511 - DNA, 22 bp, Homo sapiens
tcaaaggaatttgattttgatg

SEQ ID NO: 8040512 - DNA, 22 bp, Homo sapiens
tattccctatttagtaattctg

SEQ ID NO: 8040513 - DNA, 22 bp, Homo sapiens
tatgaagaagacaaatgacact

SEQ ID NO: 8040514 - DNA, 22 bp, Homo sapiens
tatgaagaaatctttgaaaatc

SEQ ID NO: 8040515 - DNA, 22 bp, Homo sapiens
tatgaagaagttctgtgaaatg

SEQ ID NO: 8040516 - DNA, 22 bp, Homo sapiens
tatgaagatatatctgatctct

SEQ ID NO: 8040517 - DNA, 22 bp, Homo sapiens
caggctccttcccagggatggt

SEQ ID NO: 8040518 - DNA, 22 bp, Homo sapiens
tacagtttagaaccatagatgg

SEQ ID NO: 8040519 - DNA, 22 bp, Homo sapiens
tacagcctcttccctggagtgg

SEQ ID NO: 8040520 - DNA, 22 bp, Homo sapiens
tacaatatgtgaactttggtgt

SEQ ID NO: 8040521 - DNA, 22 bp, Homo sapiens
tagcataatttgtagaaaatca

SEQ ID NO: 8040522 - DNA, 22 bp, Homo sapiens
cagggagcctgaatgttccagg

SEQ ID NO: 8040523 - DNA, 22 bp, Homo sapiens
cagggagaaatctccaggaggt

SEQ ID NO: 8040524 - DNA, 22 bp, Homo sapiens
cagggagaggcctctgttgccc

SEQ ID NO: 8040525 - DNA, 22 bp, Homo sapiens
cattacaaccccaaattacaaa

SEQ ID NO: 8040526 - DNA, 23 bp, Homo sapiens
catgtacacacagctgtacagtg

SEQ ID NO: 8040527 - DNA, 22 bp, Homo sapiens
tccaggcttgagaccaggctct

SEQ ID NO: 8040528 - DNA, 22 bp, Homo sapiens
tccaagatctacagcagtttag

SEQ ID NO: 8040529 - DNA, 22 bp, Homo sapiens
tccaagatctacagcagtttag

SEQ ID NO: 8040530 - DNA, 22 bp, Homo sapiens
catggtgaggggtgaagggcag

SEQ ID NO: 8040531 - DNA, 22 bp, Homo sapiens
tcaggaggcctgagtagctcta

SEQ ID NO: 8040532 - DNA, 22 bp, Homo sapiens
tcaggaggcggtgctgcctttg

SEQ ID NO: 8040533 - DNA, 21 bp, Homo sapiens
tcaggaggctcagactcctgc

SEQ ID NO: 8040534 - DNA, 22 bp, Homo sapiens
tcacttatatttcaggagatat

SEQ ID NO: 8040535 - DNA, 22 bp, Homo sapiens
ccagaggatcagtactggctgg

SEQ ID NO: 8040536 - DNA, 22 bp, Homo sapiens
tctctgtaaggaagaattagat

SEQ ID NO: 8040537 - DNA, 22 bp, Homo sapiens
tctcagctgcctgccctgctcc

SEQ ID NO: 8040538 - DNA, 22 bp, Homo sapiens
ccaccctaacaatccttactgt

SEQ ID NO: 8040539 - DNA, 22 bp, Homo sapiens
catttcacgcacactcattact

SEQ ID NO: 8040540 - DNA, 22 bp, Homo sapiens
catttctagacaagtcctggag

SEQ ID NO: 8040541 - DNA, 22 bp, Homo sapiens
catttctagggatcataaagta

SEQ ID NO: 8040542 - DNA, 22 bp, Homo sapiens
catttctacagcttcttcagaa

SEQ ID NO: 8040543 - DNA, 22 bp, Homo sapiens
catttctaagaaggctgcacat

SEQ ID NO: 8040544 - DNA, 21 bp, Homo sapiens
catttctattgatgagaaaag

SEQ ID NO: 8040545 - DNA, 22 bp, Homo sapiens
catttctatggcaatgggaaaa

SEQ ID NO: 8040546 - DNA, 21 bp, Homo sapiens
tcctgccttagtccagagcag

SEQ ID NO: 8040547 - DNA, 22 bp, Homo sapiens
tctggggagcagccctggtgag

SEQ ID NO: 8040548 - DNA, 22 bp, Homo sapiens
ccaggaggcggaggttgcagcg

SEQ ID NO: 8040549 - DNA, 22 bp, Homo sapiens
ccaggaggcggaggttgcagtg

SEQ ID NO: 8040550 - DNA, 22 bp, Homo sapiens
tcttacagaaaatagataacat

SEQ ID NO: 8040551 - DNA, 22 bp, Homo sapiens
tcttctggatcgatcacattgt

SEQ ID NO: 8040552 - DNA, 22 bp, Homo sapiens
tgaaacagagtggatacagtga

SEQ ID NO: 8040553 - DNA, 22 bp, Homo sapiens
tgaaacaagggaccgtcctttc

SEQ ID NO: 8040554 - DNA, 22 bp, Homo sapiens
tgaaacaaatttggaaaatcta

SEQ ID NO: 8040555 - DNA, 22 bp, Homo sapiens
ccaggctgtaagagtgatgttg

SEQ ID NO: 8040556 - DNA, 22 bp, Homo sapiens
ccaggcctctggctgcttagtc

SEQ ID NO: 8040557 - DNA, 22 bp, Homo sapiens
tgagcagagacgggggcctcca

SEQ ID NO: 8040558 - DNA, 22 bp, Homo sapiens
ccagtgcccagctgcccaggca

SEQ ID NO: 8040559 - DNA, 19 bp, Homo sapiens
ccagtcccatacaggagat

SEQ ID NO: 8040560 - DNA, 22 bp, Homo sapiens
cccagagggaagggaatgaggt

SEQ ID NO: 8040561 - DNA, 22 bp, Homo sapiens
cccagagggctgaggatatgaa

SEQ ID NO: 8040562 - DNA, 22 bp, Homo sapiens
cccagaggaggatctcggcccg

SEQ ID NO: 8040563 - DNA, 22 bp, Homo sapiens
tgcactccaggctgggtgacag

SEQ ID NO: 8040564 - DNA, 22 bp, Homo sapiens
cccaagggagtgcctggtcaac

SEQ ID NO: 8040565 - DNA, 22 bp, Homo sapiens
tgcaaatattccatgctgttca

SEQ ID NO: 8040566 - DNA, 22 bp, Homo sapiens
tgcaatatgttgcattgtatgg

SEQ ID NO: 8040567 - DNA, 22 bp, Homo sapiens
cctctcccgggtgccgctgggc

SEQ ID NO: 8040568 - DNA, 22 bp, Homo sapiens
cctcctgggccttgctctgtga

SEQ ID NO: 8040569 - DNA, 22 bp, Homo sapiens
cctcctggcttttcccattgaa

SEQ ID NO: 8040570 - DNA, 22 bp, Homo sapiens
tggcagtgtcttatcaggagtg

SEQ ID NO: 8040571 - DNA, 22 bp, Homo sapiens
tggcagtgggaatggacaaaca

SEQ ID NO: 8040572 - DNA, 22 bp, Homo sapiens
tggcagtgggaagctggaagtc

SEQ ID NO: 8040573 - DNA, 22 bp, Homo sapiens
tggcagtggtaccggctctcag

SEQ ID NO: 8040574 - DNA, 22 bp, Homo sapiens
cctgcctcccagaggtcctcta

SEQ ID NO: 8040575 - DNA, 21 bp, Homo sapiens
tggtacaccttgcctgtcaga

SEQ ID NO: 8040576 - DNA, 22 bp, Homo sapiens
tgctacagagccaggaagagtg

SEQ ID NO: 8040577 - DNA, 22 bp, Homo sapiens
tgccttctcccttggaccctga

SEQ ID NO: 8040578 - DNA, 22 bp, Homo sapiens
tgctcagggacaatggagaggg

SEQ ID NO: 8040579 - DNA, 22 bp, Homo sapiens
ccccaggagatttgggagcaca

SEQ ID NO: 8040580 - DNA, 22 bp, Homo sapiens
tggagatgaacatggtgatgtt

SEQ ID NO: 8040581 - DNA, 22 bp, Homo sapiens
tggagacagagatagccaattg

SEQ ID NO: 8040582 - DNA, 22 bp, Homo sapiens
tggaaagaaaaacaggccatga

SEQ ID NO: 8040583 - DNA, 22 bp, Homo sapiens
tggaggaagttgctggaagtca

SEQ ID NO: 8040584 - DNA, 23 bp, Homo sapiens
tggaggaaacacatcagaagacc

SEQ ID NO: 8040585 - DNA, 18 bp, Homo sapiens
tggaggaatcacaatggc

SEQ ID NO: 8040586 - DNA, 22 bp, Homo sapiens
tggaggacaggactggacagcc

SEQ ID NO: 8040587 - DNA, 21 bp, Homo sapiens
cccttgcctgcactcctcggc

SEQ ID NO: 8040588 - DNA, 22 bp, Homo sapiens
cttccaaaatttatatgttgaa

SEQ ID NO: 8040589 - DNA, 22 bp, Homo sapiens
cttacaaatacacttaggagag

SEQ ID NO: 8040590 - DNA, 22 bp, Homo sapiens
cttacaaatacacttaggagag

SEQ ID NO: 8040591 - DNA, 22 bp, Homo sapiens
cttacaaaggagaggagatagg

SEQ ID NO: 8040592 - DNA, 22 bp, Homo sapiens
ctgttttcaaagagagagaatg

SEQ ID NO: 8040593 - DNA, 22 bp, Homo sapiens
cttaaaatctggcagttagcta

SEQ ID NO: 8040594 - DNA, 20 bp, Homo sapiens
cttaaacacagagatagatt

SEQ ID NO: 8040595 - DNA, 22 bp, Homo sapiens
cttgttttggaacagagtgaat

SEQ ID NO: 8040596 - DNA, 22 bp, Homo sapiens
gaaaatttagaactgaacttct

SEQ ID NO: 8040597 - DNA, 22 bp, Homo sapiens
ctgggacatagatcagcctttt

SEQ ID NO: 8040598 - DNA, 22 bp, Homo sapiens
ctgtacataaaggaataggtgt

SEQ ID NO: 8040599 - DNA, 22 bp, Homo sapiens
ctgtacaggtcaatgataagat

SEQ ID NO: 8040600 - DNA, 22 bp, Homo sapiens
ctgtacagagttctgagtgtac

SEQ ID NO: 8040601 - DNA, 22 bp, Homo sapiens
ctgtaaaactgcttaagtatgc

SEQ ID NO: 8040602 - DNA, 22 bp, Homo sapiens
ctgtaaaacactgtagtatctg

SEQ ID NO: 8040603 - DNA, 21 bp, Homo sapiens
ctgggctttctctcaaagaca

SEQ ID NO: 8040604 - DNA, 22 bp, Homo sapiens
gaatgaattcagcacatggaat

SEQ ID NO: 8040605 - DNA, 22 bp, Homo sapiens
gactctgggctgagccagggcc

SEQ ID NO: 8040606 - DNA, 22 bp, Homo sapiens
gacagagattgaatcaggaaat

SEQ ID NO: 8040607 - DNA, 22 bp, Homo sapiens
gagactttaaaaaacattaaga

SEQ ID NO: 8040608 - DNA, 22 bp, Homo sapiens
gagagaaaagggggaattgatt

SEQ ID NO: 8040609 - DNA, 22 bp, Homo sapiens
gactgcctcagtttccctgcag

SEQ ID NO: 8040610 - DNA, 22 bp, Homo sapiens
gagaaagacgtaggctgggagg

SEQ ID NO: 8040611 - DNA, 22 bp, Homo sapiens
gagaaagatgaagagtggcgtt

SEQ ID NO: 8040612 - DNA, 22 bp, Homo sapiens
gagacagatctcggctccatgc

SEQ ID NO: 8040613 - DNA, 22 bp, Homo sapiens
gagacagatgctgctggagcat

SEQ ID NO: 8040614 - DNA, 22 bp, Homo sapiens
gagacattcttaggaacaatgt

SEQ ID NO: 8040615 - DNA, 22 bp, Homo sapiens
gagaaagatgtaggctgggagg

SEQ ID NO: 8040616 - DNA, 22 bp, Homo sapiens
gagaaagattgtccttcagggg

SEQ ID NO: 8040617 - DNA, 22 bp, Homo sapiens
gagcccaggaagtggaggctga

SEQ ID NO: 8040618 - DNA, 22 bp, Homo sapiens
gagccctgaacaacagcaggaa

SEQ ID NO: 8040619 - DNA, 22 bp, Homo sapiens
gagccctgacactgagggagtt

SEQ ID NO: 8040620 - DNA, 22 bp, Homo sapiens
gagcatgagggaaggcagcaga

SEQ ID NO: 8040621 - DNA, 22 bp, Homo sapiens
gagcagtgggaaggaacagggt

SEQ ID NO: 8040622 - DNA, 22 bp, Homo sapiens
gagccctgcgtgtctgggggca

SEQ ID NO: 8040623 - DNA, 22 bp, Homo sapiens
gagccctgctgggccttgtctc

SEQ ID NO: 8040624 - DNA, 22 bp, Homo sapiens
gagccctgcttccaagggggca

SEQ ID NO: 8040625 - DNA, 22 bp, Homo sapiens
gagccctgagagttgtgaggcc

SEQ ID NO: 8040626 - DNA, 22 bp, Homo sapiens
gagccctgatttgcagcatttg

SEQ ID NO: 8040627 - DNA, 22 bp, Homo sapiens
gagccctggcagtctgggatgg

SEQ ID NO: 8040628 - DNA, 22 bp, Homo sapiens
gagccctgtagcaagtcatgtc

SEQ ID NO: 8040629 - DNA, 22 bp, Homo sapiens
tttctgcaaacttccacgtctc

SEQ ID NO: 8040630 - DNA, 22 bp, Homo sapiens
tttgaagggcacgacaatagtt

SEQ ID NO: 8040631 - DNA, 22 bp, Homo sapiens
tttgaagtgtatgaaaatacag

SEQ ID NO: 8040632 - DNA, 22 bp, Homo sapiens
ctctgctgctttgccagtggaa

SEQ ID NO: 8040633 - DNA, 21 bp, Homo sapiens
ctctgctgtctaccagctgtt

SEQ ID NO: 8040634 - DNA, 22 bp, Homo sapiens
tttatatccatctttgaagtaa

SEQ ID NO: 8040635 - DNA, 20 bp, Homo sapiens
ctcctcagttccatgggagg

SEQ ID NO: 8040636 - DNA, 22 bp, Homo sapiens
ctctaaatccacggtatagttg

SEQ ID NO: 8040637 - DNA, 22 bp, Homo sapiens
ctctaaatccaaataagtgtcc

SEQ ID NO: 8040638 - DNA, 22 bp, Homo sapiens
ctctaatactgaccaagtcacc

SEQ ID NO: 8040639 - DNA, 22 bp, Homo sapiens
tttcaaagtcaatatcattacc

SEQ ID NO: 8040640 - DNA, 22 bp, Homo sapiens
ctccccacacactaggcctgat

SEQ ID NO: 8040641 - DNA, 22 bp, Homo sapiens
ctcctcagtcaggtctagggtc

SEQ ID NO: 8040642 - DNA, 19 bp, Homo sapiens
ctcctcagtcccagaggtc

SEQ ID NO: 8040643 - DNA, 21 bp, Homo sapiens
ctcctcaggaccagccacagg

SEQ ID NO: 8040644 - DNA, 22 bp, Homo sapiens
ctcctcagctgggaggagtccc

SEQ ID NO: 8040645 - DNA, 22 bp, Homo sapiens
ctgctgctgagagctcagcctg

SEQ ID NO: 8040646 - DNA, 22 bp, Homo sapiens
ctgcctgcaggacacctcgcta

SEQ ID NO: 8040647 - DNA, 22 bp, Homo sapiens
ctgcctgccttggcctccagga

SEQ ID NO: 8040648 - DNA, 22 bp, Homo sapiens
ctgcctgccacgttcagctgta

SEQ ID NO: 8040649 - DNA, 20 bp, Homo sapiens
ctgctccacccggctctcag

SEQ ID NO: 8040650 - DNA, 22 bp, Homo sapiens
ctgctcctccccatcaggcagc

SEQ ID NO: 8040651 - DNA, 22 bp, Homo sapiens
ctgcatatgatagatgccttgc

SEQ ID NO: 8040652 - DNA, 22 bp, Homo sapiens
ctgcatatgagaataggagaaa

SEQ ID NO: 8040653 - DNA, 22 bp, Homo sapiens
ctgccctgcagctccacggact

SEQ ID NO: 8040654 - DNA, 22 bp, Homo sapiens
ctgcctctataggagtccacca

SEQ ID NO: 8040655 - DNA, 22 bp, Homo sapiens
ctgagccttgatgtcccttgtc

SEQ ID NO: 8040656 - DNA, 22 bp, Homo sapiens
ctgagatctttatacgaggcac

SEQ ID NO: 8040657 - DNA, 22 bp, Homo sapiens
ctgagagatcaagccacaggat

SEQ ID NO: 8040658 - DNA, 22 bp, Homo sapiens
ctgagaggtaagcagcgcagtg

SEQ ID NO: 8040659 - DNA, 22 bp, Homo sapiens
ctgaaacattgcaataacaaag

SEQ ID NO: 8040660 - DNA, 22 bp, Homo sapiens
ttttcctctgtatttgaaatgc

SEQ ID NO: 8040661 - DNA, 22 bp, Homo sapiens
ccttgcctcattgtgcttctcc

SEQ ID NO: 8040662 - DNA, 22 bp, Homo sapiens
cgcaactcagcaacttaactgc

SEQ ID NO: 8040663 - DNA, 22 bp, Homo sapiens
cgcaccactgaattccagcctg

SEQ ID NO: 8040664 - DNA, 22 bp, Homo sapiens
ttatgtaagtggagtcatatag

SEQ ID NO: 8040665 - DNA, 22 bp, Homo sapiens
tgttggaattaggatacagagg

SEQ ID NO: 8040666 - DNA, 22 bp, Homo sapiens
tgttttcagtcatatagcaggt

SEQ ID NO: 8040667 - DNA, 22 bp, Homo sapiens
tgttttcatggagatggtggcg

SEQ ID NO: 8040668 - DNA, 22 bp, Homo sapiens
ttacaataccacatcacctcat

SEQ ID NO: 8040669 - DNA, 22 bp, Homo sapiens
ttacaagtttctggcttcatcc

SEQ ID NO: 8040670 - DNA, 22 bp, Homo sapiens
cctgtacaagagccatctggat

SEQ ID NO: 8040671 - DNA, 22 bp, Homo sapiens
cctgtacaagctcttggtgaca

SEQ ID NO: 8040672 - DNA, 22 bp, Homo sapiens
cctgtacagtgaatgaatgtga

SEQ ID NO: 8040673 - DNA, 22 bp, Homo sapiens
cctgtacacggtctatgcctcc

SEQ ID NO: 8040674 - DNA, 22 bp, Homo sapiens
cctgtacacaattccgaggata

SEQ ID NO: 8040675 - DNA, 22 bp, Homo sapiens
cctgtacatggccatctttacc

SEQ ID NO: 8040676 - DNA, 22 bp, Homo sapiens
cctgtacatctgctctcattgc

SEQ ID NO: 8040677 - DNA, 22 bp, Homo sapiens
cctgtacattagctgtgaattg

SEQ ID NO: 8040678 - DNA, 19 bp, Homo sapiens
cctgtacattattctcccc

SEQ ID NO: 8040679 - DNA, 21 bp, Homo sapiens
ttgaaggatcacttctgtacc

SEQ ID NO: 8040680 - DNA, 22 bp, Homo sapiens
ctcaggctaagaaggccaagtg

SEQ ID NO: 8040681 - DNA, 22 bp, Homo sapiens
ctcaggagtagttcagcagctg

SEQ ID NO: 8040682 - DNA, 22 bp, Homo sapiens
ttctaccattgggaaaacagcc

SEQ ID NO: 8040683 - DNA, 22 bp, Homo sapiens
ttctaccagctactcactgata

SEQ ID NO: 8040684 - DNA, 22 bp, Homo sapiens
ttctaccagaccccagacttgt

SEQ ID NO: 8040685 - DNA, 22 bp, Homo sapiens
ctacatgaactcttaagtcaca

SEQ ID NO: 8040686 - DNA, 21 bp, Homo sapiens
ttctacaggatgaatgaaaac

SEQ ID NO: 8040687 - DNA, 22 bp, Homo sapiens
ttcctaacaaacttcagtgaat

SEQ ID NO: 8040688 - DNA, 22 bp, Homo sapiens
cggctggtgtcgggcacagcaa

SEQ ID NO: 8040689 - DNA, 22 bp, Homo sapiens
ttccaaattaaaatgtacaatg

SEQ ID NO: 8040690 - DNA, 22 bp, Homo sapiens
ggctccctagggagagtgggag

SEQ ID NO: 8040691 - DNA, 21 bp, Homo sapiens
gggagggatggaaatgatgtt

SEQ ID NO: 8040692 - DNA, 22 bp, Homo sapiens
gggaagtttgtgggaggaatat

SEQ ID NO: 8040693 - DNA, 19 bp, Homo sapiens
gggagctgaggtctttggt

SEQ ID NO: 8040694 - DNA, 22 bp, Homo sapiens
ggctttgcattttgatggaggt

SEQ ID NO: 8040695 - DNA, 19 bp, Homo sapiens
ggatgagggtcaggcatag

SEQ ID NO: 8040696 - DNA, 22 bp, Homo sapiens
ggatgaggaaaccacagtgtcc

SEQ ID NO: 8040697 - DNA, 22 bp, Homo sapiens
ggatgaggaagattactgagaa

SEQ ID NO: 8040698 - DNA, 22 bp, Homo sapiens
ggattgagagcactggtagctg

SEQ ID NO: 8040699 - DNA, 22 bp, Homo sapiens
gggctcctggcagtcatgctca

SEQ ID NO: 8040700 - DNA, 22 bp, Homo sapiens
gggctcctgcctcctggcacct

SEQ ID NO: 8040701 - DNA, 21 bp, Homo sapiens
gggggaagaggagttgctagt

SEQ ID NO: 8040702 - DNA, 22 bp, Homo sapiens
ggtgccaggctgtagtcagggt

SEQ ID NO: 8040703 - DNA, 22 bp, Homo sapiens
ggtgccagtgggtctcaggata

SEQ ID NO: 8040704 - DNA, 22 bp, Homo sapiens
ggtgccagagtggcccaggggc

SEQ ID NO: 8040705 - DNA, 22 bp, Homo sapiens
ggtgccctgtaaaagccatgca

SEQ ID NO: 8040706 - DNA, 22 bp, Homo sapiens
ggtgcccagagccaggaatgag

SEQ ID NO: 8040707 - DNA, 22 bp, Homo sapiens
ggtaacacaggtgcagttttaa

SEQ ID NO: 8040708 - DNA, 22 bp, Homo sapiens
ggtcagcagtttctttgaattt

SEQ ID NO: 8040709 - DNA, 22 bp, Homo sapiens
gtaacacatgatgggttccagt

SEQ ID NO: 8040710 - DNA, 22 bp, Homo sapiens
gtaacacagaaatgaaattcca

SEQ ID NO: 8040711 - DNA, 22 bp, Homo sapiens
gtcaggggatgtgctggtggcc

SEQ ID NO: 8040712 - DNA, 22 bp, Homo sapiens
gtccctggagctgagcagtgct

SEQ ID NO: 8040713 - DNA, 19 bp, Homo sapiens
gtcctctcaacaacccggg

SEQ ID NO: 8040714 - DNA, 22 bp, Homo sapiens
gtgcacagaaattggtaagact

SEQ ID NO: 8040715 - DNA, 22 bp, Homo sapiens
gtgcacagaaacatacaatgtg

SEQ ID NO: 8040716 - DNA, 22 bp, Homo sapiens
gcagaggaggacccaggaatta

SEQ ID NO: 8040717 - DNA, 22 bp, Homo sapiens
gaggggctgggtagggcaaccc

SEQ ID NO: 8040718 - DNA, 22 bp, Homo sapiens
gcaagcaaaatgggagattccc

SEQ ID NO: 8040719 - DNA, 22 bp, Homo sapiens
gcaagacaatggagcataaacg

SEQ ID NO: 8040720 - DNA, 22 bp, Homo sapiens
gcaagacatgtctaaggtttaa

SEQ ID NO: 8040721 - DNA, 22 bp, Homo sapiens
gcacagcagtggcataaacaat

SEQ ID NO: 8040722 - DNA, 22 bp, Homo sapiens
gcacaggatgatgggttgaggg

SEQ ID NO: 8040723 - DNA, 22 bp, Homo sapiens
gcagaggacacaggagggcaag

SEQ ID NO: 8040724 - DNA, 22 bp, Homo sapiens
gcactgaatgcttttactgtaa

SEQ ID NO: 8040725 - DNA, 22 bp, Homo sapiens
gcactgaaattatatgcatttg

SEQ ID NO: 8040726 - DNA, 20 bp, Homo sapiens
gcactgaaattcaatgtttg

SEQ ID NO: 8040727 - DNA, 19 bp, Homo sapiens
gcactgaagagttggtcac

SEQ ID NO: 8040728 - DNA, 22 bp, Homo sapiens
gcactctcctggctgccacagt

SEQ ID NO: 8040729 - DNA, 22 bp, Homo sapiens
gccctctgttattgcatcctta

SEQ ID NO: 8040730 - DNA, 22 bp, Homo sapiens
gcctcagctcccagcccaggct

SEQ ID NO: 8040731 - DNA, 22 bp, Homo sapiens
gcctcagctgttgcaggggccc

SEQ ID NO: 8040732 - DNA, 22 bp, Homo sapiens
gcccagggcagggcaagagtga

SEQ ID NO: 8040733 - DNA, 22 bp, Homo sapiens
gcccataattcaaatataacac

SEQ ID NO: 8040734 - DNA, 22 bp, Homo sapiens
gcccaggggcagcgcatagtgg

SEQ ID NO: 8040735 - DNA, 22 bp, Homo sapiens
gccctctggtgggtgagccccg

SEQ ID NO: 8040736 - DNA, 22 bp, Homo sapiens
gccctctgtgtaacaatccaga

SEQ ID NO: 8040737 - DNA, 22 bp, Homo sapiens
gccaggttgctgacgacgatct

SEQ ID NO: 8040738 - DNA, 22 bp, Homo sapiens
gctggcagccaagtgaagaggg

SEQ ID NO: 8040739 - DNA, 22 bp, Homo sapiens
gctggcagctggaagttgggct

SEQ ID NO: 8040740 - DNA, 22 bp, Homo sapiens
gctggcagagacaagaagacta

SEQ ID NO: 8040741 - DNA, 22 bp, Homo sapiens
gctggcaggagaaacggggtgc

SEQ ID NO: 8040742 - DNA, 22 bp, Homo sapiens
gctggcaggagaccatacccta

SEQ ID NO: 8040743 - DNA, 22 bp, Homo sapiens
gctggcaggagcctttcccttt

SEQ ID NO: 8040744 - DNA, 22 bp, Homo sapiens
gctggcaggataacttctaagc

SEQ ID NO: 8040745 - DNA, 22 bp, Homo sapiens
gctggcaggatagaagtctaat

SEQ ID NO: 8040746 - DNA, 22 bp, Homo sapiens
gctggcagggacagctgcgtgt

SEQ ID NO: 8040747 - DNA, 22 bp, Homo sapiens
gctggcagaagagctggttcaa

SEQ ID NO: 8040748 - DNA, 22 bp, Homo sapiens
gctggcagaatttcttcttgct

SEQ ID NO: 8040749 - DNA, 19 bp, Homo sapiens
gctggcagaattttgaacc

SEQ ID NO: 8040750 - DNA, 22 bp, Homo sapiens
gctggcagactgggggcagaac

SEQ ID NO: 8040751 - DNA, 22 bp, Homo sapiens
gctggcagacttcctctggaac

SEQ ID NO: 8040752 - DNA, 22 bp, Homo sapiens
gctggcagacttcctctggaac

SEQ ID NO: 8040753 - DNA, 22 bp, Homo sapiens
ggagaggagattgtggcatttt

SEQ ID NO: 8040754 - DNA, 22 bp, Homo sapiens
ggacacagtggaagacagcttg

SEQ ID NO: 8040755 - DNA, 22 bp, Homo sapiens
ggaacatttcctggcagagagg

SEQ ID NO: 8040756 - DNA, 22 bp, Homo sapiens
ggaacattttttaaggcagaaa

SEQ ID NO: 8040757 - DNA, 22 bp, Homo sapiens
gcttcctccctgctgctcacta

SEQ ID NO: 8040758 - DNA, 22 bp, Homo sapiens
gcttccgcgatgtcctaggtgg

SEQ ID NO: 8040759 - DNA, 21 bp, Homo sapiens
gctcctggtgctgcgtggcgc

SEQ ID NO: 8040760 - DNA, 22 bp, Homo sapiens
gctcagggaactttttgcaggc

SEQ ID NO: 8040761 - DNA, 22 bp, Homo sapiens
gctcagggaaagagctcctgtc

SEQ ID NO: 8040762 - DNA, 22 bp, Homo sapiens
gctcagggaaagagctcctgtc

SEQ ID NO: 8040763 - DNA, 22 bp, Homo sapiens
gccttctctgtgagctcctagg

SEQ ID NO: 8040764 - DNA, 17 bp, Homo sapiens
gccttctctgccctcac

SEQ ID NO: 8040765 - DNA, 22 bp, Homo sapiens
gccttcagcggccgctcgctgc

SEQ ID NO: 8040766 - DNA, 23 bp, Homo sapiens
gccttcagctcgggaaggctccc

SEQ ID NO: 8040767 - DNA, 22 bp, Homo sapiens
gcctcaggccgccctgctgctc

SEQ ID NO: 8040768 - DNA, 22 bp, Homo sapiens
gcctcaggccgccctgctgctc

SEQ ID NO: 8040769 - DNA, 22 bp, Homo sapiens
gtttctctttgaagcctggctg

SEQ ID NO: 8040770 - DNA, 22 bp, Homo sapiens
gtgttaaccagctaaactttgc

SEQ ID NO: 8040771 - DNA, 22 bp, Homo sapiens
gttaggaacactggagcctaaa

SEQ ID NO: 8040772 - DNA, 22 bp, Homo sapiens
taactgtaatataaatatgagt

SEQ ID NO: 8040773 - DNA, 22 bp, Homo sapiens
taacacagacagccactagtaa

SEQ ID NO: 8040774 - DNA, 22 bp, Homo sapiens
taagatattgagtggtaatttg

SEQ ID NO: 8040775 - DNA, 22 bp, Homo sapiens
taagatatggtaggaagtttgg

SEQ ID NO: 8040776 - DNA, 22 bp, Homo sapiens
taagataatccattataatgtt

SEQ ID NO: 8040777 - DNA, 22 bp, Homo sapiens
tacacatgctcagattcctgtg

SEQ ID NO: 8040778 - DNA, 20 bp, Homo sapiens
tacaatattcccactttgct

SEQ ID NO: 8040779 - DNA, 22 bp, Homo sapiens
tacaatatgtggccttttgtga

SEQ ID NO: 8040780 - DNA, 22 bp, Homo sapiens
taatttttccacgtacactggg

SEQ ID NO: 8040781 - DNA, 22 bp, Homo sapiens
taatgctaacatcatatcactg

SEQ ID NO: 8040782 - DNA, 22 bp, Homo sapiens
taagttacctgttttgtcatca

SEQ ID NO: 8040783 - DNA, 22 bp, Homo sapiens
tacattatcttgttatctttca

SEQ ID NO: 8040784 - DNA, 22 bp, Homo sapiens
tacaggaagcactcaagaaatg

SEQ ID NO: 8040785 - DNA, 22 bp, Homo sapiens
tacataattaatctttaagttc

SEQ ID NO: 8040786 - DNA, 19 bp, Homo sapiens
tacattccacacaatctct

SEQ ID NO: 8040787 - DNA, 22 bp, Homo sapiens
tacttcctgtttccatgtctgt

SEQ ID NO: 8040788 - DNA, 22 bp, Homo sapiens
tatttctaagctgtaagtctga

SEQ ID NO: 8040789 - DNA, 22 bp, Homo sapiens
tattcactgtaactcagcaata

SEQ ID NO: 8040790 - DNA, 22 bp, Homo sapiens
tattcactttgggagagccatt

SEQ ID NO: 8040791 - DNA, 22 bp, Homo sapiens
tatactgtaggtgcagaaagaa

SEQ ID NO: 8040792 - DNA, 22 bp, Homo sapiens
tatatgtgtggattcttgtaga

SEQ ID NO: 8040793 - DNA, 22 bp, Homo sapiens
tagcatttcactgatcttcact

SEQ ID NO: 8040794 - DNA, 22 bp, Homo sapiens
tagcatttcccaaatgcatttg

SEQ ID NO: 8040795 - DNA, 22 bp, Homo sapiens
tagcatttggacattgtcacct

SEQ ID NO: 8040796 - DNA, 22 bp, Homo sapiens
tagcatttggcaccagttattt

SEQ ID NO: 8040797 - DNA, 22 bp, Homo sapiens
tagatgtaagcagaagaacagc

SEQ ID NO: 8040798 - DNA, 22 bp, Homo sapiens
tagatgtagccactgctaaaag

SEQ ID NO: 8040799 - DNA, 22 bp, Homo sapiens
tagcaaaaactgcagttacttt

SEQ ID NO: 8040800 - DNA, 22 bp, Homo sapiens
tagatggaggctagatgcaggg

SEQ ID NO: 8040801 - DNA, 22 bp, Homo sapiens
tagtgtatgataaaaaattctt

SEQ ID NO: 8040802 - DNA, 21 bp, Homo sapiens
tcacatctatgttaagcaaac

SEQ ID NO: 8040803 - DNA, 23 bp, Homo sapiens
tcagagaagttgtaggctgggga

SEQ ID NO: 8040804 - DNA, 22 bp, Homo sapiens
tcagagaaggtaagtgacctgc

SEQ ID NO: 8040805 - DNA, 22 bp, Homo sapiens
tcagagaagtaaggtggggtgc

SEQ ID NO: 8040806 - DNA, 22 bp, Homo sapiens
tcagaggactaccttctccagt

SEQ ID NO: 8040807 - DNA, 22 bp, Homo sapiens
tcagaggaccttactgagaacc

SEQ ID NO: 8040808 - DNA, 22 bp, Homo sapiens
tcagaggagaagttgggaaaat

SEQ ID NO: 8040809 - DNA, 22 bp, Homo sapiens
tcagaggattgcctcagcgagc

SEQ ID NO: 8040810 - DNA, 19 bp, Homo sapiens
tcagaggatttggctatga

SEQ ID NO: 8040811 - DNA, 22 bp, Homo sapiens
tcagaggagaccaaggggaata

SEQ ID NO: 8040812 - DNA, 22 bp, Homo sapiens
tcagaggacagcagctaaataa

SEQ ID NO: 8040813 - DNA, 22 bp, Homo sapiens
tcagaggacaagctccctggtg

SEQ ID NO: 8040814 - DNA, 22 bp, Homo sapiens
tcagaggaataatgctgcattt

SEQ ID NO: 8040815 - DNA, 22 bp, Homo sapiens
tcagaggaagccttggtgggag

SEQ ID NO: 8040816 - DNA, 22 bp, Homo sapiens
tcactggtgtgagaggagcaaa

SEQ ID NO: 8040817 - DNA, 21 bp, Homo sapiens
tcacgtggtcacatgagcttt

SEQ ID NO: 8040818 - DNA, 17 bp, Homo sapiens
tcagagggatgagcagg

SEQ ID NO: 8040819 - DNA, 22 bp, Homo sapiens
tcaggagggctaagactgtagc

SEQ ID NO: 8040820 - DNA, 22 bp, Homo sapiens
tcaggagcagggggaagctctg

SEQ ID NO: 8040821 - DNA, 22 bp, Homo sapiens
tcaggagctatggactgtcaaa

SEQ ID NO: 8040822 - DNA, 22 bp, Homo sapiens
tcaggagctcttccctggtgtg

SEQ ID NO: 8040823 - DNA, 22 bp, Homo sapiens
tcagggtaaaccttcactgtga

SEQ ID NO: 8040824 - DNA, 20 bp, Homo sapiens
tcatccaggacaggagtggc

SEQ ID NO: 8040825 - DNA, 22 bp, Homo sapiens
tcatctaagagtcttacattta

SEQ ID NO: 8040826 - DNA, 23 bp, Homo sapiens
tcctcctgacacagcctgagtga

SEQ ID NO: 8040827 - DNA, 22 bp, Homo sapiens
tccctgccctcagtgcacccgg

SEQ ID NO: 8040828 - DNA, 23 bp, Homo sapiens
tccctgagatgctgctctgtccc

SEQ ID NO: 8040829 - DNA, 22 bp, Homo sapiens
tccctgagggcagctcaagtcc

SEQ ID NO: 8040830 - DNA, 19 bp, Homo sapiens
tccctgagttccagcccag

SEQ ID NO: 8040831 - DNA, 23 bp, Homo sapiens
tccctgagctggagagactgcac

SEQ ID NO: 8040832 - DNA, 22 bp, Homo sapiens
tccctgagctgagctcaacagc

SEQ ID NO: 8040833 - DNA, 22 bp, Homo sapiens
tccctgagcttcatcaggcttt

SEQ ID NO: 8040834 - DNA, 22 bp, Homo sapiens
tcccagcctttcttttctgctg

SEQ ID NO: 8040835 - DNA, 22 bp, Homo sapiens
tccaggccattgactgcatcct

SEQ ID NO: 8040836 - DNA, 22 bp, Homo sapiens
tccaggaggaggaaggctgcca

SEQ ID NO: 8040837 - DNA, 17 bp, Homo sapiens
tccagccctgcccgacg

SEQ ID NO: 8040838 - DNA, 22 bp, Homo sapiens
tccaggagcatccaggtgaagc

SEQ ID NO: 8040839 - DNA, 23 bp, Homo sapiens
tccaggagcatgctggctggcga

SEQ ID NO: 8040840 - DNA, 21 bp, Homo sapiens
tccaccctctctgctcccagt

SEQ ID NO: 8040841 - DNA, 22 bp, Homo sapiens
tccaccctgcttttgtctttga

SEQ ID NO: 8040842 - DNA, 22 bp, Homo sapiens
tccaccctgctttcttatctcc

SEQ ID NO: 8040843 - DNA, 21 bp, Homo sapiens
tttatgtacttcatagagtag

SEQ ID NO: 8040844 - DNA, 22 bp, Homo sapiens
tttcaagtcattctataatatc

SEQ ID NO: 8040845 - DNA, 22 bp, Homo sapiens
tttcaagttctgttcctaaact

SEQ ID NO: 8040846 - DNA, 22 bp, Homo sapiens
tttcaagttgttgcattaaatg

SEQ ID NO: 8040847 - DNA, 21 bp, Homo sapiens
tttcagtgtatgacagtgaaa

SEQ ID NO: 8040848 - DNA, 22 bp, Homo sapiens
tttcatcatgttggcagattgg

SEQ ID NO: 8040849 - DNA, 22 bp, Homo sapiens
tttccaggtattaatactgtat

SEQ ID NO: 8040850 - DNA, 22 bp, Homo sapiens
tttccttgcacattggtttcca

SEQ ID NO: 8040851 - DNA, 22 bp, Homo sapiens
ttggaagttgatttaaaaagga

SEQ ID NO: 8040852 - DNA, 22 bp, Homo sapiens
ttggaacatgccggggtccagg

SEQ ID NO: 8040853 - DNA, 22 bp, Homo sapiens
ttgtatatattcttaaagatgt

SEQ ID NO: 8040854 - DNA, 18 bp, Homo sapiens
ttggctttgagaactggt

SEQ ID NO: 8040855 - DNA, 22 bp, Homo sapiens
ttgggaagaaacatgtccatca

SEQ ID NO: 8040856 - DNA, 23 bp, Homo sapiens
ttgggaaatagttaagacatgag

SEQ ID NO: 8040857 - DNA, 22 bp, Homo sapiens
ttgggctttaattccagagagg

SEQ ID NO: 8040858 - DNA, 22 bp, Homo sapiens
ttccaacaatgtgttattgttc

SEQ ID NO: 8040859 - DNA, 21 bp, Homo sapiens
ttcatcagccagaaatcaagc

SEQ ID NO: 8040860 - DNA, 22 bp, Homo sapiens
ttccatatttgtgtggcaaaag

SEQ ID NO: 8040861 - DNA, 22 bp, Homo sapiens
ttcaatatgatattagctgtgg

SEQ ID NO: 8040862 - DNA, 22 bp, Homo sapiens
ttcatacatttttactaacagc

SEQ ID NO: 8040863 - DNA, 22 bp, Homo sapiens
ttcatagaagcagaaagtaaac

SEQ ID NO: 8040864 - DNA, 21 bp, Homo sapiens
tcctcctgtagagggtcctgg

SEQ ID NO: 8040865 - DNA, 22 bp, Homo sapiens
tcctcggctgggccccaggctt

SEQ ID NO: 8040866 - DNA, 22 bp, Homo sapiens
tcctctggaacctcacccttgc

SEQ ID NO: 8040867 - DNA, 22 bp, Homo sapiens
tcctctggatataagcctcacc

SEQ ID NO: 8040868 - DNA, 22 bp, Homo sapiens
ttatggaaaatacaattataag

SEQ ID NO: 8040869 - DNA, 22 bp, Homo sapiens
ttccctctgcgcattgaatttc

SEQ ID NO: 8040870 - DNA, 22 bp, Homo sapiens
ttctcacaattcttgtatttgc

SEQ ID NO: 8040871 - DNA, 22 bp, Homo sapiens
ttctcacagtacctaacatgta

SEQ ID NO: 8040872 - DNA, 22 bp, Homo sapiens
ttctcacaggctggaatgatga

SEQ ID NO: 8040873 - DNA, 22 bp, Homo sapiens
ttgagaaacctggcagtagaga

SEQ ID NO: 8040874 - DNA, 22 bp, Homo sapiens
ttgaaagatatgttaatctttc

SEQ ID NO: 8040875 - DNA, 22 bp, Homo sapiens
ttgaaaaaattggtagaggatg

SEQ ID NO: 8040876 - DNA, 22 bp, Homo sapiens
ttgagacacaaggcacagtaag

SEQ ID NO: 8040877 - DNA, 22 bp, Homo sapiens
ttgagacactttgggcatcact

SEQ ID NO: 8040878 - DNA, 18 bp, Homo sapiens
ttgagaaataagcactaa

SEQ ID NO: 8040879 - DNA, 22 bp, Homo sapiens
ttgagaaatgttttttaagctg

SEQ ID NO: 8040880 - DNA, 16 bp, Homo sapiens
ttgagaaatgaagttt

SEQ ID NO: 8040881 - DNA, 22 bp, Homo sapiens
tttttgttcccagagaatttgt

SEQ ID NO: 8040882 - DNA, 22 bp, Homo sapiens
ttttcctctgcagagcagttag

SEQ ID NO: 8040883 - DNA, 20 bp, Homo sapiens
ttttcctcgtgtttgttcta

SEQ ID NO: 8040884 - DNA, 22 bp, Homo sapiens
ttttcctcaggaatgctaagct

SEQ ID NO: 8040885 - DNA, 22 bp, Homo sapiens
ttttcctctgtatgcgtgagat

SEQ ID NO: 8040886 - DNA, 22 bp, Homo sapiens
ttttcctcacctaactcaaggt

SEQ ID NO: 8040887 - DNA, 22 bp, Homo sapiens
ttttcaaagactggaggctgat

SEQ ID NO: 8040888 - DNA, 22 bp, Homo sapiens
tttgacagcataatcctacacc

SEQ ID NO: 8040889 - DNA, 22 bp, Homo sapiens
tttgaacaggagtatctatagt

SEQ ID NO: 8040890 - DNA, 22 bp, Homo sapiens
tttgaacatgctgcatgataat

SEQ ID NO: 8040891 - DNA, 22 bp, Homo sapiens
tttgacagcttgttacaaagtt

SEQ ID NO: 8040892 - DNA, 22 bp, Homo sapiens
tttgacagtgctattaagaaac

SEQ ID NO: 8040893 - DNA, 22 bp, Homo sapiens
tttgacagtgctgctaaaatgc

SEQ ID NO: 8040894 - DNA, 22 bp, Homo sapiens
tttgaaagtgtttacttgggaa

SEQ ID NO: 8040895 - DNA, 22 bp, Homo sapiens
aatcataattttgtgaatgtag

SEQ ID NO: 8040896 - DNA, 22 bp, Homo sapiens
aatataatgctgttttatgcca

SEQ ID NO: 8040897 - DNA, 22 bp, Homo sapiens
aacttacaaggatgatagctgc

SEQ ID NO: 8040898 - DNA, 22 bp, Homo sapiens
aacttacaatgttagagtctca

SEQ ID NO: 8040899 - DNA, 22 bp, Homo sapiens
aactgttcttcattttcagtat

SEQ ID NO: 8040900 - DNA, 22 bp, Homo sapiens
aacaaatggaacacaaatcttt

SEQ ID NO: 8040901 - DNA, 22 bp, Homo sapiens
aacaaatgtaaaatgcagatgc

SEQ ID NO: 8040902 - DNA, 22 bp, Homo sapiens
aacactgagaggggagtggcac

SEQ ID NO: 8040903 - DNA, 22 bp, Homo sapiens
aacactgagaacaatacagagt

SEQ ID NO: 8040904 - DNA, 20 bp, Homo sapiens
aacaaactacaaaattatgt

SEQ ID NO: 8040905 - DNA, 22 bp, Homo sapiens
aaattctctaaagaaaacatga

SEQ ID NO: 8040906 - DNA, 22 bp, Homo sapiens
aaattctcaagtgatcctgttg

SEQ ID NO: 8040907 - DNA, 22 bp, Homo sapiens
aaattgaatttgggaaacattg

SEQ ID NO: 8040908 - DNA, 22 bp, Homo sapiens
aaattcctctgatcataagaat

SEQ ID NO: 8040909 - DNA, 22 bp, Homo sapiens
aagaaatgctgatgttggatgg

SEQ ID NO: 8040910 - DNA, 22 bp, Homo sapiens
aagacagtgtgtcaggcaggtg

SEQ ID NO: 8040911 - DNA, 22 bp, Homo sapiens
aattggaaaatgctacatatca

SEQ ID NO: 8040912 - DNA, 20 bp, Homo sapiens
acaaagactggaaaagcaag

SEQ ID NO: 8040913 - DNA, 22 bp, Homo sapiens
aagagctgtgggtggtagtcct

SEQ ID NO: 8040914 - DNA, 22 bp, Homo sapiens
aagatttaccactttattcaag

SEQ ID NO: 8040915 - DNA, 22 bp, Homo sapiens
acactgcttctctggcagagcc

SEQ ID NO: 8040916 - DNA, 18 bp, Homo sapiens
acactgcagcagtctgct

SEQ ID NO: 8040917 - DNA, 22 bp, Homo sapiens
aagcacagtgggcagagcagcc

SEQ ID NO: 8040918 - DNA, 22 bp, Homo sapiens
aagcacagtaaaagcagatttt

SEQ ID NO: 8040919 - DNA, 22 bp, Homo sapiens
aagcacaggagacgcacagcca

SEQ ID NO: 8040920 - DNA, 22 bp, Homo sapiens
aaagttcagtgccttctataca

SEQ ID NO: 8040921 - DNA, 21 bp, Homo sapiens
aaagttacagtcagtgggtgc

SEQ ID NO: 8040922 - DNA, 22 bp, Homo sapiens
aaagttacccaatctctatgaa

SEQ ID NO: 8040923 - DNA, 22 bp, Homo sapiens
aaagagtcaaaggcatgtctct

SEQ ID NO: 8040924 - DNA, 22 bp, Homo sapiens
aaagagtcgtgttccaggtttg

SEQ ID NO: 8040925 - DNA, 22 bp, Homo sapiens
aaagagtctggcactgtaccag

SEQ ID NO: 8040926 - DNA, 22 bp, Homo sapiens
aaagaatagcctttgtccaaat

SEQ ID NO: 8040927 - DNA, 22 bp, Homo sapiens
aaagaatcagaagtctcaaaca

SEQ ID NO: 8040928 - DNA, 22 bp, Homo sapiens
aaactgaaacatcatcatgttg

SEQ ID NO: 8040929 - DNA, 21 bp, Homo sapiens
aaactgaagagacaggaactt

SEQ ID NO: 8040930 - DNA, 22 bp, Homo sapiens
aaacagagagatgtatgtggag

SEQ ID NO: 8040931 - DNA, 22 bp, Homo sapiens
aaacagagggccactgaggctc

SEQ ID NO: 8040932 - DNA, 23 bp, Homo sapiens
aaaaaaccatgtaggcactcagt

SEQ ID NO: 8040933 - DNA, 22 bp, Homo sapiens
aaaaacctttcccatactaaga

SEQ ID NO: 8040934 - DNA, 22 bp, Homo sapiens
aaaaactgcaattacttttgtc

SEQ ID NO: 8040935 - DNA, 22 bp, Homo sapiens
aaagacattagcttagatgtca

SEQ ID NO: 8040936 - DNA, 22 bp, Homo sapiens
aaagacatggcaagagatgggg

SEQ ID NO: 8040937 - DNA, 22 bp, Homo sapiens
aaagacattagattaacgtaca

SEQ ID NO: 8040938 - DNA, 22 bp, Homo sapiens
aaagacattgaagaaggactta

SEQ ID NO: 8040939 - DNA, 22 bp, Homo sapiens
aaagacatggaactagagatgg

SEQ ID NO: 8040940 - DNA, 22 bp, Homo sapiens
aaagatcacgtcccaggactcg

SEQ ID NO: 8040941 - DNA, 22 bp, Homo sapiens
aaagatcaatagataaagctac

SEQ ID NO: 8040942 - DNA, 22 bp, Homo sapiens
aaagatcaagtaggcatggcct

SEQ ID NO: 8040943 - DNA, 22 bp, Homo sapiens
aacaaaagccgaagtaggtgtc

SEQ ID NO: 8040944 - DNA, 22 bp, Homo sapiens
aaagtcaatgatttctcctgga

SEQ ID NO: 8040945 - DNA, 22 bp, Homo sapiens
aaagtcaaaatgctctcctgtc

SEQ ID NO: 8040946 - DNA, 22 bp, Homo sapiens
aaagggcctccgcctgggcagg

SEQ ID NO: 8040947 - DNA, 22 bp, Homo sapiens
aaataatcaatttttgtagata

SEQ ID NO: 8040948 - DNA, 22 bp, Homo sapiens
aaatgtagttgaaaagttaagg

SEQ ID NO: 8040949 - DNA, 22 bp, Homo sapiens
aagcacagagatgggcacgcct

SEQ ID NO: 8040950 - DNA, 22 bp, Homo sapiens
aaatcccagatagtaatgtatt

SEQ ID NO: 8040951 - DNA, 22 bp, Homo sapiens
aagcacagataaaacaggattc

SEQ ID NO: 8040952 - DNA, 22 bp, Homo sapiens
acaagctttgtgatagtagaga

SEQ ID NO: 8040953 - DNA, 21 bp, Homo sapiens
agcaaggcagcctctcagcct

SEQ ID NO: 8040954 - DNA, 22 bp, Homo sapiens
agcaagatttttcaggttagta

SEQ ID NO: 8040955 - DNA, 22 bp, Homo sapiens
agcaagattgaggcttcctcag

SEQ ID NO: 8040956 - DNA, 22 bp, Homo sapiens
acaaaattgtgttaaactttat

SEQ ID NO: 8040957 - DNA, 22 bp, Homo sapiens
acaaaattacctagttattttc

SEQ ID NO: 8040958 - DNA, 22 bp, Homo sapiens
acaaacttcccagacaagctcc

SEQ ID NO: 8040959 - DNA, 19 bp, Homo sapiens
acaaactgagtacacttgt

SEQ ID NO: 8040960 - DNA, 22 bp, Homo sapiens
aatgttattgtcctttccaaaa

SEQ ID NO: 8040961 - DNA, 22 bp, Homo sapiens
aatgttatttctgcatagtagt

SEQ ID NO: 8040962 - DNA, 22 bp, Homo sapiens
aatgtcatttaaaataattctg

SEQ ID NO: 8040963 - DNA, 22 bp, Homo sapiens
aatgtcattgagctccaatcct

SEQ ID NO: 8040964 - DNA, 21 bp, Homo sapiens
agacactggtttagcattcat

SEQ ID NO: 8040965 - DNA, 19 bp, Homo sapiens
agacagagctcagtgggtt

SEQ ID NO: 8040966 - DNA, 22 bp, Homo sapiens
agaagggctacacgggctctcc

SEQ ID NO: 8040967 - DNA, 19 bp, Homo sapiens
agctcctgttcagcagctc

SEQ ID NO: 8040968 - DNA, 17 bp, Homo sapiens
agcctgccccatgctgc

SEQ ID NO: 8040969 - DNA, 22 bp, Homo sapiens
acagcaaaggacgaacactctg

SEQ ID NO: 8040970 - DNA, 22 bp, Homo sapiens
acagagtcctagctgcaaagaa

SEQ ID NO: 8040971 - DNA, 22 bp, Homo sapiens
acactgtagctgagggcatgcg

SEQ ID NO: 8040972 - DNA, 22 bp, Homo sapiens
acactgtaaattgagtgcgtga

SEQ ID NO: 8040973 - DNA, 23 bp, Homo sapiens
agcaggaaaccgagggtgatgtt

SEQ ID NO: 8040974 - DNA, 22 bp, Homo sapiens
acaattttaagccagagtgggt

SEQ ID NO: 8040975 - DNA, 22 bp, Homo sapiens
agcacctgcacagtggaggaaa

SEQ ID NO: 8040976 - DNA, 22 bp, Homo sapiens
aatgaacagtgggtgaggtacc

SEQ ID NO: 8040977 - DNA, 22 bp, Homo sapiens
aatgaacaggtgaatgtcagat

SEQ ID NO: 8040978 - DNA, 22 bp, Homo sapiens
aatgaacatggacaagttaata

SEQ ID NO: 8040979 - DNA, 22 bp, Homo sapiens
aatgaacatgggagtactaata

SEQ ID NO: 8040980 - DNA, 22 bp, Homo sapiens
aatgaacacgctggtggtgcaa

SEQ ID NO: 8040981 - DNA, 22 bp, Homo sapiens
actacaatactcttagtaaaag

SEQ ID NO: 8040982 - DNA, 22 bp, Homo sapiens
actaagacctagatactagggg

SEQ ID NO: 8040983 - DNA, 22 bp, Homo sapiens
aagttacattttggtctaattg

SEQ ID NO: 8040984 - DNA, 22 bp, Homo sapiens
aagttcaaaaatgtaatcagtg

SEQ ID NO: 8040985 - DNA, 22 bp, Homo sapiens
aagttcaagagtgacatattag

SEQ ID NO: 8040986 - DNA, 22 bp, Homo sapiens
aataagaatttacttgtcaaga

SEQ ID NO: 8040987 - DNA, 22 bp, Homo sapiens
aataatgtttatttgtattctc

SEQ ID NO: 8040988 - DNA, 22 bp, Homo sapiens
aataatgttgacgatagtctta

SEQ ID NO: 8040989 - DNA, 22 bp, Homo sapiens
aataatgtgtgctgcagtctta

SEQ ID NO: 8040990 - DNA, 22 bp, Homo sapiens
aataatgttatgtcattcttct

SEQ ID NO: 8040991 - DNA, 22 bp, Homo sapiens
aataatgtgatagataagggaa

SEQ ID NO: 8040992 - DNA, 19 bp, Homo sapiens
aataatgttcatgagattg

SEQ ID NO: 8040993 - DNA, 22 bp, Homo sapiens
aataattttgagagcctggaaa

SEQ ID NO: 8040994 - DNA, 22 bp, Homo sapiens
aagctttaaggaattttatgga

SEQ ID NO: 8040995 - DNA, 22 bp, Homo sapiens
acagtataaactcctaaaagcc

SEQ ID NO: 8040996 - DNA, 21 bp, Homo sapiens
accatcttccatgcattatat

SEQ ID NO: 8040997 - DNA, 22 bp, Homo sapiens
accatcttaaggggacttctta

SEQ ID NO: 8040998 - DNA, 22 bp, Homo sapiens
aagtatgaatcaaagactatct

SEQ ID NO: 8040999 - DNA, 22 bp, Homo sapiens
aagtcaatcacatgcacactga

SEQ ID NO: 8041000 - DNA, 22 bp, Homo sapiens
aagtcaattagtaaacttggaa

SEQ ID NO: 8041001 - DNA, 22 bp, Homo sapiens
aagggcccattctctcagaaaa

SEQ ID NO: 8041002 - DNA, 17 bp, Homo sapiens
atttcctcagggctgag

SEQ ID NO: 8041003 - DNA, 22 bp, Homo sapiens
agaggtcagaggtcgccaggtc

SEQ ID NO: 8041004 - DNA, 22 bp, Homo sapiens
agatacagtgttacatttttat

SEQ ID NO: 8041005 - DNA, 22 bp, Homo sapiens
attcatttagagggattaagca

SEQ ID NO: 8041006 - DNA, 22 bp, Homo sapiens
agaggcctgtgtgctccagtgg

SEQ ID NO: 8041007 - DNA, 22 bp, Homo sapiens
agagggaaaaactcatgtcatt

SEQ ID NO: 8041008 - DNA, 22 bp, Homo sapiens
agaggcagaagtgttcaaaccc

SEQ ID NO: 8041009 - DNA, 22 bp, Homo sapiens
agagatgactgatggctgatta

SEQ ID NO: 8041010 - DNA, 22 bp, Homo sapiens
atggcctggggattcctgagca

SEQ ID NO: 8041011 - DNA, 22 bp, Homo sapiens
atggcctgatgcacctgtccca

SEQ ID NO: 8041012 - DNA, 22 bp, Homo sapiens
atggcctgcagtgctgccacag

SEQ ID NO: 8041013 - DNA, 22 bp, Homo sapiens
agagacagaggcaatatagctt

SEQ ID NO: 8041014 - DNA, 22 bp, Homo sapiens
agagaaggaaagctgacatggg

SEQ ID NO: 8041015 - DNA, 22 bp, Homo sapiens
agagacagggttttgtcgtgtt

SEQ ID NO: 8041016 - DNA, 22 bp, Homo sapiens
agagaagagcaatgataaattt

SEQ ID NO: 8041017 - DNA, 21 bp, Homo sapiens
agacagactgcctgacccacg

SEQ ID NO: 8041018 - DNA, 22 bp, Homo sapiens
agaagtggtctgtcttccagat

SEQ ID NO: 8041019 - DNA, 22 bp, Homo sapiens
agacaaattgggacattgtgtt

SEQ ID NO: 8041020 - DNA, 22 bp, Homo sapiens
agacaaatggagtatgagcaac

SEQ ID NO: 8041021 - DNA, 22 bp, Homo sapiens
atgaaattgatcttgaactttt

SEQ ID NO: 8041022 - DNA, 22 bp, Homo sapiens
atgaaactgggataactatagc

SEQ ID NO: 8041023 - DNA, 22 bp, Homo sapiens
cagactttctgactcccttgcc

SEQ ID NO: 8041024 - DNA, 22 bp, Homo sapiens
cagaatgtagatcatcatcaag

SEQ ID NO: 8041025 - DNA, 22 bp, Homo sapiens
cagccctgcacgctgcctccgc

SEQ ID NO: 8041026 - DNA, 22 bp, Homo sapiens
cagccctgcagagggcgctcct

SEQ ID NO: 8041027 - DNA, 22 bp, Homo sapiens
cagccctgagttagcccacgga

SEQ ID NO: 8041028 - DNA, 22 bp, Homo sapiens
cagccctgagagaaccatctat

SEQ ID NO: 8041029 - DNA, 22 bp, Homo sapiens
cagctccaaagccccactgtcc

SEQ ID NO: 8041030 - DNA, 22 bp, Homo sapiens
cagagggagtttctgaggttgc

SEQ ID NO: 8041031 - DNA, 22 bp, Homo sapiens
agcctctgtagaaagcagtgtg

SEQ ID NO: 8041032 - DNA, 22 bp, Homo sapiens
agcctctgggggagctgggagc

SEQ ID NO: 8041033 - DNA, 22 bp, Homo sapiens
agcctctggtcctccctcagct

SEQ ID NO: 8041034 - DNA, 18 bp, Homo sapiens
agcctctggcagagagaa

SEQ ID NO: 8041035 - DNA, 22 bp, Homo sapiens
agcctctgctggccctggcact

SEQ ID NO: 8041036 - DNA, 20 bp, Homo sapiens
agcctctgcccttcccactg

SEQ ID NO: 8041037 - DNA, 22 bp, Homo sapiens
cacaagacttatttgtgtagaa

SEQ ID NO: 8041038 - DNA, 21 bp, Homo sapiens
cacaagacacatagggtgttt

SEQ ID NO: 8041039 - DNA, 21 bp, Homo sapiens
cacaagacacatagggtgttt

SEQ ID NO: 8041040 - DNA, 22 bp, Homo sapiens
cacaagacttatttgtgtagaa

SEQ ID NO: 8041041 - DNA, 22 bp, Homo sapiens
caaatagtgtcacattgtgagg

SEQ ID NO: 8041042 - DNA, 22 bp, Homo sapiens
caagacatgcaattgccacttt

SEQ ID NO: 8041043 - DNA, 21 bp, Homo sapiens
caagacatatgagtactctgg

SEQ ID NO: 8041044 - DNA, 22 bp, Homo sapiens
caagacattgattttgtacaga

SEQ ID NO: 8041045 - DNA, 22 bp, Homo sapiens
agcacagtggcttctatgtcta

SEQ ID NO: 8041046 - DNA, 19 bp, Homo sapiens
agcacagtttccacatgca

SEQ ID NO: 8041047 - DNA, 22 bp, Homo sapiens
agcacagtttcttttccttgtc

SEQ ID NO: 8041048 - DNA, 22 bp, Homo sapiens
cacagtcctacagagatcagag

SEQ ID NO: 8041049 - DNA, 22 bp, Homo sapiens
cacagttatatgttcacaagga

SEQ ID NO: 8041050 - DNA, 22 bp, Homo sapiens
cacccaggctggagagcagtgg

SEQ ID NO: 8041051 - DNA, 22 bp, Homo sapiens
actgtaaccagtgtggtgagag

SEQ ID NO: 8041052 - DNA, 22 bp, Homo sapiens
actgtacatgtaaacattgtca

SEQ ID NO: 8041053 - DNA, 22 bp, Homo sapiens
actgtacttttcttggctagat

SEQ ID NO: 8041054 - DNA, 22 bp, Homo sapiens
actgtataaggcataggtaagc

SEQ ID NO: 8041055 - DNA, 22 bp, Homo sapiens
actgtattggttttctattgct

SEQ ID NO: 8041056 - DNA, 22 bp, Homo sapiens
ataatgcatttagaataattca

SEQ ID NO: 8041057 - DNA, 22 bp, Homo sapiens
ataatgctgggagaaattgtta

SEQ ID NO: 8041058 - DNA, 22 bp, Homo sapiens
acttaacagacattatttacct

SEQ ID NO: 8041059 - DNA, 21 bp, Homo sapiens
acttaaattccttgatattta

SEQ ID NO: 8041060 - DNA, 22 bp, Homo sapiens
atacattagtgaacaaaagaga

SEQ ID NO: 8041061 - DNA, 22 bp, Homo sapiens
atacatgttgagaaaatatctg

SEQ ID NO: 8041062 - DNA, 22 bp, Homo sapiens
atacatgttgtaccatatgttt

SEQ ID NO: 8041063 - DNA, 22 bp, Homo sapiens
atacattattgttaaagaacat

SEQ ID NO: 8041064 - DNA, 22 bp, Homo sapiens
atactgtaatacctaaatgaac

SEQ ID NO: 8041065 - DNA, 22 bp, Homo sapiens
atactgtatcacttgtgagtga

SEQ ID NO: 8041066 - DNA, 22 bp, Homo sapiens
actttcctggccctgtcctctg

SEQ ID NO: 8041067 - DNA, 22 bp, Homo sapiens
actttcatttgtgaagactgta

SEQ ID NO: 8041068 - DNA, 22 bp, Homo sapiens
actttcatgctctgagcactgg

SEQ ID NO: 8041069 - DNA, 22 bp, Homo sapiens
actttcatggatctctgttcag

SEQ ID NO: 8041070 - DNA, 22 bp, Homo sapiens
atatggcaaaggggaattaagg

SEQ ID NO: 8041071 - DNA, 22 bp, Homo sapiens
atattccttttaaagagttaca

SEQ ID NO: 8041072 - DNA, 22 bp, Homo sapiens
atattcatcgtgtagaaatact

SEQ ID NO: 8041073 - DNA, 23 bp, Homo sapiens
agaaaagttcatacctttttaac

SEQ ID NO: 8041074 - DNA, 21 bp, Homo sapiens
atctcacagcccagagaagcc

SEQ ID NO: 8041075 - DNA, 22 bp, Homo sapiens
atctcaaagcatggagcagaat

SEQ ID NO: 8041076 - DNA, 22 bp, Homo sapiens
accctctgagaggcacactttg

SEQ ID NO: 8041077 - DNA, 19 bp, Homo sapiens
accctctgccacaagcctc

SEQ ID NO: 8041078 - DNA, 22 bp, Homo sapiens
acctggcataagggcttgagtc

SEQ ID NO: 8041079 - DNA, 22 bp, Homo sapiens
agtgcaatgtgtacagaaaaat

SEQ ID NO: 8041080 - DNA, 22 bp, Homo sapiens
agtctttaacatttggagattg

SEQ ID NO: 8041081 - DNA, 20 bp, Homo sapiens
actggacactgaggtgagct

SEQ ID NO: 8041082 - DNA, 22 bp, Homo sapiens
actggctttgcctctgcctctc

SEQ ID NO: 8041083 - DNA, 23 bp, Homo sapiens
agtgttggttgggaagccaagca

SEQ ID NO: 8041084 - DNA, 22 bp, Homo sapiens
agtgttgggtctttagaattta

SEQ ID NO: 8041085 - DNA, 22 bp, Homo sapiens
acatcacagagcccagataaag

SEQ ID NO: 8041086 - DNA, 22 bp, Homo sapiens
acatgccatcactttcattcct

SEQ ID NO: 8041087 - DNA, 22 bp, Homo sapiens
acatgccaatttggttagttca

SEQ ID NO: 8041088 - DNA, 22 bp, Homo sapiens
acatgttaaacatcatggaatg

SEQ ID NO: 8041089 - DNA, 22 bp, Homo sapiens
acatgttagaaatgcagaatct

SEQ ID NO: 8041090 - DNA, 22 bp, Homo sapiens
aggcctctgggtctcctctgac

SEQ ID NO: 8041091 - DNA, 22 bp, Homo sapiens
acattgcagatgtgtttaatgt

SEQ ID NO: 8041092 - DNA, 22 bp, Homo sapiens
acattgcaattaggtacctatg

SEQ ID NO: 8041093 - DNA, 22 bp, Homo sapiens
acattgatgtgatgcagaagtg

SEQ ID NO: 8041094 - DNA, 22 bp, Homo sapiens
acatttctagttgttcatctcc

SEQ ID NO: 8041095 - DNA, 18 bp, Homo sapiens
acatttctaggtgaaagc

SEQ ID NO: 8041096 - DNA, 22 bp, Homo sapiens
acatttctaatttaatgtaaca

SEQ ID NO: 8041097 - DNA, 22 bp, Homo sapiens
acattgtataatgattatcaca

SEQ ID NO: 8041098 - DNA, 18 bp, Homo sapiens
acatttctatgcttctgg

SEQ ID NO: 8041099 - DNA, 22 bp, Homo sapiens
acatttctcagggagttttgct

SEQ ID NO: 8041100 - DNA, 22 bp, Homo sapiens
acatttctttctattcagtagc

SEQ ID NO: 8041101 - DNA, 22 bp, Homo sapiens
acatttctttgctagacagcag

SEQ ID NO: 8041102 - DNA, 22 bp, Homo sapiens
acatttcttttcatctctatat

SEQ ID NO: 8041103 - DNA, 22 bp, Homo sapiens
acatttctcttgatgtctctat

SEQ ID NO: 8041104 - DNA, 22 bp, Homo sapiens
acatttctcttagagttggact

SEQ ID NO: 8041105 - DNA, 22 bp, Homo sapiens
acatttgactgtagatacttgc

SEQ ID NO: 8041106 - DNA, 22 bp, Homo sapiens
agggctgacagtgaggagtcaa

SEQ ID NO: 8041107 - DNA, 22 bp, Homo sapiens
agggagacacatgaggaagtca

SEQ ID NO: 8041108 - DNA, 22 bp, Homo sapiens
acagtcctgtacaggccatatc

SEQ ID NO: 8041109 - DNA, 18 bp, Homo sapiens
acagtaaagaaaggaatt

SEQ ID NO: 8041110 - DNA, 22 bp, Homo sapiens
acagtatatatagtctaaaagc

SEQ ID NO: 8041111 - DNA, 22 bp, Homo sapiens
acagttcccgtcttgcacagct

SEQ ID NO: 8041112 - DNA, 22 bp, Homo sapiens
aggatgaggctggcaggtcttg

SEQ ID NO: 8041113 - DNA, 22 bp, Homo sapiens
aggatgaggctggacacttctt

SEQ ID NO: 8041114 - DNA, 22 bp, Homo sapiens
aggatgagccgcgcaagctgac

SEQ ID NO: 8041115 - DNA, 22 bp, Homo sapiens
aggatgagattgctgtgttgta

SEQ ID NO: 8041116 - DNA, 22 bp, Homo sapiens
aggatgagattccagggtcaat

SEQ ID NO: 8041117 - DNA, 22 bp, Homo sapiens
aggatgagagatacatggagca

SEQ ID NO: 8041118 - DNA, 22 bp, Homo sapiens
acatagaacttcccagtgagca

SEQ ID NO: 8041119 - DNA, 20 bp, Homo sapiens
acatagatcagtgattgaca

SEQ ID NO: 8041120 - DNA, 22 bp, Homo sapiens
acaggaggggcatgaaagacgg

SEQ ID NO: 8041121 - DNA, 22 bp, Homo sapiens
aggaagaacagataatggacgc

SEQ ID NO: 8041122 - DNA, 22 bp, Homo sapiens
aggaagaacctaagaaagtctc

SEQ ID NO: 8041123 - DNA, 22 bp, Homo sapiens
catgggggtctggacaacaggc

SEQ ID NO: 8041124 - DNA, 22 bp, Homo sapiens
catgtacattctgtagatggag

SEQ ID NO: 8041125 - DNA, 22 bp, Homo sapiens
aggagaagtaaggctagatgat

SEQ ID NO: 8041126 - DNA, 22 bp, Homo sapiens
aggagaaggaagtgcatcacta

SEQ ID NO: 8041127 - DNA, 22 bp, Homo sapiens
aggacccacgcacaggaacccc

SEQ ID NO: 8041128 - DNA, 22 bp, Homo sapiens
cagtttctccaaacgcaggctg

SEQ ID NO: 8041129 - DNA, 22 bp, Homo sapiens
agctgtggaagactgtcagggt

SEQ ID NO: 8041130 - DNA, 22 bp, Homo sapiens
caggaggacatactggctcaca

SEQ ID NO: 8041131 - DNA, 22 bp, Homo sapiens
cccagggctgcagatggaggct

SEQ ID NO: 8041132 - DNA, 23 bp, Homo sapiens
cccaggagtttcactgcaaaggt

SEQ ID NO: 8041133 - DNA, 20 bp, Homo sapiens
cccaggagtttgctcttact

SEQ ID NO: 8041134 - DNA, 22 bp, Homo sapiens
cccaggagtttgagttcagcat

SEQ ID NO: 8041135 - DNA, 22 bp, Homo sapiens
cccaggaggtggagcttgcagt

SEQ ID NO: 8041136 - DNA, 22 bp, Homo sapiens
ccctcccaggagtggccagaga

SEQ ID NO: 8041137 - DNA, 22 bp, Homo sapiens
ccctctgcctgcgccctggtgt

SEQ ID NO: 8041138 - DNA, 18 bp, Homo sapiens
ccctcttgcacaaagcaa

SEQ ID NO: 8041139 - DNA, 22 bp, Homo sapiens
agggatgactcttggctgattc

SEQ ID NO: 8041140 - DNA, 22 bp, Homo sapiens
agggatgatggaaagaagcagg

SEQ ID NO: 8041141 - DNA, 22 bp, Homo sapiens
cctctgggcaggtagcagcagc

SEQ ID NO: 8041142 - DNA, 22 bp, Homo sapiens
cctcctggaggctctaagggag

SEQ ID NO: 8041143 - DNA, 22 bp, Homo sapiens
agggctctgttggggtcagcac

SEQ ID NO: 8041144 - DNA, 22 bp, Homo sapiens
agggctctgtccccagaggccc

SEQ ID NO: 8041145 - DNA, 22 bp, Homo sapiens
agggctctgtgactatcactgc

SEQ ID NO: 8041146 - DNA, 22 bp, Homo sapiens
agggctccaaggaagtgtagct

SEQ ID NO: 8041147 - DNA, 22 bp, Homo sapiens
agggccccatagtcactgcccg

SEQ ID NO: 8041148 - DNA, 22 bp, Homo sapiens
ccagcttttcttatcattataa

SEQ ID NO: 8041149 - DNA, 22 bp, Homo sapiens
ccagccctgccagagagagctg

SEQ ID NO: 8041150 - DNA, 22 bp, Homo sapiens
aggcaggggagctggaagggta

SEQ ID NO: 8041151 - DNA, 17 bp, Homo sapiens
aggctcctcctaaggtc

SEQ ID NO: 8041152 - DNA, 22 bp, Homo sapiens
atatcagtatctatgtatttgt

SEQ ID NO: 8041153 - DNA, 22 bp, Homo sapiens
atagtcagtgtctatatcgttg

SEQ ID NO: 8041154 - DNA, 22 bp, Homo sapiens
atctggaagccagatactcagt

SEQ ID NO: 8041155 - DNA, 17 bp, Homo sapiens
atctggaagctagctga

SEQ ID NO: 8041156 - DNA, 22 bp, Homo sapiens
atctggaacaaagcttaggaat

SEQ ID NO: 8041157 - DNA, 21 bp, Homo sapiens
atctggaagaactggtaagtg

SEQ ID NO: 8041158 - DNA, 22 bp, Homo sapiens
atctcataactcatttgaagac

SEQ ID NO: 8041159 - DNA, 22 bp, Homo sapiens
ctgtccagcttggctcctgggg

SEQ ID NO: 8041160 - DNA, 22 bp, Homo sapiens
ctgagaggcggaggttgcagtg

SEQ ID NO: 8041161 - DNA, 22 bp, Homo sapiens
agtttctagcctcactgtttag

SEQ ID NO: 8041162 - DNA, 22 bp, Homo sapiens
ctgccctgtatcttctcccaat

SEQ ID NO: 8041163 - DNA, 22 bp, Homo sapiens
ataagtgttaggtaaacatctt

SEQ ID NO: 8041164 - DNA, 22 bp, Homo sapiens
ctgcctgctgccctccagagcc

SEQ ID NO: 8041165 - DNA, 22 bp, Homo sapiens
ctgcctgcttaccatgcatcag

SEQ ID NO: 8041166 - DNA, 22 bp, Homo sapiens
ctgcctgctctatccaggcctg

SEQ ID NO: 8041167 - DNA, 20 bp, Homo sapiens
agttttcagcagaacaccca

SEQ ID NO: 8041168 - DNA, 22 bp, Homo sapiens
agttttgaaatgaaatgtagtt

SEQ ID NO: 8041169 - DNA, 22 bp, Homo sapiens
ctgccctgacctgcctcagagt

SEQ ID NO: 8041170 - DNA, 18 bp, Homo sapiens
ctgcccagagcacttgtg

SEQ ID NO: 8041171 - DNA, 17 bp, Homo sapiens
agttttgatataatggc

SEQ ID NO: 8041172 - DNA, 22 bp, Homo sapiens
ataatgtaaggctccctacagt

SEQ ID NO: 8041173 - DNA, 22 bp, Homo sapiens
ataatggtgaacaaaatgactc

SEQ ID NO: 8041174 - DNA, 21 bp, Homo sapiens
ataatgtacaaaaactgtctt

SEQ ID NO: 8041175 - DNA, 22 bp, Homo sapiens
ataatgtaggtatgtgtattta

SEQ ID NO: 8041176 - DNA, 22 bp, Homo sapiens
ataatgtaggctcctgggagaa

SEQ ID NO: 8041177 - DNA, 22 bp, Homo sapiens
ataatgtacaactgcttttaat

SEQ ID NO: 8041178 - DNA, 22 bp, Homo sapiens
ataatgtttttgtataagcatg

SEQ ID NO: 8041179 - DNA, 22 bp, Homo sapiens
ataatgtttgattgagcagata

SEQ ID NO: 8041180 - DNA, 22 bp, Homo sapiens
ataatgtgaagataatgcaaga

SEQ ID NO: 8041181 - DNA, 20 bp, Homo sapiens
atagtaatgaagtcttgttc

SEQ ID NO: 8041182 - DNA, 22 bp, Homo sapiens
atagacattataacacagagct

SEQ ID NO: 8041183 - DNA, 22 bp, Homo sapiens
ctctctgggcccagttggcacc

SEQ ID NO: 8041184 - DNA, 22 bp, Homo sapiens
ctctctccttagctgcagacca

SEQ ID NO: 8041185 - DNA, 22 bp, Homo sapiens
ctgagaggcggagcttgcagtg

SEQ ID NO: 8041186 - DNA, 22 bp, Homo sapiens
ctgagaaaggacctcaaacagg

SEQ ID NO: 8041187 - DNA, 22 bp, Homo sapiens
ctgaagcagatgtggctgagat

SEQ ID NO: 8041188 - DNA, 19 bp, Homo sapiens
ctcttaaattgtctcttgc

SEQ ID NO: 8041189 - DNA, 19 bp, Homo sapiens
ctcttacagaatagacaca

SEQ ID NO: 8041190 - DNA, 22 bp, Homo sapiens
agtgcacaccttagtacaaagt

SEQ ID NO: 8041191 - DNA, 22 bp, Homo sapiens
ctcccaggttccgacgcctctt

SEQ ID NO: 8041192 - DNA, 22 bp, Homo sapiens
agtctcttggcattctgaaaca

SEQ ID NO: 8041193 - DNA, 22 bp, Homo sapiens
aggtttctcctttaaagcatgg

SEQ ID NO: 8041194 - DNA, 22 bp, Homo sapiens
aggtttctactgtgttaagaaa

SEQ ID NO: 8041195 - DNA, 22 bp, Homo sapiens
agtaatgtcccttaaatgtggt

SEQ ID NO: 8041196 - DNA, 22 bp, Homo sapiens
agtaatgtgcctgaaatacttg

SEQ ID NO: 8041197 - DNA, 22 bp, Homo sapiens
agtaatcaatttttcggtggat

SEQ ID NO: 8041198 - DNA, 22 bp, Homo sapiens
ctacagaaaatcagccacaggc

SEQ ID NO: 8041199 - DNA, 22 bp, Homo sapiens
ctacaagatttttaaaactgta

SEQ ID NO: 8041200 - DNA, 23 bp, Homo sapiens
ctacaagagcaagcatggacaag

SEQ ID NO: 8041201 - DNA, 23 bp, Homo sapiens
agtcagagagtgtgagacaactg

SEQ ID NO: 8041202 - DNA, 22 bp, Homo sapiens
cgcgaggtggaggttgcagtga

SEQ ID NO: 8041203 - DNA, 22 bp, Homo sapiens
aggtgcacctgagggtgtcatc

SEQ ID NO: 8041204 - DNA, 17 bp, Homo sapiens
attccacagggaatctg

SEQ ID NO: 8041205 - DNA, 22 bp, Homo sapiens
attgcaaagcattgtgagcgca

SEQ ID NO: 8041206 - DNA, 22 bp, Homo sapiens
attgcaaaggtcccattcaaga

SEQ ID NO: 8041207 - DNA, 22 bp, Homo sapiens
attgcaaatgagtcttaatata

SEQ ID NO: 8041208 - DNA, 22 bp, Homo sapiens
gcagagattatgccatggaaag

SEQ ID NO: 8041209 - DNA, 22 bp, Homo sapiens
attatgtagctaaaaattgtgt

SEQ ID NO: 8041210 - DNA, 22 bp, Homo sapiens
gatgatgggatccagcaatgta

SEQ ID NO: 8041211 - DNA, 21 bp, Homo sapiens
gatgatggcaggcagcactgg

SEQ ID NO: 8041212 - DNA, 22 bp, Homo sapiens
gccctggttttagaggagcagg

SEQ ID NO: 8041213 - DNA, 22 bp, Homo sapiens
attgtacagatgaggtaagtga

SEQ ID NO: 8041214 - DNA, 22 bp, Homo sapiens
atttatcaccagttagctgact

SEQ ID NO: 8041215 - DNA, 22 bp, Homo sapiens
gctcccagggcagcgcagaaga

SEQ ID NO: 8041216 - DNA, 22 bp, Homo sapiens
gctcccaggcatggaggtaatt

SEQ ID NO: 8041217 - DNA, 22 bp, Homo sapiens
gctcccaggatgaggagccagg

SEQ ID NO: 8041218 - DNA, 22 bp, Homo sapiens
caaagactgcataacacatgaa

SEQ ID NO: 8041219 - DNA, 17 bp, Homo sapiens
gccttccttcctccaca

SEQ ID NO: 8041220 - DNA, 22 bp, Homo sapiens
attttgaatcaccttggaagaa

SEQ ID NO: 8041221 - DNA, 22 bp, Homo sapiens
gctcagagaaaactggggcttg

SEQ ID NO: 8041222 - DNA, 22 bp, Homo sapiens
gctcagagaaattataggaatt

SEQ ID NO: 8041223 - DNA, 22 bp, Homo sapiens
gctcagacttgttttacaggct

SEQ ID NO: 8041224 - DNA, 19 bp, Homo sapiens
gctcagagacacctgttgc

SEQ ID NO: 8041225 - DNA, 22 bp, Homo sapiens
gctcagagaatttactgctgcc

SEQ ID NO: 8041226 - DNA, 22 bp, Homo sapiens
gctcagagaagttaaggaattt

SEQ ID NO: 8041227 - DNA, 22 bp, Homo sapiens
gccttccttacacctgctcagc

SEQ ID NO: 8041228 - DNA, 22 bp, Homo sapiens
attttcatgactaccttaaata

SEQ ID NO: 8041229 - DNA, 22 bp, Homo sapiens
attttcattttgcagggtgaga

SEQ ID NO: 8041230 - DNA, 22 bp, Homo sapiens
atttggaatgtgtttgatcacc

SEQ ID NO: 8041231 - DNA, 23 bp, Homo sapiens
atgagcatttttaatttctgtgg

SEQ ID NO: 8041232 - DNA, 22 bp, Homo sapiens
atgatggaggccgtgatggacg

SEQ ID NO: 8041233 - DNA, 22 bp, Homo sapiens
atgatggaggtgtcctggattt

SEQ ID NO: 8041234 - DNA, 22 bp, Homo sapiens
atgatgtactagttaaatatta

SEQ ID NO: 8041235 - DNA, 22 bp, Homo sapiens
atgatgtaccactttctcagtt

SEQ ID NO: 8041236 - DNA, 22 bp, Homo sapiens
atgatgtagacaaaaatatgct

SEQ ID NO: 8041237 - DNA, 22 bp, Homo sapiens
atgatgtaacataaagatgtct

SEQ ID NO: 8041238 - DNA, 22 bp, Homo sapiens
atgatgtaagggtaattgtcta

SEQ ID NO: 8041239 - DNA, 22 bp, Homo sapiens
atgatgtaatggaaagaacaga

SEQ ID NO: 8041240 - DNA, 22 bp, Homo sapiens
gaagctccgtactatgactttt

SEQ ID NO: 8041241 - DNA, 22 bp, Homo sapiens
atctggaatccttgtggacaat

SEQ ID NO: 8041242 - DNA, 22 bp, Homo sapiens
ctttacttcagcaagctttcct

SEQ ID NO: 8041243 - DNA, 22 bp, Homo sapiens
atgagatgtgtctaatggaacc

SEQ ID NO: 8041244 - DNA, 22 bp, Homo sapiens
cttttgttgcccttgtcgcagg

SEQ ID NO: 8041245 - DNA, 22 bp, Homo sapiens
atgacagaggattgtaaagagg

SEQ ID NO: 8041246 - DNA, 22 bp, Homo sapiens
atgacagaccctctaaagacaa

SEQ ID NO: 8041247 - DNA, 22 bp, Homo sapiens
atgacaatggacatagttaaaa

SEQ ID NO: 8041248 - DNA, 22 bp, Homo sapiens
atgacactgtcctagtaaggaa

SEQ ID NO: 8041249 - DNA, 22 bp, Homo sapiens
gaggcacagtcccgaggcaagg

SEQ ID NO: 8041250 - DNA, 22 bp, Homo sapiens
atgtggatttgggagtgatcag

SEQ ID NO: 8041251 - DNA, 22 bp, Homo sapiens
gagaatattagagttagtttat

SEQ ID NO: 8041252 - DNA, 22 bp, Homo sapiens
atggattggatttttatggacc

SEQ ID NO: 8041253 - DNA, 22 bp, Homo sapiens
atggatgaaggcgaggatgagg

SEQ ID NO: 8041254 - DNA, 22 bp, Homo sapiens
atggatgagtccttgagacaca

SEQ ID NO: 8041255 - DNA, 22 bp, Homo sapiens
gagcacagctggaggtagcatt

SEQ ID NO: 8041256 - DNA, 22 bp, Homo sapiens
gagcacaggctgctgtgaactg

SEQ ID NO: 8041257 - DNA, 22 bp, Homo sapiens
atggcagacctgggctggagaa

SEQ ID NO: 8041258 - DNA, 22 bp, Homo sapiens
cagaaaatagagtttctctgag

SEQ ID NO: 8041259 - DNA, 22 bp, Homo sapiens
cagaaaataaagtttctacgca

SEQ ID NO: 8041260 - DNA, 22 bp, Homo sapiens
gggatgagagctgggacagaag

SEQ ID NO: 8041261 - DNA, 22 bp, Homo sapiens
cagagacaacctggtagagaaa

SEQ ID NO: 8041262 - DNA, 22 bp, Homo sapiens
cagagacacttaacaggaatgg

SEQ ID NO: 8041263 - DNA, 22 bp, Homo sapiens
gggtaaatctcttttcatggct

SEQ ID NO: 8041264 - DNA, 22 bp, Homo sapiens
cagccctgtccagcagagggtg

SEQ ID NO: 8041265 - DNA, 22 bp, Homo sapiens
cagccctgtccaatgtctgctc

SEQ ID NO: 8041266 - DNA, 19 bp, Homo sapiens
cagccctcttaccactgtg

SEQ ID NO: 8041267 - DNA, 22 bp, Homo sapiens
gtgagcaatgttatcaggttga

SEQ ID NO: 8041268 - DNA, 22 bp, Homo sapiens
gtgagagggctgggctcatgat

SEQ ID NO: 8041269 - DNA, 22 bp, Homo sapiens
cagccaggatggagaactgttg

SEQ ID NO: 8041270 - DNA, 22 bp, Homo sapiens
gtcacaggcctggatgaggggc

SEQ ID NO: 8041271 - DNA, 22 bp, Homo sapiens
gtcacaggcagtaactaggacc

SEQ ID NO: 8041272 - DNA, 22 bp, Homo sapiens
gtagaaatatttatctctgaga

SEQ ID NO: 8041273 - DNA, 22 bp, Homo sapiens
gtagaaaaagcagtaagtctca

SEQ ID NO: 8041274 - DNA, 22 bp, Homo sapiens
caagaatataaatactttcaaa

SEQ ID NO: 8041275 - DNA, 22 bp, Homo sapiens
caatcacaaagagacaagtgtc

SEQ ID NO: 8041276 - DNA, 22 bp, Homo sapiens
caatttcaatacaaaatacatt

SEQ ID NO: 8041277 - DNA, 22 bp, Homo sapiens
caatatagagagaaaattatgt

SEQ ID NO: 8041278 - DNA, 22 bp, Homo sapiens
caatatataatgagtactttcc

SEQ ID NO: 8041279 - DNA, 22 bp, Homo sapiens
caatagaaaactcaatacttaa

SEQ ID NO: 8041280 - DNA, 22 bp, Homo sapiens
ggcaaggggtcaggctgagaca

SEQ ID NO: 8041281 - DNA, 22 bp, Homo sapiens
cacatgttcttgaagccaactc

SEQ ID NO: 8041282 - DNA, 22 bp, Homo sapiens
cactgcactccagcctgggtga

SEQ ID NO: 8041283 - DNA, 22 bp, Homo sapiens
cactgcactccagcctgggtca

SEQ ID NO: 8041284 - DNA, 22 bp, Homo sapiens
cactgtacccatttaaataaat

SEQ ID NO: 8041285 - DNA, 22 bp, Homo sapiens
cactgtacagcattaacaaggc

SEQ ID NO: 8041286 - DNA, 22 bp, Homo sapiens
cactgtactgtgaataaggagg

SEQ ID NO: 8041287 - DNA, 22 bp, Homo sapiens
cactgtactgggttgaaggacg

SEQ ID NO: 8041288 - DNA, 21 bp, Homo sapiens
cactccacttagaacagggtt

SEQ ID NO: 8041289 - DNA, 22 bp, Homo sapiens
cactgcactccagcctgggaga

SEQ ID NO: 8041290 - DNA, 22 bp, Homo sapiens
tagcgttttgtaatcaagtatg

SEQ ID NO: 8041291 - DNA, 22 bp, Homo sapiens
cagccctgtctatgactgatga

SEQ ID NO: 8041292 - DNA, 20 bp, Homo sapiens
cagccctgtgacctggccct

SEQ ID NO: 8041293 - DNA, 19 bp, Homo sapiens
tagaatagttacacagatt

SEQ ID NO: 8041294 - DNA, 22 bp, Homo sapiens
caggctggagtgcaatggcaca

SEQ ID NO: 8041295 - DNA, 22 bp, Homo sapiens
caggctggagtgcaatgacgcc

SEQ ID NO: 8041296 - DNA, 22 bp, Homo sapiens
tagggtagtaccatgctgccag

SEQ ID NO: 8041297 - DNA, 22 bp, Homo sapiens
tatcagtgtggtttctggactg

SEQ ID NO: 8041298 - DNA, 22 bp, Homo sapiens
tatcatgtccctaaagagagga

SEQ ID NO: 8041299 - DNA, 22 bp, Homo sapiens
tatcatgtctggagatactttt

SEQ ID NO: 8041300 - DNA, 22 bp, Homo sapiens
cagggctcagggactgcagaaa

SEQ ID NO: 8041301 - DNA, 21 bp, Homo sapiens
tcagctttgcaactgcacatc

SEQ ID NO: 8041302 - DNA, 22 bp, Homo sapiens
cagtttatatataagcacattg

SEQ ID NO: 8041303 - DNA, 22 bp, Homo sapiens
cagtttatagctctagcagctt

SEQ ID NO: 8041304 - DNA, 22 bp, Homo sapiens
cataaagttaagctgtaagtat

SEQ ID NO: 8041305 - DNA, 22 bp, Homo sapiens
tcagagaaataattgctgagtt

SEQ ID NO: 8041306 - DNA, 22 bp, Homo sapiens
tcagagaaatgctgagctcatg

SEQ ID NO: 8041307 - DNA, 22 bp, Homo sapiens
tcagagaacacagaggtgatgt

SEQ ID NO: 8041308 - DNA, 22 bp, Homo sapiens
cagtgggggggccatgctgcag

SEQ ID NO: 8041309 - DNA, 22 bp, Homo sapiens
tatttgaaagtgtacaaaaact

SEQ ID NO: 8041310 - DNA, 22 bp, Homo sapiens
caggttggtcggcaagtacaca

SEQ ID NO: 8041311 - DNA, 22 bp, Homo sapiens
caggttggggacttaggatgac

SEQ ID NO: 8041312 - DNA, 22 bp, Homo sapiens
caggttggtattcatctccaca

SEQ ID NO: 8041313 - DNA, 21 bp, Homo sapiens
tcctctgcagtgaggtggcct

SEQ ID NO: 8041314 - DNA, 22 bp, Homo sapiens
tcctctccatgtctcacgccac

SEQ ID NO: 8041315 - DNA, 22 bp, Homo sapiens
tctccacaccagaaggagctga

SEQ ID NO: 8041316 - DNA, 22 bp, Homo sapiens
ccagcccttagataaacctggc

SEQ ID NO: 8041317 - DNA, 22 bp, Homo sapiens
ccagccctgtcaccaactggag

SEQ ID NO: 8041318 - DNA, 19 bp, Homo sapiens
tctctgcagcgcgcccggc

SEQ ID NO: 8041319 - DNA, 22 bp, Homo sapiens
tcccagccaggctctaccactt

SEQ ID NO: 8041320 - DNA, 22 bp, Homo sapiens
tcccagccacagtttccacctg

SEQ ID NO: 8041321 - DNA, 22 bp, Homo sapiens
cattcatttatgaaatatctat

SEQ ID NO: 8041322 - DNA, 22 bp, Homo sapiens
cattcattcagcaactgttatt

SEQ ID NO: 8041323 - DNA, 22 bp, Homo sapiens
cattcattcacattttgtctat

SEQ ID NO: 8041324 - DNA, 22 bp, Homo sapiens
cattcattctgtaagtaactat

SEQ ID NO: 8041325 - DNA, 22 bp, Homo sapiens
cattcatttactttcaacagct

SEQ ID NO: 8041326 - DNA, 22 bp, Homo sapiens
cattcattagaatagatatgta

SEQ ID NO: 8041327 - DNA, 22 bp, Homo sapiens
cattcattacactcataaggtt

SEQ ID NO: 8041328 - DNA, 22 bp, Homo sapiens
cattgcacatctgagaagagat

SEQ ID NO: 8041329 - DNA, 22 bp, Homo sapiens
tccctagtcgcatctgtggaga

SEQ ID NO: 8041330 - DNA, 22 bp, Homo sapiens
tcctcagcttttatttcacttg

SEQ ID NO: 8041331 - DNA, 22 bp, Homo sapiens
catttgtacagaacagctttat

SEQ ID NO: 8041332 - DNA, 22 bp, Homo sapiens
tccaggctccctcaggatgcac

SEQ ID NO: 8041333 - DNA, 22 bp, Homo sapiens
tccaggctcccctgcgtgctcc

SEQ ID NO: 8041334 - DNA, 22 bp, Homo sapiens
tcattcatctggtgttagtcct

SEQ ID NO: 8041335 - DNA, 22 bp, Homo sapiens
catgaaaaatttactgttaaca

SEQ ID NO: 8041336 - DNA, 22 bp, Homo sapiens
tccacatagtcattaatttctg

SEQ ID NO: 8041337 - DNA, 22 bp, Homo sapiens
ccctgcctctgaagctgctcag

SEQ ID NO: 8041338 - DNA, 22 bp, Homo sapiens
ccctgccttggggtccacaccg

SEQ ID NO: 8041339 - DNA, 22 bp, Homo sapiens
tgcctgcctctggcagccctgc

SEQ ID NO: 8041340 - DNA, 22 bp, Homo sapiens
tggaaagacattcagccgctgg

SEQ ID NO: 8041341 - DNA, 22 bp, Homo sapiens
cctaaatagagtcagatgtaat

SEQ ID NO: 8041342 - DNA, 21 bp, Homo sapiens
cctcaaagatgatggggtttc

SEQ ID NO: 8041343 - DNA, 22 bp, Homo sapiens
tggctcagcgcggcctggtctt

SEQ ID NO: 8041344 - DNA, 22 bp, Homo sapiens
cctccccatgacccggtgctgg

SEQ ID NO: 8041345 - DNA, 22 bp, Homo sapiens
cctcagctcccatgagatctgc

SEQ ID NO: 8041346 - DNA, 22 bp, Homo sapiens
cctcagctgcttccctggagcc

SEQ ID NO: 8041347 - DNA, 22 bp, Homo sapiens
tggcctcccctaacagcctctt

SEQ ID NO: 8041348 - DNA, 22 bp, Homo sapiens
tggcctcccctaacagcctctt

SEQ ID NO: 8041349 - DNA, 22 bp, Homo sapiens
cctgcctgtactagagacccag

SEQ ID NO: 8041350 - DNA, 22 bp, Homo sapiens
cctgctgctatgaaggtgacag

SEQ ID NO: 8041351 - DNA, 22 bp, Homo sapiens
cctgccttcagccctgaagtct

SEQ ID NO: 8041352 - DNA, 22 bp, Homo sapiens
cctggagcactctccctggctg

SEQ ID NO: 8041353 - DNA, 22 bp, Homo sapiens
tgtaatttcctgatgttagaac

SEQ ID NO: 8041354 - DNA, 22 bp, Homo sapiens
tgtaatttgcatggctgaatgc

SEQ ID NO: 8041355 - DNA, 22 bp, Homo sapiens
cctggaaaacatgggaatcaca

SEQ ID NO: 8041356 - DNA, 22 bp, Homo sapiens
tgtaagtagtaatggaaggaca

SEQ ID NO: 8041357 - DNA, 22 bp, Homo sapiens
tgtaatatatataactgtgtgc

SEQ ID NO: 8041358 - DNA, 22 bp, Homo sapiens
cctgacctatttttctcagctg

SEQ ID NO: 8041359 - DNA, 22 bp, Homo sapiens
cctctggcaacttcacagccca

SEQ ID NO: 8041360 - DNA, 22 bp, Homo sapiens
tgaaggagaaatggaaagtggg

SEQ ID NO: 8041361 - DNA, 22 bp, Homo sapiens
tgaacagatggcccagcagagg

SEQ ID NO: 8041362 - DNA, 22 bp, Homo sapiens
tgaacagatcaatagaactgac

SEQ ID NO: 8041363 - DNA, 22 bp, Homo sapiens
ccagcctcactggcatcaccta

SEQ ID NO: 8041364 - DNA, 22 bp, Homo sapiens
ccagcccttgctgaagggtggc

SEQ ID NO: 8041365 - DNA, 22 bp, Homo sapiens
ccaggtcctgttttcaccacag

SEQ ID NO: 8041366 - DNA, 22 bp, Homo sapiens
tgaccaggatactgcagggatg

SEQ ID NO: 8041367 - DNA, 22 bp, Homo sapiens
cccaggaggcagaagttgcagt

SEQ ID NO: 8041368 - DNA, 22 bp, Homo sapiens
cccaggaggaggaaaaagctcg

SEQ ID NO: 8041369 - DNA, 22 bp, Homo sapiens
cccaggaggcagagcttgcagt

SEQ ID NO: 8041370 - DNA, 22 bp, Homo sapiens
cccaggaggcagatgttgcagt

SEQ ID NO: 8041371 - DNA, 22 bp, Homo sapiens
cccaggagacagaaacagaggt

SEQ ID NO: 8041372 - DNA, 22 bp, Homo sapiens
tgcatatatcttatttttctgt

SEQ ID NO: 8041373 - DNA, 22 bp, Homo sapiens
cccaggagataacgttcccaag

SEQ ID NO: 8041374 - DNA, 21 bp, Homo sapiens
cccaggaggctgagaagagca

SEQ ID NO: 8041375 - DNA, 22 bp, Homo sapiens
tgccctcagaattgctccctgc

SEQ ID NO: 8041376 - DNA, 22 bp, Homo sapiens
tgccctcagccacctccaagtt

SEQ ID NO: 8041377 - DNA, 22 bp, Homo sapiens
tgccctcagcagcagctcctgc

SEQ ID NO: 8041378 - DNA, 22 bp, Homo sapiens
tgccctccacagtggctccacc

SEQ ID NO: 8041379 - DNA, 22 bp, Homo sapiens
tgccctcccacattatggctgt

SEQ ID NO: 8041380 - DNA, 23 bp, Homo sapiens
tgccctcccaatgcttcggtcac

SEQ ID NO: 8041381 - DNA, 22 bp, Homo sapiens
cccaggaggttggggctacagt

SEQ ID NO: 8041382 - DNA, 21 bp, Homo sapiens
cccaggagtcctatttaaatg

SEQ ID NO: 8041383 - DNA, 20 bp, Homo sapiens
cccaggagtgagcagcttta

SEQ ID NO: 8041384 - DNA, 22 bp, Homo sapiens
tgcctcagtctaaagtctctca

SEQ ID NO: 8041385 - DNA, 22 bp, Homo sapiens
cccagcccatctcaaaggtcta

SEQ ID NO: 8041386 - DNA, 20 bp, Homo sapiens
cccagcccctacctgttgcc

SEQ ID NO: 8041387 - DNA, 22 bp, Homo sapiens
cccagcccacggtcctgggtgg

SEQ ID NO: 8041388 - DNA, 22 bp, Homo sapiens
cccaggagaatataatgttctt

SEQ ID NO: 8041389 - DNA, 21 bp, Homo sapiens
cccaggagaagaaaagatgca

SEQ ID NO: 8041390 - DNA, 22 bp, Homo sapiens
tgatgagggggaacagagattt

SEQ ID NO: 8041391 - DNA, 21 bp, Homo sapiens
tgatgaggtcatagcaccctc

SEQ ID NO: 8041392 - DNA, 22 bp, Homo sapiens
tgatgaggggctcagaggtcag

SEQ ID NO: 8041393 - DNA, 22 bp, Homo sapiens
tgatgagggagatttgagccca

SEQ ID NO: 8041394 - DNA, 22 bp, Homo sapiens
tgatgagggcagttcttgttgc

SEQ ID NO: 8041395 - DNA, 22 bp, Homo sapiens
tgatgaggagactgtggcttgg

SEQ ID NO: 8041396 - DNA, 22 bp, Homo sapiens
tgatgaggacctggtctctgct

SEQ ID NO: 8041397 - DNA, 22 bp, Homo sapiens
tgatgaggcatatgctacacat

SEQ ID NO: 8041398 - DNA, 22 bp, Homo sapiens
tgatgaggcttcttggtgaaca

SEQ ID NO: 8041399 - DNA, 22 bp, Homo sapiens
tgatgagggaactggttcatac

SEQ ID NO: 8041400 - DNA, 22 bp, Homo sapiens
tgatgaggacccatcacctggt

SEQ ID NO: 8041401 - DNA, 18 bp, Homo sapiens
tgaggcagtcagtgatgg

SEQ ID NO: 8041402 - DNA, 22 bp, Homo sapiens
cccacaggccctgctgccttga

SEQ ID NO: 8041403 - DNA, 22 bp, Homo sapiens
cggaggttgaggctgcagtgag

SEQ ID NO: 8041404 - DNA, 22 bp, Homo sapiens
cctttttccctggagggacagc

SEQ ID NO: 8041405 - DNA, 22 bp, Homo sapiens
ccttttctgaaccacttaaata

SEQ ID NO: 8041406 - DNA, 22 bp, Homo sapiens
ccttttctaatcttaagaatgt

SEQ ID NO: 8041407 - DNA, 22 bp, Homo sapiens
ttatttattcattctgtctgtc

SEQ ID NO: 8041408 - DNA, 22 bp, Homo sapiens
ttacataactttaaaatgccgt

SEQ ID NO: 8041409 - DNA, 22 bp, Homo sapiens
ttacataacggtatgaaaaatg

SEQ ID NO: 8041410 - DNA, 22 bp, Homo sapiens
ttaagatagaacccagtagtct

SEQ ID NO: 8041411 - DNA, 22 bp, Homo sapiens
ttaaattccagcctcataatag

SEQ ID NO: 8041412 - DNA, 22 bp, Homo sapiens
ccttaaattctccatttgaaag

SEQ ID NO: 8041413 - DNA, 22 bp, Homo sapiens
ctccaggaccagggctcctgga

SEQ ID NO: 8041414 - DNA, 22 bp, Homo sapiens
ctccaggacccagtggctccag

SEQ ID NO: 8041415 - DNA, 22 bp, Homo sapiens
ctccaggactcaggcccctggg

SEQ ID NO: 8041416 - DNA, 20 bp, Homo sapiens
ttggaaggtggagaagagga

SEQ ID NO: 8041417 - DNA, 22 bp, Homo sapiens
ttggaaggccctgcctagcagg

SEQ ID NO: 8041418 - DNA, 19 bp, Homo sapiens
ctcagtctggctctgcctg

SEQ ID NO: 8041419 - DNA, 19 bp, Homo sapiens
ttggaaggagccagagtgg

SEQ ID NO: 8041420 - DNA, 22 bp, Homo sapiens
ttggaaggatttagagatgtct

SEQ ID NO: 8041421 - DNA, 22 bp, Homo sapiens
ctcagaggcaagcaaggagctg

SEQ ID NO: 8041422 - DNA, 22 bp, Homo sapiens
ctcagccccaatttgccctctt

SEQ ID NO: 8041423 - DNA, 22 bp, Homo sapiens
ctcaggagatgacagaaggtat

SEQ ID NO: 8041424 - DNA, 22 bp, Homo sapiens
ctcaggaggtggtagaggccct

SEQ ID NO: 8041425 - DNA, 22 bp, Homo sapiens
ctcagggatggtgaagcaccca

SEQ ID NO: 8041426 - DNA, 22 bp, Homo sapiens
ttgccctgaagaacgtcccaga

SEQ ID NO: 8041427 - DNA, 22 bp, Homo sapiens
ttgccctgcgggtcctgcgcaa

SEQ ID NO: 8041428 - DNA, 22 bp, Homo sapiens
ttgccctgcgttaccatctctt

SEQ ID NO: 8041429 - DNA, 22 bp, Homo sapiens
ctcagagccagttagcaggtgc

SEQ ID NO: 8041430 - DNA, 21 bp, Homo sapiens
ctcagagcagttcagagggat

SEQ ID NO: 8041431 - DNA, 17 bp, Homo sapiens
ctcagagcaggacagaa

SEQ ID NO: 8041432 - DNA, 22 bp, Homo sapiens
ctcagagctgaggccagggaca

SEQ ID NO: 8041433 - DNA, 22 bp, Homo sapiens
ctcactcagacatccagtgcag

SEQ ID NO: 8041434 - DNA, 22 bp, Homo sapiens
ctcaccccactaccccttggtg

SEQ ID NO: 8041435 - DNA, 22 bp, Homo sapiens
ctccaggactgaggacagagct

SEQ ID NO: 8041436 - DNA, 22 bp, Homo sapiens
ctccaggccatggctgcggagg

SEQ ID NO: 8041437 - DNA, 22 bp, Homo sapiens
tttctacatgtcaatccaaacc

SEQ ID NO: 8041438 - DNA, 22 bp, Homo sapiens
tttctcaagtactgcacatgaa

SEQ ID NO: 8041439 - DNA, 22 bp, Homo sapiens
tttctacaggttgatgggtttg

SEQ ID NO: 8041440 - DNA, 22 bp, Homo sapiens
tttctacagtactgatttcata

SEQ ID NO: 8041441 - DNA, 21 bp, Homo sapiens
tttgttcaggggcaaagttaa

SEQ ID NO: 8041442 - DNA, 22 bp, Homo sapiens
tttggaagtcctgaaatagagg

SEQ ID NO: 8041443 - DNA, 22 bp, Homo sapiens
tttgcaaaattattcccagcat

SEQ ID NO: 8041444 - DNA, 22 bp, Homo sapiens
tttgcaaaatgaggtgaagagt

SEQ ID NO: 8041445 - DNA, 22 bp, Homo sapiens
tttgagaagataggggaatact

SEQ ID NO: 8041446 - DNA, 22 bp, Homo sapiens
tttgcaaaccggagctctgcaa

SEQ ID NO: 8041447 - DNA, 22 bp, Homo sapiens
tttgcaaacacttaagaagaga

SEQ ID NO: 8041448 - DNA, 20 bp, Homo sapiens
ctctggcaaaggatgcctat

SEQ ID NO: 8041449 - DNA, 22 bp, Homo sapiens
tttgcaaagtgactattatatg

SEQ ID NO: 8041450 - DNA, 18 bp, Homo sapiens
tttgcaaaggaagtatgg

SEQ ID NO: 8041451 - DNA, 22 bp, Homo sapiens
tttgcaaagtccattgaagtta

SEQ ID NO: 8041452 - DNA, 22 bp, Homo sapiens
tttgcaaactttcctctggacc

SEQ ID NO: 8041453 - DNA, 22 bp, Homo sapiens
tttgaaagaaaccagtgagtga

SEQ ID NO: 8041454 - DNA, 21 bp, Homo sapiens
tttgaatagaaatagtgctta

SEQ ID NO: 8041455 - DNA, 22 bp, Homo sapiens
ctggaagggtcagagtgatgag

SEQ ID NO: 8041456 - DNA, 22 bp, Homo sapiens
ctggaagggtctacttagcaga

SEQ ID NO: 8041457 - DNA, 22 bp, Homo sapiens
ctggaaggtaacaaggccatta

SEQ ID NO: 8041458 - DNA, 22 bp, Homo sapiens
ctggaagggaaatctcttggca

SEQ ID NO: 8041459 - DNA, 19 bp, Homo sapiens
ctggaaggagggactgttc

SEQ ID NO: 8041460 - DNA, 22 bp, Homo sapiens
ctggaaggagaaggaggctgtg

SEQ ID NO: 8041461 - DNA, 22 bp, Homo sapiens
ctggagcctgcagttttcactt

SEQ ID NO: 8041462 - DNA, 22 bp, Homo sapiens
ctggagagttggaagatggact

SEQ ID NO: 8041463 - DNA, 22 bp, Homo sapiens
ctgccttctttcaagggtaagc

SEQ ID NO: 8041464 - DNA, 19 bp, Homo sapiens
ctgagcagcggcagcactt

SEQ ID NO: 8041465 - DNA, 22 bp, Homo sapiens
ctgagcagtggttcttgagcgc

SEQ ID NO: 8041466 - DNA, 22 bp, Homo sapiens
ctgcaggacgaccgcctcatct

SEQ ID NO: 8041467 - DNA, 22 bp, Homo sapiens
ctgcaggagcaaagcctctgct

SEQ ID NO: 8041468 - DNA, 20 bp, Homo sapiens
ctgcccagccactgagggat

SEQ ID NO: 8041469 - DNA, 22 bp, Homo sapiens
ctgcccagattttaccacctgc

SEQ ID NO: 8041470 - DNA, 22 bp, Homo sapiens
ctgcccagtttgggagcctttc

SEQ ID NO: 8041471 - DNA, 22 bp, Homo sapiens
ctgcccaggctgaaggaacatc

SEQ ID NO: 8041472 - DNA, 22 bp, Homo sapiens
cttgcctccctcagctcacagc

SEQ ID NO: 8041473 - DNA, 22 bp, Homo sapiens
ctttcctctggcactgtctggt

SEQ ID NO: 8041474 - DNA, 22 bp, Homo sapiens
cttccctgataagagcctcaga

SEQ ID NO: 8041475 - DNA, 22 bp, Homo sapiens
cttcttcaagagaatgggagac

SEQ ID NO: 8041476 - DNA, 22 bp, Homo sapiens
gaaacttcttgtctcacagttc

SEQ ID NO: 8041477 - DNA, 22 bp, Homo sapiens
gaaagaagctttagatggctat

SEQ ID NO: 8041478 - DNA, 22 bp, Homo sapiens
gaaaaagtgaccttggtagcta

SEQ ID NO: 8041479 - DNA, 22 bp, Homo sapiens
ctttttgttgtataagcccttt

SEQ ID NO: 8041480 - DNA, 22 bp, Homo sapiens
gaagaactgtgacagaagcagt

SEQ ID NO: 8041481 - DNA, 22 bp, Homo sapiens
gaaagacttcctttgagagtac

SEQ ID NO: 8041482 - DNA, 22 bp, Homo sapiens
ctgggctcagtggctcatggct

SEQ ID NO: 8041483 - DNA, 22 bp, Homo sapiens
ctgggcctccacgggccatcac

SEQ ID NO: 8041484 - DNA, 22 bp, Homo sapiens
ctgggctcctaaccatccaggt

SEQ ID NO: 8041485 - DNA, 22 bp, Homo sapiens
ctgggttttattacagtgagct

SEQ ID NO: 8041486 - DNA, 22 bp, Homo sapiens
ctgggtttagggtctccccttg

SEQ ID NO: 8041487 - DNA, 22 bp, Homo sapiens
ctgtgacagagcttgagtgaga

SEQ ID NO: 8041488 - DNA, 22 bp, Homo sapiens
ctgtgacagtttctcagacttt

SEQ ID NO: 8041489 - DNA, 22 bp, Homo sapiens
ctgtgacagtttctcagaattt

SEQ ID NO: 8041490 - DNA, 22 bp, Homo sapiens
gaggatggaggtgtgagctatg

SEQ ID NO: 8041491 - DNA, 22 bp, Homo sapiens
gaggactctgggcgtgtatggg

SEQ ID NO: 8041492 - DNA, 18 bp, Homo sapiens
gaggatggaaggagatgc

SEQ ID NO: 8041493 - DNA, 22 bp, Homo sapiens
gagggaatggtgtgcaagaggt

SEQ ID NO: 8041494 - DNA, 19 bp, Homo sapiens
gagtacaggtgcagaaatg

SEQ ID NO: 8041495 - DNA, 22 bp, Homo sapiens
gagagacagcagaacgtgcagc

SEQ ID NO: 8041496 - DNA, 22 bp, Homo sapiens
gagagaatgtacatgctagggg

SEQ ID NO: 8041497 - DNA, 18 bp, Homo sapiens
gagagcccagcaggtggt

SEQ ID NO: 8041498 - DNA, 22 bp, Homo sapiens
gagaacaggctctggagtcaga

SEQ ID NO: 8041499 - DNA, 23 bp, Homo sapiens
gagcagagcgggcgggggtcctg

SEQ ID NO: 8041500 - DNA, 22 bp, Homo sapiens
gagaggcagaggcctgaaaccg

SEQ ID NO: 8041501 - DNA, 22 bp, Homo sapiens
gagcacagaactaaatgctggt

SEQ ID NO: 8041502 - DNA, 22 bp, Homo sapiens
gagcacagatcctggagccaca

SEQ ID NO: 8041503 - DNA, 22 bp, Homo sapiens
gaatgcatgtgaagcaaagaat

SEQ ID NO: 8041504 - DNA, 22 bp, Homo sapiens
gaatgtaagtgggcagaagaca

SEQ ID NO: 8041505 - DNA, 18 bp, Homo sapiens
gacaaaagtacagacaga

SEQ ID NO: 8041506 - DNA, 22 bp, Homo sapiens
gacaaaagtgttttgaacaagg

SEQ ID NO: 8041507 - DNA, 22 bp, Homo sapiens
gacagtctgggcacacatgaaa

SEQ ID NO: 8041508 - DNA, 22 bp, Homo sapiens
gacctgcctgagctgcctctgc

SEQ ID NO: 8041509 - DNA, 22 bp, Homo sapiens
tagtgcatacctaacatttttg

SEQ ID NO: 8041510 - DNA, 22 bp, Homo sapiens
tagttacaaaccaacaggcagc

SEQ ID NO: 8041511 - DNA, 22 bp, Homo sapiens
tagttacaatgggttctgtgac

SEQ ID NO: 8041512 - DNA, 22 bp, Homo sapiens
tagttacaattatgcatggaaa

SEQ ID NO: 8041513 - DNA, 22 bp, Homo sapiens
tagttacataaagtggactgtt

SEQ ID NO: 8041514 - DNA, 22 bp, Homo sapiens
tagatatgatgagtcacttgag

SEQ ID NO: 8041515 - DNA, 22 bp, Homo sapiens
tcaaagggtaatgtaatagtct

SEQ ID NO: 8041516 - DNA, 22 bp, Homo sapiens
tcaaagggtccttaacatgaga

SEQ ID NO: 8041517 - DNA, 22 bp, Homo sapiens
tcaaagggtagcccagggaaga

SEQ ID NO: 8041518 - DNA, 22 bp, Homo sapiens
tcaaataggcttgtagtgactg

SEQ ID NO: 8041519 - DNA, 22 bp, Homo sapiens
tcaaagaagtgcaaacctcatc

SEQ ID NO: 8041520 - DNA, 22 bp, Homo sapiens
tatttggaatagcttgctaatg

SEQ ID NO: 8041521 - DNA, 22 bp, Homo sapiens
tatttggaaacaattcacatgc

SEQ ID NO: 8041522 - DNA, 22 bp, Homo sapiens
tattacaatttacattgcactt

SEQ ID NO: 8041523 - DNA, 22 bp, Homo sapiens
tatgtaggtaaacacagacata

SEQ ID NO: 8041524 - DNA, 20 bp, Homo sapiens
tatgaagatatgtgaacagc

SEQ ID NO: 8041525 - DNA, 19 bp, Homo sapiens
tatcactgggcactgagga

SEQ ID NO: 8041526 - DNA, 22 bp, Homo sapiens
taccactacatttgctaatggc

SEQ ID NO: 8041527 - DNA, 22 bp, Homo sapiens
tactgtactcaacatgtgagtt

SEQ ID NO: 8041528 - DNA, 22 bp, Homo sapiens
tactgtactgtcttttttgctg

SEQ ID NO: 8041529 - DNA, 22 bp, Homo sapiens
tactgtactgcagttctgcaaa

SEQ ID NO: 8041530 - DNA, 22 bp, Homo sapiens
tactgtacattccgtttgttgc

SEQ ID NO: 8041531 - DNA, 22 bp, Homo sapiens
tacatgtatgtgttaatatctg

SEQ ID NO: 8041532 - DNA, 22 bp, Homo sapiens
tacagaggagaccaaggctcag

SEQ ID NO: 8041533 - DNA, 20 bp, Homo sapiens
tacagtcagggcacaggcag

SEQ ID NO: 8041534 - DNA, 22 bp, Homo sapiens
taatcgtatgtgtatcaaatca

SEQ ID NO: 8041535 - DNA, 22 bp, Homo sapiens
taatttatgatgcaaagaaaag

SEQ ID NO: 8041536 - DNA, 22 bp, Homo sapiens
taatatatacctttgttaggaa

SEQ ID NO: 8041537 - DNA, 22 bp, Homo sapiens
taatatatacctttgttaggaa

SEQ ID NO: 8041538 - DNA, 21 bp, Homo sapiens
tacaagaccggattcgggccc

SEQ ID NO: 8041539 - DNA, 22 bp, Homo sapiens
tacaagacgagggaagttcttt

SEQ ID NO: 8041540 - DNA, 22 bp, Homo sapiens
tacaagacgagggaagttcttt

SEQ ID NO: 8041541 - DNA, 21 bp, Homo sapiens
tacaagaccggattcgggccc

SEQ ID NO: 8041542 - DNA, 21 bp, Homo sapiens
tacaagatagaggtaatatat

SEQ ID NO: 8041543 - DNA, 22 bp, Homo sapiens
tacaagatgacaggtgcatgat

SEQ ID NO: 8041544 - DNA, 22 bp, Homo sapiens
taatttatttcaactgccaagg

SEQ ID NO: 8041545 - DNA, 22 bp, Homo sapiens
tacacataggagggtaataaaa

SEQ ID NO: 8041546 - DNA, 22 bp, Homo sapiens
tacacataggtctgaataaaaa

SEQ ID NO: 8041547 - DNA, 22 bp, Homo sapiens
gttatatatagtatttctctga

SEQ ID NO: 8041548 - DNA, 22 bp, Homo sapiens
gttgaagtttatatgagtgctt

SEQ ID NO: 8041549 - DNA, 23 bp, Homo sapiens
gttgaagtggtcggggaggcaga

SEQ ID NO: 8041550 - DNA, 22 bp, Homo sapiens
taagacaattcttcagtcacaa

SEQ ID NO: 8041551 - DNA, 22 bp, Homo sapiens
taacagctggcgttataggaat

SEQ ID NO: 8041552 - DNA, 22 bp, Homo sapiens
taacagctctgtgtggctgtaa

SEQ ID NO: 8041553 - DNA, 21 bp, Homo sapiens
taaaactgtaactttgtcctg

SEQ ID NO: 8041554 - DNA, 22 bp, Homo sapiens
taaaactgcttggtatggtcta

SEQ ID NO: 8041555 - DNA, 22 bp, Homo sapiens
taaaactgaatacatactgagg

SEQ ID NO: 8041556 - DNA, 22 bp, Homo sapiens
tcaggacacttggcacaaggtc

SEQ ID NO: 8041557 - DNA, 22 bp, Homo sapiens
tcagctggtgagtggatagaca

SEQ ID NO: 8041558 - DNA, 22 bp, Homo sapiens
tcagctctgcactccactgtgg

SEQ ID NO: 8041559 - DNA, 22 bp, Homo sapiens
tcagaattggacaatagaagca

SEQ ID NO: 8041560 - DNA, 22 bp, Homo sapiens
tcagattttattttcctgttac

SEQ ID NO: 8041561 - DNA, 22 bp, Homo sapiens
tcactgcaacctccacctcccg

SEQ ID NO: 8041562 - DNA, 22 bp, Homo sapiens
tcactgcaacctccacctcccg

SEQ ID NO: 8041563 - DNA, 22 bp, Homo sapiens
tcacatttgcaattgcattgtt

SEQ ID NO: 8041564 - DNA, 22 bp, Homo sapiens
tcactgcaacctccacctcctg

SEQ ID NO: 8041565 - DNA, 22 bp, Homo sapiens
tcactgcaacctccacctcctg

SEQ ID NO: 8041566 - DNA, 22 bp, Homo sapiens
tcactgcatcctccgcctcctg

SEQ ID NO: 8041567 - DNA, 22 bp, Homo sapiens
tcaagaaactgtgctacagagt

SEQ ID NO: 8041568 - DNA, 22 bp, Homo sapiens
tcaacatataggcaacctgtaa

SEQ ID NO: 8041569 - DNA, 22 bp, Homo sapiens
tcaacagacatttttaagcact

SEQ ID NO: 8041570 - DNA, 22 bp, Homo sapiens
tcacataaattatacaatttca

SEQ ID NO: 8041571 - DNA, 22 bp, Homo sapiens
tcattgttgcgttaatgtcttc

SEQ ID NO: 8041572 - DNA, 22 bp, Homo sapiens
tcatttctctgagtctgataat

SEQ ID NO: 8041573 - DNA, 22 bp, Homo sapiens
tcatttctattgctactgtctg

SEQ ID NO: 8041574 - DNA, 22 bp, Homo sapiens
tcatttctccgacctgctgtcc

SEQ ID NO: 8041575 - DNA, 20 bp, Homo sapiens
tcatttcttggggttccaag

SEQ ID NO: 8041576 - DNA, 22 bp, Homo sapiens
tcatttctatctatgcagcttc

SEQ ID NO: 8041577 - DNA, 22 bp, Homo sapiens
tccaaggctccggccctggcgt

SEQ ID NO: 8041578 - DNA, 22 bp, Homo sapiens
tccaataacatctaaaaactta

SEQ ID NO: 8041579 - DNA, 22 bp, Homo sapiens
tccaatcatgagtctatactag

SEQ ID NO: 8041580 - DNA, 22 bp, Homo sapiens
tcatgaaaatagatcagaaatt

SEQ ID NO: 8041581 - DNA, 22 bp, Homo sapiens
tcagtctcctttcctctagaca

SEQ ID NO: 8041582 - DNA, 22 bp, Homo sapiens
tcagtattcctggaaatacaag

SEQ ID NO: 8041583 - DNA, 22 bp, Homo sapiens
tcctgcagccactgcaggcaga

SEQ ID NO: 8041584 - DNA, 22 bp, Homo sapiens
tcctgagctacagtagtatgat

SEQ ID NO: 8041585 - DNA, 22 bp, Homo sapiens
tcctgagctgccgcatcagcag

SEQ ID NO: 8041586 - DNA, 22 bp, Homo sapiens
tcctgagcacagagacaaggaa

SEQ ID NO: 8041587 - DNA, 22 bp, Homo sapiens
tcctgagcaacacagctaagtg

SEQ ID NO: 8041588 - DNA, 22 bp, Homo sapiens
tcctgagccctgtaggaccctg

SEQ ID NO: 8041589 - DNA, 22 bp, Homo sapiens
tcctgagcctgacaatcaccat

SEQ ID NO: 8041590 - DNA, 22 bp, Homo sapiens
tcctctgggctccctgcaacag

SEQ ID NO: 8041591 - DNA, 22 bp, Homo sapiens
tccctcagcttgtctccatgca

SEQ ID NO: 8041592 - DNA, 22 bp, Homo sapiens
tccctcagtccctggacaggca

SEQ ID NO: 8041593 - DNA, 22 bp, Homo sapiens
tccctccccacttctgagcttt

SEQ ID NO: 8041594 - DNA, 20 bp, Homo sapiens
tccctcagtttccagccctg

SEQ ID NO: 8041595 - DNA, 20 bp, Homo sapiens
tccctccctccagctctggg

SEQ ID NO: 8041596 - DNA, 22 bp, Homo sapiens
tccctcagagggcaagcgcaga

SEQ ID NO: 8041597 - DNA, 22 bp, Homo sapiens
tccctcagatgagctcctagca

SEQ ID NO: 8041598 - DNA, 22 bp, Homo sapiens
tccctggctgggggctgccttg

SEQ ID NO: 8041599 - DNA, 22 bp, Homo sapiens
tccctgcctcctggcagtgcca

SEQ ID NO: 8041600 - DNA, 22 bp, Homo sapiens
tccctggcacaagaaggctgtc

SEQ ID NO: 8041601 - DNA, 22 bp, Homo sapiens
tcctcacagctggttcattcag

SEQ ID NO: 8041602 - DNA, 22 bp, Homo sapiens
tcctcagcaaacacttcactct

SEQ ID NO: 8041603 - DNA, 23 bp, Homo sapiens
tcctcagcatgttttgtcatgta

SEQ ID NO: 8041604 - DNA, 21 bp, Homo sapiens
tcctcagggccccagagcact

SEQ ID NO: 8041605 - DNA, 22 bp, Homo sapiens
tcctcagcattagcacagacat

SEQ ID NO: 8041606 - DNA, 22 bp, Homo sapiens
tccaggctaattttgcattgtt

SEQ ID NO: 8041607 - DNA, 22 bp, Homo sapiens
tccaggctttttcatgctgtct

SEQ ID NO: 8041608 - DNA, 22 bp, Homo sapiens
tcccagccttccagtctggttt

SEQ ID NO: 8041609 - DNA, 22 bp, Homo sapiens
gcattgcaactgacagatcatt

SEQ ID NO: 8041610 - DNA, 22 bp, Homo sapiens
gcattgcaaaaagcagcttgat

SEQ ID NO: 8041611 - DNA, 22 bp, Homo sapiens
gcattgcaggtgtacccagtta

SEQ ID NO: 8041612 - DNA, 22 bp, Homo sapiens
gcagtgtttgtgttctcacatg

SEQ ID NO: 8041613 - DNA, 22 bp, Homo sapiens
gcccaagggcatcaagttctac

SEQ ID NO: 8041614 - DNA, 22 bp, Homo sapiens
gcccaaggtatatcagagacag

SEQ ID NO: 8041615 - DNA, 20 bp, Homo sapiens
gcccaaggtccagaaggggg

SEQ ID NO: 8041616 - DNA, 22 bp, Homo sapiens
gcctccctgtttcctgctccaa

SEQ ID NO: 8041617 - DNA, 22 bp, Homo sapiens
gccccaggggaggtgccctgca

SEQ ID NO: 8041618 - DNA, 22 bp, Homo sapiens
gcccaaggtcccatggcagcac

SEQ ID NO: 8041619 - DNA, 22 bp, Homo sapiens
gccctcagaggacagctgactt

SEQ ID NO: 8041620 - DNA, 22 bp, Homo sapiens
gcacagagagcagtgggggaca

SEQ ID NO: 8041621 - DNA, 22 bp, Homo sapiens
gcacagagagtcccgggtgccc

SEQ ID NO: 8041622 - DNA, 22 bp, Homo sapiens
gcagcacaaagtccccagggac

SEQ ID NO: 8041623 - DNA, 19 bp, Homo sapiens
gctttagtttactcatcta

SEQ ID NO: 8041624 - DNA, 22 bp, Homo sapiens
gcttttatttcttcacaaaagt

SEQ ID NO: 8041625 - DNA, 22 bp, Homo sapiens
gcttttattgtctttacgacga

SEQ ID NO: 8041626 - DNA, 22 bp, Homo sapiens
gctgtacatttgtgtacacttg

SEQ ID NO: 8041627 - DNA, 22 bp, Homo sapiens
gctgtacattctgcacaggccc

SEQ ID NO: 8041628 - DNA, 22 bp, Homo sapiens
gctgtacattctgtgggtttgg

SEQ ID NO: 8041629 - DNA, 22 bp, Homo sapiens
gctgtacagggttatcctttcc

SEQ ID NO: 8041630 - DNA, 22 bp, Homo sapiens
gctgtacatcacaatttgctgt

SEQ ID NO: 8041631 - DNA, 19 bp, Homo sapiens
gctgtacagtaaggagaca

SEQ ID NO: 8041632 - DNA, 22 bp, Homo sapiens
gctgtacagtttactaggtggg

SEQ ID NO: 8041633 - DNA, 22 bp, Homo sapiens
gctgtatttatatgaaggcatg

SEQ ID NO: 8041634 - DNA, 18 bp, Homo sapiens
ggagcccagaggtgagtt

SEQ ID NO: 8041635 - DNA, 18 bp, Homo sapiens
ggagcccagaggacagga

SEQ ID NO: 8041636 - DNA, 22 bp, Homo sapiens
ggagcccaagtctgcactcggc

SEQ ID NO: 8041637 - DNA, 22 bp, Homo sapiens
ggagaagaggagctggaagcct

SEQ ID NO: 8041638 - DNA, 22 bp, Homo sapiens
gcctggcactcaatcatctgct

SEQ ID NO: 8041639 - DNA, 22 bp, Homo sapiens
gctcagggaaggccacgtgaga

SEQ ID NO: 8041640 - DNA, 22 bp, Homo sapiens
gctcagggaatgagaagatgtt

SEQ ID NO: 8041641 - DNA, 22 bp, Homo sapiens
gctcagggagtttcacagtgta

SEQ ID NO: 8041642 - DNA, 22 bp, Homo sapiens
gctcagggagagagggcagccg

SEQ ID NO: 8041643 - DNA, 22 bp, Homo sapiens
gctcagggcctggctgcggact

SEQ ID NO: 8041644 - DNA, 22 bp, Homo sapiens
gctcagggccatggaccagcag

SEQ ID NO: 8041645 - DNA, 20 bp, Homo sapiens
gctcagggcctgggtctgga

SEQ ID NO: 8041646 - DNA, 22 bp, Homo sapiens
gctcccagcaattgaggcagcc

SEQ ID NO: 8041647 - DNA, 22 bp, Homo sapiens
gctcagggcgcgagggacgtgg

SEQ ID NO: 8041648 - DNA, 22 bp, Homo sapiens
gctcccaggaagagaagggcca

SEQ ID NO: 8041649 - DNA, 22 bp, Homo sapiens
gctggcagtaaagggtttggca

SEQ ID NO: 8041650 - DNA, 22 bp, Homo sapiens
gctggcagtcccatcagctggg

SEQ ID NO: 8041651 - DNA, 22 bp, Homo sapiens
gctggcagtgtattgttagctg

SEQ ID NO: 8041652 - DNA, 22 bp, Homo sapiens
gctggcagtttcctcaccgagg

SEQ ID NO: 8041653 - DNA, 22 bp, Homo sapiens
gctggcagtgtgaatgacaagc

SEQ ID NO: 8041654 - DNA, 22 bp, Homo sapiens
gctggcagggtggttgagagag

SEQ ID NO: 8041655 - DNA, 22 bp, Homo sapiens
gctggcagggttctcactgaaa

SEQ ID NO: 8041656 - DNA, 22 bp, Homo sapiens
gctggcaggtaaagccccgggg

SEQ ID NO: 8041657 - DNA, 22 bp, Homo sapiens
gctggcaggtccaagatagagc

SEQ ID NO: 8041658 - DNA, 22 bp, Homo sapiens
gctgcctctgcgactctgggcg

SEQ ID NO: 8041659 - DNA, 22 bp, Homo sapiens
gctgcctctgcacagctcactc

SEQ ID NO: 8041660 - DNA, 22 bp, Homo sapiens
gtgcagcaaagtttgagatata

SEQ ID NO: 8041661 - DNA, 22 bp, Homo sapiens
gtgaaaaatgatttgttaactg

SEQ ID NO: 8041662 - DNA, 22 bp, Homo sapiens
gtagttctgcagtgtcacctga

SEQ ID NO: 8041663 - DNA, 22 bp, Homo sapiens
gtacaaaagttattgcggtttt

SEQ ID NO: 8041664 - DNA, 22 bp, Homo sapiens
gtacaacatgattttactctct

SEQ ID NO: 8041665 - DNA, 22 bp, Homo sapiens
gtacaataactagtcttatagt

SEQ ID NO: 8041666 - DNA, 22 bp, Homo sapiens
gtaggtcagacataagaggaca

SEQ ID NO: 8041667 - DNA, 20 bp, Homo sapiens
gtccaggacccagcaggagg

SEQ ID NO: 8041668 - DNA, 22 bp, Homo sapiens
gtcctggcccactggcaggctg

SEQ ID NO: 8041669 - DNA, 22 bp, Homo sapiens
gtcctggcacctcactggctac

SEQ ID NO: 8041670 - DNA, 22 bp, Homo sapiens
gtcctggcccaggagtacacat

SEQ ID NO: 8041671 - DNA, 19 bp, Homo sapiens
gtcctggcgccgccacacc

SEQ ID NO: 8041672 - DNA, 22 bp, Homo sapiens
gtcctggctggttctgtggggc

SEQ ID NO: 8041673 - DNA, 22 bp, Homo sapiens
ggggcccagggcagcagtgcag

SEQ ID NO: 8041674 - DNA, 22 bp, Homo sapiens
ggtccccgtggaggctggagcg

SEQ ID NO: 8041675 - DNA, 21 bp, Homo sapiens
ggtgctcgctgatgaggagtg

SEQ ID NO: 8041676 - DNA, 17 bp, Homo sapiens
ggttcagttctgcattc

SEQ ID NO: 8041677 - DNA, 22 bp, Homo sapiens
ggttcagtttacattaaaatct

SEQ ID NO: 8041678 - DNA, 22 bp, Homo sapiens
gtaatgtactgcagccagatgt

SEQ ID NO: 8041679 - DNA, 22 bp, Homo sapiens
gggagccacagtgaggtgcatg

SEQ ID NO: 8041680 - DNA, 22 bp, Homo sapiens
gggaagatagtgttgagggccc

SEQ ID NO: 8041681 - DNA, 22 bp, Homo sapiens
gggctctggagttctagaaaga

SEQ ID NO: 8041682 - DNA, 22 bp, Homo sapiens
gggctccaacggtgagcatgga

SEQ ID NO: 8041683 - DNA, 22 bp, Homo sapiens
gggccccttgctgctctgctgg

SEQ ID NO: 8041684 - DNA, 22 bp, Homo sapiens
gggccccttgtatctctggctc

SEQ ID NO: 8041685 - DNA, 22 bp, Homo sapiens
ggcagcccaccagcccacgtct

SEQ ID NO: 8041686 - DNA, 18 bp, Homo sapiens
ggcagggaaaagataggg

SEQ ID NO: 8041687 - DNA, 22 bp, Homo sapiens
ggaggatgccaagctgtgcaca

SEQ ID NO: 8041688 - DNA, 22 bp, Homo sapiens
ggcctctggggtcctgagccca

SEQ ID NO: 8041689 - DNA, 22 bp, Homo sapiens
ggcctctggtcaagacaagcat

SEQ ID NO: 8041690 - DNA, 18 bp, Homo sapiens
ggcctctggactggcagc

SEQ ID NO: 8041691 - DNA, 22 bp, Homo sapiens
ggcctctggcaggcaggccctc

SEQ ID NO: 8041692 - DNA, 19 bp, Homo sapiens
ggcctctgcaggccgcccc

SEQ ID NO: 8041693 - DNA, 22 bp, Homo sapiens
ggcctctgccccagccacacct

SEQ ID NO: 8041694 - DNA, 21 bp, Homo sapiens
ggcctctgccttgccccactc

SEQ ID NO: 8041695 - DNA, 22 bp, Homo sapiens
ggcctctctgagagcagacgtt

SEQ ID NO: 8041696 - DNA, 20 bp, Homo sapiens
ggcctctgaggacaaggaga

SEQ ID NO: 8041697 - DNA, 22 bp, Homo sapiens
ggctctctggaggagctcaccc

SEQ ID NO: 8041698 - DNA, 22 bp, Homo sapiens
tttaatgtagcgtgaaatgatt

SEQ ID NO: 8041699 - DNA, 19 bp, Homo sapiens
tttacagggaatggagacc

SEQ ID NO: 8041700 - DNA, 22 bp, Homo sapiens
tttagatgctgtatgttatttc

SEQ ID NO: 8041701 - DNA, 22 bp, Homo sapiens
tttatatagagatttgtgcatg

SEQ ID NO: 8041702 - DNA, 22 bp, Homo sapiens
ttgacaagtaatacttaaatta

SEQ ID NO: 8041703 - DNA, 22 bp, Homo sapiens
ttggaaaatgtatttctagaag

SEQ ID NO: 8041704 - DNA, 22 bp, Homo sapiens
ttggaaagtgacgttcaactgt

SEQ ID NO: 8041705 - DNA, 22 bp, Homo sapiens
ttggaaaggagattctattgtg

SEQ ID NO: 8041706 - DNA, 22 bp, Homo sapiens
ttggaaagaagggctgagcaag

SEQ ID NO: 8041707 - DNA, 22 bp, Homo sapiens
ttggaaagaccgaattcctgtt

SEQ ID NO: 8041708 - DNA, 22 bp, Homo sapiens
ttggacagcacagacatagaat

SEQ ID NO: 8041709 - DNA, 22 bp, Homo sapiens
ttggacagtactttaaagcaga

SEQ ID NO: 8041710 - DNA, 22 bp, Homo sapiens
ttggaaagtttttactgaagac

SEQ ID NO: 8041711 - DNA, 22 bp, Homo sapiens
ttggcagggcatcagacacgtg

SEQ ID NO: 8041712 - DNA, 22 bp, Homo sapiens
ttggagagatttaggtctcagt

SEQ ID NO: 8041713 - DNA, 23 bp, Homo sapiens
ttggagagggtgagtagtgtcag

SEQ ID NO: 8041714 - DNA, 17 bp, Homo sapiens
ttgggagagaaaggtat

SEQ ID NO: 8041715 - DNA, 22 bp, Homo sapiens
ttgggaagaatggaggtggtta

SEQ ID NO: 8041716 - DNA, 22 bp, Homo sapiens
ttgggaagtttaatgacagact

SEQ ID NO: 8041717 - DNA, 22 bp, Homo sapiens
ttctctatcttgaatgcgtcaa

SEQ ID NO: 8041718 - DNA, 22 bp, Homo sapiens
ttcctgcccctgagagctccca

SEQ ID NO: 8041719 - DNA, 22 bp, Homo sapiens
ttcctggcatagagagggcaca

SEQ ID NO: 8041720 - DNA, 22 bp, Homo sapiens
ttcctggcagaggccccgacag

SEQ ID NO: 8041721 - DNA, 22 bp, Homo sapiens
ttcctggccaagcagagtggaa

SEQ ID NO: 8041722 - DNA, 22 bp, Homo sapiens
ttcctggccccacccctggaga

SEQ ID NO: 8041723 - DNA, 22 bp, Homo sapiens
ttcctggcctaaggtaggtgac

SEQ ID NO: 8041724 - DNA, 22 bp, Homo sapiens
ttcctggcgccacggagccggt

SEQ ID NO: 8041725 - DNA, 22 bp, Homo sapiens
ttcctggctcacagcagtgggg

SEQ ID NO: 8041726 - DNA, 22 bp, Homo sapiens
ttgaaatatttgggagtgtttg

SEQ ID NO: 8041727 - DNA, 22 bp, Homo sapiens
ttgaaatatggattgaccttga

SEQ ID NO: 8041728 - DNA, 23 bp, Homo sapiens
ttcaaagatcttctgaaatctgt

SEQ ID NO: 8041729 - DNA, 22 bp, Homo sapiens
ttcagagaacttcatggaagag

SEQ ID NO: 8041730 - DNA, 22 bp, Homo sapiens
ttcagagagaaaccagtgggaa

SEQ ID NO: 8041731 - DNA, 22 bp, Homo sapiens
ttcagagagtttgtgagtcctt

SEQ ID NO: 8041732 - DNA, 22 bp, Homo sapiens
ttcagttccatttcaggtgggt

SEQ ID NO: 8041733 - DNA, 22 bp, Homo sapiens
ttcattgcagttcttcaggtta

SEQ ID NO: 8041734 - DNA, 22 bp, Homo sapiens
ttccaggctcccttggaggtgt

SEQ ID NO: 8041735 - DNA, 22 bp, Homo sapiens
ttccaggctatccggtgaaggg

SEQ ID NO: 8041736 - DNA, 22 bp, Homo sapiens
ttccaggcatgtcagacatagg

SEQ ID NO: 8041737 - DNA, 22 bp, Homo sapiens
ttccaggctgatgggccacagg

SEQ ID NO: 8041738 - DNA, 22 bp, Homo sapiens
ttccaggcttctctggggcgtc

SEQ ID NO: 8041739 - DNA, 23 bp, Homo sapiens
ttccaggcagagcagggattaga

SEQ ID NO: 8041740 - DNA, 22 bp, Homo sapiens
ttcattttctttcacgctgctg

SEQ ID NO: 8041741 - DNA, 22 bp, Homo sapiens
tcctgcctgtttacctgtactt

SEQ ID NO: 8041742 - DNA, 18 bp, Homo sapiens
tcctgcctgtgccccagg

SEQ ID NO: 8041743 - DNA, 19 bp, Homo sapiens
tcctgcctggggccgcctg

SEQ ID NO: 8041744 - DNA, 22 bp, Homo sapiens
ttatactaaaacgcattgaatt

SEQ ID NO: 8041745 - DNA, 22 bp, Homo sapiens
ttattatagattatgcaagatt

SEQ ID NO: 8041746 - DNA, 22 bp, Homo sapiens
tttggaaatttcatcaatagcc

SEQ ID NO: 8041747 - DNA, 22 bp, Homo sapiens
tttcctctaaacgcatttgctt

SEQ ID NO: 8041748 - DNA, 22 bp, Homo sapiens
tttcctcacttcatgagagttt

SEQ ID NO: 8041749 - DNA, 22 bp, Homo sapiens
tttcctcagaagtgtctactat

SEQ ID NO: 8041750 - DNA, 22 bp, Homo sapiens
tttcctcatttatctgctggga

SEQ ID NO: 8041751 - DNA, 22 bp, Homo sapiens
tttgacagacatttactacatt

SEQ ID NO: 8041752 - DNA, 22 bp, Homo sapiens
tttgaagataaatatggagaaa

SEQ ID NO: 8041753 - DNA, 22 bp, Homo sapiens
tttgaaaggtgtcgagatgtgt

SEQ ID NO: 8041754 - DNA, 22 bp, Homo sapiens
tttgaaagggttatgagactga

SEQ ID NO: 8041755 - DNA, 21 bp, Homo sapiens
tttgaaagctacatctatagc

SEQ ID NO: 8041756 - DNA, 22 bp, Homo sapiens
tttgaaaggaattaggatgaca

SEQ ID NO: 8041757 - DNA, 22 bp, Homo sapiens
ttttcattgttcctcgagcatt

SEQ ID NO: 8041758 - DNA, 22 bp, Homo sapiens
ttttcattgtaaatcaggaaac

SEQ ID NO: 8041759 - DNA, 22 bp, Homo sapiens
ttttcattgttactatgagcta

SEQ ID NO: 8041760 - DNA, 22 bp, Homo sapiens
ttttcattagaatgactgagaa

SEQ ID NO: 8041761 - DNA, 22 bp, Homo sapiens
ttttcattgagcacctgagtaa

SEQ ID NO: 8041762 - DNA, 22 bp, Homo sapiens
ttttcatttttgtagatgcaag

SEQ ID NO: 8041763 - DNA, 22 bp, Homo sapiens
ttttcatttacattagggaaga

SEQ ID NO: 8041764 - DNA, 22 bp, Homo sapiens
tttgtaaagtctgttctgagtt

SEQ ID NO: 8041765 - DNA, 22 bp, Homo sapiens
aaattccattatgataatttcg

SEQ ID NO: 8041766 - DNA, 22 bp, Homo sapiens
aaagcagcaacgtgcatataac

SEQ ID NO: 8041767 - DNA, 22 bp, Homo sapiens
aaagcagcacatggatatcagt

SEQ ID NO: 8041768 - DNA, 22 bp, Homo sapiens
aacatgaaacccaaacagaata

SEQ ID NO: 8041769 - DNA, 22 bp, Homo sapiens
aacatgaaacccaaacagaata

SEQ ID NO: 8041770 - DNA, 22 bp, Homo sapiens
aaagttacacgactatttatgt

SEQ ID NO: 8041771 - DNA, 22 bp, Homo sapiens
aaagttacacatctagtaagtg

SEQ ID NO: 8041772 - DNA, 22 bp, Homo sapiens
aaagtccagagggcacactgaa

SEQ ID NO: 8041773 - DNA, 22 bp, Homo sapiens
aaagggaagttgcacatgttcc

SEQ ID NO: 8041774 - DNA, 22 bp, Homo sapiens
aaatacataaaggttgtaccag

SEQ ID NO: 8041775 - DNA, 22 bp, Homo sapiens
aaatacatacactgtacgtggc

SEQ ID NO: 8041776 - DNA, 22 bp, Homo sapiens
aaagtcatgtttttgtttagca

SEQ ID NO: 8041777 - DNA, 22 bp, Homo sapiens
aaagtcatacatggtgcttact

SEQ ID NO: 8041778 - DNA, 22 bp, Homo sapiens
aaagtacaaggaaaggatctga

SEQ ID NO: 8041779 - DNA, 22 bp, Homo sapiens
aaatacaatttcaggctgtaat

SEQ ID NO: 8041780 - DNA, 22 bp, Homo sapiens
aaatgtgagttatagcaataga

SEQ ID NO: 8041781 - DNA, 22 bp, Homo sapiens
aaatgtctttcaatagagaaat

SEQ ID NO: 8041782 - DNA, 22 bp, Homo sapiens
aaagacatatttctaagtttat

SEQ ID NO: 8041783 - DNA, 23 bp, Homo sapiens
aaacttcagtagtgtcatcagcc

SEQ ID NO: 8041784 - DNA, 22 bp, Homo sapiens
aaaacagtttaggcatcacagt

SEQ ID NO: 8041785 - DNA, 20 bp, Homo sapiens
aaaagagtgcttcaactgct

SEQ ID NO: 8041786 - DNA, 22 bp, Homo sapiens
aaaaatgttatctactgtccga

SEQ ID NO: 8041787 - DNA, 22 bp, Homo sapiens
aaaagagtcttaggcagtcata

SEQ ID NO: 8041788 - DNA, 22 bp, Homo sapiens
aaaagagtgactgataagtata

SEQ ID NO: 8041789 - DNA, 22 bp, Homo sapiens
aaaacatgtccatacagaaact

SEQ ID NO: 8041790 - DNA, 22 bp, Homo sapiens
aaaagtgttcaggaagaataat

SEQ ID NO: 8041791 - DNA, 22 bp, Homo sapiens
aaaagttacctctgtaatataa

SEQ ID NO: 8041792 - DNA, 21 bp, Homo sapiens
aaagcagcccatggcacagtc

SEQ ID NO: 8041793 - DNA, 22 bp, Homo sapiens
aaagcagcggtgtctttactgc

SEQ ID NO: 8041794 - DNA, 22 bp, Homo sapiens
aaagcagctgatctcagagcct

SEQ ID NO: 8041795 - DNA, 22 bp, Homo sapiens
aagtgccatcatagcatggctg

SEQ ID NO: 8041796 - DNA, 22 bp, Homo sapiens
aatataattttattcctagagt

SEQ ID NO: 8041797 - DNA, 22 bp, Homo sapiens
aagttacagttggaactgtgaa

SEQ ID NO: 8041798 - DNA, 22 bp, Homo sapiens
aagttacatattcttgggctat

SEQ ID NO: 8041799 - DNA, 22 bp, Homo sapiens
aagttacagttacagaatggag

SEQ ID NO: 8041800 - DNA, 22 bp, Homo sapiens
aagttacagtcagaggttaaca

SEQ ID NO: 8041801 - DNA, 22 bp, Homo sapiens
aagttacacagagttggaggct

SEQ ID NO: 8041802 - DNA, 22 bp, Homo sapiens
aataatgtctttggcttgacca

SEQ ID NO: 8041803 - DNA, 23 bp, Homo sapiens
aataatgtcttgtgctctcactt

SEQ ID NO: 8041804 - DNA, 22 bp, Homo sapiens
aataatgtctgctattttaaaa

SEQ ID NO: 8041805 - DNA, 22 bp, Homo sapiens
aataatgtctatggttccaaaa

SEQ ID NO: 8041806 - DNA, 22 bp, Homo sapiens
aataatgtacatacatatttcg

SEQ ID NO: 8041807 - DNA, 22 bp, Homo sapiens
aataatgtaggatgataaatga

SEQ ID NO: 8041808 - DNA, 22 bp, Homo sapiens
aatgtacaaaccttctttgtag

SEQ ID NO: 8041809 - DNA, 21 bp, Homo sapiens
aatgatgaaagatgacagagt

SEQ ID NO: 8041810 - DNA, 22 bp, Homo sapiens
aatgatgaactcagagggaacc

SEQ ID NO: 8041811 - DNA, 22 bp, Homo sapiens
aatgaacaaaatatgctttgca

SEQ ID NO: 8041812 - DNA, 22 bp, Homo sapiens
acaacaaaatcactagtcttcc

SEQ ID NO: 8041813 - DNA, 22 bp, Homo sapiens
acaatatacacatcctaatggg

SEQ ID NO: 8041814 - DNA, 22 bp, Homo sapiens
acaatatagtccatgagcatgc

SEQ ID NO: 8041815 - DNA, 22 bp, Homo sapiens
acaatgtagagtaaaatatgtt

SEQ ID NO: 8041816 - DNA, 22 bp, Homo sapiens
acaatgtagagtaaaatatgtt

SEQ ID NO: 8041817 - DNA, 22 bp, Homo sapiens
acaatgtaggctgaaaaagctt

SEQ ID NO: 8041818 - DNA, 22 bp, Homo sapiens
acaatgtaggctgaaaaagctt

SEQ ID NO: 8041819 - DNA, 22 bp, Homo sapiens
acacagagctggaactgcttca

SEQ ID NO: 8041820 - DNA, 22 bp, Homo sapiens
aagatacaccaagagcctagta

SEQ ID NO: 8041821 - DNA, 18 bp, Homo sapiens
aagaactgaggtcctaga

SEQ ID NO: 8041822 - DNA, 21 bp, Homo sapiens
aagaactattgaggtacacag

SEQ ID NO: 8041823 - DNA, 22 bp, Homo sapiens
aagaacattttgtagaatgaca

SEQ ID NO: 8041824 - DNA, 22 bp, Homo sapiens
aagaacatttatgatggcattt

SEQ ID NO: 8041825 - DNA, 22 bp, Homo sapiens
acaaaagtgtaggaattcctta

SEQ ID NO: 8041826 - DNA, 22 bp, Homo sapiens
acacccagagcgccagtgccga

SEQ ID NO: 8041827 - DNA, 22 bp, Homo sapiens
acacaagaataatgatgaaggt

SEQ ID NO: 8041828 - DNA, 22 bp, Homo sapiens
acacatatgtcattgaaaaatc

SEQ ID NO: 8041829 - DNA, 20 bp, Homo sapiens
acagcagataccacaactat

SEQ ID NO: 8041830 - DNA, 22 bp, Homo sapiens
acagaacttccagggaacatac

SEQ ID NO: 8041831 - DNA, 22 bp, Homo sapiens
acacaagaagttaatgggcaaa

SEQ ID NO: 8041832 - DNA, 22 bp, Homo sapiens
acaattttccccataggttatc

SEQ ID NO: 8041833 - DNA, 22 bp, Homo sapiens
agcacaggaccaaggaagctgt

SEQ ID NO: 8041834 - DNA, 22 bp, Homo sapiens
agcacaggctttggtgtgaggg

SEQ ID NO: 8041835 - DNA, 22 bp, Homo sapiens
agcacagggacaatgccaggtg

SEQ ID NO: 8041836 - DNA, 22 bp, Homo sapiens
agcacaggaacatggagatggg

SEQ ID NO: 8041837 - DNA, 22 bp, Homo sapiens
agcaaggcagtcagctggctgg

SEQ ID NO: 8041838 - DNA, 22 bp, Homo sapiens
acaatacaggcttctggactta

SEQ ID NO: 8041839 - DNA, 22 bp, Homo sapiens
acaatagaaggaaactgacata

SEQ ID NO: 8041840 - DNA, 22 bp, Homo sapiens
acaatagaaataattaagcaca

SEQ ID NO: 8041841 - DNA, 21 bp, Homo sapiens
agatgctgatgctgcaggtcc

SEQ ID NO: 8041842 - DNA, 22 bp, Homo sapiens
aatttctcggttttgatattgt

SEQ ID NO: 8041843 - DNA, 22 bp, Homo sapiens
aatttggagctttgtttctaga

SEQ ID NO: 8041844 - DNA, 22 bp, Homo sapiens
agagcacagaagaataggtgct

SEQ ID NO: 8041845 - DNA, 22 bp, Homo sapiens
agaggaatttctggaaggaggc

SEQ ID NO: 8041846 - DNA, 22 bp, Homo sapiens
agaggaatgtatttccctgcaa

SEQ ID NO: 8041847 - DNA, 21 bp, Homo sapiens
agaggaagtgattggtctggc

SEQ ID NO: 8041848 - DNA, 22 bp, Homo sapiens
agaggaatttctggaaggaggc

SEQ ID NO: 8041849 - DNA, 22 bp, Homo sapiens
agaggattcactgcagaagaca

SEQ ID NO: 8041850 - DNA, 22 bp, Homo sapiens
aatgtataatatttaatgcttt

SEQ ID NO: 8041851 - DNA, 20 bp, Homo sapiens
aatgtatattttatgccagg

SEQ ID NO: 8041852 - DNA, 22 bp, Homo sapiens
aatgtatgggtgagaaagttga

SEQ ID NO: 8041853 - DNA, 22 bp, Homo sapiens
aatgtatgagcgtgaaagcact

SEQ ID NO: 8041854 - DNA, 21 bp, Homo sapiens
aatgtatgtttatctcacagt

SEQ ID NO: 8041855 - DNA, 22 bp, Homo sapiens
aatgtatgtgtatatcaaatca

SEQ ID NO: 8041856 - DNA, 21 bp, Homo sapiens
agagaagggattccaggccct

SEQ ID NO: 8041857 - DNA, 21 bp, Homo sapiens
agagaagggactcttccagtc

SEQ ID NO: 8041858 - DNA, 19 bp, Homo sapiens
agagaaggatcctatggtt

SEQ ID NO: 8041859 - DNA, 22 bp, Homo sapiens
aaggtacagttttaagaataag

SEQ ID NO: 8041860 - DNA, 22 bp, Homo sapiens
acctctgcaatgcaatgtcatg

SEQ ID NO: 8041861 - DNA, 22 bp, Homo sapiens
acctgcctatcagctgcctgct

SEQ ID NO: 8041862 - DNA, 22 bp, Homo sapiens
aaggatgttctagtttgctgag

SEQ ID NO: 8041863 - DNA, 21 bp, Homo sapiens
aaggatgtcagtggcacagga

SEQ ID NO: 8041864 - DNA, 22 bp, Homo sapiens
acatgaagtggtcagatcaaac

SEQ ID NO: 8041865 - DNA, 22 bp, Homo sapiens
actgggagtcatgaggaaggag

SEQ ID NO: 8041866 - DNA, 20 bp, Homo sapiens
aataaaagaagccttcaccc

SEQ ID NO: 8041867 - DNA, 22 bp, Homo sapiens
actgtacaaatattgcaaaata

SEQ ID NO: 8041868 - DNA, 22 bp, Homo sapiens
actgtacaacctctgcccctgt

SEQ ID NO: 8041869 - DNA, 22 bp, Homo sapiens
actgtacaactgctgagcagaa

SEQ ID NO: 8041870 - DNA, 22 bp, Homo sapiens
actgtacacacttctctgtctt

SEQ ID NO: 8041871 - DNA, 22 bp, Homo sapiens
actgtacacacttctctgtctt

SEQ ID NO: 8041872 - DNA, 22 bp, Homo sapiens
actgtccataatattggtgaac

SEQ ID NO: 8041873 - DNA, 22 bp, Homo sapiens
actgtacatgcatcttgtctat

SEQ ID NO: 8041874 - DNA, 22 bp, Homo sapiens
actgtacacagtggtgtactgt

SEQ ID NO: 8041875 - DNA, 22 bp, Homo sapiens
actgtacacattcgtcaagact

SEQ ID NO: 8041876 - DNA, 22 bp, Homo sapiens
actgtacacgtgtcatttacag

SEQ ID NO: 8041877 - DNA, 22 bp, Homo sapiens
actgtacatatggattctaaga

SEQ ID NO: 8041878 - DNA, 22 bp, Homo sapiens
aagttcaatggaaaagctttag

SEQ ID NO: 8041879 - DNA, 22 bp, Homo sapiens
aagttcaagtctgcatcttttt

SEQ ID NO: 8041880 - DNA, 22 bp, Homo sapiens
aagttcaatcagatgaaaaagc

SEQ ID NO: 8041881 - DNA, 22 bp, Homo sapiens
aagttcaagtgtaatctttatt

SEQ ID NO: 8041882 - DNA, 22 bp, Homo sapiens
actgaaaatgaattagaaacag

SEQ ID NO: 8041883 - DNA, 22 bp, Homo sapiens
actgcagttggtgacaataacc

SEQ ID NO: 8041884 - DNA, 22 bp, Homo sapiens
acctgcctatggagccacatgg

SEQ ID NO: 8041885 - DNA, 22 bp, Homo sapiens
acctgcctcagtgcagctggat

SEQ ID NO: 8041886 - DNA, 22 bp, Homo sapiens
acttttatgataatcaatgttc

SEQ ID NO: 8041887 - DNA, 22 bp, Homo sapiens
aatagcttatgggatagatgtt

SEQ ID NO: 8041888 - DNA, 22 bp, Homo sapiens
aataggaaaatatttaacaaga

SEQ ID NO: 8041889 - DNA, 22 bp, Homo sapiens
agaactggtggtgatcagttat

SEQ ID NO: 8041890 - DNA, 22 bp, Homo sapiens
agaactgtgaagtatgtgaaat

SEQ ID NO: 8041891 - DNA, 22 bp, Homo sapiens
cactgcacttcagcctgggtga

SEQ ID NO: 8041892 - DNA, 22 bp, Homo sapiens
cactgcactccagcccgggcaa

SEQ ID NO: 8041893 - DNA, 22 bp, Homo sapiens
cactgcactccatcctgggaaa

SEQ ID NO: 8041894 - DNA, 22 bp, Homo sapiens
cacatgaacatgctggaaaagc

SEQ ID NO: 8041895 - DNA, 22 bp, Homo sapiens
caagggaaggctaagggcaaca

SEQ ID NO: 8041896 - DNA, 22 bp, Homo sapiens
caatgatagattttacaaatta

SEQ ID NO: 8041897 - DNA, 22 bp, Homo sapiens
cagatcacttgaagccaggagt

SEQ ID NO: 8041898 - DNA, 22 bp, Homo sapiens
cagagtgatggcacctgctggg

SEQ ID NO: 8041899 - DNA, 22 bp, Homo sapiens
agccctcctttgttcatgctgc

SEQ ID NO: 8041900 - DNA, 22 bp, Homo sapiens
agaggaagccattgcttactga

SEQ ID NO: 8041901 - DNA, 19 bp, Homo sapiens
agaggcctcagcagctggc

SEQ ID NO: 8041902 - DNA, 22 bp, Homo sapiens
agaggcctccgaaaggtgggct

SEQ ID NO: 8041903 - DNA, 22 bp, Homo sapiens
attctacaacccaataataatt

SEQ ID NO: 8041904 - DNA, 20 bp, Homo sapiens
attctacaagaataagcatg

SEQ ID NO: 8041905 - DNA, 22 bp, Homo sapiens
attctctggctaaaacctgaag

SEQ ID NO: 8041906 - DNA, 22 bp, Homo sapiens
agatacaactgtttaaacatta

SEQ ID NO: 8041907 - DNA, 22 bp, Homo sapiens
agatacaactgtttaaacatta

SEQ ID NO: 8041908 - DNA, 22 bp, Homo sapiens
caaagggctctagactcagcag

SEQ ID NO: 8041909 - DNA, 22 bp, Homo sapiens
attttgttgatggtggagtagc

SEQ ID NO: 8041910 - DNA, 22 bp, Homo sapiens
attttgttatcagggctttgca

SEQ ID NO: 8041911 - DNA, 22 bp, Homo sapiens
attttgttatagaactctgtga

SEQ ID NO: 8041912 - DNA, 22 bp, Homo sapiens
agcaataacagaaaactttcct

SEQ ID NO: 8041913 - DNA, 22 bp, Homo sapiens
atttgaagaaagttttctagat

SEQ ID NO: 8041914 - DNA, 19 bp, Homo sapiens
atttgaaagctgtgcttgc

SEQ ID NO: 8041915 - DNA, 22 bp, Homo sapiens
agatgaggggtagaaaggactt

SEQ ID NO: 8041916 - DNA, 23 bp, Homo sapiens
agatgaggcttctccatgttggt

SEQ ID NO: 8041917 - DNA, 21 bp, Homo sapiens
agatgaggatactgaggccta

SEQ ID NO: 8041918 - DNA, 22 bp, Homo sapiens
agacatagaaaatcattaggaa

SEQ ID NO: 8041919 - DNA, 22 bp, Homo sapiens
agacatagataggcactgattg

SEQ ID NO: 8041920 - DNA, 22 bp, Homo sapiens
agacataggattccacatagca

SEQ ID NO: 8041921 - DNA, 22 bp, Homo sapiens
atgaggatgttagtggactgga

SEQ ID NO: 8041922 - DNA, 22 bp, Homo sapiens
atgacttcgttttctctctgca

SEQ ID NO: 8041923 - DNA, 21 bp, Homo sapiens
atcttaaaaggtcttaacttt

SEQ ID NO: 8041924 - DNA, 22 bp, Homo sapiens
atgacaatacttcaataagctg

SEQ ID NO: 8041925 - DNA, 22 bp, Homo sapiens
atgactgctctgggctcccatg

SEQ ID NO: 8041926 - DNA, 22 bp, Homo sapiens
atgtgcatgcacttacatgtgt

SEQ ID NO: 8041927 - DNA, 22 bp, Homo sapiens
agagactgctttatattgtact

SEQ ID NO: 8041928 - DNA, 21 bp, Homo sapiens
agagactgtcactgcagtacc

SEQ ID NO: 8041929 - DNA, 22 bp, Homo sapiens
agagacttctgccttagcaaga

SEQ ID NO: 8041930 - DNA, 22 bp, Homo sapiens
atgtaggattgagtgatagagg

SEQ ID NO: 8041931 - DNA, 22 bp, Homo sapiens
atgtataatgctaattagctag

SEQ ID NO: 8041932 - DNA, 22 bp, Homo sapiens
atctggaaaacacagtgtagac

SEQ ID NO: 8041933 - DNA, 22 bp, Homo sapiens
atcctggcccaggtgtggaggg

SEQ ID NO: 8041934 - DNA, 22 bp, Homo sapiens
agaaatgttgaatacatcagga

SEQ ID NO: 8041935 - DNA, 22 bp, Homo sapiens
agaaatgttgaatacacaaaat

SEQ ID NO: 8041936 - DNA, 22 bp, Homo sapiens
agaaatgtcaggaaagaagtcc

SEQ ID NO: 8041937 - DNA, 22 bp, Homo sapiens
atcaatgttgggccaaagcaaa

SEQ ID NO: 8041938 - DNA, 23 bp, Homo sapiens
atcaagtcatcagcaaaatacat

SEQ ID NO: 8041939 - DNA, 22 bp, Homo sapiens
agaaatatgctgattagatgaa

SEQ ID NO: 8041940 - DNA, 22 bp, Homo sapiens
atattaatgagcaagtaagtga

SEQ ID NO: 8041941 - DNA, 22 bp, Homo sapiens
agaaagaacgcacttgtgctgc

SEQ ID NO: 8041942 - DNA, 22 bp, Homo sapiens
atatagtgagagattacagaag

SEQ ID NO: 8041943 - DNA, 23 bp, Homo sapiens
atagaagattattgcaacagtcc

SEQ ID NO: 8041944 - DNA, 22 bp, Homo sapiens
atagatgtctgacacagagaaa

SEQ ID NO: 8041945 - DNA, 22 bp, Homo sapiens
atagttgagatcagattcaact

SEQ ID NO: 8041946 - DNA, 22 bp, Homo sapiens
atagttatttctgtcactgtca

SEQ ID NO: 8041947 - DNA, 22 bp, Homo sapiens
agttcactctttatgagaaagt

SEQ ID NO: 8041948 - DNA, 22 bp, Homo sapiens
ataaggtaagggtattgtcaga

SEQ ID NO: 8041949 - DNA, 22 bp, Homo sapiens
ataaggtatgaaaagtaaatgg

SEQ ID NO: 8041950 - DNA, 19 bp, Homo sapiens
atacacgtgtatacataca

SEQ ID NO: 8041951 - DNA, 22 bp, Homo sapiens
actcagagtgcatctcctattt

SEQ ID NO: 8041952 - DNA, 22 bp, Homo sapiens
actcagagcttggctccttgct

SEQ ID NO: 8041953 - DNA, 22 bp, Homo sapiens
agggtccagtaacagatgccag

SEQ ID NO: 8041954 - DNA, 22 bp, Homo sapiens
agggtccatcaaggactgcaca

SEQ ID NO: 8041955 - DNA, 22 bp, Homo sapiens
agtgcaatagcaaagaacaaca

SEQ ID NO: 8041956 - DNA, 22 bp, Homo sapiens
agttaccatatatcaaacatgg

SEQ ID NO: 8041957 - DNA, 22 bp, Homo sapiens
agttacaagtacaggctttgga

SEQ ID NO: 8041958 - DNA, 22 bp, Homo sapiens
agttacaactgtttgaatgtca

SEQ ID NO: 8041959 - DNA, 22 bp, Homo sapiens
acaggcctgtgtgcacacgagg

SEQ ID NO: 8041960 - DNA, 22 bp, Homo sapiens
acagggccattggaggattata

SEQ ID NO: 8041961 - DNA, 22 bp, Homo sapiens
aggacacaggtaagccagtgga

SEQ ID NO: 8041962 - DNA, 22 bp, Homo sapiens
acatatattactagtaaagaca

SEQ ID NO: 8041963 - DNA, 22 bp, Homo sapiens
acctcagctatttcaaaacaga

SEQ ID NO: 8041964 - DNA, 22 bp, Homo sapiens
aggggtgtgcatcctggaggat

SEQ ID NO: 8041965 - DNA, 22 bp, Homo sapiens
agggctgaagggaggtgctcat

SEQ ID NO: 8041966 - DNA, 22 bp, Homo sapiens
agggctgacaaatggcagtgac

SEQ ID NO: 8041967 - DNA, 22 bp, Homo sapiens
acatgtaggagagtcacaatgc

SEQ ID NO: 8041968 - DNA, 22 bp, Homo sapiens
aggcagtgtgtagctggaagag

SEQ ID NO: 8041969 - DNA, 22 bp, Homo sapiens
accactgggcgggcagcctgct

SEQ ID NO: 8041970 - DNA, 22 bp, Homo sapiens
accagacactgtgaagacaggc

SEQ ID NO: 8041971 - DNA, 22 bp, Homo sapiens
acatttctccttgcaggagtca

SEQ ID NO: 8041972 - DNA, 22 bp, Homo sapiens
acatttctccctgcatgcctgc

SEQ ID NO: 8041973 - DNA, 22 bp, Homo sapiens
acatttctcatctagtagagta

SEQ ID NO: 8041974 - DNA, 22 bp, Homo sapiens
acatttctcattctcccctaac

SEQ ID NO: 8041975 - DNA, 22 bp, Homo sapiens
acatttctcaggtaagtcattt

SEQ ID NO: 8041976 - DNA, 21 bp, Homo sapiens
aggctgctggctcagggtcct

SEQ ID NO: 8041977 - DNA, 22 bp, Homo sapiens
catgaggatccaggtgacaggc

SEQ ID NO: 8041978 - DNA, 22 bp, Homo sapiens
catgagatctgcagggatgggc

SEQ ID NO: 8041979 - DNA, 22 bp, Homo sapiens
catgagataatttttctccagt

SEQ ID NO: 8041980 - DNA, 22 bp, Homo sapiens
aggaggctgaactagggtctgg

SEQ ID NO: 8041981 - DNA, 22 bp, Homo sapiens
cataacatgtacatataaatgc

SEQ ID NO: 8041982 - DNA, 22 bp, Homo sapiens
aggagccagaatccagactcgg

SEQ ID NO: 8041983 - DNA, 22 bp, Homo sapiens
ccacagagagtgtcagcctttg

SEQ ID NO: 8041984 - DNA, 22 bp, Homo sapiens
cattggtcttctaacagagaga

SEQ ID NO: 8041985 - DNA, 22 bp, Homo sapiens
cattgcacttctgcttttcctc

SEQ ID NO: 8041986 - DNA, 22 bp, Homo sapiens
aggacaagctaaaggacttcct

SEQ ID NO: 8041987 - DNA, 22 bp, Homo sapiens
cagtatcttgcttatagacaca

SEQ ID NO: 8041988 - DNA, 22 bp, Homo sapiens
caggctctgctgctacagctgt

SEQ ID NO: 8041989 - DNA, 22 bp, Homo sapiens
cctcctggtgggcgcttctggc

SEQ ID NO: 8041990 - DNA, 22 bp, Homo sapiens
cctcagggtggcatcagatctt

SEQ ID NO: 8041991 - DNA, 20 bp, Homo sapiens
agggctgagaagggactagc

SEQ ID NO: 8041992 - DNA, 22 bp, Homo sapiens
agggcccagtggagagctgagc

SEQ ID NO: 8041993 - DNA, 22 bp, Homo sapiens
agggcccatgtgggagcacttg

SEQ ID NO: 8041994 - DNA, 22 bp, Homo sapiens
ccctggcatgcatgtccctggc

SEQ ID NO: 8041995 - DNA, 22 bp, Homo sapiens
ccctggcataaaacttctccag

SEQ ID NO: 8041996 - DNA, 19 bp, Homo sapiens
ccctggcaggcaagcctgg

SEQ ID NO: 8041997 - DNA, 22 bp, Homo sapiens
ccctggcagaatgtctctgggc

SEQ ID NO: 8041998 - DNA, 22 bp, Homo sapiens
ccctggcagagggggcaggtgc

SEQ ID NO: 8041999 - DNA, 22 bp, Homo sapiens
cctacacatctcacctcacagg

SEQ ID NO: 8042000 - DNA, 23 bp, Homo sapiens
agggcccaagcctggacagcagg

SEQ ID NO: 8042001 - DNA, 22 bp, Homo sapiens
agggccacagtggggcctgaga

SEQ ID NO: 8042002 - DNA, 22 bp, Homo sapiens
cccaggcctggtctgggccagt

SEQ ID NO: 8042003 - DNA, 17 bp, Homo sapiens
cccaggccgccgggagc

SEQ ID NO: 8042004 - DNA, 22 bp, Homo sapiens
agggactccctgggccgacacg

SEQ ID NO: 8042005 - DNA, 22 bp, Homo sapiens
cccaggccagaacttggttgct

SEQ ID NO: 8042006 - DNA, 22 bp, Homo sapiens
agggaatggatgatggcaggtt

SEQ ID NO: 8042007 - DNA, 22 bp, Homo sapiens
aggctttggggcattctgtgtt

SEQ ID NO: 8042008 - DNA, 22 bp, Homo sapiens
ccaggaggtgctggaagaaagc

SEQ ID NO: 8042009 - DNA, 22 bp, Homo sapiens
cccaccctgggaagctaggcag

SEQ ID NO: 8042010 - DNA, 20 bp, Homo sapiens
ctgggctcaagtgatcctcc

SEQ ID NO: 8042011 - DNA, 20 bp, Homo sapiens
atcaaaggctgattcagtcc

SEQ ID NO: 8042012 - DNA, 22 bp, Homo sapiens
atatttaaacagggtaccaata

SEQ ID NO: 8042013 - DNA, 22 bp, Homo sapiens
atcagaaaaacataatgttatt

SEQ ID NO: 8042014 - DNA, 22 bp, Homo sapiens
atcaacatgtcataaagtgaaa

SEQ ID NO: 8042015 - DNA, 22 bp, Homo sapiens
atcagaaagttcatcatgtttg

SEQ ID NO: 8042016 - DNA, 22 bp, Homo sapiens
atcagaaatagtcatgttactt

SEQ ID NO: 8042017 - DNA, 22 bp, Homo sapiens
atcagaatactatcaacagtga

SEQ ID NO: 8042018 - DNA, 22 bp, Homo sapiens
atcagaataattagatttcaga

SEQ ID NO: 8042019 - DNA, 18 bp, Homo sapiens
cttcctcatcgctctccc

SEQ ID NO: 8042020 - DNA, 22 bp, Homo sapiens
cttcctcatgtgcaatgcaagc

SEQ ID NO: 8042021 - DNA, 22 bp, Homo sapiens
cttcctcacggtgcaacaggaa

SEQ ID NO: 8042022 - DNA, 22 bp, Homo sapiens
cttcctcaggcattagctggac

SEQ ID NO: 8042023 - DNA, 22 bp, Homo sapiens
atcagaatgattagtaaccaat

SEQ ID NO: 8042024 - DNA, 22 bp, Homo sapiens
atcagaatcttctgaacagtgg

SEQ ID NO: 8042025 - DNA, 22 bp, Homo sapiens
atcagaatgcagccagcagtta

SEQ ID NO: 8042026 - DNA, 22 bp, Homo sapiens
atcagaattagccagtgaggct

SEQ ID NO: 8042027 - DNA, 22 bp, Homo sapiens
atccaggcgaatgcagaaggcc

SEQ ID NO: 8042028 - DNA, 22 bp, Homo sapiens
atccaggccccaagaccccgac

SEQ ID NO: 8042029 - DNA, 22 bp, Homo sapiens
atactaagctcattacattttg

SEQ ID NO: 8042030 - DNA, 22 bp, Homo sapiens
ctggctcccgtctggtggccat

SEQ ID NO: 8042031 - DNA, 22 bp, Homo sapiens
ctggctcccggggatcgagcac

SEQ ID NO: 8042032 - DNA, 22 bp, Homo sapiens
ctggctccatctttgcttcctg

SEQ ID NO: 8042033 - DNA, 22 bp, Homo sapiens
atagcaattaagctccagaatt

SEQ ID NO: 8042034 - DNA, 22 bp, Homo sapiens
ctggaatgtagagacagcttag

SEQ ID NO: 8042035 - DNA, 19 bp, Homo sapiens
ctggaatgatagagacctc

SEQ ID NO: 8042036 - DNA, 22 bp, Homo sapiens
ctggaatgagcagggcttatgg

SEQ ID NO: 8042037 - DNA, 22 bp, Homo sapiens
atacatgttcgtgtacatgttc

SEQ ID NO: 8042038 - DNA, 22 bp, Homo sapiens
ctgcaaataggggtgtgaataa

SEQ ID NO: 8042039 - DNA, 22 bp, Homo sapiens
ctgcaaatcaagttcttataat

SEQ ID NO: 8042040 - DNA, 22 bp, Homo sapiens
ctgcagagatgaagaaggtggc

SEQ ID NO: 8042041 - DNA, 22 bp, Homo sapiens
ataacagatgtgaagtgctaat

SEQ ID NO: 8042042 - DNA, 22 bp, Homo sapiens
ctgctgcaactctttagagggt

SEQ ID NO: 8042043 - DNA, 22 bp, Homo sapiens
aggtccctgcagcagactgcca

SEQ ID NO: 8042044 - DNA, 23 bp, Homo sapiens
cctgcagctgccacgccctgctc

SEQ ID NO: 8042045 - DNA, 18 bp, Homo sapiens
cctgcagcccaggaggcc

SEQ ID NO: 8042046 - DNA, 22 bp, Homo sapiens
aggtagggaagaaggcatgaaa

SEQ ID NO: 8042047 - DNA, 22 bp, Homo sapiens
cctggctctgcgtgcagctccg

SEQ ID NO: 8042048 - DNA, 22 bp, Homo sapiens
cctgtcagttgctgtcagggat

SEQ ID NO: 8042049 - DNA, 22 bp, Homo sapiens
cgggcaaggcgagactaggccc

SEQ ID NO: 8042050 - DNA, 20 bp, Homo sapiens
cggctcagcctctccctccc

SEQ ID NO: 8042051 - DNA, 22 bp, Homo sapiens
cgcagcttcagggccaggaggg

SEQ ID NO: 8042052 - DNA, 22 bp, Homo sapiens
ctcctcagaagagggtaacaca

SEQ ID NO: 8042053 - DNA, 18 bp, Homo sapiens
ctcctggctgatggtgag

SEQ ID NO: 8042054 - DNA, 22 bp, Homo sapiens
ctcctggctcgcccccagctga

SEQ ID NO: 8042055 - DNA, 22 bp, Homo sapiens
ctccctcaggccttagccctgc

SEQ ID NO: 8042056 - DNA, 22 bp, Homo sapiens
ctctcagaagtttatgtcagaa

SEQ ID NO: 8042057 - DNA, 22 bp, Homo sapiens
ctcctggctttcccagaccagg

SEQ ID NO: 8042058 - DNA, 22 bp, Homo sapiens
ctccaggctcgtccaagatcga

SEQ ID NO: 8042059 - DNA, 22 bp, Homo sapiens
ctgagaaaagctttcttataca

SEQ ID NO: 8042060 - DNA, 22 bp, Homo sapiens
ctgagcagcacagggcgccagg

SEQ ID NO: 8042061 - DNA, 22 bp, Homo sapiens
ctgagaaacatatttccatcta

SEQ ID NO: 8042062 - DNA, 22 bp, Homo sapiens
ctgagaaaggacctcaaacagg

SEQ ID NO: 8042063 - DNA, 22 bp, Homo sapiens
ctctgagcagaggccgtggcta

SEQ ID NO: 8042064 - DNA, 22 bp, Homo sapiens
cagagggctgtgtaaggatgtt

SEQ ID NO: 8042065 - DNA, 22 bp, Homo sapiens
cagagacaggaatcagctgcag

SEQ ID NO: 8042066 - DNA, 22 bp, Homo sapiens
cagagacaggatctcgaagact

SEQ ID NO: 8042067 - DNA, 22 bp, Homo sapiens
gtccctggggaatcagctggag

SEQ ID NO: 8042068 - DNA, 22 bp, Homo sapiens
gtctggaaggaggagatggagc

SEQ ID NO: 8042069 - DNA, 23 bp, Homo sapiens
cagccctggagatgtgggaggca

SEQ ID NO: 8042070 - DNA, 22 bp, Homo sapiens
cagccctggaacagctgactca

SEQ ID NO: 8042071 - DNA, 22 bp, Homo sapiens
cagccctgaaacaacctcctct

SEQ ID NO: 8042072 - DNA, 22 bp, Homo sapiens
cagccctgccatggagcctcct

SEQ ID NO: 8042073 - DNA, 22 bp, Homo sapiens
cagccctgctgacactgtctga

SEQ ID NO: 8042074 - DNA, 22 bp, Homo sapiens
cagccctgctcttagtgtctcc

SEQ ID NO: 8042075 - DNA, 22 bp, Homo sapiens
cagccctgctggcaatgatgag

SEQ ID NO: 8042076 - DNA, 22 bp, Homo sapiens
cagccctgcttccccgctagtt

SEQ ID NO: 8042077 - DNA, 22 bp, Homo sapiens
gtgccctcctgaagccatcaca

SEQ ID NO: 8042078 - DNA, 22 bp, Homo sapiens
gtgccctcacaaagtggaaaga

SEQ ID NO: 8042079 - DNA, 22 bp, Homo sapiens
gtgccctcatgaaacgaaggat

SEQ ID NO: 8042080 - DNA, 22 bp, Homo sapiens
ggctgccctcggggtcgcaggc

SEQ ID NO: 8042081 - DNA, 22 bp, Homo sapiens
cagaaagacctgggctcaagag

SEQ ID NO: 8042082 - DNA, 22 bp, Homo sapiens
cagaaaataaacatttgtggaa

SEQ ID NO: 8042083 - DNA, 19 bp, Homo sapiens
ggctcagggcgctgccgcc

SEQ ID NO: 8042084 - DNA, 22 bp, Homo sapiens
ggcagggagagcatgctgataa

SEQ ID NO: 8042085 - DNA, 22 bp, Homo sapiens
cacgcatttattcacgtattcg

SEQ ID NO: 8042086 - DNA, 22 bp, Homo sapiens
caagggaagaggacagggacct

SEQ ID NO: 8042087 - DNA, 22 bp, Homo sapiens
caagtcaaagactagaactagt

SEQ ID NO: 8042088 - DNA, 22 bp, Homo sapiens
gctttcttagtgtgttaattgg

SEQ ID NO: 8042089 - DNA, 22 bp, Homo sapiens
gctttcttttcaagaatgtatt

SEQ ID NO: 8042090 - DNA, 22 bp, Homo sapiens
cacagaggtctgggcccagcag

SEQ ID NO: 8042091 - DNA, 23 bp, Homo sapiens
ggagcctccggtgtgtgagaggc

SEQ ID NO: 8042092 - DNA, 22 bp, Homo sapiens
ggagcctgaaaagtctgcattt

SEQ ID NO: 8042093 - DNA, 22 bp, Homo sapiens
cacagaggctcaaagccaggtg

SEQ ID NO: 8042094 - DNA, 22 bp, Homo sapiens
cacagaggagtgcacactctct

SEQ ID NO: 8042095 - DNA, 22 bp, Homo sapiens
cacagaggatgcccaagcgatc

SEQ ID NO: 8042096 - DNA, 22 bp, Homo sapiens
cacagaactggttaatagcaga

SEQ ID NO: 8042097 - DNA, 22 bp, Homo sapiens
gataatgttaagtcataggcta

SEQ ID NO: 8042098 - DNA, 22 bp, Homo sapiens
gataatgtggatttattgtgat

SEQ ID NO: 8042099 - DNA, 22 bp, Homo sapiens
gataatggggaatgataagtca

SEQ ID NO: 8042100 - DNA, 22 bp, Homo sapiens
gataatgtaattttatgttcac

SEQ ID NO: 8042101 - DNA, 22 bp, Homo sapiens
gataatgtgccgataatttcta

SEQ ID NO: 8042102 - DNA, 22 bp, Homo sapiens
gatatgtaccacctcttaaaag

SEQ ID NO: 8042103 - DNA, 22 bp, Homo sapiens
gagggctcaactactactaggc

SEQ ID NO: 8042104 - DNA, 22 bp, Homo sapiens
gagggctctaccaagtaactct

SEQ ID NO: 8042105 - DNA, 20 bp, Homo sapiens
gagggctcgtggatggataa

SEQ ID NO: 8042106 - DNA, 22 bp, Homo sapiens
gagggctcactgagaaagcagt

SEQ ID NO: 8042107 - DNA, 22 bp, Homo sapiens
atgtagaatggtgattggcagg

SEQ ID NO: 8042108 - DNA, 22 bp, Homo sapiens
atggaggatgtgcagcatgggc

SEQ ID NO: 8042109 - DNA, 22 bp, Homo sapiens
gagatggccagtgccaggacaa

SEQ ID NO: 8042110 - DNA, 22 bp, Homo sapiens
atgggaaggttttgagagcggg

SEQ ID NO: 8042111 - DNA, 22 bp, Homo sapiens
atgggaagtgttagaagatttt

SEQ ID NO: 8042112 - DNA, 22 bp, Homo sapiens
gaggaaggctaaggggcttaga

SEQ ID NO: 8042113 - DNA, 22 bp, Homo sapiens
atggtggatttgtgattcagct

SEQ ID NO: 8042114 - DNA, 22 bp, Homo sapiens
atggtggacgggagacaggact

SEQ ID NO: 8042115 - DNA, 22 bp, Homo sapiens
atggtggactcttgattcaggc

SEQ ID NO: 8042116 - DNA, 22 bp, Homo sapiens
gaggcacatatatacagagccc

SEQ ID NO: 8042117 - DNA, 22 bp, Homo sapiens
gacactcagtaggacttcaagg

SEQ ID NO: 8042118 - DNA, 22 bp, Homo sapiens
gaacaaacacatcccagcagtg

SEQ ID NO: 8042119 - DNA, 22 bp, Homo sapiens
atgcacagacccaaaggccatc

SEQ ID NO: 8042120 - DNA, 22 bp, Homo sapiens
atgcacagaacaattttaagag

SEQ ID NO: 8042121 - DNA, 22 bp, Homo sapiens
atgcacaggtgctgatgcacgc

SEQ ID NO: 8042122 - DNA, 22 bp, Homo sapiens
atgcacaggctgtgggctggtt

SEQ ID NO: 8042123 - DNA, 22 bp, Homo sapiens
gacaatatagttgaatgagcaa

SEQ ID NO: 8042124 - DNA, 22 bp, Homo sapiens
atgaaacaaacctctatggagt

SEQ ID NO: 8042125 - DNA, 22 bp, Homo sapiens
atgaaaatgtacatgtgtataa

SEQ ID NO: 8042126 - DNA, 22 bp, Homo sapiens
gaaaatgttagcttcatagtca

SEQ ID NO: 8042127 - DNA, 23 bp, Homo sapiens
gaaagtcaatatggtagctttga

SEQ ID NO: 8042128 - DNA, 22 bp, Homo sapiens
gatatgtattgaatgatcattt

SEQ ID NO: 8042129 - DNA, 22 bp, Homo sapiens
gatatgtattccactataaagg

SEQ ID NO: 8042130 - DNA, 22 bp, Homo sapiens
gatatgtatgaggagtatgtat

SEQ ID NO: 8042131 - DNA, 18 bp, Homo sapiens
gcaccttaccaattctac

SEQ ID NO: 8042132 - DNA, 22 bp, Homo sapiens
attcacctttccccaaaatgag

SEQ ID NO: 8042133 - DNA, 22 bp, Homo sapiens
attgtgaattgagagtacttct

SEQ ID NO: 8042134 - DNA, 22 bp, Homo sapiens
attgcaaaattgtcctgtggaa

SEQ ID NO: 8042135 - DNA, 22 bp, Homo sapiens
caaagctgatactcagcaagta

SEQ ID NO: 8042136 - DNA, 22 bp, Homo sapiens
caaagaggttttgagggcagct

SEQ ID NO: 8042137 - DNA, 22 bp, Homo sapiens
caaaattctgcatttctaataa

SEQ ID NO: 8042138 - DNA, 22 bp, Homo sapiens
caaaatgtgagtcccacctcaa

SEQ ID NO: 8042139 - DNA, 22 bp, Homo sapiens
caaaatgttctggcacctttaa

SEQ ID NO: 8042140 - DNA, 22 bp, Homo sapiens
attttgtttcctttggagtaga

SEQ ID NO: 8042141 - DNA, 22 bp, Homo sapiens
attttgctttatgtaaatatgt

SEQ ID NO: 8042142 - DNA, 22 bp, Homo sapiens
attttactttgtgaatattgac

SEQ ID NO: 8042143 - DNA, 22 bp, Homo sapiens
gcctggcacagtagggacccaa

SEQ ID NO: 8042144 - DNA, 22 bp, Homo sapiens
gcctggcaaggccctgttgact

SEQ ID NO: 8042145 - DNA, 22 bp, Homo sapiens
gcctggcacaggaattaggagg

SEQ ID NO: 8042146 - DNA, 22 bp, Homo sapiens
gcctggcaatggcctcaggaag

SEQ ID NO: 8042147 - DNA, 22 bp, Homo sapiens
atttggaatagctgtagaaata

SEQ ID NO: 8042148 - DNA, 22 bp, Homo sapiens
atttggaagcatttccaaagca

SEQ ID NO: 8042149 - DNA, 22 bp, Homo sapiens
atttggaaggtttacaaagaga

SEQ ID NO: 8042150 - DNA, 22 bp, Homo sapiens
atttggaaaagtttcttcaact

SEQ ID NO: 8042151 - DNA, 22 bp, Homo sapiens
atttggaaaatctggttataga

SEQ ID NO: 8042152 - DNA, 17 bp, Homo sapiens
gcccacccttaggagct

SEQ ID NO: 8042153 - DNA, 23 bp, Homo sapiens
gcccaccctcagcgtcctcacgg

SEQ ID NO: 8042154 - DNA, 22 bp, Homo sapiens
gccacaggtactatgggagaga

SEQ ID NO: 8042155 - DNA, 22 bp, Homo sapiens
ccaggaggttgaggctgcagtg

SEQ ID NO: 8042156 - DNA, 22 bp, Homo sapiens
ccaggcccagggtactgaccaa

SEQ ID NO: 8042157 - DNA, 22 bp, Homo sapiens
tctcagagaacagttggtgctt

SEQ ID NO: 8042158 - DNA, 22 bp, Homo sapiens
tctggcagcagcatcagtggct

SEQ ID NO: 8042159 - DNA, 22 bp, Homo sapiens
tctggcagcaagtctgtttctc

SEQ ID NO: 8042160 - DNA, 22 bp, Homo sapiens
tctggcaggggttctgcacttg

SEQ ID NO: 8042161 - DNA, 22 bp, Homo sapiens
tctggcaggggttctgcacttg

SEQ ID NO: 8042162 - DNA, 22 bp, Homo sapiens
tctggcaggccttgtcaatctg

SEQ ID NO: 8042163 - DNA, 22 bp, Homo sapiens
tctggcaggcaatcggctctgg

SEQ ID NO: 8042164 - DNA, 21 bp, Homo sapiens
tctggcaggcacgggcccagc

SEQ ID NO: 8042165 - DNA, 22 bp, Homo sapiens
tctggcaggacatgctgaccat

SEQ ID NO: 8042166 - DNA, 22 bp, Homo sapiens
tctggcaggatatcgaagtgaa

SEQ ID NO: 8042167 - DNA, 22 bp, Homo sapiens
tctggcaggaccatgaagcgta

SEQ ID NO: 8042168 - DNA, 21 bp, Homo sapiens
tctggcagcagtttgttgagt

SEQ ID NO: 8042169 - DNA, 22 bp, Homo sapiens
tctggcagcgaagcgtgtactt

SEQ ID NO: 8042170 - DNA, 22 bp, Homo sapiens
tctggcagctatcctctggcca

SEQ ID NO: 8042171 - DNA, 22 bp, Homo sapiens
tctggcagctatcctctggcca

SEQ ID NO: 8042172 - DNA, 21 bp, Homo sapiens
tctggcaggaagacggatggg

SEQ ID NO: 8042173 - DNA, 22 bp, Homo sapiens
tctggcagctctcctcggcgga

SEQ ID NO: 8042174 - DNA, 22 bp, Homo sapiens
tctggcagctcagttcaggtct

SEQ ID NO: 8042175 - DNA, 21 bp, Homo sapiens
ccaggaaggactgagctccct

SEQ ID NO: 8042176 - DNA, 22 bp, Homo sapiens
tctgggagcctgaaagtgaatg

SEQ ID NO: 8042177 - DNA, 22 bp, Homo sapiens
ccattcatacaattttgttcta

SEQ ID NO: 8042178 - DNA, 22 bp, Homo sapiens
tgcaaatacaaaatggtacagc

SEQ ID NO: 8042179 - DNA, 22 bp, Homo sapiens
tgcaaataaatttctgttcatt

SEQ ID NO: 8042180 - DNA, 22 bp, Homo sapiens
cccaccctcaagggtgtctata

SEQ ID NO: 8042181 - DNA, 22 bp, Homo sapiens
tgcaaatagcctatatttatag

SEQ ID NO: 8042182 - DNA, 22 bp, Homo sapiens
tgacaacagccatcacttttag

SEQ ID NO: 8042183 - DNA, 22 bp, Homo sapiens
tgacataataatccaaacatac

SEQ ID NO: 8042184 - DNA, 22 bp, Homo sapiens
tgaggcagaaaatagcagttca

SEQ ID NO: 8042185 - DNA, 22 bp, Homo sapiens
tgagacagttctgcagctgggt

SEQ ID NO: 8042186 - DNA, 22 bp, Homo sapiens
tgagacagttggtgaaatctaa

SEQ ID NO: 8042187 - DNA, 22 bp, Homo sapiens
tgagacagtttttctatttcca

SEQ ID NO: 8042188 - DNA, 22 bp, Homo sapiens
tgagacatgtgaatatttgtac

SEQ ID NO: 8042189 - DNA, 23 bp, Homo sapiens
cccctctggtggctcagctcctg

SEQ ID NO: 8042190 - DNA, 22 bp, Homo sapiens
cccgagtgtctactcactccca

SEQ ID NO: 8042191 - DNA, 22 bp, Homo sapiens
ccccaccctcgctccatttcgg

SEQ ID NO: 8042192 - DNA, 22 bp, Homo sapiens
ccccacccacctaagagaaact

SEQ ID NO: 8042193 - DNA, 22 bp, Homo sapiens
ccctgagaggttgagtgtctgc

SEQ ID NO: 8042194 - DNA, 22 bp, Homo sapiens
ccctgagcgtgaggaggaagta

SEQ ID NO: 8042195 - DNA, 22 bp, Homo sapiens
ccctgagctcaggcccttgggg

SEQ ID NO: 8042196 - DNA, 19 bp, Homo sapiens
ccctcttgcacaaagcaaa

SEQ ID NO: 8042197 - DNA, 22 bp, Homo sapiens
cccaggagacatatagaaggac

SEQ ID NO: 8042198 - DNA, 22 bp, Homo sapiens
cccaggagacctgtgaaaggac

SEQ ID NO: 8042199 - DNA, 22 bp, Homo sapiens
cccaggagagaggccagttggc

SEQ ID NO: 8042200 - DNA, 22 bp, Homo sapiens
cccaggagagaggggataaagc

SEQ ID NO: 8042201 - DNA, 22 bp, Homo sapiens
tgccctggggagcccagccagg

SEQ ID NO: 8042202 - DNA, 21 bp, Homo sapiens
cccagggaagccgcagtcacc

SEQ ID NO: 8042203 - DNA, 22 bp, Homo sapiens
cccagggtagctgagctggcag

SEQ ID NO: 8042204 - DNA, 21 bp, Homo sapiens
cctagcctcttacccagcttt

SEQ ID NO: 8042205 - DNA, 18 bp, Homo sapiens
cctagcctccaagctcat

SEQ ID NO: 8042206 - DNA, 22 bp, Homo sapiens
cccttcctgggtgtcccggagt

SEQ ID NO: 8042207 - DNA, 22 bp, Homo sapiens
cccttccttgattttaactgga

SEQ ID NO: 8042208 - DNA, 22 bp, Homo sapiens
cccttcctcccaggcttctgtg

SEQ ID NO: 8042209 - DNA, 22 bp, Homo sapiens
cccttccttgtgactggtgggg

SEQ ID NO: 8042210 - DNA, 22 bp, Homo sapiens
cctcagagttggaatcacattt

SEQ ID NO: 8042211 - DNA, 22 bp, Homo sapiens
cctcaggctgtcttccttctgg

SEQ ID NO: 8042212 - DNA, 22 bp, Homo sapiens
cctcaggcttgtgagccttcag

SEQ ID NO: 8042213 - DNA, 22 bp, Homo sapiens
cctcaggctgctcacacttgtc

SEQ ID NO: 8042214 - DNA, 22 bp, Homo sapiens
cctcaggctgggctgcccctgg

SEQ ID NO: 8042215 - DNA, 19 bp, Homo sapiens
cctcttcctctgacactat

SEQ ID NO: 8042216 - DNA, 22 bp, Homo sapiens
tgggctctagactttagtgtgg

SEQ ID NO: 8042217 - DNA, 22 bp, Homo sapiens
cagggtagacagtaggtgtctg

SEQ ID NO: 8042218 - DNA, 22 bp, Homo sapiens
cagggcccaggccactgggttg

SEQ ID NO: 8042219 - DNA, 22 bp, Homo sapiens
cagggcccagtccctgctgtca

SEQ ID NO: 8042220 - DNA, 22 bp, Homo sapiens
cagggcccatggctcaggtagg

SEQ ID NO: 8042221 - DNA, 22 bp, Homo sapiens
cagggagcaggctctgtccatc

SEQ ID NO: 8042222 - DNA, 22 bp, Homo sapiens
cagggagatcttggctcctggt

SEQ ID NO: 8042223 - DNA, 22 bp, Homo sapiens
cagggagcagcccctagaagta

SEQ ID NO: 8042224 - DNA, 22 bp, Homo sapiens
caggtcagaggcgcagccccca

SEQ ID NO: 8042225 - DNA, 22 bp, Homo sapiens
tcaagctattggctgaggctgc

SEQ ID NO: 8042226 - DNA, 22 bp, Homo sapiens
caggtgggtgtatgaatgcaaa

SEQ ID NO: 8042227 - DNA, 22 bp, Homo sapiens
cagtattttcaggatttggaag

SEQ ID NO: 8042228 - DNA, 22 bp, Homo sapiens
cagtcagggacaccagctagga

SEQ ID NO: 8042229 - DNA, 22 bp, Homo sapiens
tagaaaatgttccactgccatt

SEQ ID NO: 8042230 - DNA, 22 bp, Homo sapiens
tagaaaatggccaagcaggact

SEQ ID NO: 8042231 - DNA, 22 bp, Homo sapiens
tagaaaatccagtgtggggaga

SEQ ID NO: 8042232 - DNA, 22 bp, Homo sapiens
tagaaaatagggcctgtggagc

SEQ ID NO: 8042233 - DNA, 22 bp, Homo sapiens
cagggacaatggcagagcctga

SEQ ID NO: 8042234 - DNA, 22 bp, Homo sapiens
cagggacagcactaaactcttg

SEQ ID NO: 8042235 - DNA, 22 bp, Homo sapiens
tacaaaagtaattacggttttt

SEQ ID NO: 8042236 - DNA, 22 bp, Homo sapiens
tacaaaaggaagagggatctta

SEQ ID NO: 8042237 - DNA, 22 bp, Homo sapiens
tacaaaaaattgatactgacga

SEQ ID NO: 8042238 - DNA, 22 bp, Homo sapiens
caggcattgccattcctccaga

SEQ ID NO: 8042239 - DNA, 22 bp, Homo sapiens
taatgtcaaggtgatagatttg

SEQ ID NO: 8042240 - DNA, 22 bp, Homo sapiens
taatccaaaactgaatctgtgg

SEQ ID NO: 8042241 - DNA, 22 bp, Homo sapiens
taatccaatggcacaatgtatg

SEQ ID NO: 8042242 - DNA, 22 bp, Homo sapiens
taatgtcaaggtcattctagag

SEQ ID NO: 8042243 - DNA, 20 bp, Homo sapiens
taatgtcaaagtcacaaggt

SEQ ID NO: 8042244 - DNA, 22 bp, Homo sapiens
taatgtataacaaatactcatc

SEQ ID NO: 8042245 - DNA, 22 bp, Homo sapiens
taatgtaaagaagatgtaggaa

SEQ ID NO: 8042246 - DNA, 22 bp, Homo sapiens
taatcacagaaacagactgttt

SEQ ID NO: 8042247 - DNA, 22 bp, Homo sapiens
tcagtcccaaggtcctgaggtg

SEQ ID NO: 8042248 - DNA, 22 bp, Homo sapiens
catgcattgtaatttttagtct

SEQ ID NO: 8042249 - DNA, 22 bp, Homo sapiens
cagttttctaaagtctctttaa

SEQ ID NO: 8042250 - DNA, 22 bp, Homo sapiens
tcagaggagctgcagaacgctg

SEQ ID NO: 8042251 - DNA, 22 bp, Homo sapiens
tcagaggagggactcagaccca

SEQ ID NO: 8042252 - DNA, 22 bp, Homo sapiens
tcagaggatagaaatacttatt

SEQ ID NO: 8042253 - DNA, 22 bp, Homo sapiens
tcagaggatcatgtccctactc

SEQ ID NO: 8042254 - DNA, 18 bp, Homo sapiens
tcagaggagatacctaaa

SEQ ID NO: 8042255 - DNA, 22 bp, Homo sapiens
tcagaggagccaaagttctgag

SEQ ID NO: 8042256 - DNA, 22 bp, Homo sapiens
tcagaggagcaaaagaggggat

SEQ ID NO: 8042257 - DNA, 22 bp, Homo sapiens
tcagaggatgctgttctttaat

SEQ ID NO: 8042258 - DNA, 22 bp, Homo sapiens
tcaatatagcagtgtacttgag

SEQ ID NO: 8042259 - DNA, 22 bp, Homo sapiens
tcaatatattccatgttttctc

SEQ ID NO: 8042260 - DNA, 21 bp, Homo sapiens
tcagagagtcacagtgaactg

SEQ ID NO: 8042261 - DNA, 22 bp, Homo sapiens
tcaggccctttgctgctgcccc

SEQ ID NO: 8042262 - DNA, 22 bp, Homo sapiens
tcaggccccttgtcagctctgt

SEQ ID NO: 8042263 - DNA, 22 bp, Homo sapiens
tcaggcccttctcccaggactc

SEQ ID NO: 8042264 - DNA, 22 bp, Homo sapiens
tcaggcccagagtcacggatcc

SEQ ID NO: 8042265 - DNA, 22 bp, Homo sapiens
cataatgttgtaacacatagag

SEQ ID NO: 8042266 - DNA, 22 bp, Homo sapiens
cataatgtgtgtcatacagact

SEQ ID NO: 8042267 - DNA, 22 bp, Homo sapiens
cataatgttaatcttgactcca

SEQ ID NO: 8042268 - DNA, 22 bp, Homo sapiens
cataatgtatgcattttccagc

SEQ ID NO: 8042269 - DNA, 22 bp, Homo sapiens
cataatgtctgacacagtaaga

SEQ ID NO: 8042270 - DNA, 22 bp, Homo sapiens
cataacatccttgctactttga

SEQ ID NO: 8042271 - DNA, 22 bp, Homo sapiens
cattcatttgcccagtaagtca

SEQ ID NO: 8042272 - DNA, 22 bp, Homo sapiens
tcccaccccttgactctttaag

SEQ ID NO: 8042273 - DNA, 22 bp, Homo sapiens
tcccaccccggtcaagggctga

SEQ ID NO: 8042274 - DNA, 22 bp, Homo sapiens
tcccaccccctccaaggaggaa

SEQ ID NO: 8042275 - DNA, 22 bp, Homo sapiens
tcccacccatcctgcatctctt

SEQ ID NO: 8042276 - DNA, 22 bp, Homo sapiens
tccattttcatctcatgtataa

SEQ ID NO: 8042277 - DNA, 22 bp, Homo sapiens
tccattttctaagtatcactta

SEQ ID NO: 8042278 - DNA, 22 bp, Homo sapiens
tccctggggttcctccagccac

SEQ ID NO: 8042279 - DNA, 22 bp, Homo sapiens
tccctcctggccgtcaccgctg

SEQ ID NO: 8042280 - DNA, 22 bp, Homo sapiens
tccttgtaaaggagctctaaca

SEQ ID NO: 8042281 - DNA, 22 bp, Homo sapiens
tccttcctgctctaacattcag

SEQ ID NO: 8042282 - DNA, 22 bp, Homo sapiens
tccttcccaggtgtcgccgcct

SEQ ID NO: 8042283 - DNA, 22 bp, Homo sapiens
ccaagggaaaccgagaggctgg

SEQ ID NO: 8042284 - DNA, 22 bp, Homo sapiens
tcctggcactttgggggctcgc

SEQ ID NO: 8042285 - DNA, 22 bp, Homo sapiens
tcctggcacccttgggttggag

SEQ ID NO: 8042286 - DNA, 22 bp, Homo sapiens
tcctggcagaaatggggctgtg

SEQ ID NO: 8042287 - DNA, 22 bp, Homo sapiens
tcctggcagagggcggcctcga

SEQ ID NO: 8042288 - DNA, 20 bp, Homo sapiens
tcctaataacctgaagaaat

SEQ ID NO: 8042289 - DNA, 22 bp, Homo sapiens
tcctggcagcccgcaggtgctg

SEQ ID NO: 8042290 - DNA, 22 bp, Homo sapiens
tcctggcagggtctaggtctag

SEQ ID NO: 8042291 - DNA, 22 bp, Homo sapiens
tcctggcagtaatttgatgttg

SEQ ID NO: 8042292 - DNA, 21 bp, Homo sapiens
ctgcaaatacctagttatctg

SEQ ID NO: 8042293 - DNA, 22 bp, Homo sapiens
ctgcacagtggacagtgaagat

SEQ ID NO: 8042294 - DNA, 22 bp, Homo sapiens
ctgcacagtgttggaagctgcc

SEQ ID NO: 8042295 - DNA, 22 bp, Homo sapiens
ctgagccagggccacacatgga

SEQ ID NO: 8042296 - DNA, 19 bp, Homo sapiens
ctgagcctcagtttcctag

SEQ ID NO: 8042297 - DNA, 22 bp, Homo sapiens
ttttagttactgcagtagcaaa

SEQ ID NO: 8042298 - DNA, 22 bp, Homo sapiens
tttgggaaccagaagttcaaaa

SEQ ID NO: 8042299 - DNA, 22 bp, Homo sapiens
tttcctttatgacatcaccact

SEQ ID NO: 8042300 - DNA, 22 bp, Homo sapiens
ctctgccatcttggagctcaag

SEQ ID NO: 8042301 - DNA, 22 bp, Homo sapiens
tttgcaaagtgcttgcagagta

SEQ ID NO: 8042302 - DNA, 22 bp, Homo sapiens
ctctgcccgcggatgccacgtc

SEQ ID NO: 8042303 - DNA, 22 bp, Homo sapiens
ctctgcccgtgcctttcccagt

SEQ ID NO: 8042304 - DNA, 22 bp, Homo sapiens
ctctgcccagtgcccacaggag

SEQ ID NO: 8042305 - DNA, 21 bp, Homo sapiens
ctctgcccagggcctcctgcc

SEQ ID NO: 8042306 - DNA, 21 bp, Homo sapiens
ttgaaagtaaattcagcagct

SEQ ID NO: 8042307 - DNA, 22 bp, Homo sapiens
ttgaaagtctaggcttacagta

SEQ ID NO: 8042308 - DNA, 22 bp, Homo sapiens
ttgaaagtaataactttgttca

SEQ ID NO: 8042309 - DNA, 22 bp, Homo sapiens
ttgaaagtgatggggaagatgg

SEQ ID NO: 8042310 - DNA, 22 bp, Homo sapiens
ttgaaagttaggatttagctgg

SEQ ID NO: 8042311 - DNA, 22 bp, Homo sapiens
ttgaaatagatgcgtcagagat

SEQ ID NO: 8042312 - DNA, 22 bp, Homo sapiens
tttaatatctcacacttccatg

SEQ ID NO: 8042313 - DNA, 22 bp, Homo sapiens
tttaatatttctttcctgaagc

SEQ ID NO: 8042314 - DNA, 18 bp, Homo sapiens
ctcctccacagcccctgc

SEQ ID NO: 8042315 - DNA, 22 bp, Homo sapiens
ctcctggcactcagtgtggaag

SEQ ID NO: 8042316 - DNA, 22 bp, Homo sapiens
ctcctggcagttccccttgtca

SEQ ID NO: 8042317 - DNA, 22 bp, Homo sapiens
ctcctggcactgtcttgaccca

SEQ ID NO: 8042318 - DNA, 22 bp, Homo sapiens
ctcctggcaggctgagtgaaat

SEQ ID NO: 8042319 - DNA, 22 bp, Homo sapiens
tttcctcaactgtcaaatgggg

SEQ ID NO: 8042320 - DNA, 22 bp, Homo sapiens
tttcctcacacagaagatcttg

SEQ ID NO: 8042321 - DNA, 22 bp, Homo sapiens
tttcctcactcatgtcatcagt

SEQ ID NO: 8042322 - DNA, 22 bp, Homo sapiens
tttccttgcctcctgtccttct

SEQ ID NO: 8042323 - DNA, 22 bp, Homo sapiens
cctgggctgggcgtctcatggg

SEQ ID NO: 8042324 - DNA, 22 bp, Homo sapiens
ccttcctggagcccatgcagat

SEQ ID NO: 8042325 - DNA, 19 bp, Homo sapiens
ccttcctccccagggccat

SEQ ID NO: 8042326 - DNA, 22 bp, Homo sapiens
cctttctctttgctgatcatgt

SEQ ID NO: 8042327 - DNA, 22 bp, Homo sapiens
cgccccggacgtctgaccaaac

SEQ ID NO: 8042328 - DNA, 22 bp, Homo sapiens
ctacaggtatgtgcatgacatc

SEQ ID NO: 8042329 - DNA, 22 bp, Homo sapiens
ctacaggtcagtaagacctaga

SEQ ID NO: 8042330 - DNA, 22 bp, Homo sapiens
ctacagcagagctacactaact

SEQ ID NO: 8042331 - DNA, 22 bp, Homo sapiens
ctacagagaactcagctgccct

SEQ ID NO: 8042332 - DNA, 22 bp, Homo sapiens
ttccaggacttcatggctctga

SEQ ID NO: 8042333 - DNA, 22 bp, Homo sapiens
gaagatattctctaaatacttt

SEQ ID NO: 8042334 - DNA, 22 bp, Homo sapiens
gaagacatgtttttaatatgta

SEQ ID NO: 8042335 - DNA, 22 bp, Homo sapiens
gaacatttggcatgagaatttg

SEQ ID NO: 8042336 - DNA, 22 bp, Homo sapiens
gaagagaaaggcaaggagtttt

SEQ ID NO: 8042337 - DNA, 22 bp, Homo sapiens
gaacagtgccagcacacaataa

SEQ ID NO: 8042338 - DNA, 17 bp, Homo sapiens
gaacagtgtaagacact

SEQ ID NO: 8042339 - DNA, 22 bp, Homo sapiens
gaaatccagttccctactctta

SEQ ID NO: 8042340 - DNA, 22 bp, Homo sapiens
ctttcattcttagatattagtg

SEQ ID NO: 8042341 - DNA, 22 bp, Homo sapiens
ctttcagttacagttacacaca

SEQ ID NO: 8042342 - DNA, 22 bp, Homo sapiens
gacaagacacctctctccatcc

SEQ ID NO: 8042343 - DNA, 22 bp, Homo sapiens
gacaagacacctctctccatcc

SEQ ID NO: 8042344 - DNA, 17 bp, Homo sapiens
gacaagacagaattcat

SEQ ID NO: 8042345 - DNA, 17 bp, Homo sapiens
gacaagacagaattcat

SEQ ID NO: 8042346 - DNA, 22 bp, Homo sapiens
gacaagacagcttgcagacaac

SEQ ID NO: 8042347 - DNA, 22 bp, Homo sapiens
gacaagacagcttgcagacaac

SEQ ID NO: 8042348 - DNA, 22 bp, Homo sapiens
gacaagacattggtaaagatat

SEQ ID NO: 8042349 - DNA, 22 bp, Homo sapiens
gacaagactatgtagaaagtat

SEQ ID NO: 8042350 - DNA, 22 bp, Homo sapiens
gacaagactatgtagaaagtat

SEQ ID NO: 8042351 - DNA, 22 bp, Homo sapiens
gacaagacattggtaaagatat

SEQ ID NO: 8042352 - DNA, 22 bp, Homo sapiens
gacaagacatgtgatgacatca

SEQ ID NO: 8042353 - DNA, 22 bp, Homo sapiens
gacaagacatgtgatgacatca

SEQ ID NO: 8042354 - DNA, 22 bp, Homo sapiens
gacaagactggtttatttaagg

SEQ ID NO: 8042355 - DNA, 22 bp, Homo sapiens
gacaagactggtttatttaagg

SEQ ID NO: 8042356 - DNA, 22 bp, Homo sapiens
gagaattcttcaacaaagtatt

SEQ ID NO: 8042357 - DNA, 22 bp, Homo sapiens
gagatgagtgggggatctctca

SEQ ID NO: 8042358 - DNA, 22 bp, Homo sapiens
gaggagctgttccctcacctct

SEQ ID NO: 8042359 - DNA, 22 bp, Homo sapiens
gagccctgttcaggcctcctca

SEQ ID NO: 8042360 - DNA, 22 bp, Homo sapiens
gagcctgatgaaacaggcagac

SEQ ID NO: 8042361 - DNA, 22 bp, Homo sapiens
gagcttttcttccagttaatga

SEQ ID NO: 8042362 - DNA, 22 bp, Homo sapiens
cttccctttttatgtcttcagc

SEQ ID NO: 8042363 - DNA, 22 bp, Homo sapiens
cttgcacatttcacacaatagg

SEQ ID NO: 8042364 - DNA, 22 bp, Homo sapiens
cttcctgcccacttcctgctgg

SEQ ID NO: 8042365 - DNA, 22 bp, Homo sapiens
cttgacactgtcactcaggcca

SEQ ID NO: 8042366 - DNA, 22 bp, Homo sapiens
ctgtcctgcccaccctgcaggg

SEQ ID NO: 8042367 - DNA, 22 bp, Homo sapiens
ctgtcctctgtcctcagcagga

SEQ ID NO: 8042368 - DNA, 18 bp, Homo sapiens
ctgccacttaatgtggtg

SEQ ID NO: 8042369 - DNA, 22 bp, Homo sapiens
ctgcatccatgttgctgcaaag

SEQ ID NO: 8042370 - DNA, 22 bp, Homo sapiens
ctggcaggagcattcacagagg

SEQ ID NO: 8042371 - DNA, 22 bp, Homo sapiens
ctggcaggcggaggttgcagtg

SEQ ID NO: 8042372 - DNA, 22 bp, Homo sapiens
ctggccctatgagcctcctgat

SEQ ID NO: 8042373 - DNA, 22 bp, Homo sapiens
ctggccctcggagtccagctgc

SEQ ID NO: 8042374 - DNA, 22 bp, Homo sapiens
ctggctcatagagcagctccaa

SEQ ID NO: 8042375 - DNA, 22 bp, Homo sapiens
gtccacagagggctgggcaggc

SEQ ID NO: 8042376 - DNA, 22 bp, Homo sapiens
ggtttggttttggccatcttcc

SEQ ID NO: 8042377 - DNA, 22 bp, Homo sapiens
ggtttctagcagagtctcttta

SEQ ID NO: 8042378 - DNA, 22 bp, Homo sapiens
gtagaaattccatttactttga

SEQ ID NO: 8042379 - DNA, 22 bp, Homo sapiens
gtagaaatggtgtgtttcttct

SEQ ID NO: 8042380 - DNA, 22 bp, Homo sapiens
gtgaagatctgagccctcaggt

SEQ ID NO: 8042381 - DNA, 22 bp, Homo sapiens
gtgaagatgcctcaggtgaccc

SEQ ID NO: 8042382 - DNA, 22 bp, Homo sapiens
gtgaagcagggaaggaaaggat

SEQ ID NO: 8042383 - DNA, 22 bp, Homo sapiens
gtgaaggactagcatggagggc

SEQ ID NO: 8042384 - DNA, 22 bp, Homo sapiens
gtgaacagttcattttatcatg

SEQ ID NO: 8042385 - DNA, 22 bp, Homo sapiens
gtgcacttgatctagacagatt

SEQ ID NO: 8042386 - DNA, 22 bp, Homo sapiens
gtgcacagattcagaggttttg

SEQ ID NO: 8042387 - DNA, 22 bp, Homo sapiens
gtgcacagaagcagaagctaga

SEQ ID NO: 8042388 - DNA, 22 bp, Homo sapiens
gtgcacagagcccagggccgcg

SEQ ID NO: 8042389 - DNA, 21 bp, Homo sapiens
gtgcacagtcctgcacacagg

SEQ ID NO: 8042390 - DNA, 23 bp, Homo sapiens
gtgcacagtcaagcccagcttag

SEQ ID NO: 8042391 - DNA, 22 bp, Homo sapiens
gtgcacagatttaattttattc

SEQ ID NO: 8042392 - DNA, 22 bp, Homo sapiens
gtgcacaggtgggaaaatgagt

SEQ ID NO: 8042393 - DNA, 22 bp, Homo sapiens
gtgagagaatttgagttaaatt

SEQ ID NO: 8042394 - DNA, 22 bp, Homo sapiens
gtgagacaagatttgtaggcag

SEQ ID NO: 8042395 - DNA, 22 bp, Homo sapiens
gtgagacaattcctcagtagac

SEQ ID NO: 8042396 - DNA, 22 bp, Homo sapiens
ggtctcaggtagggcctaggaa

SEQ ID NO: 8042397 - DNA, 19 bp, Homo sapiens
ggtctcagtgcagctgcag

SEQ ID NO: 8042398 - DNA, 22 bp, Homo sapiens
ggtctcaggagactggagagca

SEQ ID NO: 8042399 - DNA, 22 bp, Homo sapiens
ggtctcagccctcgccagcagc

SEQ ID NO: 8042400 - DNA, 22 bp, Homo sapiens
ggtctcagaggtttctgctcag

SEQ ID NO: 8042401 - DNA, 22 bp, Homo sapiens
ggtctcagactggcaggcagtg

SEQ ID NO: 8042402 - DNA, 22 bp, Homo sapiens
ggtcactgctctaaacaaaagt

SEQ ID NO: 8042403 - DNA, 22 bp, Homo sapiens
ggtcactgcaggtttaacagag

SEQ ID NO: 8042404 - DNA, 22 bp, Homo sapiens
ggtgttgggctcactggtcctt

SEQ ID NO: 8042405 - DNA, 22 bp, Homo sapiens
ggggctgagtcagtgggaagag

SEQ ID NO: 8042406 - DNA, 22 bp, Homo sapiens
ggcctctgtttggagccaggat

SEQ ID NO: 8042407 - DNA, 23 bp, Homo sapiens
ggcctctgtgttctgcccacatg

SEQ ID NO: 8042408 - DNA, 22 bp, Homo sapiens
ggcctcagagaaggctgtgcgg

SEQ ID NO: 8042409 - DNA, 22 bp, Homo sapiens
ggcaagagggcagatggagtgc

SEQ ID NO: 8042410 - DNA, 22 bp, Homo sapiens
ggcaacaactggacatagctgg

SEQ ID NO: 8042411 - DNA, 22 bp, Homo sapiens
ggcagaggtagctggaaccagg

SEQ ID NO: 8042412 - DNA, 22 bp, Homo sapiens
gggagacacgctgcaggcataa

SEQ ID NO: 8042413 - DNA, 20 bp, Homo sapiens
ggcttgtctgagtccctggc

SEQ ID NO: 8042414 - DNA, 22 bp, Homo sapiens
ggctgagagtggatcccaggga

SEQ ID NO: 8042415 - DNA, 22 bp, Homo sapiens
ggctcttgttcgtaccatggct

SEQ ID NO: 8042416 - DNA, 22 bp, Homo sapiens
ggctgagaacaggcccagcctc

SEQ ID NO: 8042417 - DNA, 22 bp, Homo sapiens
ggctgagaatcaacaacctgct

SEQ ID NO: 8042418 - DNA, 22 bp, Homo sapiens
gcccatggcttccctaggcaca

SEQ ID NO: 8042419 - DNA, 22 bp, Homo sapiens
gcccatgggcctgaggccctag

SEQ ID NO: 8042420 - DNA, 22 bp, Homo sapiens
gccccaccttgagagcagaaac

SEQ ID NO: 8042421 - DNA, 22 bp, Homo sapiens
gcctcctgagtagctgggattg

SEQ ID NO: 8042422 - DNA, 22 bp, Homo sapiens
gcctcctggaagtcacatgttt

SEQ ID NO: 8042423 - DNA, 22 bp, Homo sapiens
gcctctgggctctgcccctggc

SEQ ID NO: 8042424 - DNA, 22 bp, Homo sapiens
gcctcctgaagtgctgggatta

SEQ ID NO: 8042425 - DNA, 22 bp, Homo sapiens
gcctccggagttgcagtgtctt

SEQ ID NO: 8042426 - DNA, 22 bp, Homo sapiens
gcctccggagttgcagtgtctt

SEQ ID NO: 8042427 - DNA, 22 bp, Homo sapiens
gcctccggagtcacagtgtctt

SEQ ID NO: 8042428 - DNA, 22 bp, Homo sapiens
gcctccggagtcacagtgtctt

SEQ ID NO: 8042429 - DNA, 22 bp, Homo sapiens
gccctggcctcctggaacaggc

SEQ ID NO: 8042430 - DNA, 22 bp, Homo sapiens
gccctggccttcatctcagaca

SEQ ID NO: 8042431 - DNA, 22 bp, Homo sapiens
gcagtggcagagacagcaccaa

SEQ ID NO: 8042432 - DNA, 22 bp, Homo sapiens
gcaggcagaggtggaggagaca

SEQ ID NO: 8042433 - DNA, 22 bp, Homo sapiens
gcagggacagggcagggccttt

SEQ ID NO: 8042434 - DNA, 22 bp, Homo sapiens
gcagcctcaaactccccagctc

SEQ ID NO: 8042435 - DNA, 22 bp, Homo sapiens
gcagctttctgggacagaaagg

SEQ ID NO: 8042436 - DNA, 18 bp, Homo sapiens
gcagcccctcttccttcc

SEQ ID NO: 8042437 - DNA, 22 bp, Homo sapiens
gcagcccaggagcaggcgaccc

SEQ ID NO: 8042438 - DNA, 22 bp, Homo sapiens
gcagaggatcaggctctggaaa

SEQ ID NO: 8042439 - DNA, 22 bp, Homo sapiens
gcagacttataatctgtcccag

SEQ ID NO: 8042440 - DNA, 20 bp, Homo sapiens
gaggcccagagaggtgaagc

SEQ ID NO: 8042441 - DNA, 22 bp, Homo sapiens
ggagacagtatggcttgtagct

SEQ ID NO: 8042442 - DNA, 22 bp, Homo sapiens
ggagacagggttgaaccacgca

SEQ ID NO: 8042443 - DNA, 22 bp, Homo sapiens
ggagagaattccatggacatgt

SEQ ID NO: 8042444 - DNA, 22 bp, Homo sapiens
ggagacagtgacttagagactg

SEQ ID NO: 8042445 - DNA, 22 bp, Homo sapiens
ggagacagtggtagggcctaag

SEQ ID NO: 8042446 - DNA, 22 bp, Homo sapiens
ggagactgatctgagtgataac

SEQ ID NO: 8042447 - DNA, 22 bp, Homo sapiens
ggagactcgggttctagccttg

SEQ ID NO: 8042448 - DNA, 22 bp, Homo sapiens
ggaattggtttcaagggaaagt

SEQ ID NO: 8042449 - DNA, 22 bp, Homo sapiens
gctttcctggccctgtccctgc

SEQ ID NO: 8042450 - DNA, 22 bp, Homo sapiens
gcctctggggcagctgagtcat

SEQ ID NO: 8042451 - DNA, 22 bp, Homo sapiens
gctacagagctctgtgaagaga

SEQ ID NO: 8042452 - DNA, 22 bp, Homo sapiens
gctccaggtgtcccaggtaaaa

SEQ ID NO: 8042453 - DNA, 20 bp, Homo sapiens
gctccaggtcagagaggacg

SEQ ID NO: 8042454 - DNA, 22 bp, Homo sapiens
gctcagagttaattggatgggt

SEQ ID NO: 8042455 - DNA, 19 bp, Homo sapiens
gctcagagggccctgtgct

SEQ ID NO: 8042456 - DNA, 19 bp, Homo sapiens
gctcagagggccctgtgct

SEQ ID NO: 8042457 - DNA, 22 bp, Homo sapiens
gctcagaggttgttcttgggtt

SEQ ID NO: 8042458 - DNA, 23 bp, Homo sapiens
gctcagaggtttttctctggatg

SEQ ID NO: 8042459 - DNA, 22 bp, Homo sapiens
gctcagagtggcctggctaggg

SEQ ID NO: 8042460 - DNA, 21 bp, Homo sapiens
gctcagagtattgcactgttt

SEQ ID NO: 8042461 - DNA, 23 bp, Homo sapiens
gctcagaggtttttctctggatg

SEQ ID NO: 8042462 - DNA, 22 bp, Homo sapiens
gctcagagggaacaaggggctg

SEQ ID NO: 8042463 - DNA, 22 bp, Homo sapiens
gctcagaggccactgttggaaa

SEQ ID NO: 8042464 - DNA, 22 bp, Homo sapiens
gctctgggattaccagccttag

SEQ ID NO: 8042465 - DNA, 22 bp, Homo sapiens
gctgagacttccactgccatct

SEQ ID NO: 8042466 - DNA, 22 bp, Homo sapiens
gctgcgccggatcccacgttcc

SEQ ID NO: 8042467 - DNA, 22 bp, Homo sapiens
gctgcccagcaggccccagggg

SEQ ID NO: 8042468 - DNA, 22 bp, Homo sapiens
gctgcccagggtggagccggct

SEQ ID NO: 8042469 - DNA, 22 bp, Homo sapiens
tagccctgtccttggcctgtgc

SEQ ID NO: 8042470 - DNA, 19 bp, Homo sapiens
tagccctggccatcatgag

SEQ ID NO: 8042471 - DNA, 22 bp, Homo sapiens
tagcagagcgggtgcgaggcgg

SEQ ID NO: 8042472 - DNA, 22 bp, Homo sapiens
tagacactgtatgagctgggtg

SEQ ID NO: 8042473 - DNA, 22 bp, Homo sapiens
tataggaaataggtcttctgtg

SEQ ID NO: 8042474 - DNA, 22 bp, Homo sapiens
tataggaaatttatctcctggg

SEQ ID NO: 8042475 - DNA, 22 bp, Homo sapiens
tatttctattccccaggcaagt

SEQ ID NO: 8042476 - DNA, 22 bp, Homo sapiens
tattacagaatcaggcataact

SEQ ID NO: 8042477 - DNA, 22 bp, Homo sapiens
taatacagtagcttttacacag

SEQ ID NO: 8042478 - DNA, 22 bp, Homo sapiens
taatggtatttgttgaaaaact

SEQ ID NO: 8042479 - DNA, 22 bp, Homo sapiens
taatgtaaacacagagacagaa

SEQ ID NO: 8042480 - DNA, 22 bp, Homo sapiens
tacaaaaaattgatactgacga

SEQ ID NO: 8042481 - DNA, 22 bp, Homo sapiens
tacaaaaaattgatactgacga

SEQ ID NO: 8042482 - DNA, 22 bp, Homo sapiens
tacaaagaggtaattgcatata

SEQ ID NO: 8042483 - DNA, 22 bp, Homo sapiens
tacaacaatttccacattagaa

SEQ ID NO: 8042484 - DNA, 22 bp, Homo sapiens
tacagaactgaagtagtgaaaa

SEQ ID NO: 8042485 - DNA, 22 bp, Homo sapiens
gtgtgggaaggctaggatgctg

SEQ ID NO: 8042486 - DNA, 22 bp, Homo sapiens
gttgggaaggcaagaagtagaa

SEQ ID NO: 8042487 - DNA, 22 bp, Homo sapiens
gttgggaaggtgaacatgatgc

SEQ ID NO: 8042488 - DNA, 22 bp, Homo sapiens
gttttgaatactactagaactt

SEQ ID NO: 8042489 - DNA, 22 bp, Homo sapiens
taaacagaatgcgtaagaagtg

SEQ ID NO: 8042490 - DNA, 22 bp, Homo sapiens
taaagggtaggttttactgtaa

SEQ ID NO: 8042491 - DNA, 22 bp, Homo sapiens
taaacaagctgtctgatattct

SEQ ID NO: 8042492 - DNA, 22 bp, Homo sapiens
taaacaagggttactgagcatg

SEQ ID NO: 8042493 - DNA, 18 bp, Homo sapiens
taaaattcaaggcagggt

SEQ ID NO: 8042494 - DNA, 22 bp, Homo sapiens
taaagtatattttttctcaata

SEQ ID NO: 8042495 - DNA, 22 bp, Homo sapiens
tccaggagtgtgtgctaatggg

SEQ ID NO: 8042496 - DNA, 22 bp, Homo sapiens
tccaggctctaggctgctctcc

SEQ ID NO: 8042497 - DNA, 22 bp, Homo sapiens
tccaggctaggtttacaggaca

SEQ ID NO: 8042498 - DNA, 22 bp, Homo sapiens
tccccaggagcaatgattcagt

SEQ ID NO: 8042499 - DNA, 22 bp, Homo sapiens
tccccaggggcatctctctgct

SEQ ID NO: 8042500 - DNA, 22 bp, Homo sapiens
tccccaggaaattctgattctt

SEQ ID NO: 8042501 - DNA, 22 bp, Homo sapiens
tccccacctacacactgctcct

SEQ ID NO: 8042502 - DNA, 22 bp, Homo sapiens
tccccacctaagatacccatct

SEQ ID NO: 8042503 - DNA, 22 bp, Homo sapiens
tcccattgccatagataggaca

SEQ ID NO: 8042504 - DNA, 22 bp, Homo sapiens
tcattcactttgaaataaacga

SEQ ID NO: 8042505 - DNA, 22 bp, Homo sapiens
tcagtcttccctccagtgcaac

SEQ ID NO: 8042506 - DNA, 22 bp, Homo sapiens
tcaggatggagggaagcacaga

SEQ ID NO: 8042507 - DNA, 22 bp, Homo sapiens
tcagctctacacacacctgtgt

SEQ ID NO: 8042508 - DNA, 22 bp, Homo sapiens
tcagctctgcaaggtcacctcc

SEQ ID NO: 8042509 - DNA, 22 bp, Homo sapiens
tcactctgttttactcactgtt

SEQ ID NO: 8042510 - DNA, 22 bp, Homo sapiens
tcactttcctcatcacgactag

SEQ ID NO: 8042511 - DNA, 20 bp, Homo sapiens
tcagagaaggagctttcctg

SEQ ID NO: 8042512 - DNA, 22 bp, Homo sapiens
tcagaggaaagggaacatagtc

SEQ ID NO: 8042513 - DNA, 22 bp, Homo sapiens
tcagaggaaacaatctttagta

SEQ ID NO: 8042514 - DNA, 22 bp, Homo sapiens
tcagaggaacactgtttcatgc

SEQ ID NO: 8042515 - DNA, 22 bp, Homo sapiens
tcagaggaaaggtcagatggct

SEQ ID NO: 8042516 - DNA, 22 bp, Homo sapiens
tcagaggaactggactaaagcc

SEQ ID NO: 8042517 - DNA, 22 bp, Homo sapiens
tcagaggaagcatcaagttctc

SEQ ID NO: 8042518 - DNA, 23 bp, Homo sapiens
tcagagaggccccctgcagagat

SEQ ID NO: 8042519 - DNA, 22 bp, Homo sapiens
tcaagacatcactgtgcatttt

SEQ ID NO: 8042520 - DNA, 22 bp, Homo sapiens
tcaagacatattaaatgtgcga

SEQ ID NO: 8042521 - DNA, 22 bp, Homo sapiens
tcaagacagtgtgatactggcc

SEQ ID NO: 8042522 - DNA, 22 bp, Homo sapiens
tcaagacagggtttaaggttga

SEQ ID NO: 8042523 - DNA, 21 bp, Homo sapiens
tcaagacagcatatttaagaa

SEQ ID NO: 8042524 - DNA, 22 bp, Homo sapiens
tcaagacagatgggtaacttgg

SEQ ID NO: 8042525 - DNA, 18 bp, Homo sapiens
tcaagacatcatgaaata

SEQ ID NO: 8042526 - DNA, 20 bp, Homo sapiens
tcaagacagacatggagttt

SEQ ID NO: 8042527 - DNA, 22 bp, Homo sapiens
tcaagtctggagatctggaact

SEQ ID NO: 8042528 - DNA, 22 bp, Homo sapiens
tcaataactttgtttagcattg

SEQ ID NO: 8042529 - DNA, 22 bp, Homo sapiens
tcaagtcttgatgagacaaacc

SEQ ID NO: 8042530 - DNA, 22 bp, Homo sapiens
tcacaagatacagttagaagca

SEQ ID NO: 8042531 - DNA, 22 bp, Homo sapiens
tcacagctccagactgcaactc

SEQ ID NO: 8042532 - DNA, 20 bp, Homo sapiens
tttttccttctctacaggca

SEQ ID NO: 8042533 - DNA, 22 bp, Homo sapiens
ttttcttctacctgctgtccaa

SEQ ID NO: 8042534 - DNA, 20 bp, Homo sapiens
ttttatatgtagggtatatg

SEQ ID NO: 8042535 - DNA, 22 bp, Homo sapiens
ttttatcagcagggataacaag

SEQ ID NO: 8042536 - DNA, 18 bp, Homo sapiens
tttgttgggttgccttta

SEQ ID NO: 8042537 - DNA, 22 bp, Homo sapiens
tttgcaaataccatgaaacttg

SEQ ID NO: 8042538 - DNA, 22 bp, Homo sapiens
tttgcaaatacagaggtcttgc

SEQ ID NO: 8042539 - DNA, 22 bp, Homo sapiens
tttgcaaatatgtgtttctatt

SEQ ID NO: 8042540 - DNA, 22 bp, Homo sapiens
tttgcaaataaataagtgctcg

SEQ ID NO: 8042541 - DNA, 22 bp, Homo sapiens
tttgcaaatgctctgcagagct

SEQ ID NO: 8042542 - DNA, 22 bp, Homo sapiens
tttgcaaattagccaccctgtt

SEQ ID NO: 8042543 - DNA, 22 bp, Homo sapiens
tttgcaaatgaagctctgagga

SEQ ID NO: 8042544 - DNA, 22 bp, Homo sapiens
tttgcaaatttcgtctcctcag

SEQ ID NO: 8042545 - DNA, 22 bp, Homo sapiens
tttaatgttcatctcaaaggat

SEQ ID NO: 8042546 - DNA, 22 bp, Homo sapiens
tttaaaatcagatgggagttgg

SEQ ID NO: 8042547 - DNA, 22 bp, Homo sapiens
tttaaaatttagacctctccac

SEQ ID NO: 8042548 - DNA, 22 bp, Homo sapiens
ttggttttatcttaagattctt

SEQ ID NO: 8042549 - DNA, 22 bp, Homo sapiens
ttgtgaatagtgccgctataaa

SEQ ID NO: 8042550 - DNA, 22 bp, Homo sapiens
ttgtgaatagtgccgcaataaa

SEQ ID NO: 8042551 - DNA, 23 bp, Homo sapiens
ttgcaaatttcagttagttcatg

SEQ ID NO: 8042552 - DNA, 22 bp, Homo sapiens
ttgcaaattattttagtccctt

SEQ ID NO: 8042553 - DNA, 22 bp, Homo sapiens
ttgcaaattcatggatctgaat

SEQ ID NO: 8042554 - DNA, 22 bp, Homo sapiens
ttgcaaattgcaagagttggat

SEQ ID NO: 8042555 - DNA, 22 bp, Homo sapiens
ttgcaaattccaatccaatatt

SEQ ID NO: 8042556 - DNA, 22 bp, Homo sapiens
ttgttacaggtcctagtggctg

SEQ ID NO: 8042557 - DNA, 22 bp, Homo sapiens
ttgtttccattgcagactgtgt

SEQ ID NO: 8042558 - DNA, 22 bp, Homo sapiens
ttgtgaatggtgccgcaataaa

SEQ ID NO: 8042559 - DNA, 22 bp, Homo sapiens
tttcaaaggaggctgagaggat

SEQ ID NO: 8042560 - DNA, 22 bp, Homo sapiens
tttcaaagcaactgaaaaggaa

SEQ ID NO: 8042561 - DNA, 20 bp, Homo sapiens
tttcaaaggcacctatgaag

SEQ ID NO: 8042562 - DNA, 22 bp, Homo sapiens
tttcctcttcgattaagtttgg

SEQ ID NO: 8042563 - DNA, 22 bp, Homo sapiens
tttcctcttatacagtgtttat

SEQ ID NO: 8042564 - DNA, 22 bp, Homo sapiens
tttcagtggagtgacatgatct

SEQ ID NO: 8042565 - DNA, 22 bp, Homo sapiens
tttcattgtctacatatgacat

SEQ ID NO: 8042566 - DNA, 22 bp, Homo sapiens
tttctcagtaatgtcctggaat

SEQ ID NO: 8042567 - DNA, 22 bp, Homo sapiens
tttctacatttgtaaccagatt

SEQ ID NO: 8042568 - DNA, 22 bp, Homo sapiens
tttctacattcaaaaactacca

SEQ ID NO: 8042569 - DNA, 22 bp, Homo sapiens
tttctggaaacgggttcaagct

SEQ ID NO: 8042570 - DNA, 22 bp, Homo sapiens
ttgcaaatattgtttacctttc

SEQ ID NO: 8042571 - DNA, 22 bp, Homo sapiens
ttgcaaatctttgccagaaggc

SEQ ID NO: 8042572 - DNA, 22 bp, Homo sapiens
ttgcaaatcagaagtatagatt

SEQ ID NO: 8042573 - DNA, 20 bp, Homo sapiens
ttgcaaatatctattgattg

SEQ ID NO: 8042574 - DNA, 22 bp, Homo sapiens
ttgcaaataaacaagtatacat

SEQ ID NO: 8042575 - DNA, 22 bp, Homo sapiens
ttgcaaataatagcctgaaact

SEQ ID NO: 8042576 - DNA, 22 bp, Homo sapiens
ttgcaaatgtgaataattacac

SEQ ID NO: 8042577 - DNA, 22 bp, Homo sapiens
ttgcaaatgaccattgccacat

SEQ ID NO: 8042578 - DNA, 22 bp, Homo sapiens
ttgcaaattaaagaggatagca

SEQ ID NO: 8042579 - DNA, 22 bp, Homo sapiens
ttgcaaattatataagggatgc

SEQ ID NO: 8042580 - DNA, 22 bp, Homo sapiens
ttgcaaatgtgagtttagactg

SEQ ID NO: 8042581 - DNA, 22 bp, Homo sapiens
ttgcaaatgtggttagggcttt

SEQ ID NO: 8042582 - DNA, 22 bp, Homo sapiens
ttgcaaatgttatactgccagt

SEQ ID NO: 8042583 - DNA, 22 bp, Homo sapiens
ttgaagattattctattaaaag

SEQ ID NO: 8042584 - DNA, 22 bp, Homo sapiens
ttctttcaatagctggcatatg

SEQ ID NO: 8042585 - DNA, 22 bp, Homo sapiens
ttccttctctgtggggaaggca

SEQ ID NO: 8042586 - DNA, 22 bp, Homo sapiens
ttctacactcacccagctgtaa

SEQ ID NO: 8042587 - DNA, 22 bp, Homo sapiens
ttccctggctcttctacatcgt

SEQ ID NO: 8042588 - DNA, 22 bp, Homo sapiens
ttcctaatggcaaaacatgttt

SEQ ID NO: 8042589 - DNA, 22 bp, Homo sapiens
ttcctaatcacgaacattattt

SEQ ID NO: 8042590 - DNA, 21 bp, Homo sapiens
ttccacagtgagaactgcaag

SEQ ID NO: 8042591 - DNA, 22 bp, Homo sapiens
ttcctctgtatgctttgctgct

SEQ ID NO: 8042592 - DNA, 22 bp, Homo sapiens
ttcctcagctgtttgggctcat

SEQ ID NO: 8042593 - DNA, 22 bp, Homo sapiens
ttcctcagggcggatgggcagg

SEQ ID NO: 8042594 - DNA, 22 bp, Homo sapiens
ttccaatttgtggtgagttaat

SEQ ID NO: 8042595 - DNA, 22 bp, Homo sapiens
ttcatgtaattccataaggtaa

SEQ ID NO: 8042596 - DNA, 22 bp, Homo sapiens
ttcacattataatcagttctgc

SEQ ID NO: 8042597 - DNA, 22 bp, Homo sapiens
ttcacattccgcggctattttc

SEQ ID NO: 8042598 - DNA, 22 bp, Homo sapiens
ttcacattgaaggtgctttctt

SEQ ID NO: 8042599 - DNA, 19 bp, Homo sapiens
ttcacattggaagaagtag

SEQ ID NO: 8042600 - DNA, 22 bp, Homo sapiens
ttcagtctcctcattttacaaa

SEQ ID NO: 8042601 - DNA, 17 bp, Homo sapiens
ttaaggtggatcagcac

SEQ ID NO: 8042602 - DNA, 22 bp, Homo sapiens
ttaacacagggggagacaaagt

SEQ ID NO: 8042603 - DNA, 22 bp, Homo sapiens
ttacaaactgtcatatagtatt

SEQ ID NO: 8042604 - DNA, 22 bp, Homo sapiens
ttacactttggcaagctattaa

SEQ ID NO: 8042605 - DNA, 22 bp, Homo sapiens
ttactacattgtaacacagtac

SEQ ID NO: 8042606 - DNA, 22 bp, Homo sapiens
tgttatctgagcaacgtcgacg

SEQ ID NO: 8042607 - DNA, 18 bp, Homo sapiens
tgtttcctcctggaggct

SEQ ID NO: 8042608 - DNA, 22 bp, Homo sapiens
tgtttcctaagtgtctctgaag

SEQ ID NO: 8042609 - DNA, 22 bp, Homo sapiens
tgtttgaaaagtggagatttat

SEQ ID NO: 8042610 - DNA, 22 bp, Homo sapiens
tgtgtaaaagattagtttacta

SEQ ID NO: 8042611 - DNA, 22 bp, Homo sapiens
tccccaggtcctgtcggctcct

SEQ ID NO: 8042612 - DNA, 22 bp, Homo sapiens
gccacaggtactatgggagaga

SEQ ID NO: 8042613 - DNA, 22 bp, Homo sapiens
gccaggcgggtctcaaactcct

SEQ ID NO: 8042614 - DNA, 22 bp, Homo sapiens
gccaggtggctgagcagctgca

SEQ ID NO: 8042615 - DNA, 22 bp, Homo sapiens
gccaggtggctgagcagctgca

SEQ ID NO: 8042616 - DNA, 22 bp, Homo sapiens
gccaggtgcacctgccctggcc

SEQ ID NO: 8042617 - DNA, 22 bp, Homo sapiens
gccaggtgagaggactgaggct

SEQ ID NO: 8042618 - DNA, 22 bp, Homo sapiens
gccaggtgctatccctgcgctg

SEQ ID NO: 8042619 - DNA, 22 bp, Homo sapiens
gccaggtggaggttgcagtgag

SEQ ID NO: 8042620 - DNA, 22 bp, Homo sapiens
gccaggtgcatggctgagtctc

SEQ ID NO: 8042621 - DNA, 22 bp, Homo sapiens
gccaggtgcatattagaagcat

SEQ ID NO: 8042622 - DNA, 22 bp, Homo sapiens
gccaggtgcatattagaagcat

SEQ ID NO: 8042623 - DNA, 22 bp, Homo sapiens
gcccacagtctatcagtttgcg

SEQ ID NO: 8042624 - DNA, 21 bp, Homo sapiens
gcccacagtgaggaggatccc

SEQ ID NO: 8042625 - DNA, 22 bp, Homo sapiens
gcccacagtgtagcaggtactc

SEQ ID NO: 8042626 - DNA, 22 bp, Homo sapiens
atttctgttgcttataaattac

SEQ ID NO: 8042627 - DNA, 22 bp, Homo sapiens
gcccccagacctcagtgggctg

SEQ ID NO: 8042628 - DNA, 22 bp, Homo sapiens
gcccccagacctcagtgggctg

SEQ ID NO: 8042629 - DNA, 21 bp, Homo sapiens
gcctagggagatgggactgcc

SEQ ID NO: 8042630 - DNA, 20 bp, Homo sapiens
gcctaggggttgggaaagca

SEQ ID NO: 8042631 - DNA, 22 bp, Homo sapiens
gcctcacagactgactgaaagc

SEQ ID NO: 8042632 - DNA, 22 bp, Homo sapiens
gcctcaagacatttttaattgc

SEQ ID NO: 8042633 - DNA, 22 bp, Homo sapiens
gcctagggtgctcagggacgag

SEQ ID NO: 8042634 - DNA, 22 bp, Homo sapiens
gcctagggttggcctgagaatc

SEQ ID NO: 8042635 - DNA, 22 bp, Homo sapiens
gcctgagagtctccagaccttg

SEQ ID NO: 8042636 - DNA, 22 bp, Homo sapiens
gcctgagagttgaagttcagtg

SEQ ID NO: 8042637 - DNA, 22 bp, Homo sapiens
gcctgagaaggacacagcaggt

SEQ ID NO: 8042638 - DNA, 22 bp, Homo sapiens
gcctggagttgaaactattatt

SEQ ID NO: 8042639 - DNA, 20 bp, Homo sapiens
gcctggaggcaatgggaaga

SEQ ID NO: 8042640 - DNA, 22 bp, Homo sapiens
gcctggaggaatgtagctgagg

SEQ ID NO: 8042641 - DNA, 22 bp, Homo sapiens
gcctggagttgtggtgaagcca

SEQ ID NO: 8042642 - DNA, 22 bp, Homo sapiens
gcctggagttgtggtgaagcca

SEQ ID NO: 8042643 - DNA, 21 bp, Homo sapiens
gcctggcaaaaaccggccctg

SEQ ID NO: 8042644 - DNA, 22 bp, Homo sapiens
gcctggcacaggaattaggagg

SEQ ID NO: 8042645 - DNA, 22 bp, Homo sapiens
gcctggcacagtagggacccaa

SEQ ID NO: 8042646 - DNA, 22 bp, Homo sapiens
gcctggcaatggcctcaggaag

SEQ ID NO: 8042647 - DNA, 22 bp, Homo sapiens
gcctggcaaggccctgttgact

SEQ ID NO: 8042648 - DNA, 23 bp, Homo sapiens
gcctggcaaagcactaccgagag

SEQ ID NO: 8042649 - DNA, 22 bp, Homo sapiens
gcctggcacattgcagtggatt

SEQ ID NO: 8042650 - DNA, 22 bp, Homo sapiens
gcctggcaccacagcctttcag

SEQ ID NO: 8042651 - DNA, 22 bp, Homo sapiens
attttacttagtgtaatgtcca

SEQ ID NO: 8042652 - DNA, 22 bp, Homo sapiens
attttactactccaattaatga

SEQ ID NO: 8042653 - DNA, 22 bp, Homo sapiens
attttactttgtgaatattgac

SEQ ID NO: 8042654 - DNA, 22 bp, Homo sapiens
attttactttgtgaatattgac

SEQ ID NO: 8042655 - DNA, 22 bp, Homo sapiens
attttagagaaacaaacgtagg

SEQ ID NO: 8042656 - DNA, 22 bp, Homo sapiens
attttgctttatgtaaatatgt

SEQ ID NO: 8042657 - DNA, 22 bp, Homo sapiens
attttgctgtggtacattagga

SEQ ID NO: 8042658 - DNA, 22 bp, Homo sapiens
atttttgagctgtgaacatagc

SEQ ID NO: 8042659 - DNA, 22 bp, Homo sapiens
atttttgtatccccagctcctg

SEQ ID NO: 8042660 - DNA, 22 bp, Homo sapiens
caaaatgttctggcacctttaa

SEQ ID NO: 8042661 - DNA, 22 bp, Homo sapiens
caaaatgtgagtcccacctcaa

SEQ ID NO: 8042662 - DNA, 22 bp, Homo sapiens
caaaattctgcatttctaataa

SEQ ID NO: 8042663 - DNA, 22 bp, Homo sapiens
caaagcctctgatttcacttgt

SEQ ID NO: 8042664 - DNA, 22 bp, Homo sapiens
caaaggaggtgataggccctct

SEQ ID NO: 8042665 - DNA, 22 bp, Homo sapiens
caaatactacgattcttgcagt

SEQ ID NO: 8042666 - DNA, 22 bp, Homo sapiens
gctcttgtcaaaaattagttga

SEQ ID NO: 8042667 - DNA, 22 bp, Homo sapiens
gctctttaattcattcatggat

SEQ ID NO: 8042668 - DNA, 22 bp, Homo sapiens
gctctttactgtgagggtggtc

SEQ ID NO: 8042669 - DNA, 22 bp, Homo sapiens
gctctttagcgggggccaggcc

SEQ ID NO: 8042670 - DNA, 22 bp, Homo sapiens
gctctttagtccaagccatgtc

SEQ ID NO: 8042671 - DNA, 22 bp, Homo sapiens
gctgacagcgtttccagtgatg

SEQ ID NO: 8042672 - DNA, 22 bp, Homo sapiens
attgatttgtagtgcctgcact

SEQ ID NO: 8042673 - DNA, 22 bp, Homo sapiens
attgatttttgaggactggtat

SEQ ID NO: 8042674 - DNA, 22 bp, Homo sapiens
attgattttcagactatgcgag

SEQ ID NO: 8042675 - DNA, 22 bp, Homo sapiens
gcagggctgactcagccaccct

SEQ ID NO: 8042676 - DNA, 22 bp, Homo sapiens
attgatttagctcaagacacat

SEQ ID NO: 8042677 - DNA, 22 bp, Homo sapiens
attgatttaggcttgttatgac

SEQ ID NO: 8042678 - DNA, 22 bp, Homo sapiens
attgatttctgcttactcactg

SEQ ID NO: 8042679 - DNA, 22 bp, Homo sapiens
attgatttgaacaaagatatta

SEQ ID NO: 8042680 - DNA, 18 bp, Homo sapiens
gcagggctgcacacgcat

SEQ ID NO: 8042681 - DNA, 22 bp, Homo sapiens
gcagggctgatgttattgacga

SEQ ID NO: 8042682 - DNA, 22 bp, Homo sapiens
gcagggctgagtcatgtgtgcc

SEQ ID NO: 8042683 - DNA, 22 bp, Homo sapiens
gcagggctgggacttactggta

SEQ ID NO: 8042684 - DNA, 22 bp, Homo sapiens
gcagggctgcagagggcactgt

SEQ ID NO: 8042685 - DNA, 22 bp, Homo sapiens
gcaggcggaggttgcagtgagc

SEQ ID NO: 8042686 - DNA, 22 bp, Homo sapiens
gcaggcctgcccagcaggatgg

SEQ ID NO: 8042687 - DNA, 22 bp, Homo sapiens
gcaggcctgcaggtatggccgg

SEQ ID NO: 8042688 - DNA, 22 bp, Homo sapiens
gcaggcctgactgtagggggca

SEQ ID NO: 8042689 - DNA, 22 bp, Homo sapiens
gcaggcctgactgtagggggca

SEQ ID NO: 8042690 - DNA, 22 bp, Homo sapiens
gcaggcctgcccagcaggatgg

SEQ ID NO: 8042691 - DNA, 22 bp, Homo sapiens
gcaggcctggtttacatggtag

SEQ ID NO: 8042692 - DNA, 22 bp, Homo sapiens
gcaggcctgtcttgctcgccct

SEQ ID NO: 8042693 - DNA, 22 bp, Homo sapiens
gcaggcctgtaatgaagggaca

SEQ ID NO: 8042694 - DNA, 22 bp, Homo sapiens
gcaggcctgtaatgaagggaca

SEQ ID NO: 8042695 - DNA, 22 bp, Homo sapiens
gcaggccttggcaatgagcctg

SEQ ID NO: 8042696 - DNA, 22 bp, Homo sapiens
gcaggcctttatccctgcctca

SEQ ID NO: 8042697 - DNA, 22 bp, Homo sapiens
gcagctgctggaagttcctgcc

SEQ ID NO: 8042698 - DNA, 22 bp, Homo sapiens
gcagctgccttcagctggatgg

SEQ ID NO: 8042699 - DNA, 22 bp, Homo sapiens
gcagctggacccacacggctta

SEQ ID NO: 8042700 - DNA, 22 bp, Homo sapiens
gcagctggaagtgacactctgt

SEQ ID NO: 8042701 - DNA, 22 bp, Homo sapiens
attgtctttccactgagaagtt

SEQ ID NO: 8042702 - DNA, 22 bp, Homo sapiens
gccaaaggacctgtgggtgaca

SEQ ID NO: 8042703 - DNA, 23 bp, Homo sapiens
gccaaaggtctgttcagtggtga

SEQ ID NO: 8042704 - DNA, 22 bp, Homo sapiens
gccaacaggccttgctctgctc

SEQ ID NO: 8042705 - DNA, 22 bp, Homo sapiens
gccacagggcgagcggaggcca

SEQ ID NO: 8042706 - DNA, 17 bp, Homo sapiens
gcatcacagataacacg

SEQ ID NO: 8042707 - DNA, 22 bp, Homo sapiens
gcatatcatgacttctatctta

SEQ ID NO: 8042708 - DNA, 22 bp, Homo sapiens
attcacctttccccaaaatgag

SEQ ID NO: 8042709 - DNA, 22 bp, Homo sapiens
attcacatgatgtatgtagggc

SEQ ID NO: 8042710 - DNA, 22 bp, Homo sapiens
gcagatggaaagtgcttgaggg

SEQ ID NO: 8042711 - DNA, 22 bp, Homo sapiens
gcagcgacaggcactggtcagg

SEQ ID NO: 8042712 - DNA, 22 bp, Homo sapiens
gatattcaagtggaattattct

SEQ ID NO: 8042713 - DNA, 22 bp, Homo sapiens
gatattcaaagattactgatat

SEQ ID NO: 8042714 - DNA, 22 bp, Homo sapiens
attacatatgttggcaacattt

SEQ ID NO: 8042715 - DNA, 22 bp, Homo sapiens
attacctatgctctagtaatca

SEQ ID NO: 8042716 - DNA, 23 bp, Homo sapiens
attacatgagcaaatatagctat

SEQ ID NO: 8042717 - DNA, 22 bp, Homo sapiens
attactatgatttgatcattac

SEQ ID NO: 8042718 - DNA, 22 bp, Homo sapiens
attagaggttgttttgtaaaga

SEQ ID NO: 8042719 - DNA, 22 bp, Homo sapiens
attagaaaatctggaggtgggg

SEQ ID NO: 8042720 - DNA, 22 bp, Homo sapiens
attacttcaatttctcagtgaa

SEQ ID NO: 8042721 - DNA, 22 bp, Homo sapiens
attagaaaaactcaagggctct

SEQ ID NO: 8042722 - DNA, 20 bp, Homo sapiens
attagcttggagacagtggc

SEQ ID NO: 8042723 - DNA, 23 bp, Homo sapiens
gaaagtcaatatggtagctttga

SEQ ID NO: 8042724 - DNA, 22 bp, Homo sapiens
gaaagtattcacaaagttcttg

SEQ ID NO: 8042725 - DNA, 22 bp, Homo sapiens
gaaatagacactttctatgaat

SEQ ID NO: 8042726 - DNA, 21 bp, Homo sapiens
atgatatgcttgtatttccaa

SEQ ID NO: 8042727 - DNA, 22 bp, Homo sapiens
atgatcagcagttttcagtgtt

SEQ ID NO: 8042728 - DNA, 22 bp, Homo sapiens
atgatcagcagttttcagtgtt

SEQ ID NO: 8042729 - DNA, 22 bp, Homo sapiens
gaaatagtacagcatagttctt

SEQ ID NO: 8042730 - DNA, 22 bp, Homo sapiens
atgatcagggcagaagcagaag

SEQ ID NO: 8042731 - DNA, 22 bp, Homo sapiens
atgatgcataatttatacatgc

SEQ ID NO: 8042732 - DNA, 22 bp, Homo sapiens
atgatgaattttaaaagcacca

SEQ ID NO: 8042733 - DNA, 22 bp, Homo sapiens
atgatggaccatcccaatgtga

SEQ ID NO: 8042734 - DNA, 22 bp, Homo sapiens
gaaaatgttagcttcatagtca

SEQ ID NO: 8042735 - DNA, 22 bp, Homo sapiens
ctttctttcgaagacgtgatta

SEQ ID NO: 8042736 - DNA, 22 bp, Homo sapiens
atgacaggaggcagctgggcag

SEQ ID NO: 8042737 - DNA, 22 bp, Homo sapiens
atgaaaatgtacatgtgtataa

SEQ ID NO: 8042738 - DNA, 22 bp, Homo sapiens
atgaacagtacaaagcacagac

SEQ ID NO: 8042739 - DNA, 22 bp, Homo sapiens
atgaacagtatgcaacatgatt

SEQ ID NO: 8042740 - DNA, 22 bp, Homo sapiens
atgaactgagcttaattgctga

SEQ ID NO: 8042741 - DNA, 22 bp, Homo sapiens
atgaactgcatgtattttagtg

SEQ ID NO: 8042742 - DNA, 22 bp, Homo sapiens
ctttctggctgaagtgatgaat

SEQ ID NO: 8042743 - DNA, 22 bp, Homo sapiens
ctttctgatgtaaggaactagg

SEQ ID NO: 8042744 - DNA, 22 bp, Homo sapiens
ctttctggagtggaaaggtatt

SEQ ID NO: 8042745 - DNA, 22 bp, Homo sapiens
ctttctggcacagccgcgggat

SEQ ID NO: 8042746 - DNA, 22 bp, Homo sapiens
ctttctggacaagacagaggga

SEQ ID NO: 8042747 - DNA, 22 bp, Homo sapiens
cttcttgtgctgggccagcttc

SEQ ID NO: 8042748 - DNA, 22 bp, Homo sapiens
cttctttaatgtatacaaaaga

SEQ ID NO: 8042749 - DNA, 22 bp, Homo sapiens
gaaggctgtcagagaggagggc

SEQ ID NO: 8042750 - DNA, 22 bp, Homo sapiens
gacatttctagcccataaaact

SEQ ID NO: 8042751 - DNA, 18 bp, Homo sapiens
gacacatccccaggcctc

SEQ ID NO: 8042752 - DNA, 22 bp, Homo sapiens
gacacatatgcgtatagtttag

SEQ ID NO: 8042753 - DNA, 22 bp, Homo sapiens
gacacatagatctatctcactc

SEQ ID NO: 8042754 - DNA, 22 bp, Homo sapiens
gactggactctgaagatgggtg

SEQ ID NO: 8042755 - DNA, 22 bp, Homo sapiens
gacggggcagccagctggtggc

SEQ ID NO: 8042756 - DNA, 22 bp, Homo sapiens
gaccctggcaggtagcctcaca

SEQ ID NO: 8042757 - DNA, 22 bp, Homo sapiens
gaggcagcatggtaccttggag

SEQ ID NO: 8042758 - DNA, 22 bp, Homo sapiens
gaggcagcctcagtggacctcg

SEQ ID NO: 8042759 - DNA, 22 bp, Homo sapiens
gaggcagcggctcacagagaaa

SEQ ID NO: 8042760 - DNA, 22 bp, Homo sapiens
gaggagaaattatccttggtgt

SEQ ID NO: 8042761 - DNA, 22 bp, Homo sapiens
gaggagaagctattggaaggac

SEQ ID NO: 8042762 - DNA, 22 bp, Homo sapiens
gaggagaagctaagaaacacag

SEQ ID NO: 8042763 - DNA, 22 bp, Homo sapiens
gaggagaagggcacggagaaaa

SEQ ID NO: 8042764 - DNA, 18 bp, Homo sapiens
atggtctcatactgggag

SEQ ID NO: 8042765 - DNA, 22 bp, Homo sapiens
atgggagaaacatcatgaggca

SEQ ID NO: 8042766 - DNA, 22 bp, Homo sapiens
atggggagagaagggctgagct

SEQ ID NO: 8042767 - DNA, 22 bp, Homo sapiens
atggggagagaagggctgagct

SEQ ID NO: 8042768 - DNA, 22 bp, Homo sapiens
gagatggccagtgccaggacaa

SEQ ID NO: 8042769 - DNA, 22 bp, Homo sapiens
gagatggccctggcatgtagct

SEQ ID NO: 8042770 - DNA, 21 bp, Homo sapiens
gagatggcccagtagcgggcc

SEQ ID NO: 8042771 - DNA, 18 bp, Homo sapiens
atggaggcagagagctga

SEQ ID NO: 8042772 - DNA, 22 bp, Homo sapiens
atggagggaaaagtggagagcc

SEQ ID NO: 8042773 - DNA, 22 bp, Homo sapiens
atggagggtggtaagacagaga

SEQ ID NO: 8042774 - DNA, 22 bp, Homo sapiens
gagacatcataatgaagtttcc

SEQ ID NO: 8042775 - DNA, 22 bp, Homo sapiens
gactgggctccaagagggagag

SEQ ID NO: 8042776 - DNA, 21 bp, Homo sapiens
gactgggctgacttgtgctgg

SEQ ID NO: 8042777 - DNA, 22 bp, Homo sapiens
gagagagctctgtgcctgggat

SEQ ID NO: 8042778 - DNA, 22 bp, Homo sapiens
atggctgttgtgaggatcaaat

SEQ ID NO: 8042779 - DNA, 22 bp, Homo sapiens
atggcattgtttatagattgca

SEQ ID NO: 8042780 - DNA, 22 bp, Homo sapiens
atggcatttatgttgacaatgg

SEQ ID NO: 8042781 - DNA, 22 bp, Homo sapiens
gagatggggtcagctgggacat

SEQ ID NO: 8042782 - DNA, 22 bp, Homo sapiens
atgtagaatggtgattggcagg

SEQ ID NO: 8042783 - DNA, 22 bp, Homo sapiens
gaggcagcgggtcaggaccgtg

SEQ ID NO: 8042784 - DNA, 22 bp, Homo sapiens
atgtcctcaaaactgattgcag

SEQ ID NO: 8042785 - DNA, 20 bp, Homo sapiens
atgtcctcagccactgccct

SEQ ID NO: 8042786 - DNA, 22 bp, Homo sapiens
atgtcctcggctctgtgctgct

SEQ ID NO: 8042787 - DNA, 22 bp, Homo sapiens
atgtcctcttctgcctcaggcc

SEQ ID NO: 8042788 - DNA, 22 bp, Homo sapiens
gagggctgaagattgtggcccc

SEQ ID NO: 8042789 - DNA, 22 bp, Homo sapiens
gagggctctgtctggaagggaa

SEQ ID NO: 8042790 - DNA, 22 bp, Homo sapiens
gagggcagagacagtgattcac

SEQ ID NO: 8042791 - DNA, 22 bp, Homo sapiens
gatatcattgagcccaggagtt

SEQ ID NO: 8042792 - DNA, 22 bp, Homo sapiens
gatatcatgggaaggtgtactt

SEQ ID NO: 8042793 - DNA, 22 bp, Homo sapiens
gataatgtgccgataatttcta

SEQ ID NO: 8042794 - DNA, 22 bp, Homo sapiens
gataatgtaattttatgttcac

SEQ ID NO: 8042795 - DNA, 22 bp, Homo sapiens
gataatggggaatgataagtca

SEQ ID NO: 8042796 - DNA, 22 bp, Homo sapiens
gataatgatgacaatgacaacc

SEQ ID NO: 8042797 - DNA, 22 bp, Homo sapiens
gataatgtggatttattgtgat

SEQ ID NO: 8042798 - DNA, 22 bp, Homo sapiens
gataatgttaagtcataggcta

SEQ ID NO: 8042799 - DNA, 22 bp, Homo sapiens
atgttgtgtttgactgttaccc

SEQ ID NO: 8042800 - DNA, 22 bp, Homo sapiens
atgttggagtcgtaaggcatgg

SEQ ID NO: 8042801 - DNA, 22 bp, Homo sapiens
atgttattttggaaaatacaaa

SEQ ID NO: 8042802 - DNA, 22 bp, Homo sapiens
atgttgaactaggatctcttga

SEQ ID NO: 8042803 - DNA, 22 bp, Homo sapiens
atgttctttcagccagtgcatc

SEQ ID NO: 8042804 - DNA, 22 bp, Homo sapiens
gaggtggcactgtgaggagcac

SEQ ID NO: 8042805 - DNA, 22 bp, Homo sapiens
gaggtggcactgtgaggagcac

SEQ ID NO: 8042806 - DNA, 22 bp, Homo sapiens
gaggtggccagagtcaagagcc

SEQ ID NO: 8042807 - DNA, 22 bp, Homo sapiens
atgtgtccttgttcccattcca

SEQ ID NO: 8042808 - DNA, 22 bp, Homo sapiens
atgtgtccttataagaagaaga

SEQ ID NO: 8042809 - DNA, 21 bp, Homo sapiens
cacagaatatacattttagtt

SEQ ID NO: 8042810 - DNA, 21 bp, Homo sapiens
ggaagggctctgaggacggct

SEQ ID NO: 8042811 - DNA, 22 bp, Homo sapiens
ggaaggggagctggaaagggta

SEQ ID NO: 8042812 - DNA, 22 bp, Homo sapiens
cacacagctagtgacaggagaa

SEQ ID NO: 8042813 - DNA, 22 bp, Homo sapiens
cacacaggagagtgctggaggt

SEQ ID NO: 8042814 - DNA, 22 bp, Homo sapiens
ggaagggcctcgggcgtgggac

SEQ ID NO: 8042815 - DNA, 22 bp, Homo sapiens
ggaagggcctcgggcgtgggac

SEQ ID NO: 8042816 - DNA, 22 bp, Homo sapiens
cacaattttaatacacagtcaa

SEQ ID NO: 8042817 - DNA, 22 bp, Homo sapiens
cacacagatggtaagggaggga

SEQ ID NO: 8042818 - DNA, 22 bp, Homo sapiens
cacacagacagctctctgaaga

SEQ ID NO: 8042819 - DNA, 15 bp, Homo sapiens
cacacagacagcttg

SEQ ID NO: 8042820 - DNA, 22 bp, Homo sapiens
cacagaggatgcccaagcgatc

SEQ ID NO: 8042821 - DNA, 21 bp, Homo sapiens
cacagaggcgctgtatggctg

SEQ ID NO: 8042822 - DNA, 22 bp, Homo sapiens
cacagaggactgtagcggggag

SEQ ID NO: 8042823 - DNA, 22 bp, Homo sapiens
cacagagctgaacctgggtcat

SEQ ID NO: 8042824 - DNA, 22 bp, Homo sapiens
ggactgggagaatggaggcaag

SEQ ID NO: 8042825 - DNA, 22 bp, Homo sapiens
cacagacagtgtccctttgttg

SEQ ID NO: 8042826 - DNA, 22 bp, Homo sapiens
cacagaattttctctttacaat

SEQ ID NO: 8042827 - DNA, 22 bp, Homo sapiens
cacagaatggaccagttttaga

SEQ ID NO: 8042828 - DNA, 20 bp, Homo sapiens
cacagactgtatgggcacca

SEQ ID NO: 8042829 - DNA, 22 bp, Homo sapiens
ggactgggccaggggttggact

SEQ ID NO: 8042830 - DNA, 22 bp, Homo sapiens
ggactgggccaggggttggact

SEQ ID NO: 8042831 - DNA, 22 bp, Homo sapiens
ggactgggcatgggtgctctgc

SEQ ID NO: 8042832 - DNA, 17 bp, Homo sapiens
ggactgggcggggcagg

SEQ ID NO: 8042833 - DNA, 22 bp, Homo sapiens
ggagcctgacagtgcccagcat

SEQ ID NO: 8042834 - DNA, 22 bp, Homo sapiens
ggagcctgacagtgcccagcat

SEQ ID NO: 8042835 - DNA, 22 bp, Homo sapiens
ggagcctgaaaagtctgcattt

SEQ ID NO: 8042836 - DNA, 22 bp, Homo sapiens
ggagcctgagcggcccagggcc

SEQ ID NO: 8042837 - DNA, 23 bp, Homo sapiens
ggagctgctgttgggggagctgc

SEQ ID NO: 8042838 - DNA, 19 bp, Homo sapiens
ggagcctggagcacgtgcc

SEQ ID NO: 8042839 - DNA, 19 bp, Homo sapiens
ggagcctggagcacgtgcc

SEQ ID NO: 8042840 - DNA, 22 bp, Homo sapiens
ggagcctgcgggagctcccatt

SEQ ID NO: 8042841 - DNA, 22 bp, Homo sapiens
ggagctggcagcgcaacccaga

SEQ ID NO: 8042842 - DNA, 22 bp, Homo sapiens
ggagctggagagtacagagttt

SEQ ID NO: 8042843 - DNA, 20 bp, Homo sapiens
ggagctggcatccagcctct

SEQ ID NO: 8042844 - DNA, 20 bp, Homo sapiens
ggagctggcatccagcctct

SEQ ID NO: 8042845 - DNA, 22 bp, Homo sapiens
cacagaggtgatagtggtcaag

SEQ ID NO: 8042846 - DNA, 22 bp, Homo sapiens
ggagcaggcagggccgtgtctg

SEQ ID NO: 8042847 - DNA, 22 bp, Homo sapiens
ggagccctgccctaggcagctc

SEQ ID NO: 8042848 - DNA, 22 bp, Homo sapiens
cacaggcttgtcagcatgaggc

SEQ ID NO: 8042849 - DNA, 22 bp, Homo sapiens
cacaggcttgtcagcatgaggc

SEQ ID NO: 8042850 - DNA, 20 bp, Homo sapiens
cacaggctatatgagagcca

SEQ ID NO: 8042851 - DNA, 22 bp, Homo sapiens
cacaggagaaaggggaagctcg

SEQ ID NO: 8042852 - DNA, 22 bp, Homo sapiens
cacaggaattagcagcctaaaa

SEQ ID NO: 8042853 - DNA, 22 bp, Homo sapiens
cacaggaatcgtcacttagcgc

SEQ ID NO: 8042854 - DNA, 22 bp, Homo sapiens
cacaggaatgaacagggaaaga

SEQ ID NO: 8042855 - DNA, 22 bp, Homo sapiens
cacaggaatctgcattttgacc

SEQ ID NO: 8042856 - DNA, 22 bp, Homo sapiens
cacaggaaggccttctcacaat

SEQ ID NO: 8042857 - DNA, 22 bp, Homo sapiens
cacaggaagtggtcagtgccag

SEQ ID NO: 8042858 - DNA, 18 bp, Homo sapiens
cacaggaaggggaatatc

SEQ ID NO: 8042859 - DNA, 22 bp, Homo sapiens
cacaggaataagtcaaacttca

SEQ ID NO: 8042860 - DNA, 22 bp, Homo sapiens
cacaggaatataagtttgagtt

SEQ ID NO: 8042861 - DNA, 22 bp, Homo sapiens
cacaggaatcagcattaatggc

SEQ ID NO: 8042862 - DNA, 22 bp, Homo sapiens
gctttcttttcaagaatgtatt

SEQ ID NO: 8042863 - DNA, 22 bp, Homo sapiens
gctttgaagtctgtgtcttttg

SEQ ID NO: 8042864 - DNA, 22 bp, Homo sapiens
gctttcttagtgtgttaattgg

SEQ ID NO: 8042865 - DNA, 22 bp, Homo sapiens
gctttctgtaggtagttactgt

SEQ ID NO: 8042866 - DNA, 22 bp, Homo sapiens
gcttggggagctcagtgtcctt

SEQ ID NO: 8042867 - DNA, 22 bp, Homo sapiens
gcttggggtcatgaggctgctg

SEQ ID NO: 8042868 - DNA, 22 bp, Homo sapiens
caagttttgattttgcagtaaa

SEQ ID NO: 8042869 - DNA, 22 bp, Homo sapiens
caagttttctgggttcagagca

SEQ ID NO: 8042870 - DNA, 22 bp, Homo sapiens
gctgtggcggcagcagctggtg

SEQ ID NO: 8042871 - DNA, 22 bp, Homo sapiens
gctgtggcggcagcagctggtg

SEQ ID NO: 8042872 - DNA, 22 bp, Homo sapiens
gctgttcccttgtgcctctgtc

SEQ ID NO: 8042873 - DNA, 22 bp, Homo sapiens
caagtaattctgcaagaaacca

SEQ ID NO: 8042874 - DNA, 22 bp, Homo sapiens
caaggtgccatgctgggcgggg

SEQ ID NO: 8042875 - DNA, 22 bp, Homo sapiens
caaggtgccatgctgggcgggg

SEQ ID NO: 8042876 - DNA, 20 bp, Homo sapiens
caagggtttgcattggcttt

SEQ ID NO: 8042877 - DNA, 22 bp, Homo sapiens
gctggctgtatcacctggccag

SEQ ID NO: 8042878 - DNA, 22 bp, Homo sapiens
gctggctgggtccctgagaggc

SEQ ID NO: 8042879 - DNA, 22 bp, Homo sapiens
caaggccttcttgggagagatt

SEQ ID NO: 8042880 - DNA, 22 bp, Homo sapiens
caaggccaagtctctgtgaaga

SEQ ID NO: 8042881 - DNA, 22 bp, Homo sapiens
caaggccactccagagactggt

SEQ ID NO: 8042882 - DNA, 22 bp, Homo sapiens
gctggaggcagttcagacacca

SEQ ID NO: 8042883 - DNA, 22 bp, Homo sapiens
gctggaggctggagtgcagtgg

SEQ ID NO: 8042884 - DNA, 22 bp, Homo sapiens
gctggaggctggagtgcagtgg

SEQ ID NO: 8042885 - DNA, 22 bp, Homo sapiens
caaggccataagagatacaaaa

SEQ ID NO: 8042886 - DNA, 22 bp, Homo sapiens
caaggccagttcaccaagggca

SEQ ID NO: 8042887 - DNA, 22 bp, Homo sapiens
caaggcctatgcacacctagga

SEQ ID NO: 8042888 - DNA, 22 bp, Homo sapiens
caaatgtgacttttgggcttct

SEQ ID NO: 8042889 - DNA, 22 bp, Homo sapiens
caaatgtgtagagcttttgggg

SEQ ID NO: 8042890 - DNA, 22 bp, Homo sapiens
gctggaggatggactggaagaa

SEQ ID NO: 8042891 - DNA, 22 bp, Homo sapiens
gctggaggaggaagtgtgaggg

SEQ ID NO: 8042892 - DNA, 22 bp, Homo sapiens
caagccagctcctgccacagag

SEQ ID NO: 8042893 - DNA, 22 bp, Homo sapiens
caagccagtgacagccagggaa

SEQ ID NO: 8042894 - DNA, 22 bp, Homo sapiens
caagcagggatactgcagggag

SEQ ID NO: 8042895 - DNA, 22 bp, Homo sapiens
cacgagggcacacgtgggaggg

SEQ ID NO: 8042896 - DNA, 22 bp, Homo sapiens
ggccggcttactgggtagggtg

SEQ ID NO: 8042897 - DNA, 22 bp, Homo sapiens
cacctgggtcattgctggtgtt

SEQ ID NO: 8042898 - DNA, 22 bp, Homo sapiens
ggcccttgcagcaggcgctggc

SEQ ID NO: 8042899 - DNA, 22 bp, Homo sapiens
ggccccaggtagaagatataga

SEQ ID NO: 8042900 - DNA, 22 bp, Homo sapiens
ggccactgcctccgccatggct

SEQ ID NO: 8042901 - DNA, 22 bp, Homo sapiens
ggccactgcctccgccatggct

SEQ ID NO: 8042902 - DNA, 22 bp, Homo sapiens
ggccactccgctgctactggaa

SEQ ID NO: 8042903 - DNA, 22 bp, Homo sapiens
ggccaaggatggtggctctggt

SEQ ID NO: 8042904 - DNA, 22 bp, Homo sapiens
ggcaggtgccttctgtgctagc

SEQ ID NO: 8042905 - DNA, 22 bp, Homo sapiens
ggcatcaggagcttcttcaggt

SEQ ID NO: 8042906 - DNA, 22 bp, Homo sapiens
ggcaggtgccagttggcttggg

SEQ ID NO: 8042907 - DNA, 22 bp, Homo sapiens
ggcaggtgcccagagagcacga

SEQ ID NO: 8042908 - DNA, 22 bp, Homo sapiens
ggcaggtgcccagagagcacga

SEQ ID NO: 8042909 - DNA, 22 bp, Homo sapiens
ggcaggtgatctagagtcaata

SEQ ID NO: 8042910 - DNA, 22 bp, Homo sapiens
ggcaggtgatctagagtcaata

SEQ ID NO: 8042911 - DNA, 22 bp, Homo sapiens
ggcaggtgcacctgagccatct

SEQ ID NO: 8042912 - DNA, 22 bp, Homo sapiens
ggcaggtgcacctgagccatct

SEQ ID NO: 8042913 - DNA, 22 bp, Homo sapiens
ggcagggcaggaaagtcaggaa

SEQ ID NO: 8042914 - DNA, 22 bp, Homo sapiens
ggcagggcaggaaagtcaggaa

SEQ ID NO: 8042915 - DNA, 22 bp, Homo sapiens
ggcagggcaggaaagtcaggaa

SEQ ID NO: 8042916 - DNA, 22 bp, Homo sapiens
ggcagggcagcgctgattaggg

SEQ ID NO: 8042917 - DNA, 22 bp, Homo sapiens
ggcagggcagcgctgattaggg

SEQ ID NO: 8042918 - DNA, 22 bp, Homo sapiens
ggcagggagtggagactcccta

SEQ ID NO: 8042919 - DNA, 22 bp, Homo sapiens
ggcagggaggaggtgaaagtga

SEQ ID NO: 8042920 - DNA, 22 bp, Homo sapiens
ggcaggcatggccactccctag

SEQ ID NO: 8042921 - DNA, 22 bp, Homo sapiens
ggcaggcatggggtctgccatt

SEQ ID NO: 8042922 - DNA, 22 bp, Homo sapiens
ggcaggcaggtcttcatggccc

SEQ ID NO: 8042923 - DNA, 22 bp, Homo sapiens
cacattctgtgaagctgatttt

SEQ ID NO: 8042924 - DNA, 22 bp, Homo sapiens
cacatacttgtgtgtacatatg

SEQ ID NO: 8042925 - DNA, 22 bp, Homo sapiens
ggaggtgcagagtagggttggt

SEQ ID NO: 8042926 - DNA, 22 bp, Homo sapiens
ggaggtggaggttgcaatgagc

SEQ ID NO: 8042927 - DNA, 22 bp, Homo sapiens
ggaggtggaggttgcagtgagc

SEQ ID NO: 8042928 - DNA, 22 bp, Homo sapiens
cacataagaaatgaatatgaga

SEQ ID NO: 8042929 - DNA, 22 bp, Homo sapiens
cacatacaaggcacactggagg

SEQ ID NO: 8042930 - DNA, 22 bp, Homo sapiens
cacatacatacgtatgtataca

SEQ ID NO: 8042931 - DNA, 22 bp, Homo sapiens
cacatacattcatgttactcta

SEQ ID NO: 8042932 - DNA, 22 bp, Homo sapiens
cacatactgagaatcacaccca

SEQ ID NO: 8042933 - DNA, 22 bp, Homo sapiens
ggctcaggggccaggcctgtcc

SEQ ID NO: 8042934 - DNA, 19 bp, Homo sapiens
ggctcagggcgctgccgcc

SEQ ID NO: 8042935 - DNA, 18 bp, Homo sapiens
ggctcaggctatcctaac

SEQ ID NO: 8042936 - DNA, 22 bp, Homo sapiens
ggctcaggctggagtgcagtgg

SEQ ID NO: 8042937 - DNA, 22 bp, Homo sapiens
ggctcaggctggagtgcagtgg

SEQ ID NO: 8042938 - DNA, 22 bp, Homo sapiens
ggctcagggaatgaggaagaat

SEQ ID NO: 8042939 - DNA, 17 bp, Homo sapiens
ggcctgtgtggctgcag

SEQ ID NO: 8042940 - DNA, 22 bp, Homo sapiens
ggcctgtgcacatgtgcaggaa

SEQ ID NO: 8042941 - DNA, 22 bp, Homo sapiens
ggcctgaggcgtcccagctgtg

SEQ ID NO: 8042942 - DNA, 22 bp, Homo sapiens
ggcctgggctccgggagttact

SEQ ID NO: 8042943 - DNA, 22 bp, Homo sapiens
ggcctgaggccaccagcagccc

SEQ ID NO: 8042944 - DNA, 19 bp, Homo sapiens
ggcctgaggccacagatcc

SEQ ID NO: 8042945 - DNA, 22 bp, Homo sapiens
ggcctgaggcaatagtcagaca

SEQ ID NO: 8042946 - DNA, 22 bp, Homo sapiens
ggcctgagcttgggcagcgtat

SEQ ID NO: 8042947 - DNA, 20 bp, Homo sapiens
ggcctgagcatggctggcag

SEQ ID NO: 8042948 - DNA, 22 bp, Homo sapiens
ggcctgagcagacagcatgatg

SEQ ID NO: 8042949 - DNA, 22 bp, Homo sapiens
ggctccagtttccccttggggc

SEQ ID NO: 8042950 - DNA, 22 bp, Homo sapiens
ggctctggaatgtgtagtcagg

SEQ ID NO: 8042951 - DNA, 22 bp, Homo sapiens
ggctctggtcagtgaggggcct

SEQ ID NO: 8042952 - DNA, 22 bp, Homo sapiens
ggctccaggtgcatgccaggct

SEQ ID NO: 8042953 - DNA, 22 bp, Homo sapiens
ggctcaggttgggtcacatgac

SEQ ID NO: 8042954 - DNA, 22 bp, Homo sapiens
ggctcaggtttaaagtgcttta

SEQ ID NO: 8042955 - DNA, 22 bp, Homo sapiens
ggctccagggtacccctggatg

SEQ ID NO: 8042956 - DNA, 19 bp, Homo sapiens
ggctgagcgccttggctgc

SEQ ID NO: 8042957 - DNA, 22 bp, Homo sapiens
ggctgagcctggagcatctggt

SEQ ID NO: 8042958 - DNA, 22 bp, Homo sapiens
ggctgagctcaggggcagcagg

SEQ ID NO: 8042959 - DNA, 22 bp, Homo sapiens
ggctctggtgtgaagcagcctc

SEQ ID NO: 8042960 - DNA, 22 bp, Homo sapiens
ggctctggtgggaaggttagat

SEQ ID NO: 8042961 - DNA, 22 bp, Homo sapiens
ggctctggtgccctggctccca

SEQ ID NO: 8042962 - DNA, 22 bp, Homo sapiens
ggctctggtgagggtaggagat

SEQ ID NO: 8042963 - DNA, 22 bp, Homo sapiens
cagaaaataaacatttgtggaa

SEQ ID NO: 8042964 - DNA, 22 bp, Homo sapiens
ggctgccccatgggctgggctg

SEQ ID NO: 8042965 - DNA, 22 bp, Homo sapiens
ggctgccctagagctggcaagg

SEQ ID NO: 8042966 - DNA, 22 bp, Homo sapiens
ggctgccccatgggctgggctg

SEQ ID NO: 8042967 - DNA, 22 bp, Homo sapiens
ggctgccataactgataccata

SEQ ID NO: 8042968 - DNA, 22 bp, Homo sapiens
ggctgccataacagagtaccac

SEQ ID NO: 8042969 - DNA, 22 bp, Homo sapiens
ggctgcctcaaagctcaagctc

SEQ ID NO: 8042970 - DNA, 22 bp, Homo sapiens
ggctgccctcggggtcgcaggc

SEQ ID NO: 8042971 - DNA, 22 bp, Homo sapiens
ggctgtctctgtgactgccacc

SEQ ID NO: 8042972 - DNA, 22 bp, Homo sapiens
gtgctgtgtctatcaggaataa

SEQ ID NO: 8042973 - DNA, 22 bp, Homo sapiens
cagccctgctggttttgggcaa

SEQ ID NO: 8042974 - DNA, 22 bp, Homo sapiens
cagccctgccatggagcctcct

SEQ ID NO: 8042975 - DNA, 23 bp, Homo sapiens
cagccctgaaatcgaggtgacac

SEQ ID NO: 8042976 - DNA, 22 bp, Homo sapiens
cagccctgcagccatggcctgt

SEQ ID NO: 8042977 - DNA, 23 bp, Homo sapiens
cagccctggagatgtgggaggca

SEQ ID NO: 8042978 - DNA, 22 bp, Homo sapiens
cagccctggaacagctgactca

SEQ ID NO: 8042979 - DNA, 22 bp, Homo sapiens
cagccctggcccaggtgcctta

SEQ ID NO: 8042980 - DNA, 22 bp, Homo sapiens
cagccctggcagctttcagggt

SEQ ID NO: 8042981 - DNA, 22 bp, Homo sapiens
cagcctgcagggctgcctgttg

SEQ ID NO: 8042982 - DNA, 22 bp, Homo sapiens
cagcctgctagggcaatgcctt

SEQ ID NO: 8042983 - DNA, 22 bp, Homo sapiens
cagcctgcagggctgcctgttg

SEQ ID NO: 8042984 - DNA, 22 bp, Homo sapiens
cagctagctaagaaggccagag

SEQ ID NO: 8042985 - DNA, 22 bp, Homo sapiens
cagctaggaaaccagagggcag

SEQ ID NO: 8042986 - DNA, 22 bp, Homo sapiens
gtgcccagtcctgccttgacag

SEQ ID NO: 8042987 - DNA, 22 bp, Homo sapiens
cagctagggagtggcagagctt

SEQ ID NO: 8042988 - DNA, 22 bp, Homo sapiens
cagctagggagtggcagagctt

SEQ ID NO: 8042989 - DNA, 22 bp, Homo sapiens
cagcctggattgcagaatgcta

SEQ ID NO: 8042990 - DNA, 22 bp, Homo sapiens
cagcctggagccacagcccagg

SEQ ID NO: 8042991 - DNA, 22 bp, Homo sapiens
cagcctggacagcgaccagagt

SEQ ID NO: 8042992 - DNA, 21 bp, Homo sapiens
cagcctgctgctccagggcca

SEQ ID NO: 8042993 - DNA, 22 bp, Homo sapiens
cagcctggtccccggctcaccc

SEQ ID NO: 8042994 - DNA, 22 bp, Homo sapiens
cagcctgggctccagagtccct

SEQ ID NO: 8042995 - DNA, 22 bp, Homo sapiens
cagcctggcctgggactgctga

SEQ ID NO: 8042996 - DNA, 22 bp, Homo sapiens
cagcctggtccccggctcaccc

SEQ ID NO: 8042997 - DNA, 22 bp, Homo sapiens
cagccaggcctggtgaccaaag

SEQ ID NO: 8042998 - DNA, 22 bp, Homo sapiens
cagccagggagggcaaatgaga

SEQ ID NO: 8042999 - DNA, 22 bp, Homo sapiens
cagccagggagcaaagagttga

SEQ ID NO: 8043000 - DNA, 22 bp, Homo sapiens
gtccctgggtctaaggcagtaa

SEQ ID NO: 8043001 - DNA, 22 bp, Homo sapiens
cagccctcatcccgcctgcgtt

SEQ ID NO: 8043002 - DNA, 22 bp, Homo sapiens
cagccctcaggtcctcagcagc

SEQ ID NO: 8043003 - DNA, 22 bp, Homo sapiens
cagccctcaggtcctcagcagc

SEQ ID NO: 8043004 - DNA, 22 bp, Homo sapiens
cagcccctcacagagctgtcct

SEQ ID NO: 8043005 - DNA, 22 bp, Homo sapiens
cagccccttgtccggtagccac

SEQ ID NO: 8043006 - DNA, 22 bp, Homo sapiens
cagccccttcctggcatctgga

SEQ ID NO: 8043007 - DNA, 22 bp, Homo sapiens
cagccaggtatgggcgtgcggg

SEQ ID NO: 8043008 - DNA, 22 bp, Homo sapiens
cagccagggtcaggcagcttct

SEQ ID NO: 8043009 - DNA, 22 bp, Homo sapiens
cagccaggggctggcgtgttga

SEQ ID NO: 8043010 - DNA, 22 bp, Homo sapiens
cagccccatggtgtgctccagc

SEQ ID NO: 8043011 - DNA, 22 bp, Homo sapiens
cagccaggttcaagtccttata

SEQ ID NO: 8043012 - DNA, 22 bp, Homo sapiens
cagccaggttagtgctaattgt

SEQ ID NO: 8043013 - DNA, 22 bp, Homo sapiens
cagcagctagaggaagggcaga

SEQ ID NO: 8043014 - DNA, 22 bp, Homo sapiens
cagcagctgcaaatggaaacag

SEQ ID NO: 8043015 - DNA, 22 bp, Homo sapiens
cagcagctgcaaatggaaacag

SEQ ID NO: 8043016 - DNA, 22 bp, Homo sapiens
cagcagctgcgtgcccaggccg

SEQ ID NO: 8043017 - DNA, 22 bp, Homo sapiens
cagcagctggtgagacacagcc

SEQ ID NO: 8043018 - DNA, 22 bp, Homo sapiens
cagcagctggtgagacacagcc

SEQ ID NO: 8043019 - DNA, 22 bp, Homo sapiens
cagcagctggtgagacacagcc

SEQ ID NO: 8043020 - DNA, 22 bp, Homo sapiens
cagcagctggttatacctgtgg

SEQ ID NO: 8043021 - DNA, 22 bp, Homo sapiens
cagcagcttctgttgatcagaa

SEQ ID NO: 8043022 - DNA, 20 bp, Homo sapiens
cagcaggaaaagtgcctcag

SEQ ID NO: 8043023 - DNA, 22 bp, Homo sapiens
cagcaggaaaatcaattctgtg

SEQ ID NO: 8043024 - DNA, 22 bp, Homo sapiens
cagcaggaaagacatctgagca

SEQ ID NO: 8043025 - DNA, 22 bp, Homo sapiens
cagcaggaaggtttcccctgca

SEQ ID NO: 8043026 - DNA, 22 bp, Homo sapiens
cagcaggacatggaggagtaaa

SEQ ID NO: 8043027 - DNA, 22 bp, Homo sapiens
cagcaggctctgagtggctgcc

SEQ ID NO: 8043028 - DNA, 22 bp, Homo sapiens
cagcaggctctgagtggctgcc

SEQ ID NO: 8043029 - DNA, 22 bp, Homo sapiens
gtcccaggcaggccactggcag

SEQ ID NO: 8043030 - DNA, 22 bp, Homo sapiens
gtcccaggaacattctggctag

SEQ ID NO: 8043031 - DNA, 22 bp, Homo sapiens
cagcaggcgttgggagaaagac

SEQ ID NO: 8043032 - DNA, 20 bp, Homo sapiens
cagcaggctatggggcaccc

SEQ ID NO: 8043033 - DNA, 20 bp, Homo sapiens
cagcaggctatggggcaccc

SEQ ID NO: 8043034 - DNA, 20 bp, Homo sapiens
cagcaggctatggggcaccc

SEQ ID NO: 8043035 - DNA, 23 bp, Homo sapiens
gtcatcattaaagtcacagagac

SEQ ID NO: 8043036 - DNA, 22 bp, Homo sapiens
gggcaggtatttatcttctatt

SEQ ID NO: 8043037 - DNA, 21 bp, Homo sapiens
gggcaggtctctgatgtcaac

SEQ ID NO: 8043038 - DNA, 22 bp, Homo sapiens
gggcagtgggtggctgcagcct

SEQ ID NO: 8043039 - DNA, 22 bp, Homo sapiens
gggcagtgggtggctgcagcct

SEQ ID NO: 8043040 - DNA, 22 bp, Homo sapiens
gggcagtgggaccaggcaccag

SEQ ID NO: 8043041 - DNA, 22 bp, Homo sapiens
gggcagtggctcacgcctgtaa

SEQ ID NO: 8043042 - DNA, 20 bp, Homo sapiens
gggcagtggcgctatctcag

SEQ ID NO: 8043043 - DNA, 22 bp, Homo sapiens
gggcagtggtccaggctacagc

SEQ ID NO: 8043044 - DNA, 22 bp, Homo sapiens
gggcagtggttacacagctgag

SEQ ID NO: 8043045 - DNA, 22 bp, Homo sapiens
gggcagcatgaggaccctcatc

SEQ ID NO: 8043046 - DNA, 22 bp, Homo sapiens
gggcagcatgaggaccctcatc

SEQ ID NO: 8043047 - DNA, 22 bp, Homo sapiens
gggcagcatcaggaggggcttt

SEQ ID NO: 8043048 - DNA, 22 bp, Homo sapiens
gggcagcagcaggaggtctctg

SEQ ID NO: 8043049 - DNA, 22 bp, Homo sapiens
gggcagcagcaggaggtctctg

SEQ ID NO: 8043050 - DNA, 22 bp, Homo sapiens
gggcagcaggctccacgttcct

SEQ ID NO: 8043051 - DNA, 22 bp, Homo sapiens
cagagacaggaatcagctgcag

SEQ ID NO: 8043052 - DNA, 22 bp, Homo sapiens
gggcagcattctgtgggcaggt

SEQ ID NO: 8043053 - DNA, 22 bp, Homo sapiens
gggcagagactcagaaacagaa

SEQ ID NO: 8043054 - DNA, 22 bp, Homo sapiens
gggcagcagagccctgccgagt

SEQ ID NO: 8043055 - DNA, 22 bp, Homo sapiens
gggcagcagagccctgccgagt

SEQ ID NO: 8043056 - DNA, 22 bp, Homo sapiens
cagacctgaggagcactgagcc

SEQ ID NO: 8043057 - DNA, 22 bp, Homo sapiens
cagacctggggcctgggagccc

SEQ ID NO: 8043058 - DNA, 22 bp, Homo sapiens
cagacctgggtccctggcctgt

SEQ ID NO: 8043059 - DNA, 19 bp, Homo sapiens
cagacctgtccagcctgtg

SEQ ID NO: 8043060 - DNA, 22 bp, Homo sapiens
ggcttcagaagactggacaggt

SEQ ID NO: 8043061 - DNA, 22 bp, Homo sapiens
cagacagggtcctgtccgtcac

SEQ ID NO: 8043062 - DNA, 22 bp, Homo sapiens
cagacctcaaagctgcagtgct

SEQ ID NO: 8043063 - DNA, 17 bp, Homo sapiens
cagacctctgtgaagcc

SEQ ID NO: 8043064 - DNA, 22 bp, Homo sapiens
cagacccttttctgagaggacc

SEQ ID NO: 8043065 - DNA, 21 bp, Homo sapiens
cagaccctctagaggccacct

SEQ ID NO: 8043066 - DNA, 22 bp, Homo sapiens
gggctgagtctgctgcctgtca

SEQ ID NO: 8043067 - DNA, 22 bp, Homo sapiens
cagagcctctgccctgggcact

SEQ ID NO: 8043068 - DNA, 22 bp, Homo sapiens
cagagcctctcagccccttggg

SEQ ID NO: 8043069 - DNA, 22 bp, Homo sapiens
gggcagtgtcggggcccaggga

SEQ ID NO: 8043070 - DNA, 22 bp, Homo sapiens
gggcagtgtcgaggtctggtcc

SEQ ID NO: 8043071 - DNA, 22 bp, Homo sapiens
gggcagtgtctggcccccaggc

SEQ ID NO: 8043072 - DNA, 22 bp, Homo sapiens
gggccagcagtatcggaggcat

SEQ ID NO: 8043073 - DNA, 22 bp, Homo sapiens
gggccagagcttggcagctggg

SEQ ID NO: 8043074 - DNA, 22 bp, Homo sapiens
gggccagagcttggcagctggg

SEQ ID NO: 8043075 - DNA, 22 bp, Homo sapiens
gggccagcagtatcggaggcat

SEQ ID NO: 8043076 - DNA, 20 bp, Homo sapiens
gggctctgcttggcagaagt

SEQ ID NO: 8043077 - DNA, 20 bp, Homo sapiens
gggctctgcttggcagaagt

SEQ ID NO: 8043078 - DNA, 22 bp, Homo sapiens
gggctctgcgggcccggactcc

SEQ ID NO: 8043079 - DNA, 22 bp, Homo sapiens
cagagcctaaaacgactccact

SEQ ID NO: 8043080 - DNA, 22 bp, Homo sapiens
cagagcccttggctggagccca

SEQ ID NO: 8043081 - DNA, 22 bp, Homo sapiens
cagagcctccctcctctgccat

SEQ ID NO: 8043082 - DNA, 19 bp, Homo sapiens
cagagcctcagagctagaa

SEQ ID NO: 8043083 - DNA, 22 bp, Homo sapiens
cagagcctcagaatcctgtgga

SEQ ID NO: 8043084 - DNA, 22 bp, Homo sapiens
gggctctgtttagaccagagat

SEQ ID NO: 8043085 - DNA, 22 bp, Homo sapiens
gggctctgtttagatcagagat

SEQ ID NO: 8043086 - DNA, 22 bp, Homo sapiens
gggctgacaatctctttactta

SEQ ID NO: 8043087 - DNA, 22 bp, Homo sapiens
gggctgaccccacccctcactc

SEQ ID NO: 8043088 - DNA, 22 bp, Homo sapiens
cagagggctcttggctgcctgc

SEQ ID NO: 8043089 - DNA, 21 bp, Homo sapiens
cagaggggctagcctggctgc

SEQ ID NO: 8043090 - DNA, 22 bp, Homo sapiens
ggggagcagaagcagcaacaac

SEQ ID NO: 8043091 - DNA, 22 bp, Homo sapiens
ggggagcaatagttgaggtgtg

SEQ ID NO: 8043092 - DNA, 22 bp, Homo sapiens
ggggagcaggctgggctgtctg

SEQ ID NO: 8043093 - DNA, 22 bp, Homo sapiens
cagaggcacagtgcgggccact

SEQ ID NO: 8043094 - DNA, 22 bp, Homo sapiens
ggggagagtcctttccagttcc

SEQ ID NO: 8043095 - DNA, 22 bp, Homo sapiens
ggggagagtcctttccagttcc

SEQ ID NO: 8043096 - DNA, 22 bp, Homo sapiens
ggtcatagagctggaaattggc

SEQ ID NO: 8043097 - DNA, 18 bp, Homo sapiens
ggtcctgggcctggctca

SEQ ID NO: 8043098 - DNA, 22 bp, Homo sapiens
cagcacagtgaccagacccact

SEQ ID NO: 8043099 - DNA, 22 bp, Homo sapiens
cagcacagtgcagatgctgact

SEQ ID NO: 8043100 - DNA, 22 bp, Homo sapiens
cagcacagtttcccccatgagc

SEQ ID NO: 8043101 - DNA, 22 bp, Homo sapiens
cagcacatctgattatatgact

SEQ ID NO: 8043102 - DNA, 22 bp, Homo sapiens
cagcacatctccaagaatttct

SEQ ID NO: 8043103 - DNA, 22 bp, Homo sapiens
cagcacagtttgcttggcagag

SEQ ID NO: 8043104 - DNA, 22 bp, Homo sapiens
ggtgacctcacctggtcccacc

SEQ ID NO: 8043105 - DNA, 22 bp, Homo sapiens
cagcaagagactgttctctaag

SEQ ID NO: 8043106 - DNA, 21 bp, Homo sapiens
cagcaaggaagtcgagtaggt

SEQ ID NO: 8043107 - DNA, 22 bp, Homo sapiens
ctctgagcccgctgcagcccca

SEQ ID NO: 8043108 - DNA, 22 bp, Homo sapiens
ctctcaggtagagcccaagaat

SEQ ID NO: 8043109 - DNA, 17 bp, Homo sapiens
ctctgcagtgcatggct

SEQ ID NO: 8043110 - DNA, 22 bp, Homo sapiens
ctctgcagtgtaacagcgcttg

SEQ ID NO: 8043111 - DNA, 23 bp, Homo sapiens
ctctgcaggagagtgggcagggc

SEQ ID NO: 8043112 - DNA, 22 bp, Homo sapiens
ctctgcctgtgtcgccaccaca

SEQ ID NO: 8043113 - DNA, 22 bp, Homo sapiens
ctctgcctgcccaccgacccat

SEQ ID NO: 8043114 - DNA, 20 bp, Homo sapiens
ctctggcaaaggatgcctat

SEQ ID NO: 8043115 - DNA, 22 bp, Homo sapiens
ctctgctgatctcagctgggct

SEQ ID NO: 8043116 - DNA, 22 bp, Homo sapiens
ctgaaatagtttcatagaactt

SEQ ID NO: 8043117 - DNA, 22 bp, Homo sapiens
ctgaaaggcagtgggtagtgtg

SEQ ID NO: 8043118 - DNA, 22 bp, Homo sapiens
ctctgggaaagattgtgcaggc

SEQ ID NO: 8043119 - DNA, 22 bp, Homo sapiens
ctgagcagcagggagactggtg

SEQ ID NO: 8043120 - DNA, 22 bp, Homo sapiens
ctgagcagcacagggcgccagg

SEQ ID NO: 8043121 - DNA, 22 bp, Homo sapiens
ctgagcagcaattgctggccca

SEQ ID NO: 8043122 - DNA, 22 bp, Homo sapiens
ctgagcagatgaccagccccag

SEQ ID NO: 8043123 - DNA, 19 bp, Homo sapiens
ctgagcagagggaggaact

SEQ ID NO: 8043124 - DNA, 22 bp, Homo sapiens
ctgagcagcaacccagagcctc

SEQ ID NO: 8043125 - DNA, 22 bp, Homo sapiens
ctgagcagatgttgcccagaag

SEQ ID NO: 8043126 - DNA, 22 bp, Homo sapiens
ctgaatgctttggttctaaaag

SEQ ID NO: 8043127 - DNA, 22 bp, Homo sapiens
ctgacacactgagcatttgata

SEQ ID NO: 8043128 - DNA, 22 bp, Homo sapiens
ctgaatgaaatcaaggactgag

SEQ ID NO: 8043129 - DNA, 22 bp, Homo sapiens
ctccagctttttcccagttggc

SEQ ID NO: 8043130 - DNA, 22 bp, Homo sapiens
ctccagcttctgcccagagact

SEQ ID NO: 8043131 - DNA, 22 bp, Homo sapiens
ctccagctgctggtctgagact

SEQ ID NO: 8043132 - DNA, 22 bp, Homo sapiens
ctcattgcagttaatgagatgt

SEQ ID NO: 8043133 - DNA, 22 bp, Homo sapiens
ctcattgcagctgcattactgt

SEQ ID NO: 8043134 - DNA, 22 bp, Homo sapiens
ctccagctcttaactgcggaag

SEQ ID NO: 8043135 - DNA, 22 bp, Homo sapiens
ctccagctagggctggcttact

SEQ ID NO: 8043136 - DNA, 22 bp, Homo sapiens
ctccagctcttaactgcggaag

SEQ ID NO: 8043137 - DNA, 22 bp, Homo sapiens
ctcatgcccagagccactgttg

SEQ ID NO: 8043138 - DNA, 22 bp, Homo sapiens
ctcctggggcacttagaagcaa

SEQ ID NO: 8043139 - DNA, 19 bp, Homo sapiens
agtggcagatctggaagta

SEQ ID NO: 8043140 - DNA, 22 bp, Homo sapiens
agtggcagatctctggtctgga

SEQ ID NO: 8043141 - DNA, 22 bp, Homo sapiens
agtggcagatctctggtctgga

SEQ ID NO: 8043142 - DNA, 22 bp, Homo sapiens
agtggcagaggttgactgcagt

SEQ ID NO: 8043143 - DNA, 22 bp, Homo sapiens
agtggcagaggttgactgcagt

SEQ ID NO: 8043144 - DNA, 22 bp, Homo sapiens
agtggcagagtcagggtttgga

SEQ ID NO: 8043145 - DNA, 20 bp, Homo sapiens
ctcctggtccaggagcctga

SEQ ID NO: 8043146 - DNA, 22 bp, Homo sapiens
ctcctggtgactcccagataaa

SEQ ID NO: 8043147 - DNA, 22 bp, Homo sapiens
ctcctggtgctggggctgccgc

SEQ ID NO: 8043148 - DNA, 23 bp, Homo sapiens
ctcctggtgctgctatcaggggt

SEQ ID NO: 8043149 - DNA, 22 bp, Homo sapiens
agtggcagaagccaagtctgca

SEQ ID NO: 8043150 - DNA, 22 bp, Homo sapiens
ctccctcatatacccagcgaga

SEQ ID NO: 8043151 - DNA, 22 bp, Homo sapiens
ctccctctcaccggagccctgg

SEQ ID NO: 8043152 - DNA, 22 bp, Homo sapiens
ctcctcagaagagggtaacaca

SEQ ID NO: 8043153 - DNA, 22 bp, Homo sapiens
ctcctgcccacgtgctacttct

SEQ ID NO: 8043154 - DNA, 22 bp, Homo sapiens
ctcctcagagagcagcttgggg

SEQ ID NO: 8043155 - DNA, 22 bp, Homo sapiens
ctcctcagactttccttgtccg

SEQ ID NO: 8043156 - DNA, 22 bp, Homo sapiens
ctccctctctaaggcaaagaga

SEQ ID NO: 8043157 - DNA, 22 bp, Homo sapiens
ctcctcaaggtctcaggaataa

SEQ ID NO: 8043158 - DNA, 22 bp, Homo sapiens
ctcctcagaacagccttggctg

SEQ ID NO: 8043159 - DNA, 22 bp, Homo sapiens
cgcagcttcagggccaggaggg

SEQ ID NO: 8043160 - DNA, 22 bp, Homo sapiens
cggctcagctagcttggcccca

SEQ ID NO: 8043161 - DNA, 22 bp, Homo sapiens
cgcagggccgcgagcgggacca

SEQ ID NO: 8043162 - DNA, 22 bp, Homo sapiens
cgcaggtgaaagaggctgggca

SEQ ID NO: 8043163 - DNA, 22 bp, Homo sapiens
cgcaggtgaactgttctgcagt

SEQ ID NO: 8043164 - DNA, 22 bp, Homo sapiens
cggctcaggccacaggacggca

SEQ ID NO: 8043165 - DNA, 22 bp, Homo sapiens
cgggcacacacttgacaggttc

SEQ ID NO: 8043166 - DNA, 22 bp, Homo sapiens
cgggccctttaaggatgtgtcg

SEQ ID NO: 8043167 - DNA, 22 bp, Homo sapiens
cgggcagtgtggctccagagtc

SEQ ID NO: 8043168 - DNA, 23 bp, Homo sapiens
agtatgggggatcacgtggccct

SEQ ID NO: 8043169 - DNA, 22 bp, Homo sapiens
ctagaaggtctgggcctgggaa

SEQ ID NO: 8043170 - DNA, 20 bp, Homo sapiens
ctagaagcagaattgctgat

SEQ ID NO: 8043171 - DNA, 22 bp, Homo sapiens
ctagaagcaactagatctgttt

SEQ ID NO: 8043172 - DNA, 22 bp, Homo sapiens
agtccaggctcttcctgaagaa

SEQ ID NO: 8043173 - DNA, 22 bp, Homo sapiens
agtccagggctctctgtgggat

SEQ ID NO: 8043174 - DNA, 22 bp, Homo sapiens
cctgtcagttgctgtcagggat

SEQ ID NO: 8043175 - DNA, 22 bp, Homo sapiens
cctggtgccggtagacgcgcag

SEQ ID NO: 8043176 - DNA, 22 bp, Homo sapiens
cctggtgctgctatcaggggta

SEQ ID NO: 8043177 - DNA, 22 bp, Homo sapiens
cctgggctttcggcggcttcct

SEQ ID NO: 8043178 - DNA, 22 bp, Homo sapiens
cctgggctttgagggcaggatg

SEQ ID NO: 8043179 - DNA, 22 bp, Homo sapiens
cctgggcttctgtctagatgtt

SEQ ID NO: 8043180 - DNA, 22 bp, Homo sapiens
cctgggcttggttgttgagaac

SEQ ID NO: 8043181 - DNA, 22 bp, Homo sapiens
cctgggcttgcatctgtgctgg

SEQ ID NO: 8043182 - DNA, 22 bp, Homo sapiens
cctgggcttgcatctgtgctgg

SEQ ID NO: 8043183 - DNA, 22 bp, Homo sapiens
cctgggctcaagtgatggtccc

SEQ ID NO: 8043184 - DNA, 22 bp, Homo sapiens
cctgggcataaatcactccaag

SEQ ID NO: 8043185 - DNA, 22 bp, Homo sapiens
cctgggctcaggcttgggcagc

SEQ ID NO: 8043186 - DNA, 20 bp, Homo sapiens
cctgggctccaggagccccg

SEQ ID NO: 8043187 - DNA, 22 bp, Homo sapiens
cctgggctcaccatgccttgga

SEQ ID NO: 8043188 - DNA, 20 bp, Homo sapiens
cctgtcatcccagcattttg

SEQ ID NO: 8043189 - DNA, 22 bp, Homo sapiens
cctgtgccagccccttctgctg

SEQ ID NO: 8043190 - DNA, 22 bp, Homo sapiens
aggtgggcaatgaggcctgagt

SEQ ID NO: 8043191 - DNA, 22 bp, Homo sapiens
aggtgggcacagatggagaagt

SEQ ID NO: 8043192 - DNA, 22 bp, Homo sapiens
aggtggggagtatatgtaattg

SEQ ID NO: 8043193 - DNA, 22 bp, Homo sapiens
aggtggggccaaatgctacagt

SEQ ID NO: 8043194 - DNA, 22 bp, Homo sapiens
aggtggggccaaatgctacagt

SEQ ID NO: 8043195 - DNA, 22 bp, Homo sapiens
aggtggggcccaccaatttgca

SEQ ID NO: 8043196 - DNA, 21 bp, Homo sapiens
aggtggggctgcacctctgct

SEQ ID NO: 8043197 - DNA, 23 bp, Homo sapiens
aggtaggttattgctgctacctg

SEQ ID NO: 8043198 - DNA, 23 bp, Homo sapiens
aggtaggttattgctgctacctg

SEQ ID NO: 8043199 - DNA, 21 bp, Homo sapiens
cctgccaggaaactgagtgtc

SEQ ID NO: 8043200 - DNA, 22 bp, Homo sapiens
cctgccagctgtgggccagcct

SEQ ID NO: 8043201 - DNA, 22 bp, Homo sapiens
cctgcagagcaggagaggcatc

SEQ ID NO: 8043202 - DNA, 23 bp, Homo sapiens
cctgcagctgctggggctccacc

SEQ ID NO: 8043203 - DNA, 23 bp, Homo sapiens
cctgcagctgccacgccctgctc

SEQ ID NO: 8043204 - DNA, 22 bp, Homo sapiens
cctgcagcctcttctgaaaatc

SEQ ID NO: 8043205 - DNA, 22 bp, Homo sapiens
cctgcagccgtcctgtttgtct

SEQ ID NO: 8043206 - DNA, 22 bp, Homo sapiens
cctgccagatcccctgagctga

SEQ ID NO: 8043207 - DNA, 22 bp, Homo sapiens
cctgccagcccccatagagaca

SEQ ID NO: 8043208 - DNA, 22 bp, Homo sapiens
cctgccagccagatcactcgcc

SEQ ID NO: 8043209 - DNA, 22 bp, Homo sapiens
aggtccctcgcacatgcagggt

SEQ ID NO: 8043210 - DNA, 22 bp, Homo sapiens
cctggaggtggaggttgcagtg

SEQ ID NO: 8043211 - DNA, 22 bp, Homo sapiens
cctggagtgacaggtgtagcct

SEQ ID NO: 8043212 - DNA, 22 bp, Homo sapiens
cctggcaacatttcaaggtctt

SEQ ID NO: 8043213 - DNA, 22 bp, Homo sapiens
ctgctgaggtatactatgtgac

SEQ ID NO: 8043214 - DNA, 22 bp, Homo sapiens
ctgctgagcctggtgcgggatg

SEQ ID NO: 8043215 - DNA, 22 bp, Homo sapiens
ataacagatgtgaagtgctaat

SEQ ID NO: 8043216 - DNA, 22 bp, Homo sapiens
ctgcctctcaggtccctgagat

SEQ ID NO: 8043217 - DNA, 22 bp, Homo sapiens
ctgcctctcaggtccctgagat

SEQ ID NO: 8043218 - DNA, 22 bp, Homo sapiens
ctgcctctgcgtcccacagagt

SEQ ID NO: 8043219 - DNA, 22 bp, Homo sapiens
ataaatgattcagcaggaaata

SEQ ID NO: 8043220 - DNA, 22 bp, Homo sapiens
ctgcagggagaggggacagcct

SEQ ID NO: 8043221 - DNA, 22 bp, Homo sapiens
ctgcagggtgacgttgcccacc

SEQ ID NO: 8043222 - DNA, 20 bp, Homo sapiens
ctgcagggttagaggctcca

SEQ ID NO: 8043223 - DNA, 22 bp, Homo sapiens
ctgcagggtttcgccagttgtg

SEQ ID NO: 8043224 - DNA, 22 bp, Homo sapiens
ctgcagggttttaacaatggac

SEQ ID NO: 8043225 - DNA, 22 bp, Homo sapiens
ctgcagggtttttcaaggacaa

SEQ ID NO: 8043226 - DNA, 22 bp, Homo sapiens
ctgcaaggtcatgactctctgg

SEQ ID NO: 8043227 - DNA, 23 bp, Homo sapiens
ctgcaaggtacaagatgctggat

SEQ ID NO: 8043228 - DNA, 22 bp, Homo sapiens
atacatgttcgtgtacatgttc

SEQ ID NO: 8043229 - DNA, 22 bp, Homo sapiens
atacattcaaaggaaggataga

SEQ ID NO: 8043230 - DNA, 22 bp, Homo sapiens
ataccaccatctatgaaaggta

SEQ ID NO: 8043231 - DNA, 22 bp, Homo sapiens
ataccttttagacatgtagttg

SEQ ID NO: 8043232 - DNA, 22 bp, Homo sapiens
ctggaatgggaatcaggaaaga

SEQ ID NO: 8043233 - DNA, 22 bp, Homo sapiens
ctggagaattctatgaaatatt

SEQ ID NO: 8043234 - DNA, 22 bp, Homo sapiens
ctggagaagaggtagtatgtag

SEQ ID NO: 8043235 - DNA, 19 bp, Homo sapiens
atacagtaaggtgtttgcc

SEQ ID NO: 8043236 - DNA, 22 bp, Homo sapiens
atacagtaatttgtaactcatc

SEQ ID NO: 8043237 - DNA, 22 bp, Homo sapiens
atacagtagggaccatgtctga

SEQ ID NO: 8043238 - DNA, 19 bp, Homo sapiens
atagcagctatacccagat

SEQ ID NO: 8043239 - DNA, 22 bp, Homo sapiens
ctggctgcagctccgaggaaga

SEQ ID NO: 8043240 - DNA, 22 bp, Homo sapiens
ctggctgcaggaaggagtgggc

SEQ ID NO: 8043241 - DNA, 22 bp, Homo sapiens
ctggctggccggagcgaggcgg

SEQ ID NO: 8043242 - DNA, 22 bp, Homo sapiens
ctggctccctcgctgaggtgct

SEQ ID NO: 8043243 - DNA, 22 bp, Homo sapiens
atactacacattgactatattt

SEQ ID NO: 8043244 - DNA, 22 bp, Homo sapiens
atactacactatgcatggatgt

SEQ ID NO: 8043245 - DNA, 22 bp, Homo sapiens
atagatgttttagtaatactgt

SEQ ID NO: 8043246 - DNA, 22 bp, Homo sapiens
atagatttgaatttaagacttg

SEQ ID NO: 8043247 - DNA, 22 bp, Homo sapiens
atagatgttcaatcagatattt

SEQ ID NO: 8043248 - DNA, 22 bp, Homo sapiens
ctggcccatggtgagctctggg

SEQ ID NO: 8043249 - DNA, 22 bp, Homo sapiens
ctggccccaggcagcctgctgg

SEQ ID NO: 8043250 - DNA, 22 bp, Homo sapiens
ctggcccccacacctgtcaggg

SEQ ID NO: 8043251 - DNA, 22 bp, Homo sapiens
atccaggcttaatgggagccac

SEQ ID NO: 8043252 - DNA, 22 bp, Homo sapiens
atcagaattagccagtgaggct

SEQ ID NO: 8043253 - DNA, 22 bp, Homo sapiens
atcagaatgcagccagcagtta

SEQ ID NO: 8043254 - DNA, 22 bp, Homo sapiens
atcagaatcttctgaacagtgg

SEQ ID NO: 8043255 - DNA, 22 bp, Homo sapiens
atcagaatgattagtaaccaat

SEQ ID NO: 8043256 - DNA, 22 bp, Homo sapiens
atcagacactagtggactagaa

SEQ ID NO: 8043257 - DNA, 22 bp, Homo sapiens
ctgtggagttccatcaggggag

SEQ ID NO: 8043258 - DNA, 22 bp, Homo sapiens
ctgtggcctggggacactatct

SEQ ID NO: 8043259 - DNA, 21 bp, Homo sapiens
ctgtggcctggctagcaccgt

SEQ ID NO: 8043260 - DNA, 22 bp, Homo sapiens
ctgtggctcaaaatcccatgat

SEQ ID NO: 8043261 - DNA, 21 bp, Homo sapiens
ctgtgggaccaagcactggga

SEQ ID NO: 8043262 - DNA, 22 bp, Homo sapiens
ctgtgggagaagctagcacagg

SEQ ID NO: 8043263 - DNA, 22 bp, Homo sapiens
ctgtgggagaagttgctggagt

SEQ ID NO: 8043264 - DNA, 22 bp, Homo sapiens
ctgtgggagaggtgcctggatt

SEQ ID NO: 8043265 - DNA, 22 bp, Homo sapiens
ctgtgggaatactgcgagtgta

SEQ ID NO: 8043266 - DNA, 22 bp, Homo sapiens
ctgtgggaacactgaggacttc

SEQ ID NO: 8043267 - DNA, 22 bp, Homo sapiens
cttcccactagtatcacagagc

SEQ ID NO: 8043268 - DNA, 17 bp, Homo sapiens
cttcccaccatctcctg

SEQ ID NO: 8043269 - DNA, 22 bp, Homo sapiens
cttagaaattgttactcattca

SEQ ID NO: 8043270 - DNA, 22 bp, Homo sapiens
cttagaaggaacagtttagtgc

SEQ ID NO: 8043271 - DNA, 22 bp, Homo sapiens
cttagaaggatgtttgctgttt

SEQ ID NO: 8043272 - DNA, 22 bp, Homo sapiens
atctgaaaaatctcctttgtca

SEQ ID NO: 8043273 - DNA, 22 bp, Homo sapiens
atctgaaaagcctcttactcct

SEQ ID NO: 8043274 - DNA, 22 bp, Homo sapiens
atctgaaaagctttaatgagct

SEQ ID NO: 8043275 - DNA, 23 bp, Homo sapiens
atctgaaaagcatttgcagtttg

SEQ ID NO: 8043276 - DNA, 22 bp, Homo sapiens
atctgaaactctgacattgtct

SEQ ID NO: 8043277 - DNA, 23 bp, Homo sapiens
atctgaaaaggcattttcttccc

SEQ ID NO: 8043278 - DNA, 22 bp, Homo sapiens
cttcctctagcctagtaatgcc

SEQ ID NO: 8043279 - DNA, 21 bp, Homo sapiens
atctgaaatgtcaaagcagat

SEQ ID NO: 8043280 - DNA, 22 bp, Homo sapiens
atctgaaatagtcttatctgag

SEQ ID NO: 8043281 - DNA, 22 bp, Homo sapiens
atctgaaagctaggagttctca

SEQ ID NO: 8043282 - DNA, 22 bp, Homo sapiens
atctgaaagtttagaattcttg

SEQ ID NO: 8043283 - DNA, 21 bp, Homo sapiens
atctgaaaggttagtgttgag

SEQ ID NO: 8043284 - DNA, 21 bp, Homo sapiens
atctgaaaggttagtgttgag

SEQ ID NO: 8043285 - DNA, 22 bp, Homo sapiens
atcagaataattagatttcaga

SEQ ID NO: 8043286 - DNA, 22 bp, Homo sapiens
atcagaatactatcaacagtga

SEQ ID NO: 8043287 - DNA, 22 bp, Homo sapiens
atcagaaatagtcatgttactt

SEQ ID NO: 8043288 - DNA, 22 bp, Homo sapiens
atcagaaagttcatcatgtttg

SEQ ID NO: 8043289 - DNA, 22 bp, Homo sapiens
atcaacatgtcataaagtgaaa

SEQ ID NO: 8043290 - DNA, 22 bp, Homo sapiens
atcagaaaaacataatgttatt

SEQ ID NO: 8043291 - DNA, 21 bp, Homo sapiens
atattgtaggtaaagtgcagg

SEQ ID NO: 8043292 - DNA, 22 bp, Homo sapiens
atattgagatgaggatattaac

SEQ ID NO: 8043293 - DNA, 22 bp, Homo sapiens
atattgagataagaactgacat

SEQ ID NO: 8043294 - DNA, 22 bp, Homo sapiens
ctgggctcacctgtggctggca

SEQ ID NO: 8043295 - DNA, 22 bp, Homo sapiens
ctgggctcagaaccttgttaag

SEQ ID NO: 8043296 - DNA, 22 bp, Homo sapiens
ctgggctcagatgagaggaagg

SEQ ID NO: 8043297 - DNA, 21 bp, Homo sapiens
ctgggctcaagcaatcctttc

SEQ ID NO: 8043298 - DNA, 22 bp, Homo sapiens
ctggcttctgggccagggcaga

SEQ ID NO: 8043299 - DNA, 20 bp, Homo sapiens
ctgggctcaagtgagcctcc

SEQ ID NO: 8043300 - DNA, 22 bp, Homo sapiens
ctggctgggaagtagagtaggt

SEQ ID NO: 8043301 - DNA, 22 bp, Homo sapiens
atattaggttggtgcaaaagta

SEQ ID NO: 8043302 - DNA, 22 bp, Homo sapiens
atatgctaattagagggcatta

SEQ ID NO: 8043303 - DNA, 19 bp, Homo sapiens
ctgggctgaggtctgcctt

SEQ ID NO: 8043304 - DNA, 22 bp, Homo sapiens
ctgggctcttctcaccctgttt

SEQ ID NO: 8043305 - DNA, 22 bp, Homo sapiens
ctgggctctgtgtttcagtttc

SEQ ID NO: 8043306 - DNA, 22 bp, Homo sapiens
ctgggctctggggtcccggtgc

SEQ ID NO: 8043307 - DNA, 21 bp, Homo sapiens
cccacggaatgatgaggcact

SEQ ID NO: 8043308 - DNA, 22 bp, Homo sapiens
cccaccctgggctacacatcca

SEQ ID NO: 8043309 - DNA, 22 bp, Homo sapiens
cccacgtcgaacttgctccaga

SEQ ID NO: 8043310 - DNA, 22 bp, Homo sapiens
cccactgctgctctccatggca

SEQ ID NO: 8043311 - DNA, 22 bp, Homo sapiens
aggctgtgctcagccaatggga

SEQ ID NO: 8043312 - DNA, 22 bp, Homo sapiens
aggctgtggcatcacatcagga

SEQ ID NO: 8043313 - DNA, 22 bp, Homo sapiens
cccacacaaatcatggggagaa

SEQ ID NO: 8043314 - DNA, 22 bp, Homo sapiens
cccacacacatttatgatagga

SEQ ID NO: 8043315 - DNA, 22 bp, Homo sapiens
cccacacactggctgctgccaa

SEQ ID NO: 8043316 - DNA, 20 bp, Homo sapiens
cccacacccttcccacttgg

SEQ ID NO: 8043317 - DNA, 22 bp, Homo sapiens
cccacacatttttcacttaccg

SEQ ID NO: 8043318 - DNA, 18 bp, Homo sapiens
cccacacagcagtagctc

SEQ ID NO: 8043319 - DNA, 19 bp, Homo sapiens
aggctgcccagtctctgcc

SEQ ID NO: 8043320 - DNA, 22 bp, Homo sapiens
aggctgccgcagccaatggttg

SEQ ID NO: 8043321 - DNA, 22 bp, Homo sapiens
aggctgccctgccgccagtggg

SEQ ID NO: 8043322 - DNA, 22 bp, Homo sapiens
ccagtgggagggagctaggcca

SEQ ID NO: 8043323 - DNA, 22 bp, Homo sapiens
ccagtgggtaggccatggtgag

SEQ ID NO: 8043324 - DNA, 20 bp, Homo sapiens
aggctgccaggtctcacatc

SEQ ID NO: 8043325 - DNA, 22 bp, Homo sapiens
aggctgccagaagccttcagga

SEQ ID NO: 8043326 - DNA, 22 bp, Homo sapiens
ccaggcctgtgttgtgtggagg

SEQ ID NO: 8043327 - DNA, 22 bp, Homo sapiens
ccaggcctgtgcaaggagggag

SEQ ID NO: 8043328 - DNA, 22 bp, Homo sapiens
ccaggcctgtgcaaggagggag

SEQ ID NO: 8043329 - DNA, 22 bp, Homo sapiens
ccaggccttccagtacgcagaa

SEQ ID NO: 8043330 - DNA, 22 bp, Homo sapiens
ccaggcctcccttttccagcca

SEQ ID NO: 8043331 - DNA, 20 bp, Homo sapiens
ccaggcctgggcctgctcta

SEQ ID NO: 8043332 - DNA, 22 bp, Homo sapiens
aggctcagattcacatttggtt

SEQ ID NO: 8043333 - DNA, 22 bp, Homo sapiens
aggctcagatccttgtgtcctg

SEQ ID NO: 8043334 - DNA, 22 bp, Homo sapiens
ccaggcctttcttcttggtctg

SEQ ID NO: 8043335 - DNA, 22 bp, Homo sapiens
ccaggccttctgaggacactct

SEQ ID NO: 8043336 - DNA, 22 bp, Homo sapiens
aggctctgggaagcagtgagtt

SEQ ID NO: 8043337 - DNA, 22 bp, Homo sapiens
aggctctgggaacagacgggtg

SEQ ID NO: 8043338 - DNA, 22 bp, Homo sapiens
aggctctgggaagcagtgagtt

SEQ ID NO: 8043339 - DNA, 22 bp, Homo sapiens
aggctctggttggcaagtaaag

SEQ ID NO: 8043340 - DNA, 19 bp, Homo sapiens
aggctctgtaggagagggc

SEQ ID NO: 8043341 - DNA, 22 bp, Homo sapiens
aggctcagcccaaggtggagag

SEQ ID NO: 8043342 - DNA, 22 bp, Homo sapiens
aggctcagcatctgattcatat

SEQ ID NO: 8043343 - DNA, 21 bp, Homo sapiens
aggctcagcaggtgtataaag

SEQ ID NO: 8043344 - DNA, 22 bp, Homo sapiens
aggctcagcccctgggaggaga

SEQ ID NO: 8043345 - DNA, 22 bp, Homo sapiens
aggctcagcctgggcctagagc

SEQ ID NO: 8043346 - DNA, 22 bp, Homo sapiens
ccaggtggtgcctctgttcgca

SEQ ID NO: 8043347 - DNA, 20 bp, Homo sapiens
ccaggtggtgcctggagagg

SEQ ID NO: 8043348 - DNA, 18 bp, Homo sapiens
ccaggtggtgacagagat

SEQ ID NO: 8043349 - DNA, 22 bp, Homo sapiens
ccaggtggttcaggtcaccata

SEQ ID NO: 8043350 - DNA, 22 bp, Homo sapiens
ccaggtgtgtctggccccgaag

SEQ ID NO: 8043351 - DNA, 22 bp, Homo sapiens
ccaggtgttctttgtccctgtt

SEQ ID NO: 8043352 - DNA, 22 bp, Homo sapiens
ccaggtgttacacgagtgttaa

SEQ ID NO: 8043353 - DNA, 22 bp, Homo sapiens
ccaggtgtttggcctgcatgat

SEQ ID NO: 8043354 - DNA, 22 bp, Homo sapiens
ccagggcagcgcccctccacgc

SEQ ID NO: 8043355 - DNA, 22 bp, Homo sapiens
ccagggcagccaacccagatgc

SEQ ID NO: 8043356 - DNA, 22 bp, Homo sapiens
ccaggtggtgaaagtgggccct

SEQ ID NO: 8043357 - DNA, 16 bp, Homo sapiens
ccaggtggggctgtga

SEQ ID NO: 8043358 - DNA, 22 bp, Homo sapiens
ccaggtgctagcaatcactgtc

SEQ ID NO: 8043359 - DNA, 22 bp, Homo sapiens
ccagggcagcagaattggggca

SEQ ID NO: 8043360 - DNA, 22 bp, Homo sapiens
ccagggcagaaaaagagggaat

SEQ ID NO: 8043361 - DNA, 19 bp, Homo sapiens
aggctctgtaggagagggc

SEQ ID NO: 8043362 - DNA, 22 bp, Homo sapiens
ccagggcacttaggcccagccc

SEQ ID NO: 8043363 - DNA, 22 bp, Homo sapiens
ccagggcacttaggcccagccc

SEQ ID NO: 8043364 - DNA, 22 bp, Homo sapiens
aggctctgtcaggcggagcagc

SEQ ID NO: 8043365 - DNA, 22 bp, Homo sapiens
aggcctgggcaagaaggggcgt

SEQ ID NO: 8043366 - DNA, 22 bp, Homo sapiens
ccagctccctgaagcctggtct

SEQ ID NO: 8043367 - DNA, 22 bp, Homo sapiens
ccagctcccgcaggctgcacag

SEQ ID NO: 8043368 - DNA, 22 bp, Homo sapiens
aggccctgctttccagagctca

SEQ ID NO: 8043369 - DNA, 21 bp, Homo sapiens
aggctcagagatcaaacagta

SEQ ID NO: 8043370 - DNA, 22 bp, Homo sapiens
aggctcagagatgagtaagcac

SEQ ID NO: 8043371 - DNA, 22 bp, Homo sapiens
aggctcagagagctgtgtccat

SEQ ID NO: 8043372 - DNA, 21 bp, Homo sapiens
aggctcagagagaaactcttg

SEQ ID NO: 8043373 - DNA, 22 bp, Homo sapiens
aggcctggtgaatgaagtatct

SEQ ID NO: 8043374 - DNA, 22 bp, Homo sapiens
ccaggcaccatgttcttaggac

SEQ ID NO: 8043375 - DNA, 22 bp, Homo sapiens
ccaggcactgctcgaggtgcta

SEQ ID NO: 8043376 - DNA, 22 bp, Homo sapiens
ccaggcactgctcgaggtgcta

SEQ ID NO: 8043377 - DNA, 22 bp, Homo sapiens
ccaggcactcagagactgggac

SEQ ID NO: 8043378 - DNA, 22 bp, Homo sapiens
ccaggcactcagagactgggac

SEQ ID NO: 8043379 - DNA, 22 bp, Homo sapiens
aggctcagaggtgagcatctgc

SEQ ID NO: 8043380 - DNA, 20 bp, Homo sapiens
aggctcagagcagtagtaca

SEQ ID NO: 8043381 - DNA, 16 bp, Homo sapiens
aggctcagaggctgga

SEQ ID NO: 8043382 - DNA, 22 bp, Homo sapiens
ccaggcacaggtgggcctcaga

SEQ ID NO: 8043383 - DNA, 20 bp, Homo sapiens
aggctcagatacccagggaa

SEQ ID NO: 8043384 - DNA, 22 bp, Homo sapiens
aggcaggtctgtatctagtctc

SEQ ID NO: 8043385 - DNA, 22 bp, Homo sapiens
aggcaggtgagtcaaaacagac

SEQ ID NO: 8043386 - DNA, 22 bp, Homo sapiens
aggcaggtcccctggaaggcac

SEQ ID NO: 8043387 - DNA, 22 bp, Homo sapiens
aggcaggtcacatgcttggcga

SEQ ID NO: 8043388 - DNA, 22 bp, Homo sapiens
aggcaggtagaaggatctttat

SEQ ID NO: 8043389 - DNA, 19 bp, Homo sapiens
aggcaggtgcagaggtccc

SEQ ID NO: 8043390 - DNA, 23 bp, Homo sapiens
ccagccctccaccagctctaggc

SEQ ID NO: 8043391 - DNA, 22 bp, Homo sapiens
ccagccctgaaccctgctgcat

SEQ ID NO: 8043392 - DNA, 22 bp, Homo sapiens
aggccctgacctgggagatcta

SEQ ID NO: 8043393 - DNA, 22 bp, Homo sapiens
ccagccctgccagagagagctg

SEQ ID NO: 8043394 - DNA, 22 bp, Homo sapiens
aggccctgcccagtgccacaag

SEQ ID NO: 8043395 - DNA, 22 bp, Homo sapiens
ccagcagggaaaaacccaccaa

SEQ ID NO: 8043396 - DNA, 22 bp, Homo sapiens
ccagccagaagtccgggcttct

SEQ ID NO: 8043397 - DNA, 22 bp, Homo sapiens
ccagccagatgataagctctat

SEQ ID NO: 8043398 - DNA, 22 bp, Homo sapiens
ccagccagcaagctcccagttc

SEQ ID NO: 8043399 - DNA, 22 bp, Homo sapiens
ccagccagctggttggacgcct

SEQ ID NO: 8043400 - DNA, 22 bp, Homo sapiens
ccagccagccttgatctgagta

SEQ ID NO: 8043401 - DNA, 22 bp, Homo sapiens
ccagccagccttgatctgagta

SEQ ID NO: 8043402 - DNA, 22 bp, Homo sapiens
ccagccagctgcccttggggcc

SEQ ID NO: 8043403 - DNA, 22 bp, Homo sapiens
ccagccagctgcccttggggcc

SEQ ID NO: 8043404 - DNA, 22 bp, Homo sapiens
ccagccaggctggctgtggagg

SEQ ID NO: 8043405 - DNA, 22 bp, Homo sapiens
ccagccaggcattgcaaactga

SEQ ID NO: 8043406 - DNA, 22 bp, Homo sapiens
ccagccagggaaactttttctt

SEQ ID NO: 8043407 - DNA, 22 bp, Homo sapiens
ccagccagtatattccaaagcc

SEQ ID NO: 8043408 - DNA, 22 bp, Homo sapiens
ccagccagtatattccaaagcc

SEQ ID NO: 8043409 - DNA, 22 bp, Homo sapiens
agggaaataatctattctgagg

SEQ ID NO: 8043410 - DNA, 22 bp, Homo sapiens
agggaatggatgatggcaggtt

SEQ ID NO: 8043411 - DNA, 22 bp, Homo sapiens
agggacagttacatcatcagac

SEQ ID NO: 8043412 - DNA, 22 bp, Homo sapiens
agggaccacatcccctctgtgg

SEQ ID NO: 8043413 - DNA, 22 bp, Homo sapiens
cccaggccccagggcttgtcag

SEQ ID NO: 8043414 - DNA, 22 bp, Homo sapiens
cccaggccagaacttggttgct

SEQ ID NO: 8043415 - DNA, 22 bp, Homo sapiens
cccaggccctggcagagcttgt

SEQ ID NO: 8043416 - DNA, 21 bp, Homo sapiens
agggagctggccacacagcct

SEQ ID NO: 8043417 - DNA, 22 bp, Homo sapiens
agggagctgtggtcagctcagt

SEQ ID NO: 8043418 - DNA, 22 bp, Homo sapiens
agggagcttccgaactacagct

SEQ ID NO: 8043419 - DNA, 22 bp, Homo sapiens
agggccaccagagcagggcagt

SEQ ID NO: 8043420 - DNA, 22 bp, Homo sapiens
agggccaccagagcagggcagt

SEQ ID NO: 8043421 - DNA, 22 bp, Homo sapiens
agggccaccagggagtctcagg

SEQ ID NO: 8043422 - DNA, 22 bp, Homo sapiens
agggccacagtggggcctgaga

SEQ ID NO: 8043423 - DNA, 19 bp, Homo sapiens
agggccacggggaggtatt

SEQ ID NO: 8043424 - DNA, 22 bp, Homo sapiens
agggccaccagggagtctcagg

SEQ ID NO: 8043425 - DNA, 22 bp, Homo sapiens
agggcagctgtgagccactgtg

SEQ ID NO: 8043426 - DNA, 22 bp, Homo sapiens
agggcagcttccatagtctggc

SEQ ID NO: 8043427 - DNA, 22 bp, Homo sapiens
agggcagcttccatagtctggc

SEQ ID NO: 8043428 - DNA, 22 bp, Homo sapiens
agggcatgtgggagaggagcct

SEQ ID NO: 8043429 - DNA, 22 bp, Homo sapiens
agggcatgtgggagaggagcct

SEQ ID NO: 8043430 - DNA, 22 bp, Homo sapiens
agggcccacagttcctatggcc

SEQ ID NO: 8043431 - DNA, 23 bp, Homo sapiens
agggccaggtgcggaaacagctc

SEQ ID NO: 8043432 - DNA, 23 bp, Homo sapiens
agggccaggtgcggaaacagctc

SEQ ID NO: 8043433 - DNA, 22 bp, Homo sapiens
agggcccaggacagcatcaggg

SEQ ID NO: 8043434 - DNA, 22 bp, Homo sapiens
ccctgaggggagtggtgaggtg

SEQ ID NO: 8043435 - DNA, 22 bp, Homo sapiens
agggcagaagtacagacactta

SEQ ID NO: 8043436 - DNA, 22 bp, Homo sapiens
cccctgaagacaatggagaggt

SEQ ID NO: 8043437 - DNA, 21 bp, Homo sapiens
cccctgggagccctgtcagta

SEQ ID NO: 8043438 - DNA, 20 bp, Homo sapiens
cccaggtgtctgaagctctg

SEQ ID NO: 8043439 - DNA, 23 bp, Homo sapiens
cccaggtgtggaggcggtggcag

SEQ ID NO: 8043440 - DNA, 19 bp, Homo sapiens
cccaggtgtttgaggctgc

SEQ ID NO: 8043441 - DNA, 22 bp, Homo sapiens
cccaggtgggcacctcgaggaa

SEQ ID NO: 8043442 - DNA, 22 bp, Homo sapiens
cccaggtgggttggcctctgtc

SEQ ID NO: 8043443 - DNA, 21 bp, Homo sapiens
cccaggtgggatggttgcctc

SEQ ID NO: 8043444 - DNA, 22 bp, Homo sapiens
cccaggtggcagaagctgcagt

SEQ ID NO: 8043445 - DNA, 22 bp, Homo sapiens
cccaggtgctgaaggaggccgc

SEQ ID NO: 8043446 - DNA, 22 bp, Homo sapiens
cccaggtgctgcgtgaagcctc

SEQ ID NO: 8043447 - DNA, 20 bp, Homo sapiens
agggcctgttgcaagcgttt

SEQ ID NO: 8043448 - DNA, 20 bp, Homo sapiens
agggcctgttgcaagcgttt

SEQ ID NO: 8043449 - DNA, 22 bp, Homo sapiens
agggcctgtgctgagtagacga

SEQ ID NO: 8043450 - DNA, 22 bp, Homo sapiens
agggcctgtgcttcctgagata

SEQ ID NO: 8043451 - DNA, 22 bp, Homo sapiens
agggcctgtgctgagtagacga

SEQ ID NO: 8043452 - DNA, 21 bp, Homo sapiens
agggcctgtgctctccaggtc

SEQ ID NO: 8043453 - DNA, 22 bp, Homo sapiens
agggcctgtctgtagaactgaa

SEQ ID NO: 8043454 - DNA, 22 bp, Homo sapiens
ccctggcagagggggcaggtgc

SEQ ID NO: 8043455 - DNA, 19 bp, Homo sapiens
ccctggcaggcaagcctgg

SEQ ID NO: 8043456 - DNA, 22 bp, Homo sapiens
ccctggcatgcatgtccctggc

SEQ ID NO: 8043457 - DNA, 22 bp, Homo sapiens
ccctggcactagcgacggccat

SEQ ID NO: 8043458 - DNA, 22 bp, Homo sapiens
agggcccagtggagagctgagc

SEQ ID NO: 8043459 - DNA, 22 bp, Homo sapiens
agggcccatgtgggagcacttg

SEQ ID NO: 8043460 - DNA, 22 bp, Homo sapiens
agggctgacctaagctccactt

SEQ ID NO: 8043461 - DNA, 20 bp, Homo sapiens
agggctgagaagggactagc

SEQ ID NO: 8043462 - DNA, 22 bp, Homo sapiens
cctcaggggtcactgtgaggag

SEQ ID NO: 8043463 - DNA, 22 bp, Homo sapiens
agggctgggctgcttgttgtca

SEQ ID NO: 8043464 - DNA, 22 bp, Homo sapiens
aggggaaagaacagtcttcagg

SEQ ID NO: 8043465 - DNA, 22 bp, Homo sapiens
aggggaatgggtagactgttga

SEQ ID NO: 8043466 - DNA, 22 bp, Homo sapiens
aggggctcctggcctggagagc

SEQ ID NO: 8043467 - DNA, 22 bp, Homo sapiens
aggggctcctttgtgctgcgtc

SEQ ID NO: 8043468 - DNA, 22 bp, Homo sapiens
aggggctgcctggcttggcact

SEQ ID NO: 8043469 - DNA, 22 bp, Homo sapiens
aggggcgtctgtaggcagtggg

SEQ ID NO: 8043470 - DNA, 22 bp, Homo sapiens
agggggtgcccagatgaaggat

SEQ ID NO: 8043471 - DNA, 22 bp, Homo sapiens
agggggtgtctctgattgggtt

SEQ ID NO: 8043472 - DNA, 22 bp, Homo sapiens
agggggtgtctctgattgggtt

SEQ ID NO: 8043473 - DNA, 22 bp, Homo sapiens
agggggtctcctatcatggaag

SEQ ID NO: 8043474 - DNA, 22 bp, Homo sapiens
agggggtgatcaaggtgcggcg

SEQ ID NO: 8043475 - DNA, 22 bp, Homo sapiens
agggggctggagacacctcctc

SEQ ID NO: 8043476 - DNA, 22 bp, Homo sapiens
agggggagcttggctactcctg

SEQ ID NO: 8043477 - DNA, 22 bp, Homo sapiens
agggggagcttggctactcctg

SEQ ID NO: 8043478 - DNA, 20 bp, Homo sapiens
cctctgtgtcctgtgtcata

SEQ ID NO: 8043479 - DNA, 22 bp, Homo sapiens
cctctgtgtgtgcatgcatgcg

SEQ ID NO: 8043480 - DNA, 22 bp, Homo sapiens
caggctcttccatcctgctgag

SEQ ID NO: 8043481 - DNA, 21 bp, Homo sapiens
caggctctgctgggtgctggg

SEQ ID NO: 8043482 - DNA, 22 bp, Homo sapiens
agcttctagcccatccagcagg

SEQ ID NO: 8043483 - DNA, 22 bp, Homo sapiens
caggcccaggtgtcgatgttcc

SEQ ID NO: 8043484 - DNA, 22 bp, Homo sapiens
caggcccagggttattgggaaa

SEQ ID NO: 8043485 - DNA, 22 bp, Homo sapiens
caggcccagtgatcagggctct

SEQ ID NO: 8043486 - DNA, 22 bp, Homo sapiens
caggcccagtgatcagggctct

SEQ ID NO: 8043487 - DNA, 22 bp, Homo sapiens
caggcccatctgctcccaggct

SEQ ID NO: 8043488 - DNA, 22 bp, Homo sapiens
caggcccataatgcaaatattt

SEQ ID NO: 8043489 - DNA, 22 bp, Homo sapiens
caggcccattctaggcttgcta

SEQ ID NO: 8043490 - DNA, 22 bp, Homo sapiens
caggcccatgagggcagccaca

SEQ ID NO: 8043491 - DNA, 22 bp, Homo sapiens
caggcccatttgtagccacttt

SEQ ID NO: 8043492 - DNA, 22 bp, Homo sapiens
caggcagtgtcccaggaagcca

SEQ ID NO: 8043493 - DNA, 22 bp, Homo sapiens
caggcagcgctcgtggcctggc

SEQ ID NO: 8043494 - DNA, 22 bp, Homo sapiens
caggcagcgtcctgcttcctgt

SEQ ID NO: 8043495 - DNA, 22 bp, Homo sapiens
caggcagcgctcgtggcctggc

SEQ ID NO: 8043496 - DNA, 22 bp, Homo sapiens
caggcagctcgatgccttgttg

SEQ ID NO: 8043497 - DNA, 22 bp, Homo sapiens
caggcagctcaaccttgggagc

SEQ ID NO: 8043498 - DNA, 22 bp, Homo sapiens
caggcagggagctggaaaggat

SEQ ID NO: 8043499 - DNA, 22 bp, Homo sapiens
caggcaggtcagtgaagaagga

SEQ ID NO: 8043500 - DNA, 22 bp, Homo sapiens
caggcaggtcagtgaagaagga

SEQ ID NO: 8043501 - DNA, 22 bp, Homo sapiens
caggagccagaggcggatggag

SEQ ID NO: 8043502 - DNA, 22 bp, Homo sapiens
caggatggccccggggctgtgc

SEQ ID NO: 8043503 - DNA, 22 bp, Homo sapiens
caggatggcagagaaaagggtg

SEQ ID NO: 8043504 - DNA, 22 bp, Homo sapiens
caggatggagagttgttggttg

SEQ ID NO: 8043505 - DNA, 22 bp, Homo sapiens
caggatggagggagggctgtta

SEQ ID NO: 8043506 - DNA, 22 bp, Homo sapiens
caggatggagagtgaggggtca

SEQ ID NO: 8043507 - DNA, 22 bp, Homo sapiens
caggatgggatgtagtgggccc

SEQ ID NO: 8043508 - DNA, 22 bp, Homo sapiens
caggatgggatgtagtgggccc

SEQ ID NO: 8043509 - DNA, 22 bp, Homo sapiens
caggatgggtgtcggccagcac

SEQ ID NO: 8043510 - DNA, 22 bp, Homo sapiens
caggatgggtgtcggccagcac

SEQ ID NO: 8043511 - DNA, 22 bp, Homo sapiens
caggatggtcagatgcattgtc

SEQ ID NO: 8043512 - DNA, 22 bp, Homo sapiens
caggcacacagcacatggcctg

SEQ ID NO: 8043513 - DNA, 22 bp, Homo sapiens
caggcacacaggctccctgggc

SEQ ID NO: 8043514 - DNA, 22 bp, Homo sapiens
caggcacacatccgtgagagat

SEQ ID NO: 8043515 - DNA, 22 bp, Homo sapiens
caggcacacccactggtgcaga

SEQ ID NO: 8043516 - DNA, 20 bp, Homo sapiens
caggcacactcattcctgct

SEQ ID NO: 8043517 - DNA, 22 bp, Homo sapiens
caggacagctcaacacctcctc

SEQ ID NO: 8043518 - DNA, 20 bp, Homo sapiens
caggacagcgcaatcggagg

SEQ ID NO: 8043519 - DNA, 22 bp, Homo sapiens
caggagcaaggagcagtgggat

SEQ ID NO: 8043520 - DNA, 22 bp, Homo sapiens
caggagaaatgtggctgctacc

SEQ ID NO: 8043521 - DNA, 22 bp, Homo sapiens
caggagaaacataattttctgg

SEQ ID NO: 8043522 - DNA, 21 bp, Homo sapiens
caggactttcctccaaagtta

SEQ ID NO: 8043523 - DNA, 22 bp, Homo sapiens
caggactggctcgcagtgggtg

SEQ ID NO: 8043524 - DNA, 22 bp, Homo sapiens
caggactgaagggcacagggaa

SEQ ID NO: 8043525 - DNA, 22 bp, Homo sapiens
cagctgtgtctaattatggctg

SEQ ID NO: 8043526 - DNA, 22 bp, Homo sapiens
cagctgtccttcctggtgggcg

SEQ ID NO: 8043527 - DNA, 21 bp, Homo sapiens
aggacagatgtaggaataaag

SEQ ID NO: 8043528 - DNA, 22 bp, Homo sapiens
aggacagatttttggccaccag

SEQ ID NO: 8043529 - DNA, 22 bp, Homo sapiens
aggacagagggaccagagccca

SEQ ID NO: 8043530 - DNA, 22 bp, Homo sapiens
aggacagacctaggactggagc

SEQ ID NO: 8043531 - DNA, 22 bp, Homo sapiens
aggacagacctaggactggagc

SEQ ID NO: 8043532 - DNA, 22 bp, Homo sapiens
caggtggttccatgtttcatga

SEQ ID NO: 8043533 - DNA, 22 bp, Homo sapiens
caggtggttatgaggaaggtga

SEQ ID NO: 8043534 - DNA, 22 bp, Homo sapiens
caggtggtgcctcctcccttcc

SEQ ID NO: 8043535 - DNA, 22 bp, Homo sapiens
caggtggtgcctccaggctggt

SEQ ID NO: 8043536 - DNA, 22 bp, Homo sapiens
caggtgtcggtcaggcggtttt

SEQ ID NO: 8043537 - DNA, 22 bp, Homo sapiens
caggtgtctaattctcaccccc

SEQ ID NO: 8043538 - DNA, 22 bp, Homo sapiens
caggtggttgagagctgtaggc

SEQ ID NO: 8043539 - DNA, 22 bp, Homo sapiens
caggtggttgtttggattctaa

SEQ ID NO: 8043540 - DNA, 22 bp, Homo sapiens
caggtggtttgataggataact

SEQ ID NO: 8043541 - DNA, 22 bp, Homo sapiens
caggtgtcaaaatactaagtgg

SEQ ID NO: 8043542 - DNA, 16 bp, Homo sapiens
caggtgtcagtcacct

SEQ ID NO: 8043543 - DNA, 22 bp, Homo sapiens
caggtgtcagcagcactgtact

SEQ ID NO: 8043544 - DNA, 22 bp, Homo sapiens
cagggcagggatgttgcggcag

SEQ ID NO: 8043545 - DNA, 22 bp, Homo sapiens
cagggcagggagcttagaatga

SEQ ID NO: 8043546 - DNA, 22 bp, Homo sapiens
cagggcagggccacaccccctg

SEQ ID NO: 8043547 - DNA, 22 bp, Homo sapiens
cagggcagggatgttgcggcag

SEQ ID NO: 8043548 - DNA, 22 bp, Homo sapiens
cagggcagggccacaccccctg

SEQ ID NO: 8043549 - DNA, 22 bp, Homo sapiens
cagggcagtaacgggaacatct

SEQ ID NO: 8043550 - DNA, 22 bp, Homo sapiens
cagggcagtaacgggaacatct

SEQ ID NO: 8043551 - DNA, 22 bp, Homo sapiens
caggctcttttggtggcaagga

SEQ ID NO: 8043552 - DNA, 22 bp, Homo sapiens
cagggcaggatgctgtgattat

SEQ ID NO: 8043553 - DNA, 22 bp, Homo sapiens
cagggctggatttcatttctag

SEQ ID NO: 8043554 - DNA, 20 bp, Homo sapiens
cagggctctgggcctggcct

SEQ ID NO: 8043555 - DNA, 22 bp, Homo sapiens
cagggctctgccttgagggatg

SEQ ID NO: 8043556 - DNA, 22 bp, Homo sapiens
agctttgaatgagtgcattgca

SEQ ID NO: 8043557 - DNA, 22 bp, Homo sapiens
cagggctgggttaaaagcaggg

SEQ ID NO: 8043558 - DNA, 22 bp, Homo sapiens
cagggctgggttaaaagcaggg

SEQ ID NO: 8043559 - DNA, 23 bp, Homo sapiens
cagggctgggcttggtgttaggc

SEQ ID NO: 8043560 - DNA, 22 bp, Homo sapiens
cagggctggcttccaagttgtt

SEQ ID NO: 8043561 - DNA, 18 bp, Homo sapiens
cagggctgtggggtcact

SEQ ID NO: 8043562 - DNA, 22 bp, Homo sapiens
cagggctgttagctgctgctct

SEQ ID NO: 8043563 - DNA, 22 bp, Homo sapiens
cagggctgttagctgctgctct

SEQ ID NO: 8043564 - DNA, 18 bp, Homo sapiens
cagggctgtggggtcact

SEQ ID NO: 8043565 - DNA, 22 bp, Homo sapiens
aggaagagctggaccagaggac

SEQ ID NO: 8043566 - DNA, 22 bp, Homo sapiens
aggcaaggtgctacagacagtg

SEQ ID NO: 8043567 - DNA, 22 bp, Homo sapiens
aggcaacttgaccaggctttct

SEQ ID NO: 8043568 - DNA, 22 bp, Homo sapiens
aggcaacttgcatctcggcaag

SEQ ID NO: 8043569 - DNA, 22 bp, Homo sapiens
aggcaagaaactttctgggaga

SEQ ID NO: 8043570 - DNA, 22 bp, Homo sapiens
aggcaacttttggggatgatgg

SEQ ID NO: 8043571 - DNA, 22 bp, Homo sapiens
aggcaagaaactttctgggaga

SEQ ID NO: 8043572 - DNA, 22 bp, Homo sapiens
aggcaactggttaagtaaattg

SEQ ID NO: 8043573 - DNA, 22 bp, Homo sapiens
aggcaactgtttgataatgttg

SEQ ID NO: 8043574 - DNA, 22 bp, Homo sapiens
aggcaactgagaggcccgtgtt

SEQ ID NO: 8043575 - DNA, 22 bp, Homo sapiens
aggcaactctgaccttatgaag

SEQ ID NO: 8043576 - DNA, 22 bp, Homo sapiens
aggcaactcatcatgaaagact

SEQ ID NO: 8043577 - DNA, 22 bp, Homo sapiens
aggcaactgacagcatatcctg

SEQ ID NO: 8043578 - DNA, 22 bp, Homo sapiens
aggcaactgacagtttctgctt

SEQ ID NO: 8043579 - DNA, 17 bp, Homo sapiens
aggcaactagttccctc

SEQ ID NO: 8043580 - DNA, 20 bp, Homo sapiens
aggcaactcaagtttttgcc

SEQ ID NO: 8043581 - DNA, 22 bp, Homo sapiens
aggcaagaacagacatgggagt

SEQ ID NO: 8043582 - DNA, 22 bp, Homo sapiens
aggcaagaacagacatgggagt

SEQ ID NO: 8043583 - DNA, 20 bp, Homo sapiens
aggcaaggtagatgtctgct

SEQ ID NO: 8043584 - DNA, 22 bp, Homo sapiens
aggcaaggtgctacagacagtg

SEQ ID NO: 8043585 - DNA, 22 bp, Homo sapiens
aggcaagggggcgccaccttcc

SEQ ID NO: 8043586 - DNA, 22 bp, Homo sapiens
aggcaagcgcagaagcggagga

SEQ ID NO: 8043587 - DNA, 22 bp, Homo sapiens
aggcaagcattgggaacagggc

SEQ ID NO: 8043588 - DNA, 22 bp, Homo sapiens
catttattggcatgtagtaggt

SEQ ID NO: 8043589 - DNA, 22 bp, Homo sapiens
catttcaagcattgacttctat

SEQ ID NO: 8043590 - DNA, 22 bp, Homo sapiens
catttattggttaggccagcag

SEQ ID NO: 8043591 - DNA, 22 bp, Homo sapiens
catttattggttaggccagcag

SEQ ID NO: 8043592 - DNA, 22 bp, Homo sapiens
catttctcctgggtgataaatt

SEQ ID NO: 8043593 - DNA, 22 bp, Homo sapiens
catttctccgccgagatcactg

SEQ ID NO: 8043594 - DNA, 22 bp, Homo sapiens
ccacagagactctgcaggactg

SEQ ID NO: 8043595 - DNA, 22 bp, Homo sapiens
ccacagagacagagcccagggt

SEQ ID NO: 8043596 - DNA, 22 bp, Homo sapiens
ccacagaccttggcttccacct

SEQ ID NO: 8043597 - DNA, 22 bp, Homo sapiens
ccacagaattctgtctccagga

SEQ ID NO: 8043598 - DNA, 22 bp, Homo sapiens
ccacaggcggagtggcgggcag

SEQ ID NO: 8043599 - DNA, 19 bp, Homo sapiens
ccacagagcatgctgaggc

SEQ ID NO: 8043600 - DNA, 22 bp, Homo sapiens
ccacagagcattagatttcaga

SEQ ID NO: 8043601 - DNA, 22 bp, Homo sapiens
ccacatcatggatacagttatg

SEQ ID NO: 8043602 - DNA, 22 bp, Homo sapiens
ccacatacaaatggggtgctgt

SEQ ID NO: 8043603 - DNA, 21 bp, Homo sapiens
ccactcatgactccactcacc

SEQ ID NO: 8043604 - DNA, 22 bp, Homo sapiens
ccacggccacccgctcatgggc

SEQ ID NO: 8043605 - DNA, 22 bp, Homo sapiens
ccacccagccagatgcaggaag

SEQ ID NO: 8043606 - DNA, 22 bp, Homo sapiens
ccacccagcagaggaggcaaga

SEQ ID NO: 8043607 - DNA, 22 bp, Homo sapiens
ccacccagaccagggatctggg

SEQ ID NO: 8043608 - DNA, 20 bp, Homo sapiens
ccacctggccaaggctgtgc

SEQ ID NO: 8043609 - DNA, 18 bp, Homo sapiens
ccacccagggggagagga

SEQ ID NO: 8043610 - DNA, 22 bp, Homo sapiens
ccacctggggcctctgagtctc

SEQ ID NO: 8043611 - DNA, 22 bp, Homo sapiens
cagtgtggtgtgcacagcttag

SEQ ID NO: 8043612 - DNA, 22 bp, Homo sapiens
cagtgtggtgagattccaggtg

SEQ ID NO: 8043613 - DNA, 21 bp, Homo sapiens
cagtgtggtgaccagggtctc

SEQ ID NO: 8043614 - DNA, 21 bp, Homo sapiens
cagtgtggtgaccagggtctc

SEQ ID NO: 8043615 - DNA, 22 bp, Homo sapiens
cagtgtgggtttgggaggagta

SEQ ID NO: 8043616 - DNA, 22 bp, Homo sapiens
cagtccagctcatcagtggcac

SEQ ID NO: 8043617 - DNA, 22 bp, Homo sapiens
cagtccaggcctggaggagcca

SEQ ID NO: 8043618 - DNA, 22 bp, Homo sapiens
cagtccaggcctggaggagcca

SEQ ID NO: 8043619 - DNA, 22 bp, Homo sapiens
cataacatgtacatataaatgc

SEQ ID NO: 8043620 - DNA, 22 bp, Homo sapiens
cataacatgtacatataaatgc

SEQ ID NO: 8043621 - DNA, 22 bp, Homo sapiens
aggagccatccccatgagaggt

SEQ ID NO: 8043622 - DNA, 22 bp, Homo sapiens
aggagctgtgaatgggaggggt

SEQ ID NO: 8043623 - DNA, 22 bp, Homo sapiens
aggagctgtgaatgggaggggt

SEQ ID NO: 8043624 - DNA, 22 bp, Homo sapiens
aggagctgtgaatgggaggggt

SEQ ID NO: 8043625 - DNA, 22 bp, Homo sapiens
aggagctgtcagagtgccagag

SEQ ID NO: 8043626 - DNA, 16 bp, Homo sapiens
aggagctgggtaggag

SEQ ID NO: 8043627 - DNA, 22 bp, Homo sapiens
aggaggctgaactagggtctgg

SEQ ID NO: 8043628 - DNA, 22 bp, Homo sapiens
aggaggcctgcagctgccattc

SEQ ID NO: 8043629 - DNA, 22 bp, Homo sapiens
aggaggctctcaggtcctcccc

SEQ ID NO: 8043630 - DNA, 22 bp, Homo sapiens
catacagtgtggcatgtagtct

SEQ ID NO: 8043631 - DNA, 20 bp, Homo sapiens
catctcctgcctccatgttc

SEQ ID NO: 8043632 - DNA, 22 bp, Homo sapiens
catctcctttggtctacttcca

SEQ ID NO: 8043633 - DNA, 22 bp, Homo sapiens
catctctgagacctcagctggg

SEQ ID NO: 8043634 - DNA, 22 bp, Homo sapiens
catctctgtgtccccagagctt

SEQ ID NO: 8043635 - DNA, 22 bp, Homo sapiens
catgagataatttttctccagt

SEQ ID NO: 8043636 - DNA, 22 bp, Homo sapiens
aggatgtgagtggacacagtcc

SEQ ID NO: 8043637 - DNA, 22 bp, Homo sapiens
aggatgtggctgagacttctgg

SEQ ID NO: 8043638 - DNA, 17 bp, Homo sapiens
aggatgtggagaaaatt

SEQ ID NO: 8043639 - DNA, 22 bp, Homo sapiens
aggatgtggatggagtatttat

SEQ ID NO: 8043640 - DNA, 22 bp, Homo sapiens
aggatgtgggttttcacattgt

SEQ ID NO: 8043641 - DNA, 22 bp, Homo sapiens
catgagactgccttttcaaacc

SEQ ID NO: 8043642 - DNA, 23 bp, Homo sapiens
aggatgtgcatatgacctaatca

SEQ ID NO: 8043643 - DNA, 22 bp, Homo sapiens
aggatgtgccaccagctttgca

SEQ ID NO: 8043644 - DNA, 22 bp, Homo sapiens
aggatgtgagccagcctggcct

SEQ ID NO: 8043645 - DNA, 22 bp, Homo sapiens
catgagatttgggaggggccag

SEQ ID NO: 8043646 - DNA, 23 bp, Homo sapiens
aggatgtaggatgtatggcagag

SEQ ID NO: 8043647 - DNA, 17 bp, Homo sapiens
aggctgctgggccaggg

SEQ ID NO: 8043648 - DNA, 22 bp, Homo sapiens
aggctgcttcaatggataagat

SEQ ID NO: 8043649 - DNA, 23 bp, Homo sapiens
aggctgcttactggtatcagagc

SEQ ID NO: 8043650 - DNA, 22 bp, Homo sapiens
aggctgcttcagctgcagggag

SEQ ID NO: 8043651 - DNA, 22 bp, Homo sapiens
aggctgcttcaatggataagat

SEQ ID NO: 8043652 - DNA, 22 bp, Homo sapiens
aggctgctggcaggcgtggacg

SEQ ID NO: 8043653 - DNA, 22 bp, Homo sapiens
aggctgctgccttggagagtgt

SEQ ID NO: 8043654 - DNA, 21 bp, Homo sapiens
aggctgctggctcagggtcct

SEQ ID NO: 8043655 - DNA, 22 bp, Homo sapiens
aggctgctggctaagaataaga

SEQ ID NO: 8043656 - DNA, 22 bp, Homo sapiens
aggctgctggcaggcgtggacg

SEQ ID NO: 8043657 - DNA, 21 bp, Homo sapiens
aggctgctctttcttgtggta

SEQ ID NO: 8043658 - DNA, 22 bp, Homo sapiens
aggctgctgccttggagagtgt

SEQ ID NO: 8043659 - DNA, 21 bp, Homo sapiens
aggctgctctttcttgtggta

SEQ ID NO: 8043660 - DNA, 22 bp, Homo sapiens
aggctctggctactacagagct

SEQ ID NO: 8043661 - DNA, 22 bp, Homo sapiens
aggctctggcaacagctggtgt

SEQ ID NO: 8043662 - DNA, 22 bp, Homo sapiens
aggctggccagtgctgcagtgg

SEQ ID NO: 8043663 - DNA, 23 bp, Homo sapiens
aggctggcttcaggagcctctcc

SEQ ID NO: 8043664 - DNA, 22 bp, Homo sapiens
aggctgggaaatgtattccagc

SEQ ID NO: 8043665 - DNA, 22 bp, Homo sapiens
aggctgggaaatgtattccagc

SEQ ID NO: 8043666 - DNA, 22 bp, Homo sapiens
aggctgggaaatgtagtcttcc

SEQ ID NO: 8043667 - DNA, 22 bp, Homo sapiens
aggctgggaaatgtagtcttcc

SEQ ID NO: 8043668 - DNA, 22 bp, Homo sapiens
aggctgggaaacctgaagttgt

SEQ ID NO: 8043669 - DNA, 22 bp, Homo sapiens
aggctgggaaacctgaagttgt

SEQ ID NO: 8043670 - DNA, 22 bp, Homo sapiens
aggctggctttggtagcatggt

SEQ ID NO: 8043671 - DNA, 19 bp, Homo sapiens
aggctgtgagggaggactc

SEQ ID NO: 8043672 - DNA, 19 bp, Homo sapiens
aggctgtgaggggaaggaa

SEQ ID NO: 8043673 - DNA, 22 bp, Homo sapiens
acatggctaaagcaagtctaga

SEQ ID NO: 8043674 - DNA, 22 bp, Homo sapiens
aggcagtgttcttctaagggca

SEQ ID NO: 8043675 - DNA, 22 bp, Homo sapiens
aggctcaggcaggaatggcgga

SEQ ID NO: 8043676 - DNA, 22 bp, Homo sapiens
aggctcagggactccctccctc

SEQ ID NO: 8043677 - DNA, 22 bp, Homo sapiens
aggctcagggacggggcccctt

SEQ ID NO: 8043678 - DNA, 20 bp, Homo sapiens
aggctcagctgagctcttgg

SEQ ID NO: 8043679 - DNA, 22 bp, Homo sapiens
aggctcaggaggagctgccgga

SEQ ID NO: 8043680 - DNA, 22 bp, Homo sapiens
aggctcagctggtggtgatcgc

SEQ ID NO: 8043681 - DNA, 22 bp, Homo sapiens
acatgtggaggaggcgagggta

SEQ ID NO: 8043682 - DNA, 22 bp, Homo sapiens
acatgtggaggaggcgagggta

SEQ ID NO: 8043683 - DNA, 22 bp, Homo sapiens
acatgtgtaagatgtgatatat

SEQ ID NO: 8043684 - DNA, 22 bp, Homo sapiens
aggctcagacaggaaaagtaac

SEQ ID NO: 8043685 - DNA, 22 bp, Homo sapiens
acatgtggtcaatctgtgtagg

SEQ ID NO: 8043686 - DNA, 22 bp, Homo sapiens
acatgtgtaaaagtggataaaa

SEQ ID NO: 8043687 - DNA, 20 bp, Homo sapiens
aggctcagggtgtttaggaa

SEQ ID NO: 8043688 - DNA, 22 bp, Homo sapiens
aggctcaggtctcaggtctggc

SEQ ID NO: 8043689 - DNA, 22 bp, Homo sapiens
aggctctggagttagccaggca

SEQ ID NO: 8043690 - DNA, 22 bp, Homo sapiens
aggctctggacagtgaggagtt

SEQ ID NO: 8043691 - DNA, 22 bp, Homo sapiens
aggctctggagtgtggtgctgg

SEQ ID NO: 8043692 - DNA, 22 bp, Homo sapiens
aggctctggacagtgaggagtt

SEQ ID NO: 8043693 - DNA, 19 bp, Homo sapiens
aggctctgagctcctggag

SEQ ID NO: 8043694 - DNA, 22 bp, Homo sapiens
aggctctggacagtgaggagtt

SEQ ID NO: 8043695 - DNA, 22 bp, Homo sapiens
aggctctgacccatgggaccca

SEQ ID NO: 8043696 - DNA, 22 bp, Homo sapiens
aggctctgaaggagaacctgtt

SEQ ID NO: 8043697 - DNA, 22 bp, Homo sapiens
agggctgaagttatggctgagc

SEQ ID NO: 8043698 - DNA, 22 bp, Homo sapiens
agggctcagttgcctggagccc

SEQ ID NO: 8043699 - DNA, 22 bp, Homo sapiens
agggctcactgggaggctataa

SEQ ID NO: 8043700 - DNA, 22 bp, Homo sapiens
agggctcagaaatgtctacggg

SEQ ID NO: 8043701 - DNA, 22 bp, Homo sapiens
agggctcagggcacgtcatcca

SEQ ID NO: 8043702 - DNA, 22 bp, Homo sapiens
agggctcagccagcctgtgtgc

SEQ ID NO: 8043703 - DNA, 22 bp, Homo sapiens
agggctcagcctcctcctcagc

SEQ ID NO: 8043704 - DNA, 22 bp, Homo sapiens
aggggagccagggctgcgagtt

SEQ ID NO: 8043705 - DNA, 22 bp, Homo sapiens
aggggagccagggctgcgagtt

SEQ ID NO: 8043706 - DNA, 22 bp, Homo sapiens
aggggagcccctggtcctggtg

SEQ ID NO: 8043707 - DNA, 22 bp, Homo sapiens
aggggagcaaggccgtggtgta

SEQ ID NO: 8043708 - DNA, 22 bp, Homo sapiens
aggggaggagcttttcttgcct

SEQ ID NO: 8043709 - DNA, 22 bp, Homo sapiens
aggggcaggtgctgcacttaga

SEQ ID NO: 8043710 - DNA, 22 bp, Homo sapiens
aggggcagttccaagttttgtg

SEQ ID NO: 8043711 - DNA, 22 bp, Homo sapiens
aggggcagttccaagttttgtg

SEQ ID NO: 8043712 - DNA, 22 bp, Homo sapiens
agggtcagtgatgagggagccc

SEQ ID NO: 8043713 - DNA, 20 bp, Homo sapiens
aggggtgatcgggtgacact

SEQ ID NO: 8043714 - DNA, 22 bp, Homo sapiens
acctcatctggtttgtaaggca

SEQ ID NO: 8043715 - DNA, 21 bp, Homo sapiens
acctcaagcaacaaccaaggt

SEQ ID NO: 8043716 - DNA, 22 bp, Homo sapiens
acctcaagtgatccactcacct

SEQ ID NO: 8043717 - DNA, 22 bp, Homo sapiens
acctcaaggaaaatctagacag

SEQ ID NO: 8043718 - DNA, 20 bp, Homo sapiens
aggggcctggaacaggcctt

SEQ ID NO: 8043719 - DNA, 22 bp, Homo sapiens
agggccagtaccaggtgggtgg

SEQ ID NO: 8043720 - DNA, 22 bp, Homo sapiens
agggccagttcagaggacatgg

SEQ ID NO: 8043721 - DNA, 22 bp, Homo sapiens
agggccagtgggttgaaaggca

SEQ ID NO: 8043722 - DNA, 22 bp, Homo sapiens
agggctcaatggtgggcatgta

SEQ ID NO: 8043723 - DNA, 22 bp, Homo sapiens
agggctcaagggcatgctacgt

SEQ ID NO: 8043724 - DNA, 22 bp, Homo sapiens
agggctcaccactgtgcactcc

SEQ ID NO: 8043725 - DNA, 22 bp, Homo sapiens
agggccagttctacctctgaat

SEQ ID NO: 8043726 - DNA, 22 bp, Homo sapiens
agggccagccaggccctacaaa

SEQ ID NO: 8043727 - DNA, 22 bp, Homo sapiens
agggccagcccataatgccaaa

SEQ ID NO: 8043728 - DNA, 22 bp, Homo sapiens
agggccagcagcttggccaacc

SEQ ID NO: 8043729 - DNA, 22 bp, Homo sapiens
agggccagcactcctggcagga

SEQ ID NO: 8043730 - DNA, 22 bp, Homo sapiens
agggccagcactcctggcagga

SEQ ID NO: 8043731 - DNA, 22 bp, Homo sapiens
agggccagcactcctggcagga

SEQ ID NO: 8043732 - DNA, 22 bp, Homo sapiens
agggccagatgaagccacaagc

SEQ ID NO: 8043733 - DNA, 22 bp, Homo sapiens
agggcatgctggaggagagaca

SEQ ID NO: 8043734 - DNA, 22 bp, Homo sapiens
agggcaagttgagtgtgcgtgg

SEQ ID NO: 8043735 - DNA, 22 bp, Homo sapiens
accagagcagactactggaggt

SEQ ID NO: 8043736 - DNA, 22 bp, Homo sapiens
accagagcgctcaagccttccc

SEQ ID NO: 8043737 - DNA, 22 bp, Homo sapiens
agggagctgactggctgccatt

SEQ ID NO: 8043738 - DNA, 22 bp, Homo sapiens
acatctgaggagaccagcctct

SEQ ID NO: 8043739 - DNA, 22 bp, Homo sapiens
acatatatgtaaagtactttgt

SEQ ID NO: 8043740 - DNA, 22 bp, Homo sapiens
aggcagtggtgtttgctggtgg

SEQ ID NO: 8043741 - DNA, 22 bp, Homo sapiens
aggcagtgtattgctagcggct

SEQ ID NO: 8043742 - DNA, 22 bp, Homo sapiens
aggcagacttcctgcttggatc

SEQ ID NO: 8043743 - DNA, 22 bp, Homo sapiens
aggcagagaaaaaccagatatg

SEQ ID NO: 8043744 - DNA, 22 bp, Homo sapiens
aggcagactcaatggctagata

SEQ ID NO: 8043745 - DNA, 22 bp, Homo sapiens
aggcagaaccagctgggacttt

SEQ ID NO: 8043746 - DNA, 22 bp, Homo sapiens
aggcaggtgcttatgacttgct

SEQ ID NO: 8043747 - DNA, 22 bp, Homo sapiens
aggcaggtgggagtgattcctt

SEQ ID NO: 8043748 - DNA, 22 bp, Homo sapiens
aggcaggtgggtcacttgagtc

SEQ ID NO: 8043749 - DNA, 22 bp, Homo sapiens
aggcaggtgttaaccctctgag

SEQ ID NO: 8043750 - DNA, 22 bp, Homo sapiens
aggcaggtgttgggagacacca

SEQ ID NO: 8043751 - DNA, 22 bp, Homo sapiens
aggcaggtgttacctctggttt

SEQ ID NO: 8043752 - DNA, 22 bp, Homo sapiens
aggcaggttacaaaaactttat

SEQ ID NO: 8043753 - DNA, 22 bp, Homo sapiens
aggcaggttggggaaaagcact

SEQ ID NO: 8043754 - DNA, 22 bp, Homo sapiens
aggcaggttggtgagaagactg

SEQ ID NO: 8043755 - DNA, 22 bp, Homo sapiens
aggcagcaatgaatgaaatgga

SEQ ID NO: 8043756 - DNA, 22 bp, Homo sapiens
aggcagcaaagaaatgatgctg

SEQ ID NO: 8043757 - DNA, 22 bp, Homo sapiens
aggcacagcacacctggccccc

SEQ ID NO: 8043758 - DNA, 22 bp, Homo sapiens
aggaggccctagagctctagag

SEQ ID NO: 8043759 - DNA, 22 bp, Homo sapiens
acagtgagatccaagggcaggc

SEQ ID NO: 8043760 - DNA, 22 bp, Homo sapiens
aggacttcaaatggaaacaaaa

SEQ ID NO: 8043761 - DNA, 23 bp, Homo sapiens
acagggctagctgacagtggtat

SEQ ID NO: 8043762 - DNA, 22 bp, Homo sapiens
aggacatgtaaatggagaggga

SEQ ID NO: 8043763 - DNA, 22 bp, Homo sapiens
aggactgggtgcagagggcatc

SEQ ID NO: 8043764 - DNA, 22 bp, Homo sapiens
aggacagtggcaaggcaggaca

SEQ ID NO: 8043765 - DNA, 22 bp, Homo sapiens
aggacatgaagaaagggcaagg

SEQ ID NO: 8043766 - DNA, 22 bp, Homo sapiens
aggacagtgtggaagagggtgc

SEQ ID NO: 8043767 - DNA, 23 bp, Homo sapiens
aggacagtggaatttagggattg

SEQ ID NO: 8043768 - DNA, 22 bp, Homo sapiens
acaggccttaggagagatgggg

SEQ ID NO: 8043769 - DNA, 22 bp, Homo sapiens
acaggccttggcaggcatgtga

SEQ ID NO: 8043770 - DNA, 22 bp, Homo sapiens
acaggccttggtcctgacctaa

SEQ ID NO: 8043771 - DNA, 22 bp, Homo sapiens
acagggcagtgtcttgaaaaat

SEQ ID NO: 8043772 - DNA, 22 bp, Homo sapiens
acagggcaggtggctactggtc

SEQ ID NO: 8043773 - DNA, 17 bp, Homo sapiens
acagggcagaaacagct

SEQ ID NO: 8043774 - DNA, 22 bp, Homo sapiens
acaggctcagttcactggattt

SEQ ID NO: 8043775 - DNA, 22 bp, Homo sapiens
acaggctctctattgagtgcag

SEQ ID NO: 8043776 - DNA, 21 bp, Homo sapiens
acaggctctggggatgctggg

SEQ ID NO: 8043777 - DNA, 22 bp, Homo sapiens
acagggcatgtgcaagagacat

SEQ ID NO: 8043778 - DNA, 21 bp, Homo sapiens
acagggcatgcagctggctgt

SEQ ID NO: 8043779 - DNA, 23 bp, Homo sapiens
acagggcattgctggcctcgagg

SEQ ID NO: 8043780 - DNA, 22 bp, Homo sapiens
acagggcatttcctctatgtgt

SEQ ID NO: 8043781 - DNA, 19 bp, Homo sapiens
agcttctttggaaacattt

SEQ ID NO: 8043782 - DNA, 22 bp, Homo sapiens
agcttctttaattcagcatgat

SEQ ID NO: 8043783 - DNA, 22 bp, Homo sapiens
agcttcttgtatgaagttagag

SEQ ID NO: 8043784 - DNA, 22 bp, Homo sapiens
agcttcttgtagaactcaaaag

SEQ ID NO: 8043785 - DNA, 22 bp, Homo sapiens
agcttctttgtgggctccagaa

SEQ ID NO: 8043786 - DNA, 22 bp, Homo sapiens
acaggatgggcgcacagagcta

SEQ ID NO: 8043787 - DNA, 22 bp, Homo sapiens
acaggatgataaaggatggcca

SEQ ID NO: 8043788 - DNA, 22 bp, Homo sapiens
agcttcttcccagcctcacccg

SEQ ID NO: 8043789 - DNA, 22 bp, Homo sapiens
agcttcttctattttggggcca

SEQ ID NO: 8043790 - DNA, 22 bp, Homo sapiens
agcttcttcaaagcaggaggcc

SEQ ID NO: 8043791 - DNA, 22 bp, Homo sapiens
agcttcttccaggcagtgactc

SEQ ID NO: 8043792 - DNA, 22 bp, Homo sapiens
agcttcttagttcacttttaat

SEQ ID NO: 8043793 - DNA, 22 bp, Homo sapiens
agcttcttggctcagcacttgg

SEQ ID NO: 8043794 - DNA, 22 bp, Homo sapiens
agcttcttgggctttacacaaa

SEQ ID NO: 8043795 - DNA, 22 bp, Homo sapiens
agcttcttgacggatgttctgg

SEQ ID NO: 8043796 - DNA, 22 bp, Homo sapiens
agcttcttctgatttgtcagtc

SEQ ID NO: 8043797 - DNA, 20 bp, Homo sapiens
agcttcttctgtctaatttt

SEQ ID NO: 8043798 - DNA, 22 bp, Homo sapiens
agcttcttgaccaagcctgtaa

SEQ ID NO: 8043799 - DNA, 22 bp, Homo sapiens
agcttcttcttggtctttccca

SEQ ID NO: 8043800 - DNA, 22 bp, Homo sapiens
acaggacatgtaccaggtggtc

SEQ ID NO: 8043801 - DNA, 22 bp, Homo sapiens
acaggacatgtaccaggtggtc

SEQ ID NO: 8043802 - DNA, 22 bp, Homo sapiens
acaggacatggcttctgtgacg

SEQ ID NO: 8043803 - DNA, 22 bp, Homo sapiens
acaggacaggtaggattcgcag

SEQ ID NO: 8043804 - DNA, 22 bp, Homo sapiens
acagcttctatttctctgtact

SEQ ID NO: 8043805 - DNA, 22 bp, Homo sapiens
acagcttcttgtttcccaggag

SEQ ID NO: 8043806 - DNA, 22 bp, Homo sapiens
acaggacaaaaatctggatggc

SEQ ID NO: 8043807 - DNA, 22 bp, Homo sapiens
acaggacaggctgggctagact

SEQ ID NO: 8043808 - DNA, 22 bp, Homo sapiens
acaggacaatttataatgggca

SEQ ID NO: 8043809 - DNA, 22 bp, Homo sapiens
acaggacaactcagcagccagc

SEQ ID NO: 8043810 - DNA, 22 bp, Homo sapiens
acagccagaagtcagggtggga

SEQ ID NO: 8043811 - DNA, 20 bp, Homo sapiens
acagccagaggaggcagaca

SEQ ID NO: 8043812 - DNA, 22 bp, Homo sapiens
acagccagaggagccaggctgg

SEQ ID NO: 8043813 - DNA, 22 bp, Homo sapiens
actggggattagggactcagtg

SEQ ID NO: 8043814 - DNA, 22 bp, Homo sapiens
actggggcaggaaagtatgctg

SEQ ID NO: 8043815 - DNA, 22 bp, Homo sapiens
agtgggggccaacgagggcagc

SEQ ID NO: 8043816 - DNA, 22 bp, Homo sapiens
agtggggccggtgaggccgagg

SEQ ID NO: 8043817 - DNA, 22 bp, Homo sapiens
agtggggcggacaggaccagga

SEQ ID NO: 8043818 - DNA, 22 bp, Homo sapiens
agtgctgtctccttcccccggg

SEQ ID NO: 8043819 - DNA, 22 bp, Homo sapiens
agtgcaaagcagcctgtacacc

SEQ ID NO: 8043820 - DNA, 22 bp, Homo sapiens
agtgcaaactttattgtgacct

SEQ ID NO: 8043821 - DNA, 22 bp, Homo sapiens
agtgaatgtccccgcgggtcag

SEQ ID NO: 8043822 - DNA, 22 bp, Homo sapiens
agtgagagtattaatgtgaact

SEQ ID NO: 8043823 - DNA, 22 bp, Homo sapiens
agtggcagagccaagtagagcc

SEQ ID NO: 8043824 - DNA, 20 bp, Homo sapiens
agtgggagagggcagactgc

SEQ ID NO: 8043825 - DNA, 22 bp, Homo sapiens
agtgggagataacttaacagct

SEQ ID NO: 8043826 - DNA, 22 bp, Homo sapiens
agtgggagccagcagcttgggg

SEQ ID NO: 8043827 - DNA, 22 bp, Homo sapiens
agtgggagccagcagcttgggg

SEQ ID NO: 8043828 - DNA, 22 bp, Homo sapiens
agtgggaggaagtggtgatatt

SEQ ID NO: 8043829 - DNA, 22 bp, Homo sapiens
agtgggagcggcagtcggggac

SEQ ID NO: 8043830 - DNA, 22 bp, Homo sapiens
agtgggagcggcagtcggggac

SEQ ID NO: 8043831 - DNA, 22 bp, Homo sapiens
agtgggagggccatatggtgaa

SEQ ID NO: 8043832 - DNA, 22 bp, Homo sapiens
agtgggaggcggctgacgggcg

SEQ ID NO: 8043833 - DNA, 22 bp, Homo sapiens
agtgggaggcggctgacgggcg

SEQ ID NO: 8043834 - DNA, 16 bp, Homo sapiens
agtgggaggagaaaga

SEQ ID NO: 8043835 - DNA, 22 bp, Homo sapiens
agtgggaggaagtggtgatatt

SEQ ID NO: 8043836 - DNA, 22 bp, Homo sapiens
agtgcttggttcaatgaaggtt

SEQ ID NO: 8043837 - DNA, 22 bp, Homo sapiens
agtggcagacacaatgtgggca

SEQ ID NO: 8043838 - DNA, 22 bp, Homo sapiens
agtggcagagcaggtgctggaa

SEQ ID NO: 8043839 - DNA, 22 bp, Homo sapiens
agtggcagagcaggtgctggaa

SEQ ID NO: 8043840 - DNA, 22 bp, Homo sapiens
agtggcagagaccccagccagc

SEQ ID NO: 8043841 - DNA, 22 bp, Homo sapiens
agtggcagagaccccagccagc

SEQ ID NO: 8043842 - DNA, 22 bp, Homo sapiens
agtggcagacagagacagtacc

SEQ ID NO: 8043843 - DNA, 22 bp, Homo sapiens
agggtgcaggggaagctgccct

SEQ ID NO: 8043844 - DNA, 22 bp, Homo sapiens
agggtgcaggtgtggagtctag

SEQ ID NO: 8043845 - DNA, 21 bp, Homo sapiens
agggtcctacagggctcagga

SEQ ID NO: 8043846 - DNA, 22 bp, Homo sapiens
agggtcctaagcctcagataag

SEQ ID NO: 8043847 - DNA, 22 bp, Homo sapiens
agggtgcagaaggagcctagga

SEQ ID NO: 8043848 - DNA, 22 bp, Homo sapiens
aggtgccagctctcaggcagga

SEQ ID NO: 8043849 - DNA, 22 bp, Homo sapiens
aggtgccagatgcacagctgaa

SEQ ID NO: 8043850 - DNA, 22 bp, Homo sapiens
aggtgccacctctggtgctgtc

SEQ ID NO: 8043851 - DNA, 22 bp, Homo sapiens
aggtgcagtggctcatgcctgt

SEQ ID NO: 8043852 - DNA, 23 bp, Homo sapiens
aggtgccaactgagagctgagag

SEQ ID NO: 8043853 - DNA, 23 bp, Homo sapiens
aggtgccaactgagagctgagag

SEQ ID NO: 8043854 - DNA, 21 bp, Homo sapiens
aggtgcaggcctcaagcccca

SEQ ID NO: 8043855 - DNA, 22 bp, Homo sapiens
aggtgtccaggaagatgctggc

SEQ ID NO: 8043856 - DNA, 20 bp, Homo sapiens
aggtgtcctgtagcttgagt

SEQ ID NO: 8043857 - DNA, 22 bp, Homo sapiens
aggtgtccaatcctggttggat

SEQ ID NO: 8043858 - DNA, 22 bp, Homo sapiens
aggttcttggtgtccagatttc

SEQ ID NO: 8043859 - DNA, 22 bp, Homo sapiens
aggtggagaagagatgggcagt

SEQ ID NO: 8043860 - DNA, 22 bp, Homo sapiens
aggtggtcttaaactgctctgg

SEQ ID NO: 8043861 - DNA, 23 bp, Homo sapiens
aggtggtcttgtggatgctgcaa

SEQ ID NO: 8043862 - DNA, 21 bp, Homo sapiens
aggtggtctgcagcagctgaa

SEQ ID NO: 8043863 - DNA, 19 bp, Homo sapiens
aggtggtctaggctggaga

SEQ ID NO: 8043864 - DNA, 22 bp, Homo sapiens
aggtgggtgccgtctgtcctct

SEQ ID NO: 8043865 - DNA, 22 bp, Homo sapiens
aggtggggaggagtgtctcttt

SEQ ID NO: 8043866 - DNA, 22 bp, Homo sapiens
aggtggggaggagtgtctcttt

SEQ ID NO: 8043867 - DNA, 22 bp, Homo sapiens
agtcaggtactccgagggcatg

SEQ ID NO: 8043868 - DNA, 22 bp, Homo sapiens
agtaagtgagtcactgtgctgg

SEQ ID NO: 8043869 - DNA, 22 bp, Homo sapiens
agtccaggaaaataagctaggt

SEQ ID NO: 8043870 - DNA, 22 bp, Homo sapiens
agtccaggagttgggtgacatt

SEQ ID NO: 8043871 - DNA, 22 bp, Homo sapiens
agtccaggcattccagccattc

SEQ ID NO: 8043872 - DNA, 22 bp, Homo sapiens
agtccaggcctccctctcctgc

SEQ ID NO: 8043873 - DNA, 22 bp, Homo sapiens
actctggggtgatgtctctgag

SEQ ID NO: 8043874 - DNA, 22 bp, Homo sapiens
atacacactgctatcctttttt

SEQ ID NO: 8043875 - DNA, 22 bp, Homo sapiens
ataaggtatgaaaagtaaatgg

SEQ ID NO: 8043876 - DNA, 22 bp, Homo sapiens
ataaggtaagggtattgtcaga

SEQ ID NO: 8043877 - DNA, 22 bp, Homo sapiens
agttcactctttatgagaaagt

SEQ ID NO: 8043878 - DNA, 21 bp, Homo sapiens
ataaattctgagaggctctgc

SEQ ID NO: 8043879 - DNA, 22 bp, Homo sapiens
atagttcacagccatgcagtgg

SEQ ID NO: 8043880 - DNA, 22 bp, Homo sapiens
agaaaaggattgatggatcaga

SEQ ID NO: 8043881 - DNA, 22 bp, Homo sapiens
ataggagactgttcttggcttc

SEQ ID NO: 8043882 - DNA, 22 bp, Homo sapiens
atagctttcttaaatatataaa

SEQ ID NO: 8043883 - DNA, 22 bp, Homo sapiens
atagctttacagaagagtttag

SEQ ID NO: 8043884 - DNA, 22 bp, Homo sapiens
atagatgtctgacacagagaaa

SEQ ID NO: 8043885 - DNA, 22 bp, Homo sapiens
atagatgtctgacacagagaaa

SEQ ID NO: 8043886 - DNA, 20 bp, Homo sapiens
actttacagagaagactgac

SEQ ID NO: 8043887 - DNA, 22 bp, Homo sapiens
actttactcaacaaatatttat

SEQ ID NO: 8043888 - DNA, 23 bp, Homo sapiens
atagaagattattgcaacagtcc

SEQ ID NO: 8043889 - DNA, 22 bp, Homo sapiens
atagaagaggaaactgaggttg

SEQ ID NO: 8043890 - DNA, 22 bp, Homo sapiens
atacacttccaaatattgatta

SEQ ID NO: 8043891 - DNA, 22 bp, Homo sapiens
atatagtgagagattacagaag

SEQ ID NO: 8043892 - DNA, 20 bp, Homo sapiens
agaaacatttcttgagaact

SEQ ID NO: 8043893 - DNA, 22 bp, Homo sapiens
agaaagaacgcacttgtgctgc

SEQ ID NO: 8043894 - DNA, 22 bp, Homo sapiens
atatagaaggtgctatttacat

SEQ ID NO: 8043895 - DNA, 22 bp, Homo sapiens
atatagaaggtgctatttacat

SEQ ID NO: 8043896 - DNA, 19 bp, Homo sapiens
atatagcattattcaattt

SEQ ID NO: 8043897 - DNA, 22 bp, Homo sapiens
atattaatgagcaagtaagtga

SEQ ID NO: 8043898 - DNA, 22 bp, Homo sapiens
atattaatgagcaagtaagtga

SEQ ID NO: 8043899 - DNA, 22 bp, Homo sapiens
agaaatatgctgattagatgaa

SEQ ID NO: 8043900 - DNA, 22 bp, Homo sapiens
atcaatgttgggccaaagcaaa

SEQ ID NO: 8043901 - DNA, 22 bp, Homo sapiens
agaaatctttgaagtgtaatgt

SEQ ID NO: 8043902 - DNA, 22 bp, Homo sapiens
agaaatctttcctgaagtgttt

SEQ ID NO: 8043903 - DNA, 22 bp, Homo sapiens
agaaatgtcaggaaagaagtcc

SEQ ID NO: 8043904 - DNA, 22 bp, Homo sapiens
agaaatgttgaatacacaaaat

SEQ ID NO: 8043905 - DNA, 22 bp, Homo sapiens
agaaatgttgaatacatcagga

SEQ ID NO: 8043906 - DNA, 22 bp, Homo sapiens
agaagccaaatgccagtgacct

SEQ ID NO: 8043907 - DNA, 22 bp, Homo sapiens
agaagccaaaggggccagatat

SEQ ID NO: 8043908 - DNA, 22 bp, Homo sapiens
atgtagtctctttgggaaactc

SEQ ID NO: 8043909 - DNA, 22 bp, Homo sapiens
agagatgggcgggggcttctgc

SEQ ID NO: 8043910 - DNA, 22 bp, Homo sapiens
atgggctcggcgctgctgggat

SEQ ID NO: 8043911 - DNA, 22 bp, Homo sapiens
agagaagacttacagccacagt

SEQ ID NO: 8043912 - DNA, 22 bp, Homo sapiens
atggaattgagcatcagttgtt

SEQ ID NO: 8043913 - DNA, 21 bp, Homo sapiens
atgggccagggatacagagag

SEQ ID NO: 8043914 - DNA, 21 bp, Homo sapiens
atgggccagggatacagagag

SEQ ID NO: 8043915 - DNA, 22 bp, Homo sapiens
atgggccacacacgattgggtg

SEQ ID NO: 8043916 - DNA, 22 bp, Homo sapiens
atgggccagcaccatgttaagc

SEQ ID NO: 8043917 - DNA, 22 bp, Homo sapiens
atgggccaggcttgggatgaca

SEQ ID NO: 8043918 - DNA, 23 bp, Homo sapiens
atgggccaagcaagacccatgac

SEQ ID NO: 8043919 - DNA, 22 bp, Homo sapiens
atgggccaagtaaacattctca

SEQ ID NO: 8043920 - DNA, 22 bp, Homo sapiens
atgggcagtgtattggaaggaa

SEQ ID NO: 8043921 - DNA, 22 bp, Homo sapiens
atgggcagttaggaggccagga

SEQ ID NO: 8043922 - DNA, 22 bp, Homo sapiens
atggacaggtactgcagtgggt

SEQ ID NO: 8043923 - DNA, 23 bp, Homo sapiens
atggacagggtttcagggtcaca

SEQ ID NO: 8043924 - DNA, 22 bp, Homo sapiens
atggacagggcacaggcgcaga

SEQ ID NO: 8043925 - DNA, 22 bp, Homo sapiens
atggacaggtggataggtggat

SEQ ID NO: 8043926 - DNA, 18 bp, Homo sapiens
atgggaggggccaagaga

SEQ ID NO: 8043927 - DNA, 22 bp, Homo sapiens
atgggcagtaacagtggcagtc

SEQ ID NO: 8043928 - DNA, 22 bp, Homo sapiens
agagccagcatttgacactggc

SEQ ID NO: 8043929 - DNA, 22 bp, Homo sapiens
agagccaggaagtggcgtgggg

SEQ ID NO: 8043930 - DNA, 22 bp, Homo sapiens
agagccagccttctcagcttac

SEQ ID NO: 8043931 - DNA, 22 bp, Homo sapiens
agagccaggactgtgtctcact

SEQ ID NO: 8043932 - DNA, 22 bp, Homo sapiens
agagccaggatgtcttctgggg

SEQ ID NO: 8043933 - DNA, 21 bp, Homo sapiens
atgactgtggcacttaggagg

SEQ ID NO: 8043934 - DNA, 22 bp, Homo sapiens
atgaggcacatcacagccaatg

SEQ ID NO: 8043935 - DNA, 22 bp, Homo sapiens
atgattgaaaatgacattgcca

SEQ ID NO: 8043936 - DNA, 22 bp, Homo sapiens
atgcttccctttgctccacatg

SEQ ID NO: 8043937 - DNA, 22 bp, Homo sapiens
agagaacaaattaaaggtggtt

SEQ ID NO: 8043938 - DNA, 20 bp, Homo sapiens
agacagtggggagctcctag

SEQ ID NO: 8043939 - DNA, 22 bp, Homo sapiens
agacagtggctcagccccagtc

SEQ ID NO: 8043940 - DNA, 22 bp, Homo sapiens
atgccagggtcatcccctgggt

SEQ ID NO: 8043941 - DNA, 22 bp, Homo sapiens
atgccagtgttataaatagata

SEQ ID NO: 8043942 - DNA, 22 bp, Homo sapiens
atgccaggtacaggggtagggt

SEQ ID NO: 8043943 - DNA, 23 bp, Homo sapiens
agacagtggccgagaggtactag

SEQ ID NO: 8043944 - DNA, 19 bp, Homo sapiens
agacagtggctaggactta

SEQ ID NO: 8043945 - DNA, 22 bp, Homo sapiens
agacagtggatcgggatgcact

SEQ ID NO: 8043946 - DNA, 22 bp, Homo sapiens
atgccactgcactccagcctag

SEQ ID NO: 8043947 - DNA, 22 bp, Homo sapiens
atgccaggaacaaacagtggtg

SEQ ID NO: 8043948 - DNA, 22 bp, Homo sapiens
atgccaggagatggagcagagt

SEQ ID NO: 8043949 - DNA, 22 bp, Homo sapiens
atgccaggctgtttggcctcag

SEQ ID NO: 8043950 - DNA, 22 bp, Homo sapiens
agatgactaacatagtattgct

SEQ ID NO: 8043951 - DNA, 22 bp, Homo sapiens
atttgaaatcccttctactgta

SEQ ID NO: 8043952 - DNA, 19 bp, Homo sapiens
atttgaaagctgtgcttgc

SEQ ID NO: 8043953 - DNA, 22 bp, Homo sapiens
atttgaaatctgggttactctg

SEQ ID NO: 8043954 - DNA, 22 bp, Homo sapiens
atttgaagaaagttttctagat

SEQ ID NO: 8043955 - DNA, 22 bp, Homo sapiens
atttgaagtcttcatgatttct

SEQ ID NO: 8043956 - DNA, 22 bp, Homo sapiens
atttgaaaacctgagcctcccg

SEQ ID NO: 8043957 - DNA, 22 bp, Homo sapiens
agatttaaatttgctacaattc

SEQ ID NO: 8043958 - DNA, 22 bp, Homo sapiens
agattgtctctttttcagaaga

SEQ ID NO: 8043959 - DNA, 21 bp, Homo sapiens
attttgtacatagaatttgtc

SEQ ID NO: 8043960 - DNA, 22 bp, Homo sapiens
attttctgtgtgcagataaata

SEQ ID NO: 8043961 - DNA, 22 bp, Homo sapiens
agatttatgtggtcacactcag

SEQ ID NO: 8043962 - DNA, 22 bp, Homo sapiens
agattccagatcccaaaaatga

SEQ ID NO: 8043963 - DNA, 22 bp, Homo sapiens
agattctaccagagctagtttg

SEQ ID NO: 8043964 - DNA, 22 bp, Homo sapiens
agcaaggcttcagagctgtctg

SEQ ID NO: 8043965 - DNA, 22 bp, Homo sapiens
attttttctgtaaactggcctt

SEQ ID NO: 8043966 - DNA, 22 bp, Homo sapiens
agcaaggctcggtcagggtgat

SEQ ID NO: 8043967 - DNA, 22 bp, Homo sapiens
attttgttatagaactctgtga

SEQ ID NO: 8043968 - DNA, 22 bp, Homo sapiens
attttgtgggttctgctgatgt

SEQ ID NO: 8043969 - DNA, 22 bp, Homo sapiens
attttgtggcagatgcagaacc

SEQ ID NO: 8043970 - DNA, 22 bp, Homo sapiens
attttgttatcagggctttgca

SEQ ID NO: 8043971 - DNA, 22 bp, Homo sapiens
attttgttgaggtaattgtcaa

SEQ ID NO: 8043972 - DNA, 22 bp, Homo sapiens
attttttcagattgagtgttaa

SEQ ID NO: 8043973 - DNA, 22 bp, Homo sapiens
attgtgtttgaatgaggctcca

SEQ ID NO: 8043974 - DNA, 22 bp, Homo sapiens
attggtggtgaggacatgccag

SEQ ID NO: 8043975 - DNA, 22 bp, Homo sapiens
attgaaaatgacatttgtgccc

SEQ ID NO: 8043976 - DNA, 22 bp, Homo sapiens
attgaaaaattcacaattctgg

SEQ ID NO: 8043977 - DNA, 22 bp, Homo sapiens
attctctggtcattgagcatat

SEQ ID NO: 8043978 - DNA, 22 bp, Homo sapiens
attctctggtcattgagtataa

SEQ ID NO: 8043979 - DNA, 22 bp, Homo sapiens
attctctgggttccagtaaatg

SEQ ID NO: 8043980 - DNA, 22 bp, Homo sapiens
attgaaaaatgactattgctta

SEQ ID NO: 8043981 - DNA, 22 bp, Homo sapiens
attctctgtctttttgaaaaca

SEQ ID NO: 8043982 - DNA, 22 bp, Homo sapiens
attctctgtagatggcttgaga

SEQ ID NO: 8043983 - DNA, 22 bp, Homo sapiens
attctacaacccaataataatt

SEQ ID NO: 8043984 - DNA, 23 bp, Homo sapiens
attctaagatgtgatcttataac

SEQ ID NO: 8043985 - DNA, 22 bp, Homo sapiens
agaggcctctttgcaagtaggt

SEQ ID NO: 8043986 - DNA, 22 bp, Homo sapiens
attatttgtgtccacagaatac

SEQ ID NO: 8043987 - DNA, 22 bp, Homo sapiens
agaggcctcaaaccagacctga

SEQ ID NO: 8043988 - DNA, 22 bp, Homo sapiens
agaggccggccgagcccatggg

SEQ ID NO: 8043989 - DNA, 22 bp, Homo sapiens
agccctcctttgttcatgctgc

SEQ ID NO: 8043990 - DNA, 22 bp, Homo sapiens
agccctctgagctagtcaccat

SEQ ID NO: 8043991 - DNA, 22 bp, Homo sapiens
agccctctctatggccctcttg

SEQ ID NO: 8043992 - DNA, 22 bp, Homo sapiens
agccctctctttagagatctga

SEQ ID NO: 8043993 - DNA, 22 bp, Homo sapiens
agccctgggctgtagataagca

SEQ ID NO: 8043994 - DNA, 22 bp, Homo sapiens
agccctcttccagccagcacag

SEQ ID NO: 8043995 - DNA, 22 bp, Homo sapiens
agccggccatgtggtcttgtgc

SEQ ID NO: 8043996 - DNA, 22 bp, Homo sapiens
agcccttgcagactgtcagcat

SEQ ID NO: 8043997 - DNA, 22 bp, Homo sapiens
agcctggaggaggagttgagca

SEQ ID NO: 8043998 - DNA, 22 bp, Homo sapiens
agcctggaggaggagttgagca

SEQ ID NO: 8043999 - DNA, 22 bp, Homo sapiens
agcctggagcttgagttatgag

SEQ ID NO: 8044000 - DNA, 22 bp, Homo sapiens
agcctggagaggcgccatacac

SEQ ID NO: 8044001 - DNA, 22 bp, Homo sapiens
agcctggaccaggggcctcaga

SEQ ID NO: 8044002 - DNA, 22 bp, Homo sapiens
agcctggaccaggggcctcaga

SEQ ID NO: 8044003 - DNA, 22 bp, Homo sapiens
agcctggacagctacggagaac

SEQ ID NO: 8044004 - DNA, 22 bp, Homo sapiens
agcctggaattaaggaaatgca

SEQ ID NO: 8044005 - DNA, 19 bp, Homo sapiens
agcctggagggctggtcac

SEQ ID NO: 8044006 - DNA, 19 bp, Homo sapiens
agcctggagggctggtcac

SEQ ID NO: 8044007 - DNA, 22 bp, Homo sapiens
agcctggaggccaggagacagt

SEQ ID NO: 8044008 - DNA, 22 bp, Homo sapiens
agcctggaggccaggagacagt

SEQ ID NO: 8044009 - DNA, 22 bp, Homo sapiens
cagcactgcttcgcagccaggg

SEQ ID NO: 8044010 - DNA, 22 bp, Homo sapiens
agcctggaggtaatgaggaaac

SEQ ID NO: 8044011 - DNA, 18 bp, Homo sapiens
agcctggagggttgaagt

SEQ ID NO: 8044012 - DNA, 18 bp, Homo sapiens
agcctggagggttgaagt

SEQ ID NO: 8044013 - DNA, 22 bp, Homo sapiens
agcctgagtgcttaggactgtt

SEQ ID NO: 8044014 - DNA, 22 bp, Homo sapiens
agcctggaattaaggaaatgca

SEQ ID NO: 8044015 - DNA, 22 bp, Homo sapiens
agcctggaagaacctgaagtct

SEQ ID NO: 8044016 - DNA, 22 bp, Homo sapiens
cagatgaactctatcctgtggc

SEQ ID NO: 8044017 - DNA, 22 bp, Homo sapiens
cagagccatccaggtgcctgtt

SEQ ID NO: 8044018 - DNA, 22 bp, Homo sapiens
cagagccatcccagcctgtggt

SEQ ID NO: 8044019 - DNA, 22 bp, Homo sapiens
cagagcagtagaaaacagcctt

SEQ ID NO: 8044020 - DNA, 22 bp, Homo sapiens
cagagcagtaaatctggggcac

SEQ ID NO: 8044021 - DNA, 22 bp, Homo sapiens
agccaggccttttctcaaggtt

SEQ ID NO: 8044022 - DNA, 22 bp, Homo sapiens
agccaggctcaaggcctgctcc

SEQ ID NO: 8044023 - DNA, 22 bp, Homo sapiens
agccaagcactcaactcctgga

SEQ ID NO: 8044024 - DNA, 20 bp, Homo sapiens
agccaagaacaggcagaacc

SEQ ID NO: 8044025 - DNA, 22 bp, Homo sapiens
agccaagagatgaggctgcagg

SEQ ID NO: 8044026 - DNA, 22 bp, Homo sapiens
agccagggaagaggcctacctc

SEQ ID NO: 8044027 - DNA, 22 bp, Homo sapiens
agccagggaaggataacaagaa

SEQ ID NO: 8044028 - DNA, 22 bp, Homo sapiens
agccagggacgctgcaggctac

SEQ ID NO: 8044029 - DNA, 22 bp, Homo sapiens
agccagggacgctgcaggctac

SEQ ID NO: 8044030 - DNA, 16 bp, Homo sapiens
agccaggctgcctcgg

SEQ ID NO: 8044031 - DNA, 22 bp, Homo sapiens
agccaggctgcagttggctggc

SEQ ID NO: 8044032 - DNA, 22 bp, Homo sapiens
cagagcagggtgcaccttgggc

SEQ ID NO: 8044033 - DNA, 22 bp, Homo sapiens
agccagggctgcaggttccttg

SEQ ID NO: 8044034 - DNA, 22 bp, Homo sapiens
agccagggctgcgagcagacag

SEQ ID NO: 8044035 - DNA, 22 bp, Homo sapiens
agccaggggagtcagctgctgg

SEQ ID NO: 8044036 - DNA, 23 bp, Homo sapiens
agccagggcactggtggagattg

SEQ ID NO: 8044037 - DNA, 22 bp, Homo sapiens
agccagggatggcagtgcccag

SEQ ID NO: 8044038 - DNA, 22 bp, Homo sapiens
agccagggaggtggaggttgca

SEQ ID NO: 8044039 - DNA, 22 bp, Homo sapiens
agccagggatgcagcacagtga

SEQ ID NO: 8044040 - DNA, 19 bp, Homo sapiens
cagcccagggtgctaccaa

SEQ ID NO: 8044041 - DNA, 22 bp, Homo sapiens
cagcccaggtctctcttccagt

SEQ ID NO: 8044042 - DNA, 22 bp, Homo sapiens
cagcccaggtctctcttccagt

SEQ ID NO: 8044043 - DNA, 22 bp, Homo sapiens
cagcccaggtctctcttccagt

SEQ ID NO: 8044044 - DNA, 22 bp, Homo sapiens
cagcccatggtttgtggccagt

SEQ ID NO: 8044045 - DNA, 22 bp, Homo sapiens
cagcccatccaaggcttggcat

SEQ ID NO: 8044046 - DNA, 22 bp, Homo sapiens
cagcccagtgcacgcccgtttc

SEQ ID NO: 8044047 - DNA, 22 bp, Homo sapiens
cagcccagtaccaagcagttgg

SEQ ID NO: 8044048 - DNA, 22 bp, Homo sapiens
cagcccaggtggcggaggttgc

SEQ ID NO: 8044049 - DNA, 22 bp, Homo sapiens
cagcccattcctgccatgccgc

SEQ ID NO: 8044050 - DNA, 22 bp, Homo sapiens
cagcccatttctgggacctgag

SEQ ID NO: 8044051 - DNA, 22 bp, Homo sapiens
cagccctggtgaggttggctat

SEQ ID NO: 8044052 - DNA, 22 bp, Homo sapiens
agcgctgtgggcgtgcgaggag

SEQ ID NO: 8044053 - DNA, 22 bp, Homo sapiens
cagccagtgtgaccgaggagga

SEQ ID NO: 8044054 - DNA, 22 bp, Homo sapiens
cagccatgagtctaagcagttt

SEQ ID NO: 8044055 - DNA, 22 bp, Homo sapiens
cagcccaaagccccaggctaga

SEQ ID NO: 8044056 - DNA, 22 bp, Homo sapiens
cagcccacgtcagggccactca

SEQ ID NO: 8044057 - DNA, 22 bp, Homo sapiens
cagcccacctggcacgtgtgtt

SEQ ID NO: 8044058 - DNA, 22 bp, Homo sapiens
cagcccaaagccccaggctaga

SEQ ID NO: 8044059 - DNA, 22 bp, Homo sapiens
cagcccagagaaggggcccgtg

SEQ ID NO: 8044060 - DNA, 16 bp, Homo sapiens
cagcccaggggcgggc

SEQ ID NO: 8044061 - DNA, 21 bp, Homo sapiens
cagcccagagcagtggggcca

SEQ ID NO: 8044062 - DNA, 21 bp, Homo sapiens
cagcccagagcagtggggcca

SEQ ID NO: 8044063 - DNA, 22 bp, Homo sapiens
cagcccagagaaggggcccgtg

SEQ ID NO: 8044064 - DNA, 22 bp, Homo sapiens
cagcccactgcctctgtggtag

SEQ ID NO: 8044065 - DNA, 22 bp, Homo sapiens
cagcccacttcccagcacctac

SEQ ID NO: 8044066 - DNA, 22 bp, Homo sapiens
cagcatgggggcaattcaggtg

SEQ ID NO: 8044067 - DNA, 22 bp, Homo sapiens
cagcatggggcttggagtcagc

SEQ ID NO: 8044068 - DNA, 22 bp, Homo sapiens
cagcatggggcttggagtcagc

SEQ ID NO: 8044069 - DNA, 22 bp, Homo sapiens
cagcatggtgccagtgagtcca

SEQ ID NO: 8044070 - DNA, 22 bp, Homo sapiens
cagcatggtgccagtgagtcca

SEQ ID NO: 8044071 - DNA, 22 bp, Homo sapiens
cagcatgggttccgggggcctg

SEQ ID NO: 8044072 - DNA, 22 bp, Homo sapiens
cagcatgggttccgggggcctg

SEQ ID NO: 8044073 - DNA, 22 bp, Homo sapiens
cagcatggttgggttctgggga

SEQ ID NO: 8044074 - DNA, 22 bp, Homo sapiens
cagcatggtggagctgctcttt

SEQ ID NO: 8044075 - DNA, 22 bp, Homo sapiens
agcgccactgcactccagcctg

SEQ ID NO: 8044076 - DNA, 22 bp, Homo sapiens
agcgcctgcggtgtgagcctgc

SEQ ID NO: 8044077 - DNA, 22 bp, Homo sapiens
agcgcctgcaccactctgcggc

SEQ ID NO: 8044078 - DNA, 22 bp, Homo sapiens
cagcatggagacaaagtgggca

SEQ ID NO: 8044079 - DNA, 22 bp, Homo sapiens
cagcatggacccatcgctgagt

SEQ ID NO: 8044080 - DNA, 22 bp, Homo sapiens
cagcatggacccatcgctgagt

SEQ ID NO: 8044081 - DNA, 22 bp, Homo sapiens
cagcatggccatttctcgctgc

SEQ ID NO: 8044082 - DNA, 22 bp, Homo sapiens
cagcatggcttgagtgtttcct

SEQ ID NO: 8044083 - DNA, 22 bp, Homo sapiens
cagcatggggatcactgtaggc

SEQ ID NO: 8044084 - DNA, 22 bp, Homo sapiens
cagcatggggatcactgtaggc

SEQ ID NO: 8044085 - DNA, 22 bp, Homo sapiens
cagcatcaccaacttgagcaat

SEQ ID NO: 8044086 - DNA, 22 bp, Homo sapiens
cagcatggacaggggtggcgtt

SEQ ID NO: 8044087 - DNA, 22 bp, Homo sapiens
cagcactgcttcgcagccaggg

SEQ ID NO: 8044088 - DNA, 22 bp, Homo sapiens
cagcactggggccactggagtt

SEQ ID NO: 8044089 - DNA, 22 bp, Homo sapiens
cagcactgggaccactagaaca

SEQ ID NO: 8044090 - DNA, 22 bp, Homo sapiens
cagcactgttcccagaccactg

SEQ ID NO: 8044091 - DNA, 22 bp, Homo sapiens
cagcactgttcccagaccactg

SEQ ID NO: 8044092 - DNA, 22 bp, Homo sapiens
cagcctctgtggctgccacacc

SEQ ID NO: 8044093 - DNA, 22 bp, Homo sapiens
cagcctctgacaccacagtcgt

SEQ ID NO: 8044094 - DNA, 22 bp, Homo sapiens
cagcgctggggtaggagcacct

SEQ ID NO: 8044095 - DNA, 22 bp, Homo sapiens
cagcgctggggtaggagcacct

SEQ ID NO: 8044096 - DNA, 22 bp, Homo sapiens
cagcgctgtgggaacagggcta

SEQ ID NO: 8044097 - DNA, 22 bp, Homo sapiens
cagcggggcctgtgctggggag

SEQ ID NO: 8044098 - DNA, 22 bp, Homo sapiens
cagctgccatgacatgtcctgc

SEQ ID NO: 8044099 - DNA, 22 bp, Homo sapiens
cagctgcccaggccacctggag

SEQ ID NO: 8044100 - DNA, 22 bp, Homo sapiens
cagctgccagcttctctccatc

SEQ ID NO: 8044101 - DNA, 18 bp, Homo sapiens
cagctgccagctcatgga

SEQ ID NO: 8044102 - DNA, 22 bp, Homo sapiens
cagctgccccgctggctgacca

SEQ ID NO: 8044103 - DNA, 22 bp, Homo sapiens
cagctgcccaggccacctggag

SEQ ID NO: 8044104 - DNA, 22 bp, Homo sapiens
cagctgcccctccagggctggg

SEQ ID NO: 8044105 - DNA, 21 bp, Homo sapiens
agctctggagcagcaatcaag

SEQ ID NO: 8044106 - DNA, 22 bp, Homo sapiens
agctctggagccggaggatttc

SEQ ID NO: 8044107 - DNA, 22 bp, Homo sapiens
agctctggcactggcgcgggat

SEQ ID NO: 8044108 - DNA, 22 bp, Homo sapiens
agctctgggagtagttccacct

SEQ ID NO: 8044109 - DNA, 22 bp, Homo sapiens
agctctgggattctcaggccac

SEQ ID NO: 8044110 - DNA, 17 bp, Homo sapiens
agctgagctggccaggg

SEQ ID NO: 8044111 - DNA, 22 bp, Homo sapiens
agctgaggacgtgaagggcggc

SEQ ID NO: 8044112 - DNA, 22 bp, Homo sapiens
agctgaggaggaatgatgggta

SEQ ID NO: 8044113 - DNA, 22 bp, Homo sapiens
cagctgctttcagcaggaggga

SEQ ID NO: 8044114 - DNA, 22 bp, Homo sapiens
cagctggcaagtggagcagggt

SEQ ID NO: 8044115 - DNA, 22 bp, Homo sapiens
cagctggcagaacctgcatcca

SEQ ID NO: 8044116 - DNA, 22 bp, Homo sapiens
cagctggcatacctgggcccgg

SEQ ID NO: 8044117 - DNA, 22 bp, Homo sapiens
cagctggcagccctggccctgc

SEQ ID NO: 8044118 - DNA, 22 bp, Homo sapiens
cagctgggtggctcttctgctc

SEQ ID NO: 8044119 - DNA, 22 bp, Homo sapiens
caatgatgtttagataaaatcc

SEQ ID NO: 8044120 - DNA, 22 bp, Homo sapiens
caatgattgctatttacataaa

SEQ ID NO: 8044121 - DNA, 21 bp, Homo sapiens
caagggccagtgagatgggat

SEQ ID NO: 8044122 - DNA, 22 bp, Homo sapiens
caagggccatctgagggcactg

SEQ ID NO: 8044123 - DNA, 22 bp, Homo sapiens
caagggcctccaccttgctcgt

SEQ ID NO: 8044124 - DNA, 22 bp, Homo sapiens
caagggccctcggatgatgatg

SEQ ID NO: 8044125 - DNA, 22 bp, Homo sapiens
caagggctgctatcagctactg

SEQ ID NO: 8044126 - DNA, 22 bp, Homo sapiens
caaggccaaagggccactgtca

SEQ ID NO: 8044127 - DNA, 22 bp, Homo sapiens
caaggaagttttaggagaggaa

SEQ ID NO: 8044128 - DNA, 22 bp, Homo sapiens
agcaatttcccatctcttctgc

SEQ ID NO: 8044129 - DNA, 21 bp, Homo sapiens
agcaatttttcctcctctgca

SEQ ID NO: 8044130 - DNA, 22 bp, Homo sapiens
cacagcagcgttcctccgtgtg

SEQ ID NO: 8044131 - DNA, 22 bp, Homo sapiens
cacagcagcgttcctccgtgtg

SEQ ID NO: 8044132 - DNA, 22 bp, Homo sapiens
cacaggaacttactggccactt

SEQ ID NO: 8044133 - DNA, 22 bp, Homo sapiens
cacaggaacaaagaagacaatt

SEQ ID NO: 8044134 - DNA, 22 bp, Homo sapiens
cacaggaaatgattctgcagca

SEQ ID NO: 8044135 - DNA, 22 bp, Homo sapiens
cacaggaaatattaggagggat

SEQ ID NO: 8044136 - DNA, 22 bp, Homo sapiens
cacaggaagaggtatacaattc

SEQ ID NO: 8044137 - DNA, 22 bp, Homo sapiens
cacaggaagaggtatacaattc

SEQ ID NO: 8044138 - DNA, 22 bp, Homo sapiens
agcaggcaggcccagcggctgg

SEQ ID NO: 8044139 - DNA, 22 bp, Homo sapiens
cacaggaagatctcccagaggt

SEQ ID NO: 8044140 - DNA, 22 bp, Homo sapiens
agcaggcaggctgccagtgaat

SEQ ID NO: 8044141 - DNA, 20 bp, Homo sapiens
cacaggaaagctactcagtt

SEQ ID NO: 8044142 - DNA, 22 bp, Homo sapiens
cacaggaaagtcagccagaaga

SEQ ID NO: 8044143 - DNA, 22 bp, Homo sapiens
cacaggaaaaatgggtccttta

SEQ ID NO: 8044144 - DNA, 22 bp, Homo sapiens
cacaggaaaataaaagatctaa

SEQ ID NO: 8044145 - DNA, 22 bp, Homo sapiens
cacaggaaaaatgggtccttta

SEQ ID NO: 8044146 - DNA, 22 bp, Homo sapiens
caatttctggaactaattctga

SEQ ID NO: 8044147 - DNA, 22 bp, Homo sapiens
caatttctgggcctcacacaag

SEQ ID NO: 8044148 - DNA, 22 bp, Homo sapiens
caatttctggaactaattctga

SEQ ID NO: 8044149 - DNA, 22 bp, Homo sapiens
caatttcttgttaattctcagg

SEQ ID NO: 8044150 - DNA, 22 bp, Homo sapiens
caatttcttgttaattctcagg

SEQ ID NO: 8044151 - DNA, 22 bp, Homo sapiens
cacacatcaacctagacattgt

SEQ ID NO: 8044152 - DNA, 22 bp, Homo sapiens
cacacatcttatcccagttatt

SEQ ID NO: 8044153 - DNA, 22 bp, Homo sapiens
cacacagaaccgctcgccactt

SEQ ID NO: 8044154 - DNA, 22 bp, Homo sapiens
caatttttgtacttatagtact

SEQ ID NO: 8044155 - DNA, 22 bp, Homo sapiens
caatttttaaactatgaagttg

SEQ ID NO: 8044156 - DNA, 22 bp, Homo sapiens
cacaggctgcccgcagctggga

SEQ ID NO: 8044157 - DNA, 22 bp, Homo sapiens
cacaggctcttctcacttgatt

SEQ ID NO: 8044158 - DNA, 23 bp, Homo sapiens
cacatggattaaatgagaccaca

SEQ ID NO: 8044159 - DNA, 21 bp, Homo sapiens
cacatgtgaattactgaactg

SEQ ID NO: 8044160 - DNA, 22 bp, Homo sapiens
cacatgggcttagcaggcaggg

SEQ ID NO: 8044161 - DNA, 22 bp, Homo sapiens
cacatggcctgtgtggccagac

SEQ ID NO: 8044162 - DNA, 22 bp, Homo sapiens
agcaggctaggaacctcactgc

SEQ ID NO: 8044163 - DNA, 19 bp, Homo sapiens
agcaggctaggctgcctct

SEQ ID NO: 8044164 - DNA, 18 bp, Homo sapiens
cacaggctcccagtgagg

SEQ ID NO: 8044165 - DNA, 22 bp, Homo sapiens
cacaggctccggccttgcagcc

SEQ ID NO: 8044166 - DNA, 19 bp, Homo sapiens
agcaggccaggcaggtggc

SEQ ID NO: 8044167 - DNA, 21 bp, Homo sapiens
agcaggcccaatggagggggc

SEQ ID NO: 8044168 - DNA, 22 bp, Homo sapiens
agcaggcccaagctggggggaa

SEQ ID NO: 8044169 - DNA, 22 bp, Homo sapiens
agcaggcccaagctggggggaa

SEQ ID NO: 8044170 - DNA, 22 bp, Homo sapiens
agcaggcctgccacctcggggt

SEQ ID NO: 8044171 - DNA, 21 bp, Homo sapiens
agcaggcccaatggagggggc

SEQ ID NO: 8044172 - DNA, 21 bp, Homo sapiens
agcaggcccaatggagggggc

SEQ ID NO: 8044173 - DNA, 20 bp, Homo sapiens
agcaggccttggggagagga

SEQ ID NO: 8044174 - DNA, 22 bp, Homo sapiens
agcaggcctgccacctcggggt

SEQ ID NO: 8044175 - DNA, 22 bp, Homo sapiens
cacggtggcccacaggtgcaag

SEQ ID NO: 8044176 - DNA, 22 bp, Homo sapiens
cacggcctgtaaggacccagga

SEQ ID NO: 8044177 - DNA, 22 bp, Homo sapiens
agcaggtgggatcaagctggca

SEQ ID NO: 8044178 - DNA, 18 bp, Homo sapiens
agcaggtggcgtctgcag

SEQ ID NO: 8044179 - DNA, 22 bp, Homo sapiens
agcaggtgggatcaagctggca

SEQ ID NO: 8044180 - DNA, 22 bp, Homo sapiens
agcaggtggcctcctgtctgtc

SEQ ID NO: 8044181 - DNA, 22 bp, Homo sapiens
agcaggtggcctcctgtctgtc

SEQ ID NO: 8044182 - DNA, 18 bp, Homo sapiens
agcaggtggatttattgg

SEQ ID NO: 8044183 - DNA, 22 bp, Homo sapiens
agcaggtggccacgaggaggag

SEQ ID NO: 8044184 - DNA, 22 bp, Homo sapiens
agcaggtggatttagacgggag

SEQ ID NO: 8044185 - DNA, 22 bp, Homo sapiens
agcaggtggatttagacgggag

SEQ ID NO: 8044186 - DNA, 22 bp, Homo sapiens
cactgcactccatcctgggaaa

SEQ ID NO: 8044187 - DNA, 22 bp, Homo sapiens
cactgcactccatcctgggaaa

SEQ ID NO: 8044188 - DNA, 22 bp, Homo sapiens
cactgcactccagcccgggcaa

SEQ ID NO: 8044189 - DNA, 22 bp, Homo sapiens
cactgcactccagcccgggcaa

SEQ ID NO: 8044190 - DNA, 22 bp, Homo sapiens
cactgcactccagcccgggcaa

SEQ ID NO: 8044191 - DNA, 22 bp, Homo sapiens
cactgcactccagcccgggcaa

SEQ ID NO: 8044192 - DNA, 22 bp, Homo sapiens
cactgcacttcagcctgggtga

SEQ ID NO: 8044193 - DNA, 22 bp, Homo sapiens
cactgcacttcagcctgggtga

SEQ ID NO: 8044194 - DNA, 22 bp, Homo sapiens
cactgcactgcagcctggagac

SEQ ID NO: 8044195 - DNA, 22 bp, Homo sapiens
cactgcacttcagcctgggtga

SEQ ID NO: 8044196 - DNA, 22 bp, Homo sapiens
cactgcacttcagcctgggtga

SEQ ID NO: 8044197 - DNA, 22 bp, Homo sapiens
agcattttctgagagtatagat

SEQ ID NO: 8044198 - DNA, 22 bp, Homo sapiens
cactgggctgataccaggcttc

SEQ ID NO: 8044199 - DNA, 22 bp, Homo sapiens
agaagaaactgtcggggatatt

SEQ ID NO: 8044200 - DNA, 22 bp, Homo sapiens
agaactggtggtgatcagttat

SEQ ID NO: 8044201 - DNA, 19 bp, Homo sapiens
agaactgggtccatggctt

SEQ ID NO: 8044202 - DNA, 22 bp, Homo sapiens
agaacacacgtcagagtttcct

SEQ ID NO: 8044203 - DNA, 22 bp, Homo sapiens
aatgaagaaatggacatcttta

SEQ ID NO: 8044204 - DNA, 20 bp, Homo sapiens
aatgaagttattaatgatgt

SEQ ID NO: 8044205 - DNA, 22 bp, Homo sapiens
aatgaatgaaccacatataaca

SEQ ID NO: 8044206 - DNA, 22 bp, Homo sapiens
aatgaatgggtttaatatttta

SEQ ID NO: 8044207 - DNA, 22 bp, Homo sapiens
aatgcattttattatatgtgac

SEQ ID NO: 8044208 - DNA, 22 bp, Homo sapiens
acttttatgataatcaatgttc

SEQ ID NO: 8044209 - DNA, 22 bp, Homo sapiens
actttgatcctttgaatatttg

SEQ ID NO: 8044210 - DNA, 22 bp, Homo sapiens
aatccttactgaatgagaaaaa

SEQ ID NO: 8044211 - DNA, 22 bp, Homo sapiens
aatcacagtttcaagtaatgca

SEQ ID NO: 8044212 - DNA, 22 bp, Homo sapiens
actgcaggccttggtgccagca

SEQ ID NO: 8044213 - DNA, 22 bp, Homo sapiens
actctttagaggtacatctctt

SEQ ID NO: 8044214 - DNA, 22 bp, Homo sapiens
actgtctctctagcagttcagg

SEQ ID NO: 8044215 - DNA, 22 bp, Homo sapiens
aatagcaaagttatcaaattaa

SEQ ID NO: 8044216 - DNA, 20 bp, Homo sapiens
aataaaagaagccttcaccc

SEQ ID NO: 8044217 - DNA, 22 bp, Homo sapiens
actgggagtcatgaggaaggag

SEQ ID NO: 8044218 - DNA, 22 bp, Homo sapiens
actgggagtcatgaggaaggag

SEQ ID NO: 8044219 - DNA, 22 bp, Homo sapiens
actgggagtcatgaggaaggag

SEQ ID NO: 8044220 - DNA, 22 bp, Homo sapiens
actgggagggtcttgaagaggg

SEQ ID NO: 8044221 - DNA, 22 bp, Homo sapiens
actgggaggcaaagagcaagga

SEQ ID NO: 8044222 - DNA, 22 bp, Homo sapiens
aataatagcagagtttacaatc

SEQ ID NO: 8044223 - DNA, 22 bp, Homo sapiens
acatgaagtggtcagatcaaac

SEQ ID NO: 8044224 - DNA, 22 bp, Homo sapiens
acatgacagtgcttagcaaact

SEQ ID NO: 8044225 - DNA, 22 bp, Homo sapiens
acatgacacctctggctgggtg

SEQ ID NO: 8044226 - DNA, 22 bp, Homo sapiens
acatcccacagaaacatacata

SEQ ID NO: 8044227 - DNA, 22 bp, Homo sapiens
aaggccagcctgagagctaaca

SEQ ID NO: 8044228 - DNA, 22 bp, Homo sapiens
aaggccagagcagactggagtt

SEQ ID NO: 8044229 - DNA, 22 bp, Homo sapiens
aaggccagagcagactggagtt

SEQ ID NO: 8044230 - DNA, 21 bp, Homo sapiens
aaggatgtcagtggcacagga

SEQ ID NO: 8044231 - DNA, 22 bp, Homo sapiens
aaggatgtgactcagtcagcta

SEQ ID NO: 8044232 - DNA, 22 bp, Homo sapiens
aaggaagatgctggcctgggga

SEQ ID NO: 8044233 - DNA, 22 bp, Homo sapiens
aaggaattccctttctgacaga

SEQ ID NO: 8044234 - DNA, 22 bp, Homo sapiens
aaggaatttgaggctgcagtga

SEQ ID NO: 8044235 - DNA, 22 bp, Homo sapiens
acagctggaggggctgcagagg

SEQ ID NO: 8044236 - DNA, 22 bp, Homo sapiens
acagctggaggtctgtgagcac

SEQ ID NO: 8044237 - DNA, 22 bp, Homo sapiens
aaggaagaagggaagttactta

SEQ ID NO: 8044238 - DNA, 22 bp, Homo sapiens
acctgcctatcagctgcctgct

SEQ ID NO: 8044239 - DNA, 22 bp, Homo sapiens
aagtccttctttatatgagagt

SEQ ID NO: 8044240 - DNA, 23 bp, Homo sapiens
aagtagatagctaaagttttgtt

SEQ ID NO: 8044241 - DNA, 22 bp, Homo sapiens
aaggtgtcaccagattggcagg

SEQ ID NO: 8044242 - DNA, 22 bp, Homo sapiens
aaggtgtcaaactagaagatgt

SEQ ID NO: 8044243 - DNA, 19 bp, Homo sapiens
aaggtggtttgtctctgta

SEQ ID NO: 8044244 - DNA, 22 bp, Homo sapiens
acctcaagaatgtataacacag

SEQ ID NO: 8044245 - DNA, 22 bp, Homo sapiens
acccaggccattggcaagagtc

SEQ ID NO: 8044246 - DNA, 22 bp, Homo sapiens
aaggtggtcttactgatggtat

SEQ ID NO: 8044247 - DNA, 22 bp, Homo sapiens
aaggtggttgtaggctggtctg

SEQ ID NO: 8044248 - DNA, 22 bp, Homo sapiens
aaggtggtttgattatcccact

SEQ ID NO: 8044249 - DNA, 22 bp, Homo sapiens
aaggtggtttgcagacagaata

SEQ ID NO: 8044250 - DNA, 22 bp, Homo sapiens
aaggtggtttgctaatcccaac

SEQ ID NO: 8044251 - DNA, 22 bp, Homo sapiens
aaggtggtgcttctgctcctct

SEQ ID NO: 8044252 - DNA, 22 bp, Homo sapiens
aaggtggttcgctggtacccag

SEQ ID NO: 8044253 - DNA, 22 bp, Homo sapiens
aaggtggttgcaattaccataa

SEQ ID NO: 8044254 - DNA, 22 bp, Homo sapiens
aaggtggtgatcatcttgaagg

SEQ ID NO: 8044255 - DNA, 22 bp, Homo sapiens
aaggtggtgagtacagttaggt

SEQ ID NO: 8044256 - DNA, 22 bp, Homo sapiens
aaggtaatccataatagttact

SEQ ID NO: 8044257 - DNA, 22 bp, Homo sapiens
aagggggcggcagccagtggaa

SEQ ID NO: 8044258 - DNA, 22 bp, Homo sapiens
aaggggggcacctgcatgcccg

SEQ ID NO: 8044259 - DNA, 22 bp, Homo sapiens
aagggctggatctctctgagca

SEQ ID NO: 8044260 - DNA, 22 bp, Homo sapiens
aagggctggccacattctgggt

SEQ ID NO: 8044261 - DNA, 22 bp, Homo sapiens
aagggctggccctgggaagagt

SEQ ID NO: 8044262 - DNA, 18 bp, Homo sapiens
aagggctggcctttggag

SEQ ID NO: 8044263 - DNA, 19 bp, Homo sapiens
aagggctgggcacctcact

SEQ ID NO: 8044264 - DNA, 22 bp, Homo sapiens
aagggctggagactgggtcttc

SEQ ID NO: 8044265 - DNA, 22 bp, Homo sapiens
aagggctggagaggaaaggttg

SEQ ID NO: 8044266 - DNA, 22 bp, Homo sapiens
aagggcagaatagagaagatgg

SEQ ID NO: 8044267 - DNA, 22 bp, Homo sapiens
aagggcagaaagggacgctttg

SEQ ID NO: 8044268 - DNA, 22 bp, Homo sapiens
aagggcagagggaatcccacat

SEQ ID NO: 8044269 - DNA, 20 bp, Homo sapiens
aagggcagagggaacagact

SEQ ID NO: 8044270 - DNA, 22 bp, Homo sapiens
aatgtgtcagcttgtcgatctt

SEQ ID NO: 8044271 - DNA, 22 bp, Homo sapiens
aatgtgtcatttcccacaggtg

SEQ ID NO: 8044272 - DNA, 22 bp, Homo sapiens
aatgtgtcccttatttcacagg

SEQ ID NO: 8044273 - DNA, 22 bp, Homo sapiens
aatgtgtctatgtggttcacag

SEQ ID NO: 8044274 - DNA, 22 bp, Homo sapiens
aatgtatgtgtatatcaaatca

SEQ ID NO: 8044275 - DNA, 21 bp, Homo sapiens
aatgtatgtttatctcacagt

SEQ ID NO: 8044276 - DNA, 22 bp, Homo sapiens
aatgtatgagcgtgaaagcact

SEQ ID NO: 8044277 - DNA, 22 bp, Homo sapiens
aatgtatgggtgagaaagttga

SEQ ID NO: 8044278 - DNA, 20 bp, Homo sapiens
aatgtatattttatgccagg

SEQ ID NO: 8044279 - DNA, 22 bp, Homo sapiens
aatgtataatatttaatgcttt

SEQ ID NO: 8044280 - DNA, 22 bp, Homo sapiens
agacatgtggtataatcagggg

SEQ ID NO: 8044281 - DNA, 22 bp, Homo sapiens
agacatgtccacaaagcattca

SEQ ID NO: 8044282 - DNA, 21 bp, Homo sapiens
agacatgtgaactaaaggtga

SEQ ID NO: 8044283 - DNA, 22 bp, Homo sapiens
agacatgtcaccaattcttact

SEQ ID NO: 8044284 - DNA, 22 bp, Homo sapiens
agacaggtaaatagagatgctg

SEQ ID NO: 8044285 - DNA, 22 bp, Homo sapiens
agacaggtagcaggacagatat

SEQ ID NO: 8044286 - DNA, 22 bp, Homo sapiens
agacatggagaaggagccagtg

SEQ ID NO: 8044287 - DNA, 22 bp, Homo sapiens
agaggaatttctggaaggaggc

SEQ ID NO: 8044288 - DNA, 22 bp, Homo sapiens
agaggaagtaatcaggacctgc

SEQ ID NO: 8044289 - DNA, 22 bp, Homo sapiens
agagcctggcaaaaggtcctgc

SEQ ID NO: 8044290 - DNA, 22 bp, Homo sapiens
agagcctggctcccagctaccg

SEQ ID NO: 8044291 - DNA, 22 bp, Homo sapiens
aattaattttgttcattcagtc

SEQ ID NO: 8044292 - DNA, 22 bp, Homo sapiens
aatttctctctcatgcttcatg

SEQ ID NO: 8044293 - DNA, 22 bp, Homo sapiens
acaacagggtaaggcaggccat

SEQ ID NO: 8044294 - DNA, 22 bp, Homo sapiens
agatgcatgtttatgtctttcc

SEQ ID NO: 8044295 - DNA, 22 bp, Homo sapiens
agatgcatgcttaattagcaca

SEQ ID NO: 8044296 - DNA, 22 bp, Homo sapiens
agatgcatggaaatctcattac

SEQ ID NO: 8044297 - DNA, 19 bp, Homo sapiens
acaatagaaaagtcttttg

SEQ ID NO: 8044298 - DNA, 22 bp, Homo sapiens
acaataatgtattgccaaaagt

SEQ ID NO: 8044299 - DNA, 22 bp, Homo sapiens
agcaaatacttgaataaaaaga

SEQ ID NO: 8044300 - DNA, 22 bp, Homo sapiens
agattttgtctcaatacttctg

SEQ ID NO: 8044301 - DNA, 22 bp, Homo sapiens
agcaaggccgagaggatgctat

SEQ ID NO: 8044302 - DNA, 22 bp, Homo sapiens
agcacacaggacttgattcatg

SEQ ID NO: 8044303 - DNA, 22 bp, Homo sapiens
agcacaggaccaaggaagctgt

SEQ ID NO: 8044304 - DNA, 19 bp, Homo sapiens
agcacagacaagaccagca

SEQ ID NO: 8044305 - DNA, 22 bp, Homo sapiens
agcacagaatggcttggaagcc

SEQ ID NO: 8044306 - DNA, 22 bp, Homo sapiens
agcacagaatgaggtggaagtg

SEQ ID NO: 8044307 - DNA, 22 bp, Homo sapiens
agcacactgacctgaagccttg

SEQ ID NO: 8044308 - DNA, 22 bp, Homo sapiens
agcacagggacaatgccaggtg

SEQ ID NO: 8044309 - DNA, 22 bp, Homo sapiens
agcacagggcccagcctaggcc

SEQ ID NO: 8044310 - DNA, 22 bp, Homo sapiens
agcacagggcccagcctaggcc

SEQ ID NO: 8044311 - DNA, 22 bp, Homo sapiens
agcacaggacgtagagcttgga

SEQ ID NO: 8044312 - DNA, 22 bp, Homo sapiens
agcacaggacgtagagcttgga

SEQ ID NO: 8044313 - DNA, 22 bp, Homo sapiens
acagaactttctgatcctgagc

SEQ ID NO: 8044314 - DNA, 22 bp, Homo sapiens
acagaagtccccatgaagaagc

SEQ ID NO: 8044315 - DNA, 22 bp, Homo sapiens
acagaggccatgagctgccacc

SEQ ID NO: 8044316 - DNA, 22 bp, Homo sapiens
acagagggggccttggagtgca

SEQ ID NO: 8044317 - DNA, 22 bp, Homo sapiens
acagagggtctgggcacaggac

SEQ ID NO: 8044318 - DNA, 19 bp, Homo sapiens
acagagggcaactgagaaa

SEQ ID NO: 8044319 - DNA, 23 bp, Homo sapiens
acagaggcttaaatgagtggcag

SEQ ID NO: 8044320 - DNA, 20 bp, Homo sapiens
agcggctggcggaggacacg

SEQ ID NO: 8044321 - DNA, 20 bp, Homo sapiens
agcggctggcggaggacacg

SEQ ID NO: 8044322 - DNA, 22 bp, Homo sapiens
agcgggcagaagtggggtctgc

SEQ ID NO: 8044323 - DNA, 22 bp, Homo sapiens
agcgggtctgcaagccttccct

SEQ ID NO: 8044324 - DNA, 22 bp, Homo sapiens
agcggctgctccgcaggctggc

SEQ ID NO: 8044325 - DNA, 22 bp, Homo sapiens
agcggctgctccgcaggctggc

SEQ ID NO: 8044326 - DNA, 22 bp, Homo sapiens
acagataattagcataaatgct

SEQ ID NO: 8044327 - DNA, 22 bp, Homo sapiens
acagcagatctggctacaggtt

SEQ ID NO: 8044328 - DNA, 22 bp, Homo sapiens
acagatataaactatagtagtg

SEQ ID NO: 8044329 - DNA, 22 bp, Homo sapiens
acagcagccttgttggtttcga

SEQ ID NO: 8044330 - DNA, 22 bp, Homo sapiens
acagcagccagccactgtgagc

SEQ ID NO: 8044331 - DNA, 19 bp, Homo sapiens
acagcagggatttttggag

SEQ ID NO: 8044332 - DNA, 22 bp, Homo sapiens
acagcagggaatatgggaattg

SEQ ID NO: 8044333 - DNA, 22 bp, Homo sapiens
acagcagggaatatgggaattg

SEQ ID NO: 8044334 - DNA, 17 bp, Homo sapiens
acagcagggaagtgttg

SEQ ID NO: 8044335 - DNA, 17 bp, Homo sapiens
acagcaggcccggaggg

SEQ ID NO: 8044336 - DNA, 17 bp, Homo sapiens
acagcaggcccggaggg

SEQ ID NO: 8044337 - DNA, 22 bp, Homo sapiens
acagcaggcccatactggaagg

SEQ ID NO: 8044338 - DNA, 22 bp, Homo sapiens
acagcaggttattgttatggca

SEQ ID NO: 8044339 - DNA, 18 bp, Homo sapiens
acagcaggtttcattctt

SEQ ID NO: 8044340 - DNA, 21 bp, Homo sapiens
acagcagggctggcatgacag

SEQ ID NO: 8044341 - DNA, 21 bp, Homo sapiens
acagcagggctggcatgacag

SEQ ID NO: 8044342 - DNA, 22 bp, Homo sapiens
acagcaggttttaactttgaag

SEQ ID NO: 8044343 - DNA, 22 bp, Homo sapiens
agcagggactgagccagtggga

SEQ ID NO: 8044344 - DNA, 22 bp, Homo sapiens
acacatcatgccaagtttcacc

SEQ ID NO: 8044345 - DNA, 22 bp, Homo sapiens
acacatctcaggggacactctc

SEQ ID NO: 8044346 - DNA, 22 bp, Homo sapiens
acacatcagcctcagctttggg

SEQ ID NO: 8044347 - DNA, 22 bp, Homo sapiens
acacatcagaaatatgaatgag

SEQ ID NO: 8044348 - DNA, 22 bp, Homo sapiens
acacatattcatatgtacttac

SEQ ID NO: 8044349 - DNA, 22 bp, Homo sapiens
agcaggcttgttatgtctgaga

SEQ ID NO: 8044350 - DNA, 19 bp, Homo sapiens
agcaggccacagggccagc

SEQ ID NO: 8044351 - DNA, 22 bp, Homo sapiens
acacagttcgttgttttctact

SEQ ID NO: 8044352 - DNA, 22 bp, Homo sapiens
acacagttcatgcatgaggtct

SEQ ID NO: 8044353 - DNA, 22 bp, Homo sapiens
acacagttcgtgcttttctatt

SEQ ID NO: 8044354 - DNA, 22 bp, Homo sapiens
acacagttgattgtcactcagg

SEQ ID NO: 8044355 - DNA, 22 bp, Homo sapiens
acacagtttatggtattctgtt

SEQ ID NO: 8044356 - DNA, 23 bp, Homo sapiens
acacaatagagtactattcagcc

SEQ ID NO: 8044357 - DNA, 22 bp, Homo sapiens
acacaatacagggctcaaaata

SEQ ID NO: 8044358 - DNA, 18 bp, Homo sapiens
acacacacacctgtgtat

SEQ ID NO: 8044359 - DNA, 22 bp, Homo sapiens
acacacacaagcaggttgtgga

SEQ ID NO: 8044360 - DNA, 20 bp, Homo sapiens
acacagtgacaggaaagaga

SEQ ID NO: 8044361 - DNA, 22 bp, Homo sapiens
acacagttcaggatcaaatagc

SEQ ID NO: 8044362 - DNA, 22 bp, Homo sapiens
acacccagattatgcacacaaa

SEQ ID NO: 8044363 - DNA, 22 bp, Homo sapiens
acacccagagcgccagtgccga

SEQ ID NO: 8044364 - DNA, 22 bp, Homo sapiens
agcaggtgtatcggtcacctac

SEQ ID NO: 8044365 - DNA, 22 bp, Homo sapiens
agcaggtgtcactttcactcca

SEQ ID NO: 8044366 - DNA, 22 bp, Homo sapiens
agcaggtgtatataaggctgag

SEQ ID NO: 8044367 - DNA, 22 bp, Homo sapiens
agcaggtgtatcggtcacctac

SEQ ID NO: 8044368 - DNA, 16 bp, Homo sapiens
agcaggtgtatagtgt

SEQ ID NO: 8044369 - DNA, 22 bp, Homo sapiens
agcaggtgtagggctctttgta

SEQ ID NO: 8044370 - DNA, 21 bp, Homo sapiens
agcaggtgtaaaggaggaaat

SEQ ID NO: 8044371 - DNA, 22 bp, Homo sapiens
agcaggtgatcgcgtgtgctcc

SEQ ID NO: 8044372 - DNA, 22 bp, Homo sapiens
agcaggtggtaggcagtcagca

SEQ ID NO: 8044373 - DNA, 22 bp, Homo sapiens
agcaggtggtaggcagtcagca

SEQ ID NO: 8044374 - DNA, 21 bp, Homo sapiens
agcaggtgtaaaggaggaaat

SEQ ID NO: 8044375 - DNA, 22 bp, Homo sapiens
agcaggtggtgggccagatttg

SEQ ID NO: 8044376 - DNA, 22 bp, Homo sapiens
agcaggtggtctgttgctgctg

SEQ ID NO: 8044377 - DNA, 20 bp, Homo sapiens
agcatttagcctttatccac

SEQ ID NO: 8044378 - DNA, 22 bp, Homo sapiens
acacccagcttttgaatgccct

SEQ ID NO: 8044379 - DNA, 22 bp, Homo sapiens
agccaaggagtgcaggtggctt

SEQ ID NO: 8044380 - DNA, 22 bp, Homo sapiens
agccaaggactcagtggtaggc

SEQ ID NO: 8044381 - DNA, 22 bp, Homo sapiens
agccaaggcagctagagctctg

SEQ ID NO: 8044382 - DNA, 22 bp, Homo sapiens
agccaaggcagctagagctctg

SEQ ID NO: 8044383 - DNA, 22 bp, Homo sapiens
agccaaggtcgccccagggcaa

SEQ ID NO: 8044384 - DNA, 22 bp, Homo sapiens
acactgtgtgacttctgagact

SEQ ID NO: 8044385 - DNA, 19 bp, Homo sapiens
agccagagtggcccagggg

SEQ ID NO: 8044386 - DNA, 22 bp, Homo sapiens
agccacagtctgtagccagctt

SEQ ID NO: 8044387 - DNA, 22 bp, Homo sapiens
agccagagattgagatgcaggc

SEQ ID NO: 8044388 - DNA, 22 bp, Homo sapiens
agccacagtctgtagccagctt

SEQ ID NO: 8044389 - DNA, 14 bp, Homo sapiens
acactgtgtttaga

SEQ ID NO: 8044390 - DNA, 22 bp, Homo sapiens
acactgtgtttacatagagaat

SEQ ID NO: 8044391 - DNA, 22 bp, Homo sapiens
acactgtgtggtctctctcgga

SEQ ID NO: 8044392 - DNA, 22 bp, Homo sapiens
acaaaagtagttgcggtttttg

SEQ ID NO: 8044393 - DNA, 22 bp, Homo sapiens
acaaaatagagttctcccctgg

SEQ ID NO: 8044394 - DNA, 22 bp, Homo sapiens
aagaatatctgttttatttagg

SEQ ID NO: 8044395 - DNA, 22 bp, Homo sapiens
acaaatatttactgaatccact

SEQ ID NO: 8044396 - DNA, 22 bp, Homo sapiens
acaaatccagtgaactccagtg

SEQ ID NO: 8044397 - DNA, 22 bp, Homo sapiens
aagaacatttatgatggcattt

SEQ ID NO: 8044398 - DNA, 22 bp, Homo sapiens
acaaaaagggagatgaggtaga

SEQ ID NO: 8044399 - DNA, 22 bp, Homo sapiens
aagaactggttatgttatcttg

SEQ ID NO: 8044400 - DNA, 22 bp, Homo sapiens
acacagccccacggtgagcaaa

SEQ ID NO: 8044401 - DNA, 22 bp, Homo sapiens
acacagccccacggtgagcaaa

SEQ ID NO: 8044402 - DNA, 22 bp, Homo sapiens
acacagagcttctcaactggga

SEQ ID NO: 8044403 - DNA, 22 bp, Homo sapiens
acacagagcaaatcatgacaga

SEQ ID NO: 8044404 - DNA, 22 bp, Homo sapiens
acacagagccaaaccatatcac

SEQ ID NO: 8044405 - DNA, 20 bp, Homo sapiens
acacagactcagcttggatg

SEQ ID NO: 8044406 - DNA, 22 bp, Homo sapiens
acaatgtaggctgaaaaagctt

SEQ ID NO: 8044407 - DNA, 22 bp, Homo sapiens
acaatgtagagtaaaatatgtt

SEQ ID NO: 8044408 - DNA, 22 bp, Homo sapiens
acaatattgtacccagaagttt

SEQ ID NO: 8044409 - DNA, 22 bp, Homo sapiens
aagcaggctcacgccaggcagt

SEQ ID NO: 8044410 - DNA, 22 bp, Homo sapiens
aagcaggctagattgaagggct

SEQ ID NO: 8044411 - DNA, 21 bp, Homo sapiens
aagcaggctgtaatcatgtgg

SEQ ID NO: 8044412 - DNA, 22 bp, Homo sapiens
aagcaggcttggtgtggccgct

SEQ ID NO: 8044413 - DNA, 19 bp, Homo sapiens
aagcagtttatatatttgt

SEQ ID NO: 8044414 - DNA, 22 bp, Homo sapiens
aagcagtttttcaactgtttag

SEQ ID NO: 8044415 - DNA, 22 bp, Homo sapiens
acagcaggaagctggagggaaa

SEQ ID NO: 8044416 - DNA, 22 bp, Homo sapiens
aagcagttactatttactatta

SEQ ID NO: 8044417 - DNA, 22 bp, Homo sapiens
acagcagggtcacattccctct

SEQ ID NO: 8044418 - DNA, 22 bp, Homo sapiens
acagcaggggtggaataaacgt

SEQ ID NO: 8044419 - DNA, 22 bp, Homo sapiens
acagcaggtagctttgtgcctc

SEQ ID NO: 8044420 - DNA, 19 bp, Homo sapiens
acagcaggtgtggggataa

SEQ ID NO: 8044421 - DNA, 22 bp, Homo sapiens
acagcagggggagctgttggac

SEQ ID NO: 8044422 - DNA, 22 bp, Homo sapiens
acagcagggggagctgttggac

SEQ ID NO: 8044423 - DNA, 22 bp, Homo sapiens
acagccaggaattctggagaag

SEQ ID NO: 8044424 - DNA, 21 bp, Homo sapiens
acagccaggaacatgaggggc

SEQ ID NO: 8044425 - DNA, 22 bp, Homo sapiens
acagccagcagagctgtttcct

SEQ ID NO: 8044426 - DNA, 22 bp, Homo sapiens
acagccagcttgatgggatccg

SEQ ID NO: 8044427 - DNA, 22 bp, Homo sapiens
acagccaggacttggccctctt

SEQ ID NO: 8044428 - DNA, 22 bp, Homo sapiens
acagccaggagccatgggcagg

SEQ ID NO: 8044429 - DNA, 22 bp, Homo sapiens
acagccaggacttggccctctt

SEQ ID NO: 8044430 - DNA, 22 bp, Homo sapiens
acagccagatctgagagatctt

SEQ ID NO: 8044431 - DNA, 19 bp, Homo sapiens
acagcaggtgtggggataa

SEQ ID NO: 8044432 - DNA, 22 bp, Homo sapiens
acagcaggttacagtggcacag

SEQ ID NO: 8044433 - DNA, 23 bp, Homo sapiens
acagccaggatgggagcagaagc

SEQ ID NO: 8044434 - DNA, 22 bp, Homo sapiens
acagccaggcccagcacgcagg

SEQ ID NO: 8044435 - DNA, 22 bp, Homo sapiens
acagccaggaggaactcagtga

SEQ ID NO: 8044436 - DNA, 22 bp, Homo sapiens
aagcccagcatccctgcaccag

SEQ ID NO: 8044437 - DNA, 22 bp, Homo sapiens
acagccagggacatacaatggt

SEQ ID NO: 8044438 - DNA, 22 bp, Homo sapiens
aagcccagtttcacactgagac

SEQ ID NO: 8044439 - DNA, 22 bp, Homo sapiens
aagcccagtaccttcagtgagg

SEQ ID NO: 8044440 - DNA, 22 bp, Homo sapiens
aagcccagctgaaagcattttt

SEQ ID NO: 8044441 - DNA, 22 bp, Homo sapiens
aagcccagctctgcctgctctg

SEQ ID NO: 8044442 - DNA, 22 bp, Homo sapiens
acagactggcctgtctcgcacc

SEQ ID NO: 8044443 - DNA, 22 bp, Homo sapiens
acagaaataactttttatgttt

SEQ ID NO: 8044444 - DNA, 22 bp, Homo sapiens
acagacatttaataaatgctga

SEQ ID NO: 8044445 - DNA, 22 bp, Homo sapiens
acacataagcctaatcatctcc

SEQ ID NO: 8044446 - DNA, 22 bp, Homo sapiens
acacatacatggggaagatgag

SEQ ID NO: 8044447 - DNA, 22 bp, Homo sapiens
acacatataccactgtaaatga

SEQ ID NO: 8044448 - DNA, 22 bp, Homo sapiens
acacatatatacatatttgtgc

SEQ ID NO: 8044449 - DNA, 22 bp, Homo sapiens
acacttctcatttgatactaac

SEQ ID NO: 8044450 - DNA, 22 bp, Homo sapiens
acacttggagcaacacttatgg

SEQ ID NO: 8044451 - DNA, 22 bp, Homo sapiens
aatgaacaaaatatgctttgca

SEQ ID NO: 8044452 - DNA, 22 bp, Homo sapiens
aatctggtttgacaacttttgt

SEQ ID NO: 8044453 - DNA, 22 bp, Homo sapiens
aataatgtaggatgataaatga

SEQ ID NO: 8044454 - DNA, 22 bp, Homo sapiens
aataatgtacatacatatttcg

SEQ ID NO: 8044455 - DNA, 22 bp, Homo sapiens
aataatgtctatggttccaaaa

SEQ ID NO: 8044456 - DNA, 22 bp, Homo sapiens
aataatgtctgctattttaaaa

SEQ ID NO: 8044457 - DNA, 23 bp, Homo sapiens
aataatgtcttgtgctctcactt

SEQ ID NO: 8044458 - DNA, 22 bp, Homo sapiens
aataatgtctttggcttgacca

SEQ ID NO: 8044459 - DNA, 22 bp, Homo sapiens
aatacagatggcatgtgaagat

SEQ ID NO: 8044460 - DNA, 22 bp, Homo sapiens
aataatgaacatttaaaacctg

SEQ ID NO: 8044461 - DNA, 22 bp, Homo sapiens
aataatgagacagcttatttaa

SEQ ID NO: 8044462 - DNA, 22 bp, Homo sapiens
aatataattttattcctagagt

SEQ ID NO: 8044463 - DNA, 22 bp, Homo sapiens
aatatttatgacaggaagtagc

SEQ ID NO: 8044464 - DNA, 22 bp, Homo sapiens
aatattgtttcaagatcacaga

SEQ ID NO: 8044465 - DNA, 22 bp, Homo sapiens
aagtgcctgggcaacatagcaa

SEQ ID NO: 8044466 - DNA, 22 bp, Homo sapiens
aacagttacccttaagatcttt

SEQ ID NO: 8044467 - DNA, 22 bp, Homo sapiens
aagtaagtcttacattcacatt

SEQ ID NO: 8044468 - DNA, 19 bp, Homo sapiens
aaggtgtcccaactgcgtt

SEQ ID NO: 8044469 - DNA, 22 bp, Homo sapiens
aaggtgtcggcagagccgcttc

SEQ ID NO: 8044470 - DNA, 22 bp, Homo sapiens
aaggtgtcgggttagctcagcc

SEQ ID NO: 8044471 - DNA, 22 bp, Homo sapiens
aaggtgtctctctgcttcttgg

SEQ ID NO: 8044472 - DNA, 22 bp, Homo sapiens
aagggctggaatatctcttaga

SEQ ID NO: 8044473 - DNA, 22 bp, Homo sapiens
aaggtgtcaggcttgggaaagt

SEQ ID NO: 8044474 - DNA, 22 bp, Homo sapiens
aaggtgtcatccaggatggtgg

SEQ ID NO: 8044475 - DNA, 22 bp, Homo sapiens
aaggtgtcattgtttatggaga

SEQ ID NO: 8044476 - DNA, 23 bp, Homo sapiens
aaggtgtcattgatgggattcta

SEQ ID NO: 8044477 - DNA, 22 bp, Homo sapiens
aagggctgctgtagaagcagag

SEQ ID NO: 8044478 - DNA, 22 bp, Homo sapiens
aagggctgccagggggtgccag

SEQ ID NO: 8044479 - DNA, 22 bp, Homo sapiens
aagggcaggtgggcatttctgg

SEQ ID NO: 8044480 - DNA, 22 bp, Homo sapiens
aagggctgcaatccaaaacact

SEQ ID NO: 8044481 - DNA, 22 bp, Homo sapiens
aagggctgcatttgatgtgtca

SEQ ID NO: 8044482 - DNA, 22 bp, Homo sapiens
aaggcccaggggctctagggca

SEQ ID NO: 8044483 - DNA, 22 bp, Homo sapiens
aaggcccaggctgccctgggca

SEQ ID NO: 8044484 - DNA, 22 bp, Homo sapiens
aaggcccagggattggaggtca

SEQ ID NO: 8044485 - DNA, 22 bp, Homo sapiens
aaggcccagcgtgacctcagtg

SEQ ID NO: 8044486 - DNA, 22 bp, Homo sapiens
aaggcccacagaactgtctcca

SEQ ID NO: 8044487 - DNA, 22 bp, Homo sapiens
aaggcccagcctggagcttgtt

SEQ ID NO: 8044488 - DNA, 22 bp, Homo sapiens
aaggccaggtccctgcagtgca

SEQ ID NO: 8044489 - DNA, 22 bp, Homo sapiens
aagggcaggagaagacggatat

SEQ ID NO: 8044490 - DNA, 22 bp, Homo sapiens
aagggcaggcacccaccctcac

SEQ ID NO: 8044491 - DNA, 22 bp, Homo sapiens
aagggcagggagtttgtgtcta

SEQ ID NO: 8044492 - DNA, 22 bp, Homo sapiens
aagggcaggcagagatcatata

SEQ ID NO: 8044493 - DNA, 22 bp, Homo sapiens
aaggataagaatggaaggaaca

SEQ ID NO: 8044494 - DNA, 22 bp, Homo sapiens
aaggagtctgggccattcagag

SEQ ID NO: 8044495 - DNA, 22 bp, Homo sapiens
aaagcagctgatctcagagcct

SEQ ID NO: 8044496 - DNA, 22 bp, Homo sapiens
aaagcagcggtgtctttactgc

SEQ ID NO: 8044497 - DNA, 21 bp, Homo sapiens
aaagcagcccatggcacagtc

SEQ ID NO: 8044498 - DNA, 19 bp, Homo sapiens
aaaaggaatattctttggg

SEQ ID NO: 8044499 - DNA, 22 bp, Homo sapiens
aaaatctggcaacactaagttt

SEQ ID NO: 8044500 - DNA, 22 bp, Homo sapiens
aaaaatgttatctactgtccga

SEQ ID NO: 8044501 - DNA, 22 bp, Homo sapiens
aaaaatgttatctactgtccga

SEQ ID NO: 8044502 - DNA, 22 bp, Homo sapiens
aaaaatgaaacggctggttggc

SEQ ID NO: 8044503 - DNA, 22 bp, Homo sapiens
aaaagcaaggcagtctgtctga

SEQ ID NO: 8044504 - DNA, 22 bp, Homo sapiens
aaaacagaggtgcctgggccca

SEQ ID NO: 8044505 - DNA, 22 bp, Homo sapiens
aaatgtctgtatgagaaagaga

SEQ ID NO: 8044506 - DNA, 22 bp, Homo sapiens
aaagacacatgtctcttagatt

SEQ ID NO: 8044507 - DNA, 22 bp, Homo sapiens
aaagacacatatgcttaaccca

SEQ ID NO: 8044508 - DNA, 22 bp, Homo sapiens
aaatgtctttcaatagagaaat

SEQ ID NO: 8044509 - DNA, 22 bp, Homo sapiens
aaagacacacagccagcaagtg

SEQ ID NO: 8044510 - DNA, 22 bp, Homo sapiens
aaagacacacagtgcttcagtt

SEQ ID NO: 8044511 - DNA, 21 bp, Homo sapiens
aaatgaatgtggtagtgcaag

SEQ ID NO: 8044512 - DNA, 22 bp, Homo sapiens
aaatgaactcaatgatctccca

SEQ ID NO: 8044513 - DNA, 22 bp, Homo sapiens
aaagtacagatggtgaggttgg

SEQ ID NO: 8044514 - DNA, 22 bp, Homo sapiens
aaagtcatacatggtgcttact

SEQ ID NO: 8044515 - DNA, 22 bp, Homo sapiens
aaagtcatgtttttgtttagca

SEQ ID NO: 8044516 - DNA, 19 bp, Homo sapiens
aaagttttattctcatttg

SEQ ID NO: 8044517 - DNA, 22 bp, Homo sapiens
aaaggagataaagggcccttca

SEQ ID NO: 8044518 - DNA, 22 bp, Homo sapiens
aaaggagagtgagtcagatgcc

SEQ ID NO: 8044519 - DNA, 22 bp, Homo sapiens
aaaggagagtaggttactccat

SEQ ID NO: 8044520 - DNA, 22 bp, Homo sapiens
aaaggagaaaacatacaggact

SEQ ID NO: 8044521 - DNA, 22 bp, Homo sapiens
aaaggagacagtcttacctgga

SEQ ID NO: 8044522 - DNA, 22 bp, Homo sapiens
aaaggagacttcagatctcctt

SEQ ID NO: 8044523 - DNA, 22 bp, Homo sapiens
aagagagaactcccttcgccag

SEQ ID NO: 8044524 - DNA, 22 bp, Homo sapiens
aagaagcaggtcacagacaggg

SEQ ID NO: 8044525 - DNA, 22 bp, Homo sapiens
aagaagcattctttcattggtt

SEQ ID NO: 8044526 - DNA, 22 bp, Homo sapiens
aagaagcagctgccaggccagt

SEQ ID NO: 8044527 - DNA, 22 bp, Homo sapiens
aaatatacggtccctaacagtc

SEQ ID NO: 8044528 - DNA, 22 bp, Homo sapiens
aagagagagtgcgctcacagaa

SEQ ID NO: 8044529 - DNA, 22 bp, Homo sapiens
aagagagaccatgggggacagg

SEQ ID NO: 8044530 - DNA, 22 bp, Homo sapiens
aaatatagtgacacttatagtc

SEQ ID NO: 8044531 - DNA, 22 bp, Homo sapiens
aaatggaactgggctactaggt

SEQ ID NO: 8044532 - DNA, 22 bp, Homo sapiens
aaatgctgtcagtgttattgga

SEQ ID NO: 8044533 - DNA, 22 bp, Homo sapiens
aaatgcaaggcacattcctttt

SEQ ID NO: 8044534 - DNA, 22 bp, Homo sapiens
aaatgcaacgggctttccttat

SEQ ID NO: 8044535 - DNA, 22 bp, Homo sapiens
aaatgatgttataagaccagga

SEQ ID NO: 8044536 - DNA, 20 bp, Homo sapiens
aaatgatgggaataatctat

SEQ ID NO: 8044537 - DNA, 22 bp, Homo sapiens
aaatgatgctcacagattagtg

SEQ ID NO: 8044538 - DNA, 22 bp, Homo sapiens
aaatgatgtggagtgaaattgt

SEQ ID NO: 8044539 - DNA, 22 bp, Homo sapiens
aaatcagagtctgattttaagg

SEQ ID NO: 8044540 - DNA, 22 bp, Homo sapiens
aaatgaacagttgcattctctg

SEQ ID NO: 8044541 - DNA, 22 bp, Homo sapiens
aaagggaatgtgtaggacatgt

SEQ ID NO: 8044542 - DNA, 22 bp, Homo sapiens
aaagggaggggcgataagccgg

SEQ ID NO: 8044543 - DNA, 22 bp, Homo sapiens
aaagggagcatggctgcaggga

SEQ ID NO: 8044544 - DNA, 22 bp, Homo sapiens
aacatgatgacaaaggtatatt

SEQ ID NO: 8044545 - DNA, 22 bp, Homo sapiens
aaagtccagagggcacactgaa

SEQ ID NO: 8044546 - DNA, 22 bp, Homo sapiens
aaagtctgaaagatgctaacat

SEQ ID NO: 8044547 - DNA, 22 bp, Homo sapiens
aacttgaaactgttccagaaaa

SEQ ID NO: 8044548 - DNA, 22 bp, Homo sapiens
aacttgaaaacctcatgaattg

SEQ ID NO: 8044549 - DNA, 22 bp, Homo sapiens
aacttctttgagctccagtttt

SEQ ID NO: 8044550 - DNA, 22 bp, Homo sapiens
aacatgaaacccaaacagaata

SEQ ID NO: 8044551 - DNA, 20 bp, Homo sapiens
aaaggcacagcaacagagct

SEQ ID NO: 8044552 - DNA, 22 bp, Homo sapiens
aaagcagcacatggatatcagt

SEQ ID NO: 8044553 - DNA, 22 bp, Homo sapiens
aaagcagcaacgtgcatataac

SEQ ID NO: 8044554 - DNA, 22 bp, Homo sapiens
aaattccattatgataatttcg

SEQ ID NO: 8044555 - DNA, 22 bp, Homo sapiens
aaattgcttataaagatgaatg

SEQ ID NO: 8044556 - DNA, 22 bp, Homo sapiens
tcacagtaactttgttgctttt

SEQ ID NO: 8044557 - DNA, 23 bp, Homo sapiens
tcacaggggccagcgctctgtgg

SEQ ID NO: 8044558 - DNA, 22 bp, Homo sapiens
tcacaggctctagggattaaga

SEQ ID NO: 8044559 - DNA, 22 bp, Homo sapiens
tcacagggcattatggctccag

SEQ ID NO: 8044560 - DNA, 22 bp, Homo sapiens
tcacaggctctccaccatgagg

SEQ ID NO: 8044561 - DNA, 20 bp, Homo sapiens
tcaattttctacaacatttg

SEQ ID NO: 8044562 - DNA, 22 bp, Homo sapiens
tcacacatgagtaaatacaggg

SEQ ID NO: 8044563 - DNA, 22 bp, Homo sapiens
tcacacatgctaagccagagat

SEQ ID NO: 8044564 - DNA, 22 bp, Homo sapiens
tcaataactttgtttagcattg

SEQ ID NO: 8044565 - DNA, 22 bp, Homo sapiens
tcaagtctcaatgtattatggt

SEQ ID NO: 8044566 - DNA, 21 bp, Homo sapiens
tcaaggctgttgcattaatgc

SEQ ID NO: 8044567 - DNA, 22 bp, Homo sapiens
tcaaggccacagtgagcagagt

SEQ ID NO: 8044568 - DNA, 22 bp, Homo sapiens
tcagagcattagaggtttgtat

SEQ ID NO: 8044569 - DNA, 20 bp, Homo sapiens
tcagagcagttggcttgtct

SEQ ID NO: 8044570 - DNA, 22 bp, Homo sapiens
tcagacagtgtgatcagtctct

SEQ ID NO: 8044571 - DNA, 22 bp, Homo sapiens
tcagacagtttgcagtgtgcct

SEQ ID NO: 8044572 - DNA, 22 bp, Homo sapiens
tcagacctctgaccttgccaaa

SEQ ID NO: 8044573 - DNA, 22 bp, Homo sapiens
tcagacagggcttctcaaactt

SEQ ID NO: 8044574 - DNA, 22 bp, Homo sapiens
tcagacagggagtcagaaaata

SEQ ID NO: 8044575 - DNA, 22 bp, Homo sapiens
tcagacaggcttctttctccct

SEQ ID NO: 8044576 - DNA, 22 bp, Homo sapiens
tcagacaggctggacagcttgc

SEQ ID NO: 8044577 - DNA, 22 bp, Homo sapiens
tcagacagtcatcagagcttgt

SEQ ID NO: 8044578 - DNA, 20 bp, Homo sapiens
tcagacagtcgcagttctgg

SEQ ID NO: 8044579 - DNA, 22 bp, Homo sapiens
tcagacaggcctctccagcctc

SEQ ID NO: 8044580 - DNA, 22 bp, Homo sapiens
tcagacagcttgggataactga

SEQ ID NO: 8044581 - DNA, 22 bp, Homo sapiens
tcagacagcttgcagggaggtg

SEQ ID NO: 8044582 - DNA, 22 bp, Homo sapiens
tcagaaaaggtagctgtgacaa

SEQ ID NO: 8044583 - DNA, 22 bp, Homo sapiens
tcactttcctcatcacgactag

SEQ ID NO: 8044584 - DNA, 22 bp, Homo sapiens
tcacttgatccttccctgaaat

SEQ ID NO: 8044585 - DNA, 22 bp, Homo sapiens
tcacttgactttccagtcttgg

SEQ ID NO: 8044586 - DNA, 22 bp, Homo sapiens
tcacttgagatgtaccacaaac

SEQ ID NO: 8044587 - DNA, 22 bp, Homo sapiens
tcacttgacctcttgaactcct

SEQ ID NO: 8044588 - DNA, 22 bp, Homo sapiens
tcacttgactccagtttcttct

SEQ ID NO: 8044589 - DNA, 22 bp, Homo sapiens
tcacttgagagatattagaagt

SEQ ID NO: 8044590 - DNA, 22 bp, Homo sapiens
tcacttgaattcattctgcgaa

SEQ ID NO: 8044591 - DNA, 22 bp, Homo sapiens
tcacttgacccttctctagcct

SEQ ID NO: 8044592 - DNA, 19 bp, Homo sapiens
tcacttgaagttcagaaat

SEQ ID NO: 8044593 - DNA, 22 bp, Homo sapiens
tcacttgaacctgggaggcaga

SEQ ID NO: 8044594 - DNA, 23 bp, Homo sapiens
tcacttgaagctagaatctgccc

SEQ ID NO: 8044595 - DNA, 18 bp, Homo sapiens
tcactgtgtgtcttgggt

SEQ ID NO: 8044596 - DNA, 22 bp, Homo sapiens
tcactgtgtcctttctgcgtag

SEQ ID NO: 8044597 - DNA, 22 bp, Homo sapiens
tcactgtggtatatatgtatca

SEQ ID NO: 8044598 - DNA, 22 bp, Homo sapiens
tcactctgtggcccaggcagtg

SEQ ID NO: 8044599 - DNA, 23 bp, Homo sapiens
tcactgtgcccattgaggtagag

SEQ ID NO: 8044600 - DNA, 22 bp, Homo sapiens
tcactgtgctctctagataggc

SEQ ID NO: 8044601 - DNA, 23 bp, Homo sapiens
tcaccagaaggggtcaataaaga

SEQ ID NO: 8044602 - DNA, 22 bp, Homo sapiens
tcaccagatctctctgtaatgg

SEQ ID NO: 8044603 - DNA, 22 bp, Homo sapiens
tcacagtatagagttattttgg

SEQ ID NO: 8044604 - DNA, 22 bp, Homo sapiens
tcactctggcctctgcagcagt

SEQ ID NO: 8044605 - DNA, 22 bp, Homo sapiens
tcacccaggctggagtgtagtg

SEQ ID NO: 8044606 - DNA, 22 bp, Homo sapiens
tcacccaggctggtatgcagtg

SEQ ID NO: 8044607 - DNA, 22 bp, Homo sapiens
tcacccaggctggtgcgcagtg

SEQ ID NO: 8044608 - DNA, 22 bp, Homo sapiens
tcacccaggctggagtgcagtg

SEQ ID NO: 8044609 - DNA, 19 bp, Homo sapiens
tcacccaggctgctggctc

SEQ ID NO: 8044610 - DNA, 22 bp, Homo sapiens
tcacccaggctggactgcagtg

SEQ ID NO: 8044611 - DNA, 22 bp, Homo sapiens
tcacccagcgggcgcacactcg

SEQ ID NO: 8044612 - DNA, 22 bp, Homo sapiens
tcacccaggatattgaagtcag

SEQ ID NO: 8044613 - DNA, 22 bp, Homo sapiens
tcaggaggtgtaggtcaagtga

SEQ ID NO: 8044614 - DNA, 22 bp, Homo sapiens
tcaggaagctgctctgggtggt

SEQ ID NO: 8044615 - DNA, 22 bp, Homo sapiens
tcagctcctcagagcctcagtt

SEQ ID NO: 8044616 - DNA, 22 bp, Homo sapiens
tcagctcctcatgcaggggata

SEQ ID NO: 8044617 - DNA, 22 bp, Homo sapiens
tcagcaggcacggacaggctgc

SEQ ID NO: 8044618 - DNA, 22 bp, Homo sapiens
tcagcaggcaccggaagtgttt

SEQ ID NO: 8044619 - DNA, 21 bp, Homo sapiens
tcagcaggcaccagaaggctg

SEQ ID NO: 8044620 - DNA, 22 bp, Homo sapiens
tcagcaggcagaaatctgcaga

SEQ ID NO: 8044621 - DNA, 22 bp, Homo sapiens
tcagcaggcagaaatctgcaga

SEQ ID NO: 8044622 - DNA, 22 bp, Homo sapiens
tcagcagaaaggcactagatga

SEQ ID NO: 8044623 - DNA, 21 bp, Homo sapiens
tcagcagcttttgcagtccct

SEQ ID NO: 8044624 - DNA, 22 bp, Homo sapiens
tcagcaggcacaccaaaaactg

SEQ ID NO: 8044625 - DNA, 22 bp, Homo sapiens
tcaggatggagtctatccagtg

SEQ ID NO: 8044626 - DNA, 22 bp, Homo sapiens
tcaggatgacttcaaggaggaa

SEQ ID NO: 8044627 - DNA, 17 bp, Homo sapiens
tcaggatgtagcagtag

SEQ ID NO: 8044628 - DNA, 22 bp, Homo sapiens
tcaggatgttaatatagcatta

SEQ ID NO: 8044629 - DNA, 22 bp, Homo sapiens
tcaggatgaagtcagaggggtc

SEQ ID NO: 8044630 - DNA, 22 bp, Homo sapiens
tcaggcctgcagtgccaaccca

SEQ ID NO: 8044631 - DNA, 22 bp, Homo sapiens
tcaggcctgctgtatgatggat

SEQ ID NO: 8044632 - DNA, 22 bp, Homo sapiens
tcaggcctgccctgaaagcaca

SEQ ID NO: 8044633 - DNA, 22 bp, Homo sapiens
tcaggcctgcaggcttcctgga

SEQ ID NO: 8044634 - DNA, 22 bp, Homo sapiens
tcaggccacttcacaggtgatt

SEQ ID NO: 8044635 - DNA, 22 bp, Homo sapiens
tcaggcctgcaaatgaatggta

SEQ ID NO: 8044636 - DNA, 19 bp, Homo sapiens
tcaggcagttattcacaaa

SEQ ID NO: 8044637 - DNA, 16 bp, Homo sapiens
tcaggcctggacgagc

SEQ ID NO: 8044638 - DNA, 22 bp, Homo sapiens
tcaggcctgtgctggaggagat

SEQ ID NO: 8044639 - DNA, 22 bp, Homo sapiens
tcaggctggagtgcagtggcgc

SEQ ID NO: 8044640 - DNA, 22 bp, Homo sapiens
tcaggctgggctcctctcccca

SEQ ID NO: 8044641 - DNA, 18 bp, Homo sapiens
tcaggctgggcctccttc

SEQ ID NO: 8044642 - DNA, 22 bp, Homo sapiens
tcagtcttccctccagtgcaac

SEQ ID NO: 8044643 - DNA, 23 bp, Homo sapiens
tcagtcttccctgtcagtaatag

SEQ ID NO: 8044644 - DNA, 22 bp, Homo sapiens
tcaggtgtttctggagaagtaa

SEQ ID NO: 8044645 - DNA, 18 bp, Homo sapiens
tcaggtgttttctgtata

SEQ ID NO: 8044646 - DNA, 22 bp, Homo sapiens
tcagtctctggctgtgtctgac

SEQ ID NO: 8044647 - DNA, 17 bp, Homo sapiens
tcagtctctgtcctgga

SEQ ID NO: 8044648 - DNA, 22 bp, Homo sapiens
tcaggtgttagaagaaatttca

SEQ ID NO: 8044649 - DNA, 22 bp, Homo sapiens
tcaggtgtgttgtattttacca

SEQ ID NO: 8044650 - DNA, 22 bp, Homo sapiens
tcaggtgtttaaggatagtgat

SEQ ID NO: 8044651 - DNA, 22 bp, Homo sapiens
tcaggtgttctccactcagttt

SEQ ID NO: 8044652 - DNA, 22 bp, Homo sapiens
tcaggtgtggtcaccacagggt

SEQ ID NO: 8044653 - DNA, 22 bp, Homo sapiens
tcaggtgtgtggctctggacca

SEQ ID NO: 8044654 - DNA, 22 bp, Homo sapiens
tcaggtgtgtggtggaaggcag

SEQ ID NO: 8044655 - DNA, 22 bp, Homo sapiens
tcaggtgtgggcagagaaacca

SEQ ID NO: 8044656 - DNA, 22 bp, Homo sapiens
tcaggtgtggaccgaggtcaga

SEQ ID NO: 8044657 - DNA, 16 bp, Homo sapiens
tcaggtgtgacttttt

SEQ ID NO: 8044658 - DNA, 23 bp, Homo sapiens
tcaggtgtgcggactgctgagtc

SEQ ID NO: 8044659 - DNA, 22 bp, Homo sapiens
tcaggtgtcttgtgggatttta

SEQ ID NO: 8044660 - DNA, 22 bp, Homo sapiens
tcaggtgtgaactatttggaaa

SEQ ID NO: 8044661 - DNA, 22 bp, Homo sapiens
tcaggtgtctatctaacctggt

SEQ ID NO: 8044662 - DNA, 22 bp, Homo sapiens
tcaggtgtctgcctctttgagt

SEQ ID NO: 8044663 - DNA, 21 bp, Homo sapiens
tcaggtggcagagtgtttatg

SEQ ID NO: 8044664 - DNA, 22 bp, Homo sapiens
tcaggtgtcaagcagggagctg

SEQ ID NO: 8044665 - DNA, 22 bp, Homo sapiens
tcaggtggccaaatgggagcgc

SEQ ID NO: 8044666 - DNA, 22 bp, Homo sapiens
tcaggtggccaaatgggagcgc

SEQ ID NO: 8044667 - DNA, 22 bp, Homo sapiens
tcagtgaaccttctgtggcagg

SEQ ID NO: 8044668 - DNA, 22 bp, Homo sapiens
tcagtgtaagttatgtagatgt

SEQ ID NO: 8044669 - DNA, 22 bp, Homo sapiens
tcattattctctttaatgttct

SEQ ID NO: 8044670 - DNA, 22 bp, Homo sapiens
tcatggcacttagcacagtcct

SEQ ID NO: 8044671 - DNA, 20 bp, Homo sapiens
tcatggaatctcactctagt

SEQ ID NO: 8044672 - DNA, 23 bp, Homo sapiens
tcatgcccaggctccagatgtca

SEQ ID NO: 8044673 - DNA, 22 bp, Homo sapiens
tcatatactgccttgtagatta

SEQ ID NO: 8044674 - DNA, 22 bp, Homo sapiens
tcccaggttccaccatccaggg

SEQ ID NO: 8044675 - DNA, 22 bp, Homo sapiens
tcccagggattaggacatggat

SEQ ID NO: 8044676 - DNA, 22 bp, Homo sapiens
tcccacaggaaagtagacattg

SEQ ID NO: 8044677 - DNA, 22 bp, Homo sapiens
tcccacaggagcctgagtccca

SEQ ID NO: 8044678 - DNA, 22 bp, Homo sapiens
tcccacaggagcctgagtccca

SEQ ID NO: 8044679 - DNA, 22 bp, Homo sapiens
tcccagggactgggctaggctt

SEQ ID NO: 8044680 - DNA, 22 bp, Homo sapiens
tccccaccccagaactactagg

SEQ ID NO: 8044681 - DNA, 22 bp, Homo sapiens
tccccacacagatacagagtag

SEQ ID NO: 8044682 - DNA, 21 bp, Homo sapiens
tccccacatttctaaacagac

SEQ ID NO: 8044683 - DNA, 22 bp, Homo sapiens
tccccacatctctgcatcaggc

SEQ ID NO: 8044684 - DNA, 22 bp, Homo sapiens
tccccacatctctgcatcaggc

SEQ ID NO: 8044685 - DNA, 22 bp, Homo sapiens
tccccacagcagaagatctgag

SEQ ID NO: 8044686 - DNA, 22 bp, Homo sapiens
tccccacactttcactcctggc

SEQ ID NO: 8044687 - DNA, 22 bp, Homo sapiens
tccccagggtccctgcttccat

SEQ ID NO: 8044688 - DNA, 22 bp, Homo sapiens
tccccaggggcatctctctgct

SEQ ID NO: 8044689 - DNA, 22 bp, Homo sapiens
tccaggccactgcagaggctct

SEQ ID NO: 8044690 - DNA, 22 bp, Homo sapiens
tccaggctctcaggtgtcagca

SEQ ID NO: 8044691 - DNA, 22 bp, Homo sapiens
tccaggctgcaaggccacaggg

SEQ ID NO: 8044692 - DNA, 23 bp, Homo sapiens
tccaggctgaaggagcagatttt

SEQ ID NO: 8044693 - DNA, 22 bp, Homo sapiens
tccaggctgacgcagctattta

SEQ ID NO: 8044694 - DNA, 19 bp, Homo sapiens
tccaggctgagagtcagct

SEQ ID NO: 8044695 - DNA, 22 bp, Homo sapiens
tccaggccacatggatggcgat

SEQ ID NO: 8044696 - DNA, 22 bp, Homo sapiens
tccaggccaatgtagcaggccc

SEQ ID NO: 8044697 - DNA, 22 bp, Homo sapiens
tccagggccatctccatgaggc

SEQ ID NO: 8044698 - DNA, 19 bp, Homo sapiens
tccagggcaggaacatgta

SEQ ID NO: 8044699 - DNA, 22 bp, Homo sapiens
tccaggctgcagtcttgccctc

SEQ ID NO: 8044700 - DNA, 22 bp, Homo sapiens
tcccacacttgaaacaaggctg

SEQ ID NO: 8044701 - DNA, 22 bp, Homo sapiens
tcccacactacacggttgttgg

SEQ ID NO: 8044702 - DNA, 22 bp, Homo sapiens
tcccacacctgtctattcctag

SEQ ID NO: 8044703 - DNA, 22 bp, Homo sapiens
tcccacacagcccgctcaccgg

SEQ ID NO: 8044704 - DNA, 22 bp, Homo sapiens
tccagcttggcagagctacctg

SEQ ID NO: 8044705 - DNA, 22 bp, Homo sapiens
tccagcttggagagaagtttct

SEQ ID NO: 8044706 - DNA, 22 bp, Homo sapiens
tccagcttgcttcaggatggtc

SEQ ID NO: 8044707 - DNA, 22 bp, Homo sapiens
tccagctttcacgctcctgcct

SEQ ID NO: 8044708 - DNA, 22 bp, Homo sapiens
tccagcttgggtgggaggaggt

SEQ ID NO: 8044709 - DNA, 22 bp, Homo sapiens
tccagcttgacaaatgatttta

SEQ ID NO: 8044710 - DNA, 22 bp, Homo sapiens
tccagcttcttgacttggtggt

SEQ ID NO: 8044711 - DNA, 22 bp, Homo sapiens
tccagcttgcctggtcttttgg

SEQ ID NO: 8044712 - DNA, 18 bp, Homo sapiens
tccagcttgcacttaaat

SEQ ID NO: 8044713 - DNA, 22 bp, Homo sapiens
tccagcttccagtggctggctg

SEQ ID NO: 8044714 - DNA, 22 bp, Homo sapiens
tccagcttcagctcttggatag

SEQ ID NO: 8044715 - DNA, 22 bp, Homo sapiens
tccagcttataggtagatttaa

SEQ ID NO: 8044716 - DNA, 22 bp, Homo sapiens
tccagcttttattggatgagga

SEQ ID NO: 8044717 - DNA, 22 bp, Homo sapiens
tccagcttttaccaaatgagca

SEQ ID NO: 8044718 - DNA, 22 bp, Homo sapiens
tccagctttggctctagctaca

SEQ ID NO: 8044719 - DNA, 22 bp, Homo sapiens
tccagctttgcctgatcatata

SEQ ID NO: 8044720 - DNA, 20 bp, Homo sapiens
tccagctttgcctctaactg

SEQ ID NO: 8044721 - DNA, 22 bp, Homo sapiens
tccagctttgagattttatgga

SEQ ID NO: 8044722 - DNA, 22 bp, Homo sapiens
tccagctcagggttggctcaag

SEQ ID NO: 8044723 - DNA, 22 bp, Homo sapiens
tcattgaatgagatgcaataga

SEQ ID NO: 8044724 - DNA, 16 bp, Homo sapiens
tcattgaagacagtac

SEQ ID NO: 8044725 - DNA, 22 bp, Homo sapiens
tcattgaagcccttgacaagcc

SEQ ID NO: 8044726 - DNA, 22 bp, Homo sapiens
tcattgaatttggttcaatatg

SEQ ID NO: 8044727 - DNA, 22 bp, Homo sapiens
tccagcagcccgaaggcccatc

SEQ ID NO: 8044728 - DNA, 22 bp, Homo sapiens
taaagtatattttttctcaata

SEQ ID NO: 8044729 - DNA, 23 bp, Homo sapiens
taaagtgctgatggtgagggagc

SEQ ID NO: 8044730 - DNA, 23 bp, Homo sapiens
taaattacctttccagtgcaggg

SEQ ID NO: 8044731 - DNA, 18 bp, Homo sapiens
taacccagagggtgactt

SEQ ID NO: 8044732 - DNA, 22 bp, Homo sapiens
taactctttactatacatttat

SEQ ID NO: 8044733 - DNA, 18 bp, Homo sapiens
taaaattcaaggcagggt

SEQ ID NO: 8044734 - DNA, 22 bp, Homo sapiens
taaaatgtttgcaagagaccag

SEQ ID NO: 8044735 - DNA, 22 bp, Homo sapiens
taaagggtaggttttactgtaa

SEQ ID NO: 8044736 - DNA, 22 bp, Homo sapiens
taaacagaatgcgtaagaagtg

SEQ ID NO: 8044737 - DNA, 22 bp, Homo sapiens
gttttgaatactactagaactt

SEQ ID NO: 8044738 - DNA, 22 bp, Homo sapiens
gttttgaaatgaaagaaccaag

SEQ ID NO: 8044739 - DNA, 18 bp, Homo sapiens
gttttgaattgtcttaca

SEQ ID NO: 8044740 - DNA, 22 bp, Homo sapiens
gtttcccaggctgtggggccct

SEQ ID NO: 8044741 - DNA, 22 bp, Homo sapiens
gttgggagcagcagaccaagag

SEQ ID NO: 8044742 - DNA, 22 bp, Homo sapiens
gttgcagatgtggaactcgtgc

SEQ ID NO: 8044743 - DNA, 22 bp, Homo sapiens
gttgcatttagttatctgtctg

SEQ ID NO: 8044744 - DNA, 22 bp, Homo sapiens
gttgcattgagagttgcattgg

SEQ ID NO: 8044745 - DNA, 22 bp, Homo sapiens
gttgcaggaagcacacacatgt

SEQ ID NO: 8044746 - DNA, 22 bp, Homo sapiens
gttcagcaatagatctagaggc

SEQ ID NO: 8044747 - DNA, 22 bp, Homo sapiens
gttcagcacaggtgctcagaca

SEQ ID NO: 8044748 - DNA, 22 bp, Homo sapiens
gttcatttaggaaaggaagagt

SEQ ID NO: 8044749 - DNA, 22 bp, Homo sapiens
gttcatttaggaaaggaagagt

SEQ ID NO: 8044750 - DNA, 22 bp, Homo sapiens
gttcatttatgatgtaacatgt

SEQ ID NO: 8044751 - DNA, 22 bp, Homo sapiens
gttcattgtcatgtttcattgc

SEQ ID NO: 8044752 - DNA, 22 bp, Homo sapiens
gttcatttatgatgtaacatgt

SEQ ID NO: 8044753 - DNA, 22 bp, Homo sapiens
gtgtgcctcgccaagctgtcgg

SEQ ID NO: 8044754 - DNA, 22 bp, Homo sapiens
gttaatgagtgggctgtggaga

SEQ ID NO: 8044755 - DNA, 22 bp, Homo sapiens
gttaatgaggacaagttttgag

SEQ ID NO: 8044756 - DNA, 22 bp, Homo sapiens
gtgctcaggggcaatcctggga

SEQ ID NO: 8044757 - DNA, 22 bp, Homo sapiens
gtgctcactccccacagtgccc

SEQ ID NO: 8044758 - DNA, 22 bp, Homo sapiens
gtgctcaggaccaaatgaacca

SEQ ID NO: 8044759 - DNA, 23 bp, Homo sapiens
gtgctctgcggtctgctagtctg

SEQ ID NO: 8044760 - DNA, 22 bp, Homo sapiens
gtgctctgagtttgcatgtcag

SEQ ID NO: 8044761 - DNA, 22 bp, Homo sapiens
gtgtgccaccactgacaggatt

SEQ ID NO: 8044762 - DNA, 22 bp, Homo sapiens
gtgtgccactgcctgaggaccc

SEQ ID NO: 8044763 - DNA, 22 bp, Homo sapiens
gtgtgccagacatgatgctatg

SEQ ID NO: 8044764 - DNA, 21 bp, Homo sapiens
gtgctctgggcagcagagggc

SEQ ID NO: 8044765 - DNA, 22 bp, Homo sapiens
gtgctctgtgtattaggatgtc

SEQ ID NO: 8044766 - DNA, 22 bp, Homo sapiens
gtgctctgtggattgagttgaa

SEQ ID NO: 8044767 - DNA, 22 bp, Homo sapiens
tacagatagaattagtgagtta

SEQ ID NO: 8044768 - DNA, 22 bp, Homo sapiens
tacagatacagatctagataca

SEQ ID NO: 8044769 - DNA, 22 bp, Homo sapiens
tacagatatagagatttataga

SEQ ID NO: 8044770 - DNA, 22 bp, Homo sapiens
tacagatattgtacagttatag

SEQ ID NO: 8044771 - DNA, 22 bp, Homo sapiens
tacagaaagggatgattgatct

SEQ ID NO: 8044772 - DNA, 22 bp, Homo sapiens
tacattcctgttagcatctaag

SEQ ID NO: 8044773 - DNA, 22 bp, Homo sapiens
tacataggtacagcctttttta

SEQ ID NO: 8044774 - DNA, 22 bp, Homo sapiens
tacatatactgagtgatttgct

SEQ ID NO: 8044775 - DNA, 22 bp, Homo sapiens
tacatagagggtaatagcatca

SEQ ID NO: 8044776 - DNA, 22 bp, Homo sapiens
tacaaagaggtaattgcatata

SEQ ID NO: 8044777 - DNA, 22 bp, Homo sapiens
tacaaaaaattgatactgacga

SEQ ID NO: 8044778 - DNA, 22 bp, Homo sapiens
tacaaaaaattgatactgacga

SEQ ID NO: 8044779 - DNA, 22 bp, Homo sapiens
tacaaaggagactctgtattta

SEQ ID NO: 8044780 - DNA, 22 bp, Homo sapiens
tacaaaggacagcagaaaaata

SEQ ID NO: 8044781 - DNA, 22 bp, Homo sapiens
tacaaagtagaaattcagtaaa

SEQ ID NO: 8044782 - DNA, 22 bp, Homo sapiens
tacaaaggcggtttttctgggc

SEQ ID NO: 8044783 - DNA, 22 bp, Homo sapiens
tacaaaggcttaaagagatttc

SEQ ID NO: 8044784 - DNA, 22 bp, Homo sapiens
tacaaaggcttaaagagatttc

SEQ ID NO: 8044785 - DNA, 22 bp, Homo sapiens
taatgtaaacacagagacagaa

SEQ ID NO: 8044786 - DNA, 22 bp, Homo sapiens
taatggtatttgttgaaaaact

SEQ ID NO: 8044787 - DNA, 21 bp, Homo sapiens
taattagcaaagctgagattc

SEQ ID NO: 8044788 - DNA, 22 bp, Homo sapiens
taattagagtttggtaaacaat

SEQ ID NO: 8044789 - DNA, 22 bp, Homo sapiens
taattagagtcacaagtaacca

SEQ ID NO: 8044790 - DNA, 22 bp, Homo sapiens
taatacctactggtcattgcaa

SEQ ID NO: 8044791 - DNA, 22 bp, Homo sapiens
taagtagctcttggaatatata

SEQ ID NO: 8044792 - DNA, 22 bp, Homo sapiens
taaggtagccctaatgtgggtt

SEQ ID NO: 8044793 - DNA, 22 bp, Homo sapiens
taagggttcagaatgcagtggt

SEQ ID NO: 8044794 - DNA, 22 bp, Homo sapiens
tattacagggctagttatgagt

SEQ ID NO: 8044795 - DNA, 22 bp, Homo sapiens
tatgtgtcctgttaccggcagc

SEQ ID NO: 8044796 - DNA, 22 bp, Homo sapiens
tatgtgtctcagttgtgattga

SEQ ID NO: 8044797 - DNA, 16 bp, Homo sapiens
tatgtgtctcatctac

SEQ ID NO: 8044798 - DNA, 22 bp, Homo sapiens
tatgtgtctgtcgtgcataaat

SEQ ID NO: 8044799 - DNA, 22 bp, Homo sapiens
tatgtgtctttatctggctctt

SEQ ID NO: 8044800 - DNA, 21 bp, Homo sapiens
tatgtgtctgtggaaaactag

SEQ ID NO: 8044801 - DNA, 18 bp, Homo sapiens
tatgtgtctgttacaact

SEQ ID NO: 8044802 - DNA, 22 bp, Homo sapiens
tatttattggacagtgttgctg

SEQ ID NO: 8044803 - DNA, 21 bp, Homo sapiens
tatttattaatttgtaaggct

SEQ ID NO: 8044804 - DNA, 22 bp, Homo sapiens
tatttattcattcagcaagcat

SEQ ID NO: 8044805 - DNA, 22 bp, Homo sapiens
tatttattctttgtactgcctt

SEQ ID NO: 8044806 - DNA, 22 bp, Homo sapiens
tattaggcatttgaggataaac

SEQ ID NO: 8044807 - DNA, 20 bp, Homo sapiens
tattaggaaggaggaaggaa

SEQ ID NO: 8044808 - DNA, 22 bp, Homo sapiens
tattgaagagataagtgacaga

SEQ ID NO: 8044809 - DNA, 22 bp, Homo sapiens
tattcttgtaccttaaatgatt

SEQ ID NO: 8044810 - DNA, 22 bp, Homo sapiens
tatatcatggagattaacattc

SEQ ID NO: 8044811 - DNA, 22 bp, Homo sapiens
tatgacattgctttttagaact

SEQ ID NO: 8044812 - DNA, 22 bp, Homo sapiens
tatgacattatgtattacatgt

SEQ ID NO: 8044813 - DNA, 22 bp, Homo sapiens
tatctaaaggatttaatttagt

SEQ ID NO: 8044814 - DNA, 20 bp, Homo sapiens
tatctaaatgcttacattac

SEQ ID NO: 8044815 - DNA, 22 bp, Homo sapiens
taggtgtcttgtcactaccgtt

SEQ ID NO: 8044816 - DNA, 22 bp, Homo sapiens
taggtgtctggacaactttgta

SEQ ID NO: 8044817 - DNA, 22 bp, Homo sapiens
taggtgtctgtcctgggctgtg

SEQ ID NO: 8044818 - DNA, 23 bp, Homo sapiens
taggtgtctagtgtccactatgt

SEQ ID NO: 8044819 - DNA, 22 bp, Homo sapiens
taggtgtctgctcttatttaac

SEQ ID NO: 8044820 - DNA, 22 bp, Homo sapiens
taggtgtcaggcctcctccagc

SEQ ID NO: 8044821 - DNA, 22 bp, Homo sapiens
taggtgtcaggtatagaattta

SEQ ID NO: 8044822 - DNA, 22 bp, Homo sapiens
taggtgtccatatatgtgtgta

SEQ ID NO: 8044823 - DNA, 19 bp, Homo sapiens
taggtgtccgccggaggtg

SEQ ID NO: 8044824 - DNA, 22 bp, Homo sapiens
taggtgtcctcgtccaaagatt

SEQ ID NO: 8044825 - DNA, 22 bp, Homo sapiens
taggtgtctaacaataagtgta

SEQ ID NO: 8044826 - DNA, 22 bp, Homo sapiens
taggtggtagagcctggcttgc

SEQ ID NO: 8044827 - DNA, 22 bp, Homo sapiens
taggtggttataaattcaaggc

SEQ ID NO: 8044828 - DNA, 22 bp, Homo sapiens
taggtggtgggatatgagcatc

SEQ ID NO: 8044829 - DNA, 22 bp, Homo sapiens
taggtggtgtgcgaagagcgtg

SEQ ID NO: 8044830 - DNA, 22 bp, Homo sapiens
taggtggttgtctgctttccta

SEQ ID NO: 8044831 - DNA, 22 bp, Homo sapiens
taggtggttatgtcagcctaga

SEQ ID NO: 8044832 - DNA, 17 bp, Homo sapiens
taggtggttgctggtct

SEQ ID NO: 8044833 - DNA, 22 bp, Homo sapiens
taggtctgtaaatgagagagac

SEQ ID NO: 8044834 - DNA, 22 bp, Homo sapiens
taggtgtcttgtgtatggtaca

SEQ ID NO: 8044835 - DNA, 22 bp, Homo sapiens
taggtgtctttctgtccttgtt

SEQ ID NO: 8044836 - DNA, 22 bp, Homo sapiens
tatacacaggaatctgtgaaaa

SEQ ID NO: 8044837 - DNA, 22 bp, Homo sapiens
tatacagaacattaagaactgt

SEQ ID NO: 8044838 - DNA, 22 bp, Homo sapiens
tagacacatcaagtatagttaa

SEQ ID NO: 8044839 - DNA, 22 bp, Homo sapiens
tagacacatcttcatccacaat

SEQ ID NO: 8044840 - DNA, 22 bp, Homo sapiens
tagagggccagctggacagcga

SEQ ID NO: 8044841 - DNA, 22 bp, Homo sapiens
tagaaatgattttgatgcttca

SEQ ID NO: 8044842 - DNA, 22 bp, Homo sapiens
tagaaatctacttagactttct

SEQ ID NO: 8044843 - DNA, 22 bp, Homo sapiens
tagaaatcaggtttttagaaag

SEQ ID NO: 8044844 - DNA, 22 bp, Homo sapiens
tagaaagaacttcatgtaaaac

SEQ ID NO: 8044845 - DNA, 22 bp, Homo sapiens
tactttttatgataagaactga

SEQ ID NO: 8044846 - DNA, 22 bp, Homo sapiens
tactttgaccaccatctgatta

SEQ ID NO: 8044847 - DNA, 22 bp, Homo sapiens
tagaaacagatgtttttgaaga

SEQ ID NO: 8044848 - DNA, 22 bp, Homo sapiens
tagcagcatttttgtagagtat

SEQ ID NO: 8044849 - DNA, 22 bp, Homo sapiens
tagcagctacctggctaagagt

SEQ ID NO: 8044850 - DNA, 22 bp, Homo sapiens
tagcagcatgtaagtgagtaga

SEQ ID NO: 8044851 - DNA, 22 bp, Homo sapiens
tagaggttggccttagaaagat

SEQ ID NO: 8044852 - DNA, 22 bp, Homo sapiens
tagaggtataccaaaaaggcat

SEQ ID NO: 8044853 - DNA, 21 bp, Homo sapiens
tagcccttctccacctcgccc

SEQ ID NO: 8044854 - DNA, 22 bp, Homo sapiens
tagcccttttctgagcccacat

SEQ ID NO: 8044855 - DNA, 22 bp, Homo sapiens
tagccctctccagcgaggtctg

SEQ ID NO: 8044856 - DNA, 22 bp, Homo sapiens
tagccctcagcttggagcgtgg

SEQ ID NO: 8044857 - DNA, 22 bp, Homo sapiens
tagcagctatgccattttgaca

SEQ ID NO: 8044858 - DNA, 22 bp, Homo sapiens
tagcagctcacagcctcccatt

SEQ ID NO: 8044859 - DNA, 22 bp, Homo sapiens
tagcagctccatttctctggca

SEQ ID NO: 8044860 - DNA, 22 bp, Homo sapiens
tagcagctccatttctctggca

SEQ ID NO: 8044861 - DNA, 22 bp, Homo sapiens
tagcagctcactaactctgcgt

SEQ ID NO: 8044862 - DNA, 22 bp, Homo sapiens
tagcagctcactaactctgcgt

SEQ ID NO: 8044863 - DNA, 22 bp, Homo sapiens
tagcagctcctaaacagtggtg

SEQ ID NO: 8044864 - DNA, 22 bp, Homo sapiens
tagctttaatgagttggtaaga

SEQ ID NO: 8044865 - DNA, 22 bp, Homo sapiens
tagctttaatgagttggtaaga

SEQ ID NO: 8044866 - DNA, 22 bp, Homo sapiens
taggcacttaataaatggtata

SEQ ID NO: 8044867 - DNA, 22 bp, Homo sapiens
tagggcagagtccaggatgggc

SEQ ID NO: 8044868 - DNA, 22 bp, Homo sapiens
tagggcagagcttgtacacgat

SEQ ID NO: 8044869 - DNA, 22 bp, Homo sapiens
taggatatgcatttttatacat

SEQ ID NO: 8044870 - DNA, 22 bp, Homo sapiens
taggatatgagtaagcctttgt

SEQ ID NO: 8044871 - DNA, 22 bp, Homo sapiens
taggatatgtgaaatcatatta

SEQ ID NO: 8044872 - DNA, 22 bp, Homo sapiens
taggatatggtagaaatcattc

SEQ ID NO: 8044873 - DNA, 22 bp, Homo sapiens
taggatggtcacagagatggac

SEQ ID NO: 8044874 - DNA, 22 bp, Homo sapiens
taggatggtacaaggcaggggt

SEQ ID NO: 8044875 - DNA, 22 bp, Homo sapiens
taggacagtagctggtgcacag

SEQ ID NO: 8044876 - DNA, 22 bp, Homo sapiens
taggagggggaacaaggcatac

SEQ ID NO: 8044877 - DNA, 22 bp, Homo sapiens
tagcttttatccactgcttttg

SEQ ID NO: 8044878 - DNA, 22 bp, Homo sapiens
tagctttacaaagtgctgcacc

SEQ ID NO: 8044879 - DNA, 22 bp, Homo sapiens
tagctttagtgaaaaatatcag

SEQ ID NO: 8044880 - DNA, 22 bp, Homo sapiens
gctgcccagtgtgctcatgcag

SEQ ID NO: 8044881 - DNA, 22 bp, Homo sapiens
gctgcccattgctctcccactc

SEQ ID NO: 8044882 - DNA, 22 bp, Homo sapiens
gctgccccccggactcggcggg

SEQ ID NO: 8044883 - DNA, 22 bp, Homo sapiens
gctgccccgagccatccttcag

SEQ ID NO: 8044884 - DNA, 22 bp, Homo sapiens
gctgcgccggatcccacgttcc

SEQ ID NO: 8044885 - DNA, 22 bp, Homo sapiens
gctgcggtcactgcgggggctg

SEQ ID NO: 8044886 - DNA, 22 bp, Homo sapiens
gctgctaagcgtttctgttcca

SEQ ID NO: 8044887 - DNA, 22 bp, Homo sapiens
gctgcctgtctgctgacccagg

SEQ ID NO: 8044888 - DNA, 21 bp, Homo sapiens
gctgctcgagatccagtgctt

SEQ ID NO: 8044889 - DNA, 22 bp, Homo sapiens
gctgcttcctagaaggcccagt

SEQ ID NO: 8044890 - DNA, 22 bp, Homo sapiens
gctgaggctgggagcagcctgt

SEQ ID NO: 8044891 - DNA, 22 bp, Homo sapiens
gctgaggccaggccccaccgga

SEQ ID NO: 8044892 - DNA, 22 bp, Homo sapiens
gctgaggcctcagaaggctgag

SEQ ID NO: 8044893 - DNA, 22 bp, Homo sapiens
gctctgggccatcctggccggg

SEQ ID NO: 8044894 - DNA, 22 bp, Homo sapiens
gctctgggccgggcaccagcct

SEQ ID NO: 8044895 - DNA, 22 bp, Homo sapiens
gctctgggctgccctctggaca

SEQ ID NO: 8044896 - DNA, 22 bp, Homo sapiens
gctctggggttggaaagtgatc

SEQ ID NO: 8044897 - DNA, 22 bp, Homo sapiens
gctctgggaattcagaaagcct

SEQ ID NO: 8044898 - DNA, 18 bp, Homo sapiens
gctctggctcacctccag

SEQ ID NO: 8044899 - DNA, 22 bp, Homo sapiens
gctctggctcaaaccaccggct

SEQ ID NO: 8044900 - DNA, 19 bp, Homo sapiens
gctcagcagacccagtgct

SEQ ID NO: 8044901 - DNA, 22 bp, Homo sapiens
gctcagccgaacttcagagcag

SEQ ID NO: 8044902 - DNA, 18 bp, Homo sapiens
gctcagctatgggaggtt

SEQ ID NO: 8044903 - DNA, 22 bp, Homo sapiens
gcgtgggctggactgggatgaa

SEQ ID NO: 8044904 - DNA, 22 bp, Homo sapiens
gcggtggggaaaggaggtgctg

SEQ ID NO: 8044905 - DNA, 22 bp, Homo sapiens
gcgggtggatcatgaggtcagg

SEQ ID NO: 8044906 - DNA, 22 bp, Homo sapiens
gcggggttccgtgccccagagt

SEQ ID NO: 8044907 - DNA, 22 bp, Homo sapiens
gcctttcacagagatttaaaaa

SEQ ID NO: 8044908 - DNA, 22 bp, Homo sapiens
gcctctggtccctcatgctgtg

SEQ ID NO: 8044909 - DNA, 22 bp, Homo sapiens
gcctctgggttggtgacaggct

SEQ ID NO: 8044910 - DNA, 19 bp, Homo sapiens
gcctgagccagccatgcaa

SEQ ID NO: 8044911 - DNA, 22 bp, Homo sapiens
gcctgagccgcctgagcggcgg

SEQ ID NO: 8044912 - DNA, 22 bp, Homo sapiens
gcctgagcaggcgtggaccatg

SEQ ID NO: 8044913 - DNA, 22 bp, Homo sapiens
gccttgcctcagccatggaaac

SEQ ID NO: 8044914 - DNA, 22 bp, Homo sapiens
gcctgagctactagggagtctg

SEQ ID NO: 8044915 - DNA, 20 bp, Homo sapiens
gcctgagctccgcctcctgt

SEQ ID NO: 8044916 - DNA, 20 bp, Homo sapiens
gcctgagctccgcctcctgt

SEQ ID NO: 8044917 - DNA, 22 bp, Homo sapiens
gccttgggggtgaaagaggcta

SEQ ID NO: 8044918 - DNA, 22 bp, Homo sapiens
gccttgggcacaggcagggccc

SEQ ID NO: 8044919 - DNA, 22 bp, Homo sapiens
gccttgggacggaggggtcacc

SEQ ID NO: 8044920 - DNA, 22 bp, Homo sapiens
gccttgggaaagtgggaggaga

SEQ ID NO: 8044921 - DNA, 22 bp, Homo sapiens
gctttcctggccctgtccctgc

SEQ ID NO: 8044922 - DNA, 22 bp, Homo sapiens
gctttattttgtgagggattac

SEQ ID NO: 8044923 - DNA, 22 bp, Homo sapiens
gctttattttgtgagggattac

SEQ ID NO: 8044924 - DNA, 22 bp, Homo sapiens
ggaagaggctctcattgagggc

SEQ ID NO: 8044925 - DNA, 22 bp, Homo sapiens
ggaagaggctgaggccatgctg

SEQ ID NO: 8044926 - DNA, 22 bp, Homo sapiens
ggaagaggctggtagtgcccgt

SEQ ID NO: 8044927 - DNA, 22 bp, Homo sapiens
ggaagaggctgaggccatgctg

SEQ ID NO: 8044928 - DNA, 22 bp, Homo sapiens
ggaattcagggaagtcaaaaag

SEQ ID NO: 8044929 - DNA, 17 bp, Homo sapiens
ggacacagctcatggct

SEQ ID NO: 8044930 - DNA, 22 bp, Homo sapiens
ggaagcactgaggcagagaggg

SEQ ID NO: 8044931 - DNA, 22 bp, Homo sapiens
ggagagaattccatggacatgt

SEQ ID NO: 8044932 - DNA, 22 bp, Homo sapiens
ggagagaactgacctgaaagga

SEQ ID NO: 8044933 - DNA, 22 bp, Homo sapiens
ggagagaaattgaggtagcaag

SEQ ID NO: 8044934 - DNA, 22 bp, Homo sapiens
ggagcatgtggggtgagcaggg

SEQ ID NO: 8044935 - DNA, 22 bp, Homo sapiens
ggagcatgcgctctgtgaccga

SEQ ID NO: 8044936 - DNA, 22 bp, Homo sapiens
ggagcaggctctgtggtttcca

SEQ ID NO: 8044937 - DNA, 22 bp, Homo sapiens
ggagcagggaattacagcgcag

SEQ ID NO: 8044938 - DNA, 22 bp, Homo sapiens
ggagcagggaattacagcgcag

SEQ ID NO: 8044939 - DNA, 17 bp, Homo sapiens
ggaccaggggttgccat

SEQ ID NO: 8044940 - DNA, 19 bp, Homo sapiens
ggaccaggtcctgggcagc

SEQ ID NO: 8044941 - DNA, 22 bp, Homo sapiens
ggaccaggcaagctgaggcggg

SEQ ID NO: 8044942 - DNA, 22 bp, Homo sapiens
ggacatgattagcagggagagc

SEQ ID NO: 8044943 - DNA, 21 bp, Homo sapiens
ggacatgaggcaggagaggct

SEQ ID NO: 8044944 - DNA, 22 bp, Homo sapiens
ggacaggtgactgcccagagtg

SEQ ID NO: 8044945 - DNA, 22 bp, Homo sapiens
ggacacaggtaaataccactga

SEQ ID NO: 8044946 - DNA, 22 bp, Homo sapiens
ggacaggttcagcagtttataa

SEQ ID NO: 8044947 - DNA, 22 bp, Homo sapiens
ggacaggtgcaaagggcacatg

SEQ ID NO: 8044948 - DNA, 22 bp, Homo sapiens
ggacaggtgtgaggctggcaca

SEQ ID NO: 8044949 - DNA, 22 bp, Homo sapiens
ggacagtgtgggccatctcact

SEQ ID NO: 8044950 - DNA, 22 bp, Homo sapiens
ggacagtgaatgtggggatgca

SEQ ID NO: 8044951 - DNA, 22 bp, Homo sapiens
ggacagtgaatctggaggtata

SEQ ID NO: 8044952 - DNA, 22 bp, Homo sapiens
gctggagaaactgcagctgagg

SEQ ID NO: 8044953 - DNA, 22 bp, Homo sapiens
gctggctgcgtcatcacagggc

SEQ ID NO: 8044954 - DNA, 22 bp, Homo sapiens
gctggctgctaggacagctaca

SEQ ID NO: 8044955 - DNA, 22 bp, Homo sapiens
gctggctggaatgggagaagaa

SEQ ID NO: 8044956 - DNA, 19 bp, Homo sapiens
gctggctggaggagggaca

SEQ ID NO: 8044957 - DNA, 22 bp, Homo sapiens
gctggctggaggtgaggaagaa

SEQ ID NO: 8044958 - DNA, 22 bp, Homo sapiens
gctggctggagtaaggagggag

SEQ ID NO: 8044959 - DNA, 22 bp, Homo sapiens
gctggctggagtgagctaccct

SEQ ID NO: 8044960 - DNA, 22 bp, Homo sapiens
gctggctggcgggtgcgtcctc

SEQ ID NO: 8044961 - DNA, 20 bp, Homo sapiens
gctgggaacaggattgaatc

SEQ ID NO: 8044962 - DNA, 22 bp, Homo sapiens
gctgggctggccgccgagatcg

SEQ ID NO: 8044963 - DNA, 22 bp, Homo sapiens
gctgggctggaaggccaaggca

SEQ ID NO: 8044964 - DNA, 22 bp, Homo sapiens
gctggctttgtggtctctcctc

SEQ ID NO: 8044965 - DNA, 22 bp, Homo sapiens
gctgggcttctcaatgctgcct

SEQ ID NO: 8044966 - DNA, 22 bp, Homo sapiens
gctgggcttctcaatgctgcct

SEQ ID NO: 8044967 - DNA, 22 bp, Homo sapiens
gctgggcttcacctccagagtt

SEQ ID NO: 8044968 - DNA, 22 bp, Homo sapiens
gctgggcttcacctccagagtt

SEQ ID NO: 8044969 - DNA, 22 bp, Homo sapiens
gctgggctgtagtttgctgacc

SEQ ID NO: 8044970 - DNA, 22 bp, Homo sapiens
gctggctgtgggctccacgctc

SEQ ID NO: 8044971 - DNA, 22 bp, Homo sapiens
gctggctggctgtgcaaaggca

SEQ ID NO: 8044972 - DNA, 21 bp, Homo sapiens
gctggctggctgaccggcctt

SEQ ID NO: 8044973 - DNA, 22 bp, Homo sapiens
gctggctgtgttccttctgcca

SEQ ID NO: 8044974 - DNA, 22 bp, Homo sapiens
gctgtgtcctcacacagccttt

SEQ ID NO: 8044975 - DNA, 18 bp, Homo sapiens
gctttatttcttggggaa

SEQ ID NO: 8044976 - DNA, 22 bp, Homo sapiens
gctttatgtgagtagcactgtc

SEQ ID NO: 8044977 - DNA, 22 bp, Homo sapiens
gctttatgtgagtagcactgtc

SEQ ID NO: 8044978 - DNA, 22 bp, Homo sapiens
gctttatgtaagtccaaaggca

SEQ ID NO: 8044979 - DNA, 18 bp, Homo sapiens
gctttatttcttggggaa

SEQ ID NO: 8044980 - DNA, 22 bp, Homo sapiens
gcttgcacataagcacacactt

SEQ ID NO: 8044981 - DNA, 22 bp, Homo sapiens
gcttgctctttagccatggcca

SEQ ID NO: 8044982 - DNA, 23 bp, Homo sapiens
gcttgctcattctatcacacagc

SEQ ID NO: 8044983 - DNA, 23 bp, Homo sapiens
gcttgcctggtgtgtggctgacc

SEQ ID NO: 8044984 - DNA, 19 bp, Homo sapiens
gctgtgggacagcagggtg

SEQ ID NO: 8044985 - DNA, 22 bp, Homo sapiens
gctgtggcttgcagctggggct

SEQ ID NO: 8044986 - DNA, 22 bp, Homo sapiens
gctgtggctctcacaagcaaat

SEQ ID NO: 8044987 - DNA, 22 bp, Homo sapiens
gctgtggctccaatggtgagcc

SEQ ID NO: 8044988 - DNA, 22 bp, Homo sapiens
gctgtggctgaagatgcaggga

SEQ ID NO: 8044989 - DNA, 22 bp, Homo sapiens
gctgtggctgaccaccaggggg

SEQ ID NO: 8044990 - DNA, 22 bp, Homo sapiens
gctgtggggagagaacacacaa

SEQ ID NO: 8044991 - DNA, 22 bp, Homo sapiens
gctgtgggccatggccaagtga

SEQ ID NO: 8044992 - DNA, 22 bp, Homo sapiens
gctgtgggtaaacgctgagggt

SEQ ID NO: 8044993 - DNA, 22 bp, Homo sapiens
gctgtgggccacacggctgagt

SEQ ID NO: 8044994 - DNA, 22 bp, Homo sapiens
gctgtgggacaggtccagccag

SEQ ID NO: 8044995 - DNA, 22 bp, Homo sapiens
gctgtggtccctctgtcctcat

SEQ ID NO: 8044996 - DNA, 22 bp, Homo sapiens
gctgtgggttcctggcatttga

SEQ ID NO: 8044997 - DNA, 22 bp, Homo sapiens
gctgtgggtgctggctccaccc

SEQ ID NO: 8044998 - DNA, 22 bp, Homo sapiens
gctgtgggtacaaatacacaat

SEQ ID NO: 8044999 - DNA, 19 bp, Homo sapiens
gctggggcctgaccagaca

SEQ ID NO: 8045000 - DNA, 19 bp, Homo sapiens
gctgtgcccctgccgcttg

SEQ ID NO: 8045001 - DNA, 20 bp, Homo sapiens
gctgtgcctccagctggtgg

SEQ ID NO: 8045002 - DNA, 19 bp, Homo sapiens
gctgtgcctctctcctgct

SEQ ID NO: 8045003 - DNA, 22 bp, Homo sapiens
gctgggcttggtttccctgctt

SEQ ID NO: 8045004 - DNA, 22 bp, Homo sapiens
gctggggcctgaacagtcagct

SEQ ID NO: 8045005 - DNA, 22 bp, Homo sapiens
gctggggagggcgtcaaggcca

SEQ ID NO: 8045006 - DNA, 22 bp, Homo sapiens
gaggcccagcagcgcaggtctt

SEQ ID NO: 8045007 - DNA, 20 bp, Homo sapiens
gaggcccagagaggtgaagc

SEQ ID NO: 8045008 - DNA, 22 bp, Homo sapiens
gaggcccacagggagtaccaag

SEQ ID NO: 8045009 - DNA, 22 bp, Homo sapiens
gaggcccaatgcttccctcctt

SEQ ID NO: 8045010 - DNA, 22 bp, Homo sapiens
gaggcccaaggactctgtcccg

SEQ ID NO: 8045011 - DNA, 22 bp, Homo sapiens
gcaaaggccactggggcgatgg

SEQ ID NO: 8045012 - DNA, 22 bp, Homo sapiens
gcacacattcggattcttaacc

SEQ ID NO: 8045013 - DNA, 22 bp, Homo sapiens
gcacacatgcatgcacaggagt

SEQ ID NO: 8045014 - DNA, 22 bp, Homo sapiens
gcacacagtatatgctcattaa

SEQ ID NO: 8045015 - DNA, 19 bp, Homo sapiens
gcacacagtagggctggca

SEQ ID NO: 8045016 - DNA, 19 bp, Homo sapiens
gcacacagtagggctggca

SEQ ID NO: 8045017 - DNA, 22 bp, Homo sapiens
gcacacagtagggattcaatga

SEQ ID NO: 8045018 - DNA, 22 bp, Homo sapiens
gcacacaggggagttctcagaa

SEQ ID NO: 8045019 - DNA, 22 bp, Homo sapiens
gcacacagaatcagtgggcata

SEQ ID NO: 8045020 - DNA, 22 bp, Homo sapiens
gcacacactgttttcctcacat

SEQ ID NO: 8045021 - DNA, 22 bp, Homo sapiens
gcacacagaatcagtgggcata

SEQ ID NO: 8045022 - DNA, 22 bp, Homo sapiens
gcacagggctgccaggcggctt

SEQ ID NO: 8045023 - DNA, 22 bp, Homo sapiens
gcacaggctctcttggggacac

SEQ ID NO: 8045024 - DNA, 22 bp, Homo sapiens
gcacactgcggtgatgtgagtc

SEQ ID NO: 8045025 - DNA, 22 bp, Homo sapiens
gcacaggctccggaggagagct

SEQ ID NO: 8045026 - DNA, 22 bp, Homo sapiens
gcagacttataatctgtcccag

SEQ ID NO: 8045027 - DNA, 22 bp, Homo sapiens
gcagacctgaccttgggcagca

SEQ ID NO: 8045028 - DNA, 22 bp, Homo sapiens
gcagactgcgagcgtgctggtg

SEQ ID NO: 8045029 - DNA, 22 bp, Homo sapiens
gcagactgtatcaatgtcagta

SEQ ID NO: 8045030 - DNA, 22 bp, Homo sapiens
gcagactgtacctggaagaggg

SEQ ID NO: 8045031 - DNA, 22 bp, Homo sapiens
gcacatacccactgtcaagcac

SEQ ID NO: 8045032 - DNA, 22 bp, Homo sapiens
gcacatactgcaaagattacta

SEQ ID NO: 8045033 - DNA, 19 bp, Homo sapiens
gcagacaggtccagagagg

SEQ ID NO: 8045034 - DNA, 22 bp, Homo sapiens
gcacataactgaccacatctaa

SEQ ID NO: 8045035 - DNA, 22 bp, Homo sapiens
gcacataaagggcatgggaggt

SEQ ID NO: 8045036 - DNA, 22 bp, Homo sapiens
gcagaggcatttctgacgctgc

SEQ ID NO: 8045037 - DNA, 22 bp, Homo sapiens
gcagagggtcctgtgccagcag

SEQ ID NO: 8045038 - DNA, 20 bp, Homo sapiens
gcagagtgtgagagggtgaa

SEQ ID NO: 8045039 - DNA, 22 bp, Homo sapiens
gcagcccaggaggcgggagccc

SEQ ID NO: 8045040 - DNA, 22 bp, Homo sapiens
gcagcccaggagcaggcgaccc

SEQ ID NO: 8045041 - DNA, 22 bp, Homo sapiens
gcagcccaggtggagtaatcta

SEQ ID NO: 8045042 - DNA, 22 bp, Homo sapiens
gcagcccaggtgtagctctttg

SEQ ID NO: 8045043 - DNA, 22 bp, Homo sapiens
gcagcccaggctcgctcactgc

SEQ ID NO: 8045044 - DNA, 22 bp, Homo sapiens
gcagcccaggtctctctcactc

SEQ ID NO: 8045045 - DNA, 22 bp, Homo sapiens
gcagcccaggaccctggacaga

SEQ ID NO: 8045046 - DNA, 22 bp, Homo sapiens
gcagcccagcagggcccggagc

SEQ ID NO: 8045047 - DNA, 22 bp, Homo sapiens
gcagcccagagcgcaggacccc

SEQ ID NO: 8045048 - DNA, 22 bp, Homo sapiens
gcagcccataacatttgaggcc

SEQ ID NO: 8045049 - DNA, 22 bp, Homo sapiens
gcagatggcagcccaggctggg

SEQ ID NO: 8045050 - DNA, 22 bp, Homo sapiens
gcagatggatcacctgaggtcg

SEQ ID NO: 8045051 - DNA, 22 bp, Homo sapiens
gcagatggctgagcctgcagat

SEQ ID NO: 8045052 - DNA, 22 bp, Homo sapiens
gcagatggctcagacactgggg

SEQ ID NO: 8045053 - DNA, 21 bp, Homo sapiens
gcagatgggagtcatcaggct

SEQ ID NO: 8045054 - DNA, 22 bp, Homo sapiens
gcagatgggagccccaggggag

SEQ ID NO: 8045055 - DNA, 22 bp, Homo sapiens
gcagctttctgggacagaaagg

SEQ ID NO: 8045056 - DNA, 19 bp, Homo sapiens
gcagctgtgggaagagcca

SEQ ID NO: 8045057 - DNA, 22 bp, Homo sapiens
gcagctgtcatttacaacaggg

SEQ ID NO: 8045058 - DNA, 22 bp, Homo sapiens
gcagctgtcggaaagctaagtg

SEQ ID NO: 8045059 - DNA, 22 bp, Homo sapiens
gcagcccttcaggtgaggggca

SEQ ID NO: 8045060 - DNA, 22 bp, Homo sapiens
gcagccctttctgggcagggga

SEQ ID NO: 8045061 - DNA, 22 bp, Homo sapiens
gcagcctcaaactccccagctc

SEQ ID NO: 8045062 - DNA, 22 bp, Homo sapiens
gcaggaagaggctcgaagcccc

SEQ ID NO: 8045063 - DNA, 22 bp, Homo sapiens
gcagctttgtggagaggcccat

SEQ ID NO: 8045064 - DNA, 22 bp, Homo sapiens
gcagctttgtcacggagtgtcg

SEQ ID NO: 8045065 - DNA, 22 bp, Homo sapiens
gcaggaagccttaccaagccca

SEQ ID NO: 8045066 - DNA, 22 bp, Homo sapiens
gcaggaagccttaccaagccca

SEQ ID NO: 8045067 - DNA, 22 bp, Homo sapiens
gcaggacacagatgcaaggcca

SEQ ID NO: 8045068 - DNA, 23 bp, Homo sapiens
gcaggacaacagagtgggaaggc

SEQ ID NO: 8045069 - DNA, 22 bp, Homo sapiens
gcaggacaaaatttccagggtg

SEQ ID NO: 8045070 - DNA, 23 bp, Homo sapiens
gcaggacaacagagtgggaaggc

SEQ ID NO: 8045071 - DNA, 22 bp, Homo sapiens
gcagggaccaaaagaggcagta

SEQ ID NO: 8045072 - DNA, 22 bp, Homo sapiens
gcagggacaaggcaggtgttct

SEQ ID NO: 8045073 - DNA, 22 bp, Homo sapiens
gcagggctgaaggtcccaggcc

SEQ ID NO: 8045074 - DNA, 22 bp, Homo sapiens
gcagggacctgccactgctgtc

SEQ ID NO: 8045075 - DNA, 21 bp, Homo sapiens
gcagggaccgcgacttctggg

SEQ ID NO: 8045076 - DNA, 22 bp, Homo sapiens
gcagggctggggctgctcctga

SEQ ID NO: 8045077 - DNA, 22 bp, Homo sapiens
gcagggctgggtcctgtctcat

SEQ ID NO: 8045078 - DNA, 22 bp, Homo sapiens
gcagggctgggtgggagacaga

SEQ ID NO: 8045079 - DNA, 22 bp, Homo sapiens
gcagggctgtaatttgagcctg

SEQ ID NO: 8045080 - DNA, 22 bp, Homo sapiens
gcagggcttgcagcagctagac

SEQ ID NO: 8045081 - DNA, 22 bp, Homo sapiens
gcagggcttagaaatggtggct

SEQ ID NO: 8045082 - DNA, 22 bp, Homo sapiens
gcagggctgttcaggagggtgg

SEQ ID NO: 8045083 - DNA, 22 bp, Homo sapiens
gcaggacacagatgcaaggcca

SEQ ID NO: 8045084 - DNA, 22 bp, Homo sapiens
gcaggcagatcacctgtcagga

SEQ ID NO: 8045085 - DNA, 22 bp, Homo sapiens
gcaggcagagtcaatttgatcc

SEQ ID NO: 8045086 - DNA, 22 bp, Homo sapiens
gcaggcagccacgattcccttg

SEQ ID NO: 8045087 - DNA, 19 bp, Homo sapiens
gcaggcagctggggtatcc

SEQ ID NO: 8045088 - DNA, 22 bp, Homo sapiens
gcaggcagatcacctgtcagga

SEQ ID NO: 8045089 - DNA, 22 bp, Homo sapiens
gcaggcagttgcagttttctag

SEQ ID NO: 8045090 - DNA, 19 bp, Homo sapiens
gcaggcagtggcattcgga

SEQ ID NO: 8045091 - DNA, 22 bp, Homo sapiens
gcagggacaactgtgcacctga

SEQ ID NO: 8045092 - DNA, 22 bp, Homo sapiens
gcagtggcagctgagggggtat

SEQ ID NO: 8045093 - DNA, 22 bp, Homo sapiens
gcagtggcagagacagcaccaa

SEQ ID NO: 8045094 - DNA, 22 bp, Homo sapiens
gcagtggcatgatgtgggctca

SEQ ID NO: 8045095 - DNA, 22 bp, Homo sapiens
gcagtggcatgatgtgggctca

SEQ ID NO: 8045096 - DNA, 22 bp, Homo sapiens
gcagtggcaccgctggctctgg

SEQ ID NO: 8045097 - DNA, 22 bp, Homo sapiens
gcagtggcaccgctggctctgg

SEQ ID NO: 8045098 - DNA, 22 bp, Homo sapiens
gcagtggatggccagcaggggc

SEQ ID NO: 8045099 - DNA, 22 bp, Homo sapiens
gcaggggagtggatgatggatt

SEQ ID NO: 8045100 - DNA, 22 bp, Homo sapiens
gcaggggagtccactctatgca

SEQ ID NO: 8045101 - DNA, 22 bp, Homo sapiens
gcagtggctaggagtctggcgt

SEQ ID NO: 8045102 - DNA, 22 bp, Homo sapiens
gcagtgggaaggttggcacatg

SEQ ID NO: 8045103 - DNA, 22 bp, Homo sapiens
gcagtgggagcttaggcagtgc

SEQ ID NO: 8045104 - DNA, 22 bp, Homo sapiens
gcagtggcccagcttgcaggct

SEQ ID NO: 8045105 - DNA, 22 bp, Homo sapiens
gcagtggctaggagtctggcgt

SEQ ID NO: 8045106 - DNA, 22 bp, Homo sapiens
gcagtggctaagctcgcatgca

SEQ ID NO: 8045107 - DNA, 22 bp, Homo sapiens
gcagtggccacatggaggagga

SEQ ID NO: 8045108 - DNA, 22 bp, Homo sapiens
gcagtggcccagcttgcaggct

SEQ ID NO: 8045109 - DNA, 22 bp, Homo sapiens
gcatgcaggaagggcttgggga

SEQ ID NO: 8045110 - DNA, 22 bp, Homo sapiens
gcatgctgcaccagagcctctc

SEQ ID NO: 8045111 - DNA, 22 bp, Homo sapiens
gcatgctgcccagggactctct

SEQ ID NO: 8045112 - DNA, 22 bp, Homo sapiens
gcatggctggtgtcctgaggga

SEQ ID NO: 8045113 - DNA, 22 bp, Homo sapiens
gcatggctgctccctggctgca

SEQ ID NO: 8045114 - DNA, 22 bp, Homo sapiens
gcatggctctggcctcagtgtg

SEQ ID NO: 8045115 - DNA, 22 bp, Homo sapiens
gcatggcttacagaggctgcag

SEQ ID NO: 8045116 - DNA, 22 bp, Homo sapiens
gcatggcttccaaaagtgctaa

SEQ ID NO: 8045117 - DNA, 22 bp, Homo sapiens
gcatggctgttgaagtcagctc

SEQ ID NO: 8045118 - DNA, 22 bp, Homo sapiens
gcatggctgtgagcaccctgcc

SEQ ID NO: 8045119 - DNA, 20 bp, Homo sapiens
gcatggctaatctgtactga

SEQ ID NO: 8045120 - DNA, 22 bp, Homo sapiens
gcatggctattatgaggcagaa

SEQ ID NO: 8045121 - DNA, 22 bp, Homo sapiens
gccaccaggagcccagtccaaa

SEQ ID NO: 8045122 - DNA, 22 bp, Homo sapiens
gccacatgtcatgtgctcagta

SEQ ID NO: 8045123 - DNA, 19 bp, Homo sapiens
gccacatcttttccagagt

SEQ ID NO: 8045124 - DNA, 22 bp, Homo sapiens
gccacatagaggaggatattaa

SEQ ID NO: 8045125 - DNA, 22 bp, Homo sapiens
gcatggcttcggggtgctgcct

SEQ ID NO: 8045126 - DNA, 22 bp, Homo sapiens
gccagctgaagccctggtggaa

SEQ ID NO: 8045127 - DNA, 22 bp, Homo sapiens
gccagctcagtgccaggcccct

SEQ ID NO: 8045128 - DNA, 22 bp, Homo sapiens
gccagctcagatgcaggaagga

SEQ ID NO: 8045129 - DNA, 22 bp, Homo sapiens
gccagctcccaagtgagcccct

SEQ ID NO: 8045130 - DNA, 23 bp, Homo sapiens
gccagccttgctctcctgcagcc

SEQ ID NO: 8045131 - DNA, 20 bp, Homo sapiens
gccagccctgacacaggagc

SEQ ID NO: 8045132 - DNA, 18 bp, Homo sapiens
gccagccctccaacctcc

SEQ ID NO: 8045133 - DNA, 22 bp, Homo sapiens
gccagggctgtgcaggtttgtt

SEQ ID NO: 8045134 - DNA, 21 bp, Homo sapiens
gccagggagttaaagagtctt

SEQ ID NO: 8045135 - DNA, 22 bp, Homo sapiens
gccagggagtctgggccacaga

SEQ ID NO: 8045136 - DNA, 22 bp, Homo sapiens
gccagggagtctgggccacaga

SEQ ID NO: 8045137 - DNA, 22 bp, Homo sapiens
gccagggcaggggagcatctgc

SEQ ID NO: 8045138 - DNA, 22 bp, Homo sapiens
gccagggaggctgtagggtcct

SEQ ID NO: 8045139 - DNA, 17 bp, Homo sapiens
gccagggagaggaagcc

SEQ ID NO: 8045140 - DNA, 21 bp, Homo sapiens
gccagggaagagagttggctg

SEQ ID NO: 8045141 - DNA, 22 bp, Homo sapiens
gccagggaacccaagggcctca

SEQ ID NO: 8045142 - DNA, 18 bp, Homo sapiens
gccaggcagggtggggaa

SEQ ID NO: 8045143 - DNA, 22 bp, Homo sapiens
gccaggcaggtgtcggagccct

SEQ ID NO: 8045144 - DNA, 22 bp, Homo sapiens
gccaggcaggtgtcggagccct

SEQ ID NO: 8045145 - DNA, 22 bp, Homo sapiens
gccaggcagctgggagggtgcc

SEQ ID NO: 8045146 - DNA, 22 bp, Homo sapiens
gccaggcagctagcaacccctg

SEQ ID NO: 8045147 - DNA, 22 bp, Homo sapiens
gccaggcagcagcgaggatggt

SEQ ID NO: 8045148 - DNA, 22 bp, Homo sapiens
gccctggccttcatctcagaca

SEQ ID NO: 8045149 - DNA, 22 bp, Homo sapiens
gccctgggattgggtggaggct

SEQ ID NO: 8045150 - DNA, 22 bp, Homo sapiens
gccctggatgtacaggcatgtt

SEQ ID NO: 8045151 - DNA, 22 bp, Homo sapiens
gccctggatggcaggagccatc

SEQ ID NO: 8045152 - DNA, 22 bp, Homo sapiens
gccctgggctccctgctccaca

SEQ ID NO: 8045153 - DNA, 22 bp, Homo sapiens
gccccagcagcaatgcggttga

SEQ ID NO: 8045154 - DNA, 17 bp, Homo sapiens
gccctggagccaggcta

SEQ ID NO: 8045155 - DNA, 22 bp, Homo sapiens
gccctggagggccagcgactgg

SEQ ID NO: 8045156 - DNA, 22 bp, Homo sapiens
gcctcctcttgagggtcaggga

SEQ ID NO: 8045157 - DNA, 22 bp, Homo sapiens
gcctcctcacaatgtacccacg

SEQ ID NO: 8045158 - DNA, 22 bp, Homo sapiens
gcctctggcttctgcatcagtg

SEQ ID NO: 8045159 - DNA, 22 bp, Homo sapiens
gcctcctggttgcttctccaac

SEQ ID NO: 8045160 - DNA, 22 bp, Homo sapiens
gcctctggagtcgcagcgtctt

SEQ ID NO: 8045161 - DNA, 22 bp, Homo sapiens
gcctcctgcccagatgagtgat

SEQ ID NO: 8045162 - DNA, 22 bp, Homo sapiens
gccccacagcctgcggtctcag

SEQ ID NO: 8045163 - DNA, 22 bp, Homo sapiens
gcccatgtgatttcctgggagt

SEQ ID NO: 8045164 - DNA, 22 bp, Homo sapiens
gcccatggcagaactgtgagca

SEQ ID NO: 8045165 - DNA, 17 bp, Homo sapiens
gcccaggaaggacggcc

SEQ ID NO: 8045166 - DNA, 22 bp, Homo sapiens
gcccaggaagttgaggctgccg

SEQ ID NO: 8045167 - DNA, 22 bp, Homo sapiens
gcccagctttttgaggcaggca

SEQ ID NO: 8045168 - DNA, 22 bp, Homo sapiens
gcccagctgtctggcagggatg

SEQ ID NO: 8045169 - DNA, 22 bp, Homo sapiens
gcccagctggcttccagcacat

SEQ ID NO: 8045170 - DNA, 22 bp, Homo sapiens
gcccagcttttcacttccacac

SEQ ID NO: 8045171 - DNA, 22 bp, Homo sapiens
gcccagctgtctggcagggatg

SEQ ID NO: 8045172 - DNA, 22 bp, Homo sapiens
gcccagctttttgaggcaggca

SEQ ID NO: 8045173 - DNA, 22 bp, Homo sapiens
gcccagctccattcttggtgag

SEQ ID NO: 8045174 - DNA, 22 bp, Homo sapiens
gcccagcctccaagctccaagg

SEQ ID NO: 8045175 - DNA, 22 bp, Homo sapiens
gcccagcctccaagctccaagg

SEQ ID NO: 8045176 - DNA, 22 bp, Homo sapiens
gcccagccctgaggtcacagct

SEQ ID NO: 8045177 - DNA, 22 bp, Homo sapiens
gcccagctcctctgcagaccct

SEQ ID NO: 8045178 - DNA, 22 bp, Homo sapiens
gcccagctgagaagcgcggggc

SEQ ID NO: 8045179 - DNA, 22 bp, Homo sapiens
gcccagctggcttccagcacat

SEQ ID NO: 8045180 - DNA, 22 bp, Homo sapiens
gcccagcagatctcagtgtctc

SEQ ID NO: 8045181 - DNA, 22 bp, Homo sapiens
gcccagccctgaggtcacagct

SEQ ID NO: 8045182 - DNA, 22 bp, Homo sapiens
gcccagcactcctctctgacat

SEQ ID NO: 8045183 - DNA, 22 bp, Homo sapiens
gccaggggacgcggagcgacga

SEQ ID NO: 8045184 - DNA, 22 bp, Homo sapiens
gccagggtgtgcagggacagga

SEQ ID NO: 8045185 - DNA, 22 bp, Homo sapiens
gcccagcacatctggccttgaa

SEQ ID NO: 8045186 - DNA, 22 bp, Homo sapiens
gcccagcacattgctgaggacc

SEQ ID NO: 8045187 - DNA, 22 bp, Homo sapiens
ggctctggcaaggggaggctac

SEQ ID NO: 8045188 - DNA, 22 bp, Homo sapiens
ggctctggagcacagacgtctg

SEQ ID NO: 8045189 - DNA, 22 bp, Homo sapiens
ggctctggagatgtccgacctg

SEQ ID NO: 8045190 - DNA, 22 bp, Homo sapiens
ggctctggcgtccaatggagcg

SEQ ID NO: 8045191 - DNA, 19 bp, Homo sapiens
ggctctggcggctgtagcc

SEQ ID NO: 8045192 - DNA, 22 bp, Homo sapiens
ggctctgggcatagaaggaagc

SEQ ID NO: 8045193 - DNA, 22 bp, Homo sapiens
ggctctgggccagagttggctt

SEQ ID NO: 8045194 - DNA, 22 bp, Homo sapiens
ggctctggctcctggctttgtg

SEQ ID NO: 8045195 - DNA, 22 bp, Homo sapiens
ggctccagaaacttcagtccat

SEQ ID NO: 8045196 - DNA, 22 bp, Homo sapiens
ggcgggcagcgtcttgctggcc

SEQ ID NO: 8045197 - DNA, 22 bp, Homo sapiens
ggcggggcctcgcgaacggcct

SEQ ID NO: 8045198 - DNA, 22 bp, Homo sapiens
ggctccaggagatgctgggcag

SEQ ID NO: 8045199 - DNA, 23 bp, Homo sapiens
ggctccaggcctgacgggcgcgg

SEQ ID NO: 8045200 - DNA, 22 bp, Homo sapiens
ggctccaggagggccttggcca

SEQ ID NO: 8045201 - DNA, 22 bp, Homo sapiens
ggctctggagacatgtggagag

SEQ ID NO: 8045202 - DNA, 22 bp, Homo sapiens
ggctgagcactttaggcaggag

SEQ ID NO: 8045203 - DNA, 22 bp, Homo sapiens
ggctgctgacaaacatgatcat

SEQ ID NO: 8045204 - DNA, 22 bp, Homo sapiens
ggctgctgacttcatccagctt

SEQ ID NO: 8045205 - DNA, 22 bp, Homo sapiens
ggctgctgaagtgtggcaatct

SEQ ID NO: 8045206 - DNA, 22 bp, Homo sapiens
ggctgctgccctcctaagtgca

SEQ ID NO: 8045207 - DNA, 22 bp, Homo sapiens
ggctgctgctgtgtaggcctgt

SEQ ID NO: 8045208 - DNA, 22 bp, Homo sapiens
ggctgctggaagactgaacaag

SEQ ID NO: 8045209 - DNA, 22 bp, Homo sapiens
ggctgctgctgtgtaggcctgt

SEQ ID NO: 8045210 - DNA, 22 bp, Homo sapiens
ggctgctgagttggccaggaga

SEQ ID NO: 8045211 - DNA, 22 bp, Homo sapiens
ggctgctgggaatatgccagct

SEQ ID NO: 8045212 - DNA, 22 bp, Homo sapiens
ggctgctgggaatatgccagct

SEQ ID NO: 8045213 - DNA, 22 bp, Homo sapiens
ggctgctggcattgaggtaggt

SEQ ID NO: 8045214 - DNA, 22 bp, Homo sapiens
ggctgctggcattgaggtaggt

SEQ ID NO: 8045215 - DNA, 22 bp, Homo sapiens
ggctgctggcattgaggtaggt

SEQ ID NO: 8045216 - DNA, 22 bp, Homo sapiens
ggctggcttggtgagctgtcac

SEQ ID NO: 8045217 - DNA, 21 bp, Homo sapiens
ggctgctgggagagctgcgtg

SEQ ID NO: 8045218 - DNA, 22 bp, Homo sapiens
ggctggcttgcggagtcacaga

SEQ ID NO: 8045219 - DNA, 22 bp, Homo sapiens
ggctgggaggccgtgctgacct

SEQ ID NO: 8045220 - DNA, 22 bp, Homo sapiens
ggctgggcaaacaagactcttc

SEQ ID NO: 8045221 - DNA, 22 bp, Homo sapiens
ggctgggctgctgggtcagagc

SEQ ID NO: 8045222 - DNA, 22 bp, Homo sapiens
ggctgggctgcggctgtacctg

SEQ ID NO: 8045223 - DNA, 22 bp, Homo sapiens
ggctgggctgcggctgtacctg

SEQ ID NO: 8045224 - DNA, 22 bp, Homo sapiens
ggctgggccagggcctgtggac

SEQ ID NO: 8045225 - DNA, 22 bp, Homo sapiens
ggctgggcaggtctgcacaggg

SEQ ID NO: 8045226 - DNA, 21 bp, Homo sapiens
ggctgggcaggacccacccct

SEQ ID NO: 8045227 - DNA, 22 bp, Homo sapiens
ggctgggcaggtctgcacaggg

SEQ ID NO: 8045228 - DNA, 22 bp, Homo sapiens
ggctgggccgcggctacccaga

SEQ ID NO: 8045229 - DNA, 22 bp, Homo sapiens
ggctgggctccgggagcatgcg

SEQ ID NO: 8045230 - DNA, 22 bp, Homo sapiens
ggctgggcctctccctcagctg

SEQ ID NO: 8045231 - DNA, 22 bp, Homo sapiens
ggctgggctccgggagcatgcg

SEQ ID NO: 8045232 - DNA, 22 bp, Homo sapiens
ggcttgggagcaggcatgtgac

SEQ ID NO: 8045233 - DNA, 22 bp, Homo sapiens
ggcttggcttgggctcagaggc

SEQ ID NO: 8045234 - DNA, 22 bp, Homo sapiens
ggcttgggagcaggcatgtgac

SEQ ID NO: 8045235 - DNA, 22 bp, Homo sapiens
ggcttcttagaatttgacttac

SEQ ID NO: 8045236 - DNA, 22 bp, Homo sapiens
ggctttatagggtagaggatca

SEQ ID NO: 8045237 - DNA, 22 bp, Homo sapiens
gggacaggcccctcgctagctt

SEQ ID NO: 8045238 - DNA, 22 bp, Homo sapiens
gggacaggctgagacttgagct

SEQ ID NO: 8045239 - DNA, 22 bp, Homo sapiens
gggacatgcccctcagtgggtg

SEQ ID NO: 8045240 - DNA, 22 bp, Homo sapiens
gggacatgaggccatagtgatt

SEQ ID NO: 8045241 - DNA, 22 bp, Homo sapiens
gggacatgaagcatcggaggca

SEQ ID NO: 8045242 - DNA, 22 bp, Homo sapiens
gggacatgaagcatcggaggca

SEQ ID NO: 8045243 - DNA, 23 bp, Homo sapiens
gggaccagctagggctgtgacct

SEQ ID NO: 8045244 - DNA, 22 bp, Homo sapiens
gggaccagaggctgtgcacaat

SEQ ID NO: 8045245 - DNA, 22 bp, Homo sapiens
gggacatggaggcgcgcaggca

SEQ ID NO: 8045246 - DNA, 22 bp, Homo sapiens
gggacatggaggcgcgcaggca

SEQ ID NO: 8045247 - DNA, 22 bp, Homo sapiens
gggacatgcccctcagtgggtg

SEQ ID NO: 8045248 - DNA, 22 bp, Homo sapiens
gggacatggctaggattccaat

SEQ ID NO: 8045249 - DNA, 22 bp, Homo sapiens
gggagagaattattgccagacc

SEQ ID NO: 8045250 - DNA, 22 bp, Homo sapiens
gggagagcgggaggtgccacag

SEQ ID NO: 8045251 - DNA, 22 bp, Homo sapiens
gggagaggttacccgagcaact

SEQ ID NO: 8045252 - DNA, 18 bp, Homo sapiens
gggagctgggaagctggt

SEQ ID NO: 8045253 - DNA, 19 bp, Homo sapiens
gggagctgtctgcccgtgg

SEQ ID NO: 8045254 - DNA, 22 bp, Homo sapiens
gggagctgggctggttttgctg

SEQ ID NO: 8045255 - DNA, 22 bp, Homo sapiens
gggagctggttcctgccctcca

SEQ ID NO: 8045256 - DNA, 22 bp, Homo sapiens
gggagctgtaagggacaggtag

SEQ ID NO: 8045257 - DNA, 22 bp, Homo sapiens
gggcacaggaatttgggatgtg

SEQ ID NO: 8045258 - DNA, 22 bp, Homo sapiens
gggcacaggaatttgggatgtg

SEQ ID NO: 8045259 - DNA, 22 bp, Homo sapiens
gggcacaggagaaggatctggc

SEQ ID NO: 8045260 - DNA, 22 bp, Homo sapiens
gggcagctgcagggatggtgac

SEQ ID NO: 8045261 - DNA, 18 bp, Homo sapiens
gggcatggatgcagcatc

SEQ ID NO: 8045262 - DNA, 23 bp, Homo sapiens
gggcatggagtgtaggtggaagg

SEQ ID NO: 8045263 - DNA, 22 bp, Homo sapiens
gggcatgcctgcgcagtgcatg

SEQ ID NO: 8045264 - DNA, 22 bp, Homo sapiens
gggcaggctgagcatgtcacct

SEQ ID NO: 8045265 - DNA, 22 bp, Homo sapiens
gggcaggagagggccacctgga

SEQ ID NO: 8045266 - DNA, 22 bp, Homo sapiens
gggcaggagaaggtggatgtcc

SEQ ID NO: 8045267 - DNA, 16 bp, Homo sapiens
gggcaggaatcagggt

SEQ ID NO: 8045268 - DNA, 22 bp, Homo sapiens
gggatggggggaagcgtccatg

SEQ ID NO: 8045269 - DNA, 22 bp, Homo sapiens
gggatggggtcaacatgtacct

SEQ ID NO: 8045270 - DNA, 22 bp, Homo sapiens
gggatggggagctggaaagggg

SEQ ID NO: 8045271 - DNA, 22 bp, Homo sapiens
gggaggagctgagtgtgtgtgc

SEQ ID NO: 8045272 - DNA, 22 bp, Homo sapiens
gggcaagcacagcgagcgtgcg

SEQ ID NO: 8045273 - DNA, 22 bp, Homo sapiens
gggcacagcccagtggggtccc

SEQ ID NO: 8045274 - DNA, 22 bp, Homo sapiens
gggcaaagtggtggaggcagtt

SEQ ID NO: 8045275 - DNA, 22 bp, Homo sapiens
gggcacagcctaactatggaga

SEQ ID NO: 8045276 - DNA, 22 bp, Homo sapiens
gggcacagcctaactatggaga

SEQ ID NO: 8045277 - DNA, 22 bp, Homo sapiens
gggcacagctgctacccagtgc

SEQ ID NO: 8045278 - DNA, 22 bp, Homo sapiens
gggatggggtcgggaccctgct

SEQ ID NO: 8045279 - DNA, 22 bp, Homo sapiens
ggcagaggtagctggaaccagg

SEQ ID NO: 8045280 - DNA, 22 bp, Homo sapiens
ggcagaggtagctggaaccagg

SEQ ID NO: 8045281 - DNA, 22 bp, Homo sapiens
ggcaggaggtgagtggcgggtg

SEQ ID NO: 8045282 - DNA, 22 bp, Homo sapiens
ggcaggaggtgagtggcgggtg

SEQ ID NO: 8045283 - DNA, 22 bp, Homo sapiens
ggcaggaggtgagtggcgggtg

SEQ ID NO: 8045284 - DNA, 22 bp, Homo sapiens
ggcaggcacatttgggggccgt

SEQ ID NO: 8045285 - DNA, 22 bp, Homo sapiens
ggcaggcactgtgctaggcgct

SEQ ID NO: 8045286 - DNA, 22 bp, Homo sapiens
ggcaggcaatgaggatgggaag

SEQ ID NO: 8045287 - DNA, 22 bp, Homo sapiens
ggcaggcaatgaggatgggaag

SEQ ID NO: 8045288 - DNA, 22 bp, Homo sapiens
ggcaggcaagtctgctctgtga

SEQ ID NO: 8045289 - DNA, 21 bp, Homo sapiens
ggcaggatggcagtggacccc

SEQ ID NO: 8045290 - DNA, 21 bp, Homo sapiens
ggcaggatggcagtggacccc

SEQ ID NO: 8045291 - DNA, 22 bp, Homo sapiens
ggcaggcaaggcagcctggtga

SEQ ID NO: 8045292 - DNA, 22 bp, Homo sapiens
ggcaccaggctgggcataggcc

SEQ ID NO: 8045293 - DNA, 22 bp, Homo sapiens
ggcagaggaagctggaagtggg

SEQ ID NO: 8045294 - DNA, 22 bp, Homo sapiens
ggcaccaggacatgactcccag

SEQ ID NO: 8045295 - DNA, 20 bp, Homo sapiens
ggcagagggcctgggagaag

SEQ ID NO: 8045296 - DNA, 20 bp, Homo sapiens
ggcagagggcctgggagaag

SEQ ID NO: 8045297 - DNA, 22 bp, Homo sapiens
ggcacaggagctagtcaaagcc

SEQ ID NO: 8045298 - DNA, 17 bp, Homo sapiens
ggcaccagacggagagt

SEQ ID NO: 8045299 - DNA, 22 bp, Homo sapiens
ggcacagctgatgcagacacac

SEQ ID NO: 8045300 - DNA, 22 bp, Homo sapiens
ggcacagctacttgctcactct

SEQ ID NO: 8045301 - DNA, 22 bp, Homo sapiens
ggcacagctacttgctcactct

SEQ ID NO: 8045302 - DNA, 22 bp, Homo sapiens
ggcacagctcaggtcccagctc

SEQ ID NO: 8045303 - DNA, 22 bp, Homo sapiens
ggcacagcgactaccatcgaaa

SEQ ID NO: 8045304 - DNA, 22 bp, Homo sapiens
ggcacagccctctctgtggaca

SEQ ID NO: 8045305 - DNA, 22 bp, Homo sapiens
ggcacagccactttggagaact

SEQ ID NO: 8045306 - DNA, 22 bp, Homo sapiens
ggcaactcttcttgcaatgggg

SEQ ID NO: 8045307 - DNA, 22 bp, Homo sapiens
ggcaagaggtccaagaggtctc

SEQ ID NO: 8045308 - DNA, 22 bp, Homo sapiens
ggcacagcaggagctatgtgaa

SEQ ID NO: 8045309 - DNA, 20 bp, Homo sapiens
ggcaagcaactgagggagga

SEQ ID NO: 8045310 - DNA, 22 bp, Homo sapiens
ggcaagagttgaagctccagga

SEQ ID NO: 8045311 - DNA, 22 bp, Homo sapiens
ggcaagatccaaggggctagga

SEQ ID NO: 8045312 - DNA, 22 bp, Homo sapiens
ggagccagaggctgctgctgtg

SEQ ID NO: 8045313 - DNA, 22 bp, Homo sapiens
ggagccagagcactggggagcc

SEQ ID NO: 8045314 - DNA, 23 bp, Homo sapiens
ggagccagcctgtggggagcggg

SEQ ID NO: 8045315 - DNA, 22 bp, Homo sapiens
ggagccagcagggtgacactga

SEQ ID NO: 8045316 - DNA, 23 bp, Homo sapiens
ggagccagcctgtggggagcggg

SEQ ID NO: 8045317 - DNA, 17 bp, Homo sapiens
ggagccaggagcccacc

SEQ ID NO: 8045318 - DNA, 17 bp, Homo sapiens
ggagccaggagcccacc

SEQ ID NO: 8045319 - DNA, 22 bp, Homo sapiens
ggcctcagagaaggctgtgcgg

SEQ ID NO: 8045320 - DNA, 19 bp, Homo sapiens
ggccatggcgggggtcaca

SEQ ID NO: 8045321 - DNA, 19 bp, Homo sapiens
ggccatggcgggggtcaca

SEQ ID NO: 8045322 - DNA, 22 bp, Homo sapiens
ggccatgctcgtggctggactg

SEQ ID NO: 8045323 - DNA, 23 bp, Homo sapiens
ggccatggagacttagaatgggc

SEQ ID NO: 8045324 - DNA, 23 bp, Homo sapiens
ggccatggagacttagaatgggc

SEQ ID NO: 8045325 - DNA, 22 bp, Homo sapiens
ggcctcagaggaggtgtgagtc

SEQ ID NO: 8045326 - DNA, 21 bp, Homo sapiens
ggcctcagccacctggctctg

SEQ ID NO: 8045327 - DNA, 18 bp, Homo sapiens
ggcctcagcctggccgga

SEQ ID NO: 8045328 - DNA, 22 bp, Homo sapiens
ggcctcagggtcactctgtaga

SEQ ID NO: 8045329 - DNA, 22 bp, Homo sapiens
ggcctcagggttgggcccatta

SEQ ID NO: 8045330 - DNA, 22 bp, Homo sapiens
ggcctctggttcgtggtgacct

SEQ ID NO: 8045331 - DNA, 22 bp, Homo sapiens
ggcctcagtgggccgctgcagg

SEQ ID NO: 8045332 - DNA, 22 bp, Homo sapiens
ggcctcagtttcttcaactgta

SEQ ID NO: 8045333 - DNA, 22 bp, Homo sapiens
ggcctcagtttctccatgggtt

SEQ ID NO: 8045334 - DNA, 22 bp, Homo sapiens
ggccttggtggctttgctgatg

SEQ ID NO: 8045335 - DNA, 22 bp, Homo sapiens
ggccttggtgccatggccagtt

SEQ ID NO: 8045336 - DNA, 22 bp, Homo sapiens
ggccttggtaaagggatgcatg

SEQ ID NO: 8045337 - DNA, 22 bp, Homo sapiens
ggcgctggtggtcttgcgagcg

SEQ ID NO: 8045338 - DNA, 22 bp, Homo sapiens
ggcgctggtggtcttgcgagcg

SEQ ID NO: 8045339 - DNA, 22 bp, Homo sapiens
ggcgctggccacggtggctctg

SEQ ID NO: 8045340 - DNA, 22 bp, Homo sapiens
ggcgctggccacggtggctctg

SEQ ID NO: 8045341 - DNA, 22 bp, Homo sapiens
ggcgaggccgggacaggctgga

SEQ ID NO: 8045342 - DNA, 22 bp, Homo sapiens
ggccttggttccaaagcaggca

SEQ ID NO: 8045343 - DNA, 22 bp, Homo sapiens
ggccttggttctgtcacagccg

SEQ ID NO: 8045344 - DNA, 19 bp, Homo sapiens
ggcctgcccaatgtctgct

SEQ ID NO: 8045345 - DNA, 22 bp, Homo sapiens
ggcctgcacagaggtggctcta

SEQ ID NO: 8045346 - DNA, 17 bp, Homo sapiens
ggcctgcacctcctgct

SEQ ID NO: 8045347 - DNA, 22 bp, Homo sapiens
ggcctgagtcacatcaggagag

SEQ ID NO: 8045348 - DNA, 22 bp, Homo sapiens
ggcctgagtcccacctggctgt

SEQ ID NO: 8045349 - DNA, 22 bp, Homo sapiens
ggcctgagaatgtaccagatct

SEQ ID NO: 8045350 - DNA, 22 bp, Homo sapiens
ggcctgagggtgggctctcagt

SEQ ID NO: 8045351 - DNA, 21 bp, Homo sapiens
ggcctgagtataggacaggcc

SEQ ID NO: 8045352 - DNA, 22 bp, Homo sapiens
ggcctgagaaccatggggccaa

SEQ ID NO: 8045353 - DNA, 22 bp, Homo sapiens
ggccacagaacagctacaggac

SEQ ID NO: 8045354 - DNA, 19 bp, Homo sapiens
ggccaggctgactgtggtc

SEQ ID NO: 8045355 - DNA, 19 bp, Homo sapiens
ggccaggctgactgtggtc

SEQ ID NO: 8045356 - DNA, 22 bp, Homo sapiens
ggccaaggtggagaaggcactg

SEQ ID NO: 8045357 - DNA, 22 bp, Homo sapiens
ggccagggggcttcagactcca

SEQ ID NO: 8045358 - DNA, 22 bp, Homo sapiens
ggccaggtgcggtggctcacac

SEQ ID NO: 8045359 - DNA, 22 bp, Homo sapiens
ggccaggtggctgtcctggcgt

SEQ ID NO: 8045360 - DNA, 19 bp, Homo sapiens
ggccatctctgccccagca

SEQ ID NO: 8045361 - DNA, 20 bp, Homo sapiens
ggcatggcaaatgttcttgc

SEQ ID NO: 8045362 - DNA, 21 bp, Homo sapiens
ggcatggcacctctgggcagg

SEQ ID NO: 8045363 - DNA, 22 bp, Homo sapiens
ggcatggacgtctctgaggcca

SEQ ID NO: 8045364 - DNA, 22 bp, Homo sapiens
ggcagtgaatgaaacagaggct

SEQ ID NO: 8045365 - DNA, 22 bp, Homo sapiens
ggcatgggagtgagcaacctta

SEQ ID NO: 8045366 - DNA, 22 bp, Homo sapiens
ggcatgggccgaggtgcctcct

SEQ ID NO: 8045367 - DNA, 22 bp, Homo sapiens
ggcatggctgttggggatagag

SEQ ID NO: 8045368 - DNA, 22 bp, Homo sapiens
ggcatggctgttggggatagag

SEQ ID NO: 8045369 - DNA, 22 bp, Homo sapiens
ggcatggcctgtaagacggaga

SEQ ID NO: 8045370 - DNA, 22 bp, Homo sapiens
ggcatggctcggagtcagaaca

SEQ ID NO: 8045371 - DNA, 21 bp, Homo sapiens
ggcatggcacctctgggcagg

SEQ ID NO: 8045372 - DNA, 22 bp, Homo sapiens
ggcatggggtgtatgtggcacg

SEQ ID NO: 8045373 - DNA, 22 bp, Homo sapiens
ggcatggggtgtatgtggcacg

SEQ ID NO: 8045374 - DNA, 19 bp, Homo sapiens
ggcatggggtccggggacc

SEQ ID NO: 8045375 - DNA, 22 bp, Homo sapiens
ggcagtcagtttggagatggat

SEQ ID NO: 8045376 - DNA, 22 bp, Homo sapiens
ggcaggtgtgagatcgaggcca

SEQ ID NO: 8045377 - DNA, 22 bp, Homo sapiens
ggcaggtgggaaccctccccac

SEQ ID NO: 8045378 - DNA, 21 bp, Homo sapiens
ggcaggtgggtctctgttgct

SEQ ID NO: 8045379 - DNA, 22 bp, Homo sapiens
ggcaggtggtaaggatttcata

SEQ ID NO: 8045380 - DNA, 22 bp, Homo sapiens
ggcaggtggccaagtgtctaag

SEQ ID NO: 8045381 - DNA, 22 bp, Homo sapiens
ggcaggcagatggctgcaccaa

SEQ ID NO: 8045382 - DNA, 22 bp, Homo sapiens
ggcaggtggcactgctgctccc

SEQ ID NO: 8045383 - DNA, 22 bp, Homo sapiens
ggcaggtggcactgctgctccc

SEQ ID NO: 8045384 - DNA, 22 bp, Homo sapiens
ggcaggtggattttctactcta

SEQ ID NO: 8045385 - DNA, 22 bp, Homo sapiens
ggcaggtggacgtgctaaagct

SEQ ID NO: 8045386 - DNA, 15 bp, Homo sapiens
ggcaggtggatcact

SEQ ID NO: 8045387 - DNA, 22 bp, Homo sapiens
ggggctgatggaactcaggcct

SEQ ID NO: 8045388 - DNA, 20 bp, Homo sapiens
ggggctgcatgcagagaaga

SEQ ID NO: 8045389 - DNA, 22 bp, Homo sapiens
ggggctcagttcggacagcctg

SEQ ID NO: 8045390 - DNA, 22 bp, Homo sapiens
ggggcctccagcactaggcagc

SEQ ID NO: 8045391 - DNA, 22 bp, Homo sapiens
ggggccgaccgcggttcaggcc

SEQ ID NO: 8045392 - DNA, 22 bp, Homo sapiens
ggggccgaccgcggttcaggcc

SEQ ID NO: 8045393 - DNA, 22 bp, Homo sapiens
ggggtgtgagtagagctgggga

SEQ ID NO: 8045394 - DNA, 21 bp, Homo sapiens
ggggttggcaagagcagagac

SEQ ID NO: 8045395 - DNA, 22 bp, Homo sapiens
ggggtgggcgtgcagggacacc

SEQ ID NO: 8045396 - DNA, 22 bp, Homo sapiens
ggggtgggcgtgcagggacacc

SEQ ID NO: 8045397 - DNA, 22 bp, Homo sapiens
ggggtgggcgtgcagggacacc

SEQ ID NO: 8045398 - DNA, 22 bp, Homo sapiens
ggggtgggcgtgcagggacacc

SEQ ID NO: 8045399 - DNA, 22 bp, Homo sapiens
gggtagggtgacttaggctggc

SEQ ID NO: 8045400 - DNA, 22 bp, Homo sapiens
gggtaggctgctcctggggccc

SEQ ID NO: 8045401 - DNA, 22 bp, Homo sapiens
gggtagggtgacttaggctggc

SEQ ID NO: 8045402 - DNA, 22 bp, Homo sapiens
gggcatggccaggtgaggggtc

SEQ ID NO: 8045403 - DNA, 22 bp, Homo sapiens
gggcatggcgtgtgctggattc

SEQ ID NO: 8045404 - DNA, 18 bp, Homo sapiens
gggcatggatgcagcatc

SEQ ID NO: 8045405 - DNA, 22 bp, Homo sapiens
gggcatggccaggtgaggggtc

SEQ ID NO: 8045406 - DNA, 22 bp, Homo sapiens
gggcatggccaggtgaggggtc

SEQ ID NO: 8045407 - DNA, 22 bp, Homo sapiens
gggcatggccaggtgaggggtc

SEQ ID NO: 8045408 - DNA, 22 bp, Homo sapiens
gggccacacagggcagctccct

SEQ ID NO: 8045409 - DNA, 22 bp, Homo sapiens
gggccacacagggcagctccct

SEQ ID NO: 8045410 - DNA, 22 bp, Homo sapiens
gggcatggtggtgcacacctgt

SEQ ID NO: 8045411 - DNA, 22 bp, Homo sapiens
gggcatttaaacaagcatacaa

SEQ ID NO: 8045412 - DNA, 22 bp, Homo sapiens
gggcatttcttgtcaatgtagg

SEQ ID NO: 8045413 - DNA, 22 bp, Homo sapiens
gggccaaggggagctggaaggg

SEQ ID NO: 8045414 - DNA, 22 bp, Homo sapiens
gggctgagcacatactgacagc

SEQ ID NO: 8045415 - DNA, 22 bp, Homo sapiens
gggctgagattggtgccctgtc

SEQ ID NO: 8045416 - DNA, 21 bp, Homo sapiens
gggccacaccttctgcagacc

SEQ ID NO: 8045417 - DNA, 21 bp, Homo sapiens
gggccacaccttctgcagacc

SEQ ID NO: 8045418 - DNA, 22 bp, Homo sapiens
gggctgagagctggaatctgag

SEQ ID NO: 8045419 - DNA, 22 bp, Homo sapiens
gggctgagtgtcccaggccgaa

SEQ ID NO: 8045420 - DNA, 22 bp, Homo sapiens
gggctgagtgtcccaggccgaa

SEQ ID NO: 8045421 - DNA, 22 bp, Homo sapiens
gggctgaggctaccactggtct

SEQ ID NO: 8045422 - DNA, 22 bp, Homo sapiens
gggctgctacgagaactgaata

SEQ ID NO: 8045423 - DNA, 23 bp, Homo sapiens
gggctgctccaggccaaggctgg

SEQ ID NO: 8045424 - DNA, 22 bp, Homo sapiens
gggctgctgccaatcacagcct

SEQ ID NO: 8045425 - DNA, 22 bp, Homo sapiens
gggctgccaagcctgcctgcct

SEQ ID NO: 8045426 - DNA, 22 bp, Homo sapiens
gggctgcatcagcaggacccgg

SEQ ID NO: 8045427 - DNA, 20 bp, Homo sapiens
gggcttggaggactcgaggg

SEQ ID NO: 8045428 - DNA, 22 bp, Homo sapiens
gggcttgctgtttagttccatt

SEQ ID NO: 8045429 - DNA, 22 bp, Homo sapiens
gggcttggagtaggctgatgaa

SEQ ID NO: 8045430 - DNA, 22 bp, Homo sapiens
gggcttgggtattgtgagaggt

SEQ ID NO: 8045431 - DNA, 22 bp, Homo sapiens
gggctgctgctgccagcgacac

SEQ ID NO: 8045432 - DNA, 22 bp, Homo sapiens
gggctgctgtagagaacatgtt

SEQ ID NO: 8045433 - DNA, 22 bp, Homo sapiens
gggctgctgggcaagaaacatt

SEQ ID NO: 8045434 - DNA, 22 bp, Homo sapiens
gggctgctgcccaggaggcacc

SEQ ID NO: 8045435 - DNA, 22 bp, Homo sapiens
gggctgctgccaccaggtggat

SEQ ID NO: 8045436 - DNA, 22 bp, Homo sapiens
gggcttgctaagaagagcgcat

SEQ ID NO: 8045437 - DNA, 22 bp, Homo sapiens
gggctgctgtgttcctgaggca

SEQ ID NO: 8045438 - DNA, 22 bp, Homo sapiens
ggtgtccttagaaagcagacct

SEQ ID NO: 8045439 - DNA, 22 bp, Homo sapiens
ggtgtccttcgtccgctggcat

SEQ ID NO: 8045440 - DNA, 22 bp, Homo sapiens
ggtgtccttgctccttcagctt

SEQ ID NO: 8045441 - DNA, 22 bp, Homo sapiens
ggtgtccttgcagaaggcggcg

SEQ ID NO: 8045442 - DNA, 22 bp, Homo sapiens
ggtggctctctgtcagtgacag

SEQ ID NO: 8045443 - DNA, 22 bp, Homo sapiens
ggtggctctcttaagggcagcg

SEQ ID NO: 8045444 - DNA, 22 bp, Homo sapiens
ggtggctcggccagtgcaggcc

SEQ ID NO: 8045445 - DNA, 22 bp, Homo sapiens
ggtggctctccctggactcagc

SEQ ID NO: 8045446 - DNA, 19 bp, Homo sapiens
ggtggctctccctcaggga

SEQ ID NO: 8045447 - DNA, 22 bp, Homo sapiens
ggtggctctcaggcttctcgga

SEQ ID NO: 8045448 - DNA, 22 bp, Homo sapiens
ggtggctccgcttccatgggct

SEQ ID NO: 8045449 - DNA, 22 bp, Homo sapiens
ggtggctcagtgtcaggccctg

SEQ ID NO: 8045450 - DNA, 22 bp, Homo sapiens
ggtggctcagggctccaagcat

SEQ ID NO: 8045451 - DNA, 18 bp, Homo sapiens
ggtggctcagtcatgggg

SEQ ID NO: 8045452 - DNA, 22 bp, Homo sapiens
ggtggctcaaagagagcacaga

SEQ ID NO: 8045453 - DNA, 17 bp, Homo sapiens
ggtggcctgcagtggct

SEQ ID NO: 8045454 - DNA, 22 bp, Homo sapiens
ggtcactgtcttctgggctctg

SEQ ID NO: 8045455 - DNA, 22 bp, Homo sapiens
gggtggctcctatgggcatagc

SEQ ID NO: 8045456 - DNA, 22 bp, Homo sapiens
gggtggctgagaacaggacccc

SEQ ID NO: 8045457 - DNA, 22 bp, Homo sapiens
ggtaggggaagacaagtgaaaa

SEQ ID NO: 8045458 - DNA, 22 bp, Homo sapiens
gggtggcatagggtgatggctt

SEQ ID NO: 8045459 - DNA, 22 bp, Homo sapiens
gggtggccttcatagctcaggg

SEQ ID NO: 8045460 - DNA, 22 bp, Homo sapiens
gggtggcatctctctgagctgt

SEQ ID NO: 8045461 - DNA, 22 bp, Homo sapiens
gggtggcaaaggcgctgaaagg

SEQ ID NO: 8045462 - DNA, 22 bp, Homo sapiens
gggtggcacaggtgcagagggt

SEQ ID NO: 8045463 - DNA, 22 bp, Homo sapiens
gggtggcacaggtgcagagggt

SEQ ID NO: 8045464 - DNA, 22 bp, Homo sapiens
gggtggcagctgttgccaaggt

SEQ ID NO: 8045465 - DNA, 22 bp, Homo sapiens
ggtctctgagtgaggacctggg

SEQ ID NO: 8045466 - DNA, 20 bp, Homo sapiens
ggtctctgacagctggttgc

SEQ ID NO: 8045467 - DNA, 22 bp, Homo sapiens
ggtctcagactggcaggcagtg

SEQ ID NO: 8045468 - DNA, 22 bp, Homo sapiens
gtgagcagctcagggtggtctc

SEQ ID NO: 8045469 - DNA, 22 bp, Homo sapiens
gtgagcaggataggggctccct

SEQ ID NO: 8045470 - DNA, 22 bp, Homo sapiens
gtgagcaggatttcatggtgta

SEQ ID NO: 8045471 - DNA, 22 bp, Homo sapiens
gtgcattggtgcgccacttcac

SEQ ID NO: 8045472 - DNA, 22 bp, Homo sapiens
gtgcattgcgatgcagacgacc

SEQ ID NO: 8045473 - DNA, 22 bp, Homo sapiens
gtgcaggtgttttggctgccag

SEQ ID NO: 8045474 - DNA, 22 bp, Homo sapiens
gtgaaggactgaatgaaaatgt

SEQ ID NO: 8045475 - DNA, 22 bp, Homo sapiens
gtgaaggaggggccacagatat

SEQ ID NO: 8045476 - DNA, 22 bp, Homo sapiens
gtgaaggataaggatctaaatt

SEQ ID NO: 8045477 - DNA, 22 bp, Homo sapiens
gtctgcccttggcctgggactt

SEQ ID NO: 8045478 - DNA, 22 bp, Homo sapiens
gtattaggttggtgcaaaagta

SEQ ID NO: 8045479 - DNA, 22 bp, Homo sapiens
gtattaggaggaacacaggcct

SEQ ID NO: 8045480 - DNA, 22 bp, Homo sapiens
gtattagggccaaaggcaggaa

SEQ ID NO: 8045481 - DNA, 22 bp, Homo sapiens
gtccacagggatggccacacat

SEQ ID NO: 8045482 - DNA, 22 bp, Homo sapiens
gtcattttgctgcatatttaga

SEQ ID NO: 8045483 - DNA, 22 bp, Homo sapiens
gtcatttttttcgtaatagtgg

SEQ ID NO: 8045484 - DNA, 22 bp, Homo sapiens
gtcattttctagaattatttga

SEQ ID NO: 8045485 - DNA, 22 bp, Homo sapiens
gtccctgcatctgcaggccatg

SEQ ID NO: 8045486 - DNA, 22 bp, Homo sapiens
gtccctgccctcctgggactca

SEQ ID NO: 8045487 - DNA, 20 bp, Homo sapiens
gtcctgggagccacagcaca

SEQ ID NO: 8045488 - DNA, 17 bp, Homo sapiens
gtcctgggaggagagag

SEQ ID NO: 8045489 - DNA, 22 bp, Homo sapiens
gtccccgacgtttggcttgatg

SEQ ID NO: 8045490 - DNA, 22 bp, Homo sapiens
gtccccttggtaaccttcagct

SEQ ID NO: 8045491 - DNA, 22 bp, Homo sapiens
gtcccctggtggctggagctgc

SEQ ID NO: 8045492 - DNA, 22 bp, Homo sapiens
gtcccctgctggtgttgctgct

SEQ ID NO: 8045493 - DNA, 23 bp, Homo sapiens
gtccctcacccctaggcaatgcc

SEQ ID NO: 8045494 - DNA, 22 bp, Homo sapiens
gtccctctgtgtccctgcagtc

SEQ ID NO: 8045495 - DNA, 22 bp, Homo sapiens
gtccctgcatcaccacgggact

SEQ ID NO: 8045496 - DNA, 22 bp, Homo sapiens
ctggctcattttagcatcaggt

SEQ ID NO: 8045497 - DNA, 22 bp, Homo sapiens
ctggctgcagtagcaagagact

SEQ ID NO: 8045498 - DNA, 22 bp, Homo sapiens
ctggctgcaggatgaggctgcc

SEQ ID NO: 8045499 - DNA, 22 bp, Homo sapiens
ctggctccaaggaagaggtttt

SEQ ID NO: 8045500 - DNA, 22 bp, Homo sapiens
ctggctgcttgggacagccatg

SEQ ID NO: 8045501 - DNA, 22 bp, Homo sapiens
ctggctgctggcctgaggatgc

SEQ ID NO: 8045502 - DNA, 22 bp, Homo sapiens
ctggctgcgtctgctctgacag

SEQ ID NO: 8045503 - DNA, 22 bp, Homo sapiens
ctggctgcgtctgctctgacag

SEQ ID NO: 8045504 - DNA, 22 bp, Homo sapiens
ctggctgccagcatttggggga

SEQ ID NO: 8045505 - DNA, 22 bp, Homo sapiens
ctggctgcattggcaagtcaat

SEQ ID NO: 8045506 - DNA, 22 bp, Homo sapiens
ctggctgccacttcagggtctt

SEQ ID NO: 8045507 - DNA, 22 bp, Homo sapiens
ctggctgcctggagtgagggag

SEQ ID NO: 8045508 - DNA, 22 bp, Homo sapiens
ctggctgcctatagtctccctt

SEQ ID NO: 8045509 - DNA, 22 bp, Homo sapiens
ctggccctcggagtccagctgc

SEQ ID NO: 8045510 - DNA, 22 bp, Homo sapiens
ctggccctggagggctgtgcga

SEQ ID NO: 8045511 - DNA, 19 bp, Homo sapiens
ctggccaggccaggggccc

SEQ ID NO: 8045512 - DNA, 22 bp, Homo sapiens
ctggcctgtgggctgtctccgg

SEQ ID NO: 8045513 - DNA, 22 bp, Homo sapiens
ctggctcactagccctgccctg

SEQ ID NO: 8045514 - DNA, 22 bp, Homo sapiens
ctggcaggcggcagagcccagg

SEQ ID NO: 8045515 - DNA, 22 bp, Homo sapiens
ctggcaggcggcagagcccagg

SEQ ID NO: 8045516 - DNA, 22 bp, Homo sapiens
ctggcaggcggaggttgcagtg

SEQ ID NO: 8045517 - DNA, 22 bp, Homo sapiens
ctggcaggctctctggtcggtt

SEQ ID NO: 8045518 - DNA, 22 bp, Homo sapiens
ctggcagggctctttgggtgct

SEQ ID NO: 8045519 - DNA, 20 bp, Homo sapiens
ctggcaggagcgagtctacc

SEQ ID NO: 8045520 - DNA, 22 bp, Homo sapiens
ctggcaggagctgtggccgtag

SEQ ID NO: 8045521 - DNA, 22 bp, Homo sapiens
ctggcaggatctaaccagggaa

SEQ ID NO: 8045522 - DNA, 22 bp, Homo sapiens
ctggcaggatctaaccagggaa

SEQ ID NO: 8045523 - DNA, 22 bp, Homo sapiens
ctggcaggcaaattggtgggag

SEQ ID NO: 8045524 - DNA, 22 bp, Homo sapiens
ctggcaggcagacttctgcaag

SEQ ID NO: 8045525 - DNA, 22 bp, Homo sapiens
ctggcaggcactcatgaaataa

SEQ ID NO: 8045526 - DNA, 22 bp, Homo sapiens
ctggccagctgacagcagggct

SEQ ID NO: 8045527 - DNA, 22 bp, Homo sapiens
ctggccagcctgtcgatgccct

SEQ ID NO: 8045528 - DNA, 22 bp, Homo sapiens
ctggccaggcatcccctgatcc

SEQ ID NO: 8045529 - DNA, 22 bp, Homo sapiens
ctggccagcatggctgaagtac

SEQ ID NO: 8045530 - DNA, 22 bp, Homo sapiens
ctggccagatgttacgtccaat

SEQ ID NO: 8045531 - DNA, 22 bp, Homo sapiens
ctggccagagttggagggtgtg

SEQ ID NO: 8045532 - DNA, 22 bp, Homo sapiens
ctgcatccatgttgctgcaaag

SEQ ID NO: 8045533 - DNA, 22 bp, Homo sapiens
ctgccaccatgccccagcagag

SEQ ID NO: 8045534 - DNA, 22 bp, Homo sapiens
ctgccaccaaatagctgcatga

SEQ ID NO: 8045535 - DNA, 22 bp, Homo sapiens
ctgccacaggggagcaggcaga

SEQ ID NO: 8045536 - DNA, 22 bp, Homo sapiens
ctgccacaagctggccctgtgt

SEQ ID NO: 8045537 - DNA, 22 bp, Homo sapiens
ctgccactttcacccagtgctc

SEQ ID NO: 8045538 - DNA, 22 bp, Homo sapiens
ctgccagaagagaacaccagtt

SEQ ID NO: 8045539 - DNA, 22 bp, Homo sapiens
ctgccagaaggttcctgctgca

SEQ ID NO: 8045540 - DNA, 22 bp, Homo sapiens
ctgccagcagaggccagcgctg

SEQ ID NO: 8045541 - DNA, 22 bp, Homo sapiens
ctgccagcactgcctcctgagg

SEQ ID NO: 8045542 - DNA, 22 bp, Homo sapiens
ctggcagccaagtgggatactc

SEQ ID NO: 8045543 - DNA, 22 bp, Homo sapiens
ctggcagcccaacctagagtct

SEQ ID NO: 8045544 - DNA, 22 bp, Homo sapiens
ctggcagcccaacctagagtct

SEQ ID NO: 8045545 - DNA, 22 bp, Homo sapiens
ctggcaggagcattcacagagg

SEQ ID NO: 8045546 - DNA, 22 bp, Homo sapiens
ctggcaggaagttagatggtaa

SEQ ID NO: 8045547 - DNA, 22 bp, Homo sapiens
ctggcaggaagttagatggtaa

SEQ ID NO: 8045548 - DNA, 19 bp, Homo sapiens
ctggcagcctgtctgtgtc

SEQ ID NO: 8045549 - DNA, 19 bp, Homo sapiens
ctggcagcctgtctgtgtc

SEQ ID NO: 8045550 - DNA, 22 bp, Homo sapiens
ctggcagcttcaggacactcgg

SEQ ID NO: 8045551 - DNA, 22 bp, Homo sapiens
ctggcagcttcctttgcatctg

SEQ ID NO: 8045552 - DNA, 22 bp, Homo sapiens
ctggcaggaagaggaaaggtca

SEQ ID NO: 8045553 - DNA, 20 bp, Homo sapiens
ctggggaggaggatgtgttc

SEQ ID NO: 8045554 - DNA, 22 bp, Homo sapiens
ctgggctgcgggcgcccctcca

SEQ ID NO: 8045555 - DNA, 20 bp, Homo sapiens
ctgggctgcccagctatggg

SEQ ID NO: 8045556 - DNA, 22 bp, Homo sapiens
ctgggccagaccttgtggtctt

SEQ ID NO: 8045557 - DNA, 19 bp, Homo sapiens
ctgggccagagctgtcctc

SEQ ID NO: 8045558 - DNA, 19 bp, Homo sapiens
ctgggccagagctgtcctc

SEQ ID NO: 8045559 - DNA, 18 bp, Homo sapiens
ctgggccagagtttctgc

SEQ ID NO: 8045560 - DNA, 18 bp, Homo sapiens
ctgggccagagtttctgc

SEQ ID NO: 8045561 - DNA, 22 bp, Homo sapiens
ctgggctctgcagttgatgttt

SEQ ID NO: 8045562 - DNA, 22 bp, Homo sapiens
ctgggctctgcagttgatgttt

SEQ ID NO: 8045563 - DNA, 22 bp, Homo sapiens
ctgggctctgcggtgtcgctct

SEQ ID NO: 8045564 - DNA, 22 bp, Homo sapiens
ctgggccagatccagcctcaca

SEQ ID NO: 8045565 - DNA, 22 bp, Homo sapiens
ctgggccagatccagcctcaca

SEQ ID NO: 8045566 - DNA, 22 bp, Homo sapiens
ctggggtgtgctcagagcaggg

SEQ ID NO: 8045567 - DNA, 22 bp, Homo sapiens
ctggggctgcggtggaggagcc

SEQ ID NO: 8045568 - DNA, 22 bp, Homo sapiens
ctggggctgcagcgatcttcat

SEQ ID NO: 8045569 - DNA, 22 bp, Homo sapiens
ctggggctcactttggtcaggc

SEQ ID NO: 8045570 - DNA, 22 bp, Homo sapiens
ctggggcattgggagaggcctg

SEQ ID NO: 8045571 - DNA, 22 bp, Homo sapiens
ctgggagctagctctgagctga

SEQ ID NO: 8045572 - DNA, 22 bp, Homo sapiens
ctgggagctagctctgagctga

SEQ ID NO: 8045573 - DNA, 22 bp, Homo sapiens
ctgggagctgaggctgacgctg

SEQ ID NO: 8045574 - DNA, 22 bp, Homo sapiens
ctggcttggcttattcatggaa

SEQ ID NO: 8045575 - DNA, 22 bp, Homo sapiens
ctgggcaggagggctctatgga

SEQ ID NO: 8045576 - DNA, 22 bp, Homo sapiens
ctgggcagtttattcagttctg

SEQ ID NO: 8045577 - DNA, 22 bp, Homo sapiens
ctgggccacaaaaaactcctgt

SEQ ID NO: 8045578 - DNA, 22 bp, Homo sapiens
ctgggccacaaaaaactcctgt

SEQ ID NO: 8045579 - DNA, 22 bp, Homo sapiens
ctgggccaaaagaagtgttctt

SEQ ID NO: 8045580 - DNA, 22 bp, Homo sapiens
ctgggccaagaagttgtgtatg

SEQ ID NO: 8045581 - DNA, 22 bp, Homo sapiens
ctgggcatgaaaaggatgccag

SEQ ID NO: 8045582 - DNA, 22 bp, Homo sapiens
ctgggccacatcagatgaagac

SEQ ID NO: 8045583 - DNA, 22 bp, Homo sapiens
ctgggccacatcagatgaagac

SEQ ID NO: 8045584 - DNA, 22 bp, Homo sapiens
ctgggccacagactcaaggcag

SEQ ID NO: 8045585 - DNA, 22 bp, Homo sapiens
ctgggccacagactcaaggcag

SEQ ID NO: 8045586 - DNA, 22 bp, Homo sapiens
ctgggccacaagcctgtgtgat

SEQ ID NO: 8045587 - DNA, 19 bp, Homo sapiens
ctgggccagaatcagctca

SEQ ID NO: 8045588 - DNA, 22 bp, Homo sapiens
ctgggccagaagacatttagga

SEQ ID NO: 8045589 - DNA, 22 bp, Homo sapiens
ctgggccacttcctcaggggaa

SEQ ID NO: 8045590 - DNA, 22 bp, Homo sapiens
ctgggccagaagacatttagga

SEQ ID NO: 8045591 - DNA, 22 bp, Homo sapiens
ctgggccactccagatgcccac

SEQ ID NO: 8045592 - DNA, 22 bp, Homo sapiens
ctgggaggcagaggttgcagtg

SEQ ID NO: 8045593 - DNA, 22 bp, Homo sapiens
ctgggaggcagaggttgcagtg

SEQ ID NO: 8045594 - DNA, 22 bp, Homo sapiens
ctgggaggcactattcaggagg

SEQ ID NO: 8045595 - DNA, 22 bp, Homo sapiens
ctgggaggcggagcttgcagtg

SEQ ID NO: 8045596 - DNA, 22 bp, Homo sapiens
ctgggcaggagaggtggttgga

SEQ ID NO: 8045597 - DNA, 22 bp, Homo sapiens
ctgggaggcggagcttgcagtg

SEQ ID NO: 8045598 - DNA, 22 bp, Homo sapiens
ctgggtgccagcatggctgagt

SEQ ID NO: 8045599 - DNA, 19 bp, Homo sapiens
ctgggtcttattctgtgaa

SEQ ID NO: 8045600 - DNA, 22 bp, Homo sapiens
ctgtgagggccagagtcagggc

SEQ ID NO: 8045601 - DNA, 22 bp, Homo sapiens
ctgtgcagtggcagcgtgtggg

SEQ ID NO: 8045602 - DNA, 22 bp, Homo sapiens
ctgtgccaggcccagctgactt

SEQ ID NO: 8045603 - DNA, 22 bp, Homo sapiens
ctgtgccagcctgtcccaggag

SEQ ID NO: 8045604 - DNA, 22 bp, Homo sapiens
ctgtgccactgggggccggcaa

SEQ ID NO: 8045605 - DNA, 22 bp, Homo sapiens
ctgtgccactgccctgccacgc

SEQ ID NO: 8045606 - DNA, 22 bp, Homo sapiens
ctgtgccacctgagggactcta

SEQ ID NO: 8045607 - DNA, 22 bp, Homo sapiens
ctgtgcagtgtggggtaggcct

SEQ ID NO: 8045608 - DNA, 23 bp, Homo sapiens
ctgtgcccggggctccacctgat

SEQ ID NO: 8045609 - DNA, 22 bp, Homo sapiens
ctgtggccagtcccacacctcc

SEQ ID NO: 8045610 - DNA, 22 bp, Homo sapiens
ctgtggccagatggtgccagtt

SEQ ID NO: 8045611 - DNA, 22 bp, Homo sapiens
ctgtgcccaggcccctggggat

SEQ ID NO: 8045612 - DNA, 22 bp, Homo sapiens
ctgtgccattctttgtagcatg

SEQ ID NO: 8045613 - DNA, 22 bp, Homo sapiens
ctgtgccatcctagggctgctg

SEQ ID NO: 8045614 - DNA, 22 bp, Homo sapiens
ctgtgccaggcccgggtgggtg

SEQ ID NO: 8045615 - DNA, 22 bp, Homo sapiens
ctgtgccaggcccgggtgggtg

SEQ ID NO: 8045616 - DNA, 22 bp, Homo sapiens
ctgttctgaccagtgcagggat

SEQ ID NO: 8045617 - DNA, 22 bp, Homo sapiens
ctgttgcttcaggaaacagtaa

SEQ ID NO: 8045618 - DNA, 22 bp, Homo sapiens
ctgttgctccagggaacacaga

SEQ ID NO: 8045619 - DNA, 22 bp, Homo sapiens
ctgttgcagaggggcggagagg

SEQ ID NO: 8045620 - DNA, 18 bp, Homo sapiens
ctgttgagatgtggctga

SEQ ID NO: 8045621 - DNA, 20 bp, Homo sapiens
ctgtggctcatgcatctgcc

SEQ ID NO: 8045622 - DNA, 22 bp, Homo sapiens
ctgtgtcctgcgtcaagccaat

SEQ ID NO: 8045623 - DNA, 22 bp, Homo sapiens
ctgtgtcctgtctcctaaggtg

SEQ ID NO: 8045624 - DNA, 22 bp, Homo sapiens
ctgtgtcctttaaaaaagacac

SEQ ID NO: 8045625 - DNA, 22 bp, Homo sapiens
ctgtgtcctcccgctgcaccca

SEQ ID NO: 8045626 - DNA, 22 bp, Homo sapiens
ctgtgtcctcccgctgcaccca

SEQ ID NO: 8045627 - DNA, 22 bp, Homo sapiens
ctgtgtccttttagttgctgtg

SEQ ID NO: 8045628 - DNA, 22 bp, Homo sapiens
cttcctgcccacttcctgctgg

SEQ ID NO: 8045629 - DNA, 22 bp, Homo sapiens
cttcctgcattgtgccagagtt

SEQ ID NO: 8045630 - DNA, 19 bp, Homo sapiens
cttcctggaggagagcctc

SEQ ID NO: 8045631 - DNA, 22 bp, Homo sapiens
cttcctggatgaacagtagaaa

SEQ ID NO: 8045632 - DNA, 22 bp, Homo sapiens
cttcctggcaaagcaatcagag

SEQ ID NO: 8045633 - DNA, 23 bp, Homo sapiens
cttgcaggaagcagatggcacac

SEQ ID NO: 8045634 - DNA, 22 bp, Homo sapiens
cttgcaggcctttctagctcta

SEQ ID NO: 8045635 - DNA, 22 bp, Homo sapiens
cttgcagggctgatgggaagtg

SEQ ID NO: 8045636 - DNA, 22 bp, Homo sapiens
cttgcaggcagggcctcctgga

SEQ ID NO: 8045637 - DNA, 22 bp, Homo sapiens
cttgatttcagccttgtgatat

SEQ ID NO: 8045638 - DNA, 22 bp, Homo sapiens
cttgggtgctggaggctgccgc

SEQ ID NO: 8045639 - DNA, 22 bp, Homo sapiens
cttgccagtgttgcagaagctc

SEQ ID NO: 8045640 - DNA, 22 bp, Homo sapiens
cttgccagggactcagtcaggg

SEQ ID NO: 8045641 - DNA, 22 bp, Homo sapiens
cttgtccagatgtttgttaggt

SEQ ID NO: 8045642 - DNA, 22 bp, Homo sapiens
cttcctgaacaatgccatcaat

SEQ ID NO: 8045643 - DNA, 22 bp, Homo sapiens
cttcctgaaggatggcagcctc

SEQ ID NO: 8045644 - DNA, 22 bp, Homo sapiens
cttcagccctgagtgccagcag

SEQ ID NO: 8045645 - DNA, 22 bp, Homo sapiens
cttatttactgatccacagatg

SEQ ID NO: 8045646 - DNA, 22 bp, Homo sapiens
cttatttaatgagggttagaat

SEQ ID NO: 8045647 - DNA, 22 bp, Homo sapiens
cttattgaaagcccctgtgcct

SEQ ID NO: 8045648 - DNA, 22 bp, Homo sapiens
cttcagccagctggggatgcgg

SEQ ID NO: 8045649 - DNA, 22 bp, Homo sapiens
gagcttttcttccagttaatga

SEQ ID NO: 8045650 - DNA, 22 bp, Homo sapiens
gagcttctcaacagttatctct

SEQ ID NO: 8045651 - DNA, 22 bp, Homo sapiens
gagcttcttgtttcttcatctg

SEQ ID NO: 8045652 - DNA, 22 bp, Homo sapiens
gagccaggtttgaatctcagtc

SEQ ID NO: 8045653 - DNA, 22 bp, Homo sapiens
gagcctggattgaagtgggtgg

SEQ ID NO: 8045654 - DNA, 22 bp, Homo sapiens
gagcctggattgaagtgggtgg

SEQ ID NO: 8045655 - DNA, 22 bp, Homo sapiens
gagcctggattgtcaccgactt

SEQ ID NO: 8045656 - DNA, 22 bp, Homo sapiens
gagcctggacatctcaggccca

SEQ ID NO: 8045657 - DNA, 22 bp, Homo sapiens
gagcctgcccctccaccaggat

SEQ ID NO: 8045658 - DNA, 22 bp, Homo sapiens
gagctctgttctcgtcctgctg

SEQ ID NO: 8045659 - DNA, 22 bp, Homo sapiens
gagctctgaaaaagcttgcctt

SEQ ID NO: 8045660 - DNA, 22 bp, Homo sapiens
gaggaggctatcagcaatcagg

SEQ ID NO: 8045661 - DNA, 22 bp, Homo sapiens
gaggaggccagtggaaggaagc

SEQ ID NO: 8045662 - DNA, 22 bp, Homo sapiens
gaggaggcacttgagcagatgt

SEQ ID NO: 8045663 - DNA, 22 bp, Homo sapiens
gaggaggaagttctctgtaggc

SEQ ID NO: 8045664 - DNA, 22 bp, Homo sapiens
gaggcagaggttgcagtgagct

SEQ ID NO: 8045665 - DNA, 22 bp, Homo sapiens
gaggccagatgtcatgtcttat

SEQ ID NO: 8045666 - DNA, 22 bp, Homo sapiens
gaggccagcccctcttgaaggc

SEQ ID NO: 8045667 - DNA, 22 bp, Homo sapiens
gaggccagcgcgcagcactttt

SEQ ID NO: 8045668 - DNA, 22 bp, Homo sapiens
gaggccagcgcgcagcactttt

SEQ ID NO: 8045669 - DNA, 22 bp, Homo sapiens
gaggccagctagtccaggaagt

SEQ ID NO: 8045670 - DNA, 22 bp, Homo sapiens
gaggccagctagtccaggaagt

SEQ ID NO: 8045671 - DNA, 22 bp, Homo sapiens
gaggccagctacccaagggtca

SEQ ID NO: 8045672 - DNA, 22 bp, Homo sapiens
gaggccaggacatgaaagctga

SEQ ID NO: 8045673 - DNA, 22 bp, Homo sapiens
gaggccaggaagcccaagatca

SEQ ID NO: 8045674 - DNA, 22 bp, Homo sapiens
gaggccaggaggatctctctaa

SEQ ID NO: 8045675 - DNA, 22 bp, Homo sapiens
gaggcagagaccttcaggacct

SEQ ID NO: 8045676 - DNA, 22 bp, Homo sapiens
gaggcagaagttgcagtgagca

SEQ ID NO: 8045677 - DNA, 22 bp, Homo sapiens
gaggcactgctgggcccctgta

SEQ ID NO: 8045678 - DNA, 22 bp, Homo sapiens
gagaggccatggctgtgcagtg

SEQ ID NO: 8045679 - DNA, 22 bp, Homo sapiens
gagaggccatggggtgggatgc

SEQ ID NO: 8045680 - DNA, 22 bp, Homo sapiens
gagaggccatggctgtgcagtg

SEQ ID NO: 8045681 - DNA, 22 bp, Homo sapiens
gagaggccatggctgtgcagtg

SEQ ID NO: 8045682 - DNA, 22 bp, Homo sapiens
gagaggcctgggcccgtgagct

SEQ ID NO: 8045683 - DNA, 22 bp, Homo sapiens
gagaattcttcaacaaagtatt

SEQ ID NO: 8045684 - DNA, 22 bp, Homo sapiens
gagcagctggaggccttgttgg

SEQ ID NO: 8045685 - DNA, 22 bp, Homo sapiens
gagcagctggctgtattggttt

SEQ ID NO: 8045686 - DNA, 22 bp, Homo sapiens
gagcagctgtccccaaagcttc

SEQ ID NO: 8045687 - DNA, 22 bp, Homo sapiens
gagcagctgtggggttgaccat

SEQ ID NO: 8045688 - DNA, 22 bp, Homo sapiens
gagcagctgttctgacttgtct

SEQ ID NO: 8045689 - DNA, 20 bp, Homo sapiens
gagcagctgtttgcattgca

SEQ ID NO: 8045690 - DNA, 22 bp, Homo sapiens
gagccaagctcttctccatgag

SEQ ID NO: 8045691 - DNA, 22 bp, Homo sapiens
gagccaagggttgccatggaga

SEQ ID NO: 8045692 - DNA, 22 bp, Homo sapiens
gagccaggttggaggctgcagt

SEQ ID NO: 8045693 - DNA, 22 bp, Homo sapiens
gagccaggttggaggctgcagt

SEQ ID NO: 8045694 - DNA, 16 bp, Homo sapiens
gagccaggtgccttga

SEQ ID NO: 8045695 - DNA, 22 bp, Homo sapiens
gagccaggggtcagctccgagg

SEQ ID NO: 8045696 - DNA, 22 bp, Homo sapiens
gagccagggtttgaaactagac

SEQ ID NO: 8045697 - DNA, 22 bp, Homo sapiens
gagatgtttagggtggggagag

SEQ ID NO: 8045698 - DNA, 22 bp, Homo sapiens
gagcagcagattgtctccatgg

SEQ ID NO: 8045699 - DNA, 22 bp, Homo sapiens
gagcagcacttgaggcatgtca

SEQ ID NO: 8045700 - DNA, 22 bp, Homo sapiens
gagcagcacttgaggcatgtca

SEQ ID NO: 8045701 - DNA, 22 bp, Homo sapiens
gagcagcagctgggccaggttc

SEQ ID NO: 8045702 - DNA, 22 bp, Homo sapiens
gagcagagtctatttccacact

SEQ ID NO: 8045703 - DNA, 22 bp, Homo sapiens
gagcagcaggccaggttgcagg

SEQ ID NO: 8045704 - DNA, 22 bp, Homo sapiens
gagcagcaggtggctgtgatgg

SEQ ID NO: 8045705 - DNA, 22 bp, Homo sapiens
gagcagcaggtggggctggctt

SEQ ID NO: 8045706 - DNA, 22 bp, Homo sapiens
gagcagcaggtggggctggctt

SEQ ID NO: 8045707 - DNA, 22 bp, Homo sapiens
gaatacatgtgtgtatagaggt

SEQ ID NO: 8045708 - DNA, 22 bp, Homo sapiens
gaccctggctggagctggcctg

SEQ ID NO: 8045709 - DNA, 22 bp, Homo sapiens
gacccatataggaccctccaaa

SEQ ID NO: 8045710 - DNA, 22 bp, Homo sapiens
gaccctggtgggcactggcacc

SEQ ID NO: 8045711 - DNA, 22 bp, Homo sapiens
gaccctggtgtccaggtcctgc

SEQ ID NO: 8045712 - DNA, 22 bp, Homo sapiens
gacaggtgggtacctttatgga

SEQ ID NO: 8045713 - DNA, 18 bp, Homo sapiens
gacaggtgggtgagacca

SEQ ID NO: 8045714 - DNA, 22 bp, Homo sapiens
gacaggtggggaaactaaggta

SEQ ID NO: 8045715 - DNA, 22 bp, Homo sapiens
gacaggtgctaagggacctggc

SEQ ID NO: 8045716 - DNA, 22 bp, Homo sapiens
gacaggtgtgatgatttaggct

SEQ ID NO: 8045717 - DNA, 22 bp, Homo sapiens
gacaggtgtgtgtatattaggg

SEQ ID NO: 8045718 - DNA, 22 bp, Homo sapiens
gacaggtgggttctcgtatctg

SEQ ID NO: 8045719 - DNA, 22 bp, Homo sapiens
gacagggtccaaaggcagggga

SEQ ID NO: 8045720 - DNA, 22 bp, Homo sapiens
gacaggtgagatgaggaacacc

SEQ ID NO: 8045721 - DNA, 22 bp, Homo sapiens
gacaggtgaaacagcaaggtaa

SEQ ID NO: 8045722 - DNA, 21 bp, Homo sapiens
gacaggtgattcagagcaggg

SEQ ID NO: 8045723 - DNA, 20 bp, Homo sapiens
gacaggtgctaaagaggggc

SEQ ID NO: 8045724 - DNA, 22 bp, Homo sapiens
gacacagacagttagaggtaat

SEQ ID NO: 8045725 - DNA, 22 bp, Homo sapiens
gacacagaatttactcccgata

SEQ ID NO: 8045726 - DNA, 22 bp, Homo sapiens
gacaggccaggggctgaggtgg

SEQ ID NO: 8045727 - DNA, 22 bp, Homo sapiens
gacaggccccctcaggactgat

SEQ ID NO: 8045728 - DNA, 22 bp, Homo sapiens
gacacagaaggtcacatgttca

SEQ ID NO: 8045729 - DNA, 22 bp, Homo sapiens
gacaagggttctgcagagcctg

SEQ ID NO: 8045730 - DNA, 22 bp, Homo sapiens
gacaggcttcatgatggcagga

SEQ ID NO: 8045731 - DNA, 22 bp, Homo sapiens
gacaggctgtgatggccgggag

SEQ ID NO: 8045732 - DNA, 22 bp, Homo sapiens
gacaggggtccctctgggctgt

SEQ ID NO: 8045733 - DNA, 22 bp, Homo sapiens
gacaggggtccctctgggctgt

SEQ ID NO: 8045734 - DNA, 22 bp, Homo sapiens
gacagggctgtgggaggagcag

SEQ ID NO: 8045735 - DNA, 22 bp, Homo sapiens
ctttcagttacagttacacaca

SEQ ID NO: 8045736 - DNA, 22 bp, Homo sapiens
ctttcagttacagttacacaca

SEQ ID NO: 8045737 - DNA, 22 bp, Homo sapiens
ctttcataaaggaaatgatgag

SEQ ID NO: 8045738 - DNA, 22 bp, Homo sapiens
ctttcagttaatgactccatag

SEQ ID NO: 8045739 - DNA, 23 bp, Homo sapiens
ctttcattgtggtttcacagagc

SEQ ID NO: 8045740 - DNA, 22 bp, Homo sapiens
ctttcatttgataagaatgcca

SEQ ID NO: 8045741 - DNA, 22 bp, Homo sapiens
ctttcatagttaaaatagtttg

SEQ ID NO: 8045742 - DNA, 22 bp, Homo sapiens
ctttcattcttagatattagtg

SEQ ID NO: 8045743 - DNA, 22 bp, Homo sapiens
gaaatcaatttcttggttgata

SEQ ID NO: 8045744 - DNA, 22 bp, Homo sapiens
gaaatcaaggctacattcaggt

SEQ ID NO: 8045745 - DNA, 22 bp, Homo sapiens
gaaatcaaacccttttctgata

SEQ ID NO: 8045746 - DNA, 22 bp, Homo sapiens
gaaatccagttccctactctta

SEQ ID NO: 8045747 - DNA, 22 bp, Homo sapiens
gaagagaagcatcaataggtaa

SEQ ID NO: 8045748 - DNA, 22 bp, Homo sapiens
gaagaggctttcctagggcaag

SEQ ID NO: 8045749 - DNA, 22 bp, Homo sapiens
gaagacacaattggtgggtcca

SEQ ID NO: 8045750 - DNA, 21 bp, Homo sapiens
gaagacacataacctctctcc

SEQ ID NO: 8045751 - DNA, 20 bp, Homo sapiens
gaagacacagagttcatctc

SEQ ID NO: 8045752 - DNA, 22 bp, Homo sapiens
gaagacatgtttttaatatgta

SEQ ID NO: 8045753 - DNA, 22 bp, Homo sapiens
gaagacatgtggattctagttt

SEQ ID NO: 8045754 - DNA, 22 bp, Homo sapiens
gaagacactaaggcccagggag

SEQ ID NO: 8045755 - DNA, 22 bp, Homo sapiens
gaagacactaaactggggcttc

SEQ ID NO: 8045756 - DNA, 22 bp, Homo sapiens
gaagacacctactgtcatttct

SEQ ID NO: 8045757 - DNA, 22 bp, Homo sapiens
gaagacactctgcagagttatc

SEQ ID NO: 8045758 - DNA, 22 bp, Homo sapiens
gaagatgggaatgatgagtggg

SEQ ID NO: 8045759 - DNA, 22 bp, Homo sapiens
gaagcctcaacatctctgcgtc

SEQ ID NO: 8045760 - DNA, 22 bp, Homo sapiens
gaagcccaggcttccttggctt

SEQ ID NO: 8045761 - DNA, 22 bp, Homo sapiens
gaagccaggggcctgacaggca

SEQ ID NO: 8045762 - DNA, 22 bp, Homo sapiens
ctacagagaactcagctgccct

SEQ ID NO: 8045763 - DNA, 22 bp, Homo sapiens
ctacaggctcagggagccctct

SEQ ID NO: 8045764 - DNA, 22 bp, Homo sapiens
ttctctggatgtttctcagtca

SEQ ID NO: 8045765 - DNA, 22 bp, Homo sapiens
ctattaggttggtgcaaaagta

SEQ ID NO: 8045766 - DNA, 22 bp, Homo sapiens
ctcacagagctcatactgggag

SEQ ID NO: 8045767 - DNA, 22 bp, Homo sapiens
ctatgagaagaaaacaagatta

SEQ ID NO: 8045768 - DNA, 22 bp, Homo sapiens
ctagatgccaatttttatggat

SEQ ID NO: 8045769 - DNA, 22 bp, Homo sapiens
ctagcaggtcaaaccagctgat

SEQ ID NO: 8045770 - DNA, 22 bp, Homo sapiens
ctagcagggtcgacgtctggcg

SEQ ID NO: 8045771 - DNA, 22 bp, Homo sapiens
ctagcaggtcaaaccagctgat

SEQ ID NO: 8045772 - DNA, 22 bp, Homo sapiens
ctagcagggattgggcactggg

SEQ ID NO: 8045773 - DNA, 22 bp, Homo sapiens
ctagccagactcaagggccacc

SEQ ID NO: 8045774 - DNA, 22 bp, Homo sapiens
ctagccagatgattcccaaata

SEQ ID NO: 8045775 - DNA, 22 bp, Homo sapiens
ctagccagatttaaagagagac

SEQ ID NO: 8045776 - DNA, 22 bp, Homo sapiens
cgccccggacgtctgaccaaac

SEQ ID NO: 8045777 - DNA, 19 bp, Homo sapiens
ttcacaattatgaaattag

SEQ ID NO: 8045778 - DNA, 22 bp, Homo sapiens
cctttctgacagtgatgggggg

SEQ ID NO: 8045779 - DNA, 19 bp, Homo sapiens
cctttcagaacagaagcca

SEQ ID NO: 8045780 - DNA, 22 bp, Homo sapiens
cgcaggtgttcagtaaatgtat

SEQ ID NO: 8045781 - DNA, 22 bp, Homo sapiens
cgcaggtgggcccttcattgat

SEQ ID NO: 8045782 - DNA, 22 bp, Homo sapiens
cgcaggtgtgttttcaggacta

SEQ ID NO: 8045783 - DNA, 22 bp, Homo sapiens
cgcatacatagaaacacacaga

SEQ ID NO: 8045784 - DNA, 22 bp, Homo sapiens
cgcaggtgccggcagatggggt

SEQ ID NO: 8045785 - DNA, 19 bp, Homo sapiens
cgcaggtggaaggagccgc

SEQ ID NO: 8045786 - DNA, 22 bp, Homo sapiens
cgcagctggatatcatgtgcct

SEQ ID NO: 8045787 - DNA, 20 bp, Homo sapiens
cgcatagtttccatcattcc

SEQ ID NO: 8045788 - DNA, 22 bp, Homo sapiens
ttcacagaattgtcttgactgg

SEQ ID NO: 8045789 - DNA, 22 bp, Homo sapiens
ctaaatactagccttcagattt

SEQ ID NO: 8045790 - DNA, 22 bp, Homo sapiens
ttcatgaatgttccatgtgagt

SEQ ID NO: 8045791 - DNA, 22 bp, Homo sapiens
cgtaggtggctcagcacctggg

SEQ ID NO: 8045792 - DNA, 22 bp, Homo sapiens
ccttccttcaagcacacatcta

SEQ ID NO: 8045793 - DNA, 22 bp, Homo sapiens
ccttcattattcctgaactgtt

SEQ ID NO: 8045794 - DNA, 22 bp, Homo sapiens
ccttccagttcttggttgtaat

SEQ ID NO: 8045795 - DNA, 22 bp, Homo sapiens
cctgtgtgtaggccaggggagt

SEQ ID NO: 8045796 - DNA, 22 bp, Homo sapiens
cctgtgtgcacacgaggccatg

SEQ ID NO: 8045797 - DNA, 22 bp, Homo sapiens
cctttacatctgacttctttca

SEQ ID NO: 8045798 - DNA, 22 bp, Homo sapiens
cctttacagtatggttgtatca

SEQ ID NO: 8045799 - DNA, 19 bp, Homo sapiens
cctgtgctaggagctgacc

SEQ ID NO: 8045800 - DNA, 22 bp, Homo sapiens
cctgtgctccctatgtatctgg

SEQ ID NO: 8045801 - DNA, 22 bp, Homo sapiens
cctgtgccctacacctttccag

SEQ ID NO: 8045802 - DNA, 22 bp, Homo sapiens
cctgtgccctcagcctggctct

SEQ ID NO: 8045803 - DNA, 22 bp, Homo sapiens
cctgtgccttaaccctttaggc

SEQ ID NO: 8045804 - DNA, 22 bp, Homo sapiens
cctgtgctgggtgtgagggaca

SEQ ID NO: 8045805 - DNA, 21 bp, Homo sapiens
cctgtggtctggagggagcac

SEQ ID NO: 8045806 - DNA, 22 bp, Homo sapiens
cctgggctgggcgtctcatggg

SEQ ID NO: 8045807 - DNA, 21 bp, Homo sapiens
cctgggctgtggtttggagac

SEQ ID NO: 8045808 - DNA, 22 bp, Homo sapiens
cctgggcttacgacctctgact

SEQ ID NO: 8045809 - DNA, 22 bp, Homo sapiens
cctgggcttccacgagcagagg

SEQ ID NO: 8045810 - DNA, 22 bp, Homo sapiens
tgtgttctgaaggagaagagtg

SEQ ID NO: 8045811 - DNA, 22 bp, Homo sapiens
cctgggctgcatgatggcattt

SEQ ID NO: 8045812 - DNA, 22 bp, Homo sapiens
cctgggctggagtacagcagtg

SEQ ID NO: 8045813 - DNA, 22 bp, Homo sapiens
cctgggctctgtcagaattggg

SEQ ID NO: 8045814 - DNA, 22 bp, Homo sapiens
cctgggctctgaggagggagtc

SEQ ID NO: 8045815 - DNA, 22 bp, Homo sapiens
tgttacaggaaatagaattacc

SEQ ID NO: 8045816 - DNA, 23 bp, Homo sapiens
tgttccagatacgccttttcctc

SEQ ID NO: 8045817 - DNA, 22 bp, Homo sapiens
cctgggtgtcatgggcagctgg

SEQ ID NO: 8045818 - DNA, 22 bp, Homo sapiens
cctggtgcttaccagagctttt

SEQ ID NO: 8045819 - DNA, 22 bp, Homo sapiens
tgtgtctctttgtcctagagct

SEQ ID NO: 8045820 - DNA, 22 bp, Homo sapiens
tgtgtctccatagccagctagc

SEQ ID NO: 8045821 - DNA, 22 bp, Homo sapiens
tgtgtctcctttccctgtctaa

SEQ ID NO: 8045822 - DNA, 22 bp, Homo sapiens
cctgggcaacatagggagaccc

SEQ ID NO: 8045823 - DNA, 22 bp, Homo sapiens
cctgggcaaatgccagagacaa

SEQ ID NO: 8045824 - DNA, 22 bp, Homo sapiens
cctgggcaacatagtgagaccc

SEQ ID NO: 8045825 - DNA, 22 bp, Homo sapiens
cctgggcaacatagtgagaccc

SEQ ID NO: 8045826 - DNA, 22 bp, Homo sapiens
cctgggcaacatagtgagacct

SEQ ID NO: 8045827 - DNA, 22 bp, Homo sapiens
cctgggcaacatagtgagacct

SEQ ID NO: 8045828 - DNA, 19 bp, Homo sapiens
cctgggagtcagctgaagg

SEQ ID NO: 8045829 - DNA, 22 bp, Homo sapiens
cctgggagtggcactcacagca

SEQ ID NO: 8045830 - DNA, 22 bp, Homo sapiens
cctgggagtgtgccatctctgt

SEQ ID NO: 8045831 - DNA, 22 bp, Homo sapiens
cctgggaggctgaggctgcagt

SEQ ID NO: 8045832 - DNA, 19 bp, Homo sapiens
cctgggagtcagctgaagg

SEQ ID NO: 8045833 - DNA, 22 bp, Homo sapiens
cctgggaggctgaggctgcagt

SEQ ID NO: 8045834 - DNA, 23 bp, Homo sapiens
tggggccaagtgaggaagggtct

SEQ ID NO: 8045835 - DNA, 23 bp, Homo sapiens
tggggccaagtgaggaagggtct

SEQ ID NO: 8045836 - DNA, 23 bp, Homo sapiens
tggggccaagtgaggaagggtct

SEQ ID NO: 8045837 - DNA, 22 bp, Homo sapiens
tggggcagctccatctattcca

SEQ ID NO: 8045838 - DNA, 22 bp, Homo sapiens
tggggcagctccatctattcca

SEQ ID NO: 8045839 - DNA, 22 bp, Homo sapiens
tggggcagccacatagacaaca

SEQ ID NO: 8045840 - DNA, 22 bp, Homo sapiens
tggggaggaagtcagatttcag

SEQ ID NO: 8045841 - DNA, 22 bp, Homo sapiens
tggggcagggatgggaaactat

SEQ ID NO: 8045842 - DNA, 22 bp, Homo sapiens
ctctctggaagggggagctgat

SEQ ID NO: 8045843 - DNA, 22 bp, Homo sapiens
ctctctcttgtgttgctgcaga

SEQ ID NO: 8045844 - DNA, 22 bp, Homo sapiens
ctctctctatgcgttgttccta

SEQ ID NO: 8045845 - DNA, 20 bp, Homo sapiens
ctctctctccattcccaggg

SEQ ID NO: 8045846 - DNA, 22 bp, Homo sapiens
ctctccaggggtagatgccttc

SEQ ID NO: 8045847 - DNA, 22 bp, Homo sapiens
tttcacaggtaagcaatacagg

SEQ ID NO: 8045848 - DNA, 22 bp, Homo sapiens
tttcacagttagcatgaggact

SEQ ID NO: 8045849 - DNA, 22 bp, Homo sapiens
tttcacagtgctctgtaagtat

SEQ ID NO: 8045850 - DNA, 22 bp, Homo sapiens
tttcacagtcaatttggagtca

SEQ ID NO: 8045851 - DNA, 22 bp, Homo sapiens
tttcacatacagtgtatagtag

SEQ ID NO: 8045852 - DNA, 22 bp, Homo sapiens
ctcctggccacgttcttgctgg

SEQ ID NO: 8045853 - DNA, 22 bp, Homo sapiens
ctcctccacagagtccttgcca

SEQ ID NO: 8045854 - DNA, 22 bp, Homo sapiens
ctcctccacagacctactgaat

SEQ ID NO: 8045855 - DNA, 22 bp, Homo sapiens
tttaatatccagtggatacaaa

SEQ ID NO: 8045856 - DNA, 22 bp, Homo sapiens
tttaacagatgtgaaattttca

SEQ ID NO: 8045857 - DNA, 22 bp, Homo sapiens
ctcccaggactcagaggagaag

SEQ ID NO: 8045858 - DNA, 22 bp, Homo sapiens
ctcccagccttcgccagtctga

SEQ ID NO: 8045859 - DNA, 22 bp, Homo sapiens
ctcccagagaccaagctgagaa

SEQ ID NO: 8045860 - DNA, 22 bp, Homo sapiens
ttgtggggaacccctgtcccac

SEQ ID NO: 8045861 - DNA, 22 bp, Homo sapiens
ttgtcttttgtgggaaatatgg

SEQ ID NO: 8045862 - DNA, 22 bp, Homo sapiens
ttgaaatagatgcgtcagagat

SEQ ID NO: 8045863 - DNA, 22 bp, Homo sapiens
ttgaaagttaggatttagctgg

SEQ ID NO: 8045864 - DNA, 22 bp, Homo sapiens
ttgaaagtgatggggaagatgg

SEQ ID NO: 8045865 - DNA, 22 bp, Homo sapiens
ttgaaagtaataactttgttca

SEQ ID NO: 8045866 - DNA, 22 bp, Homo sapiens
ttgaaagtctaggcttacagta

SEQ ID NO: 8045867 - DNA, 21 bp, Homo sapiens
ttgaaagtaaattcagcagct

SEQ ID NO: 8045868 - DNA, 22 bp, Homo sapiens
ttcttttcggcctgtgagaagg

SEQ ID NO: 8045869 - DNA, 22 bp, Homo sapiens
ttcttttcctacacagcgattt

SEQ ID NO: 8045870 - DNA, 22 bp, Homo sapiens
ttcttttcctacacagcgattt

SEQ ID NO: 8045871 - DNA, 18 bp, Homo sapiens
ttcttttcatgtgatctc

SEQ ID NO: 8045872 - DNA, 22 bp, Homo sapiens
ttcttttcccaatattttgctg

SEQ ID NO: 8045873 - DNA, 22 bp, Homo sapiens
ttcttttagtcattcagggaag

SEQ ID NO: 8045874 - DNA, 22 bp, Homo sapiens
ttcttttagaatttcctaaggt

SEQ ID NO: 8045875 - DNA, 22 bp, Homo sapiens
ttcttttacattaagatttcag

SEQ ID NO: 8045876 - DNA, 22 bp, Homo sapiens
ttctttcttagcaatctatggt

SEQ ID NO: 8045877 - DNA, 22 bp, Homo sapiens
ttcttttaatttctgtctgcag

SEQ ID NO: 8045878 - DNA, 22 bp, Homo sapiens
ctccacagcccctccagtggca

SEQ ID NO: 8045879 - DNA, 22 bp, Homo sapiens
ctctgcccagtgcccacaggag

SEQ ID NO: 8045880 - DNA, 22 bp, Homo sapiens
ctctgcccgcggatgccacgtc

SEQ ID NO: 8045881 - DNA, 22 bp, Homo sapiens
tttgcattttgataagatcact

SEQ ID NO: 8045882 - DNA, 19 bp, Homo sapiens
ctctgcctccctcctgggt

SEQ ID NO: 8045883 - DNA, 19 bp, Homo sapiens
ctctgcctccctcctgggt

SEQ ID NO: 8045884 - DNA, 22 bp, Homo sapiens
ctctgccagtttctggcctcag

SEQ ID NO: 8045885 - DNA, 20 bp, Homo sapiens
ctctgcagcaaggcctgggt

SEQ ID NO: 8045886 - DNA, 22 bp, Homo sapiens
tttgggaataattgcacagatt

SEQ ID NO: 8045887 - DNA, 22 bp, Homo sapiens
tttgctctgacagtgccagaga

SEQ ID NO: 8045888 - DNA, 22 bp, Homo sapiens
ttttagttactgcagtagcaaa

SEQ ID NO: 8045889 - DNA, 22 bp, Homo sapiens
ttttagttactgcagtagcaaa

SEQ ID NO: 8045890 - DNA, 22 bp, Homo sapiens
ctctttactgctactacaaaga

SEQ ID NO: 8045891 - DNA, 22 bp, Homo sapiens
ttttcacttaaggaatttcatg

SEQ ID NO: 8045892 - DNA, 22 bp, Homo sapiens
ttttcagaaagatgagaaatta

SEQ ID NO: 8045893 - DNA, 20 bp, Homo sapiens
ctgagcccccagcctgcagg

SEQ ID NO: 8045894 - DNA, 22 bp, Homo sapiens
ctgagccagtagtcagggacaa

SEQ ID NO: 8045895 - DNA, 20 bp, Homo sapiens
ctgagccaactctcttcttg

SEQ ID NO: 8045896 - DNA, 22 bp, Homo sapiens
ctgagccataagggaggctggg

SEQ ID NO: 8045897 - DNA, 22 bp, Homo sapiens
ctgagccataagggaggctggg

SEQ ID NO: 8045898 - DNA, 22 bp, Homo sapiens
ctgactcccaagctagtgctct

SEQ ID NO: 8045899 - DNA, 23 bp, Homo sapiens
ctgactcatcccaccacctcctc

SEQ ID NO: 8045900 - DNA, 22 bp, Homo sapiens
ctgactccttaccatatgcttt

SEQ ID NO: 8045901 - DNA, 22 bp, Homo sapiens
ctctttgaaatccatcactgct

SEQ ID NO: 8045902 - DNA, 21 bp, Homo sapiens
ctctttatatagtaaagatat

SEQ ID NO: 8045903 - DNA, 17 bp, Homo sapiens
ctctttataaagagtta

SEQ ID NO: 8045904 - DNA, 22 bp, Homo sapiens
ctgaatcatggtcattagttta

SEQ ID NO: 8045905 - DNA, 22 bp, Homo sapiens
ctgacagatgctgctggcagta

SEQ ID NO: 8045906 - DNA, 22 bp, Homo sapiens
ctgacaggctgagatccctggt

SEQ ID NO: 8045907 - DNA, 22 bp, Homo sapiens
ctgacaggttggtagctttgga

SEQ ID NO: 8045908 - DNA, 22 bp, Homo sapiens
ctgcaccgtgtctcgggctgcc

SEQ ID NO: 8045909 - DNA, 22 bp, Homo sapiens
ctgcagggatgtgaggcccgtt

SEQ ID NO: 8045910 - DNA, 22 bp, Homo sapiens
ctgcagggagcagatggcgtgt

SEQ ID NO: 8045911 - DNA, 22 bp, Homo sapiens
ctgcaggctcgaagacacggat

SEQ ID NO: 8045912 - DNA, 22 bp, Homo sapiens
ctgcaggcccccttcctggagt

SEQ ID NO: 8045913 - DNA, 22 bp, Homo sapiens
ctgcagggcccgcctgagccct

SEQ ID NO: 8045914 - DNA, 22 bp, Homo sapiens
ctgcagggcttaccttgctctg

SEQ ID NO: 8045915 - DNA, 22 bp, Homo sapiens
ctgcagggcttaccttgctctg

SEQ ID NO: 8045916 - DNA, 22 bp, Homo sapiens
ctgcaggggcctcgagcacagg

SEQ ID NO: 8045917 - DNA, 19 bp, Homo sapiens
ctgcagggatgtgcagagt

SEQ ID NO: 8045918 - DNA, 22 bp, Homo sapiens
ctgcagggcagggcctcctggc

SEQ ID NO: 8045919 - DNA, 22 bp, Homo sapiens
ctgcacagcctgtctgggggcc

SEQ ID NO: 8045920 - DNA, 22 bp, Homo sapiens
ctgcacagagcagggcagacac

SEQ ID NO: 8045921 - DNA, 22 bp, Homo sapiens
ctgaggccagctgcagagctct

SEQ ID NO: 8045922 - DNA, 17 bp, Homo sapiens
ctgaggcccagggccca

SEQ ID NO: 8045923 - DNA, 18 bp, Homo sapiens
ctgaggcccagagagggc

SEQ ID NO: 8045924 - DNA, 18 bp, Homo sapiens
tcctggcagtcagagagg

SEQ ID NO: 8045925 - DNA, 22 bp, Homo sapiens
tcctggcagtcaaataaccttg

SEQ ID NO: 8045926 - DNA, 22 bp, Homo sapiens
tcctggcaggtctgagaggtct

SEQ ID NO: 8045927 - DNA, 22 bp, Homo sapiens
tcctggcaggtcagcaggagca

SEQ ID NO: 8045928 - DNA, 22 bp, Homo sapiens
tcctggcagggtggcagcgggt

SEQ ID NO: 8045929 - DNA, 21 bp, Homo sapiens
tcctggcaggcccaggaccct

SEQ ID NO: 8045930 - DNA, 22 bp, Homo sapiens
ccacactgaccagctgtgagac

SEQ ID NO: 8045931 - DNA, 22 bp, Homo sapiens
ccacagaaaataaagcacgatt

SEQ ID NO: 8045932 - DNA, 22 bp, Homo sapiens
ccacactgtctaacaaggcata

SEQ ID NO: 8045933 - DNA, 22 bp, Homo sapiens
ccacactgaacctcagtgtctt

SEQ ID NO: 8045934 - DNA, 22 bp, Homo sapiens
ccacactaaactgctcaaacca

SEQ ID NO: 8045935 - DNA, 19 bp, Homo sapiens
ccacacagtgtgcaattta

SEQ ID NO: 8045936 - DNA, 22 bp, Homo sapiens
ccacacagtcagtttccaagaa

SEQ ID NO: 8045937 - DNA, 22 bp, Homo sapiens
ccacacagggggatgagttatt

SEQ ID NO: 8045938 - DNA, 22 bp, Homo sapiens
tcctgggcttaagtgatcctcc

SEQ ID NO: 8045939 - DNA, 20 bp, Homo sapiens
tcctaataacctgaagaaat

SEQ ID NO: 8045940 - DNA, 22 bp, Homo sapiens
ccaaggccacaaacagcctggc

SEQ ID NO: 8045941 - DNA, 22 bp, Homo sapiens
ccaaggccatcaggtaggtcct

SEQ ID NO: 8045942 - DNA, 22 bp, Homo sapiens
ccaaggcacactctgcaaggtt

SEQ ID NO: 8045943 - DNA, 22 bp, Homo sapiens
ccaaggagtagagcaggaagct

SEQ ID NO: 8045944 - DNA, 22 bp, Homo sapiens
tcctggaggagatccaatctga

SEQ ID NO: 8045945 - DNA, 22 bp, Homo sapiens
tcctggaggacagaggcatctc

SEQ ID NO: 8045946 - DNA, 22 bp, Homo sapiens
ccaagggaaaccgagaggctgg

SEQ ID NO: 8045947 - DNA, 18 bp, Homo sapiens
ccaaggcccctgctgggg

SEQ ID NO: 8045948 - DNA, 22 bp, Homo sapiens
ccaaggcccctgtggtctagcc

SEQ ID NO: 8045949 - DNA, 22 bp, Homo sapiens
ccaaggctcctcagctggtctt

SEQ ID NO: 8045950 - DNA, 22 bp, Homo sapiens
ccaaggctgtggggctgtgcag

SEQ ID NO: 8045951 - DNA, 22 bp, Homo sapiens
ccaaggctggagtgcagtggcg

SEQ ID NO: 8045952 - DNA, 22 bp, Homo sapiens
tccttcctgctctaacattcag

SEQ ID NO: 8045953 - DNA, 22 bp, Homo sapiens
tccttcctgcaggccaagtcct

SEQ ID NO: 8045954 - DNA, 20 bp, Homo sapiens
tcctttactgttggggttgg

SEQ ID NO: 8045955 - DNA, 22 bp, Homo sapiens
ccactgctaacttgctgcagct

SEQ ID NO: 8045956 - DNA, 22 bp, Homo sapiens
ccactgtgagcatgaacaggac

SEQ ID NO: 8045957 - DNA, 22 bp, Homo sapiens
ccactgtgcccagcctcatggg

SEQ ID NO: 8045958 - DNA, 22 bp, Homo sapiens
ccactgtgtccaccaggaatgc

SEQ ID NO: 8045959 - DNA, 22 bp, Homo sapiens
ccactgtggaaagcagttcaga

SEQ ID NO: 8045960 - DNA, 22 bp, Homo sapiens
ccactgtgtccaccaggaatgc

SEQ ID NO: 8045961 - DNA, 22 bp, Homo sapiens
ccagacagttccttgaggttca

SEQ ID NO: 8045962 - DNA, 18 bp, Homo sapiens
tccctcctgcctgcttcc

SEQ ID NO: 8045963 - DNA, 22 bp, Homo sapiens
tccctcctgcatgaggctcggc

SEQ ID NO: 8045964 - DNA, 22 bp, Homo sapiens
catttaatctggctcatgagca

SEQ ID NO: 8045965 - DNA, 18 bp, Homo sapiens
cattgtttccagaagacc

SEQ ID NO: 8045966 - DNA, 22 bp, Homo sapiens
cattgtattgaggatacttaag

SEQ ID NO: 8045967 - DNA, 22 bp, Homo sapiens
tccctggggtatcgctgaggca

SEQ ID NO: 8045968 - DNA, 22 bp, Homo sapiens
tccctgggtcctgcttgctctc

SEQ ID NO: 8045969 - DNA, 22 bp, Homo sapiens
tccctctctggctggggtgcgg

SEQ ID NO: 8045970 - DNA, 22 bp, Homo sapiens
catttattcagctcagtcggtt

SEQ ID NO: 8045971 - DNA, 22 bp, Homo sapiens
catttattagttagttcgatgt

SEQ ID NO: 8045972 - DNA, 22 bp, Homo sapiens
tccctctccctattgcctggag

SEQ ID NO: 8045973 - DNA, 22 bp, Homo sapiens
catttattcatgatctgtagct

SEQ ID NO: 8045974 - DNA, 22 bp, Homo sapiens
catttattctcagatccttgtc

SEQ ID NO: 8045975 - DNA, 22 bp, Homo sapiens
catttattcatttgctagggct

SEQ ID NO: 8045976 - DNA, 22 bp, Homo sapiens
catgggcccgtgagaggcaggg

SEQ ID NO: 8045977 - DNA, 22 bp, Homo sapiens
tccattttagaagaaaatccac

SEQ ID NO: 8045978 - DNA, 22 bp, Homo sapiens
tccattttagagatgaagaaac

SEQ ID NO: 8045979 - DNA, 22 bp, Homo sapiens
catgggctctctgagctccagg

SEQ ID NO: 8045980 - DNA, 22 bp, Homo sapiens
catgggaggcctgctgctggtg

SEQ ID NO: 8045981 - DNA, 22 bp, Homo sapiens
catgggaggtctgcaaggtgct

SEQ ID NO: 8045982 - DNA, 22 bp, Homo sapiens
tcccacattaccctgactgaca

SEQ ID NO: 8045983 - DNA, 22 bp, Homo sapiens
tcccacatgtgaatcctcaggt

SEQ ID NO: 8045984 - DNA, 22 bp, Homo sapiens
cattctgagtcactctttagca

SEQ ID NO: 8045985 - DNA, 22 bp, Homo sapiens
cattctctacactcctgccctg

SEQ ID NO: 8045986 - DNA, 22 bp, Homo sapiens
cattacatctttgatgcagtat

SEQ ID NO: 8045987 - DNA, 22 bp, Homo sapiens
cattacatttcaaaatgtttcc

SEQ ID NO: 8045988 - DNA, 22 bp, Homo sapiens
cataacatccttgctactttga

SEQ ID NO: 8045989 - DNA, 22 bp, Homo sapiens
cataatgtctgacacagtaaga

SEQ ID NO: 8045990 - DNA, 22 bp, Homo sapiens
cataatgtatgcattttccagc

SEQ ID NO: 8045991 - DNA, 22 bp, Homo sapiens
tcagcaggtgaacatcatgcca

SEQ ID NO: 8045992 - DNA, 22 bp, Homo sapiens
tcagcaggtctgaggcggggcc

SEQ ID NO: 8045993 - DNA, 22 bp, Homo sapiens
tcagcagggtttgacttctaat

SEQ ID NO: 8045994 - DNA, 22 bp, Homo sapiens
tcagcaggtgcctcagattctt

SEQ ID NO: 8045995 - DNA, 22 bp, Homo sapiens
tcagcaggtgctttgtttactc

SEQ ID NO: 8045996 - DNA, 22 bp, Homo sapiens
tcagcaggtggtgggcaggtga

SEQ ID NO: 8045997 - DNA, 22 bp, Homo sapiens
tcagcaggtggtgggcaggtga

SEQ ID NO: 8045998 - DNA, 22 bp, Homo sapiens
cataatgttaatcttgactcca

SEQ ID NO: 8045999 - DNA, 22 bp, Homo sapiens
cataatgtgtgtcatacagact

SEQ ID NO: 8046000 - DNA, 22 bp, Homo sapiens
cataatgttgtaacacatagag

SEQ ID NO: 8046001 - DNA, 22 bp, Homo sapiens
cataattaggcagttgatcatt

SEQ ID NO: 8046002 - DNA, 22 bp, Homo sapiens
tcaggcccagagtcacggatcc

SEQ ID NO: 8046003 - DNA, 22 bp, Homo sapiens
tcaggcagagttaatttgctcc

SEQ ID NO: 8046004 - DNA, 22 bp, Homo sapiens
tcaggcagagtggaagctgcaa

SEQ ID NO: 8046005 - DNA, 22 bp, Homo sapiens
tcaggccccttgtcagctctgt

SEQ ID NO: 8046006 - DNA, 22 bp, Homo sapiens
tcaggccccatcccagacttat

SEQ ID NO: 8046007 - DNA, 22 bp, Homo sapiens
tcaggcctagaacacagcagat

SEQ ID NO: 8046008 - DNA, 22 bp, Homo sapiens
tcaggcctagggagaaaattca

SEQ ID NO: 8046009 - DNA, 22 bp, Homo sapiens
tcaggcctagggagccacacca

SEQ ID NO: 8046010 - DNA, 22 bp, Homo sapiens
tcaggcctcagcagcccacagg

SEQ ID NO: 8046011 - DNA, 22 bp, Homo sapiens
tcaggcctcaagctgctttaag

SEQ ID NO: 8046012 - DNA, 22 bp, Homo sapiens
catagaaatcaggtgagaatct

SEQ ID NO: 8046013 - DNA, 22 bp, Homo sapiens
tcagggagaggtgagagcctgt

SEQ ID NO: 8046014 - DNA, 22 bp, Homo sapiens
tcaggctgttagccacctcctc

SEQ ID NO: 8046015 - DNA, 22 bp, Homo sapiens
tcaggctgtgggcactggccat

SEQ ID NO: 8046016 - DNA, 17 bp, Homo sapiens
tcaggctgtgcctggta

SEQ ID NO: 8046017 - DNA, 22 bp, Homo sapiens
tcagagagtgcaaaatatagct

SEQ ID NO: 8046018 - DNA, 22 bp, Homo sapiens
tcagagcaaattcctgtgagcc

SEQ ID NO: 8046019 - DNA, 22 bp, Homo sapiens
tcagatatgaattcatatctct

SEQ ID NO: 8046020 - DNA, 22 bp, Homo sapiens
tcagatatagtcatttaaataa

SEQ ID NO: 8046021 - DNA, 22 bp, Homo sapiens
cagttttctaaagtctctttaa

SEQ ID NO: 8046022 - DNA, 22 bp, Homo sapiens
cagttttaaattgttagataat

SEQ ID NO: 8046023 - DNA, 22 bp, Homo sapiens
catggaaggcaaaagacacaga

SEQ ID NO: 8046024 - DNA, 22 bp, Homo sapiens
catggcagagcctgcaggtggg

SEQ ID NO: 8046025 - DNA, 23 bp, Homo sapiens
catggcagcaagagctcatggcc

SEQ ID NO: 8046026 - DNA, 22 bp, Homo sapiens
catggcagctcctccagtgtga

SEQ ID NO: 8046027 - DNA, 22 bp, Homo sapiens
catggcagcctgccctgcttgc

SEQ ID NO: 8046028 - DNA, 22 bp, Homo sapiens
catggcagctttgggaggagga

SEQ ID NO: 8046029 - DNA, 22 bp, Homo sapiens
catggcagctttgggaggagga

SEQ ID NO: 8046030 - DNA, 22 bp, Homo sapiens
catggccacatctagctgcaag

SEQ ID NO: 8046031 - DNA, 22 bp, Homo sapiens
catggcaggaggctgctggcag

SEQ ID NO: 8046032 - DNA, 22 bp, Homo sapiens
catggcaggatctgggcccaca

SEQ ID NO: 8046033 - DNA, 22 bp, Homo sapiens
catggcaggatctgggcccaca

SEQ ID NO: 8046034 - DNA, 22 bp, Homo sapiens
catggcagggctgtgggcaggt

SEQ ID NO: 8046035 - DNA, 22 bp, Homo sapiens
catggcagtgattcagcctttg

SEQ ID NO: 8046036 - DNA, 22 bp, Homo sapiens
catgcaggcctatggagcagtg

SEQ ID NO: 8046037 - DNA, 22 bp, Homo sapiens
catgcagggactagagaacagg

SEQ ID NO: 8046038 - DNA, 22 bp, Homo sapiens
catgcagggacttgtgctccat

SEQ ID NO: 8046039 - DNA, 22 bp, Homo sapiens
catgcaggtctggagcttgggg

SEQ ID NO: 8046040 - DNA, 22 bp, Homo sapiens
catgcagggagcagaggagaca

SEQ ID NO: 8046041 - DNA, 22 bp, Homo sapiens
catgcagggagcagaggagaca

SEQ ID NO: 8046042 - DNA, 22 bp, Homo sapiens
catgcaggtgaccaggtgtggg

SEQ ID NO: 8046043 - DNA, 22 bp, Homo sapiens
catgcaggttatatgtgcttct

SEQ ID NO: 8046044 - DNA, 22 bp, Homo sapiens
tcagtgccaattctgccatggg

SEQ ID NO: 8046045 - DNA, 22 bp, Homo sapiens
tcagtgccatgggcagacaggc

SEQ ID NO: 8046046 - DNA, 22 bp, Homo sapiens
tcagtgctgctttatgacagtt

SEQ ID NO: 8046047 - DNA, 22 bp, Homo sapiens
tcagtgctgccatggcagggcc

SEQ ID NO: 8046048 - DNA, 19 bp, Homo sapiens
tcagtgctcctatgtcctt

SEQ ID NO: 8046049 - DNA, 22 bp, Homo sapiens
tcagtgctaaaagagctggtgt

SEQ ID NO: 8046050 - DNA, 22 bp, Homo sapiens
tcaggtgtattgatgtctgtga

SEQ ID NO: 8046051 - DNA, 22 bp, Homo sapiens
tcaggtgtatcatggagttgaa

SEQ ID NO: 8046052 - DNA, 22 bp, Homo sapiens
tcagtatttctaaacattggct

SEQ ID NO: 8046053 - DNA, 22 bp, Homo sapiens
tcagtattgctagagttcactg

SEQ ID NO: 8046054 - DNA, 22 bp, Homo sapiens
tcagggaggtgtctgccagaga

SEQ ID NO: 8046055 - DNA, 22 bp, Homo sapiens
tcagggaggtgtctgccagaga

SEQ ID NO: 8046056 - DNA, 22 bp, Homo sapiens
tcagggagcctggacttcaagg

SEQ ID NO: 8046057 - DNA, 22 bp, Homo sapiens
tcagggagatttggggactcaa

SEQ ID NO: 8046058 - DNA, 22 bp, Homo sapiens
tcagggagggacctgaggctgg

SEQ ID NO: 8046059 - DNA, 22 bp, Homo sapiens
catctgcctaagtggccctgtt

SEQ ID NO: 8046060 - DNA, 22 bp, Homo sapiens
catctgaataaagacttgcaga

SEQ ID NO: 8046061 - DNA, 22 bp, Homo sapiens
catgaacatttgtttacatctg

SEQ ID NO: 8046062 - DNA, 22 bp, Homo sapiens
taatatttctaccctgctgcct

SEQ ID NO: 8046063 - DNA, 22 bp, Homo sapiens
taatgtaaagaagatgtaggaa

SEQ ID NO: 8046064 - DNA, 22 bp, Homo sapiens
taatgtataacaaatactcatc

SEQ ID NO: 8046065 - DNA, 20 bp, Homo sapiens
taatgtcaaagtcacaaggt

SEQ ID NO: 8046066 - DNA, 22 bp, Homo sapiens
taatgtcaaggtcattctagag

SEQ ID NO: 8046067 - DNA, 22 bp, Homo sapiens
taatgtcaaggtgatagatttg

SEQ ID NO: 8046068 - DNA, 22 bp, Homo sapiens
caggcatggagaggcagagact

SEQ ID NO: 8046069 - DNA, 22 bp, Homo sapiens
caggcatgggccatgggaagtg

SEQ ID NO: 8046070 - DNA, 22 bp, Homo sapiens
caggcatggatctggaatcatt

SEQ ID NO: 8046071 - DNA, 22 bp, Homo sapiens
caggcatggagaggcagagact

SEQ ID NO: 8046072 - DNA, 22 bp, Homo sapiens
caggcagggagctggaaaggat

SEQ ID NO: 8046073 - DNA, 22 bp, Homo sapiens
caggcatgtggcccaggggtga

SEQ ID NO: 8046074 - DNA, 22 bp, Homo sapiens
caggcatgggccatgggaagtg

SEQ ID NO: 8046075 - DNA, 22 bp, Homo sapiens
tacaaaaaattgatactgacga

SEQ ID NO: 8046076 - DNA, 22 bp, Homo sapiens
caggccagagcgcgtggttggg

SEQ ID NO: 8046077 - DNA, 19 bp, Homo sapiens
caggccagtgtcagggggc

SEQ ID NO: 8046078 - DNA, 19 bp, Homo sapiens
caggccagtgtcagggggc

SEQ ID NO: 8046079 - DNA, 22 bp, Homo sapiens
caggccagggttgagaagagaa

SEQ ID NO: 8046080 - DNA, 22 bp, Homo sapiens
caggcccaagactgatgagtct

SEQ ID NO: 8046081 - DNA, 22 bp, Homo sapiens
caggcccacgaggcacacagag

SEQ ID NO: 8046082 - DNA, 22 bp, Homo sapiens
caggcccactgcttgtctagtc

SEQ ID NO: 8046083 - DNA, 22 bp, Homo sapiens
caggcccagaggcctcttccca

SEQ ID NO: 8046084 - DNA, 22 bp, Homo sapiens
caggcccaaatgcaaccttctt

SEQ ID NO: 8046085 - DNA, 22 bp, Homo sapiens
caggccagtgtgcttcccaggc

SEQ ID NO: 8046086 - DNA, 22 bp, Homo sapiens
caggcagagttagagcaactgg

SEQ ID NO: 8046087 - DNA, 22 bp, Homo sapiens
caggcaccagtgagaagggcct

SEQ ID NO: 8046088 - DNA, 22 bp, Homo sapiens
caggcaccctctgaggggaagc

SEQ ID NO: 8046089 - DNA, 22 bp, Homo sapiens
caggcagcagaggagtgtggga

SEQ ID NO: 8046090 - DNA, 22 bp, Homo sapiens
gtgctgttttaagtgttcttat

SEQ ID NO: 8046091 - DNA, 22 bp, Homo sapiens
taagtcatcccataacagtgct

SEQ ID NO: 8046092 - DNA, 22 bp, Homo sapiens
cagggacagagactgcaccttg

SEQ ID NO: 8046093 - DNA, 22 bp, Homo sapiens
cagggacaatggcagagcctga

SEQ ID NO: 8046094 - DNA, 22 bp, Homo sapiens
tagatacaggctctctgagcct

SEQ ID NO: 8046095 - DNA, 22 bp, Homo sapiens
tagattcagatatttaggacaa

SEQ ID NO: 8046096 - DNA, 22 bp, Homo sapiens
caggcttggcagggaggctggt

SEQ ID NO: 8046097 - DNA, 22 bp, Homo sapiens
caggctgtctgaatggaggccc

SEQ ID NO: 8046098 - DNA, 22 bp, Homo sapiens
cagggaaactaggaaataagct

SEQ ID NO: 8046099 - DNA, 22 bp, Homo sapiens
tagaaaatagggcctgtggagc

SEQ ID NO: 8046100 - DNA, 22 bp, Homo sapiens
tagaaaatccagtgtggggaga

SEQ ID NO: 8046101 - DNA, 22 bp, Homo sapiens
tagaaaatggccaagcaggact

SEQ ID NO: 8046102 - DNA, 22 bp, Homo sapiens
tagaaaatgttccactgccatt

SEQ ID NO: 8046103 - DNA, 22 bp, Homo sapiens
caggctgggactgacccctgct

SEQ ID NO: 8046104 - DNA, 22 bp, Homo sapiens
caggctgcagtgcagtggctat

SEQ ID NO: 8046105 - DNA, 22 bp, Homo sapiens
caggctgccaaggctggggagg

SEQ ID NO: 8046106 - DNA, 22 bp, Homo sapiens
caggctgccaaggctggggagg

SEQ ID NO: 8046107 - DNA, 22 bp, Homo sapiens
caggctgccgaggctgcagaat

SEQ ID NO: 8046108 - DNA, 22 bp, Homo sapiens
caggctgccctagcttggacat

SEQ ID NO: 8046109 - DNA, 22 bp, Homo sapiens
caggctgccgtgaagcaggcct

SEQ ID NO: 8046110 - DNA, 22 bp, Homo sapiens
caggctggagtgcagtggtgcc

SEQ ID NO: 8046111 - DNA, 22 bp, Homo sapiens
caggctggagttcagtggtgtg

SEQ ID NO: 8046112 - DNA, 22 bp, Homo sapiens
caggctgccgtggggtccaggc

SEQ ID NO: 8046113 - DNA, 22 bp, Homo sapiens
caggctggagttcagtggtgtg

SEQ ID NO: 8046114 - DNA, 22 bp, Homo sapiens
caggcgggacgtgggaggatca

SEQ ID NO: 8046115 - DNA, 22 bp, Homo sapiens
caggcgggacgtgggaggatca

SEQ ID NO: 8046116 - DNA, 18 bp, Homo sapiens
caggcctttgagacagaa

SEQ ID NO: 8046117 - DNA, 22 bp, Homo sapiens
caggcctttctggggaagtgag

SEQ ID NO: 8046118 - DNA, 22 bp, Homo sapiens
tactgtgggatgttgtgattag

SEQ ID NO: 8046119 - DNA, 18 bp, Homo sapiens
tactgtggatcaggggtt

SEQ ID NO: 8046120 - DNA, 22 bp, Homo sapiens
caggctagattggggccagtag

SEQ ID NO: 8046121 - DNA, 22 bp, Homo sapiens
tactgtggttactgctattaga

SEQ ID NO: 8046122 - DNA, 22 bp, Homo sapiens
tactgtggggatattgattgta

SEQ ID NO: 8046123 - DNA, 22 bp, Homo sapiens
tactgtggtaacattttaaatt

SEQ ID NO: 8046124 - DNA, 22 bp, Homo sapiens
tactttatcagcgtcaaaggta

SEQ ID NO: 8046125 - DNA, 22 bp, Homo sapiens
tactttatattgtggctggcca

SEQ ID NO: 8046126 - DNA, 22 bp, Homo sapiens
tactttattcaggaaggctggt

SEQ ID NO: 8046127 - DNA, 18 bp, Homo sapiens
tactttattccccctcca

SEQ ID NO: 8046128 - DNA, 22 bp, Homo sapiens
tactttattgtaaatgctgatg

SEQ ID NO: 8046129 - DNA, 22 bp, Homo sapiens
caggcccagcccagcccttcga

SEQ ID NO: 8046130 - DNA, 22 bp, Homo sapiens
caggcccagcccttagccaggt

SEQ ID NO: 8046131 - DNA, 22 bp, Homo sapiens
caggcccaggccagtggttccc

SEQ ID NO: 8046132 - DNA, 22 bp, Homo sapiens
caggcctcctatgagcactagc

SEQ ID NO: 8046133 - DNA, 22 bp, Homo sapiens
caggcctcgaggagacagctac

SEQ ID NO: 8046134 - DNA, 22 bp, Homo sapiens
caggccgggcactgcgctaggt

SEQ ID NO: 8046135 - DNA, 22 bp, Homo sapiens
caggcccagggagggagaccaa

SEQ ID NO: 8046136 - DNA, 22 bp, Homo sapiens
caggcccagggagggagaccaa

SEQ ID NO: 8046137 - DNA, 22 bp, Homo sapiens
caggcctctccttagtctggca

SEQ ID NO: 8046138 - DNA, 22 bp, Homo sapiens
caggcctctatggtcagctgag

SEQ ID NO: 8046139 - DNA, 20 bp, Homo sapiens
caggcctctgggggccctgg

SEQ ID NO: 8046140 - DNA, 19 bp, Homo sapiens
caggcctctggtctgctgt

SEQ ID NO: 8046141 - DNA, 19 bp, Homo sapiens
caggcctcttaccctctct

SEQ ID NO: 8046142 - DNA, 18 bp, Homo sapiens
caggcctcttgatcttcc

SEQ ID NO: 8046143 - DNA, 22 bp, Homo sapiens
caggcctgaccctgagcttcac

SEQ ID NO: 8046144 - DNA, 22 bp, Homo sapiens
caggcctcttccatgcagcagc

SEQ ID NO: 8046145 - DNA, 22 bp, Homo sapiens
caggcctgagacatctgagata

SEQ ID NO: 8046146 - DNA, 22 bp, Homo sapiens
caggcctgagtgtggaagtctt

SEQ ID NO: 8046147 - DNA, 22 bp, Homo sapiens
caggcctgcttcttacccttca

SEQ ID NO: 8046148 - DNA, 22 bp, Homo sapiens
caggcctgcaggaaaggctccc

SEQ ID NO: 8046149 - DNA, 22 bp, Homo sapiens
tatttgaagattcttctgatgt

SEQ ID NO: 8046150 - DNA, 20 bp, Homo sapiens
tatttgaaatggccaagtgt

SEQ ID NO: 8046151 - DNA, 19 bp, Homo sapiens
caggtggtaatctgagcct

SEQ ID NO: 8046152 - DNA, 23 bp, Homo sapiens
caggtggtagagaaaaatccaga

SEQ ID NO: 8046153 - DNA, 22 bp, Homo sapiens
caggtggtcaggcaaggacacg

SEQ ID NO: 8046154 - DNA, 22 bp, Homo sapiens
caggtggtacttaaagtcagaa

SEQ ID NO: 8046155 - DNA, 22 bp, Homo sapiens
cagtcacataggtatacacata

SEQ ID NO: 8046156 - DNA, 22 bp, Homo sapiens
cagtcactccagcctgcctcag

SEQ ID NO: 8046157 - DNA, 22 bp, Homo sapiens
tcaaaaattttctgaggatgag

SEQ ID NO: 8046158 - DNA, 22 bp, Homo sapiens
caggtagtccacagtgagggag

SEQ ID NO: 8046159 - DNA, 22 bp, Homo sapiens
caggtagctgctggccatgtac

SEQ ID NO: 8046160 - DNA, 22 bp, Homo sapiens
caggtgcctcaggatgagacaa

SEQ ID NO: 8046161 - DNA, 22 bp, Homo sapiens
caggtgctgtcctgcacatgtc

SEQ ID NO: 8046162 - DNA, 22 bp, Homo sapiens
caggtccacagcccatcactgc

SEQ ID NO: 8046163 - DNA, 22 bp, Homo sapiens
caggtgcccagctcctgctgtg

SEQ ID NO: 8046164 - DNA, 22 bp, Homo sapiens
caggtcagctggtgccccaggt

SEQ ID NO: 8046165 - DNA, 22 bp, Homo sapiens
tattatatttagtaatgtggag

SEQ ID NO: 8046166 - DNA, 18 bp, Homo sapiens
caggtgggtctcctgccc

SEQ ID NO: 8046167 - DNA, 22 bp, Homo sapiens
caggtgggtacatcacagagac

SEQ ID NO: 8046168 - DNA, 22 bp, Homo sapiens
caggtggccagtactcaaggat

SEQ ID NO: 8046169 - DNA, 22 bp, Homo sapiens
caggtggcagaggtctctggaa

SEQ ID NO: 8046170 - DNA, 22 bp, Homo sapiens
cagggagcagcgctggggcctc

SEQ ID NO: 8046171 - DNA, 22 bp, Homo sapiens
cagggagcaggctctgtccatc

SEQ ID NO: 8046172 - DNA, 22 bp, Homo sapiens
cagggagcactgcgagcggcag

SEQ ID NO: 8046173 - DNA, 22 bp, Homo sapiens
cagggagcagcatgggcaaagg

SEQ ID NO: 8046174 - DNA, 22 bp, Homo sapiens
cagggagcagcatgggcaaagg

SEQ ID NO: 8046175 - DNA, 22 bp, Homo sapiens
cagggagcagcccctagaagta

SEQ ID NO: 8046176 - DNA, 22 bp, Homo sapiens
cagggccaggctgatggcctgg

SEQ ID NO: 8046177 - DNA, 22 bp, Homo sapiens
cagggccactgtagatgaggag

SEQ ID NO: 8046178 - DNA, 22 bp, Homo sapiens
cagggccagttctcgcagcagt

SEQ ID NO: 8046179 - DNA, 22 bp, Homo sapiens
cagggccagttctcgcagcagt

SEQ ID NO: 8046180 - DNA, 22 bp, Homo sapiens
cagggccatatcttgtgcacca

SEQ ID NO: 8046181 - DNA, 22 bp, Homo sapiens
cagggccatgaggcacagggtc

SEQ ID NO: 8046182 - DNA, 22 bp, Homo sapiens
cagggccatgaggcacagggtc

SEQ ID NO: 8046183 - DNA, 20 bp, Homo sapiens
cagggcctaagagctgaaaa

SEQ ID NO: 8046184 - DNA, 20 bp, Homo sapiens
cagggcctatgattgagctt

SEQ ID NO: 8046185 - DNA, 22 bp, Homo sapiens
cagggcctcattgtcagtcctg

SEQ ID NO: 8046186 - DNA, 22 bp, Homo sapiens
cagggctccatgcagggactcc

SEQ ID NO: 8046187 - DNA, 22 bp, Homo sapiens
cagggctccatgcagggactcc

SEQ ID NO: 8046188 - DNA, 22 bp, Homo sapiens
tagctttaagacatggtgaatg

SEQ ID NO: 8046189 - DNA, 22 bp, Homo sapiens
tagcttctcataatttatgctg

SEQ ID NO: 8046190 - DNA, 22 bp, Homo sapiens
cagggtagacagtaggtgtctg

SEQ ID NO: 8046191 - DNA, 22 bp, Homo sapiens
caggggtggctgcagcagaggt

SEQ ID NO: 8046192 - DNA, 22 bp, Homo sapiens
caggggtgtttttggccaggag

SEQ ID NO: 8046193 - DNA, 22 bp, Homo sapiens
caggggtgtttttggccaggag

SEQ ID NO: 8046194 - DNA, 22 bp, Homo sapiens
cagggtcaggctgctagaagct

SEQ ID NO: 8046195 - DNA, 22 bp, Homo sapiens
cagggtggggctggctatcaaa

SEQ ID NO: 8046196 - DNA, 17 bp, Homo sapiens
cagggctgtctgcctag

SEQ ID NO: 8046197 - DNA, 22 bp, Homo sapiens
cagggctgtgcccatcttcccc

SEQ ID NO: 8046198 - DNA, 22 bp, Homo sapiens
cagggctgtggaaaactggtgc

SEQ ID NO: 8046199 - DNA, 22 bp, Homo sapiens
cagggctgtggaaaactggtgc

SEQ ID NO: 8046200 - DNA, 22 bp, Homo sapiens
cagggctgtggctttgtgctgt

SEQ ID NO: 8046201 - DNA, 22 bp, Homo sapiens
caggggcgggtaaaaggcctcc

SEQ ID NO: 8046202 - DNA, 22 bp, Homo sapiens
caggggcttaagtgacagaagg

SEQ ID NO: 8046203 - DNA, 22 bp, Homo sapiens
caggggggcaggagtcattgat

SEQ ID NO: 8046204 - DNA, 22 bp, Homo sapiens
cagggggtggtccaggctgcgc

SEQ ID NO: 8046205 - DNA, 22 bp, Homo sapiens
cagggggctgtggctgtccagt

SEQ ID NO: 8046206 - DNA, 22 bp, Homo sapiens
cagggggcagcgtagaaaatga

SEQ ID NO: 8046207 - DNA, 22 bp, Homo sapiens
cagggctggtttgtcgaagaaa

SEQ ID NO: 8046208 - DNA, 22 bp, Homo sapiens
cagggctgtctccaaaggcccc

SEQ ID NO: 8046209 - DNA, 22 bp, Homo sapiens
cagggctgtaaattagtgctga

SEQ ID NO: 8046210 - DNA, 22 bp, Homo sapiens
cagggctgtaaattagtgctga

SEQ ID NO: 8046211 - DNA, 23 bp, Homo sapiens
cagggctggtagggaagagcgtg

SEQ ID NO: 8046212 - DNA, 22 bp, Homo sapiens
cagggctgaagaaattcaaaag

SEQ ID NO: 8046213 - DNA, 22 bp, Homo sapiens
cagggctgaaatcaaggtgtag

SEQ ID NO: 8046214 - DNA, 22 bp, Homo sapiens
cagggctgaaatcaaggtgtag

SEQ ID NO: 8046215 - DNA, 22 bp, Homo sapiens
cagggctgaactgagcttgtga

SEQ ID NO: 8046216 - DNA, 22 bp, Homo sapiens
cagggctcttccggagcaggga

SEQ ID NO: 8046217 - DNA, 23 bp, Homo sapiens
tgggcccttggaatctctatttt

SEQ ID NO: 8046218 - DNA, 22 bp, Homo sapiens
tgggctgctgtctgcacatgct

SEQ ID NO: 8046219 - DNA, 22 bp, Homo sapiens
tgggccctggtggccatgcctc

SEQ ID NO: 8046220 - DNA, 23 bp, Homo sapiens
tgggccctggagtcgccagtctg

SEQ ID NO: 8046221 - DNA, 22 bp, Homo sapiens
tgggccctgacttcaagcatcc

SEQ ID NO: 8046222 - DNA, 21 bp, Homo sapiens
tgggcccagttcccgctgggc

SEQ ID NO: 8046223 - DNA, 22 bp, Homo sapiens
tgggcccatcattgctgtgggc

SEQ ID NO: 8046224 - DNA, 22 bp, Homo sapiens
tgggcccaagtgcaatgcagtg

SEQ ID NO: 8046225 - DNA, 22 bp, Homo sapiens
tgggctggagcttgttgcttcc

SEQ ID NO: 8046226 - DNA, 22 bp, Homo sapiens
tgggctgcttcctcagctgaga

SEQ ID NO: 8046227 - DNA, 21 bp, Homo sapiens
cctgagcctgtttatccagaa

SEQ ID NO: 8046228 - DNA, 22 bp, Homo sapiens
cctgagctgcggggcagtgctc

SEQ ID NO: 8046229 - DNA, 17 bp, Homo sapiens
cctcttcctctcagctg

SEQ ID NO: 8046230 - DNA, 17 bp, Homo sapiens
cctcttcctctcagctg

SEQ ID NO: 8046231 - DNA, 22 bp, Homo sapiens
cctcttctaggacgtccttgtg

SEQ ID NO: 8046232 - DNA, 18 bp, Homo sapiens
tgggagtgggagtggata

SEQ ID NO: 8046233 - DNA, 22 bp, Homo sapiens
tgggagtggggcatagaaggta

SEQ ID NO: 8046234 - DNA, 22 bp, Homo sapiens
cctgagcagctctgaggggcga

SEQ ID NO: 8046235 - DNA, 22 bp, Homo sapiens
cctgagcatcagcgcctcctta

SEQ ID NO: 8046236 - DNA, 18 bp, Homo sapiens
cctgagccctgcttactt

SEQ ID NO: 8046237 - DNA, 22 bp, Homo sapiens
cctgagccgagcgctctttctc

SEQ ID NO: 8046238 - DNA, 22 bp, Homo sapiens
cctgagcctgcagccgagcaga

SEQ ID NO: 8046239 - DNA, 22 bp, Homo sapiens
cctgagcctggctcatgcactc

SEQ ID NO: 8046240 - DNA, 22 bp, Homo sapiens
tgggaaggacgtgtcagtggca

SEQ ID NO: 8046241 - DNA, 22 bp, Homo sapiens
tgggaaggacagaacataattg

SEQ ID NO: 8046242 - DNA, 22 bp, Homo sapiens
tgggaaggaactgcctttagct

SEQ ID NO: 8046243 - DNA, 22 bp, Homo sapiens
tgggaagctttaaatgggtgtc

SEQ ID NO: 8046244 - DNA, 22 bp, Homo sapiens
cctcttcctcaccatctacaac

SEQ ID NO: 8046245 - DNA, 22 bp, Homo sapiens
cctctgcctgcacatcatcctg

SEQ ID NO: 8046246 - DNA, 20 bp, Homo sapiens
cctctgcctttctagtctga

SEQ ID NO: 8046247 - DNA, 22 bp, Homo sapiens
cctctgctctggtccatgtgct

SEQ ID NO: 8046248 - DNA, 22 bp, Homo sapiens
tggctggctgtccagctgggca

SEQ ID NO: 8046249 - DNA, 22 bp, Homo sapiens
tggctggcttgttcactgactg

SEQ ID NO: 8046250 - DNA, 22 bp, Homo sapiens
tggctgggagctggaactgggc

SEQ ID NO: 8046251 - DNA, 22 bp, Homo sapiens
tggctgctagccagagcttcag

SEQ ID NO: 8046252 - DNA, 22 bp, Homo sapiens
tggctgctcaagggaggaggct

SEQ ID NO: 8046253 - DNA, 22 bp, Homo sapiens
tggctggctagtgggcaggatt

SEQ ID NO: 8046254 - DNA, 19 bp, Homo sapiens
tggctctgtcgaaggcaca

SEQ ID NO: 8046255 - DNA, 17 bp, Homo sapiens
tggctctgtcctcagct

SEQ ID NO: 8046256 - DNA, 22 bp, Homo sapiens
cctcagggaatgggaggctggg

SEQ ID NO: 8046257 - DNA, 22 bp, Homo sapiens
cctcagagtaggtctcagctgt

SEQ ID NO: 8046258 - DNA, 22 bp, Homo sapiens
cctcagagtttaagatgtcaga

SEQ ID NO: 8046259 - DNA, 22 bp, Homo sapiens
tggcccagagcactgctgggca

SEQ ID NO: 8046260 - DNA, 19 bp, Homo sapiens
tggcccagatggtcctggg

SEQ ID NO: 8046261 - DNA, 22 bp, Homo sapiens
cctccaaggtgagagaggatgg

SEQ ID NO: 8046262 - DNA, 22 bp, Homo sapiens
tggcctgggccggcagatatac

SEQ ID NO: 8046263 - DNA, 22 bp, Homo sapiens
tggcctgggcctgccggtgcaa

SEQ ID NO: 8046264 - DNA, 22 bp, Homo sapiens
tggcctggggaagaccatgggc

SEQ ID NO: 8046265 - DNA, 22 bp, Homo sapiens
tggctctgagacacaggctctc

SEQ ID NO: 8046266 - DNA, 21 bp, Homo sapiens
tggctctgggtaggagagtgc

SEQ ID NO: 8046267 - DNA, 22 bp, Homo sapiens
tggctctgtcactgtgagctat

SEQ ID NO: 8046268 - DNA, 22 bp, Homo sapiens
cccttccttgtgactggtgggg

SEQ ID NO: 8046269 - DNA, 22 bp, Homo sapiens
cccttctctttcactcactatt

SEQ ID NO: 8046270 - DNA, 19 bp, Homo sapiens
tggcagaggacaaggactt

SEQ ID NO: 8046271 - DNA, 22 bp, Homo sapiens
cccttcctcctcgcctgtcaga

SEQ ID NO: 8046272 - DNA, 22 bp, Homo sapiens
cccttcctcccaggcttctgtg

SEQ ID NO: 8046273 - DNA, 22 bp, Homo sapiens
ccctgtggtgacaggcctgtct

SEQ ID NO: 8046274 - DNA, 22 bp, Homo sapiens
cccttcctgggtgtcccggagt

SEQ ID NO: 8046275 - DNA, 22 bp, Homo sapiens
cccttcctggagtaccctctgt

SEQ ID NO: 8046276 - DNA, 21 bp, Homo sapiens
ccctgcaggccagggctgagc

SEQ ID NO: 8046277 - DNA, 22 bp, Homo sapiens
ccctgcaggctcagactggagt

SEQ ID NO: 8046278 - DNA, 22 bp, Homo sapiens
ccctgcagcttttgcatagtca

SEQ ID NO: 8046279 - DNA, 21 bp, Homo sapiens
ccctgcaggccagggctgagc

SEQ ID NO: 8046280 - DNA, 22 bp, Homo sapiens
ccctgcaggggacctgcagcct

SEQ ID NO: 8046281 - DNA, 23 bp, Homo sapiens
ccctgcagtcagggtgagatggt

SEQ ID NO: 8046282 - DNA, 22 bp, Homo sapiens
ccctgcagccttgcatgccttc

SEQ ID NO: 8046283 - DNA, 22 bp, Homo sapiens
tggagcaggccggaagtggctt

SEQ ID NO: 8046284 - DNA, 18 bp, Homo sapiens
cctaggaaagggaggcaa

SEQ ID NO: 8046285 - DNA, 22 bp, Homo sapiens
cctagcagggagaggatacctg

SEQ ID NO: 8046286 - DNA, 22 bp, Homo sapiens
cctagcagggaagcagtgagga

SEQ ID NO: 8046287 - DNA, 19 bp, Homo sapiens
cctagagggaaggcaggac

SEQ ID NO: 8046288 - DNA, 19 bp, Homo sapiens
tggcagaggcagtttgtac

SEQ ID NO: 8046289 - DNA, 22 bp, Homo sapiens
tggcagaggctctgtgatgttg

SEQ ID NO: 8046290 - DNA, 22 bp, Homo sapiens
cctaggagttcgaagctgcagt

SEQ ID NO: 8046291 - DNA, 22 bp, Homo sapiens
tggcagggtgggcttcagcccc

SEQ ID NO: 8046292 - DNA, 22 bp, Homo sapiens
tggcagggtgggcttcagcccc

SEQ ID NO: 8046293 - DNA, 22 bp, Homo sapiens
tggcagggtgggcttcagcccc

SEQ ID NO: 8046294 - DNA, 22 bp, Homo sapiens
tggcagggttggccaccttacc

SEQ ID NO: 8046295 - DNA, 22 bp, Homo sapiens
tggcagggttggccaccttacc

SEQ ID NO: 8046296 - DNA, 22 bp, Homo sapiens
tggcaggtagtcagaggcgaca

SEQ ID NO: 8046297 - DNA, 22 bp, Homo sapiens
tggcaggtagagttctgagatg

SEQ ID NO: 8046298 - DNA, 18 bp, Homo sapiens
tggcaggtagactcaggt

SEQ ID NO: 8046299 - DNA, 22 bp, Homo sapiens
tggcaggtacccattggctgta

SEQ ID NO: 8046300 - DNA, 22 bp, Homo sapiens
cccagggtccctgctctctgtg

SEQ ID NO: 8046301 - DNA, 20 bp, Homo sapiens
cccaggggttgtggtgagga

SEQ ID NO: 8046302 - DNA, 20 bp, Homo sapiens
cccaggggttgtggtgagga

SEQ ID NO: 8046303 - DNA, 22 bp, Homo sapiens
cccagggtagctgagctggcag

SEQ ID NO: 8046304 - DNA, 17 bp, Homo sapiens
cccagggaccactgctt

SEQ ID NO: 8046305 - DNA, 22 bp, Homo sapiens
tgcctgttgcccacctgataaa

SEQ ID NO: 8046306 - DNA, 22 bp, Homo sapiens
cccagggaaggcagatggagga

SEQ ID NO: 8046307 - DNA, 22 bp, Homo sapiens
cccaggctggtcctgaactcct

SEQ ID NO: 8046308 - DNA, 22 bp, Homo sapiens
cccagggaatgactctggcctt

SEQ ID NO: 8046309 - DNA, 22 bp, Homo sapiens
cccagggaagggctacctgagg

SEQ ID NO: 8046310 - DNA, 22 bp, Homo sapiens
cccaggctggggctcctccagc

SEQ ID NO: 8046311 - DNA, 22 bp, Homo sapiens
cccaggctggagtgcagtggcg

SEQ ID NO: 8046312 - DNA, 22 bp, Homo sapiens
tgccctggtagacacagactgt

SEQ ID NO: 8046313 - DNA, 22 bp, Homo sapiens
cccaggctggagggcagtgtca

SEQ ID NO: 8046314 - DNA, 22 bp, Homo sapiens
tgccctggggtctggagcagca

SEQ ID NO: 8046315 - DNA, 22 bp, Homo sapiens
cccaggctcccaggtgggacaa

SEQ ID NO: 8046316 - DNA, 22 bp, Homo sapiens
tgcccagcctaaacttggcaag

SEQ ID NO: 8046317 - DNA, 19 bp, Homo sapiens
cccaggctacatggagagg

SEQ ID NO: 8046318 - DNA, 22 bp, Homo sapiens
tgcccagcccctatccctggga

SEQ ID NO: 8046319 - DNA, 22 bp, Homo sapiens
tgccaggctaagtggaggactt

SEQ ID NO: 8046320 - DNA, 22 bp, Homo sapiens
tgccagctccgaggagctgcag

SEQ ID NO: 8046321 - DNA, 19 bp, Homo sapiens
tgccacagataaaaactga

SEQ ID NO: 8046322 - DNA, 22 bp, Homo sapiens
tgccacagaggtgaagcccact

SEQ ID NO: 8046323 - DNA, 22 bp, Homo sapiens
tgccagctgacagcagagacaa

SEQ ID NO: 8046324 - DNA, 22 bp, Homo sapiens
tgccagcttctaaggacccagg

SEQ ID NO: 8046325 - DNA, 18 bp, Homo sapiens
ccctctcctgctagtggg

SEQ ID NO: 8046326 - DNA, 22 bp, Homo sapiens
ccctctccctgcagaatgtggc

SEQ ID NO: 8046327 - DNA, 20 bp, Homo sapiens
ccctgagaccagagagcagc

SEQ ID NO: 8046328 - DNA, 20 bp, Homo sapiens
ccctgagacaaaggaggggc

SEQ ID NO: 8046329 - DNA, 22 bp, Homo sapiens
ccctgagcacacctggcagaca

SEQ ID NO: 8046330 - DNA, 23 bp, Homo sapiens
ccctgagctggtccaggctcaac

SEQ ID NO: 8046331 - DNA, 22 bp, Homo sapiens
ccctgaggaaagggtggagggc

SEQ ID NO: 8046332 - DNA, 22 bp, Homo sapiens
ccctcgggtcgcggactgcgct

SEQ ID NO: 8046333 - DNA, 22 bp, Homo sapiens
ccctccttaccaccacagctcc

SEQ ID NO: 8046334 - DNA, 22 bp, Homo sapiens
ccctcctggaggcggatgccca

SEQ ID NO: 8046335 - DNA, 22 bp, Homo sapiens
ccctcctgtgcctgaggccagc

SEQ ID NO: 8046336 - DNA, 22 bp, Homo sapiens
tgctgtggttcccagagtggat

SEQ ID NO: 8046337 - DNA, 22 bp, Homo sapiens
tgctgtggattcagagatgaaa

SEQ ID NO: 8046338 - DNA, 22 bp, Homo sapiens
tgctggagcccaggcggccttt

SEQ ID NO: 8046339 - DNA, 22 bp, Homo sapiens
tgctggccaatggcagaggcgg

SEQ ID NO: 8046340 - DNA, 21 bp, Homo sapiens
tgctggccatgtgctgggcat

SEQ ID NO: 8046341 - DNA, 22 bp, Homo sapiens
ccccacagccgccagcagggag

SEQ ID NO: 8046342 - DNA, 22 bp, Homo sapiens
ccccacactctttacattcata

SEQ ID NO: 8046343 - DNA, 22 bp, Homo sapiens
ccccacacctgccgggcagcag

SEQ ID NO: 8046344 - DNA, 20 bp, Homo sapiens
ccccacactattgagcactt

SEQ ID NO: 8046345 - DNA, 22 bp, Homo sapiens
ccccacagtccgtgaggagcca

SEQ ID NO: 8046346 - DNA, 22 bp, Homo sapiens
ccccacagcttgtggagagaat

SEQ ID NO: 8046347 - DNA, 22 bp, Homo sapiens
ccccaaagctgagttcccgcct

SEQ ID NO: 8046348 - DNA, 22 bp, Homo sapiens
ccccaaagcctcagcctgcctg

SEQ ID NO: 8046349 - DNA, 21 bp, Homo sapiens
cccaggtcgtggtcttcccag

SEQ ID NO: 8046350 - DNA, 22 bp, Homo sapiens
cccaggtctatgccagctctga

SEQ ID NO: 8046351 - DNA, 22 bp, Homo sapiens
ccccttctgtgtcctgtcagcc

SEQ ID NO: 8046352 - DNA, 22 bp, Homo sapiens
tgctgggcacacagtaggtgct

SEQ ID NO: 8046353 - DNA, 22 bp, Homo sapiens
ccccttccttcctcagacagcc

SEQ ID NO: 8046354 - DNA, 22 bp, Homo sapiens
tgctggcctcggcgctgggcct

SEQ ID NO: 8046355 - DNA, 22 bp, Homo sapiens
tgctggcctgggctgcaccttg

SEQ ID NO: 8046356 - DNA, 22 bp, Homo sapiens
ccaggtgtagcactgctcacag

SEQ ID NO: 8046357 - DNA, 22 bp, Homo sapiens
ccaggtgtaagacatggtccta

SEQ ID NO: 8046358 - DNA, 22 bp, Homo sapiens
ccaggtgggcgtgtcttcacct

SEQ ID NO: 8046359 - DNA, 22 bp, Homo sapiens
tgagacgaagtcttgctctgtt

SEQ ID NO: 8046360 - DNA, 22 bp, Homo sapiens
ccaggtgtctgtctctttttca

SEQ ID NO: 8046361 - DNA, 22 bp, Homo sapiens
ccaggtgtccccgtcactgcag

SEQ ID NO: 8046362 - DNA, 22 bp, Homo sapiens
ccaggtgtctgtggccagccct

SEQ ID NO: 8046363 - DNA, 22 bp, Homo sapiens
ccaggtgtgagcattctgtctt

SEQ ID NO: 8046364 - DNA, 22 bp, Homo sapiens
ccaggtgtaggacaccaaggga

SEQ ID NO: 8046365 - DNA, 22 bp, Homo sapiens
ccaggtgtcatggataatgggt

SEQ ID NO: 8046366 - DNA, 22 bp, Homo sapiens
ccaggtgtcatgcgtgtgaccc

SEQ ID NO: 8046367 - DNA, 22 bp, Homo sapiens
tgaggactacctggggtgggag

SEQ ID NO: 8046368 - DNA, 22 bp, Homo sapiens
ccaggtgtggtggcatacacct

SEQ ID NO: 8046369 - DNA, 22 bp, Homo sapiens
ccaggtgtgtacagaacagcac

SEQ ID NO: 8046370 - DNA, 22 bp, Homo sapiens
ccaggtgtggccacatggctgg

SEQ ID NO: 8046371 - DNA, 22 bp, Homo sapiens
ccaggtgtggggaggactcaca

SEQ ID NO: 8046372 - DNA, 22 bp, Homo sapiens
ccaggtgtgatttcatctgagg

SEQ ID NO: 8046373 - DNA, 22 bp, Homo sapiens
ccaggtgtgatttggcagtgtc

SEQ ID NO: 8046374 - DNA, 22 bp, Homo sapiens
ccaggtgtgccagcagggactg

SEQ ID NO: 8046375 - DNA, 22 bp, Homo sapiens
ccaggtgtgctctgcagtggat

SEQ ID NO: 8046376 - DNA, 22 bp, Homo sapiens
ccaggtgtgctctgcagtggat

SEQ ID NO: 8046377 - DNA, 22 bp, Homo sapiens
ccaggggctggtgctgagctgg

SEQ ID NO: 8046378 - DNA, 22 bp, Homo sapiens
ccaggggctggtgctgagctgg

SEQ ID NO: 8046379 - DNA, 22 bp, Homo sapiens
ccaggggctgcagatccatggt

SEQ ID NO: 8046380 - DNA, 18 bp, Homo sapiens
tgagaatatttatcccac

SEQ ID NO: 8046381 - DNA, 17 bp, Homo sapiens
ccaggtggaatcgtgga

SEQ ID NO: 8046382 - DNA, 22 bp, Homo sapiens
ccaggtggacaaggctttcaca

SEQ ID NO: 8046383 - DNA, 22 bp, Homo sapiens
ccaggtggacggcgagtacagg

SEQ ID NO: 8046384 - DNA, 22 bp, Homo sapiens
ccaggtggaaggtctgtgctct

SEQ ID NO: 8046385 - DNA, 19 bp, Homo sapiens
ccaggtggaactgaggtag

SEQ ID NO: 8046386 - DNA, 22 bp, Homo sapiens
ccaggtgctcttgccagggctg

SEQ ID NO: 8046387 - DNA, 22 bp, Homo sapiens
ccagggggcttggtgaggccat

SEQ ID NO: 8046388 - DNA, 22 bp, Homo sapiens
ccagggggcttggtgaggccat

SEQ ID NO: 8046389 - DNA, 22 bp, Homo sapiens
ccaggggggcgtagatgctggg

SEQ ID NO: 8046390 - DNA, 22 bp, Homo sapiens
ccaggggggcgtagatgctggg

SEQ ID NO: 8046391 - DNA, 22 bp, Homo sapiens
ccaggtgctagcaatcactgtc

SEQ ID NO: 8046392 - DNA, 22 bp, Homo sapiens
tgacataataatccaaacatac

SEQ ID NO: 8046393 - DNA, 22 bp, Homo sapiens
tgacatagggcaaaagagtagg

SEQ ID NO: 8046394 - DNA, 22 bp, Homo sapiens
tgacagtgttgggggtaaattt

SEQ ID NO: 8046395 - DNA, 22 bp, Homo sapiens
tgacagtgtttgcacttcaggt

SEQ ID NO: 8046396 - DNA, 22 bp, Homo sapiens
tgacagtgtcagtttcctaata

SEQ ID NO: 8046397 - DNA, 21 bp, Homo sapiens
tgacagtgtggcatggaaggt

SEQ ID NO: 8046398 - DNA, 22 bp, Homo sapiens
ccagggctttatctgcctttga

SEQ ID NO: 8046399 - DNA, 22 bp, Homo sapiens
ccagggctttgccaaagtccag

SEQ ID NO: 8046400 - DNA, 22 bp, Homo sapiens
ccagggcttggtggcttgtatc

SEQ ID NO: 8046401 - DNA, 19 bp, Homo sapiens
ccagggctttaagttgagg

SEQ ID NO: 8046402 - DNA, 22 bp, Homo sapiens
ccagggcttcccacgtgccctg

SEQ ID NO: 8046403 - DNA, 22 bp, Homo sapiens
tgaatgctcacatgcctaggtc

SEQ ID NO: 8046404 - DNA, 22 bp, Homo sapiens
tgaatgatgaggggagaataat

SEQ ID NO: 8046405 - DNA, 21 bp, Homo sapiens
ccaggctggccatggtattga

SEQ ID NO: 8046406 - DNA, 22 bp, Homo sapiens
ccaggctggattttgcagttca

SEQ ID NO: 8046407 - DNA, 22 bp, Homo sapiens
ccaggctggagtgcaatggtgc

SEQ ID NO: 8046408 - DNA, 22 bp, Homo sapiens
ccaggctggagtgcagtagtgt

SEQ ID NO: 8046409 - DNA, 22 bp, Homo sapiens
ccaggctggagtgcagtagtgt

SEQ ID NO: 8046410 - DNA, 22 bp, Homo sapiens
ccaggctggagtgcagtggcac

SEQ ID NO: 8046411 - DNA, 22 bp, Homo sapiens
tgcaaagggctttgcatacaga

SEQ ID NO: 8046412 - DNA, 22 bp, Homo sapiens
cccagacccagagggaggcagg

SEQ ID NO: 8046413 - DNA, 22 bp, Homo sapiens
cccagaaggtcgaggctgcagt

SEQ ID NO: 8046414 - DNA, 22 bp, Homo sapiens
ccatgtgttgattctctgcaga

SEQ ID NO: 8046415 - DNA, 22 bp, Homo sapiens
ccatgtgttgagattccagcct

SEQ ID NO: 8046416 - DNA, 22 bp, Homo sapiens
tgattttacttagcatgatgtt

SEQ ID NO: 8046417 - DNA, 22 bp, Homo sapiens
tgagggctaaattgtggcaggt

SEQ ID NO: 8046418 - DNA, 22 bp, Homo sapiens
tgaggggaactgatgcccattg

SEQ ID NO: 8046419 - DNA, 22 bp, Homo sapiens
tgagggctgcttccagagctag

SEQ ID NO: 8046420 - DNA, 22 bp, Homo sapiens
ccagtctcttccctcctgccag

SEQ ID NO: 8046421 - DNA, 22 bp, Homo sapiens
tgaggtatggtaaggtaaaatc

SEQ ID NO: 8046422 - DNA, 22 bp, Homo sapiens
ccatgtgtaaattagataactc

SEQ ID NO: 8046423 - DNA, 22 bp, Homo sapiens
ccatgtgtcgggcctgcagtgg

SEQ ID NO: 8046424 - DNA, 18 bp, Homo sapiens
ccatgtgttccttttggg

SEQ ID NO: 8046425 - DNA, 22 bp, Homo sapiens
ccatgtgtctcccctggaagta

SEQ ID NO: 8046426 - DNA, 22 bp, Homo sapiens
ccatgtgttcaataagggagtt

SEQ ID NO: 8046427 - DNA, 22 bp, Homo sapiens
ccatggctaagtatctgtagaa

SEQ ID NO: 8046428 - DNA, 22 bp, Homo sapiens
ccatgccctaaaggactggcag

SEQ ID NO: 8046429 - DNA, 22 bp, Homo sapiens
ccatgctggagtccctagctgt

SEQ ID NO: 8046430 - DNA, 22 bp, Homo sapiens
ccatgcagtgctggagctgatt

SEQ ID NO: 8046431 - DNA, 22 bp, Homo sapiens
ccatcctggccttgctgtccac

SEQ ID NO: 8046432 - DNA, 22 bp, Homo sapiens
ccatcctggcctcgctgtccac

SEQ ID NO: 8046433 - DNA, 22 bp, Homo sapiens
ccatgcccacgttgtggctcag

SEQ ID NO: 8046434 - DNA, 22 bp, Homo sapiens
tctgggagccatgccttggagt

SEQ ID NO: 8046435 - DNA, 20 bp, Homo sapiens
tctggggatgaggtctagga

SEQ ID NO: 8046436 - DNA, 22 bp, Homo sapiens
tctgggagcagatgatggtata

SEQ ID NO: 8046437 - DNA, 22 bp, Homo sapiens
ccaggacacgatttttagtctg

SEQ ID NO: 8046438 - DNA, 17 bp, Homo sapiens
tctggccttcctgaact

SEQ ID NO: 8046439 - DNA, 18 bp, Homo sapiens
ccaggacaggcaaaaggt

SEQ ID NO: 8046440 - DNA, 22 bp, Homo sapiens
ccaggacaggagttggcttcgc

SEQ ID NO: 8046441 - DNA, 19 bp, Homo sapiens
ccaggacctttccagggtc

SEQ ID NO: 8046442 - DNA, 22 bp, Homo sapiens
tctggcagctcagttcaggtct

SEQ ID NO: 8046443 - DNA, 22 bp, Homo sapiens
tctggcagctctcctcggcgga

SEQ ID NO: 8046444 - DNA, 22 bp, Homo sapiens
tctggcaggacatgctgaccat

SEQ ID NO: 8046445 - DNA, 21 bp, Homo sapiens
tctggcaggaagacggatggg

SEQ ID NO: 8046446 - DNA, 22 bp, Homo sapiens
tctggcagctatcctctggcca

SEQ ID NO: 8046447 - DNA, 22 bp, Homo sapiens
tctggcagcgaagcgtgtactt

SEQ ID NO: 8046448 - DNA, 21 bp, Homo sapiens
tctggcagcagtttgttgagt

SEQ ID NO: 8046449 - DNA, 22 bp, Homo sapiens
tctggcaggatatcgaagtgaa

SEQ ID NO: 8046450 - DNA, 22 bp, Homo sapiens
tctggcaggaccatgaagcgta

SEQ ID NO: 8046451 - DNA, 22 bp, Homo sapiens
tctggcaggccttgtcaatctg

SEQ ID NO: 8046452 - DNA, 22 bp, Homo sapiens
tctggcaggcaatcggctctgg

SEQ ID NO: 8046453 - DNA, 21 bp, Homo sapiens
tctggcaggcacgggcccagc

SEQ ID NO: 8046454 - DNA, 22 bp, Homo sapiens
tctggcaggggttctgcacttg

SEQ ID NO: 8046455 - DNA, 22 bp, Homo sapiens
tctggcagggtcagggcccagg

SEQ ID NO: 8046456 - DNA, 22 bp, Homo sapiens
tctggcagcagcatcagtggct

SEQ ID NO: 8046457 - DNA, 22 bp, Homo sapiens
tctggcagcagcatcagtggct

SEQ ID NO: 8046458 - DNA, 22 bp, Homo sapiens
tctggcagcaagtctgtttctc

SEQ ID NO: 8046459 - DNA, 22 bp, Homo sapiens
tctggaggccatagggaaggat

SEQ ID NO: 8046460 - DNA, 22 bp, Homo sapiens
ccagctgcccaagaggcatcct

SEQ ID NO: 8046461 - DNA, 22 bp, Homo sapiens
ccagctgcgggcatcgagagtt

SEQ ID NO: 8046462 - DNA, 22 bp, Homo sapiens
ccagctgcatcctattcactgc

SEQ ID NO: 8046463 - DNA, 22 bp, Homo sapiens
ccagctgcaggggagcagtgga

SEQ ID NO: 8046464 - DNA, 22 bp, Homo sapiens
ccagctctgcagggcctggggt

SEQ ID NO: 8046465 - DNA, 22 bp, Homo sapiens
ccagctctgccaagcgtcagct

SEQ ID NO: 8046466 - DNA, 22 bp, Homo sapiens
ccagctctcttcaagcccactc

SEQ ID NO: 8046467 - DNA, 22 bp, Homo sapiens
tctgctcaatactgctcatgaa

SEQ ID NO: 8046468 - DNA, 22 bp, Homo sapiens
ccagagagaaaatggagggcca

SEQ ID NO: 8046469 - DNA, 22 bp, Homo sapiens
ccaggccccagggctggctttc

SEQ ID NO: 8046470 - DNA, 22 bp, Homo sapiens
ccaggcccagggtactgaccaa

SEQ ID NO: 8046471 - DNA, 22 bp, Homo sapiens
ccaggcccaccttggccactta

SEQ ID NO: 8046472 - DNA, 22 bp, Homo sapiens
ccaggcccccgagcagaagaca

SEQ ID NO: 8046473 - DNA, 22 bp, Homo sapiens
ccaggccagggctgcagcgagc

SEQ ID NO: 8046474 - DNA, 21 bp, Homo sapiens
ccaggccaggcctacggggat

SEQ ID NO: 8046475 - DNA, 19 bp, Homo sapiens
ccaggccatcccagttccc

SEQ ID NO: 8046476 - DNA, 22 bp, Homo sapiens
ccaggccattcccagagttgct

SEQ ID NO: 8046477 - DNA, 18 bp, Homo sapiens
ccaggccatgaacctctg

SEQ ID NO: 8046478 - DNA, 19 bp, Homo sapiens
ccaggcctgcgggcgttgg

SEQ ID NO: 8046479 - DNA, 22 bp, Homo sapiens
ccaggcctgcattccctctcag

SEQ ID NO: 8046480 - DNA, 22 bp, Homo sapiens
ccaggcctggaccatgccaggg

SEQ ID NO: 8046481 - DNA, 22 bp, Homo sapiens
ccaggctggagtgcaatggcgt

SEQ ID NO: 8046482 - DNA, 22 bp, Homo sapiens
ccaggctggagtgcaatggtgc

SEQ ID NO: 8046483 - DNA, 22 bp, Homo sapiens
ccaggctgctgttggtgtccgc

SEQ ID NO: 8046484 - DNA, 22 bp, Homo sapiens
ccaggctctgtgtgggctagag

SEQ ID NO: 8046485 - DNA, 22 bp, Homo sapiens
ccaggctctgtctggtcagaag

SEQ ID NO: 8046486 - DNA, 22 bp, Homo sapiens
ccaggcctggacgggtggcctg

SEQ ID NO: 8046487 - DNA, 22 bp, Homo sapiens
ccaggcctggccaggggatgcc

SEQ ID NO: 8046488 - DNA, 22 bp, Homo sapiens
ccaggctgaatatgttccaggg

SEQ ID NO: 8046489 - DNA, 23 bp, Homo sapiens
ccaggctctttcacctgctattc

SEQ ID NO: 8046490 - DNA, 22 bp, Homo sapiens
ccaggctctgttccccgaggag

SEQ ID NO: 8046491 - DNA, 22 bp, Homo sapiens
ccaggagggaggagttcctgag

SEQ ID NO: 8046492 - DNA, 22 bp, Homo sapiens
ccaggaggttgaggctgcagtg

SEQ ID NO: 8046493 - DNA, 22 bp, Homo sapiens
ccaggagacccagggaaggagc

SEQ ID NO: 8046494 - DNA, 22 bp, Homo sapiens
ccaggatggggagcagatagaa

SEQ ID NO: 8046495 - DNA, 22 bp, Homo sapiens
tcttcacattttaagaagttct

SEQ ID NO: 8046496 - DNA, 22 bp, Homo sapiens
tcttcacattcacgtaacatag

SEQ ID NO: 8046497 - DNA, 22 bp, Homo sapiens
tcttcagagtgagcagtgtcat

SEQ ID NO: 8046498 - DNA, 22 bp, Homo sapiens
tcttccaggtatgtttctagtt

SEQ ID NO: 8046499 - DNA, 22 bp, Homo sapiens
tcttccagtgtagacatctgcc

SEQ ID NO: 8046500 - DNA, 22 bp, Homo sapiens
ccaggccagcctggagcatggc

SEQ ID NO: 8046501 - DNA, 22 bp, Homo sapiens
ccaggccagcaggcacacctgc

SEQ ID NO: 8046502 - DNA, 22 bp, Homo sapiens
ccaggccagagtgcagtggcac

SEQ ID NO: 8046503 - DNA, 22 bp, Homo sapiens
ccaggccagcgctggctggagg

SEQ ID NO: 8046504 - DNA, 22 bp, Homo sapiens
tcccctctggaggctgcagggg

SEQ ID NO: 8046505 - DNA, 22 bp, Homo sapiens
tgtggaggattctgatgccagc

SEQ ID NO: 8046506 - DNA, 22 bp, Homo sapiens
tgtggcagagtaaggacccagt

SEQ ID NO: 8046507 - DNA, 22 bp, Homo sapiens
tgtggcagagtaaggacccagt

SEQ ID NO: 8046508 - DNA, 22 bp, Homo sapiens
tgtggcagaggaggcagcgtcc

SEQ ID NO: 8046509 - DNA, 21 bp, Homo sapiens
tgtggcagatgttgggaggca

SEQ ID NO: 8046510 - DNA, 21 bp, Homo sapiens
tgtggcagatgttgggaggca

SEQ ID NO: 8046511 - DNA, 22 bp, Homo sapiens
tgtggcagctgctgcaggagct

SEQ ID NO: 8046512 - DNA, 22 bp, Homo sapiens
tgtggcagctgctgcaggagct

SEQ ID NO: 8046513 - DNA, 22 bp, Homo sapiens
tgtggcagctgctgcaggagct

SEQ ID NO: 8046514 - DNA, 22 bp, Homo sapiens
tgtggcagaactgggactcaaa

SEQ ID NO: 8046515 - DNA, 22 bp, Homo sapiens
tgtggcagtataagagctagaa

SEQ ID NO: 8046516 - DNA, 22 bp, Homo sapiens
tgtggcctagttaaggacgcct

SEQ ID NO: 8046517 - DNA, 22 bp, Homo sapiens
tgtggcccagatgagtgtgcta

SEQ ID NO: 8046518 - DNA, 22 bp, Homo sapiens
tgtggccataaagcttaaaatg

SEQ ID NO: 8046519 - DNA, 22 bp, Homo sapiens
tgtggccaggcccctgatggtg

SEQ ID NO: 8046520 - DNA, 22 bp, Homo sapiens
tgtggccagccacaggcatggt

SEQ ID NO: 8046521 - DNA, 22 bp, Homo sapiens
tgtgtaaaagattagtttacta

SEQ ID NO: 8046522 - DNA, 22 bp, Homo sapiens
tgtggttttggttcagaaacaa

SEQ ID NO: 8046523 - DNA, 20 bp, Homo sapiens
tgtggcctctagagacagcc

SEQ ID NO: 8046524 - DNA, 22 bp, Homo sapiens
tgtggggactttcaaagccaat

SEQ ID NO: 8046525 - DNA, 17 bp, Homo sapiens
tgtggccttctgagctt

SEQ ID NO: 8046526 - DNA, 19 bp, Homo sapiens
tgtggcctggggacaggcc

SEQ ID NO: 8046527 - DNA, 19 bp, Homo sapiens
tgtggcctggggacaggcc

SEQ ID NO: 8046528 - DNA, 22 bp, Homo sapiens
tgtgtcctgtgatctctagggt

SEQ ID NO: 8046529 - DNA, 22 bp, Homo sapiens
tgtgtcctgtgcaaggggatga

SEQ ID NO: 8046530 - DNA, 22 bp, Homo sapiens
tgtgtcctggtgttaattttat

SEQ ID NO: 8046531 - DNA, 22 bp, Homo sapiens
tgtgtcctgtccccttgctgct

SEQ ID NO: 8046532 - DNA, 22 bp, Homo sapiens
tgtgtcctcatgtggcagagag

SEQ ID NO: 8046533 - DNA, 22 bp, Homo sapiens
tgtgtcctccagggagatgtaa

SEQ ID NO: 8046534 - DNA, 22 bp, Homo sapiens
tgtgtcctcttacctctgaccc

SEQ ID NO: 8046535 - DNA, 22 bp, Homo sapiens
tgtgtcctgcagacagactcag

SEQ ID NO: 8046536 - DNA, 22 bp, Homo sapiens
tgtgtcctgcaggtgctgcctg

SEQ ID NO: 8046537 - DNA, 23 bp, Homo sapiens
tgtgtccttaactgtatatacta

SEQ ID NO: 8046538 - DNA, 22 bp, Homo sapiens
tgtgtccttatgaaaatactgt

SEQ ID NO: 8046539 - DNA, 22 bp, Homo sapiens
tgtgtccttccagtttttcctg

SEQ ID NO: 8046540 - DNA, 22 bp, Homo sapiens
tgtgtccttctgggagtcccag

SEQ ID NO: 8046541 - DNA, 22 bp, Homo sapiens
tgtgtcctttctaatgcccaga

SEQ ID NO: 8046542 - DNA, 22 bp, Homo sapiens
tgtgtcctttcttaagagtgag

SEQ ID NO: 8046543 - DNA, 22 bp, Homo sapiens
tgtgtcctttggaggatcagcg

SEQ ID NO: 8046544 - DNA, 22 bp, Homo sapiens
tgtgtcctcactgtatgcaagg

SEQ ID NO: 8046545 - DNA, 22 bp, Homo sapiens
tgtgtcctatgaaagagggtta

SEQ ID NO: 8046546 - DNA, 22 bp, Homo sapiens
tgtgtcctcatgaggtttgcag

SEQ ID NO: 8046547 - DNA, 22 bp, Homo sapiens
tgtgtcctcagggaagcagaga

SEQ ID NO: 8046548 - DNA, 22 bp, Homo sapiens
tgtgtcctactgaggagctcct

SEQ ID NO: 8046549 - DNA, 19 bp, Homo sapiens
tgtgtcctagcagccagtc

SEQ ID NO: 8046550 - DNA, 22 bp, Homo sapiens
tgtttgaaaagtggagatttat

SEQ ID NO: 8046551 - DNA, 22 bp, Homo sapiens
tgtttcactgaaagccttacta

SEQ ID NO: 8046552 - DNA, 22 bp, Homo sapiens
tgtttactccagctgatggaac

SEQ ID NO: 8046553 - DNA, 22 bp, Homo sapiens
tgttctcactggatgcttcaca

SEQ ID NO: 8046554 - DNA, 22 bp, Homo sapiens
tgttctcatctggatctcagga

SEQ ID NO: 8046555 - DNA, 22 bp, Homo sapiens
tgttctggggttgagagacaat

SEQ ID NO: 8046556 - DNA, 17 bp, Homo sapiens
tgttctcttcagaaatc

SEQ ID NO: 8046557 - DNA, 22 bp, Homo sapiens
tgttatctgagcaacgtcgacg

SEQ ID NO: 8046558 - DNA, 22 bp, Homo sapiens
tgttatcctcagctcacctcta

SEQ ID NO: 8046559 - DNA, 22 bp, Homo sapiens
tgttatttgggaaagttgtaca

SEQ ID NO: 8046560 - DNA, 22 bp, Homo sapiens
tgttatttctttgccatatctt

SEQ ID NO: 8046561 - DNA, 22 bp, Homo sapiens
tgtgtgcacaaagagtacatgg

SEQ ID NO: 8046562 - DNA, 22 bp, Homo sapiens
tgtgttttggaaggaacatgca

SEQ ID NO: 8046563 - DNA, 22 bp, Homo sapiens
ttactcttccaaatgaatttca

SEQ ID NO: 8046564 - DNA, 22 bp, Homo sapiens
ttactatagtccagcccttttt

SEQ ID NO: 8046565 - DNA, 22 bp, Homo sapiens
ttactttagatcatactgtgtg

SEQ ID NO: 8046566 - DNA, 22 bp, Homo sapiens
ttagagagaaccatcaggatct

SEQ ID NO: 8046567 - DNA, 20 bp, Homo sapiens
ttagaagggccagatgaagg

SEQ ID NO: 8046568 - DNA, 21 bp, Homo sapiens
ttagaagctaatgcagctggt

SEQ ID NO: 8046569 - DNA, 19 bp, Homo sapiens
ttagaagccataggtacag

SEQ ID NO: 8046570 - DNA, 22 bp, Homo sapiens
ttacagtagatacaatgagtaa

SEQ ID NO: 8046571 - DNA, 22 bp, Homo sapiens
ttacagtaatcgagtgttgtgg

SEQ ID NO: 8046572 - DNA, 22 bp, Homo sapiens
ttacatattatccaaaactgct

SEQ ID NO: 8046573 - DNA, 22 bp, Homo sapiens
ttacacagatggttagtagagg

SEQ ID NO: 8046574 - DNA, 22 bp, Homo sapiens
ttacactaagctacttctatat

SEQ ID NO: 8046575 - DNA, 22 bp, Homo sapiens
tgttttctgatggttaatgagt

SEQ ID NO: 8046576 - DNA, 22 bp, Homo sapiens
tgttttgtctaatctaaattct

SEQ ID NO: 8046577 - DNA, 22 bp, Homo sapiens
ttaaggatgttgtgatttatta

SEQ ID NO: 8046578 - DNA, 22 bp, Homo sapiens
ttaataaacaggtgcagctgaa

SEQ ID NO: 8046579 - DNA, 22 bp, Homo sapiens
ttaattgagccagaaagtatct

SEQ ID NO: 8046580 - DNA, 22 bp, Homo sapiens
ttaagacatgtgagcataactt

SEQ ID NO: 8046581 - DNA, 22 bp, Homo sapiens
ttcagtctcaagtgctgctcac

SEQ ID NO: 8046582 - DNA, 22 bp, Homo sapiens
ttcagtccatcaggcgtggcat

SEQ ID NO: 8046583 - DNA, 22 bp, Homo sapiens
ttcagtattcaaatatgtctta

SEQ ID NO: 8046584 - DNA, 22 bp, Homo sapiens
ttcagtatacattatctaattg

SEQ ID NO: 8046585 - DNA, 22 bp, Homo sapiens
ttcagtatacttcataacattt

SEQ ID NO: 8046586 - DNA, 22 bp, Homo sapiens
ttcagtatgtagaacaagtgtt

SEQ ID NO: 8046587 - DNA, 22 bp, Homo sapiens
ttcagtatgctgaatgattttt

SEQ ID NO: 8046588 - DNA, 22 bp, Homo sapiens
ttcaggtgtggccagaggagaa

SEQ ID NO: 8046589 - DNA, 22 bp, Homo sapiens
ttcacagtggctaagttctgca

SEQ ID NO: 8046590 - DNA, 20 bp, Homo sapiens
ttcatgggagcaaagaggcc

SEQ ID NO: 8046591 - DNA, 22 bp, Homo sapiens
ttcatggagttgagaaggctaa

SEQ ID NO: 8046592 - DNA, 22 bp, Homo sapiens
ttcagtgcctgtccacagcttc

SEQ ID NO: 8046593 - DNA, 22 bp, Homo sapiens
ttcagtgcagtcggaactactg

SEQ ID NO: 8046594 - DNA, 22 bp, Homo sapiens
ttcagtgcacagtactgagact

SEQ ID NO: 8046595 - DNA, 22 bp, Homo sapiens
ttcacagtataggtttccagcg

SEQ ID NO: 8046596 - DNA, 22 bp, Homo sapiens
ttcacagtcacccttctccatg

SEQ ID NO: 8046597 - DNA, 22 bp, Homo sapiens
ttcacaaagctggagcatttcc

SEQ ID NO: 8046598 - DNA, 22 bp, Homo sapiens
ttcacaaagctggagcatttcc

SEQ ID NO: 8046599 - DNA, 22 bp, Homo sapiens
ttcacaaagctggagcatttcc

SEQ ID NO: 8046600 - DNA, 22 bp, Homo sapiens
ttcacaaaacactattttctgg

SEQ ID NO: 8046601 - DNA, 22 bp, Homo sapiens
ttcacaaaatggtttgttgatg

SEQ ID NO: 8046602 - DNA, 22 bp, Homo sapiens
ttcacaaaaatgctgaacagtt

SEQ ID NO: 8046603 - DNA, 21 bp, Homo sapiens
ttagagtagagaacatgatcc

SEQ ID NO: 8046604 - DNA, 22 bp, Homo sapiens
ttagataaattgcaacttgatt

SEQ ID NO: 8046605 - DNA, 22 bp, Homo sapiens
ttcaactcttcaagatcacatc

SEQ ID NO: 8046606 - DNA, 22 bp, Homo sapiens
ttcctcagggaggctagcagta

SEQ ID NO: 8046607 - DNA, 22 bp, Homo sapiens
ttcctcagttagtgcctgaggc

SEQ ID NO: 8046608 - DNA, 22 bp, Homo sapiens
ttcctcaacaacttccctacag

SEQ ID NO: 8046609 - DNA, 20 bp, Homo sapiens
ttccacatctttgcacatgc

SEQ ID NO: 8046610 - DNA, 23 bp, Homo sapiens
ttccacaatgaaaataaagcagg

SEQ ID NO: 8046611 - DNA, 22 bp, Homo sapiens
ttcctaatcacgaacattattt

SEQ ID NO: 8046612 - DNA, 22 bp, Homo sapiens
ttcctaatggcaaaacatgttt

SEQ ID NO: 8046613 - DNA, 22 bp, Homo sapiens
ttccagactatcagcagcagga

SEQ ID NO: 8046614 - DNA, 22 bp, Homo sapiens
ttctagaaacacatgcaaacag

SEQ ID NO: 8046615 - DNA, 22 bp, Homo sapiens
ttctagaaactggagcaaacag

SEQ ID NO: 8046616 - DNA, 22 bp, Homo sapiens
ttctacaatatgaataatgaag

SEQ ID NO: 8046617 - DNA, 22 bp, Homo sapiens
ttctagaaccatgacttcaggg

SEQ ID NO: 8046618 - DNA, 22 bp, Homo sapiens
ttctagaaatccgtaagtgaat

SEQ ID NO: 8046619 - DNA, 22 bp, Homo sapiens
ttctaggcctggcttgggccca

SEQ ID NO: 8046620 - DNA, 22 bp, Homo sapiens
ttccttctccagaacttctagg

SEQ ID NO: 8046621 - DNA, 20 bp, Homo sapiens
ttctaaggttttggtgcaca

SEQ ID NO: 8046622 - DNA, 22 bp, Homo sapiens
ttctaagaatgctttgcaaaat

SEQ ID NO: 8046623 - DNA, 22 bp, Homo sapiens
ttctttcagaacacaagtgatt

SEQ ID NO: 8046624 - DNA, 22 bp, Homo sapiens
ttctttattagtttagtgagct

SEQ ID NO: 8046625 - DNA, 22 bp, Homo sapiens
ttgaagatgctgtctcttccag

SEQ ID NO: 8046626 - DNA, 22 bp, Homo sapiens
ttgaagatctttgcattgcagg

SEQ ID NO: 8046627 - DNA, 22 bp, Homo sapiens
ttgaagagtgcattagcatatt

SEQ ID NO: 8046628 - DNA, 22 bp, Homo sapiens
ttgagcaatgctgcaaagagat

SEQ ID NO: 8046629 - DNA, 22 bp, Homo sapiens
ttgagcaatgtcactgaggctt

SEQ ID NO: 8046630 - DNA, 20 bp, Homo sapiens
ttgagcaatcagtaaaggat

SEQ ID NO: 8046631 - DNA, 22 bp, Homo sapiens
ttgaggattcatgtcagaattc

SEQ ID NO: 8046632 - DNA, 21 bp, Homo sapiens
ttgaagcaagggtggctctga

SEQ ID NO: 8046633 - DNA, 22 bp, Homo sapiens
ttgaagattattctattaaaag

SEQ ID NO: 8046634 - DNA, 22 bp, Homo sapiens
ttgaagcaggaaaatttctatt

SEQ ID NO: 8046635 - DNA, 22 bp, Homo sapiens
ttgaagcattgtggcttgtatt

SEQ ID NO: 8046636 - DNA, 22 bp, Homo sapiens
ttgaatgaataaaagagtaagg

SEQ ID NO: 8046637 - DNA, 22 bp, Homo sapiens
ttgaatgattaaagtcatctga

SEQ ID NO: 8046638 - DNA, 22 bp, Homo sapiens
ttgaatgccaatatctccttct

SEQ ID NO: 8046639 - DNA, 22 bp, Homo sapiens
ttgcaaataaacaagtatacat

SEQ ID NO: 8046640 - DNA, 22 bp, Homo sapiens
ttgatttgattgatgaactaag

SEQ ID NO: 8046641 - DNA, 22 bp, Homo sapiens
ttgattttaaaatagtgacact

SEQ ID NO: 8046642 - DNA, 22 bp, Homo sapiens
ttgatttcaaaatatatgcttg

SEQ ID NO: 8046643 - DNA, 22 bp, Homo sapiens
ttgattttcaattcattgacaa

SEQ ID NO: 8046644 - DNA, 22 bp, Homo sapiens
ttgattttgcctgatctgagag

SEQ ID NO: 8046645 - DNA, 21 bp, Homo sapiens
ttgattttaggaagtttgtca

SEQ ID NO: 8046646 - DNA, 20 bp, Homo sapiens
ttgcaaagtgaatagcaatt

SEQ ID NO: 8046647 - DNA, 22 bp, Homo sapiens
ttgcaaagagataatcctaggc

SEQ ID NO: 8046648 - DNA, 22 bp, Homo sapiens
ttgcaaaggggaataaagcaat

SEQ ID NO: 8046649 - DNA, 20 bp, Homo sapiens
ttgaggcatgtctagaagta

SEQ ID NO: 8046650 - DNA, 22 bp, Homo sapiens
ttgatcttcatcgaaatattgt

SEQ ID NO: 8046651 - DNA, 22 bp, Homo sapiens
ttctgctttcagttcttctggg

SEQ ID NO: 8046652 - DNA, 22 bp, Homo sapiens
ttctgcttttctctgtctgagt

SEQ ID NO: 8046653 - DNA, 20 bp, Homo sapiens
ttctatacatatcactgaaa

SEQ ID NO: 8046654 - DNA, 22 bp, Homo sapiens
ttctgagatacttttggcacca

SEQ ID NO: 8046655 - DNA, 22 bp, Homo sapiens
ttctggggccaattgccactgc

SEQ ID NO: 8046656 - DNA, 19 bp, Homo sapiens
ttctggggcctggccttgg

SEQ ID NO: 8046657 - DNA, 22 bp, Homo sapiens
ttcttaaaacttatggacaggt

SEQ ID NO: 8046658 - DNA, 22 bp, Homo sapiens
ttctgtttgccatatatagtag

SEQ ID NO: 8046659 - DNA, 22 bp, Homo sapiens
ttcttgaccatgtatgtggtcc

SEQ ID NO: 8046660 - DNA, 22 bp, Homo sapiens
ttcttctttccaattacatggt

SEQ ID NO: 8046661 - DNA, 22 bp, Homo sapiens
ttcttctttcctataattaatt

SEQ ID NO: 8046662 - DNA, 19 bp, Homo sapiens
ttcttgaacatgtttctca

SEQ ID NO: 8046663 - DNA, 22 bp, Homo sapiens
tttctggaacagtaattgaaga

SEQ ID NO: 8046664 - DNA, 22 bp, Homo sapiens
tttctggattcatacagatgta

SEQ ID NO: 8046665 - DNA, 22 bp, Homo sapiens
tttctgtacacccactattcat

SEQ ID NO: 8046666 - DNA, 22 bp, Homo sapiens
tttctgacctgcaacagtttac

SEQ ID NO: 8046667 - DNA, 22 bp, Homo sapiens
tttctgaataactctatgatat

SEQ ID NO: 8046668 - DNA, 23 bp, Homo sapiens
tttctgaagttgagatggacttt

SEQ ID NO: 8046669 - DNA, 22 bp, Homo sapiens
tttctcctgctagaacaaggag

SEQ ID NO: 8046670 - DNA, 22 bp, Homo sapiens
tttctcctgagttccacgctac

SEQ ID NO: 8046671 - DNA, 22 bp, Homo sapiens
tttctccttgtgtctcctttga

SEQ ID NO: 8046672 - DNA, 17 bp, Homo sapiens
tttctccttccatctca

SEQ ID NO: 8046673 - DNA, 19 bp, Homo sapiens
tttctctgtgcaccttttc

SEQ ID NO: 8046674 - DNA, 22 bp, Homo sapiens
tttctctgtgccatttccataa

SEQ ID NO: 8046675 - DNA, 21 bp, Homo sapiens
tttctgaaggcaacatctatc

SEQ ID NO: 8046676 - DNA, 22 bp, Homo sapiens
tttctgaaatctcttttgagga

SEQ ID NO: 8046677 - DNA, 22 bp, Homo sapiens
tttctgaaatgctggctttgga

SEQ ID NO: 8046678 - DNA, 22 bp, Homo sapiens
tttctgtatttaaaagatctgg

SEQ ID NO: 8046679 - DNA, 22 bp, Homo sapiens
tttctgtcattactttcctccc

SEQ ID NO: 8046680 - DNA, 22 bp, Homo sapiens
tttcttcaattgctaacaagga

SEQ ID NO: 8046681 - DNA, 22 bp, Homo sapiens
tttcttccaaaggcacgttctc

SEQ ID NO: 8046682 - DNA, 22 bp, Homo sapiens
tttcttcccaagcagtttcaga

SEQ ID NO: 8046683 - DNA, 22 bp, Homo sapiens
tttcttctatgtgtgatatttt

SEQ ID NO: 8046684 - DNA, 22 bp, Homo sapiens
tttcttctatgtgtgatatttt

SEQ ID NO: 8046685 - DNA, 22 bp, Homo sapiens
tttcttctaagatttcaaacta

SEQ ID NO: 8046686 - DNA, 22 bp, Homo sapiens
tttcttctctaatctcaatgat

SEQ ID NO: 8046687 - DNA, 22 bp, Homo sapiens
tttcttgtctttagtatctggc

SEQ ID NO: 8046688 - DNA, 22 bp, Homo sapiens
tttctaagtaagattaacttct

SEQ ID NO: 8046689 - DNA, 22 bp, Homo sapiens
tttctaagtaaacacagcatac

SEQ ID NO: 8046690 - DNA, 23 bp, Homo sapiens
tttctaaggtttttatctgctac

SEQ ID NO: 8046691 - DNA, 22 bp, Homo sapiens
tttctaagtgaacattcaagtt

SEQ ID NO: 8046692 - DNA, 22 bp, Homo sapiens
tttctaagtatcttgcagtttt

SEQ ID NO: 8046693 - DNA, 22 bp, Homo sapiens
tttctaagtgtgtttcatagga

SEQ ID NO: 8046694 - DNA, 22 bp, Homo sapiens
tttcctggttggggacgtggtt

SEQ ID NO: 8046695 - DNA, 22 bp, Homo sapiens
tttcatttcatagaattgtgtt

SEQ ID NO: 8046696 - DNA, 22 bp, Homo sapiens
tttcagtggagtgacatgatct

SEQ ID NO: 8046697 - DNA, 22 bp, Homo sapiens
tttcattttggttatgccataa

SEQ ID NO: 8046698 - DNA, 22 bp, Homo sapiens
tttcattttggttatgccataa

SEQ ID NO: 8046699 - DNA, 22 bp, Homo sapiens
tttcatttcatagaattgtgtt

SEQ ID NO: 8046700 - DNA, 22 bp, Homo sapiens
ttgtgaatggtgccgcaataaa

SEQ ID NO: 8046701 - DNA, 21 bp, Homo sapiens
ttgtgtttccccagtcacttt

SEQ ID NO: 8046702 - DNA, 22 bp, Homo sapiens
ttgtgtttcccttgcatattcc

SEQ ID NO: 8046703 - DNA, 22 bp, Homo sapiens
ttgtgttaaggtgcatctagtg

SEQ ID NO: 8046704 - DNA, 22 bp, Homo sapiens
ttgtgtttctggccaagatgga

SEQ ID NO: 8046705 - DNA, 22 bp, Homo sapiens
ttgtgtttctgtgatatgtaaa

SEQ ID NO: 8046706 - DNA, 22 bp, Homo sapiens
ttgtgtttgatgctgacacgca

SEQ ID NO: 8046707 - DNA, 22 bp, Homo sapiens
ttgtgtgtgtaactttatgaga

SEQ ID NO: 8046708 - DNA, 22 bp, Homo sapiens
ttgttacaggtcctagtggctg

SEQ ID NO: 8046709 - DNA, 22 bp, Homo sapiens
ttgtgttttcttatggcataaa

SEQ ID NO: 8046710 - DNA, 22 bp, Homo sapiens
ttgttttcacagctttgcccgg

SEQ ID NO: 8046711 - DNA, 22 bp, Homo sapiens
ttgttttcagggtgtcattcac

SEQ ID NO: 8046712 - DNA, 22 bp, Homo sapiens
ttgtttttaaacatgtgactga

SEQ ID NO: 8046713 - DNA, 23 bp, Homo sapiens
ttgtttctttgtattgtctctat

SEQ ID NO: 8046714 - DNA, 22 bp, Homo sapiens
ttgtttgaggtcactgatattt

SEQ ID NO: 8046715 - DNA, 22 bp, Homo sapiens
ttgtttctgagttttcatgtat

SEQ ID NO: 8046716 - DNA, 22 bp, Homo sapiens
ttgtttctcctggtgcctgata

SEQ ID NO: 8046717 - DNA, 22 bp, Homo sapiens
ttgcaatcaaaaagaagtacag

SEQ ID NO: 8046718 - DNA, 19 bp, Homo sapiens
ttggtgcacacatgggccc

SEQ ID NO: 8046719 - DNA, 22 bp, Homo sapiens
ttggtgggagaagactctggtt

SEQ ID NO: 8046720 - DNA, 22 bp, Homo sapiens
ttggtgggttaatgagtgactg

SEQ ID NO: 8046721 - DNA, 22 bp, Homo sapiens
ttgtgaatagtgccgctataaa

SEQ ID NO: 8046722 - DNA, 22 bp, Homo sapiens
ttgtgaatagtgccgctataaa

SEQ ID NO: 8046723 - DNA, 22 bp, Homo sapiens
ttgtgaatagtgccgcaataaa

SEQ ID NO: 8046724 - DNA, 22 bp, Homo sapiens
ttgtgaatggtgccgcaataaa

SEQ ID NO: 8046725 - DNA, 22 bp, Homo sapiens
ttgtgaatagtgccgcaataaa

SEQ ID NO: 8046726 - DNA, 22 bp, Homo sapiens
ttggttttagttcttgctcatg

SEQ ID NO: 8046727 - DNA, 22 bp, Homo sapiens
tttaatgttcatctcaaaggat

SEQ ID NO: 8046728 - DNA, 22 bp, Homo sapiens
ttgttttctccactgcatctta

SEQ ID NO: 8046729 - DNA, 22 bp, Homo sapiens
ttgtttttatgaacatccagga

SEQ ID NO: 8046730 - DNA, 22 bp, Homo sapiens
tttattatagtggtggggactg

SEQ ID NO: 8046731 - DNA, 22 bp, Homo sapiens
tttattagtgcttgtatcactg

SEQ ID NO: 8046732 - DNA, 22 bp, Homo sapiens
tttattagtgcttgtatcactg

SEQ ID NO: 8046733 - DNA, 22 bp, Homo sapiens
tttattagattatcaaagaggt

SEQ ID NO: 8046734 - DNA, 22 bp, Homo sapiens
tttattattctgttctctctac

SEQ ID NO: 8046735 - DNA, 22 bp, Homo sapiens
tttataagaagcaatgtctgag

SEQ ID NO: 8046736 - DNA, 22 bp, Homo sapiens
tttataaacagtaccacggtgc

SEQ ID NO: 8046737 - DNA, 22 bp, Homo sapiens
tttataaaatagactgggtcta

SEQ ID NO: 8046738 - DNA, 22 bp, Homo sapiens
tttatagttatatacagatgtt

SEQ ID NO: 8046739 - DNA, 23 bp, Homo sapiens
tttgcaaattttcctgactactc

SEQ ID NO: 8046740 - DNA, 20 bp, Homo sapiens
tttgatttcacaaggccagt

SEQ ID NO: 8046741 - DNA, 22 bp, Homo sapiens
tttgcaaaatgaggtgaagagt

SEQ ID NO: 8046742 - DNA, 22 bp, Homo sapiens
tttgattttcagcaatagtggc

SEQ ID NO: 8046743 - DNA, 22 bp, Homo sapiens
tttgcaaataccatgaaacttg

SEQ ID NO: 8046744 - DNA, 22 bp, Homo sapiens
tttgtacacaacctgtggtagt

SEQ ID NO: 8046745 - DNA, 22 bp, Homo sapiens
tttgttgtgaacagaataatat

SEQ ID NO: 8046746 - DNA, 22 bp, Homo sapiens
tttgtcaaagatcagatgcttt

SEQ ID NO: 8046747 - DNA, 22 bp, Homo sapiens
tttgtagaactatacttacatt

SEQ ID NO: 8046748 - DNA, 22 bp, Homo sapiens
tttgtagagggtaattgacaga

SEQ ID NO: 8046749 - DNA, 22 bp, Homo sapiens
tttgttttgaactagctcagaa

SEQ ID NO: 8046750 - DNA, 22 bp, Homo sapiens
tttgttttctgtaggcctttcc

SEQ ID NO: 8046751 - DNA, 22 bp, Homo sapiens
tttgttttcaatgtgtcattca

SEQ ID NO: 8046752 - DNA, 22 bp, Homo sapiens
ttttgaaagagtcctgctacag

SEQ ID NO: 8046753 - DNA, 22 bp, Homo sapiens
ttttcctttggaagatgcatat

SEQ ID NO: 8046754 - DNA, 20 bp, Homo sapiens
ttttccttctgagtatgttg

SEQ ID NO: 8046755 - DNA, 22 bp, Homo sapiens
ttttgacaatgctaatctcaat

SEQ ID NO: 8046756 - DNA, 22 bp, Homo sapiens
ttttgatatcatgatgaacaga

SEQ ID NO: 8046757 - DNA, 22 bp, Homo sapiens
ttttgaaagccaggtttgtatg

SEQ ID NO: 8046758 - DNA, 22 bp, Homo sapiens
ttttgaaagccaggtttgtatg

SEQ ID NO: 8046759 - DNA, 22 bp, Homo sapiens
ttttgaaagggtgatttggctt

SEQ ID NO: 8046760 - DNA, 22 bp, Homo sapiens
ttttgaagaagatgggaattta

SEQ ID NO: 8046761 - DNA, 22 bp, Homo sapiens
ttttggaatttatacagtaatg

SEQ ID NO: 8046762 - DNA, 22 bp, Homo sapiens
tttttctactgcccacattgta

SEQ ID NO: 8046763 - DNA, 22 bp, Homo sapiens
tttttgaaggctgatgtgatta

SEQ ID NO: 8046764 - DNA, 22 bp, Homo sapiens
cactgcactccagcctgggaga

SEQ ID NO: 8046765 - DNA, 22 bp, Homo sapiens
cactgcactccagcctgggaga

SEQ ID NO: 8046766 - DNA, 22 bp, Homo sapiens
cactgcactccagcctgggaga

SEQ ID NO: 8046767 - DNA, 21 bp, Homo sapiens
cactctcccaatccttgctga

SEQ ID NO: 8046768 - DNA, 21 bp, Homo sapiens
cactccacttagaacagggtt

SEQ ID NO: 8046769 - DNA, 22 bp, Homo sapiens
cactatttcctggattttgacg

SEQ ID NO: 8046770 - DNA, 23 bp, Homo sapiens
cacggcagcctccgagggtgctg

SEQ ID NO: 8046771 - DNA, 22 bp, Homo sapiens
ggccagggccaaggctttccca

SEQ ID NO: 8046772 - DNA, 22 bp, Homo sapiens
cacgccagccggacactgggcc

SEQ ID NO: 8046773 - DNA, 22 bp, Homo sapiens
caccaggatgggcaggtaggtc

SEQ ID NO: 8046774 - DNA, 22 bp, Homo sapiens
caccaggctgcccaggacaggg

SEQ ID NO: 8046775 - DNA, 22 bp, Homo sapiens
cacctgcctcatttgtccctgc

SEQ ID NO: 8046776 - DNA, 22 bp, Homo sapiens
caccctgggctgggcctgttaa

SEQ ID NO: 8046777 - DNA, 22 bp, Homo sapiens
caccaggctggagtgcagaggt

SEQ ID NO: 8046778 - DNA, 22 bp, Homo sapiens
ggccaggctggttccttgacct

SEQ ID NO: 8046779 - DNA, 22 bp, Homo sapiens
ggccagggaggagaggcccctg

SEQ ID NO: 8046780 - DNA, 22 bp, Homo sapiens
ggccaggctggtctcagacttc

SEQ ID NO: 8046781 - DNA, 22 bp, Homo sapiens
ggccaggctggtctcagacttc

SEQ ID NO: 8046782 - DNA, 22 bp, Homo sapiens
ggccaggctgctgggaccccgc

SEQ ID NO: 8046783 - DNA, 22 bp, Homo sapiens
ggccaggctgccctgggagcag

SEQ ID NO: 8046784 - DNA, 22 bp, Homo sapiens
ggccaggctgccctgggagcag

SEQ ID NO: 8046785 - DNA, 22 bp, Homo sapiens
ggctctgctggtaagatgcctc

SEQ ID NO: 8046786 - DNA, 22 bp, Homo sapiens
cactgcactccagcctgggtca

SEQ ID NO: 8046787 - DNA, 22 bp, Homo sapiens
cactgcactccagcctgggtca

SEQ ID NO: 8046788 - DNA, 22 bp, Homo sapiens
cactgcactccagcctgggtca

SEQ ID NO: 8046789 - DNA, 22 bp, Homo sapiens
cactgcactccagcctgggtca

SEQ ID NO: 8046790 - DNA, 22 bp, Homo sapiens
cactgcactccagcctgggcaa

SEQ ID NO: 8046791 - DNA, 22 bp, Homo sapiens
cactgcactccagcctgggtga

SEQ ID NO: 8046792 - DNA, 22 bp, Homo sapiens
cactgcactccagcctgggtga

SEQ ID NO: 8046793 - DNA, 22 bp, Homo sapiens
cactgcactccagcctgggtga

SEQ ID NO: 8046794 - DNA, 22 bp, Homo sapiens
cactgcactccagcctgggtga

SEQ ID NO: 8046795 - DNA, 22 bp, Homo sapiens
cactgcactccagcttgggtga

SEQ ID NO: 8046796 - DNA, 22 bp, Homo sapiens
cactgggagtacaaagaatggg

SEQ ID NO: 8046797 - DNA, 20 bp, Homo sapiens
ggctgctgtgggcagagagg

SEQ ID NO: 8046798 - DNA, 22 bp, Homo sapiens
ggctggcaaaaaccttctctga

SEQ ID NO: 8046799 - DNA, 17 bp, Homo sapiens
ggctgctgtgctggtgc

SEQ ID NO: 8046800 - DNA, 20 bp, Homo sapiens
ggctctgcttgtgagcagcc

SEQ ID NO: 8046801 - DNA, 20 bp, Homo sapiens
ggctctgcttgtgagcagcc

SEQ ID NO: 8046802 - DNA, 22 bp, Homo sapiens
ggctctggaaagtgtccttgat

SEQ ID NO: 8046803 - DNA, 20 bp, Homo sapiens
ggctctggaatctggtgggc

SEQ ID NO: 8046804 - DNA, 20 bp, Homo sapiens
cactgtggcacattggttta

SEQ ID NO: 8046805 - DNA, 22 bp, Homo sapiens
cactgtggcttaccaaagctaa

SEQ ID NO: 8046806 - DNA, 22 bp, Homo sapiens
cactgtggaattagaataacct

SEQ ID NO: 8046807 - DNA, 22 bp, Homo sapiens
cactgtggcaacctgtgcccaa

SEQ ID NO: 8046808 - DNA, 22 bp, Homo sapiens
cactgtggatacagaaattagt

SEQ ID NO: 8046809 - DNA, 22 bp, Homo sapiens
cactgtggagcaaatttattta

SEQ ID NO: 8046810 - DNA, 19 bp, Homo sapiens
cacttcacatggtgaaagc

SEQ ID NO: 8046811 - DNA, 22 bp, Homo sapiens
cacatgtgtgctgaggactgtg

SEQ ID NO: 8046812 - DNA, 22 bp, Homo sapiens
cacatgtgggaaatggtgctta

SEQ ID NO: 8046813 - DNA, 22 bp, Homo sapiens
cacatgtgtatatgtgaggggg

SEQ ID NO: 8046814 - DNA, 22 bp, Homo sapiens
cacatgtgcaaatactgaggct

SEQ ID NO: 8046815 - DNA, 22 bp, Homo sapiens
cacatgtgcagttacatgaatt

SEQ ID NO: 8046816 - DNA, 22 bp, Homo sapiens
cacattcctggtgctcagcagc

SEQ ID NO: 8046817 - DNA, 22 bp, Homo sapiens
caccaggagccatcaggagtcc

SEQ ID NO: 8046818 - DNA, 22 bp, Homo sapiens
ggcagatggaagaggctgggtc

SEQ ID NO: 8046819 - DNA, 22 bp, Homo sapiens
cacatgaaggctggggtcgtga

SEQ ID NO: 8046820 - DNA, 22 bp, Homo sapiens
ggcaatatggtgaaaccccatc

SEQ ID NO: 8046821 - DNA, 22 bp, Homo sapiens
ggcaatttgcagtttgtcttat

SEQ ID NO: 8046822 - DNA, 22 bp, Homo sapiens
ggcaattttaggcatgaatgaa

SEQ ID NO: 8046823 - DNA, 22 bp, Homo sapiens
ggcaaggggtcaggctgagaca

SEQ ID NO: 8046824 - DNA, 22 bp, Homo sapiens
ggcaagtgatcctggagcaccg

SEQ ID NO: 8046825 - DNA, 22 bp, Homo sapiens
ggcaagtggtagaacatctgag

SEQ ID NO: 8046826 - DNA, 22 bp, Homo sapiens
cacagtgcaatcggccacaaat

SEQ ID NO: 8046827 - DNA, 17 bp, Homo sapiens
cacaggtgtggtttgag

SEQ ID NO: 8046828 - DNA, 22 bp, Homo sapiens
cacaggtgtctctagtagcgtt

SEQ ID NO: 8046829 - DNA, 22 bp, Homo sapiens
cacaggtgtccaatacctgctt

SEQ ID NO: 8046830 - DNA, 21 bp, Homo sapiens
cacaggtgggtcagtgaggcc

SEQ ID NO: 8046831 - DNA, 22 bp, Homo sapiens
cacaggtggcttctttcatctt

SEQ ID NO: 8046832 - DNA, 22 bp, Homo sapiens
cacaggtgtatgaatatgtcca

SEQ ID NO: 8046833 - DNA, 23 bp, Homo sapiens
cacaggtgtttcatcttctcagt

SEQ ID NO: 8046834 - DNA, 22 bp, Homo sapiens
cacaggtgtttgttatactcag

SEQ ID NO: 8046835 - DNA, 22 bp, Homo sapiens
cacaggtgttcttgcagtgaaa

SEQ ID NO: 8046836 - DNA, 22 bp, Homo sapiens
cacaggtgtgtcctggtcttgt

SEQ ID NO: 8046837 - DNA, 22 bp, Homo sapiens
cacaggtgtgtgccttatcaaa

SEQ ID NO: 8046838 - DNA, 22 bp, Homo sapiens
cacaggccaataccctctctct

SEQ ID NO: 8046839 - DNA, 22 bp, Homo sapiens
cacaggccagtaagactgtgtt

SEQ ID NO: 8046840 - DNA, 20 bp, Homo sapiens
cacaggccccaagacctgta

SEQ ID NO: 8046841 - DNA, 20 bp, Homo sapiens
cacaggccttgtgagcagac

SEQ ID NO: 8046842 - DNA, 20 bp, Homo sapiens
cacaggccttgtgagcagac

SEQ ID NO: 8046843 - DNA, 22 bp, Homo sapiens
cacaggcctggggttgagcggg

SEQ ID NO: 8046844 - DNA, 22 bp, Homo sapiens
cacaggcctgtctctttctaac

SEQ ID NO: 8046845 - DNA, 22 bp, Homo sapiens
cacagggcaggtactctcagag

SEQ ID NO: 8046846 - DNA, 22 bp, Homo sapiens
cacaggtgctcctcggggagct

SEQ ID NO: 8046847 - DNA, 22 bp, Homo sapiens
cacaggtggctccaagttagag

SEQ ID NO: 8046848 - DNA, 22 bp, Homo sapiens
cacaggtgccatctcttcatgg

SEQ ID NO: 8046849 - DNA, 22 bp, Homo sapiens
cacaggtgcaagaagttgcagt

SEQ ID NO: 8046850 - DNA, 22 bp, Homo sapiens
cacaggggcaaactgtagggga

SEQ ID NO: 8046851 - DNA, 22 bp, Homo sapiens
ggagagctgaagcatggacagg

SEQ ID NO: 8046852 - DNA, 22 bp, Homo sapiens
caatagaaaactcaatacttaa

SEQ ID NO: 8046853 - DNA, 22 bp, Homo sapiens
caatagataactgagatagact

SEQ ID NO: 8046854 - DNA, 22 bp, Homo sapiens
gctggggaggcagcagagaaca

SEQ ID NO: 8046855 - DNA, 22 bp, Homo sapiens
gctggggagctagacctcagca

SEQ ID NO: 8046856 - DNA, 22 bp, Homo sapiens
caatcacaaagagacaagtgtc

SEQ ID NO: 8046857 - DNA, 22 bp, Homo sapiens
caattcccagctgccgggctgc

SEQ ID NO: 8046858 - DNA, 22 bp, Homo sapiens
ggagaaggcacacccacctctg

SEQ ID NO: 8046859 - DNA, 22 bp, Homo sapiens
ggactgggtaggagcccagggc

SEQ ID NO: 8046860 - DNA, 22 bp, Homo sapiens
cacacagtaggcactcattaat

SEQ ID NO: 8046861 - DNA, 21 bp, Homo sapiens
cacacagtgatctatccacat

SEQ ID NO: 8046862 - DNA, 22 bp, Homo sapiens
cacacagggagaaagaaagcct

SEQ ID NO: 8046863 - DNA, 22 bp, Homo sapiens
cacacaggtaagcctctttcaa

SEQ ID NO: 8046864 - DNA, 22 bp, Homo sapiens
ggagagcagggtcctgagatac

SEQ ID NO: 8046865 - DNA, 20 bp, Homo sapiens
ggagagccacatagtctccc

SEQ ID NO: 8046866 - DNA, 22 bp, Homo sapiens
ggagaagggccaattccatgta

SEQ ID NO: 8046867 - DNA, 22 bp, Homo sapiens
cacaacttagcaatgttttaga

SEQ ID NO: 8046868 - DNA, 20 bp, Homo sapiens
cacaactgtccacatgctcc

SEQ ID NO: 8046869 - DNA, 22 bp, Homo sapiens
ggacatggaagtatggagtgga

SEQ ID NO: 8046870 - DNA, 22 bp, Homo sapiens
ggacatgtgcaacttctttgga

SEQ ID NO: 8046871 - DNA, 22 bp, Homo sapiens
ggacatgttccttttcatcttt

SEQ ID NO: 8046872 - DNA, 23 bp, Homo sapiens
ggacatgtctctgggtattttga

SEQ ID NO: 8046873 - DNA, 22 bp, Homo sapiens
ggacatttgcacctacctcagc

SEQ ID NO: 8046874 - DNA, 22 bp, Homo sapiens
ggacatttttcttcctacaatg

SEQ ID NO: 8046875 - DNA, 22 bp, Homo sapiens
ggaagctgaatccagagacagg

SEQ ID NO: 8046876 - DNA, 22 bp, Homo sapiens
ggaagctggtaattgttgggac

SEQ ID NO: 8046877 - DNA, 22 bp, Homo sapiens
cacaaataccagtttcctaaca

SEQ ID NO: 8046878 - DNA, 22 bp, Homo sapiens
gctggagaaacaggaggaggaa

SEQ ID NO: 8046879 - DNA, 22 bp, Homo sapiens
gctggacaggccacatggagga

SEQ ID NO: 8046880 - DNA, 22 bp, Homo sapiens
gctgcctgccttgcctggagga

SEQ ID NO: 8046881 - DNA, 22 bp, Homo sapiens
gctgctggcgctgggcgtccgg

SEQ ID NO: 8046882 - DNA, 17 bp, Homo sapiens
gctggctgacccatgcc

SEQ ID NO: 8046883 - DNA, 22 bp, Homo sapiens
gctggcccagcgtggggccgtg

SEQ ID NO: 8046884 - DNA, 22 bp, Homo sapiens
caagcctgtctcaccagtgcta

SEQ ID NO: 8046885 - DNA, 22 bp, Homo sapiens
caagcccaggattccccagtta

SEQ ID NO: 8046886 - DNA, 22 bp, Homo sapiens
caagcccagatcctgcgtgtct

SEQ ID NO: 8046887 - DNA, 22 bp, Homo sapiens
caagcccactgctcagagccaa

SEQ ID NO: 8046888 - DNA, 22 bp, Homo sapiens
caagcccactgctcagagccaa

SEQ ID NO: 8046889 - DNA, 22 bp, Homo sapiens
gctggctgaggtctagctcttt

SEQ ID NO: 8046890 - DNA, 20 bp, Homo sapiens
gctgggctttgactgacaca

SEQ ID NO: 8046891 - DNA, 22 bp, Homo sapiens
gctggggaccagctgtctctga

SEQ ID NO: 8046892 - DNA, 22 bp, Homo sapiens
gctggggagcaagagtagtgag

SEQ ID NO: 8046893 - DNA, 22 bp, Homo sapiens
gctggggactccccaccatagc

SEQ ID NO: 8046894 - DNA, 22 bp, Homo sapiens
gctgggcttgtggccagctggg

SEQ ID NO: 8046895 - DNA, 22 bp, Homo sapiens
gctgggcttgtggccagctggg

SEQ ID NO: 8046896 - DNA, 22 bp, Homo sapiens
gctgggctcagacctagtgaac

SEQ ID NO: 8046897 - DNA, 22 bp, Homo sapiens
caagcgtggctgctctgatgga

SEQ ID NO: 8046898 - DNA, 22 bp, Homo sapiens
gctgccctgactccagcagcct

SEQ ID NO: 8046899 - DNA, 22 bp, Homo sapiens
gctctggaacctgccaggatgc

SEQ ID NO: 8046900 - DNA, 22 bp, Homo sapiens
gctctggactggggcctgagaa

SEQ ID NO: 8046901 - DNA, 22 bp, Homo sapiens
gctctggaccctggagtggctg

SEQ ID NO: 8046902 - DNA, 17 bp, Homo sapiens
gctctggcacaggattg

SEQ ID NO: 8046903 - DNA, 22 bp, Homo sapiens
caactagttttaatgttcatgg

SEQ ID NO: 8046904 - DNA, 22 bp, Homo sapiens
gctgccctgtctgcagcaggac

SEQ ID NO: 8046905 - DNA, 22 bp, Homo sapiens
caacaatatgctgagtttttca

SEQ ID NO: 8046906 - DNA, 22 bp, Homo sapiens
gtagaaaaagcagtaagtctca

SEQ ID NO: 8046907 - DNA, 22 bp, Homo sapiens
gtactttaaatcaatgtagatt

SEQ ID NO: 8046908 - DNA, 22 bp, Homo sapiens
gtactttagagtaaaatagacc

SEQ ID NO: 8046909 - DNA, 22 bp, Homo sapiens
gtactttaagactccagtagca

SEQ ID NO: 8046910 - DNA, 22 bp, Homo sapiens
gtaggcaggtggaggagtgaag

SEQ ID NO: 8046911 - DNA, 22 bp, Homo sapiens
gtacacactatgtattgtacac

SEQ ID NO: 8046912 - DNA, 22 bp, Homo sapiens
gtacacactatttaaagtgttt

SEQ ID NO: 8046913 - DNA, 22 bp, Homo sapiens
cagcagcctagggttccatcat

SEQ ID NO: 8046914 - DNA, 22 bp, Homo sapiens
gtacacactgtttgatcatttc

SEQ ID NO: 8046915 - DNA, 22 bp, Homo sapiens
gtacacagatgcttgagaatct

SEQ ID NO: 8046916 - DNA, 20 bp, Homo sapiens
gtactcagatcaagtcagct

SEQ ID NO: 8046917 - DNA, 22 bp, Homo sapiens
cagattctcactgtattcaggt

SEQ ID NO: 8046918 - DNA, 22 bp, Homo sapiens
cagattctgggcccagcttgtc

SEQ ID NO: 8046919 - DNA, 22 bp, Homo sapiens
cagatttaggtcactagaattt

SEQ ID NO: 8046920 - DNA, 22 bp, Homo sapiens
cagcagcagccccaggaaggtt

SEQ ID NO: 8046921 - DNA, 22 bp, Homo sapiens
cagcaaagcttgttccttcctg

SEQ ID NO: 8046922 - DNA, 19 bp, Homo sapiens
cagcagccagggggcccct

SEQ ID NO: 8046923 - DNA, 20 bp, Homo sapiens
cagcagccattctagtagta

SEQ ID NO: 8046924 - DNA, 22 bp, Homo sapiens
cagcagcccacgcgtgctgtcc

SEQ ID NO: 8046925 - DNA, 22 bp, Homo sapiens
cagcagccgagagggggctctg

SEQ ID NO: 8046926 - DNA, 22 bp, Homo sapiens
gtcacagaggctgccagggttg

SEQ ID NO: 8046927 - DNA, 22 bp, Homo sapiens
gtcacacagggcctccaaatca

SEQ ID NO: 8046928 - DNA, 22 bp, Homo sapiens
gtagggagcccagagcccagtg

SEQ ID NO: 8046929 - DNA, 22 bp, Homo sapiens
gtcagcaattcaagagctctta

SEQ ID NO: 8046930 - DNA, 22 bp, Homo sapiens
gtcagcaaggaaaatgtgtcac

SEQ ID NO: 8046931 - DNA, 22 bp, Homo sapiens
cagccaggcccagatcatgctg

SEQ ID NO: 8046932 - DNA, 22 bp, Homo sapiens
cagccaggatggagaactgttg

SEQ ID NO: 8046933 - DNA, 22 bp, Homo sapiens
cagccaggcccccgagtcgttg

SEQ ID NO: 8046934 - DNA, 22 bp, Homo sapiens
cagccaggagctccccctgctc

SEQ ID NO: 8046935 - DNA, 22 bp, Homo sapiens
cagccaggagcctctgcaacta

SEQ ID NO: 8046936 - DNA, 22 bp, Homo sapiens
cagccaggactcccatttagga

SEQ ID NO: 8046937 - DNA, 22 bp, Homo sapiens
cagccagaacctaggatgagct

SEQ ID NO: 8046938 - DNA, 22 bp, Homo sapiens
cagccagctggtgcggcagagc

SEQ ID NO: 8046939 - DNA, 22 bp, Homo sapiens
cagcatctggatttcctccact

SEQ ID NO: 8046940 - DNA, 22 bp, Homo sapiens
cagcatctctgcctgcctgcaa

SEQ ID NO: 8046941 - DNA, 22 bp, Homo sapiens
gtgaattacatgtatttttaag

SEQ ID NO: 8046942 - DNA, 22 bp, Homo sapiens
cagccaggcccccgagtcgttg

SEQ ID NO: 8046943 - DNA, 22 bp, Homo sapiens
gtgagcaattcaaaggcaggaa

SEQ ID NO: 8046944 - DNA, 22 bp, Homo sapiens
gtgagatggagttggtgtcttt

SEQ ID NO: 8046945 - DNA, 22 bp, Homo sapiens
cagccctgaaacaacctcctct

SEQ ID NO: 8046946 - DNA, 19 bp, Homo sapiens
cagccctcttaccactgtg

SEQ ID NO: 8046947 - DNA, 19 bp, Homo sapiens
cagccctcttaccactgtg

SEQ ID NO: 8046948 - DNA, 22 bp, Homo sapiens
cagccctctctgggccccaagg

SEQ ID NO: 8046949 - DNA, 20 bp, Homo sapiens
cagccctccagtggaggcag

SEQ ID NO: 8046950 - DNA, 22 bp, Homo sapiens
cagccctcctaccctgccaggc

SEQ ID NO: 8046951 - DNA, 22 bp, Homo sapiens
cagccctgtccagcagagggtg

SEQ ID NO: 8046952 - DNA, 22 bp, Homo sapiens
cagccctgtccctgagggacct

SEQ ID NO: 8046953 - DNA, 22 bp, Homo sapiens
cagccctggccccaggtggtct

SEQ ID NO: 8046954 - DNA, 22 bp, Homo sapiens
cagccctgtctatgactgatga

SEQ ID NO: 8046955 - DNA, 22 bp, Homo sapiens
gggtaaatctcttttcatggct

SEQ ID NO: 8046956 - DNA, 22 bp, Homo sapiens
ggggttggtttaaatgcttgag

SEQ ID NO: 8046957 - DNA, 20 bp, Homo sapiens
ggggttggctggcacaggga

SEQ ID NO: 8046958 - DNA, 22 bp, Homo sapiens
gggtaaggtcagccagaagttc

SEQ ID NO: 8046959 - DNA, 22 bp, Homo sapiens
gggtacagttcttccagtgtca

SEQ ID NO: 8046960 - DNA, 22 bp, Homo sapiens
ggggcctgtagagcttcaggga

SEQ ID NO: 8046961 - DNA, 19 bp, Homo sapiens
ggggcctgtgatggtcaca

SEQ ID NO: 8046962 - DNA, 22 bp, Homo sapiens
ggggcagaagtagtgcccctga

SEQ ID NO: 8046963 - DNA, 22 bp, Homo sapiens
ggggaggaagctctcagttcca

SEQ ID NO: 8046964 - DNA, 21 bp, Homo sapiens
ggggcagagctaggccctgca

SEQ ID NO: 8046965 - DNA, 23 bp, Homo sapiens
ggggcctgcaccggtctgcgcgg

SEQ ID NO: 8046966 - DNA, 21 bp, Homo sapiens
ggggcctctccacacagccgg

SEQ ID NO: 8046967 - DNA, 22 bp, Homo sapiens
ggggcctctgcagtcacgctgg

SEQ ID NO: 8046968 - DNA, 22 bp, Homo sapiens
ggggcagcctccaggaaagctg

SEQ ID NO: 8046969 - DNA, 22 bp, Homo sapiens
gggctgtggagccgcgagggct

SEQ ID NO: 8046970 - DNA, 22 bp, Homo sapiens
gggctgtgtaatgtgctctttt

SEQ ID NO: 8046971 - DNA, 22 bp, Homo sapiens
gggctgtgctgagtaggaggtg

SEQ ID NO: 8046972 - DNA, 22 bp, Homo sapiens
gggctgtgcctcaggtggggtc

SEQ ID NO: 8046973 - DNA, 22 bp, Homo sapiens
gggctgtgagagtggggctgct

SEQ ID NO: 8046974 - DNA, 18 bp, Homo sapiens
gggctgtgagatgggaag

SEQ ID NO: 8046975 - DNA, 22 bp, Homo sapiens
gggctggaggcctgcctggtta

SEQ ID NO: 8046976 - DNA, 22 bp, Homo sapiens
gggctggaggtgagcaggacag

SEQ ID NO: 8046977 - DNA, 21 bp, Homo sapiens
cagagccagactgctgaattt

SEQ ID NO: 8046978 - DNA, 22 bp, Homo sapiens
cagagccagaactagaccttgt

SEQ ID NO: 8046979 - DNA, 22 bp, Homo sapiens
cagagccagagacctgctgtgc

SEQ ID NO: 8046980 - DNA, 20 bp, Homo sapiens
gggtgtgggcccggccaggc

SEQ ID NO: 8046981 - DNA, 22 bp, Homo sapiens
gggttcagtccctcttgctact

SEQ ID NO: 8046982 - DNA, 22 bp, Homo sapiens
gggtcctgcgtgggcccaggac

SEQ ID NO: 8046983 - DNA, 22 bp, Homo sapiens
gggtacagttcttccagtgtca

SEQ ID NO: 8046984 - DNA, 22 bp, Homo sapiens
cagatatgtggattctattagc

SEQ ID NO: 8046985 - DNA, 22 bp, Homo sapiens
cagatgaataaatgatgaggta

SEQ ID NO: 8046986 - DNA, 19 bp, Homo sapiens
ggtcctcagcagagcatgc

SEQ ID NO: 8046987 - DNA, 22 bp, Homo sapiens
ggtcctcaatcccaacaaggca

SEQ ID NO: 8046988 - DNA, 22 bp, Homo sapiens
gggatgagagtagggtgtgaaa

SEQ ID NO: 8046989 - DNA, 22 bp, Homo sapiens
gggatgagagctgggacagaag

SEQ ID NO: 8046990 - DNA, 22 bp, Homo sapiens
cagagcagaagcggtcctcaca

SEQ ID NO: 8046991 - DNA, 22 bp, Homo sapiens
cagagccacagcctccagattt

SEQ ID NO: 8046992 - DNA, 19 bp, Homo sapiens
cagagcagtggttcctgaa

SEQ ID NO: 8046993 - DNA, 22 bp, Homo sapiens
gggcaggggtagcattccaagt

SEQ ID NO: 8046994 - DNA, 22 bp, Homo sapiens
gggcaggggtagcattccaagt

SEQ ID NO: 8046995 - DNA, 22 bp, Homo sapiens
gggcaggggtcagtggccccaa

SEQ ID NO: 8046996 - DNA, 22 bp, Homo sapiens
gggcaggggtcagtggccccaa

SEQ ID NO: 8046997 - DNA, 22 bp, Homo sapiens
cagagcagaaggtccaagcctg

SEQ ID NO: 8046998 - DNA, 18 bp, Homo sapiens
cagagcagaggtggagcg

SEQ ID NO: 8046999 - DNA, 18 bp, Homo sapiens
cagagcagaggtggagcg

SEQ ID NO: 8047000 - DNA, 22 bp, Homo sapiens
gggcaggtaggtgaaataatga

SEQ ID NO: 8047001 - DNA, 22 bp, Homo sapiens
cagagcagtgaggagttgtgta

SEQ ID NO: 8047002 - DNA, 22 bp, Homo sapiens
gggcaggtacaagatgcttctt

SEQ ID NO: 8047003 - DNA, 22 bp, Homo sapiens
gggcaggtactgggtggtgagc

SEQ ID NO: 8047004 - DNA, 22 bp, Homo sapiens
gggcaggggtcagtggccccaa

SEQ ID NO: 8047005 - DNA, 22 bp, Homo sapiens
cagaaaataaagtttctacgca

SEQ ID NO: 8047006 - DNA, 22 bp, Homo sapiens
cagaaaatagagtttctctgag

SEQ ID NO: 8047007 - DNA, 22 bp, Homo sapiens
ggctggcactctgtccagtgtc

SEQ ID NO: 8047008 - DNA, 22 bp, Homo sapiens
ggctggcacgaagccctgctgg

SEQ ID NO: 8047009 - DNA, 22 bp, Homo sapiens
ggctggcacccttggggatagg

SEQ ID NO: 8047010 - DNA, 22 bp, Homo sapiens
ggctggcacctgccctccgctg

SEQ ID NO: 8047011 - DNA, 22 bp, Homo sapiens
ggctggcacagagggctggtgt

SEQ ID NO: 8047012 - DNA, 22 bp, Homo sapiens
ggctggcacccttggggatagg

SEQ ID NO: 8047013 - DNA, 22 bp, Homo sapiens
ggctggcaagtgtctgctcatg

SEQ ID NO: 8047014 - DNA, 19 bp, Homo sapiens
ggctggcaagtgacagtgt

SEQ ID NO: 8047015 - DNA, 22 bp, Homo sapiens
gggaggcacgaggcgcgcagtg

SEQ ID NO: 8047016 - DNA, 22 bp, Homo sapiens
gggaggcagtgctggaggctgg

SEQ ID NO: 8047017 - DNA, 22 bp, Homo sapiens
gggagctgctgaacacaagggt

SEQ ID NO: 8047018 - DNA, 22 bp, Homo sapiens
gggagctgccaccacccctggg

SEQ ID NO: 8047019 - DNA, 21 bp, Homo sapiens
gggagctggaaactgggtgac

SEQ ID NO: 8047020 - DNA, 21 bp, Homo sapiens
gggagctggaaactgggtgac

SEQ ID NO: 8047021 - DNA, 20 bp, Homo sapiens
gggagctggaattgtcttag

SEQ ID NO: 8047022 - DNA, 22 bp, Homo sapiens
gggagctgcacacgccccggaa

SEQ ID NO: 8047023 - DNA, 22 bp, Homo sapiens
gggagctgatgatgtaagtccc

SEQ ID NO: 8047024 - DNA, 22 bp, Homo sapiens
gggagccacagtagcagctact

SEQ ID NO: 8047025 - DNA, 22 bp, Homo sapiens
cagacagaaggctccttgaggt

SEQ ID NO: 8047026 - DNA, 22 bp, Homo sapiens
atggcagacgaggcagcagggg

SEQ ID NO: 8047027 - DNA, 22 bp, Homo sapiens
atggctgcagccggccctgcgc

SEQ ID NO: 8047028 - DNA, 22 bp, Homo sapiens
atggctgcatcatcctggttga

SEQ ID NO: 8047029 - DNA, 22 bp, Homo sapiens
atggctgcagtccgtgccctgg

SEQ ID NO: 8047030 - DNA, 22 bp, Homo sapiens
gagcacagctggaggtagcatt

SEQ ID NO: 8047031 - DNA, 22 bp, Homo sapiens
gagctctgtgtagcctgagggt

SEQ ID NO: 8047032 - DNA, 22 bp, Homo sapiens
gagccctcattgaatctgcatt

SEQ ID NO: 8047033 - DNA, 22 bp, Homo sapiens
gagccctcaatgaatctgcatt

SEQ ID NO: 8047034 - DNA, 22 bp, Homo sapiens
atgggcagagctggtgggaggc

SEQ ID NO: 8047035 - DNA, 22 bp, Homo sapiens
atgggcagacagggagctcacg

SEQ ID NO: 8047036 - DNA, 22 bp, Homo sapiens
atggatgtgaagagggagaagc

SEQ ID NO: 8047037 - DNA, 22 bp, Homo sapiens
atggcacacaggtctgcaaggg

SEQ ID NO: 8047038 - DNA, 22 bp, Homo sapiens
atggcagacctcctggccacaa

SEQ ID NO: 8047039 - DNA, 22 bp, Homo sapiens
atggcagacctcctggccacaa

SEQ ID NO: 8047040 - DNA, 22 bp, Homo sapiens
atggcagacctgggctggagaa

SEQ ID NO: 8047041 - DNA, 22 bp, Homo sapiens
atggcagaaaggcatgtgggcc

SEQ ID NO: 8047042 - DNA, 22 bp, Homo sapiens
atggcagaaagaatagaggcta

SEQ ID NO: 8047043 - DNA, 22 bp, Homo sapiens
atggcaccttccccagagctca

SEQ ID NO: 8047044 - DNA, 22 bp, Homo sapiens
atggcaccaaatatgtctcatt

SEQ ID NO: 8047045 - DNA, 21 bp, Homo sapiens
gagaatagaggggaagctgaa

SEQ ID NO: 8047046 - DNA, 22 bp, Homo sapiens
gagacaggatttaaccaaagct

SEQ ID NO: 8047047 - DNA, 22 bp, Homo sapiens
gagacaggccaggtggtactta

SEQ ID NO: 8047048 - DNA, 22 bp, Homo sapiens
gagacaggcagctagtgggtca

SEQ ID NO: 8047049 - DNA, 22 bp, Homo sapiens
gagacaggcagctagtgggtca

SEQ ID NO: 8047050 - DNA, 22 bp, Homo sapiens
atgctgtgtggtcaagttaatt

SEQ ID NO: 8047051 - DNA, 22 bp, Homo sapiens
atgctgtgtcctagtgaaagaa

SEQ ID NO: 8047052 - DNA, 22 bp, Homo sapiens
atgctgggaaactgaaaggaat

SEQ ID NO: 8047053 - DNA, 22 bp, Homo sapiens
atgctggcagccgagtgctcca

SEQ ID NO: 8047054 - DNA, 22 bp, Homo sapiens
atgctgtggatgccttgcccca

SEQ ID NO: 8047055 - DNA, 22 bp, Homo sapiens
atgctgtggccagagttcaact

SEQ ID NO: 8047056 - DNA, 22 bp, Homo sapiens
atgctgtgtattttactctttc

SEQ ID NO: 8047057 - DNA, 22 bp, Homo sapiens
atgctgtgaaaaagaaggctga

SEQ ID NO: 8047058 - DNA, 22 bp, Homo sapiens
atgtggcacagcacagtaagag

SEQ ID NO: 8047059 - DNA, 22 bp, Homo sapiens
atgtggcagtgggaggtgaatt

SEQ ID NO: 8047060 - DNA, 22 bp, Homo sapiens
atgtgcttcattctacatgaca

SEQ ID NO: 8047061 - DNA, 22 bp, Homo sapiens
atgttatgacaagcatgacaga

SEQ ID NO: 8047062 - DNA, 22 bp, Homo sapiens
gaggtgtggtcctcagccccca

SEQ ID NO: 8047063 - DNA, 22 bp, Homo sapiens
gaggtgtggtcctcagccccca

SEQ ID NO: 8047064 - DNA, 22 bp, Homo sapiens
gagtgcagtatgagaggctgct

SEQ ID NO: 8047065 - DNA, 22 bp, Homo sapiens
gaggcacagagccctaggagct

SEQ ID NO: 8047066 - DNA, 22 bp, Homo sapiens
atgggcaggcaaggtggcgagt

SEQ ID NO: 8047067 - DNA, 22 bp, Homo sapiens
atgggcaggcactggctctcag

SEQ ID NO: 8047068 - DNA, 22 bp, Homo sapiens
atgggcagctgcagcagtggtg

SEQ ID NO: 8047069 - DNA, 22 bp, Homo sapiens
atgggcagcagctgtcattttc

SEQ ID NO: 8047070 - DNA, 22 bp, Homo sapiens
gaggcctgggttggaggtgcat

SEQ ID NO: 8047071 - DNA, 22 bp, Homo sapiens
atgacacttggtgatactttgt

SEQ ID NO: 8047072 - DNA, 22 bp, Homo sapiens
atgacacaagcagaggctctaa

SEQ ID NO: 8047073 - DNA, 22 bp, Homo sapiens
atgacacataaaacaaggactg

SEQ ID NO: 8047074 - DNA, 22 bp, Homo sapiens
atgacacaattttagagctgaa

SEQ ID NO: 8047075 - DNA, 22 bp, Homo sapiens
atgacacatttgtgctgttgaa

SEQ ID NO: 8047076 - DNA, 22 bp, Homo sapiens
atgacagaccctctaaagacaa

SEQ ID NO: 8047077 - DNA, 22 bp, Homo sapiens
atgacagaggagtgcaggtgat

SEQ ID NO: 8047078 - DNA, 22 bp, Homo sapiens
atgacagaggattgtaaagagg

SEQ ID NO: 8047079 - DNA, 22 bp, Homo sapiens
ctttttcactgtgtcctcacac

SEQ ID NO: 8047080 - DNA, 22 bp, Homo sapiens
atgagataggaacaaacttaca

SEQ ID NO: 8047081 - DNA, 22 bp, Homo sapiens
atgagaaggacataaattatag

SEQ ID NO: 8047082 - DNA, 22 bp, Homo sapiens
ctttacttcagcaagctttcct

SEQ ID NO: 8047083 - DNA, 22 bp, Homo sapiens
ctttattgtccttcttaggtgg

SEQ ID NO: 8047084 - DNA, 22 bp, Homo sapiens
ctttattagatgtagactttct

SEQ ID NO: 8047085 - DNA, 21 bp, Homo sapiens
atctttgaagcatgcagtgag

SEQ ID NO: 8047086 - DNA, 22 bp, Homo sapiens
atctttctatggtactttctcc

SEQ ID NO: 8047087 - DNA, 21 bp, Homo sapiens
atctttattacgcagagaaga

SEQ ID NO: 8047088 - DNA, 22 bp, Homo sapiens
gaagccttgaactgcaaacccc

SEQ ID NO: 8047089 - DNA, 22 bp, Homo sapiens
atgatgtaatggaaagaacaga

SEQ ID NO: 8047090 - DNA, 22 bp, Homo sapiens
atgatgtaagggtaattgtcta

SEQ ID NO: 8047091 - DNA, 22 bp, Homo sapiens
atgatgtaacataaagatgtct

SEQ ID NO: 8047092 - DNA, 22 bp, Homo sapiens
atgatgtagacaaaaatatgct

SEQ ID NO: 8047093 - DNA, 22 bp, Homo sapiens
atgatgtaccactttctcagtt

SEQ ID NO: 8047094 - DNA, 22 bp, Homo sapiens
atgatgtactagttaaatatta

SEQ ID NO: 8047095 - DNA, 22 bp, Homo sapiens
gaagagcatttgcccaggctgt

SEQ ID NO: 8047096 - DNA, 22 bp, Homo sapiens
atgcatttgacgggatatattt

SEQ ID NO: 8047097 - DNA, 22 bp, Homo sapiens
atgccactgcactccagcctgg

SEQ ID NO: 8047098 - DNA, 22 bp, Homo sapiens
atgccactgcacttcagcctgg

SEQ ID NO: 8047099 - DNA, 22 bp, Homo sapiens
atgccactgcacttcagcctgg

SEQ ID NO: 8047100 - DNA, 22 bp, Homo sapiens
gacaggaaacaagaaggcagga

SEQ ID NO: 8047101 - DNA, 22 bp, Homo sapiens
atgcctggtatgaagcaaggaa

SEQ ID NO: 8047102 - DNA, 22 bp, Homo sapiens
gaatttctggaccctttgagaa

SEQ ID NO: 8047103 - DNA, 22 bp, Homo sapiens
atttgtaatttcttatctgtgt

SEQ ID NO: 8047104 - DNA, 22 bp, Homo sapiens
attttagatttaagaataaggt

SEQ ID NO: 8047105 - DNA, 22 bp, Homo sapiens
attttcatgactaccttaaata

SEQ ID NO: 8047106 - DNA, 22 bp, Homo sapiens
gccttcctgcagctctgagcgt

SEQ ID NO: 8047107 - DNA, 20 bp, Homo sapiens
gccttccagttcagtggcac

SEQ ID NO: 8047108 - DNA, 22 bp, Homo sapiens
gcctgtgcttaactgacgtgag

SEQ ID NO: 8047109 - DNA, 22 bp, Homo sapiens
gcctgtgctgttccctctgcca

SEQ ID NO: 8047110 - DNA, 22 bp, Homo sapiens
gctcagagaatcagcagacacc

SEQ ID NO: 8047111 - DNA, 22 bp, Homo sapiens
gctcagagaatttactgctgcc

SEQ ID NO: 8047112 - DNA, 19 bp, Homo sapiens
gctcagagacacctgttgc

SEQ ID NO: 8047113 - DNA, 22 bp, Homo sapiens
gctcagactgcacaccctggtc

SEQ ID NO: 8047114 - DNA, 22 bp, Homo sapiens
gccttccttttaccaccagcca

SEQ ID NO: 8047115 - DNA, 22 bp, Homo sapiens
gctctgctgtgtttgttcagca

SEQ ID NO: 8047116 - DNA, 22 bp, Homo sapiens
caaagaatgagtgagtacataa

SEQ ID NO: 8047117 - DNA, 22 bp, Homo sapiens
gccagctggaaatctgcttgaa

SEQ ID NO: 8047118 - DNA, 22 bp, Homo sapiens
gccagctggagactggcagggg

SEQ ID NO: 8047119 - DNA, 18 bp, Homo sapiens
atttatgctaatgggata

SEQ ID NO: 8047120 - DNA, 22 bp, Homo sapiens
gcatggcattaacaagatggaa

SEQ ID NO: 8047121 - DNA, 22 bp, Homo sapiens
gcatggcatttgaaggtagaag

SEQ ID NO: 8047122 - DNA, 22 bp, Homo sapiens
gcatggcatttgaaggtagaag

SEQ ID NO: 8047123 - DNA, 22 bp, Homo sapiens
gccagccacaagggaggcttgt

SEQ ID NO: 8047124 - DNA, 22 bp, Homo sapiens
gccagccacgttagactggccc

SEQ ID NO: 8047125 - DNA, 22 bp, Homo sapiens
gccagccataggccagcactgg

SEQ ID NO: 8047126 - DNA, 22 bp, Homo sapiens
gccagccataggccagcactgg

SEQ ID NO: 8047127 - DNA, 21 bp, Homo sapiens
gccagctgcagggcttccttg

SEQ ID NO: 8047128 - DNA, 22 bp, Homo sapiens
gccagctgcatctcctgggctg

SEQ ID NO: 8047129 - DNA, 22 bp, Homo sapiens
gccagccagagaggcatggtta

SEQ ID NO: 8047130 - DNA, 22 bp, Homo sapiens
gccagccagagaggcatggtta

SEQ ID NO: 8047131 - DNA, 22 bp, Homo sapiens
gccagccagagtggctgtgtgt

SEQ ID NO: 8047132 - DNA, 22 bp, Homo sapiens
gccagccagagtccatctgaga

SEQ ID NO: 8047133 - DNA, 22 bp, Homo sapiens
gccagccagtttgctgatggct

SEQ ID NO: 8047134 - DNA, 22 bp, Homo sapiens
gccagccagggaagggagagac

SEQ ID NO: 8047135 - DNA, 22 bp, Homo sapiens
gccagccagggaagggagagac

SEQ ID NO: 8047136 - DNA, 22 bp, Homo sapiens
gccagccacttcccagactggc

SEQ ID NO: 8047137 - DNA, 22 bp, Homo sapiens
gccagccacttcccagactggc

SEQ ID NO: 8047138 - DNA, 22 bp, Homo sapiens
gccagccagaaacgtcacactg

SEQ ID NO: 8047139 - DNA, 22 bp, Homo sapiens
atttctgtttgctactataagt

SEQ ID NO: 8047140 - DNA, 22 bp, Homo sapiens
gccctggggaaggtgtctccaa

SEQ ID NO: 8047141 - DNA, 19 bp, Homo sapiens
atttattgtatgattccat

SEQ ID NO: 8047142 - DNA, 22 bp, Homo sapiens
gccatgcctgtgtctccaggcc

SEQ ID NO: 8047143 - DNA, 22 bp, Homo sapiens
gcccaggtgccctctgccttac

SEQ ID NO: 8047144 - DNA, 22 bp, Homo sapiens
atgttatttattgaaacacttt

SEQ ID NO: 8047145 - DNA, 22 bp, Homo sapiens
atgttatttctgaaagatcatt

SEQ ID NO: 8047146 - DNA, 22 bp, Homo sapiens
gatggcaggtagtggtctcatc

SEQ ID NO: 8047147 - DNA, 20 bp, Homo sapiens
gagtgggccatggagtgaga

SEQ ID NO: 8047148 - DNA, 22 bp, Homo sapiens
gagtgggcaccgtgggcacact

SEQ ID NO: 8047149 - DNA, 21 bp, Homo sapiens
gagtgggctgagatggggctg

SEQ ID NO: 8047150 - DNA, 22 bp, Homo sapiens
gagtggggcccactgctgggtg

SEQ ID NO: 8047151 - DNA, 22 bp, Homo sapiens
gagtggggcgtggatccagcgt

SEQ ID NO: 8047152 - DNA, 22 bp, Homo sapiens
gatgtgtcatttggtcatctgc

SEQ ID NO: 8047153 - DNA, 22 bp, Homo sapiens
gattcactcatattttacgttt

SEQ ID NO: 8047154 - DNA, 22 bp, Homo sapiens
attatgtagctaaaaattgtgt

SEQ ID NO: 8047155 - DNA, 22 bp, Homo sapiens
gcacccagaataaggacaggac

SEQ ID NO: 8047156 - DNA, 22 bp, Homo sapiens
gcacacaggcagtttccagcca

SEQ ID NO: 8047157 - DNA, 22 bp, Homo sapiens
gcacacagctagattaccattc

SEQ ID NO: 8047158 - DNA, 16 bp, Homo sapiens
gcacacagccagcctt

SEQ ID NO: 8047159 - DNA, 22 bp, Homo sapiens
gcacacagagaggtggtatgtc

SEQ ID NO: 8047160 - DNA, 22 bp, Homo sapiens
gcaccaggcttagagccccagg

SEQ ID NO: 8047161 - DNA, 22 bp, Homo sapiens
gcacacaggcagtttccagcca

SEQ ID NO: 8047162 - DNA, 22 bp, Homo sapiens
gcaccaggcagctgagcaggcc

SEQ ID NO: 8047163 - DNA, 22 bp, Homo sapiens
attgcaaaggtcccattcaaga

SEQ ID NO: 8047164 - DNA, 22 bp, Homo sapiens
gcaggtgtggagtggggtgagc

SEQ ID NO: 8047165 - DNA, 22 bp, Homo sapiens
gcaggtgtggagagtggtcggg

SEQ ID NO: 8047166 - DNA, 18 bp, Homo sapiens
gcaggtgtggagaagggg

SEQ ID NO: 8047167 - DNA, 22 bp, Homo sapiens
attcttttttaaggaatagaac

SEQ ID NO: 8047168 - DNA, 19 bp, Homo sapiens
gcaggtggatgtggtcagc

SEQ ID NO: 8047169 - DNA, 19 bp, Homo sapiens
gcaggtggatgtggtcagc

SEQ ID NO: 8047170 - DNA, 21 bp, Homo sapiens
gcaggtgtggtatcagcttcc

SEQ ID NO: 8047171 - DNA, 22 bp, Homo sapiens
gcaggtgttctcagaggaggct

SEQ ID NO: 8047172 - DNA, 22 bp, Homo sapiens
gcaggtgtggatttgcatccag

SEQ ID NO: 8047173 - DNA, 22 bp, Homo sapiens
gcaggtgtgggtggctgccagg

SEQ ID NO: 8047174 - DNA, 22 bp, Homo sapiens
gcaggtgttttaagacattgaa

SEQ ID NO: 8047175 - DNA, 22 bp, Homo sapiens
gcatggcaagatcaggagacca

SEQ ID NO: 8047176 - DNA, 21 bp, Homo sapiens
gcatggcaggtcactggggca

SEQ ID NO: 8047177 - DNA, 22 bp, Homo sapiens
gcatggcagggattagtagtag

SEQ ID NO: 8047178 - DNA, 22 bp, Homo sapiens
gcatggcagtgaggatggtgct

SEQ ID NO: 8047179 - DNA, 22 bp, Homo sapiens
gcatggcaagatcaggagacca

SEQ ID NO: 8047180 - DNA, 22 bp, Homo sapiens
gcatggcaagatcaggagacca

SEQ ID NO: 8047181 - DNA, 22 bp, Homo sapiens
gcatggagaagtgggaacaggt

SEQ ID NO: 8047182 - DNA, 22 bp, Homo sapiens
gcatggagaagtgggaacaggt

SEQ ID NO: 8047183 - DNA, 22 bp, Homo sapiens
attcttttcccaactgctttaa

SEQ ID NO: 8047184 - DNA, 22 bp, Homo sapiens
attcttttcccaactgctttaa

SEQ ID NO: 8047185 - DNA, 22 bp, Homo sapiens
attcttttaagccccagggatt

SEQ ID NO: 8047186 - DNA, 22 bp, Homo sapiens
attcttttgtcctagcttgata

SEQ ID NO: 8047187 - DNA, 22 bp, Homo sapiens
attcttttaaatggcagtagta

SEQ ID NO: 8047188 - DNA, 22 bp, Homo sapiens
attcttttaagccccagggatt

SEQ ID NO: 8047189 - DNA, 22 bp, Homo sapiens
gcagggcatagaggcacggagg

SEQ ID NO: 8047190 - DNA, 22 bp, Homo sapiens
gcagggcatagaggcacggagg

SEQ ID NO: 8047191 - DNA, 22 bp, Homo sapiens
gcagggcatccctgagcgggtg

SEQ ID NO: 8047192 - DNA, 20 bp, Homo sapiens
gcagggcatcttggccccca

SEQ ID NO: 8047193 - DNA, 22 bp, Homo sapiens
gcagggcatgggccctgtctgc

SEQ ID NO: 8047194 - DNA, 22 bp, Homo sapiens
gcaggcaggtggcatcttgtga

SEQ ID NO: 8047195 - DNA, 22 bp, Homo sapiens
gcagggcaaacccaggtgttca

SEQ ID NO: 8047196 - DNA, 22 bp, Homo sapiens
gcagggcaaacccaggtgttca

SEQ ID NO: 8047197 - DNA, 22 bp, Homo sapiens
gcagggcagtgtgtctgtgggg

SEQ ID NO: 8047198 - DNA, 22 bp, Homo sapiens
gcagggcagtgtgtctgtgggg

SEQ ID NO: 8047199 - DNA, 22 bp, Homo sapiens
attccacagctacatcaatcta

SEQ ID NO: 8047200 - DNA, 22 bp, Homo sapiens
attccaaagcctgaataatgga

SEQ ID NO: 8047201 - DNA, 22 bp, Homo sapiens
attccacaagaccataaattag

SEQ ID NO: 8047202 - DNA, 22 bp, Homo sapiens
attccacacagtaatactcaat

SEQ ID NO: 8047203 - DNA, 22 bp, Homo sapiens
attcacaaaatgatatagatac

SEQ ID NO: 8047204 - DNA, 22 bp, Homo sapiens
attccaaacttaccccagagga

SEQ ID NO: 8047205 - DNA, 19 bp, Homo sapiens
attcatttttgccttctaa

SEQ ID NO: 8047206 - DNA, 22 bp, Homo sapiens
gcagctgtgggcctcggagagc

SEQ ID NO: 8047207 - DNA, 22 bp, Homo sapiens
gcagctgtgtaatgagcccaca

SEQ ID NO: 8047208 - DNA, 22 bp, Homo sapiens
gcagctgtggtgctgagatagg

SEQ ID NO: 8047209 - DNA, 23 bp, Homo sapiens
attctgagtcagaaagtttgggg

SEQ ID NO: 8047210 - DNA, 22 bp, Homo sapiens
attctgaattctgagcctttca

SEQ ID NO: 8047211 - DNA, 20 bp, Homo sapiens
gcaggcagggaatgggggtg

SEQ ID NO: 8047212 - DNA, 20 bp, Homo sapiens
gcaggcagggaatgggggtg

SEQ ID NO: 8047213 - DNA, 22 bp, Homo sapiens
gcaggcaggcttccttgaactg

SEQ ID NO: 8047214 - DNA, 22 bp, Homo sapiens
gcaggcaggagcccaactgcct

SEQ ID NO: 8047215 - DNA, 22 bp, Homo sapiens
gcagcttcctgagtgtggacag

SEQ ID NO: 8047216 - DNA, 22 bp, Homo sapiens
gcagcttcagtaggtgaagaca

SEQ ID NO: 8047217 - DNA, 22 bp, Homo sapiens
gcagcttcagccagagggccag

SEQ ID NO: 8047218 - DNA, 22 bp, Homo sapiens
gcagcttcaagatactttttct

SEQ ID NO: 8047219 - DNA, 21 bp, Homo sapiens
aggtgcagagccagggaccag

SEQ ID NO: 8047220 - DNA, 22 bp, Homo sapiens
aggtggagtgtgcagggagagc

SEQ ID NO: 8047221 - DNA, 22 bp, Homo sapiens
aggtattattagcatctctatt

SEQ ID NO: 8047222 - DNA, 22 bp, Homo sapiens
aggtctgagtatggcctgagaa

SEQ ID NO: 8047223 - DNA, 19 bp, Homo sapiens
aggtgaggggcaccatgtc

SEQ ID NO: 8047224 - DNA, 22 bp, Homo sapiens
cctggagcatcaggaggaaggg

SEQ ID NO: 8047225 - DNA, 22 bp, Homo sapiens
cctggagcccaaggcagtgaga

SEQ ID NO: 8047226 - DNA, 22 bp, Homo sapiens
cctggagcccaaggcagtgaga

SEQ ID NO: 8047227 - DNA, 22 bp, Homo sapiens
cctggagcaggagctgcagagg

SEQ ID NO: 8047228 - DNA, 22 bp, Homo sapiens
agggtggcagttactggagcaa

SEQ ID NO: 8047229 - DNA, 22 bp, Homo sapiens
agggtggcagttactggagcaa

SEQ ID NO: 8047230 - DNA, 22 bp, Homo sapiens
agggtggcacctggaagggatg

SEQ ID NO: 8047231 - DNA, 19 bp, Homo sapiens
agggtggcaaaggagggtg

SEQ ID NO: 8047232 - DNA, 22 bp, Homo sapiens
agggtggccatgagggagagat

SEQ ID NO: 8047233 - DNA, 22 bp, Homo sapiens
cctggagctcactgggagccgg

SEQ ID NO: 8047234 - DNA, 22 bp, Homo sapiens
cctggagcccctctggccagcc

SEQ ID NO: 8047235 - DNA, 22 bp, Homo sapiens
cctggctaggagagctgggctc

SEQ ID NO: 8047236 - DNA, 22 bp, Homo sapiens
cgcgaggtggaggttgcagtga

SEQ ID NO: 8047237 - DNA, 22 bp, Homo sapiens
cgcctgggagtccacacctgct

SEQ ID NO: 8047238 - DNA, 22 bp, Homo sapiens
cgcctggatgttcacgggcagc

SEQ ID NO: 8047239 - DNA, 22 bp, Homo sapiens
cgtgccccggtgaggagttcag

SEQ ID NO: 8047240 - DNA, 21 bp, Homo sapiens
ctacagaatcgagcattctgg

SEQ ID NO: 8047241 - DNA, 22 bp, Homo sapiens
agtaatgtgcctgaaatacttg

SEQ ID NO: 8047242 - DNA, 22 bp, Homo sapiens
agtaatgtcccttaaatgtggt

SEQ ID NO: 8047243 - DNA, 23 bp, Homo sapiens
agtaatgagtgatgcagatattc

SEQ ID NO: 8047244 - DNA, 22 bp, Homo sapiens
agtaatgattatgtacagaatg

SEQ ID NO: 8047245 - DNA, 22 bp, Homo sapiens
agtaatgaatacggtatttgaa

SEQ ID NO: 8047246 - DNA, 22 bp, Homo sapiens
agtaatgaggatgtttgcaaaa

SEQ ID NO: 8047247 - DNA, 22 bp, Homo sapiens
agtaatgaagatttgttgcaca

SEQ ID NO: 8047248 - DNA, 22 bp, Homo sapiens
agtaatgtgcctgaaatacttg

SEQ ID NO: 8047249 - DNA, 22 bp, Homo sapiens
agtacaaaatgcagcatcatca

SEQ ID NO: 8047250 - DNA, 22 bp, Homo sapiens
cgcctggagaggaggcgacgcg

SEQ ID NO: 8047251 - DNA, 22 bp, Homo sapiens
cgcctggaacctctaggaccag

SEQ ID NO: 8047252 - DNA, 22 bp, Homo sapiens
cgcctggaacctctaggaccag

SEQ ID NO: 8047253 - DNA, 19 bp, Homo sapiens
aggtttatggggagggtga

SEQ ID NO: 8047254 - DNA, 22 bp, Homo sapiens
cctttatgagatcctggggtga

SEQ ID NO: 8047255 - DNA, 22 bp, Homo sapiens
cctttatgatagatgctttcag

SEQ ID NO: 8047256 - DNA, 22 bp, Homo sapiens
cctttatgtcactctggagagc

SEQ ID NO: 8047257 - DNA, 21 bp, Homo sapiens
cctttatgcaaggactggcat

SEQ ID NO: 8047258 - DNA, 22 bp, Homo sapiens
cctttattcaattagtcctaat

SEQ ID NO: 8047259 - DNA, 20 bp, Homo sapiens
cctttattatttgtatgatg

SEQ ID NO: 8047260 - DNA, 22 bp, Homo sapiens
cctttatgtttctgcagccccc

SEQ ID NO: 8047261 - DNA, 19 bp, Homo sapiens
aggtgtgggggctgcagac

SEQ ID NO: 8047262 - DNA, 22 bp, Homo sapiens
aggtgtcttcagggtgagacag

SEQ ID NO: 8047263 - DNA, 22 bp, Homo sapiens
cctggtgcaccaagtaagggtg

SEQ ID NO: 8047264 - DNA, 22 bp, Homo sapiens
cctggtgccactagagaatgtc

SEQ ID NO: 8047265 - DNA, 22 bp, Homo sapiens
cctggtgcaggtgtgttgccag

SEQ ID NO: 8047266 - DNA, 22 bp, Homo sapiens
cctggtgcccccaagccagctg

SEQ ID NO: 8047267 - DNA, 22 bp, Homo sapiens
agtctctttctaaataaggtca

SEQ ID NO: 8047268 - DNA, 22 bp, Homo sapiens
agtcatgactccattggtcaag

SEQ ID NO: 8047269 - DNA, 22 bp, Homo sapiens
agtcatcaccagtacagtgtgc

SEQ ID NO: 8047270 - DNA, 22 bp, Homo sapiens
agtcatcatgtacagagagcaa

SEQ ID NO: 8047271 - DNA, 22 bp, Homo sapiens
agtcatcatggaaaatgttgtt

SEQ ID NO: 8047272 - DNA, 22 bp, Homo sapiens
ctcaggcagttctgtagcctcc

SEQ ID NO: 8047273 - DNA, 22 bp, Homo sapiens
ctcctcccacggtctcaggaag

SEQ ID NO: 8047274 - DNA, 22 bp, Homo sapiens
ctcctccctgcgattgctctgc

SEQ ID NO: 8047275 - DNA, 22 bp, Homo sapiens
ctcctcctggacacaggctgtg

SEQ ID NO: 8047276 - DNA, 22 bp, Homo sapiens
agtgcagctaagtggctctgtg

SEQ ID NO: 8047277 - DNA, 22 bp, Homo sapiens
agtgactgacacctgtaatccc

SEQ ID NO: 8047278 - DNA, 20 bp, Homo sapiens
agtgactgggagaatggatt

SEQ ID NO: 8047279 - DNA, 22 bp, Homo sapiens
agtgactggtgtgaagttaaat

SEQ ID NO: 8047280 - DNA, 22 bp, Homo sapiens
agtgtcctggcaagggtttcag

SEQ ID NO: 8047281 - DNA, 20 bp, Homo sapiens
agtggggagtcaggagtgcc

SEQ ID NO: 8047282 - DNA, 22 bp, Homo sapiens
ctgaagcaattgagagatgttt

SEQ ID NO: 8047283 - DNA, 23 bp, Homo sapiens
ctgaagcaatatcccctcacttc

SEQ ID NO: 8047284 - DNA, 22 bp, Homo sapiens
ctgaagcaggcctacttcattg

SEQ ID NO: 8047285 - DNA, 19 bp, Homo sapiens
ctgagagatgcttcacaca

SEQ ID NO: 8047286 - DNA, 22 bp, Homo sapiens
ctgagaggatgctgcagtggag

SEQ ID NO: 8047287 - DNA, 22 bp, Homo sapiens
agtgcaggccccaggccaggcc

SEQ ID NO: 8047288 - DNA, 22 bp, Homo sapiens
ctctctgggcccagttggcacc

SEQ ID NO: 8047289 - DNA, 18 bp, Homo sapiens
ctctctgggtgaggacaa

SEQ ID NO: 8047290 - DNA, 22 bp, Homo sapiens
agtggcagctgtcatgccctag

SEQ ID NO: 8047291 - DNA, 22 bp, Homo sapiens
agtggcagccgagcaggagatg

SEQ ID NO: 8047292 - DNA, 22 bp, Homo sapiens
agtggcaggaaagtggaagaga

SEQ ID NO: 8047293 - DNA, 22 bp, Homo sapiens
agtggcaggcagaagcttctca

SEQ ID NO: 8047294 - DNA, 17 bp, Homo sapiens
agtggcaggcagatggg

SEQ ID NO: 8047295 - DNA, 17 bp, Homo sapiens
agtggcaggcagatggg

SEQ ID NO: 8047296 - DNA, 17 bp, Homo sapiens
agtggcaggcagatggg

SEQ ID NO: 8047297 - DNA, 19 bp, Homo sapiens
agtggctgggcagaagcaa

SEQ ID NO: 8047298 - DNA, 22 bp, Homo sapiens
agtggctggcataggaacagac

SEQ ID NO: 8047299 - DNA, 22 bp, Homo sapiens
agtggcaggcggagatgtagga

SEQ ID NO: 8047300 - DNA, 22 bp, Homo sapiens
agtgggagggccatatggtgaa

SEQ ID NO: 8047301 - DNA, 19 bp, Homo sapiens
agtgggcaaggaagatgac

SEQ ID NO: 8047302 - DNA, 22 bp, Homo sapiens
agtgggcagcccaggaggtctt

SEQ ID NO: 8047303 - DNA, 22 bp, Homo sapiens
agtgggcaaaacagctcagagc

SEQ ID NO: 8047304 - DNA, 22 bp, Homo sapiens
agtgggcaggcagggtgcgcag

SEQ ID NO: 8047305 - DNA, 22 bp, Homo sapiens
agtgggcatatgaagtctcaag

SEQ ID NO: 8047306 - DNA, 22 bp, Homo sapiens
agtgggcatgatctggtgtctg

SEQ ID NO: 8047307 - DNA, 22 bp, Homo sapiens
agtgggcccttgtcacactgat

SEQ ID NO: 8047308 - DNA, 22 bp, Homo sapiens
agtggctggtagttactgagca

SEQ ID NO: 8047309 - DNA, 22 bp, Homo sapiens
agtggctggtagttactgagca

SEQ ID NO: 8047310 - DNA, 22 bp, Homo sapiens
agtggctggtctaaggtcacag

SEQ ID NO: 8047311 - DNA, 22 bp, Homo sapiens
atagggcctaaaaagtattgct

SEQ ID NO: 8047312 - DNA, 22 bp, Homo sapiens
atagggcctaaaaagtattgct

SEQ ID NO: 8047313 - DNA, 22 bp, Homo sapiens
ctggccagtgactgctcacccg

SEQ ID NO: 8047314 - DNA, 22 bp, Homo sapiens
ctggccagtgcctgtgggcccc

SEQ ID NO: 8047315 - DNA, 22 bp, Homo sapiens
ctggaggaaaacaactgcagac

SEQ ID NO: 8047316 - DNA, 22 bp, Homo sapiens
ctggccagaggttcctctgccc

SEQ ID NO: 8047317 - DNA, 22 bp, Homo sapiens
ctggccaggcttgggacagaca

SEQ ID NO: 8047318 - DNA, 22 bp, Homo sapiens
atagaatatgacttttagatcc

SEQ ID NO: 8047319 - DNA, 22 bp, Homo sapiens
ataatgtgaagataatgcaaga

SEQ ID NO: 8047320 - DNA, 22 bp, Homo sapiens
ataatgtttgattgagcagata

SEQ ID NO: 8047321 - DNA, 22 bp, Homo sapiens
ataatgtttttgtataagcatg

SEQ ID NO: 8047322 - DNA, 22 bp, Homo sapiens
ataatgtacaactgcttttaat

SEQ ID NO: 8047323 - DNA, 22 bp, Homo sapiens
ataatgtaggctcctgggagaa

SEQ ID NO: 8047324 - DNA, 22 bp, Homo sapiens
ataatgtaggtatgtgtattta

SEQ ID NO: 8047325 - DNA, 21 bp, Homo sapiens
ataatgtacaaaaactgtctt

SEQ ID NO: 8047326 - DNA, 22 bp, Homo sapiens
ataatggtgaacaaaatgactc

SEQ ID NO: 8047327 - DNA, 22 bp, Homo sapiens
ataatgtaaggctccctacagt

SEQ ID NO: 8047328 - DNA, 22 bp, Homo sapiens
ctgcctggaaggagcaagggga

SEQ ID NO: 8047329 - DNA, 20 bp, Homo sapiens
atacacattcatagaaaaat

SEQ ID NO: 8047330 - DNA, 22 bp, Homo sapiens
atacatgatcactgtattataa

SEQ ID NO: 8047331 - DNA, 22 bp, Homo sapiens
ctggagctggtatagggacaaa

SEQ ID NO: 8047332 - DNA, 22 bp, Homo sapiens
ctggagctgtcttcacaggcct

SEQ ID NO: 8047333 - DNA, 22 bp, Homo sapiens
atacatcttccttttaaaatgc

SEQ ID NO: 8047334 - DNA, 22 bp, Homo sapiens
atacatcttgtcagattcatgt

SEQ ID NO: 8047335 - DNA, 22 bp, Homo sapiens
atacatctcatgtaagagataa

SEQ ID NO: 8047336 - DNA, 22 bp, Homo sapiens
atacatgacactgggctacagg

SEQ ID NO: 8047337 - DNA, 22 bp, Homo sapiens
atacatgactcacacattctgc

SEQ ID NO: 8047338 - DNA, 22 bp, Homo sapiens
atacatgactcacacattctgc

SEQ ID NO: 8047339 - DNA, 22 bp, Homo sapiens
atacatgaggctcatttatgtc

SEQ ID NO: 8047340 - DNA, 22 bp, Homo sapiens
ctggaagactcaatggcctgcc

SEQ ID NO: 8047341 - DNA, 17 bp, Homo sapiens
agttttgatataatggc

SEQ ID NO: 8047342 - DNA, 18 bp, Homo sapiens
ctgccccttctctgagat

SEQ ID NO: 8047343 - DNA, 21 bp, Homo sapiens
ctgccctagatggctctggaa

SEQ ID NO: 8047344 - DNA, 22 bp, Homo sapiens
ctgccctgacctgcctcagagt

SEQ ID NO: 8047345 - DNA, 22 bp, Homo sapiens
ctgccctctagggatgcactgg

SEQ ID NO: 8047346 - DNA, 22 bp, Homo sapiens
agttttgaaatgaaatgtagtt

SEQ ID NO: 8047347 - DNA, 22 bp, Homo sapiens
agttttctcacatcaaaaatga

SEQ ID NO: 8047348 - DNA, 18 bp, Homo sapiens
ctgcctgctctccagctt

SEQ ID NO: 8047349 - DNA, 23 bp, Homo sapiens
ataataattatggcagcaaagtg

SEQ ID NO: 8047350 - DNA, 22 bp, Homo sapiens
ataataacacctgaataggaaa

SEQ ID NO: 8047351 - DNA, 22 bp, Homo sapiens
ataagtgttaggtaaacatctt

SEQ ID NO: 8047352 - DNA, 22 bp, Homo sapiens
agtttcttggtcacagttttca

SEQ ID NO: 8047353 - DNA, 22 bp, Homo sapiens
agtttcttgaagactgatgttt

SEQ ID NO: 8047354 - DNA, 22 bp, Homo sapiens
agtttctgcaaatcatttttat

SEQ ID NO: 8047355 - DNA, 22 bp, Homo sapiens
agtttctgtgactcttggcata

SEQ ID NO: 8047356 - DNA, 22 bp, Homo sapiens
agtttcttattcttagttatgt

SEQ ID NO: 8047357 - DNA, 22 bp, Homo sapiens
agtttctgttaccatatttgac

SEQ ID NO: 8047358 - DNA, 22 bp, Homo sapiens
ctgatattcttgaaatcatggt

SEQ ID NO: 8047359 - DNA, 18 bp, Homo sapiens
ctgataggggtggcagct

SEQ ID NO: 8047360 - DNA, 22 bp, Homo sapiens
agtttatgttgtttataagcca

SEQ ID NO: 8047361 - DNA, 22 bp, Homo sapiens
agtttattgtatatggtagttt

SEQ ID NO: 8047362 - DNA, 22 bp, Homo sapiens
agtttattctgcttggccctcc

SEQ ID NO: 8047363 - DNA, 22 bp, Homo sapiens
ctgtgcctaagatgcatgtctc

SEQ ID NO: 8047364 - DNA, 22 bp, Homo sapiens
ctgtgccttagtattctcattt

SEQ ID NO: 8047365 - DNA, 20 bp, Homo sapiens
ctgtgcctcctgctagtcct

SEQ ID NO: 8047366 - DNA, 20 bp, Homo sapiens
ctgtgctccgggttcctgga

SEQ ID NO: 8047367 - DNA, 17 bp, Homo sapiens
ctgtgctcgagtgatgg

SEQ ID NO: 8047368 - DNA, 22 bp, Homo sapiens
atcaggccagcaatccctgggc

SEQ ID NO: 8047369 - DNA, 22 bp, Homo sapiens
ctgtgggagcacatgacagata

SEQ ID NO: 8047370 - DNA, 22 bp, Homo sapiens
ctgtgggagcacatgacagata

SEQ ID NO: 8047371 - DNA, 22 bp, Homo sapiens
ctgtgtccaatggccttagcag

SEQ ID NO: 8047372 - DNA, 22 bp, Homo sapiens
ctgtgtccatgttctaatttgg

SEQ ID NO: 8047373 - DNA, 22 bp, Homo sapiens
ctgtgtccatttatcattgtca

SEQ ID NO: 8047374 - DNA, 22 bp, Homo sapiens
ctgtgtcccacacgaggtgtat

SEQ ID NO: 8047375 - DNA, 22 bp, Homo sapiens
ctgtgggagcactggggaccga

SEQ ID NO: 8047376 - DNA, 23 bp, Homo sapiens
atcattactttgataccttttct

SEQ ID NO: 8047377 - DNA, 22 bp, Homo sapiens
ctgtgtcctccccatcacttct

SEQ ID NO: 8047378 - DNA, 22 bp, Homo sapiens
ctgtgtcccagccaggataatg

SEQ ID NO: 8047379 - DNA, 22 bp, Homo sapiens
ctgtgtcccagtaccttgggta

SEQ ID NO: 8047380 - DNA, 22 bp, Homo sapiens
ctgtgtccccctcagccaggtg

SEQ ID NO: 8047381 - DNA, 22 bp, Homo sapiens
ctgtgtcccttgtcccagagcc

SEQ ID NO: 8047382 - DNA, 22 bp, Homo sapiens
atctcccagccacagcattctt

SEQ ID NO: 8047383 - DNA, 22 bp, Homo sapiens
atccttctccaaaactggctcc

SEQ ID NO: 8047384 - DNA, 22 bp, Homo sapiens
ctgtttccaccttcatggctaa

SEQ ID NO: 8047385 - DNA, 22 bp, Homo sapiens
ctgtttcctgtcttctcactat

SEQ ID NO: 8047386 - DNA, 22 bp, Homo sapiens
atatcagtatctatgtatttgt

SEQ ID NO: 8047387 - DNA, 22 bp, Homo sapiens
atatcacaggaaaggaagatac

SEQ ID NO: 8047388 - DNA, 22 bp, Homo sapiens
atatcaaagctagtggaaattt

SEQ ID NO: 8047389 - DNA, 22 bp, Homo sapiens
ctgggcctggagcccacgagcc

SEQ ID NO: 8047390 - DNA, 22 bp, Homo sapiens
ctgggcctgggaggccaggtct

SEQ ID NO: 8047391 - DNA, 22 bp, Homo sapiens
ctgggcctggacgggcagatct

SEQ ID NO: 8047392 - DNA, 22 bp, Homo sapiens
ctgggctgggtttaccctcttc

SEQ ID NO: 8047393 - DNA, 22 bp, Homo sapiens
ctgggctgtcaatggccctctg

SEQ ID NO: 8047394 - DNA, 17 bp, Homo sapiens
ctgggcctctgcccttt

SEQ ID NO: 8047395 - DNA, 22 bp, Homo sapiens
ctgggccatgggccagcgaggc

SEQ ID NO: 8047396 - DNA, 22 bp, Homo sapiens
ctgggccatgggccagcgaggc

SEQ ID NO: 8047397 - DNA, 22 bp, Homo sapiens
ctgggccatctctctgcaagtg

SEQ ID NO: 8047398 - DNA, 22 bp, Homo sapiens
ctgggccatctctctgcaagtg

SEQ ID NO: 8047399 - DNA, 22 bp, Homo sapiens
ctgggccatggaagtctctgcc

SEQ ID NO: 8047400 - DNA, 22 bp, Homo sapiens
ctgggccatcagaggggctgga

SEQ ID NO: 8047401 - DNA, 20 bp, Homo sapiens
ctgggccatccttttacaat

SEQ ID NO: 8047402 - DNA, 20 bp, Homo sapiens
ctgggccatccttttacaat

SEQ ID NO: 8047403 - DNA, 22 bp, Homo sapiens
ctgggccatctcctttgtgtgg

SEQ ID NO: 8047404 - DNA, 22 bp, Homo sapiens
ctgggccagttatgtctcatct

SEQ ID NO: 8047405 - DNA, 22 bp, Homo sapiens
ctgggccagttatgtctcatct

SEQ ID NO: 8047406 - DNA, 22 bp, Homo sapiens
ctgggccagggaggtgtctgta

SEQ ID NO: 8047407 - DNA, 22 bp, Homo sapiens
ctgggccagtctcggccgctct

SEQ ID NO: 8047408 - DNA, 22 bp, Homo sapiens
ctggggaggatgctacgacctg

SEQ ID NO: 8047409 - DNA, 22 bp, Homo sapiens
ctggtgggaggcaaggtggaag

SEQ ID NO: 8047410 - DNA, 22 bp, Homo sapiens
ctggtgggagcagcaggcagct

SEQ ID NO: 8047411 - DNA, 22 bp, Homo sapiens
ctggtgggagcagcaggcagct

SEQ ID NO: 8047412 - DNA, 22 bp, Homo sapiens
ctggtgctgggcagggctcagg

SEQ ID NO: 8047413 - DNA, 22 bp, Homo sapiens
ctggtgctggcaacagagtagg

SEQ ID NO: 8047414 - DNA, 19 bp, Homo sapiens
ctggtgcttgagtgagtca

SEQ ID NO: 8047415 - DNA, 22 bp, Homo sapiens
ctggtggaagcctgggctcaga

SEQ ID NO: 8047416 - DNA, 22 bp, Homo sapiens
ctggggcagagcccagcaattt

SEQ ID NO: 8047417 - DNA, 22 bp, Homo sapiens
ctgtaatgaactctttgtcagt

SEQ ID NO: 8047418 - DNA, 22 bp, Homo sapiens
ccagggagcggggctgggtctc

SEQ ID NO: 8047419 - DNA, 17 bp, Homo sapiens
ccagggaggggccgcgc

SEQ ID NO: 8047420 - DNA, 22 bp, Homo sapiens
ccagggagcccacaggacaatg

SEQ ID NO: 8047421 - DNA, 22 bp, Homo sapiens
ccagggagcggggctgggtctc

SEQ ID NO: 8047422 - DNA, 22 bp, Homo sapiens
ccagggtgaccctcccggtggc

SEQ ID NO: 8047423 - DNA, 22 bp, Homo sapiens
ccagggtgagtgtcatgggtta

SEQ ID NO: 8047424 - DNA, 22 bp, Homo sapiens
ccagggtgaggaggctcccacg

SEQ ID NO: 8047425 - DNA, 22 bp, Homo sapiens
ccagggtgctctgtggcgtcgc

SEQ ID NO: 8047426 - DNA, 22 bp, Homo sapiens
ccagggtgagtgtcatgggtta

SEQ ID NO: 8047427 - DNA, 22 bp, Homo sapiens
aggctcagttctgtggtgagcc

SEQ ID NO: 8047428 - DNA, 22 bp, Homo sapiens
aggctcagttctgtggtgagcc

SEQ ID NO: 8047429 - DNA, 22 bp, Homo sapiens
aggctcagttcacgtcaacttt

SEQ ID NO: 8047430 - DNA, 22 bp, Homo sapiens
aggctcagtttggtttccattg

SEQ ID NO: 8047431 - DNA, 22 bp, Homo sapiens
aggctccaccccgccagacctt

SEQ ID NO: 8047432 - DNA, 22 bp, Homo sapiens
aggctccaccctacagagctcc

SEQ ID NO: 8047433 - DNA, 22 bp, Homo sapiens
aggctccaccagtcaggtgcat

SEQ ID NO: 8047434 - DNA, 22 bp, Homo sapiens
aggctcagtgatgtaaaatata

SEQ ID NO: 8047435 - DNA, 22 bp, Homo sapiens
aggctcagtgcaaatcattctg

SEQ ID NO: 8047436 - DNA, 22 bp, Homo sapiens
aggctcagtctgttcatgcact

SEQ ID NO: 8047437 - DNA, 22 bp, Homo sapiens
aggctcagtcccggcccgcgcc

SEQ ID NO: 8047438 - DNA, 22 bp, Homo sapiens
aggctcagtatagctggcaagt

SEQ ID NO: 8047439 - DNA, 22 bp, Homo sapiens
aggctcaggtgcctcattcaca

SEQ ID NO: 8047440 - DNA, 17 bp, Homo sapiens
ccaggagcgtgggtctc

SEQ ID NO: 8047441 - DNA, 22 bp, Homo sapiens
ccaggagctggcatgtggagag

SEQ ID NO: 8047442 - DNA, 22 bp, Homo sapiens
aggctgcctcgtgagctcgctg

SEQ ID NO: 8047443 - DNA, 22 bp, Homo sapiens
aggctgcctaggttcaacacct

SEQ ID NO: 8047444 - DNA, 20 bp, Homo sapiens
aggctgcctaaggctctgca

SEQ ID NO: 8047445 - DNA, 22 bp, Homo sapiens
aggctgctataaacattcccgt

SEQ ID NO: 8047446 - DNA, 22 bp, Homo sapiens
aggctgctcagtagatggagct

SEQ ID NO: 8047447 - DNA, 22 bp, Homo sapiens
aggctgcctctgcaggatccct

SEQ ID NO: 8047448 - DNA, 22 bp, Homo sapiens
aggctgcctggctgtgagtgaa

SEQ ID NO: 8047449 - DNA, 22 bp, Homo sapiens
aggctgcctggctgtgagtgaa

SEQ ID NO: 8047450 - DNA, 22 bp, Homo sapiens
aggctgcctcttttgagagggt

SEQ ID NO: 8047451 - DNA, 22 bp, Homo sapiens
aggctgcctcttttgagagggt

SEQ ID NO: 8047452 - DNA, 21 bp, Homo sapiens
cccagagcctagggagggcac

SEQ ID NO: 8047453 - DNA, 22 bp, Homo sapiens
cccagagccggtggtgctcaca

SEQ ID NO: 8047454 - DNA, 22 bp, Homo sapiens
aggctggctgacttctgaagca

SEQ ID NO: 8047455 - DNA, 17 bp, Homo sapiens
aggctggctcacaggga

SEQ ID NO: 8047456 - DNA, 20 bp, Homo sapiens
cccagagccatagccagaca

SEQ ID NO: 8047457 - DNA, 22 bp, Homo sapiens
ccatggcttacagatggagcat

SEQ ID NO: 8047458 - DNA, 22 bp, Homo sapiens
ccatggctgcaattcttctgga

SEQ ID NO: 8047459 - DNA, 22 bp, Homo sapiens
ccatggcttctttctctgccag

SEQ ID NO: 8047460 - DNA, 22 bp, Homo sapiens
ccatggcttttgagtctcaaga

SEQ ID NO: 8047461 - DNA, 22 bp, Homo sapiens
ccatggcttggaaagggaggtg

SEQ ID NO: 8047462 - DNA, 19 bp, Homo sapiens
ccatgcagcctgggggcag

SEQ ID NO: 8047463 - DNA, 22 bp, Homo sapiens
ccatggctctagagattgaaaa

SEQ ID NO: 8047464 - DNA, 22 bp, Homo sapiens
ccatggctcttaccttgttata

SEQ ID NO: 8047465 - DNA, 18 bp, Homo sapiens
ccatggctccctcctgcc

SEQ ID NO: 8047466 - DNA, 22 bp, Homo sapiens
aggctctgtgactaaagaggat

SEQ ID NO: 8047467 - DNA, 22 bp, Homo sapiens
aggctctgtgatgtgccaggca

SEQ ID NO: 8047468 - DNA, 22 bp, Homo sapiens
aggctctgtgatccacaatgag

SEQ ID NO: 8047469 - DNA, 22 bp, Homo sapiens
aggcagggtcttgctatgttgc

SEQ ID NO: 8047470 - DNA, 22 bp, Homo sapiens
aggcagggtcttgctatgttgc

SEQ ID NO: 8047471 - DNA, 22 bp, Homo sapiens
aggcagggtgatgataatgatt

SEQ ID NO: 8047472 - DNA, 17 bp, Homo sapiens
aggcaggtaagagttat

SEQ ID NO: 8047473 - DNA, 22 bp, Homo sapiens
aggcagggtgatgataatgatt

SEQ ID NO: 8047474 - DNA, 22 bp, Homo sapiens
ccacaggaagttatgagtacta

SEQ ID NO: 8047475 - DNA, 22 bp, Homo sapiens
ccacaggacacaactgctgacc

SEQ ID NO: 8047476 - DNA, 22 bp, Homo sapiens
ccacaggacagttaatgtgcag

SEQ ID NO: 8047477 - DNA, 22 bp, Homo sapiens
ccacaggacagttaatgtgcag

SEQ ID NO: 8047478 - DNA, 22 bp, Homo sapiens
ccacaggaggaacaattagatg

SEQ ID NO: 8047479 - DNA, 20 bp, Homo sapiens
ccacaggagtccagtcgacc

SEQ ID NO: 8047480 - DNA, 23 bp, Homo sapiens
ccacaggcacagaggcttgcatc

SEQ ID NO: 8047481 - DNA, 22 bp, Homo sapiens
ccacaggatccaagggaaggca

SEQ ID NO: 8047482 - DNA, 22 bp, Homo sapiens
ccagagagtatcatggagagta

SEQ ID NO: 8047483 - DNA, 22 bp, Homo sapiens
ccagcagaagctcccgctgggt

SEQ ID NO: 8047484 - DNA, 22 bp, Homo sapiens
ccagcagaggggcggagtgcag

SEQ ID NO: 8047485 - DNA, 23 bp, Homo sapiens
aggcatggcatggatggtggctc

SEQ ID NO: 8047486 - DNA, 22 bp, Homo sapiens
aggcatggcatggggcagatgt

SEQ ID NO: 8047487 - DNA, 23 bp, Homo sapiens
aggcatggcatggatggtggctc

SEQ ID NO: 8047488 - DNA, 22 bp, Homo sapiens
aggcatggcactgagcagcttc

SEQ ID NO: 8047489 - DNA, 22 bp, Homo sapiens
aggcatggatgtagcagtgacc

SEQ ID NO: 8047490 - DNA, 22 bp, Homo sapiens
aggcatggatgtagcagtgacc

SEQ ID NO: 8047491 - DNA, 22 bp, Homo sapiens
aggcatggatgtagcagtgacc

SEQ ID NO: 8047492 - DNA, 22 bp, Homo sapiens
aggcatggcactgagcagcttc

SEQ ID NO: 8047493 - DNA, 22 bp, Homo sapiens
aggcatggatgtagcagtgacc

SEQ ID NO: 8047494 - DNA, 20 bp, Homo sapiens
ccagagcagccactgaagtt

SEQ ID NO: 8047495 - DNA, 21 bp, Homo sapiens
aggcatggaaatggcacactg

SEQ ID NO: 8047496 - DNA, 21 bp, Homo sapiens
aggcatggaaatggcacactg

SEQ ID NO: 8047497 - DNA, 22 bp, Homo sapiens
aggcatggatggatccagggct

SEQ ID NO: 8047498 - DNA, 22 bp, Homo sapiens
aggcatggacatttcggcagct

SEQ ID NO: 8047499 - DNA, 22 bp, Homo sapiens
ccagagcagatgtggccttggt

SEQ ID NO: 8047500 - DNA, 22 bp, Homo sapiens
ccagagcagaaccggaacacca

SEQ ID NO: 8047501 - DNA, 22 bp, Homo sapiens
ccagcctccatgtagatagctg

SEQ ID NO: 8047502 - DNA, 22 bp, Homo sapiens
aggcccagcccgtcctcgtgct

SEQ ID NO: 8047503 - DNA, 19 bp, Homo sapiens
aggcccagcgctgggggct

SEQ ID NO: 8047504 - DNA, 22 bp, Homo sapiens
aggcccagagcaggaaagggtt

SEQ ID NO: 8047505 - DNA, 22 bp, Homo sapiens
ccagcctggactgggtcttgtg

SEQ ID NO: 8047506 - DNA, 22 bp, Homo sapiens
ccagcctggactgggtcttgtg

SEQ ID NO: 8047507 - DNA, 21 bp, Homo sapiens
ccagctttcccaagtcccttt

SEQ ID NO: 8047508 - DNA, 22 bp, Homo sapiens
ccagctttccagggttgactgg

SEQ ID NO: 8047509 - DNA, 22 bp, Homo sapiens
ccagctttatagcttcaaagga

SEQ ID NO: 8047510 - DNA, 22 bp, Homo sapiens
ccagctttcatatcatgaggta

SEQ ID NO: 8047511 - DNA, 22 bp, Homo sapiens
ccagctttatcaagtctgagct

SEQ ID NO: 8047512 - DNA, 22 bp, Homo sapiens
ccagctttaggttgcctgccag

SEQ ID NO: 8047513 - DNA, 22 bp, Homo sapiens
ccagcttctctgttccagcccc

SEQ ID NO: 8047514 - DNA, 22 bp, Homo sapiens
ccagcttctctctgatgcagct

SEQ ID NO: 8047515 - DNA, 22 bp, Homo sapiens
aggcccagctggacaaactgct

SEQ ID NO: 8047516 - DNA, 19 bp, Homo sapiens
ccagctggcctgggacctc

SEQ ID NO: 8047517 - DNA, 22 bp, Homo sapiens
ccagcttttcttatcattataa

SEQ ID NO: 8047518 - DNA, 22 bp, Homo sapiens
ccagcttttggggtgacaattt

SEQ ID NO: 8047519 - DNA, 22 bp, Homo sapiens
ccagcttttgcactggactggg

SEQ ID NO: 8047520 - DNA, 22 bp, Homo sapiens
ccagcttttcctctcattgctt

SEQ ID NO: 8047521 - DNA, 22 bp, Homo sapiens
ccagcttttcagaatctgcctg

SEQ ID NO: 8047522 - DNA, 22 bp, Homo sapiens
ccagctttcctgcgagttgatt

SEQ ID NO: 8047523 - DNA, 20 bp, Homo sapiens
ccagctttccctgcagcatc

SEQ ID NO: 8047524 - DNA, 22 bp, Homo sapiens
ccagctttctcagaggcttcta

SEQ ID NO: 8047525 - DNA, 22 bp, Homo sapiens
ccagctttctgggtggtttctg

SEQ ID NO: 8047526 - DNA, 22 bp, Homo sapiens
ccagctttggagtgttgttgct

SEQ ID NO: 8047527 - DNA, 22 bp, Homo sapiens
ccagcttttagtgggcttatta

SEQ ID NO: 8047528 - DNA, 22 bp, Homo sapiens
aggccctggcccccagagattc

SEQ ID NO: 8047529 - DNA, 22 bp, Homo sapiens
aggccctggcactgcctgggag

SEQ ID NO: 8047530 - DNA, 22 bp, Homo sapiens
aggccctgggttagggcccact

SEQ ID NO: 8047531 - DNA, 22 bp, Homo sapiens
ccaggacaagtgtggccatggc

SEQ ID NO: 8047532 - DNA, 22 bp, Homo sapiens
ccaggacaagtgtggccatggc

SEQ ID NO: 8047533 - DNA, 22 bp, Homo sapiens
aggccctgggcagttctgtagc

SEQ ID NO: 8047534 - DNA, 22 bp, Homo sapiens
aggccctgggagcagagatgca

SEQ ID NO: 8047535 - DNA, 18 bp, Homo sapiens
aggccctggcctcgaaca

SEQ ID NO: 8047536 - DNA, 22 bp, Homo sapiens
ccaggagcgggaaaaggaagaa

SEQ ID NO: 8047537 - DNA, 22 bp, Homo sapiens
ccaggagcaaagatcactggga

SEQ ID NO: 8047538 - DNA, 22 bp, Homo sapiens
ccgcccacactaaatatgagcg

SEQ ID NO: 8047539 - DNA, 22 bp, Homo sapiens
ccctggagggacagctgctcta

SEQ ID NO: 8047540 - DNA, 22 bp, Homo sapiens
ccctggagggacagctgctcta

SEQ ID NO: 8047541 - DNA, 23 bp, Homo sapiens
agggccactgggaaggattactg

SEQ ID NO: 8047542 - DNA, 22 bp, Homo sapiens
ccctggaggctggaggcagtag

SEQ ID NO: 8047543 - DNA, 22 bp, Homo sapiens
ccctggaggcggatgttgcagt

SEQ ID NO: 8047544 - DNA, 22 bp, Homo sapiens
ccctggaggcggagcttgcagt

SEQ ID NO: 8047545 - DNA, 22 bp, Homo sapiens
ccctggaggcggagcttgcagt

SEQ ID NO: 8047546 - DNA, 22 bp, Homo sapiens
ccctggaggcaaaggttgcagt

SEQ ID NO: 8047547 - DNA, 22 bp, Homo sapiens
ccctggaggcaaaggttgcagt

SEQ ID NO: 8047548 - DNA, 22 bp, Homo sapiens
agggccagaatccctcagtcta

SEQ ID NO: 8047549 - DNA, 22 bp, Homo sapiens
agggccagaggcaccttgcagc

SEQ ID NO: 8047550 - DNA, 22 bp, Homo sapiens
agggccagagtacatcagggct

SEQ ID NO: 8047551 - DNA, 22 bp, Homo sapiens
agggccagagtacatcagggct

SEQ ID NO: 8047552 - DNA, 22 bp, Homo sapiens
agggccagagtctgtgtagata

SEQ ID NO: 8047553 - DNA, 22 bp, Homo sapiens
agggctcataattcctgacttc

SEQ ID NO: 8047554 - DNA, 22 bp, Homo sapiens
agggctcattgacatggaaaag

SEQ ID NO: 8047555 - DNA, 22 bp, Homo sapiens
agggctcatctgagactgacat

SEQ ID NO: 8047556 - DNA, 22 bp, Homo sapiens
agggccctggggtgcactgaca

SEQ ID NO: 8047557 - DNA, 18 bp, Homo sapiens
agggccctggtggccatt

SEQ ID NO: 8047558 - DNA, 22 bp, Homo sapiens
agggcccttacgcaggcccttc

SEQ ID NO: 8047559 - DNA, 22 bp, Homo sapiens
agggccctagggaatgagacat

SEQ ID NO: 8047560 - DNA, 22 bp, Homo sapiens
agggctctggggtggcagagat

SEQ ID NO: 8047561 - DNA, 22 bp, Homo sapiens
agggctctcttggacaactgct

SEQ ID NO: 8047562 - DNA, 22 bp, Homo sapiens
cctcctggagcattggtgagga

SEQ ID NO: 8047563 - DNA, 21 bp, Homo sapiens
cctctggcttgtgctgtgccc

SEQ ID NO: 8047564 - DNA, 22 bp, Homo sapiens
aggggctggcttatctgagagt

SEQ ID NO: 8047565 - DNA, 22 bp, Homo sapiens
aggggctggcttatctgagagt

SEQ ID NO: 8047566 - DNA, 22 bp, Homo sapiens
aggggctggcttatctgagagt

SEQ ID NO: 8047567 - DNA, 22 bp, Homo sapiens
aggggctgcctggcttggcact

SEQ ID NO: 8047568 - DNA, 22 bp, Homo sapiens
cctgaggcaaggacttggtggc

SEQ ID NO: 8047569 - DNA, 22 bp, Homo sapiens
cctgaggcccctgaggatagca

SEQ ID NO: 8047570 - DNA, 22 bp, Homo sapiens
cctgaggccctggctgtgctga

SEQ ID NO: 8047571 - DNA, 22 bp, Homo sapiens
cctgaggatgccagcatgggtg

SEQ ID NO: 8047572 - DNA, 22 bp, Homo sapiens
cctgaggacacacgctgcagga

SEQ ID NO: 8047573 - DNA, 17 bp, Homo sapiens
aggggagagtgggaaga

SEQ ID NO: 8047574 - DNA, 17 bp, Homo sapiens
aggggagagtgggaaga

SEQ ID NO: 8047575 - DNA, 22 bp, Homo sapiens
aggggagaatttcaactcaggt

SEQ ID NO: 8047576 - DNA, 22 bp, Homo sapiens
aggggagagaacataaggaagt

SEQ ID NO: 8047577 - DNA, 22 bp, Homo sapiens
aggggacacggcttctccaggg

SEQ ID NO: 8047578 - DNA, 21 bp, Homo sapiens
aggggacagagtagctccagg

SEQ ID NO: 8047579 - DNA, 21 bp, Homo sapiens
aggggacagagtagctccagg

SEQ ID NO: 8047580 - DNA, 21 bp, Homo sapiens
aggggacagagtagctccagg

SEQ ID NO: 8047581 - DNA, 22 bp, Homo sapiens
agggatgactcttggctgattc

SEQ ID NO: 8047582 - DNA, 22 bp, Homo sapiens
agggagtgtaaatggtgctcag

SEQ ID NO: 8047583 - DNA, 22 bp, Homo sapiens
cccaggggtatccatggagaag

SEQ ID NO: 8047584 - DNA, 22 bp, Homo sapiens
agggactggctctctgagcagg

SEQ ID NO: 8047585 - DNA, 18 bp, Homo sapiens
ccctcttgcacaaagcaa

SEQ ID NO: 8047586 - DNA, 22 bp, Homo sapiens
ccctctctcggttgctgtggtt

SEQ ID NO: 8047587 - DNA, 21 bp, Homo sapiens
ccctggaatcctgagtgccag

SEQ ID NO: 8047588 - DNA, 19 bp, Homo sapiens
ccctggaggagtgttggct

SEQ ID NO: 8047589 - DNA, 22 bp, Homo sapiens
ccctggaggagcttagagcttg

SEQ ID NO: 8047590 - DNA, 22 bp, Homo sapiens
agggcagagatctgagtgggca

SEQ ID NO: 8047591 - DNA, 22 bp, Homo sapiens
agggcagagacatgcttcctga

SEQ ID NO: 8047592 - DNA, 22 bp, Homo sapiens
cccaggagttggaggctgcagt

SEQ ID NO: 8047593 - DNA, 22 bp, Homo sapiens
aggcttgcaatggacacatgtg

SEQ ID NO: 8047594 - DNA, 22 bp, Homo sapiens
aggcttctggaatccagtttct

SEQ ID NO: 8047595 - DNA, 22 bp, Homo sapiens
aggcttctctgcaagatgttaa

SEQ ID NO: 8047596 - DNA, 22 bp, Homo sapiens
aggctggctggcaggggacaca

SEQ ID NO: 8047597 - DNA, 22 bp, Homo sapiens
cccaggagttggaggctgcagt

SEQ ID NO: 8047598 - DNA, 21 bp, Homo sapiens
agctgccaccctagcttctga

SEQ ID NO: 8047599 - DNA, 22 bp, Homo sapiens
agctgccactgagggtgcacag

SEQ ID NO: 8047600 - DNA, 19 bp, Homo sapiens
agctgctgattggtggagg

SEQ ID NO: 8047601 - DNA, 22 bp, Homo sapiens
caggcacactgtctacactgag

SEQ ID NO: 8047602 - DNA, 19 bp, Homo sapiens
agctgctggcccagggacc

SEQ ID NO: 8047603 - DNA, 22 bp, Homo sapiens
agctgctgccggtggccaccct

SEQ ID NO: 8047604 - DNA, 22 bp, Homo sapiens
agctgctgcccataggtgacat

SEQ ID NO: 8047605 - DNA, 22 bp, Homo sapiens
agctgctgcgcctcaccctggc

SEQ ID NO: 8047606 - DNA, 22 bp, Homo sapiens
caggcactcattcagagaggtg

SEQ ID NO: 8047607 - DNA, 19 bp, Homo sapiens
agctgggctgtcacagtga

SEQ ID NO: 8047608 - DNA, 22 bp, Homo sapiens
agctgggctggagctccaagcg

SEQ ID NO: 8047609 - DNA, 22 bp, Homo sapiens
agctgggctgggctgagctgag

SEQ ID NO: 8047610 - DNA, 22 bp, Homo sapiens
caggccagcggcccgcgcgttc

SEQ ID NO: 8047611 - DNA, 22 bp, Homo sapiens
caggccagcagggcctccgtgg

SEQ ID NO: 8047612 - DNA, 22 bp, Homo sapiens
caggccagagtccaactccaga

SEQ ID NO: 8047613 - DNA, 22 bp, Homo sapiens
caggccagcttcctgacatcct

SEQ ID NO: 8047614 - DNA, 22 bp, Homo sapiens
caggccagcgtccagaacaagc

SEQ ID NO: 8047615 - DNA, 20 bp, Homo sapiens
agctggcccccggtggcctg

SEQ ID NO: 8047616 - DNA, 22 bp, Homo sapiens
agctggcccactgtgtggtcca

SEQ ID NO: 8047617 - DNA, 18 bp, Homo sapiens
agctggccctggctgccg

SEQ ID NO: 8047618 - DNA, 18 bp, Homo sapiens
agctggccctggctgccg

SEQ ID NO: 8047619 - DNA, 22 bp, Homo sapiens
agctggccggcctccaggtgga

SEQ ID NO: 8047620 - DNA, 22 bp, Homo sapiens
agctggccggcctccaggtgga

SEQ ID NO: 8047621 - DNA, 22 bp, Homo sapiens
agctggcctccgggtgcctggg

SEQ ID NO: 8047622 - DNA, 22 bp, Homo sapiens
agctggcctccgggtgcctggg

SEQ ID NO: 8047623 - DNA, 20 bp, Homo sapiens
caggccagaggtttgatggc

SEQ ID NO: 8047624 - DNA, 22 bp, Homo sapiens
caggccagaggctgttgttgcg

SEQ ID NO: 8047625 - DNA, 22 bp, Homo sapiens
agctgagggcaggatggggtga

SEQ ID NO: 8047626 - DNA, 22 bp, Homo sapiens
cagctctggggcagagtgacta

SEQ ID NO: 8047627 - DNA, 22 bp, Homo sapiens
cagctctggggcagagtgacta

SEQ ID NO: 8047628 - DNA, 20 bp, Homo sapiens
cagctctgggcaggtcgagg

SEQ ID NO: 8047629 - DNA, 22 bp, Homo sapiens
cagctctgggtaggaggaatct

SEQ ID NO: 8047630 - DNA, 22 bp, Homo sapiens
cagctctgggtgacaggagggc

SEQ ID NO: 8047631 - DNA, 22 bp, Homo sapiens
cagctctggttcctgggcccag

SEQ ID NO: 8047632 - DNA, 22 bp, Homo sapiens
cagctctgtaaattccttcatc

SEQ ID NO: 8047633 - DNA, 22 bp, Homo sapiens
cagctctgtctgtagaaacttc

SEQ ID NO: 8047634 - DNA, 22 bp, Homo sapiens
caggaagagaacatggaggctg

SEQ ID NO: 8047635 - DNA, 22 bp, Homo sapiens
agctgcagcactccagtagccg

SEQ ID NO: 8047636 - DNA, 22 bp, Homo sapiens
agctgccacatgcccaagggca

SEQ ID NO: 8047637 - DNA, 22 bp, Homo sapiens
agctgccaagtttctcagttta

SEQ ID NO: 8047638 - DNA, 22 bp, Homo sapiens
agctgccacagagcctggccag

SEQ ID NO: 8047639 - DNA, 22 bp, Homo sapiens
agctgccaagttggagtagcaa

SEQ ID NO: 8047640 - DNA, 22 bp, Homo sapiens
caggaaggcgcggctgtgcctg

SEQ ID NO: 8047641 - DNA, 22 bp, Homo sapiens
agctgtgccttgctgcacggtg

SEQ ID NO: 8047642 - DNA, 19 bp, Homo sapiens
agctgtgcagacacttcgc

SEQ ID NO: 8047643 - DNA, 22 bp, Homo sapiens
agctgtgcctattcgtggcaag

SEQ ID NO: 8047644 - DNA, 22 bp, Homo sapiens
agctgtgcctattcgtggcaag

SEQ ID NO: 8047645 - DNA, 22 bp, Homo sapiens
agctgtgcacactgtgaagtag

SEQ ID NO: 8047646 - DNA, 22 bp, Homo sapiens
agctgtggaagactgtcagggt

SEQ ID NO: 8047647 - DNA, 22 bp, Homo sapiens
caggctgcggtcggctctggtc

SEQ ID NO: 8047648 - DNA, 22 bp, Homo sapiens
caggctgcggccgtgtgagcat

SEQ ID NO: 8047649 - DNA, 22 bp, Homo sapiens
agctgtgattatccactggaat

SEQ ID NO: 8047650 - DNA, 22 bp, Homo sapiens
caggctccactgtaggcagctc

SEQ ID NO: 8047651 - DNA, 22 bp, Homo sapiens
caggctcagatgccctgcgctg

SEQ ID NO: 8047652 - DNA, 22 bp, Homo sapiens
caggctcagctctggccagtgc

SEQ ID NO: 8047653 - DNA, 22 bp, Homo sapiens
caggctcagctctggccagtgc

SEQ ID NO: 8047654 - DNA, 22 bp, Homo sapiens
agctggggcatttatccactaa

SEQ ID NO: 8047655 - DNA, 18 bp, Homo sapiens
agctggggcctctggtcc

SEQ ID NO: 8047656 - DNA, 22 bp, Homo sapiens
caggctcactttctcagtcaca

SEQ ID NO: 8047657 - DNA, 22 bp, Homo sapiens
caggcctgtctgcacatgaggc

SEQ ID NO: 8047658 - DNA, 22 bp, Homo sapiens
cagggagctgacaaccaaggag

SEQ ID NO: 8047659 - DNA, 22 bp, Homo sapiens
cagggagctctgggccggactc

SEQ ID NO: 8047660 - DNA, 22 bp, Homo sapiens
cagggatggttgagaattggta

SEQ ID NO: 8047661 - DNA, 22 bp, Homo sapiens
cagggagctggtgccagccgac

SEQ ID NO: 8047662 - DNA, 22 bp, Homo sapiens
cagggagctttcccaggaccct

SEQ ID NO: 8047663 - DNA, 22 bp, Homo sapiens
cagggagctttcccaggaccct

SEQ ID NO: 8047664 - DNA, 22 bp, Homo sapiens
caggctggagttacctttaggg

SEQ ID NO: 8047665 - DNA, 22 bp, Homo sapiens
caggctggagtgcagttgtgca

SEQ ID NO: 8047666 - DNA, 22 bp, Homo sapiens
caggctggagtgcagttgtgca

SEQ ID NO: 8047667 - DNA, 22 bp, Homo sapiens
cagggagaaatctccaggaggt

SEQ ID NO: 8047668 - DNA, 22 bp, Homo sapiens
cagggagctattagggttagtg

SEQ ID NO: 8047669 - DNA, 22 bp, Homo sapiens
cagggagcggagtcccatgcct

SEQ ID NO: 8047670 - DNA, 22 bp, Homo sapiens
cagggcctgcctggttcctgga

SEQ ID NO: 8047671 - DNA, 22 bp, Homo sapiens
cagggctcccaaatatctcttc

SEQ ID NO: 8047672 - DNA, 22 bp, Homo sapiens
caggggctccctgggtgccagt

SEQ ID NO: 8047673 - DNA, 22 bp, Homo sapiens
cagggcttgatctgcatcctgc

SEQ ID NO: 8047674 - DNA, 22 bp, Homo sapiens
cagggcctctcctccaggaact

SEQ ID NO: 8047675 - DNA, 22 bp, Homo sapiens
cagggcctcgaagcctctgggc

SEQ ID NO: 8047676 - DNA, 22 bp, Homo sapiens
cagggcctctgtgggctctctc

SEQ ID NO: 8047677 - DNA, 22 bp, Homo sapiens
cagggcctgagggctgctctgc

SEQ ID NO: 8047678 - DNA, 22 bp, Homo sapiens
cagggcctgcaagagacctggg

SEQ ID NO: 8047679 - DNA, 22 bp, Homo sapiens
cagggcctcctaaggcatctaa

SEQ ID NO: 8047680 - DNA, 22 bp, Homo sapiens
cagggatgtgatgagctgagcc

SEQ ID NO: 8047681 - DNA, 22 bp, Homo sapiens
cagggatgtctctggaagggag

SEQ ID NO: 8047682 - DNA, 22 bp, Homo sapiens
caggggctgtttgcctcaggcc

SEQ ID NO: 8047683 - DNA, 22 bp, Homo sapiens
caggggctgaaatgttggggtt

SEQ ID NO: 8047684 - DNA, 22 bp, Homo sapiens
caggtgaggctgaacagatgaa

SEQ ID NO: 8047685 - DNA, 22 bp, Homo sapiens
caggtgagtttgctattgtaca

SEQ ID NO: 8047686 - DNA, 22 bp, Homo sapiens
cagtttattgttgcgttcacat

SEQ ID NO: 8047687 - DNA, 22 bp, Homo sapiens
cagtttctctcaataagcatcg

SEQ ID NO: 8047688 - DNA, 22 bp, Homo sapiens
cagtggctgagagtggacactg

SEQ ID NO: 8047689 - DNA, 21 bp, Homo sapiens
cagtggtctgtctccattttt

SEQ ID NO: 8047690 - DNA, 22 bp, Homo sapiens
aggaggctgtggagcactccat

SEQ ID NO: 8047691 - DNA, 23 bp, Homo sapiens
catattcaaaactggaccactct

SEQ ID NO: 8047692 - DNA, 22 bp, Homo sapiens
catattctgttggtcacataga

SEQ ID NO: 8047693 - DNA, 20 bp, Homo sapiens
catagtaaagacattttagg

SEQ ID NO: 8047694 - DNA, 22 bp, Homo sapiens
catataaatacaacatgtgtta

SEQ ID NO: 8047695 - DNA, 22 bp, Homo sapiens
aggaccctgctcaagcatctcc

SEQ ID NO: 8047696 - DNA, 22 bp, Homo sapiens
aggaccagtgagtctggcaagt

SEQ ID NO: 8047697 - DNA, 22 bp, Homo sapiens
aggaccagcctccaggtctctt

SEQ ID NO: 8047698 - DNA, 22 bp, Homo sapiens
aggacatgtgcctccagggcag

SEQ ID NO: 8047699 - DNA, 22 bp, Homo sapiens
aggacatgtttgtatcttcctt

SEQ ID NO: 8047700 - DNA, 22 bp, Homo sapiens
aggacaggattgagctgaactg

SEQ ID NO: 8047701 - DNA, 22 bp, Homo sapiens
caggtgggagcgaggagctact

SEQ ID NO: 8047702 - DNA, 22 bp, Homo sapiens
caggtgggagcgaggagctact

SEQ ID NO: 8047703 - DNA, 22 bp, Homo sapiens
caggtgggagcgaggagctact

SEQ ID NO: 8047704 - DNA, 22 bp, Homo sapiens
caggtgggaccatgatagggca

SEQ ID NO: 8047705 - DNA, 22 bp, Homo sapiens
caggtggcttctccctaggcca

SEQ ID NO: 8047706 - DNA, 18 bp, Homo sapiens
cagtggcatagttgagta

SEQ ID NO: 8047707 - DNA, 22 bp, Homo sapiens
cagtggcatacttggctgatat

SEQ ID NO: 8047708 - DNA, 22 bp, Homo sapiens
cagtggcatacttggctgatat

SEQ ID NO: 8047709 - DNA, 22 bp, Homo sapiens
aggactcacatagcttcagatg

SEQ ID NO: 8047710 - DNA, 22 bp, Homo sapiens
cagtgcctcttaagtgtcaccc

SEQ ID NO: 8047711 - DNA, 22 bp, Homo sapiens
cagtgcctcaggccagcctgca

SEQ ID NO: 8047712 - DNA, 22 bp, Homo sapiens
cagtgcctggcatagaggcggc

SEQ ID NO: 8047713 - DNA, 22 bp, Homo sapiens
cagtgcctggccggcttccatt

SEQ ID NO: 8047714 - DNA, 20 bp, Homo sapiens
cagtgcctgccccttgggtt

SEQ ID NO: 8047715 - DNA, 22 bp, Homo sapiens
cagtgcctcttaagtgtcaccc

SEQ ID NO: 8047716 - DNA, 22 bp, Homo sapiens
cagtgcctggatagcaacatga

SEQ ID NO: 8047717 - DNA, 21 bp, Homo sapiens
cagtgctcaatctgacagtgg

SEQ ID NO: 8047718 - DNA, 22 bp, Homo sapiens
cagtgctcatagctgttcctcc

SEQ ID NO: 8047719 - DNA, 18 bp, Homo sapiens
catgggtgacaggtggat

SEQ ID NO: 8047720 - DNA, 22 bp, Homo sapiens
aggcactgcagattacaggcgc

SEQ ID NO: 8047721 - DNA, 22 bp, Homo sapiens
catgggggctgaggctgctgta

SEQ ID NO: 8047722 - DNA, 22 bp, Homo sapiens
catggggcccatgtgctccaag

SEQ ID NO: 8047723 - DNA, 22 bp, Homo sapiens
catgggctgctgacaggggctc

SEQ ID NO: 8047724 - DNA, 22 bp, Homo sapiens
catgggctttggaggctggagg

SEQ ID NO: 8047725 - DNA, 22 bp, Homo sapiens
catgggcttgctctctgagctc

SEQ ID NO: 8047726 - DNA, 22 bp, Homo sapiens
catggggagacacctagggaaa

SEQ ID NO: 8047727 - DNA, 22 bp, Homo sapiens
catggacagtgggacagtgtgt

SEQ ID NO: 8047728 - DNA, 22 bp, Homo sapiens
catggacaacctccattcgagt

SEQ ID NO: 8047729 - DNA, 22 bp, Homo sapiens
catggacatatgagacctttcc

SEQ ID NO: 8047730 - DNA, 22 bp, Homo sapiens
catggatatattgtacagtagc

SEQ ID NO: 8047731 - DNA, 22 bp, Homo sapiens
aggatgtgttttgagctgacta

SEQ ID NO: 8047732 - DNA, 22 bp, Homo sapiens
aggatgtgttcatagctgacgc

SEQ ID NO: 8047733 - DNA, 22 bp, Homo sapiens
aggatgtggtctgttttctgag

SEQ ID NO: 8047734 - DNA, 22 bp, Homo sapiens
aggatgtgtgtaggctggttaa

SEQ ID NO: 8047735 - DNA, 22 bp, Homo sapiens
catggcagagaaggggaactgg

SEQ ID NO: 8047736 - DNA, 22 bp, Homo sapiens
aggagggcaggctggctgccta

SEQ ID NO: 8047737 - DNA, 21 bp, Homo sapiens
aggagggcacaaggccaggaa

SEQ ID NO: 8047738 - DNA, 22 bp, Homo sapiens
aggaggggcaatgatagtctgg

SEQ ID NO: 8047739 - DNA, 22 bp, Homo sapiens
aggaggggcaatgatagtctgg

SEQ ID NO: 8047740 - DNA, 16 bp, Homo sapiens
aggaggggaattagga

SEQ ID NO: 8047741 - DNA, 20 bp, Homo sapiens
aggaggggatagaatcaaag

SEQ ID NO: 8047742 - DNA, 22 bp, Homo sapiens
aggcaggctggtctgaagagtg

SEQ ID NO: 8047743 - DNA, 22 bp, Homo sapiens
ccaaaggccaggcactgaggtt

SEQ ID NO: 8047744 - DNA, 22 bp, Homo sapiens
aggcagcagggccactggctga

SEQ ID NO: 8047745 - DNA, 22 bp, Homo sapiens
catttgttgggacaatgaaaag

SEQ ID NO: 8047746 - DNA, 17 bp, Homo sapiens
catttgttgatcagttg

SEQ ID NO: 8047747 - DNA, 22 bp, Homo sapiens
catttgaaattcttagaacaaa

SEQ ID NO: 8047748 - DNA, 22 bp, Homo sapiens
aggcactggtctaccccttagt

SEQ ID NO: 8047749 - DNA, 22 bp, Homo sapiens
aggcactgtactaggtacaggg

SEQ ID NO: 8047750 - DNA, 22 bp, Homo sapiens
aggcactgtactaggtacaggg

SEQ ID NO: 8047751 - DNA, 22 bp, Homo sapiens
aggcactgtggaagacatggtt

SEQ ID NO: 8047752 - DNA, 22 bp, Homo sapiens
aggcactgtggaagacatggtt

SEQ ID NO: 8047753 - DNA, 21 bp, Homo sapiens
aggaagaaaggttggaggttg

SEQ ID NO: 8047754 - DNA, 22 bp, Homo sapiens
aggaagaaactgagctctgaca

SEQ ID NO: 8047755 - DNA, 19 bp, Homo sapiens
acagggcttggcctgacat

SEQ ID NO: 8047756 - DNA, 22 bp, Homo sapiens
acagggcttttaatcagtagtt

SEQ ID NO: 8047757 - DNA, 22 bp, Homo sapiens
acaggggcaagggctcacggcc

SEQ ID NO: 8047758 - DNA, 20 bp, Homo sapiens
acaggggcagcacaataatg

SEQ ID NO: 8047759 - DNA, 22 bp, Homo sapiens
acaggggcaagggctcacggcc

SEQ ID NO: 8047760 - DNA, 22 bp, Homo sapiens
acaggggcaggcaggacccttt

SEQ ID NO: 8047761 - DNA, 19 bp, Homo sapiens
acaggggcctttccagggt

SEQ ID NO: 8047762 - DNA, 19 bp, Homo sapiens
acaggggctagcggaagca

SEQ ID NO: 8047763 - DNA, 22 bp, Homo sapiens
aggacacacagaatacaaatcc

SEQ ID NO: 8047764 - DNA, 22 bp, Homo sapiens
aggacacactgcaagagcctgg

SEQ ID NO: 8047765 - DNA, 22 bp, Homo sapiens
aggacacactgcaagagcctgg

SEQ ID NO: 8047766 - DNA, 22 bp, Homo sapiens
acagggagatgggtgaaagcgg

SEQ ID NO: 8047767 - DNA, 22 bp, Homo sapiens
acaggcagcactaatctctggt

SEQ ID NO: 8047768 - DNA, 22 bp, Homo sapiens
acaggcagattaagggtaggca

SEQ ID NO: 8047769 - DNA, 22 bp, Homo sapiens
acaggcagattaagggtaggca

SEQ ID NO: 8047770 - DNA, 22 bp, Homo sapiens
acaggcaggcttcggccagagc

SEQ ID NO: 8047771 - DNA, 22 bp, Homo sapiens
acaggcagcgtcattgctgctc

SEQ ID NO: 8047772 - DNA, 22 bp, Homo sapiens
agctggcaagttgaaggtggct

SEQ ID NO: 8047773 - DNA, 22 bp, Homo sapiens
agctggcaaaactaatgggaag

SEQ ID NO: 8047774 - DNA, 22 bp, Homo sapiens
agctggcaagttgaaggtggct

SEQ ID NO: 8047775 - DNA, 22 bp, Homo sapiens
agctggcacagaccaggagatc

SEQ ID NO: 8047776 - DNA, 22 bp, Homo sapiens
agctggcaccaaatatagtaaa

SEQ ID NO: 8047777 - DNA, 22 bp, Homo sapiens
agctggcagctctcaggggtac

SEQ ID NO: 8047778 - DNA, 22 bp, Homo sapiens
agctggcagagcatttgtggcc

SEQ ID NO: 8047779 - DNA, 21 bp, Homo sapiens
agctggcagatatggtgtctg

SEQ ID NO: 8047780 - DNA, 22 bp, Homo sapiens
acaggcacctccaggggtatgt

SEQ ID NO: 8047781 - DNA, 22 bp, Homo sapiens
agctggtggattatgctgtaca

SEQ ID NO: 8047782 - DNA, 22 bp, Homo sapiens
agctgaatcgaatggcccagtg

SEQ ID NO: 8047783 - DNA, 22 bp, Homo sapiens
agctgaatcttgactaggaaga

SEQ ID NO: 8047784 - DNA, 22 bp, Homo sapiens
agctctggttattgaagcaggg

SEQ ID NO: 8047785 - DNA, 22 bp, Homo sapiens
agctctgggtcacggctgccga

SEQ ID NO: 8047786 - DNA, 21 bp, Homo sapiens
acagctggtgcagggcgggga

SEQ ID NO: 8047787 - DNA, 21 bp, Homo sapiens
acagctggtgcagggcgggga

SEQ ID NO: 8047788 - DNA, 22 bp, Homo sapiens
acagctggcaggggggcatgaa

SEQ ID NO: 8047789 - DNA, 22 bp, Homo sapiens
acagctggccgaggctcaggga

SEQ ID NO: 8047790 - DNA, 22 bp, Homo sapiens
acagctgggtgctgctcagagc

SEQ ID NO: 8047791 - DNA, 22 bp, Homo sapiens
acagctgggaatcagctgggga

SEQ ID NO: 8047792 - DNA, 22 bp, Homo sapiens
aggatgagattccagggtcaat

SEQ ID NO: 8047793 - DNA, 22 bp, Homo sapiens
aggatggaattaggtagcaagt

SEQ ID NO: 8047794 - DNA, 21 bp, Homo sapiens
aggatggaaaggactaggggt

SEQ ID NO: 8047795 - DNA, 22 bp, Homo sapiens
acagttcccgtcttgcacagct

SEQ ID NO: 8047796 - DNA, 19 bp, Homo sapiens
aggatggagcaggcggtga

SEQ ID NO: 8047797 - DNA, 22 bp, Homo sapiens
aggatggattctgtatgtggga

SEQ ID NO: 8047798 - DNA, 20 bp, Homo sapiens
aggcactggggataggtaag

SEQ ID NO: 8047799 - DNA, 22 bp, Homo sapiens
aggcactgcttctaagtaggaa

SEQ ID NO: 8047800 - DNA, 21 bp, Homo sapiens
acagtttattagagtaagtgc

SEQ ID NO: 8047801 - DNA, 22 bp, Homo sapiens
aggagcagaccgtagtcctgca

SEQ ID NO: 8047802 - DNA, 22 bp, Homo sapiens
aggagatggagctcagtgggca

SEQ ID NO: 8047803 - DNA, 22 bp, Homo sapiens
acaggtgttgactcacaggccc

SEQ ID NO: 8047804 - DNA, 22 bp, Homo sapiens
acaggtgtacaatgcatgacag

SEQ ID NO: 8047805 - DNA, 22 bp, Homo sapiens
acaggtgttttggaggatgatt

SEQ ID NO: 8047806 - DNA, 22 bp, Homo sapiens
aggacacacttctgaggtcttt

SEQ ID NO: 8047807 - DNA, 22 bp, Homo sapiens
aggacacagctgctctgcagag

SEQ ID NO: 8047808 - DNA, 22 bp, Homo sapiens
agggagagaagttatacaagat

SEQ ID NO: 8047809 - DNA, 22 bp, Homo sapiens
agggacagtctactgttcactg

SEQ ID NO: 8047810 - DNA, 22 bp, Homo sapiens
accagccccaccgggactgcag

SEQ ID NO: 8047811 - DNA, 20 bp, Homo sapiens
aggcttggcttggcaggaac

SEQ ID NO: 8047812 - DNA, 19 bp, Homo sapiens
accagcccactcccagttt

SEQ ID NO: 8047813 - DNA, 22 bp, Homo sapiens
accagccaccaccaggagatcg

SEQ ID NO: 8047814 - DNA, 22 bp, Homo sapiens
accagcaggccaggggcactgc

SEQ ID NO: 8047815 - DNA, 22 bp, Homo sapiens
accagcaggccaggggcactgc

SEQ ID NO: 8047816 - DNA, 22 bp, Homo sapiens
agggcagcaaagtttgacctca

SEQ ID NO: 8047817 - DNA, 22 bp, Homo sapiens
agggcagcaatgcagctgctgc

SEQ ID NO: 8047818 - DNA, 22 bp, Homo sapiens
agggcagcaatgcagctgctgc

SEQ ID NO: 8047819 - DNA, 22 bp, Homo sapiens
agggcagcagcccatggctctg

SEQ ID NO: 8047820 - DNA, 22 bp, Homo sapiens
agggcagcagcccatggctctg

SEQ ID NO: 8047821 - DNA, 22 bp, Homo sapiens
agggcagcagcccatggctctg

SEQ ID NO: 8047822 - DNA, 22 bp, Homo sapiens
agggcagcacaaggcatggact

SEQ ID NO: 8047823 - DNA, 22 bp, Homo sapiens
agggcagcacaaggcatggact

SEQ ID NO: 8047824 - DNA, 22 bp, Homo sapiens
agggcagcacagctgtgctcct

SEQ ID NO: 8047825 - DNA, 22 bp, Homo sapiens
agggcagcaatttggttcctgg

SEQ ID NO: 8047826 - DNA, 22 bp, Homo sapiens
agggctgccccagtccagccgg

SEQ ID NO: 8047827 - DNA, 22 bp, Homo sapiens
acccagctggatgcatggaggc

SEQ ID NO: 8047828 - DNA, 22 bp, Homo sapiens
accaggcctggctgggcagcca

SEQ ID NO: 8047829 - DNA, 19 bp, Homo sapiens
acccagcccaggagtggca

SEQ ID NO: 8047830 - DNA, 22 bp, Homo sapiens
acccagccatgttcagttctct

SEQ ID NO: 8047831 - DNA, 22 bp, Homo sapiens
acccagccacagcattgaggga

SEQ ID NO: 8047832 - DNA, 22 bp, Homo sapiens
agggctgcctgactccagagcc

SEQ ID NO: 8047833 - DNA, 22 bp, Homo sapiens
agggggcaggagagacctgctg

SEQ ID NO: 8047834 - DNA, 22 bp, Homo sapiens
agggggcatcaggtcctggctc

SEQ ID NO: 8047835 - DNA, 22 bp, Homo sapiens
aggggcctggcactgagctggc

SEQ ID NO: 8047836 - DNA, 22 bp, Homo sapiens
aggggcctggttggcctctgtt

SEQ ID NO: 8047837 - DNA, 22 bp, Homo sapiens
agggggaggctgtgctgcgtct

SEQ ID NO: 8047838 - DNA, 22 bp, Homo sapiens
agggggctcagtgactgaagtg

SEQ ID NO: 8047839 - DNA, 22 bp, Homo sapiens
agggggctcctccggtgcttcc

SEQ ID NO: 8047840 - DNA, 22 bp, Homo sapiens
agggggctcagcatggatggag

SEQ ID NO: 8047841 - DNA, 22 bp, Homo sapiens
acatttctttgctagacagcag

SEQ ID NO: 8047842 - DNA, 22 bp, Homo sapiens
aggctctgttattctagagggc

SEQ ID NO: 8047843 - DNA, 22 bp, Homo sapiens
aggcctgaaggaagatgagctg

SEQ ID NO: 8047844 - DNA, 22 bp, Homo sapiens
acatgtgtaaggtctctcagtc

SEQ ID NO: 8047845 - DNA, 22 bp, Homo sapiens
aggccagggtcccacactcgca

SEQ ID NO: 8047846 - DNA, 22 bp, Homo sapiens
aggccagggtagggcccattgt

SEQ ID NO: 8047847 - DNA, 22 bp, Homo sapiens
aggccagggcactgctctttag

SEQ ID NO: 8047848 - DNA, 22 bp, Homo sapiens
aggccaggcgagacacccggct

SEQ ID NO: 8047849 - DNA, 22 bp, Homo sapiens
aggccagggtagggcccattgt

SEQ ID NO: 8047850 - DNA, 22 bp, Homo sapiens
aggccaggggtgagcacttctg

SEQ ID NO: 8047851 - DNA, 22 bp, Homo sapiens
acatgccaatttggttagttca

SEQ ID NO: 8047852 - DNA, 22 bp, Homo sapiens
acatgccatcactttcattcct

SEQ ID NO: 8047853 - DNA, 22 bp, Homo sapiens
acatgctttaacttattttgat

SEQ ID NO: 8047854 - DNA, 22 bp, Homo sapiens
acatgctttgatgtattttgca

SEQ ID NO: 8047855 - DNA, 22 bp, Homo sapiens
aggccaggcctttctccattcc

SEQ ID NO: 8047856 - DNA, 22 bp, Homo sapiens
acatcacacgccttccaggagg

SEQ ID NO: 8047857 - DNA, 22 bp, Homo sapiens
acatattttgaaagctttctaa

SEQ ID NO: 8047858 - DNA, 22 bp, Homo sapiens
acatcacagagcccagataaag

SEQ ID NO: 8047859 - DNA, 22 bp, Homo sapiens
acatcacagtagttaagccaga

SEQ ID NO: 8047860 - DNA, 22 bp, Homo sapiens
actggaaaaccactgaaatgag

SEQ ID NO: 8047861 - DNA, 22 bp, Homo sapiens
actggaaaggctctgaatggga

SEQ ID NO: 8047862 - DNA, 22 bp, Homo sapiens
agtggcagggctggctgctgca

SEQ ID NO: 8047863 - DNA, 22 bp, Homo sapiens
agtggcagggctggctgctgca

SEQ ID NO: 8047864 - DNA, 22 bp, Homo sapiens
agtggcagggctggctgctgca

SEQ ID NO: 8047865 - DNA, 22 bp, Homo sapiens
agtggcagagctgtgtcttgaa

SEQ ID NO: 8047866 - DNA, 22 bp, Homo sapiens
agtggcagtagatgagctggtt

SEQ ID NO: 8047867 - DNA, 22 bp, Homo sapiens
agtggcaggtgtttcgtggtgc

SEQ ID NO: 8047868 - DNA, 22 bp, Homo sapiens
agtggcaggtgtttcgtggtgc

SEQ ID NO: 8047869 - DNA, 22 bp, Homo sapiens
agtggcagtggctgggcagagc

SEQ ID NO: 8047870 - DNA, 22 bp, Homo sapiens
agtggcagtggaaagcacacgg

SEQ ID NO: 8047871 - DNA, 22 bp, Homo sapiens
agtggcagtggaaagcacacgg

SEQ ID NO: 8047872 - DNA, 22 bp, Homo sapiens
actgcacttcagcctgggtgtc

SEQ ID NO: 8047873 - DNA, 22 bp, Homo sapiens
agtctttaacatttggagattg

SEQ ID NO: 8047874 - DNA, 22 bp, Homo sapiens
agtcttctgggtgtttccagag

SEQ ID NO: 8047875 - DNA, 17 bp, Homo sapiens
actcctggtctgaaggg

SEQ ID NO: 8047876 - DNA, 22 bp, Homo sapiens
actcctggtgctgatgaagaga

SEQ ID NO: 8047877 - DNA, 22 bp, Homo sapiens
actcttcacacttgtctccagg

SEQ ID NO: 8047878 - DNA, 22 bp, Homo sapiens
agtgcagggggaaagggtgtct

SEQ ID NO: 8047879 - DNA, 22 bp, Homo sapiens
agtgcagtgatgaataatggtt

SEQ ID NO: 8047880 - DNA, 21 bp, Homo sapiens
actgagggccagagaggacct

SEQ ID NO: 8047881 - DNA, 22 bp, Homo sapiens
acctggcaggaaggtgggtgat

SEQ ID NO: 8047882 - DNA, 22 bp, Homo sapiens
acctggcactacaggcacctgt

SEQ ID NO: 8047883 - DNA, 22 bp, Homo sapiens
acctggcatgaagcatgcctta

SEQ ID NO: 8047884 - DNA, 22 bp, Homo sapiens
aggtggcatgcctgagacataa

SEQ ID NO: 8047885 - DNA, 18 bp, Homo sapiens
aggtggcctgggagcttt

SEQ ID NO: 8047886 - DNA, 22 bp, Homo sapiens
aggtggctatgaggatgcagtc

SEQ ID NO: 8047887 - DNA, 22 bp, Homo sapiens
aggtggctcctcccatggctgg

SEQ ID NO: 8047888 - DNA, 22 bp, Homo sapiens
acctggagtcatttgaggagta

SEQ ID NO: 8047889 - DNA, 22 bp, Homo sapiens
acctggaggcagaggttgcagt

SEQ ID NO: 8047890 - DNA, 22 bp, Homo sapiens
acctggagggaagttctgactt

SEQ ID NO: 8047891 - DNA, 22 bp, Homo sapiens
acctggagtcatttgaggagta

SEQ ID NO: 8047892 - DNA, 22 bp, Homo sapiens
aggtcctgtgtccaggggcctg

SEQ ID NO: 8047893 - DNA, 22 bp, Homo sapiens
acctgcagctaaagatgtaggg

SEQ ID NO: 8047894 - DNA, 22 bp, Homo sapiens
acgcatggtaaatccactgact

SEQ ID NO: 8047895 - DNA, 22 bp, Homo sapiens
acgcaggagtgggtggagtgga

SEQ ID NO: 8047896 - DNA, 22 bp, Homo sapiens
agtccaggcgggtatagaggct

SEQ ID NO: 8047897 - DNA, 22 bp, Homo sapiens
actaggggctcaggcccaggga

SEQ ID NO: 8047898 - DNA, 22 bp, Homo sapiens
atctaaaaggagctctttatct

SEQ ID NO: 8047899 - DNA, 22 bp, Homo sapiens
atcctttataagacttgtattc

SEQ ID NO: 8047900 - DNA, 20 bp, Homo sapiens
atcggcttgcctggaaacaa

SEQ ID NO: 8047901 - DNA, 19 bp, Homo sapiens
atcatcctgggtcatgcac

SEQ ID NO: 8047902 - DNA, 22 bp, Homo sapiens
agaacagcagtagtatacagta

SEQ ID NO: 8047903 - DNA, 22 bp, Homo sapiens
agaaagttatcacaaaattgag

SEQ ID NO: 8047904 - DNA, 22 bp, Homo sapiens
agaaagttcactggtatatttt

SEQ ID NO: 8047905 - DNA, 22 bp, Homo sapiens
agaaaagtgctctagtgagagc

SEQ ID NO: 8047906 - DNA, 22 bp, Homo sapiens
atattctagccaaagtgtgagc

SEQ ID NO: 8047907 - DNA, 22 bp, Homo sapiens
atattctataagcagttggaag

SEQ ID NO: 8047908 - DNA, 22 bp, Homo sapiens
atattcttatccttttctctgt

SEQ ID NO: 8047909 - DNA, 22 bp, Homo sapiens
atatggcaaaggggaattaagg

SEQ ID NO: 8047910 - DNA, 22 bp, Homo sapiens
atatggaatggtaatctacaat

SEQ ID NO: 8047911 - DNA, 22 bp, Homo sapiens
actttctcaggaattcacagac

SEQ ID NO: 8047912 - DNA, 22 bp, Homo sapiens
actttcatggatctctgttcag

SEQ ID NO: 8047913 - DNA, 22 bp, Homo sapiens
actttcatgctctgagcactgg

SEQ ID NO: 8047914 - DNA, 22 bp, Homo sapiens
actttcatttgtgaagactgta

SEQ ID NO: 8047915 - DNA, 22 bp, Homo sapiens
actttcatttgtaataaacttc

SEQ ID NO: 8047916 - DNA, 22 bp, Homo sapiens
actttcacatgtgtgcagacag

SEQ ID NO: 8047917 - DNA, 22 bp, Homo sapiens
atactgtgtgcagagtcctaat

SEQ ID NO: 8047918 - DNA, 22 bp, Homo sapiens
actttatttcctattgcatcca

SEQ ID NO: 8047919 - DNA, 22 bp, Homo sapiens
atactgtaatacctaaatgaac

SEQ ID NO: 8047920 - DNA, 22 bp, Homo sapiens
atacatgttgtaccatatgttt

SEQ ID NO: 8047921 - DNA, 22 bp, Homo sapiens
atacatgttgagaaaatatctg

SEQ ID NO: 8047922 - DNA, 22 bp, Homo sapiens
atacattagtgaacaaaagaga

SEQ ID NO: 8047923 - DNA, 22 bp, Homo sapiens
atacattagctcatatgattaa

SEQ ID NO: 8047924 - DNA, 22 bp, Homo sapiens
atacatgttcgtgtacatgttc

SEQ ID NO: 8047925 - DNA, 22 bp, Homo sapiens
atacatctatgcctttctgaca

SEQ ID NO: 8047926 - DNA, 22 bp, Homo sapiens
ataatgctgggagaaattgtta

SEQ ID NO: 8047927 - DNA, 22 bp, Homo sapiens
ataatgcatttagaataattca

SEQ ID NO: 8047928 - DNA, 22 bp, Homo sapiens
ataatggccgggggctgaatgc

SEQ ID NO: 8047929 - DNA, 22 bp, Homo sapiens
acttagaaagggattctagatt

SEQ ID NO: 8047930 - DNA, 22 bp, Homo sapiens
atacagtaaccacattctatag

SEQ ID NO: 8047931 - DNA, 22 bp, Homo sapiens
atacagggacatccagtttttc

SEQ ID NO: 8047932 - DNA, 22 bp, Homo sapiens
actgtattggttttctattgct

SEQ ID NO: 8047933 - DNA, 20 bp, Homo sapiens
actgggagctaacggagatt

SEQ ID NO: 8047934 - DNA, 22 bp, Homo sapiens
actgggagaaactgacacctta

SEQ ID NO: 8047935 - DNA, 22 bp, Homo sapiens
actgtgcaggtagatgcctggg

SEQ ID NO: 8047936 - DNA, 22 bp, Homo sapiens
ataatctggcttgtttgcttaa

SEQ ID NO: 8047937 - DNA, 22 bp, Homo sapiens
ataatgaatgcagagttatttt

SEQ ID NO: 8047938 - DNA, 22 bp, Homo sapiens
ataatgaatcagcatagggtga

SEQ ID NO: 8047939 - DNA, 19 bp, Homo sapiens
ataatgaaggtggagccag

SEQ ID NO: 8047940 - DNA, 22 bp, Homo sapiens
ataatgaaatatgaggaaggtc

SEQ ID NO: 8047941 - DNA, 20 bp, Homo sapiens
agcaggtaaggcacagcagt

SEQ ID NO: 8047942 - DNA, 22 bp, Homo sapiens
agcaggggtggaaggtagcttt

SEQ ID NO: 8047943 - DNA, 22 bp, Homo sapiens
agcaggggtaacagaaggaaag

SEQ ID NO: 8047944 - DNA, 22 bp, Homo sapiens
agcaggggtaacagaaggaaag

SEQ ID NO: 8047945 - DNA, 22 bp, Homo sapiens
agcaggggtctctgctaatgaa

SEQ ID NO: 8047946 - DNA, 22 bp, Homo sapiens
agcagggggccacagtcacagc

SEQ ID NO: 8047947 - DNA, 22 bp, Homo sapiens
agcagggggagttagactagat

SEQ ID NO: 8047948 - DNA, 22 bp, Homo sapiens
agcagggggcatccttgccctt

SEQ ID NO: 8047949 - DNA, 22 bp, Homo sapiens
agcagggctgtgctccttccga

SEQ ID NO: 8047950 - DNA, 23 bp, Homo sapiens
agcaggctgcttctccacagctg

SEQ ID NO: 8047951 - DNA, 22 bp, Homo sapiens
agcaggggctcctccacagcca

SEQ ID NO: 8047952 - DNA, 22 bp, Homo sapiens
agcaggggctcctccacagcca

SEQ ID NO: 8047953 - DNA, 22 bp, Homo sapiens
cactgcctgtgagctgtgtgcc

SEQ ID NO: 8047954 - DNA, 22 bp, Homo sapiens
caccgtggaggagctggagggc

SEQ ID NO: 8047955 - DNA, 22 bp, Homo sapiens
caccgcggagtgatggagaaac

SEQ ID NO: 8047956 - DNA, 22 bp, Homo sapiens
cacccagggctgtgcctgccca

SEQ ID NO: 8047957 - DNA, 22 bp, Homo sapiens
agcaggctgagcacccaggggg

SEQ ID NO: 8047958 - DNA, 22 bp, Homo sapiens
agcaggctccaggctggccatc

SEQ ID NO: 8047959 - DNA, 22 bp, Homo sapiens
agcaggctccttccttctctgg

SEQ ID NO: 8047960 - DNA, 22 bp, Homo sapiens
cacagttagctccagtcttagc

SEQ ID NO: 8047961 - DNA, 22 bp, Homo sapiens
agcaggcaggaaggcagcactg

SEQ ID NO: 8047962 - DNA, 22 bp, Homo sapiens
agcaggcagctgggggagttga

SEQ ID NO: 8047963 - DNA, 22 bp, Homo sapiens
agcaggcagcctaggaagtgaa

SEQ ID NO: 8047964 - DNA, 22 bp, Homo sapiens
agcaggcagcctaggaagtgaa

SEQ ID NO: 8047965 - DNA, 22 bp, Homo sapiens
agcaggcactatgccaggatct

SEQ ID NO: 8047966 - DNA, 22 bp, Homo sapiens
agcaggcagcatgggaccctcc

SEQ ID NO: 8047967 - DNA, 22 bp, Homo sapiens
cacacacagttttgtattctgt

SEQ ID NO: 8047968 - DNA, 22 bp, Homo sapiens
cacacactcttcctggcaccta

SEQ ID NO: 8047969 - DNA, 22 bp, Homo sapiens
cacacactgacaccttatcttg

SEQ ID NO: 8047970 - DNA, 22 bp, Homo sapiens
agcaggagcccttatcaccagg

SEQ ID NO: 8047971 - DNA, 22 bp, Homo sapiens
cacacactgttaatgtaggagt

SEQ ID NO: 8047972 - DNA, 22 bp, Homo sapiens
cacacactggagcaaggagatg

SEQ ID NO: 8047973 - DNA, 22 bp, Homo sapiens
agcaggcaccagggctcgtcct

SEQ ID NO: 8047974 - DNA, 22 bp, Homo sapiens
agcaggcacgctccctgcgcga

SEQ ID NO: 8047975 - DNA, 17 bp, Homo sapiens
agcaggcacgtcagcac

SEQ ID NO: 8047976 - DNA, 22 bp, Homo sapiens
agcaggcaaggtccgtgcctcg

SEQ ID NO: 8047977 - DNA, 22 bp, Homo sapiens
agcaggcaagcgtgagttctct

SEQ ID NO: 8047978 - DNA, 22 bp, Homo sapiens
agcaggattttgaagtgcaagt

SEQ ID NO: 8047979 - DNA, 21 bp, Homo sapiens
agcaggcaaaggtgaagtctt

SEQ ID NO: 8047980 - DNA, 23 bp, Homo sapiens
agcaggataattttattatgccc

SEQ ID NO: 8047981 - DNA, 22 bp, Homo sapiens
agcagctgcagagggctccccc

SEQ ID NO: 8047982 - DNA, 22 bp, Homo sapiens
agcagctgatggggaaggagtt

SEQ ID NO: 8047983 - DNA, 22 bp, Homo sapiens
agcagctgccagagagagttcc

SEQ ID NO: 8047984 - DNA, 22 bp, Homo sapiens
agcagctgccactggaatagga

SEQ ID NO: 8047985 - DNA, 22 bp, Homo sapiens
agcacaggtgaaacagtcaggt

SEQ ID NO: 8047986 - DNA, 22 bp, Homo sapiens
agcacagtaattgatattactg

SEQ ID NO: 8047987 - DNA, 22 bp, Homo sapiens
caaatagtatgagcaatgattc

SEQ ID NO: 8047988 - DNA, 22 bp, Homo sapiens
agcaaagacagggacgaccaag

SEQ ID NO: 8047989 - DNA, 22 bp, Homo sapiens
agcaaagaaatggaggctcaga

SEQ ID NO: 8047990 - DNA, 22 bp, Homo sapiens
agcacaggtgaaacagtcaggt

SEQ ID NO: 8047991 - DNA, 21 bp, Homo sapiens
agcacagctttaagccatgtg

SEQ ID NO: 8047992 - DNA, 22 bp, Homo sapiens
caagacattgattttgtacaga

SEQ ID NO: 8047993 - DNA, 22 bp, Homo sapiens
agcaccaggctgttggaagccc

SEQ ID NO: 8047994 - DNA, 22 bp, Homo sapiens
agcaccagcaactatgggctgc

SEQ ID NO: 8047995 - DNA, 22 bp, Homo sapiens
agcagcagggtgatagtgccca

SEQ ID NO: 8047996 - DNA, 22 bp, Homo sapiens
agcagcagggtgatagtgccca

SEQ ID NO: 8047997 - DNA, 22 bp, Homo sapiens
agcagcagggctctgcccgtgc

SEQ ID NO: 8047998 - DNA, 22 bp, Homo sapiens
agcagcagggacaaaggaacag

SEQ ID NO: 8047999 - DNA, 22 bp, Homo sapiens
agcagcagggcatgtcttactc

SEQ ID NO: 8048000 - DNA, 22 bp, Homo sapiens
agcagcaggcttaaggaaaagt

SEQ ID NO: 8048001 - DNA, 21 bp, Homo sapiens
agcagcagggaagcctcatcc

SEQ ID NO: 8048002 - DNA, 21 bp, Homo sapiens
agcagcagggaagcctcatcc

SEQ ID NO: 8048003 - DNA, 22 bp, Homo sapiens
agcagccaaggtaacctgtgct

SEQ ID NO: 8048004 - DNA, 22 bp, Homo sapiens
cacaaggctgggacaagtgctg

SEQ ID NO: 8048005 - DNA, 22 bp, Homo sapiens
agcagccacccagctgctcatt

SEQ ID NO: 8048006 - DNA, 22 bp, Homo sapiens
agcagccacccagctgctcatt

SEQ ID NO: 8048007 - DNA, 22 bp, Homo sapiens
caagagcacgtgccctccataa

SEQ ID NO: 8048008 - DNA, 22 bp, Homo sapiens
caagagcatccctgcatccagc

SEQ ID NO: 8048009 - DNA, 22 bp, Homo sapiens
caagagcctttgggcagaagga

SEQ ID NO: 8048010 - DNA, 22 bp, Homo sapiens
agcagcaggaggccattgtctt

SEQ ID NO: 8048011 - DNA, 22 bp, Homo sapiens
agcagcaggagccgtggggtga

SEQ ID NO: 8048012 - DNA, 22 bp, Homo sapiens
agcagcaggagccgtggggtga

SEQ ID NO: 8048013 - DNA, 22 bp, Homo sapiens
agcagcaggaggctgtccacca

SEQ ID NO: 8048014 - DNA, 22 bp, Homo sapiens
agcagcaggaggctgtccacca

SEQ ID NO: 8048015 - DNA, 23 bp, Homo sapiens
agcagcaggaggtattgataagg

SEQ ID NO: 8048016 - DNA, 20 bp, Homo sapiens
agcagcagatgttggaggtg

SEQ ID NO: 8048017 - DNA, 22 bp, Homo sapiens
agcagcagattatggtctacat

SEQ ID NO: 8048018 - DNA, 22 bp, Homo sapiens
agcagcagctctgttgccctac

SEQ ID NO: 8048019 - DNA, 22 bp, Homo sapiens
agcagcaggcttaaggaaaagt

SEQ ID NO: 8048020 - DNA, 22 bp, Homo sapiens
agcagcaggctgtgtggactga

SEQ ID NO: 8048021 - DNA, 22 bp, Homo sapiens
agcagcaggctgggatgagtct

SEQ ID NO: 8048022 - DNA, 22 bp, Homo sapiens
agcagcaggctgggatgagtct

SEQ ID NO: 8048023 - DNA, 22 bp, Homo sapiens
agcagcaggattttcgttggga

SEQ ID NO: 8048024 - DNA, 22 bp, Homo sapiens
agcctctgctggccctggcact

SEQ ID NO: 8048025 - DNA, 22 bp, Homo sapiens
agcctctgcacttcttacaggt

SEQ ID NO: 8048026 - DNA, 22 bp, Homo sapiens
agcctctggccctagactgctt

SEQ ID NO: 8048027 - DNA, 18 bp, Homo sapiens
agcctctggcagagagaa

SEQ ID NO: 8048028 - DNA, 18 bp, Homo sapiens
agcctctggcagagagaa

SEQ ID NO: 8048029 - DNA, 22 bp, Homo sapiens
agcctctggtcctccctcagct

SEQ ID NO: 8048030 - DNA, 22 bp, Homo sapiens
agcctctggccctagactgctt

SEQ ID NO: 8048031 - DNA, 22 bp, Homo sapiens
agcctctgtagaaagcagtgtg

SEQ ID NO: 8048032 - DNA, 22 bp, Homo sapiens
cagagggcacatggtttcctca

SEQ ID NO: 8048033 - DNA, 22 bp, Homo sapiens
cagagggccccctggccacagt

SEQ ID NO: 8048034 - DNA, 22 bp, Homo sapiens
agcctggagttcccaggagaag

SEQ ID NO: 8048035 - DNA, 22 bp, Homo sapiens
agcctggaggtaatgaggaaac

SEQ ID NO: 8048036 - DNA, 22 bp, Homo sapiens
cagcagctgaggcgctggcgtg

SEQ ID NO: 8048037 - DNA, 22 bp, Homo sapiens
agcctggatccatgtggctacc

SEQ ID NO: 8048038 - DNA, 22 bp, Homo sapiens
agcctggagttcccaggagaag

SEQ ID NO: 8048039 - DNA, 22 bp, Homo sapiens
agcctggatcctaggctcagct

SEQ ID NO: 8048040 - DNA, 22 bp, Homo sapiens
agcctggatcctaggctcagct

SEQ ID NO: 8048041 - DNA, 22 bp, Homo sapiens
agcctggattcgtgcatccaca

SEQ ID NO: 8048042 - DNA, 22 bp, Homo sapiens
agcctggcactgaggcagggcg

SEQ ID NO: 8048043 - DNA, 22 bp, Homo sapiens
agcctggattcgtgcatccaca

SEQ ID NO: 8048044 - DNA, 22 bp, Homo sapiens
cagcagggcccccgggtgcgcc

SEQ ID NO: 8048045 - DNA, 22 bp, Homo sapiens
cagcaggatatggtggagagag

SEQ ID NO: 8048046 - DNA, 22 bp, Homo sapiens
cagcaggatatggtggagagag

SEQ ID NO: 8048047 - DNA, 22 bp, Homo sapiens
cagcagctcaggctccttccca

SEQ ID NO: 8048048 - DNA, 22 bp, Homo sapiens
cagcagctcaggctgcttccca

SEQ ID NO: 8048049 - DNA, 22 bp, Homo sapiens
cagcagctcaggctgcttccca

SEQ ID NO: 8048050 - DNA, 22 bp, Homo sapiens
cagcagctcagtctctcagtag

SEQ ID NO: 8048051 - DNA, 22 bp, Homo sapiens
cagcagctccaaagaatagcca

SEQ ID NO: 8048052 - DNA, 22 bp, Homo sapiens
cagcagctcactcaggtggctc

SEQ ID NO: 8048053 - DNA, 22 bp, Homo sapiens
agcctcttccagctcctttcta

SEQ ID NO: 8048054 - DNA, 22 bp, Homo sapiens
agctcctgaaaatccagactgg

SEQ ID NO: 8048055 - DNA, 22 bp, Homo sapiens
cagctcagtttcaataccaggt

SEQ ID NO: 8048056 - DNA, 22 bp, Homo sapiens
cagctcagtgatgccttcacag

SEQ ID NO: 8048057 - DNA, 22 bp, Homo sapiens
cagctcagtcttgaagcactgg

SEQ ID NO: 8048058 - DNA, 22 bp, Homo sapiens
agctcctgattctcagagatag

SEQ ID NO: 8048059 - DNA, 20 bp, Homo sapiens
cagctctgggcaggtcgagg

SEQ ID NO: 8048060 - DNA, 22 bp, Homo sapiens
cagctctgagactgaggctatg

SEQ ID NO: 8048061 - DNA, 22 bp, Homo sapiens
agctcaggcaactctgggcccc

SEQ ID NO: 8048062 - DNA, 22 bp, Homo sapiens
agctcagcttcctctccatgct

SEQ ID NO: 8048063 - DNA, 22 bp, Homo sapiens
agctcagcgggcttctggtaag

SEQ ID NO: 8048064 - DNA, 21 bp, Homo sapiens
agctcagccgggcacagtggc

SEQ ID NO: 8048065 - DNA, 22 bp, Homo sapiens
agctcagccctcctgtgcagct

SEQ ID NO: 8048066 - DNA, 22 bp, Homo sapiens
agctcagagctcgggaggatgg

SEQ ID NO: 8048067 - DNA, 22 bp, Homo sapiens
cagctcaggctctccatgctcc

SEQ ID NO: 8048068 - DNA, 22 bp, Homo sapiens
cagctcaggcactggcgcggga

SEQ ID NO: 8048069 - DNA, 19 bp, Homo sapiens
cagctcaggactcagcccc

SEQ ID NO: 8048070 - DNA, 22 bp, Homo sapiens
cagccctgagaaggaggatctc

SEQ ID NO: 8048071 - DNA, 22 bp, Homo sapiens
cagcatcaacattctcagctct

SEQ ID NO: 8048072 - DNA, 22 bp, Homo sapiens
cagccctgcagagggcgctcct

SEQ ID NO: 8048073 - DNA, 22 bp, Homo sapiens
agctcagagataatcaagagac

SEQ ID NO: 8048074 - DNA, 22 bp, Homo sapiens
cagcagggttaagtgactcacc

SEQ ID NO: 8048075 - DNA, 22 bp, Homo sapiens
cagcagggtatacagggaattt

SEQ ID NO: 8048076 - DNA, 22 bp, Homo sapiens
cagcagttatgagtagaatagt

SEQ ID NO: 8048077 - DNA, 22 bp, Homo sapiens
cagcagtgtggaagctgagggg

SEQ ID NO: 8048078 - DNA, 22 bp, Homo sapiens
cagaatgtagatcatcatcaag

SEQ ID NO: 8048079 - DNA, 22 bp, Homo sapiens
agccactgtgagaggaccaggg

SEQ ID NO: 8048080 - DNA, 22 bp, Homo sapiens
agccactgtgagaggaccaggg

SEQ ID NO: 8048081 - DNA, 22 bp, Homo sapiens
agccactgtgcaggagcagtgt

SEQ ID NO: 8048082 - DNA, 22 bp, Homo sapiens
agccactgtgtgaccagctgtc

SEQ ID NO: 8048083 - DNA, 22 bp, Homo sapiens
agccagagaacagcaggaaatg

SEQ ID NO: 8048084 - DNA, 22 bp, Homo sapiens
cagacagggttttggtctttgg

SEQ ID NO: 8048085 - DNA, 22 bp, Homo sapiens
cagacagggtgggtttctgggc

SEQ ID NO: 8048086 - DNA, 22 bp, Homo sapiens
cagacaggaagttcagaagaaa

SEQ ID NO: 8048087 - DNA, 22 bp, Homo sapiens
cagacaggaagttcagaagaaa

SEQ ID NO: 8048088 - DNA, 22 bp, Homo sapiens
agccagagagtgttggagatgt

SEQ ID NO: 8048089 - DNA, 22 bp, Homo sapiens
cagacaggtagggacagaacat

SEQ ID NO: 8048090 - DNA, 22 bp, Homo sapiens
cagacaggttgcaaaacttcaa

SEQ ID NO: 8048091 - DNA, 22 bp, Homo sapiens
cagacaggttgcaaaacttcaa

SEQ ID NO: 8048092 - DNA, 22 bp, Homo sapiens
cagacagtggacttgataaagg

SEQ ID NO: 8048093 - DNA, 22 bp, Homo sapiens
cagacagtgttagagtcaagct

SEQ ID NO: 8048094 - DNA, 22 bp, Homo sapiens
cagacatgatgtaagcagaggc

SEQ ID NO: 8048095 - DNA, 22 bp, Homo sapiens
agccactggcctgggcagctct

SEQ ID NO: 8048096 - DNA, 22 bp, Homo sapiens
agccactgcccttagccatttg

SEQ ID NO: 8048097 - DNA, 22 bp, Homo sapiens
agccactggtaaactggtagga

SEQ ID NO: 8048098 - DNA, 22 bp, Homo sapiens
agccactggtaaactggtagga

SEQ ID NO: 8048099 - DNA, 22 bp, Homo sapiens
cagaaatatcagttgaaagtgc

SEQ ID NO: 8048100 - DNA, 22 bp, Homo sapiens
agccacctctgtgcaggcctcg

SEQ ID NO: 8048101 - DNA, 22 bp, Homo sapiens
agccacagtgggctaccagctc

SEQ ID NO: 8048102 - DNA, 22 bp, Homo sapiens
agccacagtgggctaccagctc

SEQ ID NO: 8048103 - DNA, 22 bp, Homo sapiens
agccacagtgcaagagagaaaa

SEQ ID NO: 8048104 - DNA, 22 bp, Homo sapiens
agccacatttttctgctcctga

SEQ ID NO: 8048105 - DNA, 22 bp, Homo sapiens
agccacaggaaacagagacagc

SEQ ID NO: 8048106 - DNA, 22 bp, Homo sapiens
agccacaggaaacagagacagc

SEQ ID NO: 8048107 - DNA, 22 bp, Homo sapiens
agccacagtgcaagagagaaaa

SEQ ID NO: 8048108 - DNA, 22 bp, Homo sapiens
agcatataaatggacatatttg

SEQ ID NO: 8048109 - DNA, 22 bp, Homo sapiens
agcatatacaaactcatataca

SEQ ID NO: 8048110 - DNA, 22 bp, Homo sapiens
cagacatggcgccaagtgctag

SEQ ID NO: 8048111 - DNA, 22 bp, Homo sapiens
cagacttttgacattaatacag

SEQ ID NO: 8048112 - DNA, 22 bp, Homo sapiens
agccagtttgcttgtaataaca

SEQ ID NO: 8048113 - DNA, 22 bp, Homo sapiens
agcccaagcctggctggcgatg

SEQ ID NO: 8048114 - DNA, 22 bp, Homo sapiens
agcccaagctatgaggtgacct

SEQ ID NO: 8048115 - DNA, 22 bp, Homo sapiens
agcccaagcataggagggaggc

SEQ ID NO: 8048116 - DNA, 22 bp, Homo sapiens
agcccagcagaaagtccagcct

SEQ ID NO: 8048117 - DNA, 23 bp, Homo sapiens
agcccagcagagaacctaggtcc

SEQ ID NO: 8048118 - DNA, 22 bp, Homo sapiens
agcccagatggtagccctagaa

SEQ ID NO: 8048119 - DNA, 22 bp, Homo sapiens
agcccagagggtagcagaagaa

SEQ ID NO: 8048120 - DNA, 22 bp, Homo sapiens
agcccagagccccggccatgtt

SEQ ID NO: 8048121 - DNA, 20 bp, Homo sapiens
agcccaggcctgtgtgagtc

SEQ ID NO: 8048122 - DNA, 20 bp, Homo sapiens
agcccaggcctgtgtgagtc

SEQ ID NO: 8048123 - DNA, 22 bp, Homo sapiens
agcccagggaaccaggaagtgg

SEQ ID NO: 8048124 - DNA, 22 bp, Homo sapiens
agcccagggaaccaggaagtgg

SEQ ID NO: 8048125 - DNA, 22 bp, Homo sapiens
agcccaggctggagtgcagtgg

SEQ ID NO: 8048126 - DNA, 22 bp, Homo sapiens
agcccaggctggagtgcagtgg

SEQ ID NO: 8048127 - DNA, 22 bp, Homo sapiens
agcccaggcagagggatgcttg

SEQ ID NO: 8048128 - DNA, 21 bp, Homo sapiens
cagaggcaggtcctgggacgg

SEQ ID NO: 8048129 - DNA, 22 bp, Homo sapiens
agcccagccggattcccagttc

SEQ ID NO: 8048130 - DNA, 22 bp, Homo sapiens
atgaaagtgaaggtttactaag

SEQ ID NO: 8048131 - DNA, 22 bp, Homo sapiens
atgaaattgatcttgaactttt

SEQ ID NO: 8048132 - DNA, 22 bp, Homo sapiens
agacaaatggagtatgagcaac

SEQ ID NO: 8048133 - DNA, 22 bp, Homo sapiens
agacaaattgggacattgtgtt

SEQ ID NO: 8048134 - DNA, 22 bp, Homo sapiens
agacaaagaaaccgtagaagca

SEQ ID NO: 8048135 - DNA, 22 bp, Homo sapiens
atctcaggaggaccctgatgct

SEQ ID NO: 8048136 - DNA, 22 bp, Homo sapiens
agaagtgagtgtgactcagcag

SEQ ID NO: 8048137 - DNA, 22 bp, Homo sapiens
agaagtcaccctgttgctgtga

SEQ ID NO: 8048138 - DNA, 22 bp, Homo sapiens
agacagactggtttgaattggt

SEQ ID NO: 8048139 - DNA, 21 bp, Homo sapiens
agacagactgcctgacccacg

SEQ ID NO: 8048140 - DNA, 22 bp, Homo sapiens
agacagacgtagtgtgagagta

SEQ ID NO: 8048141 - DNA, 17 bp, Homo sapiens
agacagacctctgcatc

SEQ ID NO: 8048142 - DNA, 22 bp, Homo sapiens
agacagacggctttatacacag

SEQ ID NO: 8048143 - DNA, 22 bp, Homo sapiens
agacagacatgctagttttctt

SEQ ID NO: 8048144 - DNA, 22 bp, Homo sapiens
agacagacattctagagccacc

SEQ ID NO: 8048145 - DNA, 22 bp, Homo sapiens
agacagaccatggctattcaga

SEQ ID NO: 8048146 - DNA, 22 bp, Homo sapiens
agacagctatcaacaactttct

SEQ ID NO: 8048147 - DNA, 22 bp, Homo sapiens
agacagctagggctgcagggac

SEQ ID NO: 8048148 - DNA, 22 bp, Homo sapiens
agacagactgtgtttgaatcct

SEQ ID NO: 8048149 - DNA, 22 bp, Homo sapiens
agacagacttgaaaatgttctt

SEQ ID NO: 8048150 - DNA, 22 bp, Homo sapiens
agacagcagggagcaggattca

SEQ ID NO: 8048151 - DNA, 22 bp, Homo sapiens
agacagcatgatacatgatgct

SEQ ID NO: 8048152 - DNA, 22 bp, Homo sapiens
agacaggcagaggctgcagagg

SEQ ID NO: 8048153 - DNA, 22 bp, Homo sapiens
agacaggcagaggctgcagagg

SEQ ID NO: 8048154 - DNA, 22 bp, Homo sapiens
agagaagagcaatgataaattt

SEQ ID NO: 8048155 - DNA, 22 bp, Homo sapiens
atggccagggtggcactgtggt

SEQ ID NO: 8048156 - DNA, 22 bp, Homo sapiens
atggccagggtggcactgtggt

SEQ ID NO: 8048157 - DNA, 22 bp, Homo sapiens
atggccagcaagttcagaattt

SEQ ID NO: 8048158 - DNA, 22 bp, Homo sapiens
atggcagcggagctggaaatga

SEQ ID NO: 8048159 - DNA, 22 bp, Homo sapiens
atggcagcctgagcagaggaat

SEQ ID NO: 8048160 - DNA, 22 bp, Homo sapiens
atggccagccactcctgatggc

SEQ ID NO: 8048161 - DNA, 22 bp, Homo sapiens
agacccacactttgagtagcaa

SEQ ID NO: 8048162 - DNA, 22 bp, Homo sapiens
agacccagaaagcagctgcatt

SEQ ID NO: 8048163 - DNA, 22 bp, Homo sapiens
atggcctgcagtgctgccacag

SEQ ID NO: 8048164 - DNA, 22 bp, Homo sapiens
atggcctggggattcctgagca

SEQ ID NO: 8048165 - DNA, 22 bp, Homo sapiens
atggcctggggagcatgggaag

SEQ ID NO: 8048166 - DNA, 22 bp, Homo sapiens
atggcctgatgcacctgtccca

SEQ ID NO: 8048167 - DNA, 17 bp, Homo sapiens
atggctcacctgtgggc

SEQ ID NO: 8048168 - DNA, 22 bp, Homo sapiens
atggctcagcccatggaagaaa

SEQ ID NO: 8048169 - DNA, 22 bp, Homo sapiens
agagatgaatcttgagactctg

SEQ ID NO: 8048170 - DNA, 22 bp, Homo sapiens
atgggggaaagtacgagcatgg

SEQ ID NO: 8048171 - DNA, 22 bp, Homo sapiens
atgggggcggctgaagcccagg

SEQ ID NO: 8048172 - DNA, 22 bp, Homo sapiens
atggggtgaccatgagcattta

SEQ ID NO: 8048173 - DNA, 22 bp, Homo sapiens
atggggtgagactaggattaaa

SEQ ID NO: 8048174 - DNA, 22 bp, Homo sapiens
atggggtggagtccgggcagcg

SEQ ID NO: 8048175 - DNA, 22 bp, Homo sapiens
atggggtgcatgcagattggga

SEQ ID NO: 8048176 - DNA, 22 bp, Homo sapiens
agagccactgggagacagagca

SEQ ID NO: 8048177 - DNA, 22 bp, Homo sapiens
agagccagaccattgccgtgca

SEQ ID NO: 8048178 - DNA, 22 bp, Homo sapiens
atggggttcacctgacagagaa

SEQ ID NO: 8048179 - DNA, 22 bp, Homo sapiens
atgggtggagggtgacacggat

SEQ ID NO: 8048180 - DNA, 22 bp, Homo sapiens
agagcagcctgtgatgatgcac

SEQ ID NO: 8048181 - DNA, 22 bp, Homo sapiens
agagcctgggaatttgcatgtt

SEQ ID NO: 8048182 - DNA, 22 bp, Homo sapiens
agagcctgcatcaggcttgggg

SEQ ID NO: 8048183 - DNA, 22 bp, Homo sapiens
agagcctgcagtggagaccttg

SEQ ID NO: 8048184 - DNA, 22 bp, Homo sapiens
agagcctgcagtggagaccttg

SEQ ID NO: 8048185 - DNA, 22 bp, Homo sapiens
agagcctgggcagctcctctgg

SEQ ID NO: 8048186 - DNA, 22 bp, Homo sapiens
agagcctggggattggcaaggg

SEQ ID NO: 8048187 - DNA, 22 bp, Homo sapiens
agagccagcaactctagccctg

SEQ ID NO: 8048188 - DNA, 22 bp, Homo sapiens
agagcctgtgggagatgcagct

SEQ ID NO: 8048189 - DNA, 22 bp, Homo sapiens
agagcctgtgattgtcatcacc

SEQ ID NO: 8048190 - DNA, 22 bp, Homo sapiens
agagcctgttttgtgggagatg

SEQ ID NO: 8048191 - DNA, 22 bp, Homo sapiens
agagcctgttcggaggcgcccc

SEQ ID NO: 8048192 - DNA, 22 bp, Homo sapiens
agagcctgtacttttctgtgaa

SEQ ID NO: 8048193 - DNA, 22 bp, Homo sapiens
agagcctggttcaaattttacc

SEQ ID NO: 8048194 - DNA, 22 bp, Homo sapiens
agagcctgtaacatctttctta

SEQ ID NO: 8048195 - DNA, 22 bp, Homo sapiens
agagcctggtctgagataggac

SEQ ID NO: 8048196 - DNA, 22 bp, Homo sapiens
agagcctgtctgcctttctacc

SEQ ID NO: 8048197 - DNA, 22 bp, Homo sapiens
agagcctgtcaattgtaaagag

SEQ ID NO: 8048198 - DNA, 22 bp, Homo sapiens
atgtggttgaagaattacatct

SEQ ID NO: 8048199 - DNA, 22 bp, Homo sapiens
attattactcctgattgtactg

SEQ ID NO: 8048200 - DNA, 22 bp, Homo sapiens
agagggaaatccaggagtgctt

SEQ ID NO: 8048201 - DNA, 22 bp, Homo sapiens
attgcattgcagctagattttg

SEQ ID NO: 8048202 - DNA, 22 bp, Homo sapiens
agaggcctgtgtgctccagtgg

SEQ ID NO: 8048203 - DNA, 22 bp, Homo sapiens
agaggcctgtgtgctccagtgg

SEQ ID NO: 8048204 - DNA, 22 bp, Homo sapiens
attcatttgctattgtgtatgg

SEQ ID NO: 8048205 - DNA, 22 bp, Homo sapiens
attcatttagagggattaagca

SEQ ID NO: 8048206 - DNA, 22 bp, Homo sapiens
attcatttagagggattaagca

SEQ ID NO: 8048207 - DNA, 22 bp, Homo sapiens
attcatttaggtattcacttac

SEQ ID NO: 8048208 - DNA, 22 bp, Homo sapiens
agaggcctttctgttgagtgaa

SEQ ID NO: 8048209 - DNA, 20 bp, Homo sapiens
agatacagtttaattactct

SEQ ID NO: 8048210 - DNA, 22 bp, Homo sapiens
attgcattgtttgaggcagagg

SEQ ID NO: 8048211 - DNA, 22 bp, Homo sapiens
attgcattgtgttttaggaggt

SEQ ID NO: 8048212 - DNA, 22 bp, Homo sapiens
attgcatttgtcattgttgagg

SEQ ID NO: 8048213 - DNA, 22 bp, Homo sapiens
attgcattcattgacatatgag

SEQ ID NO: 8048214 - DNA, 22 bp, Homo sapiens
caaaagtaattgtggttttcac

SEQ ID NO: 8048215 - DNA, 22 bp, Homo sapiens
caaaagtaattgcagtttttgc

SEQ ID NO: 8048216 - DNA, 22 bp, Homo sapiens
caaaagtaatcgtggcttttgc

SEQ ID NO: 8048217 - DNA, 20 bp, Homo sapiens
atttgtttctactctctgac

SEQ ID NO: 8048218 - DNA, 21 bp, Homo sapiens
caaaaggataggaaattaggg

SEQ ID NO: 8048219 - DNA, 19 bp, Homo sapiens
aagggcctctgctgtcttc

SEQ ID NO: 8048220 - DNA, 22 bp, Homo sapiens
aagggcctcctggggagcctgg

SEQ ID NO: 8048221 - DNA, 22 bp, Homo sapiens
aagggccttgccaggtgaagag

SEQ ID NO: 8048222 - DNA, 22 bp, Homo sapiens
aagggcctttcaaaggtgatta

SEQ ID NO: 8048223 - DNA, 22 bp, Homo sapiens
aagggccttgccaggtgaagag

SEQ ID NO: 8048224 - DNA, 22 bp, Homo sapiens
aagggcaggaaaagatggatgt

SEQ ID NO: 8048225 - DNA, 22 bp, Homo sapiens
acatgtgtacatatatatgtgc

SEQ ID NO: 8048226 - DNA, 22 bp, Homo sapiens
acatgtgtacttttaaggatgt

SEQ ID NO: 8048227 - DNA, 22 bp, Homo sapiens
aaggctgaggcagtgaggcaga

SEQ ID NO: 8048228 - DNA, 22 bp, Homo sapiens
acatgtgtgtatacgtatttat

SEQ ID NO: 8048229 - DNA, 22 bp, Homo sapiens
acatgtgtggccgctgtagaca

SEQ ID NO: 8048230 - DNA, 22 bp, Homo sapiens
acatgtgtggacatgaatctac

SEQ ID NO: 8048231 - DNA, 22 bp, Homo sapiens
acatgtgtatagcctgtataga

SEQ ID NO: 8048232 - DNA, 22 bp, Homo sapiens
acatgtgtgacaacagaggtga

SEQ ID NO: 8048233 - DNA, 22 bp, Homo sapiens
acatgtgtctaagaatgaaaga

SEQ ID NO: 8048234 - DNA, 22 bp, Homo sapiens
aagtatgaatcaaagactatct

SEQ ID NO: 8048235 - DNA, 22 bp, Homo sapiens
aagtacagagcctcagtttgac

SEQ ID NO: 8048236 - DNA, 22 bp, Homo sapiens
aaggtggcgctggagctggtcc

SEQ ID NO: 8048237 - DNA, 22 bp, Homo sapiens
aaggtggcgctggagctggtcc

SEQ ID NO: 8048238 - DNA, 22 bp, Homo sapiens
aaggtggtaggctatatcagta

SEQ ID NO: 8048239 - DNA, 22 bp, Homo sapiens
aaggtggtaatagtgcaggatt

SEQ ID NO: 8048240 - DNA, 22 bp, Homo sapiens
aagggctgaatgaagggttgaa

SEQ ID NO: 8048241 - DNA, 22 bp, Homo sapiens
aagggctgaaagaccttgggca

SEQ ID NO: 8048242 - DNA, 22 bp, Homo sapiens
aagggctgagaagtggggctgg

SEQ ID NO: 8048243 - DNA, 22 bp, Homo sapiens
aagggctgagcacagtgagcca

SEQ ID NO: 8048244 - DNA, 22 bp, Homo sapiens
aagggctgatctcactttcttt

SEQ ID NO: 8048245 - DNA, 22 bp, Homo sapiens
acagtagattggtatgatgtca

SEQ ID NO: 8048246 - DNA, 22 bp, Homo sapiens
acagtagtacacatctatgtcc

SEQ ID NO: 8048247 - DNA, 22 bp, Homo sapiens
acagtagttggttgttttggga

SEQ ID NO: 8048248 - DNA, 22 bp, Homo sapiens
acagtagttatctaacttattt

SEQ ID NO: 8048249 - DNA, 22 bp, Homo sapiens
aaggaagaaatgaataggtgga

SEQ ID NO: 8048250 - DNA, 22 bp, Homo sapiens
aaggaactgatgctcaaagaat

SEQ ID NO: 8048251 - DNA, 22 bp, Homo sapiens
aaggaacttgccacagaaaaga

SEQ ID NO: 8048252 - DNA, 22 bp, Homo sapiens
aaggcagaaagggatgtgagtg

SEQ ID NO: 8048253 - DNA, 22 bp, Homo sapiens
aaggcagccgtgtgactgcatg

SEQ ID NO: 8048254 - DNA, 22 bp, Homo sapiens
acagttgaggacttaaacaaaa

SEQ ID NO: 8048255 - DNA, 22 bp, Homo sapiens
acaggccagaggtggggcagcc

SEQ ID NO: 8048256 - DNA, 22 bp, Homo sapiens
aagctttaagtgtcagtcagcc

SEQ ID NO: 8048257 - DNA, 22 bp, Homo sapiens
acaggccacagtggagtctctg

SEQ ID NO: 8048258 - DNA, 22 bp, Homo sapiens
acagggctgaggctggcttctt

SEQ ID NO: 8048259 - DNA, 23 bp, Homo sapiens
acagggctggcagctgcaagacc

SEQ ID NO: 8048260 - DNA, 22 bp, Homo sapiens
acagggctggggcacttggctg

SEQ ID NO: 8048261 - DNA, 22 bp, Homo sapiens
acagggctccttgggctgacac

SEQ ID NO: 8048262 - DNA, 19 bp, Homo sapiens
acagggctctggacgccat

SEQ ID NO: 8048263 - DNA, 22 bp, Homo sapiens
acagtacaggacgagttttcct

SEQ ID NO: 8048264 - DNA, 23 bp, Homo sapiens
acagggctgtccagggctaggtc

SEQ ID NO: 8048265 - DNA, 22 bp, Homo sapiens
acaggtgtgttcccggaaagcc

SEQ ID NO: 8048266 - DNA, 22 bp, Homo sapiens
acaggtgttgaatgatgtcaca

SEQ ID NO: 8048267 - DNA, 22 bp, Homo sapiens
aagccaggggttggtatgctat

SEQ ID NO: 8048268 - DNA, 22 bp, Homo sapiens
aagccagggtcaggggcctcct

SEQ ID NO: 8048269 - DNA, 22 bp, Homo sapiens
aagccagggattcctgagggag

SEQ ID NO: 8048270 - DNA, 22 bp, Homo sapiens
aagccagggatggaatgatagg

SEQ ID NO: 8048271 - DNA, 22 bp, Homo sapiens
aagccaggttccatggaggagc

SEQ ID NO: 8048272 - DNA, 22 bp, Homo sapiens
aagccaggtgttgtggtaagag

SEQ ID NO: 8048273 - DNA, 22 bp, Homo sapiens
aagccaggtgtttaggccagcg

SEQ ID NO: 8048274 - DNA, 18 bp, Homo sapiens
aagccaggtcaagataag

SEQ ID NO: 8048275 - DNA, 22 bp, Homo sapiens
acaggcagtgatttcctctggt

SEQ ID NO: 8048276 - DNA, 22 bp, Homo sapiens
aataattttagctcagagttgt

SEQ ID NO: 8048277 - DNA, 19 bp, Homo sapiens
aataatgttcatgagattg

SEQ ID NO: 8048278 - DNA, 22 bp, Homo sapiens
aataatgtgatagataagggaa

SEQ ID NO: 8048279 - DNA, 22 bp, Homo sapiens
aataatgttatgtcattcttct

SEQ ID NO: 8048280 - DNA, 22 bp, Homo sapiens
aataatgtgtgctgcagtctta

SEQ ID NO: 8048281 - DNA, 22 bp, Homo sapiens
aataatgttgacgatagtctta

SEQ ID NO: 8048282 - DNA, 22 bp, Homo sapiens
aataatgtttatttgtattctc

SEQ ID NO: 8048283 - DNA, 22 bp, Homo sapiens
aataattagtgggacagagaac

SEQ ID NO: 8048284 - DNA, 22 bp, Homo sapiens
aagtttcaagaggttctttgaa

SEQ ID NO: 8048285 - DNA, 22 bp, Homo sapiens
aagtggactaatacaaggacta

SEQ ID NO: 8048286 - DNA, 22 bp, Homo sapiens
aatgaacacgctggtggtgcaa

SEQ ID NO: 8048287 - DNA, 22 bp, Homo sapiens
aatgaacaagagagagaacttt

SEQ ID NO: 8048288 - DNA, 22 bp, Homo sapiens
aatgaacatgggagtactaata

SEQ ID NO: 8048289 - DNA, 22 bp, Homo sapiens
aatgaactccgaacatttacat

SEQ ID NO: 8048290 - DNA, 22 bp, Homo sapiens
aatgaactccgaacatttacat

SEQ ID NO: 8048291 - DNA, 22 bp, Homo sapiens
aatgaacatggacaagttaata

SEQ ID NO: 8048292 - DNA, 22 bp, Homo sapiens
aatgaacaggtgaatgtcagat

SEQ ID NO: 8048293 - DNA, 22 bp, Homo sapiens
aatgaacagtgggtgaggtacc

SEQ ID NO: 8048294 - DNA, 22 bp, Homo sapiens
aatgaacatataaagagatctt

SEQ ID NO: 8048295 - DNA, 22 bp, Homo sapiens
aatgaactggagaacaatgacc

SEQ ID NO: 8048296 - DNA, 22 bp, Homo sapiens
aatgagaaccttgaaaggaact

SEQ ID NO: 8048297 - DNA, 22 bp, Homo sapiens
aatgagatgttgaattattgtt

SEQ ID NO: 8048298 - DNA, 22 bp, Homo sapiens
aatgagatggaggactcttaat

SEQ ID NO: 8048299 - DNA, 22 bp, Homo sapiens
aatcataattgtatacattcat

SEQ ID NO: 8048300 - DNA, 22 bp, Homo sapiens
aatcctaagcatccttttctgc

SEQ ID NO: 8048301 - DNA, 22 bp, Homo sapiens
acttgaaagaagtttccttaaa

SEQ ID NO: 8048302 - DNA, 22 bp, Homo sapiens
acttgaaaggaagctctaaaac

SEQ ID NO: 8048303 - DNA, 22 bp, Homo sapiens
acttgaaaccttggcaaacaat

SEQ ID NO: 8048304 - DNA, 22 bp, Homo sapiens
aatacagagaatgttatttgga

SEQ ID NO: 8048305 - DNA, 21 bp, Homo sapiens
aatacagaaatgagtagttgc

SEQ ID NO: 8048306 - DNA, 22 bp, Homo sapiens
agcaccctggggaagcacaaag

SEQ ID NO: 8048307 - DNA, 22 bp, Homo sapiens
acaattctgatggtttcccagt

SEQ ID NO: 8048308 - DNA, 21 bp, Homo sapiens
acacaggagtttcttctttct

SEQ ID NO: 8048309 - DNA, 22 bp, Homo sapiens
acacaggacggccctgtggctt

SEQ ID NO: 8048310 - DNA, 22 bp, Homo sapiens
acacaggaagtcagcactgatg

SEQ ID NO: 8048311 - DNA, 22 bp, Homo sapiens
acacaggaagcaatttcagagc

SEQ ID NO: 8048312 - DNA, 22 bp, Homo sapiens
acacatatggttgctgcagtga

SEQ ID NO: 8048313 - DNA, 18 bp, Homo sapiens
agcagctttgacaggaaa

SEQ ID NO: 8048314 - DNA, 21 bp, Homo sapiens
agcagctttggttgaagcaga

SEQ ID NO: 8048315 - DNA, 18 bp, Homo sapiens
agcagctttgtgcttgat

SEQ ID NO: 8048316 - DNA, 22 bp, Homo sapiens
agcagcttggttttaggcatgg

SEQ ID NO: 8048317 - DNA, 22 bp, Homo sapiens
agcagcttgttaaaaagttcca

SEQ ID NO: 8048318 - DNA, 22 bp, Homo sapiens
agcagctttaagtcactggtta

SEQ ID NO: 8048319 - DNA, 22 bp, Homo sapiens
agcagctttcacctccccgcct

SEQ ID NO: 8048320 - DNA, 22 bp, Homo sapiens
agcagctttcctctggggtcag

SEQ ID NO: 8048321 - DNA, 22 bp, Homo sapiens
agcagcttgggtctctcctgct

SEQ ID NO: 8048322 - DNA, 22 bp, Homo sapiens
agcagcttggggccgagataga

SEQ ID NO: 8048323 - DNA, 22 bp, Homo sapiens
agcagcttgggtctctcctgct

SEQ ID NO: 8048324 - DNA, 21 bp, Homo sapiens
agcagcttgagtctggagctc

SEQ ID NO: 8048325 - DNA, 22 bp, Homo sapiens
acacatatatgtgcgtgtatat

SEQ ID NO: 8048326 - DNA, 22 bp, Homo sapiens
acacataagaaactacaaagag

SEQ ID NO: 8048327 - DNA, 22 bp, Homo sapiens
agcagcagttgctgacgttcta

SEQ ID NO: 8048328 - DNA, 22 bp, Homo sapiens
acacataagaaactacaaagag

SEQ ID NO: 8048329 - DNA, 23 bp, Homo sapiens
agcagcagtgagaggtgtcttac

SEQ ID NO: 8048330 - DNA, 22 bp, Homo sapiens
agcagcagtgacagccgaaagc

SEQ ID NO: 8048331 - DNA, 22 bp, Homo sapiens
agcagcagtgtgtggtcatgtt

SEQ ID NO: 8048332 - DNA, 22 bp, Homo sapiens
agcagcagtatccttccccggc

SEQ ID NO: 8048333 - DNA, 22 bp, Homo sapiens
agcagcagtcatgcctatgctc

SEQ ID NO: 8048334 - DNA, 22 bp, Homo sapiens
agcagcagtcatgcctatgctc

SEQ ID NO: 8048335 - DNA, 22 bp, Homo sapiens
agcagcagtcctttgtgtaatt

SEQ ID NO: 8048336 - DNA, 22 bp, Homo sapiens
agcagcaggtgacctcgatgcc

SEQ ID NO: 8048337 - DNA, 22 bp, Homo sapiens
agcagcaggtgcttctggatct

SEQ ID NO: 8048338 - DNA, 22 bp, Homo sapiens
acacattatctcattaaatact

SEQ ID NO: 8048339 - DNA, 19 bp, Homo sapiens
acacatttgcacaatccac

SEQ ID NO: 8048340 - DNA, 22 bp, Homo sapiens
acacatttgcataatacctcat

SEQ ID NO: 8048341 - DNA, 22 bp, Homo sapiens
agcagggcagttaaagggtcct

SEQ ID NO: 8048342 - DNA, 22 bp, Homo sapiens
acactgtgacaaaggctgttct

SEQ ID NO: 8048343 - DNA, 22 bp, Homo sapiens
acactgtgacaagaaagagctg

SEQ ID NO: 8048344 - DNA, 22 bp, Homo sapiens
acactgtgacggaaataaagaa

SEQ ID NO: 8048345 - DNA, 22 bp, Homo sapiens
acactgtgagctgaagggctgc

SEQ ID NO: 8048346 - DNA, 23 bp, Homo sapiens
acactgtctcatggatagactgc

SEQ ID NO: 8048347 - DNA, 22 bp, Homo sapiens
agcagggcccactaggggagat

SEQ ID NO: 8048348 - DNA, 23 bp, Homo sapiens
agcagggccagaatacttgctgt

SEQ ID NO: 8048349 - DNA, 22 bp, Homo sapiens
agcagggcccactaggggagat

SEQ ID NO: 8048350 - DNA, 22 bp, Homo sapiens
agcagggcccactaggggagat

SEQ ID NO: 8048351 - DNA, 22 bp, Homo sapiens
agcagggcccactaggggagat

SEQ ID NO: 8048352 - DNA, 22 bp, Homo sapiens
agcagggcagttaaagggtcct

SEQ ID NO: 8048353 - DNA, 22 bp, Homo sapiens
agcagggcatgaataagggttt

SEQ ID NO: 8048354 - DNA, 18 bp, Homo sapiens
agcagggcattttgccat

SEQ ID NO: 8048355 - DNA, 22 bp, Homo sapiens
agcagggccaacagtaaacacc

SEQ ID NO: 8048356 - DNA, 22 bp, Homo sapiens
agccacaggccatgagatacca

SEQ ID NO: 8048357 - DNA, 22 bp, Homo sapiens
acagaacaagacctgcttattg

SEQ ID NO: 8048358 - DNA, 22 bp, Homo sapiens
agccacagggggtgagggacaa

SEQ ID NO: 8048359 - DNA, 22 bp, Homo sapiens
agccacaggtgttggccagtgt

SEQ ID NO: 8048360 - DNA, 22 bp, Homo sapiens
agccacaggtgttggccagtgt

SEQ ID NO: 8048361 - DNA, 22 bp, Homo sapiens
agccacagggggtgagggacaa

SEQ ID NO: 8048362 - DNA, 22 bp, Homo sapiens
agcagtggtgtgaggagggctc

SEQ ID NO: 8048363 - DNA, 22 bp, Homo sapiens
acactgtgcagattccctgtga

SEQ ID NO: 8048364 - DNA, 22 bp, Homo sapiens
acactgtgatcttgagaaaggt

SEQ ID NO: 8048365 - DNA, 22 bp, Homo sapiens
acactgtgatttctgggttcca

SEQ ID NO: 8048366 - DNA, 22 bp, Homo sapiens
acactgtgcatgcatatacaca

SEQ ID NO: 8048367 - DNA, 22 bp, Homo sapiens
acactgtgtctagcattttaca

SEQ ID NO: 8048368 - DNA, 21 bp, Homo sapiens
acactgtgtcataatgcttaa

SEQ ID NO: 8048369 - DNA, 20 bp, Homo sapiens
acactgtgctaaggattttc

SEQ ID NO: 8048370 - DNA, 22 bp, Homo sapiens
acactgtgcttagatgctgaac

SEQ ID NO: 8048371 - DNA, 22 bp, Homo sapiens
agcagtgggtgacagagctgag

SEQ ID NO: 8048372 - DNA, 22 bp, Homo sapiens
agcagtgggtgacagagctgag

SEQ ID NO: 8048373 - DNA, 22 bp, Homo sapiens
agcccctgtaccctgagtgctt

SEQ ID NO: 8048374 - DNA, 22 bp, Homo sapiens
agcccctgctgggtgtagctca

SEQ ID NO: 8048375 - DNA, 22 bp, Homo sapiens
agcccctgggagtagctgctgc

SEQ ID NO: 8048376 - DNA, 22 bp, Homo sapiens
acagagcatataaagtgctttg

SEQ ID NO: 8048377 - DNA, 22 bp, Homo sapiens
acagagcatataaagtgctttg

SEQ ID NO: 8048378 - DNA, 22 bp, Homo sapiens
acagagcactgccctgtgccgc

SEQ ID NO: 8048379 - DNA, 22 bp, Homo sapiens
agcccagctgcctgcctgctgt

SEQ ID NO: 8048380 - DNA, 22 bp, Homo sapiens
agcccagctgcctgcctgctgt

SEQ ID NO: 8048381 - DNA, 22 bp, Homo sapiens
agcccagcggagcgggcccggg

SEQ ID NO: 8048382 - DNA, 22 bp, Homo sapiens
agccatggtctcagggccataa

SEQ ID NO: 8048383 - DNA, 22 bp, Homo sapiens
agccatggtctcagggccataa

SEQ ID NO: 8048384 - DNA, 22 bp, Homo sapiens
agccatggcgccactagaggga

SEQ ID NO: 8048385 - DNA, 22 bp, Homo sapiens
agccatggcgccactagaggga

SEQ ID NO: 8048386 - DNA, 22 bp, Homo sapiens
agccatggcgccactagaggga

SEQ ID NO: 8048387 - DNA, 22 bp, Homo sapiens
agccatgctcagttcctggagc

SEQ ID NO: 8048388 - DNA, 22 bp, Homo sapiens
agccagggtgggtgaatgctat

SEQ ID NO: 8048389 - DNA, 22 bp, Homo sapiens
agccagggtgggtgaatgctat

SEQ ID NO: 8048390 - DNA, 22 bp, Homo sapiens
agccacagtctgatgcctgaga

SEQ ID NO: 8048391 - DNA, 22 bp, Homo sapiens
agccacagtcaacctgtccata

SEQ ID NO: 8048392 - DNA, 22 bp, Homo sapiens
agccacagtcaacctgtccata

SEQ ID NO: 8048393 - DNA, 22 bp, Homo sapiens
agcctgcctcagactcaggata

SEQ ID NO: 8048394 - DNA, 20 bp, Homo sapiens
agcctgccagctggcccaga

SEQ ID NO: 8048395 - DNA, 19 bp, Homo sapiens
agctcctgttcagcagctc

SEQ ID NO: 8048396 - DNA, 22 bp, Homo sapiens
agctcctgttctgagagcagga

SEQ ID NO: 8048397 - DNA, 22 bp, Homo sapiens
agctctgggctgacatgctccc

SEQ ID NO: 8048398 - DNA, 18 bp, Homo sapiens
agctctggggagatgggc

SEQ ID NO: 8048399 - DNA, 22 bp, Homo sapiens
agctctgggggaaagtctgctc

SEQ ID NO: 8048400 - DNA, 22 bp, Homo sapiens
agctctggggcctgtcccacat

SEQ ID NO: 8048401 - DNA, 22 bp, Homo sapiens
agctctggggtggagcccagga

SEQ ID NO: 8048402 - DNA, 22 bp, Homo sapiens
agctctggggtagggcccaaca

SEQ ID NO: 8048403 - DNA, 22 bp, Homo sapiens
acagcagctaaaggtgtctcct

SEQ ID NO: 8048404 - DNA, 22 bp, Homo sapiens
acagcaggagccttcatatgct

SEQ ID NO: 8048405 - DNA, 22 bp, Homo sapiens
acagcaggatttggcgatgttg

SEQ ID NO: 8048406 - DNA, 22 bp, Homo sapiens
acagcaggaattaacatataag

SEQ ID NO: 8048407 - DNA, 22 bp, Homo sapiens
acagcaggcacacaaggataga

SEQ ID NO: 8048408 - DNA, 22 bp, Homo sapiens
acagcaggcatgaagaaatgtt

SEQ ID NO: 8048409 - DNA, 22 bp, Homo sapiens
acagcaggcatgaatgacactg

SEQ ID NO: 8048410 - DNA, 22 bp, Homo sapiens
agaagggccagctggacacctg

SEQ ID NO: 8048411 - DNA, 22 bp, Homo sapiens
aatgcaaagctctttaatcctt

SEQ ID NO: 8048412 - DNA, 22 bp, Homo sapiens
agacagactttgatctggatgt

SEQ ID NO: 8048413 - DNA, 22 bp, Homo sapiens
agacaggccactctggtctggt

SEQ ID NO: 8048414 - DNA, 22 bp, Homo sapiens
aatgtcattgagctccaatcct

SEQ ID NO: 8048415 - DNA, 22 bp, Homo sapiens
agacagggtgatcgcttgagcc

SEQ ID NO: 8048416 - DNA, 22 bp, Homo sapiens
agacagggagggagcgcggctg

SEQ ID NO: 8048417 - DNA, 22 bp, Homo sapiens
agacagggtcttgatcagagct

SEQ ID NO: 8048418 - DNA, 22 bp, Homo sapiens
aatgtcatttaaaataattctg

SEQ ID NO: 8048419 - DNA, 22 bp, Homo sapiens
aatgttatttctgcatagtagt

SEQ ID NO: 8048420 - DNA, 22 bp, Homo sapiens
aatgttattgtcctttccaaaa

SEQ ID NO: 8048421 - DNA, 22 bp, Homo sapiens
aatgttgaggatatcagaaaat

SEQ ID NO: 8048422 - DNA, 22 bp, Homo sapiens
aatgttgagaaatgactactct

SEQ ID NO: 8048423 - DNA, 22 bp, Homo sapiens
aatgttgagcttgaaagtaggt

SEQ ID NO: 8048424 - DNA, 22 bp, Homo sapiens
aattagctgcaaaggatgttat

SEQ ID NO: 8048425 - DNA, 22 bp, Homo sapiens
aattagctgtcaatgaggatct

SEQ ID NO: 8048426 - DNA, 20 bp, Homo sapiens
aattagcttaagtcaatcag

SEQ ID NO: 8048427 - DNA, 22 bp, Homo sapiens
aattagcttatgtgtacttttc

SEQ ID NO: 8048428 - DNA, 22 bp, Homo sapiens
aattagcttcagcttgtggggc

SEQ ID NO: 8048429 - DNA, 22 bp, Homo sapiens
aattagctttacctaggattgt

SEQ ID NO: 8048430 - DNA, 22 bp, Homo sapiens
aattagctttccgccatcacac

SEQ ID NO: 8048431 - DNA, 22 bp, Homo sapiens
aattatacattgaacaatctag

SEQ ID NO: 8048432 - DNA, 22 bp, Homo sapiens
aattatacatgaaggcattata

SEQ ID NO: 8048433 - DNA, 22 bp, Homo sapiens
aattatatgttaatcttcaatt

SEQ ID NO: 8048434 - DNA, 22 bp, Homo sapiens
acaaaattgtgttaaactttat

SEQ ID NO: 8048435 - DNA, 22 bp, Homo sapiens
acaaactaaaattctttattga

SEQ ID NO: 8048436 - DNA, 21 bp, Homo sapiens
agaggccctcggactgggcgt

SEQ ID NO: 8048437 - DNA, 22 bp, Homo sapiens
agaggccatgctagaggcctgg

SEQ ID NO: 8048438 - DNA, 20 bp, Homo sapiens
acaaaataggtactgggtag

SEQ ID NO: 8048439 - DNA, 22 bp, Homo sapiens
agaggccatgctagaggcctgg

SEQ ID NO: 8048440 - DNA, 22 bp, Homo sapiens
acaattctctcatatcttatta

SEQ ID NO: 8048441 - DNA, 22 bp, Homo sapiens
agcaaggaaactatggagagat

SEQ ID NO: 8048442 - DNA, 22 bp, Homo sapiens
agcaaggcagtcagctggctgg

SEQ ID NO: 8048443 - DNA, 21 bp, Homo sapiens
agcaccagttttatgccaggc

SEQ ID NO: 8048444 - DNA, 22 bp, Homo sapiens
agatggggctcagtgtggaggc

SEQ ID NO: 8048445 - DNA, 22 bp, Homo sapiens
agatggggcagaatggagccat

SEQ ID NO: 8048446 - DNA, 19 bp, Homo sapiens
agatggggaagagtgtgag

SEQ ID NO: 8048447 - DNA, 22 bp, Homo sapiens
aaatcccagatagtaatgtatt

SEQ ID NO: 8048448 - DNA, 22 bp, Homo sapiens
aaatcctaaaagtttgacttaa

SEQ ID NO: 8048449 - DNA, 22 bp, Homo sapiens
aaatctagaagtttaaaaggat

SEQ ID NO: 8048450 - DNA, 22 bp, Homo sapiens
aagcacagataaaacaggattc

SEQ ID NO: 8048451 - DNA, 22 bp, Homo sapiens
aagcacagaccagatctccagg

SEQ ID NO: 8048452 - DNA, 22 bp, Homo sapiens
aaatgtagttgaaaagttaagg

SEQ ID NO: 8048453 - DNA, 22 bp, Homo sapiens
aagcatctataggttctaggag

SEQ ID NO: 8048454 - DNA, 22 bp, Homo sapiens
aagcatctcctcatcatttggg

SEQ ID NO: 8048455 - DNA, 20 bp, Homo sapiens
aagcatctggatgtagcaat

SEQ ID NO: 8048456 - DNA, 22 bp, Homo sapiens
aagcatggctgagtgcaatggt

SEQ ID NO: 8048457 - DNA, 22 bp, Homo sapiens
aagcatggcctctccgctcccc

SEQ ID NO: 8048458 - DNA, 22 bp, Homo sapiens
aagcatggagcaatagaatgac

SEQ ID NO: 8048459 - DNA, 22 bp, Homo sapiens
aagcatgggaggcctggaggag

SEQ ID NO: 8048460 - DNA, 22 bp, Homo sapiens
aagcatggctgttctagctata

SEQ ID NO: 8048461 - DNA, 22 bp, Homo sapiens
aagcatgggaatcccacagggt

SEQ ID NO: 8048462 - DNA, 20 bp, Homo sapiens
aagcatggtcaaaacttatg

SEQ ID NO: 8048463 - DNA, 19 bp, Homo sapiens
aagcatggtgcctcacctc

SEQ ID NO: 8048464 - DNA, 22 bp, Homo sapiens
aaataattatagcgagtctatc

SEQ ID NO: 8048465 - DNA, 22 bp, Homo sapiens
aaatccatggtaatctgttaca

SEQ ID NO: 8048466 - DNA, 22 bp, Homo sapiens
aaataattgagttggtcaatat

SEQ ID NO: 8048467 - DNA, 22 bp, Homo sapiens
aaatagatttcctagcattgga

SEQ ID NO: 8048468 - DNA, 22 bp, Homo sapiens
aaaggaaaataagtagttccat

SEQ ID NO: 8048469 - DNA, 22 bp, Homo sapiens
aactaacagtcattaaaagaac

SEQ ID NO: 8048470 - DNA, 22 bp, Homo sapiens
aactaaatctggcatttagagc

SEQ ID NO: 8048471 - DNA, 22 bp, Homo sapiens
aaactcagacacagtatctgtt

SEQ ID NO: 8048472 - DNA, 22 bp, Homo sapiens
aaagactaaatgaatgagctca

SEQ ID NO: 8048473 - DNA, 22 bp, Homo sapiens
aaaatctgcacaggtcagtttt

SEQ ID NO: 8048474 - DNA, 22 bp, Homo sapiens
aaaatctggtaatttgaatgtg

SEQ ID NO: 8048475 - DNA, 22 bp, Homo sapiens
aaactctgtagctaaacataat

SEQ ID NO: 8048476 - DNA, 22 bp, Homo sapiens
aaactgaggagttagactaggg

SEQ ID NO: 8048477 - DNA, 22 bp, Homo sapiens
aaagaatagcctttgtccaaat

SEQ ID NO: 8048478 - DNA, 22 bp, Homo sapiens
aaagacacaaatgtagaccaaa

SEQ ID NO: 8048479 - DNA, 22 bp, Homo sapiens
aaactgagtggcttataaacaa

SEQ ID NO: 8048480 - DNA, 22 bp, Homo sapiens
aaactgataaaataagtacatt

SEQ ID NO: 8048481 - DNA, 22 bp, Homo sapiens
aaattacagatcaccaatgcat

SEQ ID NO: 8048482 - DNA, 20 bp, Homo sapiens
aaattactgccacacatttc

SEQ ID NO: 8048483 - DNA, 22 bp, Homo sapiens
aaattagaaatactttcaaagc

SEQ ID NO: 8048484 - DNA, 22 bp, Homo sapiens
aaaggtagtacttctagaaggg

SEQ ID NO: 8048485 - DNA, 22 bp, Homo sapiens
aagcacaggatcttgaggagcg

SEQ ID NO: 8048486 - DNA, 22 bp, Homo sapiens
aagcacagtaaaagcagatttt

SEQ ID NO: 8048487 - DNA, 22 bp, Homo sapiens
aagcacagtgccaagttctatt

SEQ ID NO: 8048488 - DNA, 22 bp, Homo sapiens
aagcacaggggaaataagttgt

SEQ ID NO: 8048489 - DNA, 22 bp, Homo sapiens
aagcacaggttgaggattattc

SEQ ID NO: 8048490 - DNA, 22 bp, Homo sapiens
aagaggcctggaggcagaggtg

SEQ ID NO: 8048491 - DNA, 22 bp, Homo sapiens
acacaggaactcaagctcgctt

SEQ ID NO: 8048492 - DNA, 22 bp, Homo sapiens
acacagtaaatattgtctcctc

SEQ ID NO: 8048493 - DNA, 22 bp, Homo sapiens
acacagtaggatagtttgagga

SEQ ID NO: 8048494 - DNA, 22 bp, Homo sapiens
aagcagcatgattgtaatacta

SEQ ID NO: 8048495 - DNA, 22 bp, Homo sapiens
aagcagcatcctgggcagacct

SEQ ID NO: 8048496 - DNA, 22 bp, Homo sapiens
aagcagcatgtgggttatcggg

SEQ ID NO: 8048497 - DNA, 22 bp, Homo sapiens
aagcagcatgctatgctggtgg

SEQ ID NO: 8048498 - DNA, 22 bp, Homo sapiens
aagcagcattgtaaccaatgcc

SEQ ID NO: 8048499 - DNA, 22 bp, Homo sapiens
aagcagcattcagtgaaatgtg

SEQ ID NO: 8048500 - DNA, 22 bp, Homo sapiens
aagcagctgaaggattcagggt

SEQ ID NO: 8048501 - DNA, 22 bp, Homo sapiens
aagcagcattgtggtaggggag

SEQ ID NO: 8048502 - DNA, 22 bp, Homo sapiens
aagcagctgatttcacagctca

SEQ ID NO: 8048503 - DNA, 22 bp, Homo sapiens
aagcagctgatttcacagctca

SEQ ID NO: 8048504 - DNA, 22 bp, Homo sapiens
aagcatggtttctgacgtcatg

SEQ ID NO: 8048505 - DNA, 22 bp, Homo sapiens
acagcagctaacccctgggcca

SEQ ID NO: 8048506 - DNA, 22 bp, Homo sapiens
acagcagcttcctgactgtact

SEQ ID NO: 8048507 - DNA, 22 bp, Homo sapiens
acagcagcttgcgtgtctggtc

SEQ ID NO: 8048508 - DNA, 22 bp, Homo sapiens
acagcagctgggttcccaccat

SEQ ID NO: 8048509 - DNA, 22 bp, Homo sapiens
aagccaggagcgaggcctcggc

SEQ ID NO: 8048510 - DNA, 22 bp, Homo sapiens
aagccaggaatggagtcttcgc

SEQ ID NO: 8048511 - DNA, 22 bp, Homo sapiens
aagccaggaagagagccttcac

SEQ ID NO: 8048512 - DNA, 22 bp, Homo sapiens
aagccaggaagggagctgtccc

SEQ ID NO: 8048513 - DNA, 22 bp, Homo sapiens
acaaagagggaccagtgacttg

SEQ ID NO: 8048514 - DNA, 22 bp, Homo sapiens
acaaagagaccatgagccaaac

SEQ ID NO: 8048515 - DNA, 22 bp, Homo sapiens
aagagagaacacagcttgggca

SEQ ID NO: 8048516 - DNA, 22 bp, Homo sapiens
acaaagatgtttaaagcattta

SEQ ID NO: 8048517 - DNA, 22 bp, Homo sapiens
aagaatacgtatcaacaatggt

SEQ ID NO: 8048518 - DNA, 22 bp, Homo sapiens
aagaagcagagctgtgggtgtt

SEQ ID NO: 8048519 - DNA, 22 bp, Homo sapiens
aagaataacacttaggttttgc

SEQ ID NO: 8048520 - DNA, 22 bp, Homo sapiens
aagacaggaacatagcaaatcc

SEQ ID NO: 8048521 - DNA, 22 bp, Homo sapiens
aagacaggaaaagctccaggcc

SEQ ID NO: 8048522 - DNA, 20 bp, Homo sapiens
aagacaccagtggcagcccc

SEQ ID NO: 8048523 - DNA, 22 bp, Homo sapiens
aagaagcactttcctacatgtt

SEQ ID NO: 8048524 - DNA, 22 bp, Homo sapiens
aaattcctctgatcataagaat

SEQ ID NO: 8048525 - DNA, 22 bp, Homo sapiens
aaattctcaagtgatcctgttg

SEQ ID NO: 8048526 - DNA, 22 bp, Homo sapiens
aaattctctaaagaaaacatga

SEQ ID NO: 8048527 - DNA, 22 bp, Homo sapiens
aaggtcaagacacaggaatcta

SEQ ID NO: 8048528 - DNA, 22 bp, Homo sapiens
aaggtcaacactgattttagtc

SEQ ID NO: 8048529 - DNA, 22 bp, Homo sapiens
aacaaatgtaaaatgcagatgc

SEQ ID NO: 8048530 - DNA, 22 bp, Homo sapiens
aacaaatggaacacaaatcttt

SEQ ID NO: 8048531 - DNA, 22 bp, Homo sapiens
aagtcattggtagcttgatagg

SEQ ID NO: 8048532 - DNA, 22 bp, Homo sapiens
aatgatatagcagacatagcct

SEQ ID NO: 8048533 - DNA, 22 bp, Homo sapiens
aatataatgctgttttatgcca

SEQ ID NO: 8048534 - DNA, 22 bp, Homo sapiens
aatataatgctgttttatgcca

SEQ ID NO: 8048535 - DNA, 20 bp, Homo sapiens
aatataattctctgaattta

SEQ ID NO: 8048536 - DNA, 22 bp, Homo sapiens
aatcataattttgtgaatgtag

SEQ ID NO: 8048537 - DNA, 22 bp, Homo sapiens
aactacattgtcctttctgaag

SEQ ID NO: 8048538 - DNA, 22 bp, Homo sapiens
aactacagtatgtccaaagaat

SEQ ID NO: 8048539 - DNA, 19 bp, Homo sapiens
aactacagcgcactgtcct

SEQ ID NO: 8048540 - DNA, 22 bp, Homo sapiens
aactacagctcttgtctttctg

SEQ ID NO: 8048541 - DNA, 22 bp, Homo sapiens
aactgcaacttgtttgattctt

SEQ ID NO: 8048542 - DNA, 22 bp, Homo sapiens
aactgcaagagtaaatgtctag

SEQ ID NO: 8048543 - DNA, 22 bp, Homo sapiens
aatagttctagctcagaagctc

SEQ ID NO: 8048544 - DNA, 22 bp, Homo sapiens
aacaggcctatagggaaggcgc

SEQ ID NO: 8048545 - DNA, 22 bp, Homo sapiens
ggctcagcacagggctggcatc

SEQ ID NO: 8048546 - DNA, 22 bp, Homo sapiens
ggctcagcaatgatgagcccct

SEQ ID NO: 8048547 - DNA, 22 bp, Homo sapiens
ggctcagatggtttgttctaga

SEQ ID NO: 8048548 - DNA, 22 bp, Homo sapiens
ggctcagagttaggacccatgt

SEQ ID NO: 8048549 - DNA, 22 bp, Homo sapiens
ggctcagattccgagtggccct

SEQ ID NO: 8048550 - DNA, 22 bp, Homo sapiens
ggctcagaggttgaggccggca

SEQ ID NO: 8048551 - DNA, 22 bp, Homo sapiens
ggctcagaggccagcaggtaga

SEQ ID NO: 8048552 - DNA, 22 bp, Homo sapiens
ggctcagaggagctggaacggt

SEQ ID NO: 8048553 - DNA, 22 bp, Homo sapiens
ggctcagacctcccagctccag

SEQ ID NO: 8048554 - DNA, 22 bp, Homo sapiens
ggctcagagacctgcgatctga

SEQ ID NO: 8048555 - DNA, 22 bp, Homo sapiens
ggctcagactcccaggccctct

SEQ ID NO: 8048556 - DNA, 22 bp, Homo sapiens
ggctcagaaggccatgctctgc

SEQ ID NO: 8048557 - DNA, 22 bp, Homo sapiens
ggctcagaaacctctggtgtct

SEQ ID NO: 8048558 - DNA, 23 bp, Homo sapiens
ggctcagaaaaagtcctggcctc

SEQ ID NO: 8048559 - DNA, 22 bp, Homo sapiens
ggctctgacctcccaggcagtt

SEQ ID NO: 8048560 - DNA, 22 bp, Homo sapiens
ggctctgcaaaagtagatactt

SEQ ID NO: 8048561 - DNA, 22 bp, Homo sapiens
ggctctgcctgcctgagtgtcc

SEQ ID NO: 8048562 - DNA, 22 bp, Homo sapiens
ggcctcctcaccctgctcaggc

SEQ ID NO: 8048563 - DNA, 22 bp, Homo sapiens
ggcctccaggcctactcagggc

SEQ ID NO: 8048564 - DNA, 22 bp, Homo sapiens
ggcctctgcctcatctgggcac

SEQ ID NO: 8048565 - DNA, 22 bp, Homo sapiens
ggcctctgcaactggctgtggc

SEQ ID NO: 8048566 - DNA, 18 bp, Homo sapiens
ggcctctggactggcagc

SEQ ID NO: 8048567 - DNA, 22 bp, Homo sapiens
ggcctctgcttatgctgatgac

SEQ ID NO: 8048568 - DNA, 22 bp, Homo sapiens
ggctagggacacagctctgctc

SEQ ID NO: 8048569 - DNA, 22 bp, Homo sapiens
ggcccagcgaggccacctacag

SEQ ID NO: 8048570 - DNA, 22 bp, Homo sapiens
ggcccagctgggcggggacacg

SEQ ID NO: 8048571 - DNA, 22 bp, Homo sapiens
ggcccagctctattgaattaca

SEQ ID NO: 8048572 - DNA, 22 bp, Homo sapiens
ggccagctgctcagtgtctctg

SEQ ID NO: 8048573 - DNA, 21 bp, Homo sapiens
ggccagctgcatatgtcactg

SEQ ID NO: 8048574 - DNA, 22 bp, Homo sapiens
ggccagcatatagagtgaagta

SEQ ID NO: 8048575 - DNA, 22 bp, Homo sapiens
ggccagcatatagagtgaagta

SEQ ID NO: 8048576 - DNA, 22 bp, Homo sapiens
ggccagcagtcacagggtcaga

SEQ ID NO: 8048577 - DNA, 22 bp, Homo sapiens
ggccagcaggccctgtgatcct

SEQ ID NO: 8048578 - DNA, 22 bp, Homo sapiens
ggccagcaggccctgtgatcct

SEQ ID NO: 8048579 - DNA, 22 bp, Homo sapiens
ggccagcagtcacagggtcaga

SEQ ID NO: 8048580 - DNA, 22 bp, Homo sapiens
ggccagctgagctgctgcacag

SEQ ID NO: 8048581 - DNA, 22 bp, Homo sapiens
ggccagctctgcacagcagctg

SEQ ID NO: 8048582 - DNA, 19 bp, Homo sapiens
ggccagccacctcgcctgg

SEQ ID NO: 8048583 - DNA, 22 bp, Homo sapiens
ggccagcatggcaagaccaact

SEQ ID NO: 8048584 - DNA, 22 bp, Homo sapiens
ggccagcccagtggtcctctct

SEQ ID NO: 8048585 - DNA, 22 bp, Homo sapiens
ggcccagctgtatattacagtt

SEQ ID NO: 8048586 - DNA, 22 bp, Homo sapiens
ggcccagctttcattccttgct

SEQ ID NO: 8048587 - DNA, 22 bp, Homo sapiens
ggcccagctgtgcttccagccc

SEQ ID NO: 8048588 - DNA, 22 bp, Homo sapiens
ggcccaggatgcaagaactgaa

SEQ ID NO: 8048589 - DNA, 22 bp, Homo sapiens
ggcccaggatgcaagaactgaa

SEQ ID NO: 8048590 - DNA, 22 bp, Homo sapiens
ggcccaggctggagtgcagtgg

SEQ ID NO: 8048591 - DNA, 22 bp, Homo sapiens
ggcccaggctggagtgcagtgg

SEQ ID NO: 8048592 - DNA, 22 bp, Homo sapiens
ggcccaggtccagcgagtacct

SEQ ID NO: 8048593 - DNA, 22 bp, Homo sapiens
ggcccagtgttgccagacctga

SEQ ID NO: 8048594 - DNA, 22 bp, Homo sapiens
ggcccatgaccctagccaactg

SEQ ID NO: 8048595 - DNA, 22 bp, Homo sapiens
ggccagcagacctcagggactc

SEQ ID NO: 8048596 - DNA, 22 bp, Homo sapiens
ggccacattcaaagctgtcctg

SEQ ID NO: 8048597 - DNA, 22 bp, Homo sapiens
ggccaccagtcctctggcaggg

SEQ ID NO: 8048598 - DNA, 21 bp, Homo sapiens
ggccacagttagggctcagga

SEQ ID NO: 8048599 - DNA, 22 bp, Homo sapiens
ggccacagtgggaaatcctggg

SEQ ID NO: 8048600 - DNA, 21 bp, Homo sapiens
ggccacagttagggctcagga

SEQ ID NO: 8048601 - DNA, 22 bp, Homo sapiens
ggcagtggcatgtgggtagtgg

SEQ ID NO: 8048602 - DNA, 22 bp, Homo sapiens
ggcagtggctcctctctactcc

SEQ ID NO: 8048603 - DNA, 22 bp, Homo sapiens
ggcagtgggaaataagtgagaa

SEQ ID NO: 8048604 - DNA, 17 bp, Homo sapiens
ggccacagagcttgggg

SEQ ID NO: 8048605 - DNA, 22 bp, Homo sapiens
ggccacagagggcgggatgctg

SEQ ID NO: 8048606 - DNA, 22 bp, Homo sapiens
ggccacagcaatgctgtgatgt

SEQ ID NO: 8048607 - DNA, 22 bp, Homo sapiens
ggccacagcagatgcttcagat

SEQ ID NO: 8048608 - DNA, 22 bp, Homo sapiens
ggccacagcagatgcttcagat

SEQ ID NO: 8048609 - DNA, 22 bp, Homo sapiens
ggccacagtctctggaaggatg

SEQ ID NO: 8048610 - DNA, 20 bp, Homo sapiens
ggccacagggtgctggtgga

SEQ ID NO: 8048611 - DNA, 22 bp, Homo sapiens
ggccacagggctgaacgtggac

SEQ ID NO: 8048612 - DNA, 17 bp, Homo sapiens
ggaggcaacagacaggg

SEQ ID NO: 8048613 - DNA, 23 bp, Homo sapiens
ggaggcacttaggcagagcagag

SEQ ID NO: 8048614 - DNA, 22 bp, Homo sapiens
ggaggcacacctcagactggga

SEQ ID NO: 8048615 - DNA, 22 bp, Homo sapiens
ggcaccagggcaagggtctttc

SEQ ID NO: 8048616 - DNA, 22 bp, Homo sapiens
ggcacctgtgtaagatctggaa

SEQ ID NO: 8048617 - DNA, 22 bp, Homo sapiens
ggcacctggtaagtgctcagta

SEQ ID NO: 8048618 - DNA, 22 bp, Homo sapiens
ggcacctgctcatctggactca

SEQ ID NO: 8048619 - DNA, 22 bp, Homo sapiens
ggcacctggatgtagcagtgaa

SEQ ID NO: 8048620 - DNA, 22 bp, Homo sapiens
ggcacctggtaagtgctcagta

SEQ ID NO: 8048621 - DNA, 22 bp, Homo sapiens
ggcagcagaactggccctgtat

SEQ ID NO: 8048622 - DNA, 21 bp, Homo sapiens
ggcagcactacctgaagcata

SEQ ID NO: 8048623 - DNA, 22 bp, Homo sapiens
ggcactgagaacaggctgactt

SEQ ID NO: 8048624 - DNA, 22 bp, Homo sapiens
ggcagggaagctggcatcacgg

SEQ ID NO: 8048625 - DNA, 22 bp, Homo sapiens
ggcagggccctgattcctgggg

SEQ ID NO: 8048626 - DNA, 22 bp, Homo sapiens
ggcagggccctgattcctgggg

SEQ ID NO: 8048627 - DNA, 22 bp, Homo sapiens
ggcagggccctgattcctgggg

SEQ ID NO: 8048628 - DNA, 22 bp, Homo sapiens
ggcagggcttgtctctgtgatg

SEQ ID NO: 8048629 - DNA, 20 bp, Homo sapiens
ggcagggcatcaacagctct

SEQ ID NO: 8048630 - DNA, 20 bp, Homo sapiens
ggcagggcatcaacagctct

SEQ ID NO: 8048631 - DNA, 22 bp, Homo sapiens
ggcaggggtcctggtgttgact

SEQ ID NO: 8048632 - DNA, 18 bp, Homo sapiens
ggcaggggtgaaccacag

SEQ ID NO: 8048633 - DNA, 22 bp, Homo sapiens
ggcaggggtcctggtgttgact

SEQ ID NO: 8048634 - DNA, 18 bp, Homo sapiens
ggcaggggtgaaccacag

SEQ ID NO: 8048635 - DNA, 22 bp, Homo sapiens
ggcagtgagaggtctcctggtc

SEQ ID NO: 8048636 - DNA, 22 bp, Homo sapiens
ggcagtgcaaggctggcacagt

SEQ ID NO: 8048637 - DNA, 22 bp, Homo sapiens
ggcagtggcagagcttggtcta

SEQ ID NO: 8048638 - DNA, 22 bp, Homo sapiens
ggcagtggcagagcttggtcta

SEQ ID NO: 8048639 - DNA, 22 bp, Homo sapiens
ggcagtggaggaccctgtgtct

SEQ ID NO: 8048640 - DNA, 17 bp, Homo sapiens
ggcagtggaggaagaga

SEQ ID NO: 8048641 - DNA, 21 bp, Homo sapiens
ggcagcccgccctctcctggc

SEQ ID NO: 8048642 - DNA, 22 bp, Homo sapiens
ggcagccatgtcccagggcttc

SEQ ID NO: 8048643 - DNA, 22 bp, Homo sapiens
ggcagccctgtggagaggccca

SEQ ID NO: 8048644 - DNA, 22 bp, Homo sapiens
ggcagccctttctggccagctc

SEQ ID NO: 8048645 - DNA, 17 bp, Homo sapiens
ggcagcctcaggcgttt

SEQ ID NO: 8048646 - DNA, 22 bp, Homo sapiens
ggcagccttgagggaggcctgg

SEQ ID NO: 8048647 - DNA, 22 bp, Homo sapiens
ggcagccttgactagtgactta

SEQ ID NO: 8048648 - DNA, 18 bp, Homo sapiens
ggcagcctggacatgctc

SEQ ID NO: 8048649 - DNA, 21 bp, Homo sapiens
ggcagcctgacccccagagag

SEQ ID NO: 8048650 - DNA, 21 bp, Homo sapiens
ggcagcctctgtggaagggga

SEQ ID NO: 8048651 - DNA, 19 bp, Homo sapiens
ggcagcctgcacgggctgc

SEQ ID NO: 8048652 - DNA, 18 bp, Homo sapiens
ggcagggaaaagataggg

SEQ ID NO: 8048653 - DNA, 22 bp, Homo sapiens
ggcaggcttgatatggggggac

SEQ ID NO: 8048654 - DNA, 22 bp, Homo sapiens
gggcaggtggcagggtctctgg

SEQ ID NO: 8048655 - DNA, 22 bp, Homo sapiens
gggcaggtggagggcccagcca

SEQ ID NO: 8048656 - DNA, 22 bp, Homo sapiens
gggcaggtggcaaagccagagg

SEQ ID NO: 8048657 - DNA, 22 bp, Homo sapiens
gggcaggtgtttccaaggtgag

SEQ ID NO: 8048658 - DNA, 22 bp, Homo sapiens
gggcaggtgttgtcaatctaat

SEQ ID NO: 8048659 - DNA, 22 bp, Homo sapiens
gggcaggtgtgcagagctgttg

SEQ ID NO: 8048660 - DNA, 22 bp, Homo sapiens
gggcaggtggcctcttgtacta

SEQ ID NO: 8048661 - DNA, 22 bp, Homo sapiens
gggccctgccccgtggctctga

SEQ ID NO: 8048662 - DNA, 22 bp, Homo sapiens
gggccctgatctgtgagcgcag

SEQ ID NO: 8048663 - DNA, 22 bp, Homo sapiens
gggccctggggatgtggacgcg

SEQ ID NO: 8048664 - DNA, 22 bp, Homo sapiens
gggccctgcctaaggaacacac

SEQ ID NO: 8048665 - DNA, 22 bp, Homo sapiens
gggccctgtgatttcttgagga

SEQ ID NO: 8048666 - DNA, 22 bp, Homo sapiens
gggctcagacatccctcctgga

SEQ ID NO: 8048667 - DNA, 22 bp, Homo sapiens
gggctctgactgaatattgaat

SEQ ID NO: 8048668 - DNA, 22 bp, Homo sapiens
gggctctggaaatgggagctcc

SEQ ID NO: 8048669 - DNA, 22 bp, Homo sapiens
gggctctggagttctagaaaga

SEQ ID NO: 8048670 - DNA, 18 bp, Homo sapiens
gggctctggcatctgggt

SEQ ID NO: 8048671 - DNA, 22 bp, Homo sapiens
gggctctggaaatgggagctcc

SEQ ID NO: 8048672 - DNA, 22 bp, Homo sapiens
gggctctggacccaggcaagag

SEQ ID NO: 8048673 - DNA, 22 bp, Homo sapiens
gggctctggacccaggcaagag

SEQ ID NO: 8048674 - DNA, 22 bp, Homo sapiens
gggctcagagcatttgggttgg

SEQ ID NO: 8048675 - DNA, 22 bp, Homo sapiens
gggctcagaggagtggcctggg

SEQ ID NO: 8048676 - DNA, 21 bp, Homo sapiens
gggctcagcgctcggctcctc

SEQ ID NO: 8048677 - DNA, 22 bp, Homo sapiens
gggctcagcctcctcacttcga

SEQ ID NO: 8048678 - DNA, 22 bp, Homo sapiens
gggctcagccccattgaaccag

SEQ ID NO: 8048679 - DNA, 23 bp, Homo sapiens
gggctcagatttcattctgtgcc

SEQ ID NO: 8048680 - DNA, 16 bp, Homo sapiens
gggctcagatctttga

SEQ ID NO: 8048681 - DNA, 22 bp, Homo sapiens
gggctcagctccttccttccta

SEQ ID NO: 8048682 - DNA, 22 bp, Homo sapiens
gggctcagctgggcgtgctggt

SEQ ID NO: 8048683 - DNA, 22 bp, Homo sapiens
gggctcagttctgcttcatgct

SEQ ID NO: 8048684 - DNA, 22 bp, Homo sapiens
gggcaggtgccagctccctgtc

SEQ ID NO: 8048685 - DNA, 22 bp, Homo sapiens
gggcaggtgcccagggccagag

SEQ ID NO: 8048686 - DNA, 22 bp, Homo sapiens
gggcaggtgacctcttgtcctg

SEQ ID NO: 8048687 - DNA, 22 bp, Homo sapiens
gggcaggtgattttggctccat

SEQ ID NO: 8048688 - DNA, 15 bp, Homo sapiens
gggcaggtctggggc

SEQ ID NO: 8048689 - DNA, 22 bp, Homo sapiens
gggcaggtctgggtcagcctga

SEQ ID NO: 8048690 - DNA, 21 bp, Homo sapiens
gggcagaggggcctcctgggt

SEQ ID NO: 8048691 - DNA, 21 bp, Homo sapiens
gggcagaggggcctcctgggt

SEQ ID NO: 8048692 - DNA, 17 bp, Homo sapiens
gggcagggactcctggg

SEQ ID NO: 8048693 - DNA, 17 bp, Homo sapiens
gggcagggactcctggg

SEQ ID NO: 8048694 - DNA, 17 bp, Homo sapiens
gggcagggactcctggg

SEQ ID NO: 8048695 - DNA, 21 bp, Homo sapiens
gggcagaggggcctcctgggt

SEQ ID NO: 8048696 - DNA, 18 bp, Homo sapiens
gggatcaggctgcctagg

SEQ ID NO: 8048697 - DNA, 22 bp, Homo sapiens
gggcagagagctggaactcctt

SEQ ID NO: 8048698 - DNA, 22 bp, Homo sapiens
gggcagaggctctggcccatcc

SEQ ID NO: 8048699 - DNA, 20 bp, Homo sapiens
gggcagagccagccagtccc

SEQ ID NO: 8048700 - DNA, 20 bp, Homo sapiens
gggcagagccagccagtccc

SEQ ID NO: 8048701 - DNA, 22 bp, Homo sapiens
gggagtggttgatggtgaaaat

SEQ ID NO: 8048702 - DNA, 22 bp, Homo sapiens
gggagtgggtttggcctaggcc

SEQ ID NO: 8048703 - DNA, 22 bp, Homo sapiens
gggagtgggtttggcctaggcc

SEQ ID NO: 8048704 - DNA, 22 bp, Homo sapiens
gggagtgggtttggcctaggcc

SEQ ID NO: 8048705 - DNA, 22 bp, Homo sapiens
gggatcagcaagccactgcacc

SEQ ID NO: 8048706 - DNA, 22 bp, Homo sapiens
gggagctgaagtaggggtaaat

SEQ ID NO: 8048707 - DNA, 22 bp, Homo sapiens
gggagctgaatggcaatggaga

SEQ ID NO: 8048708 - DNA, 22 bp, Homo sapiens
gggagctgaagtaggggtaaat

SEQ ID NO: 8048709 - DNA, 22 bp, Homo sapiens
gggagctgaaggagccggcggg

SEQ ID NO: 8048710 - DNA, 22 bp, Homo sapiens
gggagctgaactgctgaagttg

SEQ ID NO: 8048711 - DNA, 22 bp, Homo sapiens
gggagcgggactgcgcaggctt

SEQ ID NO: 8048712 - DNA, 22 bp, Homo sapiens
gggagccttgggagtgccagcc

SEQ ID NO: 8048713 - DNA, 22 bp, Homo sapiens
gggagcgcccctgcctgtttga

SEQ ID NO: 8048714 - DNA, 22 bp, Homo sapiens
gggagctgaatggcaatggaga

SEQ ID NO: 8048715 - DNA, 22 bp, Homo sapiens
gggagtggattatgtggaccca

SEQ ID NO: 8048716 - DNA, 22 bp, Homo sapiens
gggagtggattatgtggaccca

SEQ ID NO: 8048717 - DNA, 22 bp, Homo sapiens
gggaagagtaactagcccatgt

SEQ ID NO: 8048718 - DNA, 22 bp, Homo sapiens
gggaaggcagtgggaggaactg

SEQ ID NO: 8048719 - DNA, 22 bp, Homo sapiens
gggaaggcatacctgagggaga

SEQ ID NO: 8048720 - DNA, 22 bp, Homo sapiens
gggaaggccggtccagtcaggt

SEQ ID NO: 8048721 - DNA, 22 bp, Homo sapiens
gggagccagcagggcatggagc

SEQ ID NO: 8048722 - DNA, 22 bp, Homo sapiens
gggagccagcagggcatggagc

SEQ ID NO: 8048723 - DNA, 22 bp, Homo sapiens
gggaagagggagctggaatgat

SEQ ID NO: 8048724 - DNA, 22 bp, Homo sapiens
ggctgtggtcattaggaggttg

SEQ ID NO: 8048725 - DNA, 22 bp, Homo sapiens
ggctgtgggtgtgacaggcctc

SEQ ID NO: 8048726 - DNA, 22 bp, Homo sapiens
ggctgtggtcattaggaggttg

SEQ ID NO: 8048727 - DNA, 22 bp, Homo sapiens
ggctgtggccagcggggctgag

SEQ ID NO: 8048728 - DNA, 22 bp, Homo sapiens
ggctgtggccagcggggctgag

SEQ ID NO: 8048729 - DNA, 22 bp, Homo sapiens
ggctgtgggatgcataggagct

SEQ ID NO: 8048730 - DNA, 22 bp, Homo sapiens
ggctgtggggaccaacaggact

SEQ ID NO: 8048731 - DNA, 22 bp, Homo sapiens
ggctgtggcagctggaagtggt

SEQ ID NO: 8048732 - DNA, 22 bp, Homo sapiens
ggctgtggcattaggtgaggcc

SEQ ID NO: 8048733 - DNA, 22 bp, Homo sapiens
ggctgtggcattaggtgaggcc

SEQ ID NO: 8048734 - DNA, 22 bp, Homo sapiens
ggctgtggcattaggtgaggcc

SEQ ID NO: 8048735 - DNA, 21 bp, Homo sapiens
ggctgtggagccatgactcac

SEQ ID NO: 8048736 - DNA, 22 bp, Homo sapiens
ggctgtggcagctggaagtggt

SEQ ID NO: 8048737 - DNA, 22 bp, Homo sapiens
ggctgtggcagctggaagtggt

SEQ ID NO: 8048738 - DNA, 22 bp, Homo sapiens
ggctgtgctgagggggaagccc

SEQ ID NO: 8048739 - DNA, 22 bp, Homo sapiens
ggctgtgcttggtgtccttgga

SEQ ID NO: 8048740 - DNA, 22 bp, Homo sapiens
ggctgtgctttgttaggttgtc

SEQ ID NO: 8048741 - DNA, 18 bp, Homo sapiens
ggctgtgcgtggaggctg

SEQ ID NO: 8048742 - DNA, 22 bp, Homo sapiens
ggctgtgcgtcatccggctgca

SEQ ID NO: 8048743 - DNA, 18 bp, Homo sapiens
ggctgtgcgtggaggctg

SEQ ID NO: 8048744 - DNA, 17 bp, Homo sapiens
ggctgcagtccaggagg

SEQ ID NO: 8048745 - DNA, 22 bp, Homo sapiens
ggctgcaggttggttggcagct

SEQ ID NO: 8048746 - DNA, 22 bp, Homo sapiens
ggctctgcgcggtaaagtgact

SEQ ID NO: 8048747 - DNA, 22 bp, Homo sapiens
ggctgcctcctgctgggctgga

SEQ ID NO: 8048748 - DNA, 22 bp, Homo sapiens
ggctgcagttgtgtgaaggccg

SEQ ID NO: 8048749 - DNA, 22 bp, Homo sapiens
ggctgccacgtcgagggtccaa

SEQ ID NO: 8048750 - DNA, 22 bp, Homo sapiens
ggctgccagcactggtgtagag

SEQ ID NO: 8048751 - DNA, 22 bp, Homo sapiens
ggctgccaggagggaggccagt

SEQ ID NO: 8048752 - DNA, 22 bp, Homo sapiens
ggctggaggagaatgggtgtga

SEQ ID NO: 8048753 - DNA, 19 bp, Homo sapiens
ggctgcctggagcgagggc

SEQ ID NO: 8048754 - DNA, 22 bp, Homo sapiens
ggctgcctgctcctcctgcacg

SEQ ID NO: 8048755 - DNA, 22 bp, Homo sapiens
ggctgcctgccgcccacttggc

SEQ ID NO: 8048756 - DNA, 22 bp, Homo sapiens
ggctgcctgaggctgaggcccg

SEQ ID NO: 8048757 - DNA, 22 bp, Homo sapiens
ggctggcagaagtgtgctggct

SEQ ID NO: 8048758 - DNA, 22 bp, Homo sapiens
ggctggcattgctctattgcct

SEQ ID NO: 8048759 - DNA, 22 bp, Homo sapiens
ggctggcaggggatgtcagatg

SEQ ID NO: 8048760 - DNA, 22 bp, Homo sapiens
ggctggcagtgtgagagaggga

SEQ ID NO: 8048761 - DNA, 22 bp, Homo sapiens
ggctggcagtgtgagagaggga

SEQ ID NO: 8048762 - DNA, 22 bp, Homo sapiens
ggctggcagaggggagtctgtg

SEQ ID NO: 8048763 - DNA, 22 bp, Homo sapiens
ggctggcagaagtgtgctggct

SEQ ID NO: 8048764 - DNA, 22 bp, Homo sapiens
ggctggcaggcacagtatgcaa

SEQ ID NO: 8048765 - DNA, 22 bp, Homo sapiens
ggctggcagcttcatcccagat

SEQ ID NO: 8048766 - DNA, 22 bp, Homo sapiens
gtaatgtactgcagccagatgt

SEQ ID NO: 8048767 - DNA, 22 bp, Homo sapiens
ggttccacctggcgaggggtat

SEQ ID NO: 8048768 - DNA, 22 bp, Homo sapiens
ggttggggcgagctggaggccc

SEQ ID NO: 8048769 - DNA, 22 bp, Homo sapiens
ggtgggcaggcgaggcccaggt

SEQ ID NO: 8048770 - DNA, 22 bp, Homo sapiens
ggtggcagagaggaggtagttt

SEQ ID NO: 8048771 - DNA, 22 bp, Homo sapiens
ggtggcagagaggaggtagttt

SEQ ID NO: 8048772 - DNA, 22 bp, Homo sapiens
ggtggcagagacataggacata

SEQ ID NO: 8048773 - DNA, 19 bp, Homo sapiens
ggtggcagaacgtgggtcc

SEQ ID NO: 8048774 - DNA, 22 bp, Homo sapiens
ggtggagctggaccaggagagg

SEQ ID NO: 8048775 - DNA, 22 bp, Homo sapiens
ggtggagcgcagggtgctggcg

SEQ ID NO: 8048776 - DNA, 22 bp, Homo sapiens
ggtggcaccttaccctgcgcag

SEQ ID NO: 8048777 - DNA, 22 bp, Homo sapiens
ggtggcaccttaccctgcgcag

SEQ ID NO: 8048778 - DNA, 22 bp, Homo sapiens
ggtggggcctgctccagcggcc

SEQ ID NO: 8048779 - DNA, 22 bp, Homo sapiens
ggtggggcctgctccagcggcc

SEQ ID NO: 8048780 - DNA, 22 bp, Homo sapiens
ggtggggctaggacctcaggat

SEQ ID NO: 8048781 - DNA, 22 bp, Homo sapiens
ggtggggccctggcactggtat

SEQ ID NO: 8048782 - DNA, 22 bp, Homo sapiens
ggtggggccctggcactggtat

SEQ ID NO: 8048783 - DNA, 22 bp, Homo sapiens
ggtggggcccaggcatctgatg

SEQ ID NO: 8048784 - DNA, 22 bp, Homo sapiens
ggtggggattcctgatcactgt

SEQ ID NO: 8048785 - DNA, 22 bp, Homo sapiens
ggtggggccagggctccaacct

SEQ ID NO: 8048786 - DNA, 22 bp, Homo sapiens
ggtggggcccaggcatctgatg

SEQ ID NO: 8048787 - DNA, 22 bp, Homo sapiens
ggtgggccaggaaggccgccag

SEQ ID NO: 8048788 - DNA, 22 bp, Homo sapiens
ggtggggattcctgatcactgt

SEQ ID NO: 8048789 - DNA, 18 bp, Homo sapiens
ggtgagggagctggaagc

SEQ ID NO: 8048790 - DNA, 22 bp, Homo sapiens
ggtgagggacatcactcagcca

SEQ ID NO: 8048791 - DNA, 18 bp, Homo sapiens
ggtgagggagctggaagc

SEQ ID NO: 8048792 - DNA, 22 bp, Homo sapiens
ggtgagggagtggaacgaggtg

SEQ ID NO: 8048793 - DNA, 22 bp, Homo sapiens
ggtgaggcgtccccaccatggg

SEQ ID NO: 8048794 - DNA, 22 bp, Homo sapiens
ggtgaggctaagtgacacaggg

SEQ ID NO: 8048795 - DNA, 18 bp, Homo sapiens
ggtgaggcggcggccagc

SEQ ID NO: 8048796 - DNA, 22 bp, Homo sapiens
ggtccctgaagatgcctgagga

SEQ ID NO: 8048797 - DNA, 22 bp, Homo sapiens
gggttggggcccagcagtctgc

SEQ ID NO: 8048798 - DNA, 22 bp, Homo sapiens
gggttggattacttagggagaa

SEQ ID NO: 8048799 - DNA, 22 bp, Homo sapiens
ggggcccttgtggctgcaggcc

SEQ ID NO: 8048800 - DNA, 22 bp, Homo sapiens
ggggtagggtgattgtgaagta

SEQ ID NO: 8048801 - DNA, 22 bp, Homo sapiens
ggggtagggcgattgctgcttt

SEQ ID NO: 8048802 - DNA, 22 bp, Homo sapiens
ggggccagatatcactaaggtt

SEQ ID NO: 8048803 - DNA, 22 bp, Homo sapiens
ggggccagcaatgttgaggaat

SEQ ID NO: 8048804 - DNA, 22 bp, Homo sapiens
ggggccagcaatgttgaggaat

SEQ ID NO: 8048805 - DNA, 22 bp, Homo sapiens
ggggccagcttcgcgtgctctt

SEQ ID NO: 8048806 - DNA, 22 bp, Homo sapiens
ggggccaggtccagcttccaaa

SEQ ID NO: 8048807 - DNA, 19 bp, Homo sapiens
ggggtggctggggctccag

SEQ ID NO: 8048808 - DNA, 22 bp, Homo sapiens
ggggtgctagagtggggccact

SEQ ID NO: 8048809 - DNA, 19 bp, Homo sapiens
ggggtgctagggagggatc

SEQ ID NO: 8048810 - DNA, 22 bp, Homo sapiens
ggggtggattcctacaggtcca

SEQ ID NO: 8048811 - DNA, 22 bp, Homo sapiens
gggtgggtggcagcaccgaggc

SEQ ID NO: 8048812 - DNA, 22 bp, Homo sapiens
gggtgggtggtccgcagacata

SEQ ID NO: 8048813 - DNA, 22 bp, Homo sapiens
gggtggtggccagcagtgggca

SEQ ID NO: 8048814 - DNA, 22 bp, Homo sapiens
gggtggtggccagcagtgggca

SEQ ID NO: 8048815 - DNA, 22 bp, Homo sapiens
gggtgcaggcagcccaggcagg

SEQ ID NO: 8048816 - DNA, 22 bp, Homo sapiens
gggtgcaggcagcccaggcagg

SEQ ID NO: 8048817 - DNA, 18 bp, Homo sapiens
gggtgcaggcactgactg

SEQ ID NO: 8048818 - DNA, 22 bp, Homo sapiens
gggctctggggtgccctggcat

SEQ ID NO: 8048819 - DNA, 22 bp, Homo sapiens
gggctctggggtgccctggcat

SEQ ID NO: 8048820 - DNA, 16 bp, Homo sapiens
gggctgggggattctg

SEQ ID NO: 8048821 - DNA, 22 bp, Homo sapiens
gggctgtgtgcccacttcccat

SEQ ID NO: 8048822 - DNA, 22 bp, Homo sapiens
gggctgtgttaggtgcggttac

SEQ ID NO: 8048823 - DNA, 18 bp, Homo sapiens
gggctgtgttcatgccca

SEQ ID NO: 8048824 - DNA, 22 bp, Homo sapiens
gggctctgggatgctcttagag

SEQ ID NO: 8048825 - DNA, 19 bp, Homo sapiens
gggctctggcctcagtggg

SEQ ID NO: 8048826 - DNA, 19 bp, Homo sapiens
gggctctggcctcagtggg

SEQ ID NO: 8048827 - DNA, 22 bp, Homo sapiens
gggctctgggattcagagcaag

SEQ ID NO: 8048828 - DNA, 22 bp, Homo sapiens
gggctctgggattcagagcaag

SEQ ID NO: 8048829 - DNA, 22 bp, Homo sapiens
gggctctggggtcagacagcct

SEQ ID NO: 8048830 - DNA, 22 bp, Homo sapiens
gggcttcagttctgaccatctt

SEQ ID NO: 8048831 - DNA, 20 bp, Homo sapiens
ggggcaggtttttatggcta

SEQ ID NO: 8048832 - DNA, 22 bp, Homo sapiens
ggggcagtgaggtggcagcccg

SEQ ID NO: 8048833 - DNA, 22 bp, Homo sapiens
ggggccagagaggacccaggtg

SEQ ID NO: 8048834 - DNA, 22 bp, Homo sapiens
ggggccagatatcactaaggtt

SEQ ID NO: 8048835 - DNA, 22 bp, Homo sapiens
ggggcaggaggtgttctctttt

SEQ ID NO: 8048836 - DNA, 22 bp, Homo sapiens
ggggcagggaggttatcgccga

SEQ ID NO: 8048837 - DNA, 22 bp, Homo sapiens
ggggatgagactagagctaaag

SEQ ID NO: 8048838 - DNA, 21 bp, Homo sapiens
ggggatgcgaccacaggctcc

SEQ ID NO: 8048839 - DNA, 22 bp, Homo sapiens
ggggagaccatctgaaggtgat

SEQ ID NO: 8048840 - DNA, 22 bp, Homo sapiens
ggggaggacctttccaaggctt

SEQ ID NO: 8048841 - DNA, 22 bp, Homo sapiens
ggggaggcaagatgaagtgagg

SEQ ID NO: 8048842 - DNA, 22 bp, Homo sapiens
ggggaggacctttccaaggctt

SEQ ID NO: 8048843 - DNA, 22 bp, Homo sapiens
ggggaggctgatgtgggcaaag

SEQ ID NO: 8048844 - DNA, 22 bp, Homo sapiens
ggggaggctgatgtgggcaaag

SEQ ID NO: 8048845 - DNA, 22 bp, Homo sapiens
gtcctctgtagggctgggccac

SEQ ID NO: 8048846 - DNA, 22 bp, Homo sapiens
gtcctctgtagggctgggccac

SEQ ID NO: 8048847 - DNA, 22 bp, Homo sapiens
gtcctctgtccctggggcacgg

SEQ ID NO: 8048848 - DNA, 22 bp, Homo sapiens
gtcctctgggctttgagcagtc

SEQ ID NO: 8048849 - DNA, 22 bp, Homo sapiens
gtcctctgggctttgagcagtc

SEQ ID NO: 8048850 - DNA, 22 bp, Homo sapiens
gtcctctggtgaaagcattccc

SEQ ID NO: 8048851 - DNA, 22 bp, Homo sapiens
gtccaggccatggtggacacag

SEQ ID NO: 8048852 - DNA, 22 bp, Homo sapiens
gtccaggcctgcctctgaggag

SEQ ID NO: 8048853 - DNA, 22 bp, Homo sapiens
gtccaggccccagggattcttg

SEQ ID NO: 8048854 - DNA, 22 bp, Homo sapiens
gtccaggctgacccctagagga

SEQ ID NO: 8048855 - DNA, 22 bp, Homo sapiens
gtcctctggaagatgagttctt

SEQ ID NO: 8048856 - DNA, 22 bp, Homo sapiens
gtcctctgcttcatgccctgat

SEQ ID NO: 8048857 - DNA, 22 bp, Homo sapiens
gtcctctgggagccttgagcct

SEQ ID NO: 8048858 - DNA, 22 bp, Homo sapiens
gtcctctgggcagctgccccac

SEQ ID NO: 8048859 - DNA, 22 bp, Homo sapiens
gtcctctggcctttcccaggac

SEQ ID NO: 8048860 - DNA, 22 bp, Homo sapiens
gtcctctggaggtttttaggtg

SEQ ID NO: 8048861 - DNA, 23 bp, Homo sapiens
gtcctctggagagaaaggcagta

SEQ ID NO: 8048862 - DNA, 22 bp, Homo sapiens
gtcacctctcatcacatgctac

SEQ ID NO: 8048863 - DNA, 22 bp, Homo sapiens
gtccagctgatcttgacccagc

SEQ ID NO: 8048864 - DNA, 22 bp, Homo sapiens
gtccagctctcagatggctgca

SEQ ID NO: 8048865 - DNA, 22 bp, Homo sapiens
gtccagctctgagaagaaacat

SEQ ID NO: 8048866 - DNA, 22 bp, Homo sapiens
gtccagctgggccagggcactc

SEQ ID NO: 8048867 - DNA, 22 bp, Homo sapiens
gtccagctgcagctgggcagaa

SEQ ID NO: 8048868 - DNA, 22 bp, Homo sapiens
gtccagctccagggaggcaggc

SEQ ID NO: 8048869 - DNA, 19 bp, Homo sapiens
gtccagcctttgggtctta

SEQ ID NO: 8048870 - DNA, 22 bp, Homo sapiens
gtccagccctctgcctccaggt

SEQ ID NO: 8048871 - DNA, 22 bp, Homo sapiens
gtaggtcagacataagaggaca

SEQ ID NO: 8048872 - DNA, 22 bp, Homo sapiens
gtaggtgagtgatgctcagatt

SEQ ID NO: 8048873 - DNA, 22 bp, Homo sapiens
gtagttctgcagtgtcacctga

SEQ ID NO: 8048874 - DNA, 22 bp, Homo sapiens
gtatttttaggtaaggaaagta

SEQ ID NO: 8048875 - DNA, 22 bp, Homo sapiens
gtatttttcattccaagtgaga

SEQ ID NO: 8048876 - DNA, 22 bp, Homo sapiens
gtcaaaaagtagtcatttctgt

SEQ ID NO: 8048877 - DNA, 22 bp, Homo sapiens
gtatttttcagttaggagctta

SEQ ID NO: 8048878 - DNA, 22 bp, Homo sapiens
gtatttttagtagagtcggggt

SEQ ID NO: 8048879 - DNA, 22 bp, Homo sapiens
gtgaaaaatgatttgttaactg

SEQ ID NO: 8048880 - DNA, 22 bp, Homo sapiens
gtgaaaaatgatttgttaactg

SEQ ID NO: 8048881 - DNA, 22 bp, Homo sapiens
gtgagcagtggccagggtccta

SEQ ID NO: 8048882 - DNA, 22 bp, Homo sapiens
gtgaaaaatcatcatgacttga

SEQ ID NO: 8048883 - DNA, 21 bp, Homo sapiens
gtcttttaagtgaagagaggc

SEQ ID NO: 8048884 - DNA, 22 bp, Homo sapiens
gtgagctgttggagtggcagag

SEQ ID NO: 8048885 - DNA, 22 bp, Homo sapiens
gtgaggagctgacactggggtg

SEQ ID NO: 8048886 - DNA, 22 bp, Homo sapiens
gtgcaggcaaaagggccaggcc

SEQ ID NO: 8048887 - DNA, 22 bp, Homo sapiens
gtgcagggcaggtgtccttcca

SEQ ID NO: 8048888 - DNA, 22 bp, Homo sapiens
gtgcaggggatcaggttgcagc

SEQ ID NO: 8048889 - DNA, 22 bp, Homo sapiens
gtgccaggcccagggagcgggg

SEQ ID NO: 8048890 - DNA, 22 bp, Homo sapiens
gtgccagggagtggaggagctt

SEQ ID NO: 8048891 - DNA, 20 bp, Homo sapiens
gtgccaggcaagacaggtgg

SEQ ID NO: 8048892 - DNA, 18 bp, Homo sapiens
gtgccaggaggcgcagcc

SEQ ID NO: 8048893 - DNA, 22 bp, Homo sapiens
gtgccagcctggtgcgcctggg

SEQ ID NO: 8048894 - DNA, 22 bp, Homo sapiens
gtgccagcctggtgcgcctggg

SEQ ID NO: 8048895 - DNA, 22 bp, Homo sapiens
gtgccaggtgctaagctgtgct

SEQ ID NO: 8048896 - DNA, 22 bp, Homo sapiens
gtgcccaggcccaaggcaccac

SEQ ID NO: 8048897 - DNA, 22 bp, Homo sapiens
gtgctggccctgtcctcgagct

SEQ ID NO: 8048898 - DNA, 22 bp, Homo sapiens
gtgctgccagacagtgagaggg

SEQ ID NO: 8048899 - DNA, 22 bp, Homo sapiens
gctgcctccgccggctccacag

SEQ ID NO: 8048900 - DNA, 22 bp, Homo sapiens
gctgcctccactggctcccagt

SEQ ID NO: 8048901 - DNA, 22 bp, Homo sapiens
gctgcctcccagagccctgcag

SEQ ID NO: 8048902 - DNA, 22 bp, Homo sapiens
gctgcagggagctggaaggctc

SEQ ID NO: 8048903 - DNA, 22 bp, Homo sapiens
gctgcaggctgtggcaggggag

SEQ ID NO: 8048904 - DNA, 22 bp, Homo sapiens
gctgcaggggggtctggacttg

SEQ ID NO: 8048905 - DNA, 22 bp, Homo sapiens
gctgcagggctctcacaggggg

SEQ ID NO: 8048906 - DNA, 22 bp, Homo sapiens
gctgcagggagctggaaggctc

SEQ ID NO: 8048907 - DNA, 21 bp, Homo sapiens
gctgcagggcccagggcaccc

SEQ ID NO: 8048908 - DNA, 22 bp, Homo sapiens
gctctgtggtggggcagagttt

SEQ ID NO: 8048909 - DNA, 22 bp, Homo sapiens
gctgcaggcattttcctgggca

SEQ ID NO: 8048910 - DNA, 18 bp, Homo sapiens
gctgcaggcgcctgcggt

SEQ ID NO: 8048911 - DNA, 22 bp, Homo sapiens
gctggcaggtccaagatagagc

SEQ ID NO: 8048912 - DNA, 22 bp, Homo sapiens
gctggcaggtaaagccccgggg

SEQ ID NO: 8048913 - DNA, 22 bp, Homo sapiens
gctggcagggttctcactgaaa

SEQ ID NO: 8048914 - DNA, 22 bp, Homo sapiens
gctggcagggtggttgagagag

SEQ ID NO: 8048915 - DNA, 22 bp, Homo sapiens
gctggcagtttcctcaccgagg

SEQ ID NO: 8048916 - DNA, 22 bp, Homo sapiens
gctggcagtgtgaatgacaagc

SEQ ID NO: 8048917 - DNA, 22 bp, Homo sapiens
gctggccaaagtgtacctggag

SEQ ID NO: 8048918 - DNA, 22 bp, Homo sapiens
gctggcagtgtattgttagctg

SEQ ID NO: 8048919 - DNA, 22 bp, Homo sapiens
gctggcagtcccatcagctggg

SEQ ID NO: 8048920 - DNA, 22 bp, Homo sapiens
gctggcagtaaagggtttggca

SEQ ID NO: 8048921 - DNA, 22 bp, Homo sapiens
gctggagtatctggggaaggag

SEQ ID NO: 8048922 - DNA, 22 bp, Homo sapiens
gctggaggtttcacctgagttt

SEQ ID NO: 8048923 - DNA, 22 bp, Homo sapiens
gctggaggtagggaggtcctgt

SEQ ID NO: 8048924 - DNA, 22 bp, Homo sapiens
gctggagcttgagaggacaggg

SEQ ID NO: 8048925 - DNA, 22 bp, Homo sapiens
gctggaggggtaataggatggg

SEQ ID NO: 8048926 - DNA, 22 bp, Homo sapiens
gctggagcttgagaggacaggg

SEQ ID NO: 8048927 - DNA, 18 bp, Homo sapiens
gctgctggtggagggagc

SEQ ID NO: 8048928 - DNA, 22 bp, Homo sapiens
gctgctgggtccctctgtgcca

SEQ ID NO: 8048929 - DNA, 22 bp, Homo sapiens
gctgctggtcctcagagctcat

SEQ ID NO: 8048930 - DNA, 22 bp, Homo sapiens
gctgctgggaatgaacagtgtt

SEQ ID NO: 8048931 - DNA, 22 bp, Homo sapiens
gctgctggcttcctgctgtttt

SEQ ID NO: 8048932 - DNA, 22 bp, Homo sapiens
gctgctggggtcacatggtaag

SEQ ID NO: 8048933 - DNA, 19 bp, Homo sapiens
gctgctggctctggctgga

SEQ ID NO: 8048934 - DNA, 22 bp, Homo sapiens
gctccctccatgaggcagaccg

SEQ ID NO: 8048935 - DNA, 22 bp, Homo sapiens
gctccccattgatctgcaggct

SEQ ID NO: 8048936 - DNA, 19 bp, Homo sapiens
gctctgtgatgctgagggg

SEQ ID NO: 8048937 - DNA, 22 bp, Homo sapiens
gctctgtgcccctgccgtggac

SEQ ID NO: 8048938 - DNA, 22 bp, Homo sapiens
gctctgtgccagggctgggcca

SEQ ID NO: 8048939 - DNA, 22 bp, Homo sapiens
gctctcttgacagcttgctgtt

SEQ ID NO: 8048940 - DNA, 18 bp, Homo sapiens
gctcagtgtgttaacact

SEQ ID NO: 8048941 - DNA, 22 bp, Homo sapiens
gctcagggcgcgagggacgtgg

SEQ ID NO: 8048942 - DNA, 22 bp, Homo sapiens
gctcagggccatggaccagcag

SEQ ID NO: 8048943 - DNA, 22 bp, Homo sapiens
gctcagggaaggccacgtgaga

SEQ ID NO: 8048944 - DNA, 20 bp, Homo sapiens
gctcagggaattcaggaagc

SEQ ID NO: 8048945 - DNA, 22 bp, Homo sapiens
gctaggtgcagcagacagctta

SEQ ID NO: 8048946 - DNA, 22 bp, Homo sapiens
gcctggcactcactgaagaggc

SEQ ID NO: 8048947 - DNA, 22 bp, Homo sapiens
gcctggcactcaatcatctgct

SEQ ID NO: 8048948 - DNA, 22 bp, Homo sapiens
gcctggcacgggctcggcccac

SEQ ID NO: 8048949 - DNA, 22 bp, Homo sapiens
gcctggcactgggctcctggcc

SEQ ID NO: 8048950 - DNA, 22 bp, Homo sapiens
gcctggcagattgacatagcca

SEQ ID NO: 8048951 - DNA, 22 bp, Homo sapiens
gcctggcaggaatctcagtgct

SEQ ID NO: 8048952 - DNA, 22 bp, Homo sapiens
gcctggcagcctccaaccttca

SEQ ID NO: 8048953 - DNA, 22 bp, Homo sapiens
gcctggcagcccctagacattt

SEQ ID NO: 8048954 - DNA, 22 bp, Homo sapiens
gcctggcaggcctcatgagggg

SEQ ID NO: 8048955 - DNA, 22 bp, Homo sapiens
gcctggagttcagccaagtccc

SEQ ID NO: 8048956 - DNA, 22 bp, Homo sapiens
gcctggagttcagccaagtccc

SEQ ID NO: 8048957 - DNA, 16 bp, Homo sapiens
gcctggcaccgtcggc

SEQ ID NO: 8048958 - DNA, 20 bp, Homo sapiens
gcctggcacccggggctggc

SEQ ID NO: 8048959 - DNA, 20 bp, Homo sapiens
gcctggagttagttttcctt

SEQ ID NO: 8048960 - DNA, 22 bp, Homo sapiens
gcctggagtgttggtatttctc

SEQ ID NO: 8048961 - DNA, 22 bp, Homo sapiens
gcctggagtggtcctgctgccc

SEQ ID NO: 8048962 - DNA, 22 bp, Homo sapiens
gcctggagtggtcctgctgccc

SEQ ID NO: 8048963 - DNA, 22 bp, Homo sapiens
gctagggactagggaaggagca

SEQ ID NO: 8048964 - DNA, 18 bp, Homo sapiens
gctagggcatgcatggtg

SEQ ID NO: 8048965 - DNA, 22 bp, Homo sapiens
gctaggagtggtgggtcaagga

SEQ ID NO: 8048966 - DNA, 22 bp, Homo sapiens
gctagctgggtttcactgtgga

SEQ ID NO: 8048967 - DNA, 22 bp, Homo sapiens
gctagcagaaagcaggctgctc

SEQ ID NO: 8048968 - DNA, 22 bp, Homo sapiens
gctagcctcccttttccatggt

SEQ ID NO: 8048969 - DNA, 18 bp, Homo sapiens
ggagaagaacagatgtgg

SEQ ID NO: 8048970 - DNA, 22 bp, Homo sapiens
ggagaaagtacagcaggcaaca

SEQ ID NO: 8048971 - DNA, 22 bp, Homo sapiens
ggagaagattggaattaagcac

SEQ ID NO: 8048972 - DNA, 22 bp, Homo sapiens
ggagccaggcatatcggggcac

SEQ ID NO: 8048973 - DNA, 22 bp, Homo sapiens
ggagcccaagtctgcactcggc

SEQ ID NO: 8048974 - DNA, 22 bp, Homo sapiens
ggagccctcaccggcgagtgcc

SEQ ID NO: 8048975 - DNA, 22 bp, Homo sapiens
ggagcctggcaatgctgcgtcc

SEQ ID NO: 8048976 - DNA, 22 bp, Homo sapiens
ggagcctggagtttctgatggg

SEQ ID NO: 8048977 - DNA, 19 bp, Homo sapiens
ggagcctggcaggggcgtg

SEQ ID NO: 8048978 - DNA, 23 bp, Homo sapiens
ggagcctggcatatgagacgcat

SEQ ID NO: 8048979 - DNA, 22 bp, Homo sapiens
ggagcctggcccggcccttggc

SEQ ID NO: 8048980 - DNA, 22 bp, Homo sapiens
ggagctgggaattggatcatct

SEQ ID NO: 8048981 - DNA, 21 bp, Homo sapiens
ggagctggggagctggcccca

SEQ ID NO: 8048982 - DNA, 21 bp, Homo sapiens
ggagctggggagctggcccca

SEQ ID NO: 8048983 - DNA, 18 bp, Homo sapiens
ggagctgggccccactcc

SEQ ID NO: 8048984 - DNA, 22 bp, Homo sapiens
ggagcctggtcaggttggctcc

SEQ ID NO: 8048985 - DNA, 22 bp, Homo sapiens
ggagcctggtatagtgttgcat

SEQ ID NO: 8048986 - DNA, 19 bp, Homo sapiens
ggagcttggtggctgtggc

SEQ ID NO: 8048987 - DNA, 22 bp, Homo sapiens
ggaggaggggtgactgaatgct

SEQ ID NO: 8048988 - DNA, 22 bp, Homo sapiens
ggactgggaatcagggagatgc

SEQ ID NO: 8048989 - DNA, 22 bp, Homo sapiens
ggactggccggcgctgaggccc

SEQ ID NO: 8048990 - DNA, 22 bp, Homo sapiens
ggactgtctccttgctggtagg

SEQ ID NO: 8048991 - DNA, 22 bp, Homo sapiens
ggacaggcgcagggccaaggaa

SEQ ID NO: 8048992 - DNA, 22 bp, Homo sapiens
ggacaggccctctggtcagctt

SEQ ID NO: 8048993 - DNA, 22 bp, Homo sapiens
ggacaggccgcctcggtggggg

SEQ ID NO: 8048994 - DNA, 19 bp, Homo sapiens
ggacagggggagcttttat

SEQ ID NO: 8048995 - DNA, 22 bp, Homo sapiens
ggacagggtaagtactagtgtg

SEQ ID NO: 8048996 - DNA, 22 bp, Homo sapiens
ggacagggatcattatctgagc

SEQ ID NO: 8048997 - DNA, 23 bp, Homo sapiens
ggacagggccctgccctatggcc

SEQ ID NO: 8048998 - DNA, 23 bp, Homo sapiens
ggacagggccctgccctatggcc

SEQ ID NO: 8048999 - DNA, 22 bp, Homo sapiens
ggacagggctcttggcactcct

SEQ ID NO: 8049000 - DNA, 22 bp, Homo sapiens
ggacagggctcttggcactcct

SEQ ID NO: 8049001 - DNA, 22 bp, Homo sapiens
ggaagggagtagttggaatgca

SEQ ID NO: 8049002 - DNA, 22 bp, Homo sapiens
ggacagagggttgacagagtat

SEQ ID NO: 8049003 - DNA, 22 bp, Homo sapiens
ggacagagggttgacagagtat

SEQ ID NO: 8049004 - DNA, 19 bp, Homo sapiens
ggaaggccacggcaggctt

SEQ ID NO: 8049005 - DNA, 22 bp, Homo sapiens
ggaaggaggatgctctggcctt

SEQ ID NO: 8049006 - DNA, 22 bp, Homo sapiens
ggaaggaggatgctctggcctt

SEQ ID NO: 8049007 - DNA, 22 bp, Homo sapiens
ggaaggagccatatcatatcca

SEQ ID NO: 8049008 - DNA, 22 bp, Homo sapiens
ggaaggagggcggcaatgatga

SEQ ID NO: 8049009 - DNA, 22 bp, Homo sapiens
ggaaggagggcggcaatgatga

SEQ ID NO: 8049010 - DNA, 22 bp, Homo sapiens
ggaaggaggggcaaagcagttc

SEQ ID NO: 8049011 - DNA, 22 bp, Homo sapiens
ggaaggaggggcaaagcagttc

SEQ ID NO: 8049012 - DNA, 22 bp, Homo sapiens
ggaaggagtctttaacacccat

SEQ ID NO: 8049013 - DNA, 18 bp, Homo sapiens
ggaaggagtggaccccag

SEQ ID NO: 8049014 - DNA, 18 bp, Homo sapiens
ggaaggagtggaccccag

SEQ ID NO: 8049015 - DNA, 19 bp, Homo sapiens
ggaaggagagaaatgcatg

SEQ ID NO: 8049016 - DNA, 22 bp, Homo sapiens
ggaaggagcatttgccagttta

SEQ ID NO: 8049017 - DNA, 22 bp, Homo sapiens
ggaaaaatgacacatatctcaa

SEQ ID NO: 8049018 - DNA, 22 bp, Homo sapiens
gctggtccactccctggaggct

SEQ ID NO: 8049019 - DNA, 22 bp, Homo sapiens
gctggtccacatcctggtacgt

SEQ ID NO: 8049020 - DNA, 22 bp, Homo sapiens
gctggccaggaagagtctcaga

SEQ ID NO: 8049021 - DNA, 22 bp, Homo sapiens
gctggccacactgctgatggag

SEQ ID NO: 8049022 - DNA, 22 bp, Homo sapiens
gctgtctggaggctctgaggga

SEQ ID NO: 8049023 - DNA, 22 bp, Homo sapiens
gctgtctcatacaaggccctgc

SEQ ID NO: 8049024 - DNA, 23 bp, Homo sapiens
gctgtcgccagagccccacctac

SEQ ID NO: 8049025 - DNA, 22 bp, Homo sapiens
gcttttctataagaactttcaa

SEQ ID NO: 8049026 - DNA, 22 bp, Homo sapiens
gcttttgttccacagttttgaa

SEQ ID NO: 8049027 - DNA, 22 bp, Homo sapiens
gctttatgggccatgcggtgtc

SEQ ID NO: 8049028 - DNA, 22 bp, Homo sapiens
gctttatgcaaacctggtactt

SEQ ID NO: 8049029 - DNA, 22 bp, Homo sapiens
gctttatgagtgaggcaggata

SEQ ID NO: 8049030 - DNA, 22 bp, Homo sapiens
gctttatggattgtaaactgca

SEQ ID NO: 8049031 - DNA, 22 bp, Homo sapiens
gctttatgctacgatttctagt

SEQ ID NO: 8049032 - DNA, 22 bp, Homo sapiens
gctttacataaacatttattat

SEQ ID NO: 8049033 - DNA, 22 bp, Homo sapiens
gctttacatgtttccctttaag

SEQ ID NO: 8049034 - DNA, 22 bp, Homo sapiens
gcagcacaaagtccccagggac

SEQ ID NO: 8049035 - DNA, 22 bp, Homo sapiens
gcagcactaatgggccccagaa

SEQ ID NO: 8049036 - DNA, 22 bp, Homo sapiens
gcagcagcagcaattttctgtc

SEQ ID NO: 8049037 - DNA, 22 bp, Homo sapiens
gcagcagcaagaaggttggact

SEQ ID NO: 8049038 - DNA, 22 bp, Homo sapiens
gcagcagcagggagtctgactt

SEQ ID NO: 8049039 - DNA, 22 bp, Homo sapiens
gcagcagccactattctggcat

SEQ ID NO: 8049040 - DNA, 22 bp, Homo sapiens
gcagcagcagggagtctgactt

SEQ ID NO: 8049041 - DNA, 22 bp, Homo sapiens
gcagcagcaggcgctcggccgt

SEQ ID NO: 8049042 - DNA, 22 bp, Homo sapiens
gcagccagaagactcagaacaa

SEQ ID NO: 8049043 - DNA, 22 bp, Homo sapiens
gcagccacctcccatggcgggg

SEQ ID NO: 8049044 - DNA, 22 bp, Homo sapiens
gcagccacagaggagggatgca

SEQ ID NO: 8049045 - DNA, 22 bp, Homo sapiens
gcagccacagaggagggatgca

SEQ ID NO: 8049046 - DNA, 22 bp, Homo sapiens
gcagcagcccagggctctcaga

SEQ ID NO: 8049047 - DNA, 22 bp, Homo sapiens
gcagccagccctagtcccactt

SEQ ID NO: 8049048 - DNA, 21 bp, Homo sapiens
gcagccagccgagaccatgcc

SEQ ID NO: 8049049 - DNA, 21 bp, Homo sapiens
gcagccagccgagaccatgcc

SEQ ID NO: 8049050 - DNA, 22 bp, Homo sapiens
gcagccaggaaagctggaccct

SEQ ID NO: 8049051 - DNA, 21 bp, Homo sapiens
gcagccagacgggattcagtt

SEQ ID NO: 8049052 - DNA, 22 bp, Homo sapiens
gcagccagagggggtgtgatca

SEQ ID NO: 8049053 - DNA, 22 bp, Homo sapiens
gcagccagcccctctgacctct

SEQ ID NO: 8049054 - DNA, 22 bp, Homo sapiens
gcagccagcaggaagcgggaga

SEQ ID NO: 8049055 - DNA, 22 bp, Homo sapiens
gcagccagcaggaagcgggaga

SEQ ID NO: 8049056 - DNA, 22 bp, Homo sapiens
gcagcccaagagactctgttga

SEQ ID NO: 8049057 - DNA, 22 bp, Homo sapiens
gcagcccaaaaaagaggtagat

SEQ ID NO: 8049058 - DNA, 22 bp, Homo sapiens
gcagcccaagcctgagcatcct

SEQ ID NO: 8049059 - DNA, 22 bp, Homo sapiens
gcagccagtgggatgagaaaga

SEQ ID NO: 8049060 - DNA, 22 bp, Homo sapiens
gcagcccaaaaaagaggtagat

SEQ ID NO: 8049061 - DNA, 22 bp, Homo sapiens
gcagccagtatcctctgagatt

SEQ ID NO: 8049062 - DNA, 22 bp, Homo sapiens
gcagccaggaagcccaggacac

SEQ ID NO: 8049063 - DNA, 17 bp, Homo sapiens
gcagccagtgcagcagg

SEQ ID NO: 8049064 - DNA, 17 bp, Homo sapiens
gcagccagtgcagcagg

SEQ ID NO: 8049065 - DNA, 22 bp, Homo sapiens
gcagctgggacactgaggccag

SEQ ID NO: 8049066 - DNA, 22 bp, Homo sapiens
gcagctgggacactgaggccag

SEQ ID NO: 8049067 - DNA, 22 bp, Homo sapiens
gcagcccacaccactctgctca

SEQ ID NO: 8049068 - DNA, 22 bp, Homo sapiens
gcagcccaatggactgagacag

SEQ ID NO: 8049069 - DNA, 22 bp, Homo sapiens
gcagcccacagctggaggccta

SEQ ID NO: 8049070 - DNA, 22 bp, Homo sapiens
gcagcccacagctggaggccta

SEQ ID NO: 8049071 - DNA, 22 bp, Homo sapiens
gcagctgggtctgtgtgggctg

SEQ ID NO: 8049072 - DNA, 22 bp, Homo sapiens
gcagctgggtctgtgtgggctg

SEQ ID NO: 8049073 - DNA, 22 bp, Homo sapiens
gcagctggggccacacttaggc

SEQ ID NO: 8049074 - DNA, 22 bp, Homo sapiens
gcagctggggccacacttaggc

SEQ ID NO: 8049075 - DNA, 22 bp, Homo sapiens
gcagctggggaggtcgtgggga

SEQ ID NO: 8049076 - DNA, 22 bp, Homo sapiens
gcagctgggccccagcctctcc

SEQ ID NO: 8049077 - DNA, 23 bp, Homo sapiens
gcagctggttagaagggaaggag

SEQ ID NO: 8049078 - DNA, 22 bp, Homo sapiens
gcagctggtgcaaatgtcactc

SEQ ID NO: 8049079 - DNA, 22 bp, Homo sapiens
gcagctggtgcaaatgtcactc

SEQ ID NO: 8049080 - DNA, 22 bp, Homo sapiens
gcagctggtctggcctagagta

SEQ ID NO: 8049081 - DNA, 22 bp, Homo sapiens
gcagctggtctggcctagagta

SEQ ID NO: 8049082 - DNA, 19 bp, Homo sapiens
gcaggtcattaggctaggt

SEQ ID NO: 8049083 - DNA, 22 bp, Homo sapiens
gcagggcagtaagagctagagt

SEQ ID NO: 8049084 - DNA, 22 bp, Homo sapiens
gcagggcagtaagagctagagt

SEQ ID NO: 8049085 - DNA, 22 bp, Homo sapiens
gcagggcaggatttgaacccag

SEQ ID NO: 8049086 - DNA, 22 bp, Homo sapiens
gcagggcaggatttgaacccag

SEQ ID NO: 8049087 - DNA, 22 bp, Homo sapiens
gcagggcagggcaagaactggg

SEQ ID NO: 8049088 - DNA, 22 bp, Homo sapiens
gcagggcatgggccctgtctgc

SEQ ID NO: 8049089 - DNA, 22 bp, Homo sapiens
gcagggccagggctcaggctgt

SEQ ID NO: 8049090 - DNA, 22 bp, Homo sapiens
gcagggccagtgcagagaggaa

SEQ ID NO: 8049091 - DNA, 22 bp, Homo sapiens
gcagggcagctgaagctaggtg

SEQ ID NO: 8049092 - DNA, 22 bp, Homo sapiens
gcagggcagcttagtccctgtc

SEQ ID NO: 8049093 - DNA, 22 bp, Homo sapiens
gcagggcagcttagtccctgtc

SEQ ID NO: 8049094 - DNA, 22 bp, Homo sapiens
gcagggcagctcactgtggttc

SEQ ID NO: 8049095 - DNA, 22 bp, Homo sapiens
gcagggcagctcactgtggttc

SEQ ID NO: 8049096 - DNA, 22 bp, Homo sapiens
gcagggcagctgaagctaggtg

SEQ ID NO: 8049097 - DNA, 20 bp, Homo sapiens
gcaggccctctctctagtct

SEQ ID NO: 8049098 - DNA, 19 bp, Homo sapiens
gcaggcccagtcgggctgg

SEQ ID NO: 8049099 - DNA, 22 bp, Homo sapiens
gcaggcccttagccttggtggg

SEQ ID NO: 8049100 - DNA, 18 bp, Homo sapiens
gcaggccctgtttctggg

SEQ ID NO: 8049101 - DNA, 22 bp, Homo sapiens
gcaggcccttagccttggtggg

SEQ ID NO: 8049102 - DNA, 22 bp, Homo sapiens
gcaggcctaagagaaggcattg

SEQ ID NO: 8049103 - DNA, 22 bp, Homo sapiens
gcaggcctctaattcaccgcag

SEQ ID NO: 8049104 - DNA, 22 bp, Homo sapiens
gcaggcctcccctgctggagct

SEQ ID NO: 8049105 - DNA, 22 bp, Homo sapiens
gcaggccacagtggagtctctg

SEQ ID NO: 8049106 - DNA, 22 bp, Homo sapiens
gcaggccaagccctcgcagaga

SEQ ID NO: 8049107 - DNA, 22 bp, Homo sapiens
gcaggccaagccctcgcagaga

SEQ ID NO: 8049108 - DNA, 22 bp, Homo sapiens
gcaggcagtttgcttttccctc

SEQ ID NO: 8049109 - DNA, 22 bp, Homo sapiens
gcaggcatctctgtagccaggg

SEQ ID NO: 8049110 - DNA, 22 bp, Homo sapiens
gcagctgtaaagcagaaatagt

SEQ ID NO: 8049111 - DNA, 22 bp, Homo sapiens
gcagctgtactggcagcattgt

SEQ ID NO: 8049112 - DNA, 22 bp, Homo sapiens
gcaggccactgtctcctctggg

SEQ ID NO: 8049113 - DNA, 22 bp, Homo sapiens
gcaggccagctgtgcagatggg

SEQ ID NO: 8049114 - DNA, 22 bp, Homo sapiens
gcaggcccagagtcgctggcct

SEQ ID NO: 8049115 - DNA, 22 bp, Homo sapiens
gcaggccaggctaggggctgtc

SEQ ID NO: 8049116 - DNA, 19 bp, Homo sapiens
gcaggccaggaggcggagg

SEQ ID NO: 8049117 - DNA, 22 bp, Homo sapiens
gcaggccattcaggagatgtgc

SEQ ID NO: 8049118 - DNA, 22 bp, Homo sapiens
gcaggccaggctaggggctgtc

SEQ ID NO: 8049119 - DNA, 22 bp, Homo sapiens
gcacagagagtcccgggtgccc

SEQ ID NO: 8049120 - DNA, 22 bp, Homo sapiens
gcacagaggtggaggacaaata

SEQ ID NO: 8049121 - DNA, 22 bp, Homo sapiens
gcacagagggcagtgagcctct

SEQ ID NO: 8049122 - DNA, 22 bp, Homo sapiens
gcacagagagcagtgggggaca

SEQ ID NO: 8049123 - DNA, 22 bp, Homo sapiens
gcacagagaggctgtgagcgcc

SEQ ID NO: 8049124 - DNA, 22 bp, Homo sapiens
gcacagagacagtcctgagatc

SEQ ID NO: 8049125 - DNA, 22 bp, Homo sapiens
gcacagagacagtcctgagatc

SEQ ID NO: 8049126 - DNA, 22 bp, Homo sapiens
gcacagacagaatccctactcc

SEQ ID NO: 8049127 - DNA, 22 bp, Homo sapiens
gcacagactttgattgcagtca

SEQ ID NO: 8049128 - DNA, 22 bp, Homo sapiens
gcacatggacaatggaggtgca

SEQ ID NO: 8049129 - DNA, 22 bp, Homo sapiens
gcacagagtgggtgagatgtgg

SEQ ID NO: 8049130 - DNA, 22 bp, Homo sapiens
gcacagagtcactagctaagca

SEQ ID NO: 8049131 - DNA, 20 bp, Homo sapiens
gcaaggcacagtgaggaggg

SEQ ID NO: 8049132 - DNA, 22 bp, Homo sapiens
gcaaggcagtcctggggccctg

SEQ ID NO: 8049133 - DNA, 21 bp, Homo sapiens
gcaaggcctatcatggcagct

SEQ ID NO: 8049134 - DNA, 22 bp, Homo sapiens
gcaaggcctgaggtgggtgctc

SEQ ID NO: 8049135 - DNA, 22 bp, Homo sapiens
gcaaggctcacattgaactgaa

SEQ ID NO: 8049136 - DNA, 22 bp, Homo sapiens
gcaaggaggctggtggaggaag

SEQ ID NO: 8049137 - DNA, 22 bp, Homo sapiens
gcaaggagcctggaggtgagtg

SEQ ID NO: 8049138 - DNA, 22 bp, Homo sapiens
gcaaggagcctggaggtgagtg

SEQ ID NO: 8049139 - DNA, 22 bp, Homo sapiens
gcaaggagactgtagggccaag

SEQ ID NO: 8049140 - DNA, 22 bp, Homo sapiens
gcaccagctgcagggtggctga

SEQ ID NO: 8049141 - DNA, 22 bp, Homo sapiens
gcaccagctgccttctgtgccc

SEQ ID NO: 8049142 - DNA, 22 bp, Homo sapiens
gcacccagaggtcagcagtgct

SEQ ID NO: 8049143 - DNA, 22 bp, Homo sapiens
gcacccagagggcagggtctcc

SEQ ID NO: 8049144 - DNA, 20 bp, Homo sapiens
gcacccagcttcttgttcta

SEQ ID NO: 8049145 - DNA, 22 bp, Homo sapiens
gcacccagcccagggcgtgatg

SEQ ID NO: 8049146 - DNA, 22 bp, Homo sapiens
gcacccagatagcaaggattag

SEQ ID NO: 8049147 - DNA, 22 bp, Homo sapiens
gcacccagatattgccttgacc

SEQ ID NO: 8049148 - DNA, 22 bp, Homo sapiens
gcacccagccagcatctcagag

SEQ ID NO: 8049149 - DNA, 22 bp, Homo sapiens
gcagacaggcccagtggaggga

SEQ ID NO: 8049150 - DNA, 22 bp, Homo sapiens
gcagacagccagactgcactgg

SEQ ID NO: 8049151 - DNA, 22 bp, Homo sapiens
gcagacaggattgggttaatag

SEQ ID NO: 8049152 - DNA, 22 bp, Homo sapiens
gcagacagcatgttgggctatt

SEQ ID NO: 8049153 - DNA, 22 bp, Homo sapiens
gcagacagcatgttgggctatt

SEQ ID NO: 8049154 - DNA, 22 bp, Homo sapiens
gcagacagatgagggtgctggg

SEQ ID NO: 8049155 - DNA, 22 bp, Homo sapiens
gcagacagatgagggtgctggg

SEQ ID NO: 8049156 - DNA, 22 bp, Homo sapiens
gcagacagatgagggtgctggg

SEQ ID NO: 8049157 - DNA, 22 bp, Homo sapiens
gcagacagaagctaagtagaca

SEQ ID NO: 8049158 - DNA, 22 bp, Homo sapiens
gcagacagaagctaagtagaca

SEQ ID NO: 8049159 - DNA, 23 bp, Homo sapiens
gcagacagagcagactaagacaa

SEQ ID NO: 8049160 - DNA, 22 bp, Homo sapiens
gcagacagactgcagtgatttt

SEQ ID NO: 8049161 - DNA, 22 bp, Homo sapiens
gcagacaccttgtaggtgtgta

SEQ ID NO: 8049162 - DNA, 18 bp, Homo sapiens
gcagacactcgtggaggg

SEQ ID NO: 8049163 - DNA, 22 bp, Homo sapiens
gcagaagggaataaggagcttt

SEQ ID NO: 8049164 - DNA, 22 bp, Homo sapiens
gcagacacagggaaggcaagga

SEQ ID NO: 8049165 - DNA, 22 bp, Homo sapiens
gcagacaggggcttaggaaagg

SEQ ID NO: 8049166 - DNA, 22 bp, Homo sapiens
gcagacaggggcttaggaaagg

SEQ ID NO: 8049167 - DNA, 22 bp, Homo sapiens
gcagacagggctacagaggtac

SEQ ID NO: 8049168 - DNA, 22 bp, Homo sapiens
gcagacagggctacagaggtac

SEQ ID NO: 8049169 - DNA, 19 bp, Homo sapiens
gcagagtggggtggagggt

SEQ ID NO: 8049170 - DNA, 22 bp, Homo sapiens
gcagagtgaagggagaggtgtg

SEQ ID NO: 8049171 - DNA, 22 bp, Homo sapiens
gccctgagttgagccttccaaa

SEQ ID NO: 8049172 - DNA, 22 bp, Homo sapiens
gccccttgggaattcctccact

SEQ ID NO: 8049173 - DNA, 22 bp, Homo sapiens
gccccttgtctccaggccccaa

SEQ ID NO: 8049174 - DNA, 22 bp, Homo sapiens
gccctagcgccagctcagcacc

SEQ ID NO: 8049175 - DNA, 22 bp, Homo sapiens
gcccaaggtcccatggcagcac

SEQ ID NO: 8049176 - DNA, 22 bp, Homo sapiens
gcccacaccatttattctttgt

SEQ ID NO: 8049177 - DNA, 22 bp, Homo sapiens
gcccacacagcagatcctttgg

SEQ ID NO: 8049178 - DNA, 22 bp, Homo sapiens
gcccacacaccagctcaggagg

SEQ ID NO: 8049179 - DNA, 22 bp, Homo sapiens
gcccacaggggacctggtggct

SEQ ID NO: 8049180 - DNA, 22 bp, Homo sapiens
gcccctggctggccagctcctc

SEQ ID NO: 8049181 - DNA, 22 bp, Homo sapiens
gcctcaggtgcatctctcattc

SEQ ID NO: 8049182 - DNA, 22 bp, Homo sapiens
gccctggaatctctccatggga

SEQ ID NO: 8049183 - DNA, 22 bp, Homo sapiens
gccctggaaaggaacctgggct

SEQ ID NO: 8049184 - DNA, 22 bp, Homo sapiens
gccctgcttggtcatggccttc

SEQ ID NO: 8049185 - DNA, 20 bp, Homo sapiens
gccctggacgtggcctcggc

SEQ ID NO: 8049186 - DNA, 22 bp, Homo sapiens
gccctgctctggtctctgcccg

SEQ ID NO: 8049187 - DNA, 23 bp, Homo sapiens
gccctgctcctggctgggaggga

SEQ ID NO: 8049188 - DNA, 22 bp, Homo sapiens
gccctgctcatttcacgtgttt

SEQ ID NO: 8049189 - DNA, 22 bp, Homo sapiens
gccctgcttctggcatgcagaa

SEQ ID NO: 8049190 - DNA, 22 bp, Homo sapiens
gccctgctgtttagagagctac

SEQ ID NO: 8049191 - DNA, 23 bp, Homo sapiens
gccctgctgggacctcctgctac

SEQ ID NO: 8049192 - DNA, 22 bp, Homo sapiens
gcctgcagaggtgctgctagct

SEQ ID NO: 8049193 - DNA, 21 bp, Homo sapiens
gcctgcagaccccaccaggct

SEQ ID NO: 8049194 - DNA, 20 bp, Homo sapiens
gcctgcagagaaggtcagag

SEQ ID NO: 8049195 - DNA, 22 bp, Homo sapiens
gcctgcacccacaggcatggcc

SEQ ID NO: 8049196 - DNA, 22 bp, Homo sapiens
gcctgcagaactgtgaggcaat

SEQ ID NO: 8049197 - DNA, 19 bp, Homo sapiens
gcctgcagaaaaggcaggg

SEQ ID NO: 8049198 - DNA, 22 bp, Homo sapiens
gcctgcagatatataggatggt

SEQ ID NO: 8049199 - DNA, 22 bp, Homo sapiens
gcctgcagcctcaagggctgag

SEQ ID NO: 8049200 - DNA, 22 bp, Homo sapiens
gcctgcagcccctctgcagtag

SEQ ID NO: 8049201 - DNA, 22 bp, Homo sapiens
gcctgcagggcctgggcctacc

SEQ ID NO: 8049202 - DNA, 17 bp, Homo sapiens
gcctgcaggcccgcaga

SEQ ID NO: 8049203 - DNA, 22 bp, Homo sapiens
gcctgcagggcccttgtgggtc

SEQ ID NO: 8049204 - DNA, 18 bp, Homo sapiens
gcctgcaggcacgggggt

SEQ ID NO: 8049205 - DNA, 22 bp, Homo sapiens
gcctgcagcctcagagaatttt

SEQ ID NO: 8049206 - DNA, 22 bp, Homo sapiens
gcctggagaggaagccggtgga

SEQ ID NO: 8049207 - DNA, 22 bp, Homo sapiens
gcctggagaggaagccggtgga

SEQ ID NO: 8049208 - DNA, 22 bp, Homo sapiens
gcctggagcagacgtgtcccgg

SEQ ID NO: 8049209 - DNA, 22 bp, Homo sapiens
gcctggagcagacgtgtcccgg

SEQ ID NO: 8049210 - DNA, 22 bp, Homo sapiens
gcctggagacctgctcctctac

SEQ ID NO: 8049211 - DNA, 22 bp, Homo sapiens
gcctggagacctgctcctctac

SEQ ID NO: 8049212 - DNA, 22 bp, Homo sapiens
gcctggagacagcagaggcggc

SEQ ID NO: 8049213 - DNA, 22 bp, Homo sapiens
gcctggagagcactgtgcgctt

SEQ ID NO: 8049214 - DNA, 22 bp, Homo sapiens
gcctggagagcactgtgcgctt

SEQ ID NO: 8049215 - DNA, 22 bp, Homo sapiens
gcctggagtgcagtggcgtgat

SEQ ID NO: 8049216 - DNA, 22 bp, Homo sapiens
gcctggagcccagtgtggggct

SEQ ID NO: 8049217 - DNA, 16 bp, Homo sapiens
gcctggagtggcaggg

SEQ ID NO: 8049218 - DNA, 16 bp, Homo sapiens
gcctggagtggcaggg

SEQ ID NO: 8049219 - DNA, 22 bp, Homo sapiens
gcctggagtggacttggcccct

SEQ ID NO: 8049220 - DNA, 22 bp, Homo sapiens
gcctggagtgcagtggcgtgat

SEQ ID NO: 8049221 - DNA, 22 bp, Homo sapiens
gcctggagaaaggaaggtggga

SEQ ID NO: 8049222 - DNA, 22 bp, Homo sapiens
gcctggagaaaggaaggtggga

SEQ ID NO: 8049223 - DNA, 22 bp, Homo sapiens
gcctggagaattaaaaggaagg

SEQ ID NO: 8049224 - DNA, 22 bp, Homo sapiens
gcctggagaagatggaactagc

SEQ ID NO: 8049225 - DNA, 22 bp, Homo sapiens
gcctggagaattaaaaggaagg

SEQ ID NO: 8049226 - DNA, 22 bp, Homo sapiens
gcctggagacaaggacaaaggg

SEQ ID NO: 8049227 - DNA, 22 bp, Homo sapiens
gcctggagacagcagaggcggc

SEQ ID NO: 8049228 - DNA, 22 bp, Homo sapiens
gcctggagacaaggacaaaggg

SEQ ID NO: 8049229 - DNA, 23 bp, Homo sapiens
gcctggagaaaagctgcagttca

SEQ ID NO: 8049230 - DNA, 23 bp, Homo sapiens
gcctggagaaaagctgcagttca

SEQ ID NO: 8049231 - DNA, 22 bp, Homo sapiens
gcctgcagttctgtgctaggca

SEQ ID NO: 8049232 - DNA, 22 bp, Homo sapiens
gcctgcagggtgatgggctgcc

SEQ ID NO: 8049233 - DNA, 20 bp, Homo sapiens
gcctgcaggttggatgggat

SEQ ID NO: 8049234 - DNA, 22 bp, Homo sapiens
gcctgcagtgagtgcagaaggt

SEQ ID NO: 8049235 - DNA, 22 bp, Homo sapiens
gcccaaggtcacacacaggaag

SEQ ID NO: 8049236 - DNA, 22 bp, Homo sapiens
gcccaaggtatatcagagacag

SEQ ID NO: 8049237 - DNA, 22 bp, Homo sapiens
gccaggctctcagtgactgccc

SEQ ID NO: 8049238 - DNA, 22 bp, Homo sapiens
gcccaaagtcactcagctagga

SEQ ID NO: 8049239 - DNA, 22 bp, Homo sapiens
gccaggctaagaaaggtgtgat

SEQ ID NO: 8049240 - DNA, 22 bp, Homo sapiens
gccaggctaagaaaggtgtgat

SEQ ID NO: 8049241 - DNA, 23 bp, Homo sapiens
gccaggctccggtctgtggccac

SEQ ID NO: 8049242 - DNA, 23 bp, Homo sapiens
gccaggctccggtctgtggccac

SEQ ID NO: 8049243 - DNA, 22 bp, Homo sapiens
gccaggctccccggatccctgg

SEQ ID NO: 8049244 - DNA, 17 bp, Homo sapiens
gccagcttgagggccat

SEQ ID NO: 8049245 - DNA, 22 bp, Homo sapiens
gccagcttggcatgtgaggagt

SEQ ID NO: 8049246 - DNA, 22 bp, Homo sapiens
gccagcttcccatctggcttcc

SEQ ID NO: 8049247 - DNA, 22 bp, Homo sapiens
gccagcttccatggccacgtca

SEQ ID NO: 8049248 - DNA, 23 bp, Homo sapiens
gccagctttggtctgtctcctag

SEQ ID NO: 8049249 - DNA, 22 bp, Homo sapiens
gccagcttggccagtggccagt

SEQ ID NO: 8049250 - DNA, 22 bp, Homo sapiens
gccagctgtttcagagcccagt

SEQ ID NO: 8049251 - DNA, 22 bp, Homo sapiens
gcagttggcagggagcccagat

SEQ ID NO: 8049252 - DNA, 18 bp, Homo sapiens
gcaggtgccactgctgtt

SEQ ID NO: 8049253 - DNA, 22 bp, Homo sapiens
gcaggtggaagcagcagactca

SEQ ID NO: 8049254 - DNA, 22 bp, Homo sapiens
gcaggtggaagcagcagactca

SEQ ID NO: 8049255 - DNA, 22 bp, Homo sapiens
gcagtttctgaatttatccaag

SEQ ID NO: 8049256 - DNA, 22 bp, Homo sapiens
gcattgaatcctatcaggcaaa

SEQ ID NO: 8049257 - DNA, 22 bp, Homo sapiens
gcattctttgaatgcttctaat

SEQ ID NO: 8049258 - DNA, 22 bp, Homo sapiens
gcattgcaggtgtacccagtta

SEQ ID NO: 8049259 - DNA, 22 bp, Homo sapiens
gcattgcaagggaaatagctgc

SEQ ID NO: 8049260 - DNA, 22 bp, Homo sapiens
gcattgatctgtatgcattaag

SEQ ID NO: 8049261 - DNA, 22 bp, Homo sapiens
gcattgttgaaaggaatgggct

SEQ ID NO: 8049262 - DNA, 22 bp, Homo sapiens
gcattgtttcagtccactgtag

SEQ ID NO: 8049263 - DNA, 22 bp, Homo sapiens
gccacctgtttcagatgtggtt

SEQ ID NO: 8049264 - DNA, 22 bp, Homo sapiens
gccacctgtaagccattaggcc

SEQ ID NO: 8049265 - DNA, 22 bp, Homo sapiens
gccacctggactcagagccagg

SEQ ID NO: 8049266 - DNA, 22 bp, Homo sapiens
gccacctgcgggccgtggtgga

SEQ ID NO: 8049267 - DNA, 22 bp, Homo sapiens
gccacctcccaggacgaggctg

SEQ ID NO: 8049268 - DNA, 21 bp, Homo sapiens
gccacctcgtctcggagcagc

SEQ ID NO: 8049269 - DNA, 22 bp, Homo sapiens
gccacctctagcaaagctcagc

SEQ ID NO: 8049270 - DNA, 22 bp, Homo sapiens
gccacctctttgtctctgccgc

SEQ ID NO: 8049271 - DNA, 22 bp, Homo sapiens
tcccagccttatctcccctggc

SEQ ID NO: 8049272 - DNA, 22 bp, Homo sapiens
tcccagcctggaccctgccagt

SEQ ID NO: 8049273 - DNA, 22 bp, Homo sapiens
tcccaggccataaaactcagag

SEQ ID NO: 8049274 - DNA, 22 bp, Homo sapiens
tcccaggccataaaactcagag

SEQ ID NO: 8049275 - DNA, 22 bp, Homo sapiens
tcccagcattaatgcctgtcag

SEQ ID NO: 8049276 - DNA, 22 bp, Homo sapiens
tcccagccacaggtgtagccct

SEQ ID NO: 8049277 - DNA, 22 bp, Homo sapiens
tcccagccggtgcctgggtccc

SEQ ID NO: 8049278 - DNA, 22 bp, Homo sapiens
tccatggagtttttatttggta

SEQ ID NO: 8049279 - DNA, 22 bp, Homo sapiens
tccattgctcaatatagagttt

SEQ ID NO: 8049280 - DNA, 22 bp, Homo sapiens
tccagggctgggttggctcagc

SEQ ID NO: 8049281 - DNA, 19 bp, Homo sapiens
tccaggtggagagacaccc

SEQ ID NO: 8049282 - DNA, 22 bp, Homo sapiens
tccaggtgccggggactgaggc

SEQ ID NO: 8049283 - DNA, 22 bp, Homo sapiens
tccaggtgagtgcaggtgcaga

SEQ ID NO: 8049284 - DNA, 22 bp, Homo sapiens
tccaggcctttgcacatgttgt

SEQ ID NO: 8049285 - DNA, 22 bp, Homo sapiens
tccaggccttgacaggtcagtt

SEQ ID NO: 8049286 - DNA, 22 bp, Homo sapiens
tccaggcctgcaatgacaaagc

SEQ ID NO: 8049287 - DNA, 22 bp, Homo sapiens
tcctcagacaccctgctggctt

SEQ ID NO: 8049288 - DNA, 22 bp, Homo sapiens
tcccaggctggcaggcagcagt

SEQ ID NO: 8049289 - DNA, 20 bp, Homo sapiens
tcccaggctgggctccagct

SEQ ID NO: 8049290 - DNA, 22 bp, Homo sapiens
tcccaggctaggcctctgcgtt

SEQ ID NO: 8049291 - DNA, 20 bp, Homo sapiens
tcccaggctccaccctagac

SEQ ID NO: 8049292 - DNA, 20 bp, Homo sapiens
tcccaggctccaccctagac

SEQ ID NO: 8049293 - DNA, 22 bp, Homo sapiens
tcccaggctggggccaggtgac

SEQ ID NO: 8049294 - DNA, 23 bp, Homo sapiens
tcccagggaaggtgagcgaggct

SEQ ID NO: 8049295 - DNA, 22 bp, Homo sapiens
tccctctgggctggagcagggt

SEQ ID NO: 8049296 - DNA, 22 bp, Homo sapiens
tccctctgggctccagcacgga

SEQ ID NO: 8049297 - DNA, 22 bp, Homo sapiens
tccctgaatctcgaactagcct

SEQ ID NO: 8049298 - DNA, 22 bp, Homo sapiens
tccctgaagccagggaaggaag

SEQ ID NO: 8049299 - DNA, 22 bp, Homo sapiens
tccctgaaccactagtgatgag

SEQ ID NO: 8049300 - DNA, 22 bp, Homo sapiens
tccctctgtgttgggcatgcct

SEQ ID NO: 8049301 - DNA, 22 bp, Homo sapiens
tccctgaaacatctctgtggat

SEQ ID NO: 8049302 - DNA, 22 bp, Homo sapiens
tcctcttcaaaaggatttcctt

SEQ ID NO: 8049303 - DNA, 22 bp, Homo sapiens
tcctgagccctactctagacga

SEQ ID NO: 8049304 - DNA, 22 bp, Homo sapiens
tcctgagcaacacagctaagtg

SEQ ID NO: 8049305 - DNA, 22 bp, Homo sapiens
tcctgagatgagacagtgctgc

SEQ ID NO: 8049306 - DNA, 22 bp, Homo sapiens
tcctgcagccttgggctggagc

SEQ ID NO: 8049307 - DNA, 22 bp, Homo sapiens
tcctgcagccattagaggtcaa

SEQ ID NO: 8049308 - DNA, 22 bp, Homo sapiens
tcctgcagagccgccctcaggt

SEQ ID NO: 8049309 - DNA, 22 bp, Homo sapiens
tcctgcagagtcccactgattt

SEQ ID NO: 8049310 - DNA, 23 bp, Homo sapiens
tcctgcagataagctggttgaca

SEQ ID NO: 8049311 - DNA, 22 bp, Homo sapiens
tcctgcagacctcagtcaggtc

SEQ ID NO: 8049312 - DNA, 22 bp, Homo sapiens
tcctgcagagacagaggcctca

SEQ ID NO: 8049313 - DNA, 19 bp, Homo sapiens
tcctgcagaccagacctgt

SEQ ID NO: 8049314 - DNA, 22 bp, Homo sapiens
tcctgcagacatttacaccttt

SEQ ID NO: 8049315 - DNA, 21 bp, Homo sapiens
tcctgcagaatgccttcctac

SEQ ID NO: 8049316 - DNA, 22 bp, Homo sapiens
tcctgcagctgaagctcatgtg

SEQ ID NO: 8049317 - DNA, 22 bp, Homo sapiens
tcctgcagctctgagaagcatc

SEQ ID NO: 8049318 - DNA, 22 bp, Homo sapiens
tcctgcaggccagaggggtgag

SEQ ID NO: 8049319 - DNA, 21 bp, Homo sapiens
tcctgcaggaggcctgagagg

SEQ ID NO: 8049320 - DNA, 21 bp, Homo sapiens
tcctgcagggcagcagagtgg

SEQ ID NO: 8049321 - DNA, 19 bp, Homo sapiens
tcctgcaggtggcttgcag

SEQ ID NO: 8049322 - DNA, 22 bp, Homo sapiens
tcctgcaggggctgaggaacca

SEQ ID NO: 8049323 - DNA, 20 bp, Homo sapiens
tcctgcagtcgctagcgccc

SEQ ID NO: 8049324 - DNA, 22 bp, Homo sapiens
tcctgcagtctgcactctgcct

SEQ ID NO: 8049325 - DNA, 22 bp, Homo sapiens
tcagtattcctggaaatacaag

SEQ ID NO: 8049326 - DNA, 22 bp, Homo sapiens
tcagtcctccacacaggcaccc

SEQ ID NO: 8049327 - DNA, 22 bp, Homo sapiens
tcagtcctccacacaggcaccc

SEQ ID NO: 8049328 - DNA, 22 bp, Homo sapiens
tcagtcctgatgacaggcccaa

SEQ ID NO: 8049329 - DNA, 22 bp, Homo sapiens
tcagtcctgggccggcatcctc

SEQ ID NO: 8049330 - DNA, 22 bp, Homo sapiens
tcagtcctgatgacaggcccaa

SEQ ID NO: 8049331 - DNA, 22 bp, Homo sapiens
tcagtgttggtcaagaatcagt

SEQ ID NO: 8049332 - DNA, 22 bp, Homo sapiens
tcagtgttttaactgtctttta

SEQ ID NO: 8049333 - DNA, 18 bp, Homo sapiens
tcatagaagtgaatcaga

SEQ ID NO: 8049334 - DNA, 22 bp, Homo sapiens
tcagggcaggacagtgtaggcc

SEQ ID NO: 8049335 - DNA, 22 bp, Homo sapiens
tcagggcaggcgagcagctgct

SEQ ID NO: 8049336 - DNA, 22 bp, Homo sapiens
tcagggcaggttaacttgggtg

SEQ ID NO: 8049337 - DNA, 21 bp, Homo sapiens
tcagggcagtgggaggttcct

SEQ ID NO: 8049338 - DNA, 19 bp, Homo sapiens
tcagggcagtccggtcccc

SEQ ID NO: 8049339 - DNA, 22 bp, Homo sapiens
tcaggctgtatatcttgcactc

SEQ ID NO: 8049340 - DNA, 22 bp, Homo sapiens
tcagggctcagcatctggcatt

SEQ ID NO: 8049341 - DNA, 22 bp, Homo sapiens
tcagggctgcagaagaggcagg

SEQ ID NO: 8049342 - DNA, 22 bp, Homo sapiens
tcagggctgcatacaggagata

SEQ ID NO: 8049343 - DNA, 22 bp, Homo sapiens
tcagggcatggctgcacttggc

SEQ ID NO: 8049344 - DNA, 22 bp, Homo sapiens
tcagggcatctcttaagtggtg

SEQ ID NO: 8049345 - DNA, 22 bp, Homo sapiens
tcagggcatccattgcctgttg

SEQ ID NO: 8049346 - DNA, 22 bp, Homo sapiens
tcagggcatcatcatgaatata

SEQ ID NO: 8049347 - DNA, 22 bp, Homo sapiens
tcagggcatactcttcaaggtc

SEQ ID NO: 8049348 - DNA, 22 bp, Homo sapiens
tcagtacagcttagtcttctca

SEQ ID NO: 8049349 - DNA, 22 bp, Homo sapiens
tcagtacacttcagtatttgtg

SEQ ID NO: 8049350 - DNA, 22 bp, Homo sapiens
tcagtacaaaggtgctctcaag

SEQ ID NO: 8049351 - DNA, 22 bp, Homo sapiens
tccaatcatgagtctatactag

SEQ ID NO: 8049352 - DNA, 22 bp, Homo sapiens
tccaaagcatctgagtgtgcat

SEQ ID NO: 8049353 - DNA, 22 bp, Homo sapiens
tcattttttgcatacctgtgtc

SEQ ID NO: 8049354 - DNA, 21 bp, Homo sapiens
tcatttttattgctaccttgc

SEQ ID NO: 8049355 - DNA, 22 bp, Homo sapiens
tcatttcaatgatactactaag

SEQ ID NO: 8049356 - DNA, 22 bp, Homo sapiens
tcatttcttaactagagtgaac

SEQ ID NO: 8049357 - DNA, 22 bp, Homo sapiens
tcattgttgcgttaatgtcttc

SEQ ID NO: 8049358 - DNA, 22 bp, Homo sapiens
tcattgttgacataccaagagc

SEQ ID NO: 8049359 - DNA, 22 bp, Homo sapiens
tcattgtttctgcttttcatga

SEQ ID NO: 8049360 - DNA, 22 bp, Homo sapiens
tcattgttttgattccttcatg

SEQ ID NO: 8049361 - DNA, 22 bp, Homo sapiens
tcatttatattgtattctgtag

SEQ ID NO: 8049362 - DNA, 22 bp, Homo sapiens
tcattgttaattgtatgatctg

SEQ ID NO: 8049363 - DNA, 22 bp, Homo sapiens
tcattgttaactcccagattca

SEQ ID NO: 8049364 - DNA, 22 bp, Homo sapiens
tcacataaattatacaatttca

SEQ ID NO: 8049365 - DNA, 22 bp, Homo sapiens
tcacataaatttaccagatgat

SEQ ID NO: 8049366 - DNA, 23 bp, Homo sapiens
tcacataatccttcatccacagg

SEQ ID NO: 8049367 - DNA, 22 bp, Homo sapiens
tcacatacactaggatattttt

SEQ ID NO: 8049368 - DNA, 22 bp, Homo sapiens
tcacagtgacagccaatgtttt

SEQ ID NO: 8049369 - DNA, 22 bp, Homo sapiens
tcacagtgataactaagtcctg

SEQ ID NO: 8049370 - DNA, 19 bp, Homo sapiens
tcacagtgcagaaccctcc

SEQ ID NO: 8049371 - DNA, 22 bp, Homo sapiens
tcacatactgaaagtccagtga

SEQ ID NO: 8049372 - DNA, 22 bp, Homo sapiens
tcaacagacatttttaagcact

SEQ ID NO: 8049373 - DNA, 22 bp, Homo sapiens
tcaacatataggcaacctgtaa

SEQ ID NO: 8049374 - DNA, 22 bp, Homo sapiens
tcaagaaactgtgctacagagt

SEQ ID NO: 8049375 - DNA, 22 bp, Homo sapiens
tcacagtgacttacagagattg

SEQ ID NO: 8049376 - DNA, 22 bp, Homo sapiens
tcactgcgcttcagcctgggtg

SEQ ID NO: 8049377 - DNA, 22 bp, Homo sapiens
tcactgcaacctccacctcctg

SEQ ID NO: 8049378 - DNA, 23 bp, Homo sapiens
tcactgctactcagcctgagatt

SEQ ID NO: 8049379 - DNA, 22 bp, Homo sapiens
tcactgcaacctccacctcccg

SEQ ID NO: 8049380 - DNA, 20 bp, Homo sapiens
tcagaagtttcctggagcat

SEQ ID NO: 8049381 - DNA, 22 bp, Homo sapiens
tcagatttcctgttgaagaagt

SEQ ID NO: 8049382 - DNA, 22 bp, Homo sapiens
tcagaattggacaatagaagca

SEQ ID NO: 8049383 - DNA, 22 bp, Homo sapiens
tcagacagattttgacacttgc

SEQ ID NO: 8049384 - DNA, 22 bp, Homo sapiens
tcagacagaggagctcgtgcag

SEQ ID NO: 8049385 - DNA, 22 bp, Homo sapiens
tcagacaagttgatgtacctgg

SEQ ID NO: 8049386 - DNA, 22 bp, Homo sapiens
tcagacagaaagatgagtatgg

SEQ ID NO: 8049387 - DNA, 22 bp, Homo sapiens
tcagacagaaggactatttgaa

SEQ ID NO: 8049388 - DNA, 22 bp, Homo sapiens
tcagacagagaagtacaatgag

SEQ ID NO: 8049389 - DNA, 22 bp, Homo sapiens
tcagacagagaagtacaatgag

SEQ ID NO: 8049390 - DNA, 17 bp, Homo sapiens
tcagcaggggccaagct

SEQ ID NO: 8049391 - DNA, 22 bp, Homo sapiens
tcagcaggggccgttgggtgga

SEQ ID NO: 8049392 - DNA, 22 bp, Homo sapiens
tcagcagggctgggagctgtga

SEQ ID NO: 8049393 - DNA, 22 bp, Homo sapiens
tcagcagggctgtggtgtggct

SEQ ID NO: 8049394 - DNA, 22 bp, Homo sapiens
tcagcagggcatactgagccta

SEQ ID NO: 8049395 - DNA, 22 bp, Homo sapiens
tcagcagggccatgctctctct

SEQ ID NO: 8049396 - DNA, 22 bp, Homo sapiens
tcagcagggcctccttgtgcag

SEQ ID NO: 8049397 - DNA, 22 bp, Homo sapiens
tcagcagggcctccttgtgcag

SEQ ID NO: 8049398 - DNA, 22 bp, Homo sapiens
tcagcagggagaggagaatgca

SEQ ID NO: 8049399 - DNA, 22 bp, Homo sapiens
tcagcagggcatactgagccta

SEQ ID NO: 8049400 - DNA, 22 bp, Homo sapiens
tcagcagggaggctctgtgccc

SEQ ID NO: 8049401 - DNA, 22 bp, Homo sapiens
tcagcaggcccatcctccaggc

SEQ ID NO: 8049402 - DNA, 22 bp, Homo sapiens
tcagcaggcagtgggtcacaat

SEQ ID NO: 8049403 - DNA, 22 bp, Homo sapiens
tcagcaggcggttccttgtggg

SEQ ID NO: 8049404 - DNA, 22 bp, Homo sapiens
tcagcaggctctggttgaccat

SEQ ID NO: 8049405 - DNA, 22 bp, Homo sapiens
tcagcaggctgtcagcaggggc

SEQ ID NO: 8049406 - DNA, 22 bp, Homo sapiens
tcagcaggctgtcagcaggggc

SEQ ID NO: 8049407 - DNA, 22 bp, Homo sapiens
tcagcaaaggcaattcattatt

SEQ ID NO: 8049408 - DNA, 22 bp, Homo sapiens
tcagcaggcaggaggcatgcca

SEQ ID NO: 8049409 - DNA, 22 bp, Homo sapiens
tcagcaggcaggaggcatgcca

SEQ ID NO: 8049410 - DNA, 22 bp, Homo sapiens
tcagctctgcctgtggaggcac

SEQ ID NO: 8049411 - DNA, 22 bp, Homo sapiens
tcagccaggccaggcattcaca

SEQ ID NO: 8049412 - DNA, 19 bp, Homo sapiens
tcagctctggggtcagtgg

SEQ ID NO: 8049413 - DNA, 22 bp, Homo sapiens
tcagccaggccaccttcagctt

SEQ ID NO: 8049414 - DNA, 22 bp, Homo sapiens
tcagccaggccaccttcagctt

SEQ ID NO: 8049415 - DNA, 22 bp, Homo sapiens
tcagccaggcagccccctggtc

SEQ ID NO: 8049416 - DNA, 22 bp, Homo sapiens
tcagccaggcagccccctggtc

SEQ ID NO: 8049417 - DNA, 22 bp, Homo sapiens
tcagccaggcacaatggcagct

SEQ ID NO: 8049418 - DNA, 22 bp, Homo sapiens
tcagccaggcacaatggcagct

SEQ ID NO: 8049419 - DNA, 22 bp, Homo sapiens
tcagccagctgtgtgcttctgc

SEQ ID NO: 8049420 - DNA, 22 bp, Homo sapiens
tcagccagctgtgtgcttctgc

SEQ ID NO: 8049421 - DNA, 22 bp, Homo sapiens
tcagccagctcttggactctga

SEQ ID NO: 8049422 - DNA, 20 bp, Homo sapiens
tcagccagctaacatgggga

SEQ ID NO: 8049423 - DNA, 20 bp, Homo sapiens
tcagccagctaacatgggga

SEQ ID NO: 8049424 - DNA, 20 bp, Homo sapiens
tcagccagctaacatgggga

SEQ ID NO: 8049425 - DNA, 22 bp, Homo sapiens
tcagctgctcaaatttatgtca

SEQ ID NO: 8049426 - DNA, 22 bp, Homo sapiens
tcagccagccagctacaggctt

SEQ ID NO: 8049427 - DNA, 22 bp, Homo sapiens
tcagccagccagctacaggctt

SEQ ID NO: 8049428 - DNA, 22 bp, Homo sapiens
tcagccagcatcagctaagtgc

SEQ ID NO: 8049429 - DNA, 22 bp, Homo sapiens
tcagccagcatcagctaagtgc

SEQ ID NO: 8049430 - DNA, 22 bp, Homo sapiens
tcagccagcattacccctgact

SEQ ID NO: 8049431 - DNA, 22 bp, Homo sapiens
tcagccagaggtggatgagtca

SEQ ID NO: 8049432 - DNA, 22 bp, Homo sapiens
tcagccagagggggcaaaggaa

SEQ ID NO: 8049433 - DNA, 22 bp, Homo sapiens
tcagccagagggggcaaaggaa

SEQ ID NO: 8049434 - DNA, 22 bp, Homo sapiens
tcagccagaaagtgattttcag

SEQ ID NO: 8049435 - DNA, 22 bp, Homo sapiens
tcagccagaggcttcttggttt

SEQ ID NO: 8049436 - DNA, 22 bp, Homo sapiens
tcagccagaggcttcttggttt

SEQ ID NO: 8049437 - DNA, 20 bp, Homo sapiens
tcagcatgctcctcagacat

SEQ ID NO: 8049438 - DNA, 22 bp, Homo sapiens
tcagctggtgaatggactcatc

SEQ ID NO: 8049439 - DNA, 22 bp, Homo sapiens
tcaggacaacaagacttgttta

SEQ ID NO: 8049440 - DNA, 22 bp, Homo sapiens
tcaggacagaaggctgccaggg

SEQ ID NO: 8049441 - DNA, 22 bp, Homo sapiens
tcaggacagactagactagcgt

SEQ ID NO: 8049442 - DNA, 22 bp, Homo sapiens
tcaggacaccctgtgcttcctt

SEQ ID NO: 8049443 - DNA, 22 bp, Homo sapiens
tcaggacaacatgttgctaatc

SEQ ID NO: 8049444 - DNA, 22 bp, Homo sapiens
tcaggacaacctgttttcagac

SEQ ID NO: 8049445 - DNA, 22 bp, Homo sapiens
tcaggacaatagtgatttttac

SEQ ID NO: 8049446 - DNA, 22 bp, Homo sapiens
tcaggacagccagggtgcagac

SEQ ID NO: 8049447 - DNA, 22 bp, Homo sapiens
tcaggacagagatcagaacttc

SEQ ID NO: 8049448 - DNA, 22 bp, Homo sapiens
tcaggacatttgtcagcaggag

SEQ ID NO: 8049449 - DNA, 22 bp, Homo sapiens
taaaacttctcatttttatggt

SEQ ID NO: 8049450 - DNA, 22 bp, Homo sapiens
taaaaggaggttgaagctgtca

SEQ ID NO: 8049451 - DNA, 22 bp, Homo sapiens
taaaaggattagcaggatgggc

SEQ ID NO: 8049452 - DNA, 22 bp, Homo sapiens
taaagcaattactcagtggctt

SEQ ID NO: 8049453 - DNA, 22 bp, Homo sapiens
taaatgtggagactcaggagtc

SEQ ID NO: 8049454 - DNA, 22 bp, Homo sapiens
taacagtaccattaactttgat

SEQ ID NO: 8049455 - DNA, 22 bp, Homo sapiens
taagacatgtccaggctgtgag

SEQ ID NO: 8049456 - DNA, 19 bp, Homo sapiens
gttcttttcacctctgtgc

SEQ ID NO: 8049457 - DNA, 22 bp, Homo sapiens
gttcttttggtagagtgtgcat

SEQ ID NO: 8049458 - DNA, 22 bp, Homo sapiens
gtttatgaatgttactatagag

SEQ ID NO: 8049459 - DNA, 22 bp, Homo sapiens
gtttatgaatgtgtcagacata

SEQ ID NO: 8049460 - DNA, 22 bp, Homo sapiens
gtttatgaggaaaagttatgat

SEQ ID NO: 8049461 - DNA, 22 bp, Homo sapiens
gtttgattcaagaacaaagagt

SEQ ID NO: 8049462 - DNA, 22 bp, Homo sapiens
gtttgaaagtggcaagtccttg

SEQ ID NO: 8049463 - DNA, 22 bp, Homo sapiens
gtttgaaagaccaattagattt

SEQ ID NO: 8049464 - DNA, 22 bp, Homo sapiens
gtttcttttaaaatatgtagac

SEQ ID NO: 8049465 - DNA, 22 bp, Homo sapiens
gtttgaaaaaagcagtatgtaa

SEQ ID NO: 8049466 - DNA, 22 bp, Homo sapiens
gttatttaactttgtagcatgg

SEQ ID NO: 8049467 - DNA, 22 bp, Homo sapiens
gttatttataaggtgtaactcc

SEQ ID NO: 8049468 - DNA, 22 bp, Homo sapiens
gtgctggctggggcatcaggca

SEQ ID NO: 8049469 - DNA, 21 bp, Homo sapiens
gtgctgggacacagccaggct

SEQ ID NO: 8049470 - DNA, 22 bp, Homo sapiens
gtgctggctggacatggagcac

SEQ ID NO: 8049471 - DNA, 17 bp, Homo sapiens
gtgctggcctggggctc

SEQ ID NO: 8049472 - DNA, 22 bp, Homo sapiens
gtgttattagagcattaatttt

SEQ ID NO: 8049473 - DNA, 22 bp, Homo sapiens
gtgttctttatttagtgatgct

SEQ ID NO: 8049474 - DNA, 22 bp, Homo sapiens
tacacataggtctgaataaaaa

SEQ ID NO: 8049475 - DNA, 22 bp, Homo sapiens
tacacataggagggtaataaaa

SEQ ID NO: 8049476 - DNA, 22 bp, Homo sapiens
tacagacagtttttcagatatt

SEQ ID NO: 8049477 - DNA, 22 bp, Homo sapiens
tacagacagtttttcagatatt

SEQ ID NO: 8049478 - DNA, 22 bp, Homo sapiens
tacagacaaagtgctatagggt

SEQ ID NO: 8049479 - DNA, 22 bp, Homo sapiens
tacagacaaagtgctatagggt

SEQ ID NO: 8049480 - DNA, 22 bp, Homo sapiens
tacagacagacttcccaccctc

SEQ ID NO: 8049481 - DNA, 22 bp, Homo sapiens
tacagacaaagagcatgcggta

SEQ ID NO: 8049482 - DNA, 22 bp, Homo sapiens
tacagacaaagagcatgcggta

SEQ ID NO: 8049483 - DNA, 22 bp, Homo sapiens
tacagaatgtgtatcattacca

SEQ ID NO: 8049484 - DNA, 22 bp, Homo sapiens
tacacacatgcatttgccttat

SEQ ID NO: 8049485 - DNA, 22 bp, Homo sapiens
tacacacttactggagatgaag

SEQ ID NO: 8049486 - DNA, 22 bp, Homo sapiens
tacacacagaggccatgggatt

SEQ ID NO: 8049487 - DNA, 22 bp, Homo sapiens
taatttatttcaactgccaagg

SEQ ID NO: 8049488 - DNA, 22 bp, Homo sapiens
tacacaactgacaaccattctg

SEQ ID NO: 8049489 - DNA, 22 bp, Homo sapiens
taatatatacctttgttaggaa

SEQ ID NO: 8049490 - DNA, 22 bp, Homo sapiens
taatatacttcccatagtttga

SEQ ID NO: 8049491 - DNA, 22 bp, Homo sapiens
taatataccaaactgtaatttt

SEQ ID NO: 8049492 - DNA, 22 bp, Homo sapiens
taaggagagaatttagaggttt

SEQ ID NO: 8049493 - DNA, 22 bp, Homo sapiens
taaggaaagtgccatgatttct

SEQ ID NO: 8049494 - DNA, 22 bp, Homo sapiens
taaggaaacaacttgtattttt

SEQ ID NO: 8049495 - DNA, 22 bp, Homo sapiens
taatttatgatgcaaagaaaag

SEQ ID NO: 8049496 - DNA, 22 bp, Homo sapiens
taattgaactaacatgcaaaca

SEQ ID NO: 8049497 - DNA, 22 bp, Homo sapiens
taatcgtatgtgtatcaaatca

SEQ ID NO: 8049498 - DNA, 22 bp, Homo sapiens
tacagtatttgaagaatatgag

SEQ ID NO: 8049499 - DNA, 18 bp, Homo sapiens
tacagtattttctcgcct

SEQ ID NO: 8049500 - DNA, 22 bp, Homo sapiens
tacagacattcaattttgaccc

SEQ ID NO: 8049501 - DNA, 20 bp, Homo sapiens
tacagacatgacaataatgg

SEQ ID NO: 8049502 - DNA, 20 bp, Homo sapiens
tacagacatgacaataatgg

SEQ ID NO: 8049503 - DNA, 22 bp, Homo sapiens
tacagtattactgtgttgtttt

SEQ ID NO: 8049504 - DNA, 22 bp, Homo sapiens
tacagtattatgagtgattgaa

SEQ ID NO: 8049505 - DNA, 22 bp, Homo sapiens
tacagtatatactgtgtgtaga

SEQ ID NO: 8049506 - DNA, 22 bp, Homo sapiens
tacagtatagaatgtgtattaa

SEQ ID NO: 8049507 - DNA, 22 bp, Homo sapiens
tacatgtatgtgttaatatctg

SEQ ID NO: 8049508 - DNA, 22 bp, Homo sapiens
tactgaaagaatacataatttc

SEQ ID NO: 8049509 - DNA, 22 bp, Homo sapiens
taccagaatcattttatgttgg

SEQ ID NO: 8049510 - DNA, 22 bp, Homo sapiens
taccagggaacagggatattaa

SEQ ID NO: 8049511 - DNA, 22 bp, Homo sapiens
taccagggaacagggatattaa

SEQ ID NO: 8049512 - DNA, 22 bp, Homo sapiens
tactagtttctaccttacagaa

SEQ ID NO: 8049513 - DNA, 20 bp, Homo sapiens
tatgaagatatgtgaacagc

SEQ ID NO: 8049514 - DNA, 22 bp, Homo sapiens
tatgaatataccacaatttagg

SEQ ID NO: 8049515 - DNA, 22 bp, Homo sapiens
tatgaaaatttagctgaagcat

SEQ ID NO: 8049516 - DNA, 22 bp, Homo sapiens
tatcatttagagtatttcttca

SEQ ID NO: 8049517 - DNA, 21 bp, Homo sapiens
tattaatatgtctaagctgat

SEQ ID NO: 8049518 - DNA, 22 bp, Homo sapiens
tatggtcaaagatatgaagccc

SEQ ID NO: 8049519 - DNA, 22 bp, Homo sapiens
tatgtaaagtagatggcaggta

SEQ ID NO: 8049520 - DNA, 22 bp, Homo sapiens
tattgtttctggctgtggcagc

SEQ ID NO: 8049521 - DNA, 22 bp, Homo sapiens
tattttctggacagtcttgctt

SEQ ID NO: 8049522 - DNA, 22 bp, Homo sapiens
tatttaattagtgattgtagag

SEQ ID NO: 8049523 - DNA, 22 bp, Homo sapiens
tatttgaaggcatacattttga

SEQ ID NO: 8049524 - DNA, 22 bp, Homo sapiens
tatttgaagggagaaagtgcca

SEQ ID NO: 8049525 - DNA, 22 bp, Homo sapiens
tatttgaataaaggataaggaa

SEQ ID NO: 8049526 - DNA, 22 bp, Homo sapiens
tcaaagaagtgcaaacctcatc

SEQ ID NO: 8049527 - DNA, 22 bp, Homo sapiens
tcaaacttggtaagagaaatac

SEQ ID NO: 8049528 - DNA, 22 bp, Homo sapiens
tattttgtaattggtcatagct

SEQ ID NO: 8049529 - DNA, 22 bp, Homo sapiens
tattttgagcccctgacatcta

SEQ ID NO: 8049530 - DNA, 22 bp, Homo sapiens
tattttgttaataatccagtcc

SEQ ID NO: 8049531 - DNA, 22 bp, Homo sapiens
tattttgttttgtatccactgt

SEQ ID NO: 8049532 - DNA, 22 bp, Homo sapiens
tattttgtatttatgcaagaaa

SEQ ID NO: 8049533 - DNA, 22 bp, Homo sapiens
tatttttgcctctcagataaaa

SEQ ID NO: 8049534 - DNA, 22 bp, Homo sapiens
tcaaataccagcaatttcatgt

SEQ ID NO: 8049535 - DNA, 19 bp, Homo sapiens
tcaaaggcttttaggagac

SEQ ID NO: 8049536 - DNA, 22 bp, Homo sapiens
tcaaataatgccattcatcatc

SEQ ID NO: 8049537 - DNA, 22 bp, Homo sapiens
tcaaataatgccattcatcatc

SEQ ID NO: 8049538 - DNA, 22 bp, Homo sapiens
tagatataggacagtactgtat

SEQ ID NO: 8049539 - DNA, 22 bp, Homo sapiens
tagatataaggtccttagaaca

SEQ ID NO: 8049540 - DNA, 21 bp, Homo sapiens
tagatactgtattaaacctag

SEQ ID NO: 8049541 - DNA, 22 bp, Homo sapiens
tagagtatagctaactgtatta

SEQ ID NO: 8049542 - DNA, 22 bp, Homo sapiens
tagacaggaaacattaggatgg

SEQ ID NO: 8049543 - DNA, 22 bp, Homo sapiens
tagactagaggatcagcaaggg

SEQ ID NO: 8049544 - DNA, 22 bp, Homo sapiens
tagaagcacagcctgatggaca

SEQ ID NO: 8049545 - DNA, 22 bp, Homo sapiens
tagaagacaggaaatacaaacc

SEQ ID NO: 8049546 - DNA, 22 bp, Homo sapiens
tagaactttcagaaattccaaa

SEQ ID NO: 8049547 - DNA, 22 bp, Homo sapiens
tagcagcttccagagagggcag

SEQ ID NO: 8049548 - DNA, 19 bp, Homo sapiens
tagcagctgccaaaggaga

SEQ ID NO: 8049549 - DNA, 22 bp, Homo sapiens
tagcagctgcatcattttacag

SEQ ID NO: 8049550 - DNA, 22 bp, Homo sapiens
tagcagctggggctattcatca

SEQ ID NO: 8049551 - DNA, 22 bp, Homo sapiens
tagcagctgtgagtaaaagcca

SEQ ID NO: 8049552 - DNA, 22 bp, Homo sapiens
tagcagctgtcagtttcacata

SEQ ID NO: 8049553 - DNA, 22 bp, Homo sapiens
tagcagctgtggaggggctgtg

SEQ ID NO: 8049554 - DNA, 22 bp, Homo sapiens
tagcagcttaagtaattagaat

SEQ ID NO: 8049555 - DNA, 22 bp, Homo sapiens
tagcaggcatggagatgactgt

SEQ ID NO: 8049556 - DNA, 22 bp, Homo sapiens
tagcagctctgattctgggccc

SEQ ID NO: 8049557 - DNA, 22 bp, Homo sapiens
tagcagctctttactaaccagt

SEQ ID NO: 8049558 - DNA, 22 bp, Homo sapiens
tagcaaccagaacagcactcta

SEQ ID NO: 8049559 - DNA, 22 bp, Homo sapiens
tagatgaaatgtgtgttattat

SEQ ID NO: 8049560 - DNA, 22 bp, Homo sapiens
tagatgaaggggttcagcatgg

SEQ ID NO: 8049561 - DNA, 22 bp, Homo sapiens
tagatgaagcaacatgtgtaat

SEQ ID NO: 8049562 - DNA, 21 bp, Homo sapiens
tagcaaagccagatgtatatt

SEQ ID NO: 8049563 - DNA, 22 bp, Homo sapiens
tagttttgaggattatatgtga

SEQ ID NO: 8049564 - DNA, 22 bp, Homo sapiens
tagttttgattagtattgtctt

SEQ ID NO: 8049565 - DNA, 22 bp, Homo sapiens
tagtgcaattccccatactaac

SEQ ID NO: 8049566 - DNA, 22 bp, Homo sapiens
taggggaggggatcatgtgctg

SEQ ID NO: 8049567 - DNA, 22 bp, Homo sapiens
taggggagctcgggtgcaatcg

SEQ ID NO: 8049568 - DNA, 22 bp, Homo sapiens
tagggctgtgtctccaggacca

SEQ ID NO: 8049569 - DNA, 22 bp, Homo sapiens
tagggctggcgtgctcagggaa

SEQ ID NO: 8049570 - DNA, 22 bp, Homo sapiens
tagggctgtggtcagtcctcta

SEQ ID NO: 8049571 - DNA, 22 bp, Homo sapiens
tagggcagattcggtggagttt

SEQ ID NO: 8049572 - DNA, 22 bp, Homo sapiens
tagggcagccacccaggctgct

SEQ ID NO: 8049573 - DNA, 22 bp, Homo sapiens
tagggcagctgcatcaggcact

SEQ ID NO: 8049574 - DNA, 22 bp, Homo sapiens
tagggcagccttatagctccca

SEQ ID NO: 8049575 - DNA, 23 bp, Homo sapiens
tagggcagctgggagggacatgc

SEQ ID NO: 8049576 - DNA, 23 bp, Homo sapiens
taggccagggtgacctggggaga

SEQ ID NO: 8049577 - DNA, 19 bp, Homo sapiens
gacctggccaagttactta

SEQ ID NO: 8049578 - DNA, 22 bp, Homo sapiens
gacatgtgtctgcaagttgatc

SEQ ID NO: 8049579 - DNA, 22 bp, Homo sapiens
gacatgtgagcaagcgtgcggc

SEQ ID NO: 8049580 - DNA, 22 bp, Homo sapiens
gacatgtgctgtctcttaaatt

SEQ ID NO: 8049581 - DNA, 22 bp, Homo sapiens
gacatgtgagagctcggttttc

SEQ ID NO: 8049582 - DNA, 17 bp, Homo sapiens
gacagctgggcgcacgc

SEQ ID NO: 8049583 - DNA, 22 bp, Homo sapiens
gacatctgaggccctcagagcc

SEQ ID NO: 8049584 - DNA, 22 bp, Homo sapiens
gacagcatccaagagggaggga

SEQ ID NO: 8049585 - DNA, 22 bp, Homo sapiens
gacagcatctgtgtggcaggag

SEQ ID NO: 8049586 - DNA, 22 bp, Homo sapiens
gacagccaactggggagggcat

SEQ ID NO: 8049587 - DNA, 22 bp, Homo sapiens
gacagcattccatctgcaggtt

SEQ ID NO: 8049588 - DNA, 22 bp, Homo sapiens
gacagctgaacaggtgggataa

SEQ ID NO: 8049589 - DNA, 22 bp, Homo sapiens
gacaacagcatatggactgtca

SEQ ID NO: 8049590 - DNA, 22 bp, Homo sapiens
gacaacaataatgtggagctga

SEQ ID NO: 8049591 - DNA, 22 bp, Homo sapiens
gaatgtaagtgggcagaagaca

SEQ ID NO: 8049592 - DNA, 22 bp, Homo sapiens
gaatgctggcttacaggcagtt

SEQ ID NO: 8049593 - DNA, 22 bp, Homo sapiens
gaagaaggtgctacacagggca

SEQ ID NO: 8049594 - DNA, 22 bp, Homo sapiens
gagcacacagtgtgcctgtgta

SEQ ID NO: 8049595 - DNA, 22 bp, Homo sapiens
gagcaaagcttttagggccttt

SEQ ID NO: 8049596 - DNA, 23 bp, Homo sapiens
gagcagagcgggcgggggtcctg

SEQ ID NO: 8049597 - DNA, 19 bp, Homo sapiens
gagcagcttcctatctggt

SEQ ID NO: 8049598 - DNA, 22 bp, Homo sapiens
gagcagcttgcgctgtcttcac

SEQ ID NO: 8049599 - DNA, 22 bp, Homo sapiens
gagcaggaacagatcccttgga

SEQ ID NO: 8049600 - DNA, 22 bp, Homo sapiens
gagcaggaaggccagaagggtc

SEQ ID NO: 8049601 - DNA, 22 bp, Homo sapiens
gagcaggacgtgggaatgggaa

SEQ ID NO: 8049602 - DNA, 22 bp, Homo sapiens
gagcactgatttatttttgtct

SEQ ID NO: 8049603 - DNA, 22 bp, Homo sapiens
gagaagcaatcagcagccaccc

SEQ ID NO: 8049604 - DNA, 22 bp, Homo sapiens
gagaagcaatttccaactgtgc

SEQ ID NO: 8049605 - DNA, 22 bp, Homo sapiens
gagaagcaggtttagcagacaa

SEQ ID NO: 8049606 - DNA, 22 bp, Homo sapiens
gagaagcaatcgtgacatctcc

SEQ ID NO: 8049607 - DNA, 22 bp, Homo sapiens
gagagccatggtggagatgggg

SEQ ID NO: 8049608 - DNA, 22 bp, Homo sapiens
gagagccagcagtaaagacatt

SEQ ID NO: 8049609 - DNA, 22 bp, Homo sapiens
gagagacagcacacagtgtggg

SEQ ID NO: 8049610 - DNA, 22 bp, Homo sapiens
gagaggagtccctatcacagtt

SEQ ID NO: 8049611 - DNA, 19 bp, Homo sapiens
gaggtgtctttcctgagta

SEQ ID NO: 8049612 - DNA, 22 bp, Homo sapiens
gaggtgtctgttaggaataggc

SEQ ID NO: 8049613 - DNA, 22 bp, Homo sapiens
gaggtggcttagtctctggaca

SEQ ID NO: 8049614 - DNA, 22 bp, Homo sapiens
gaggtggctgcttgctgggaaa

SEQ ID NO: 8049615 - DNA, 22 bp, Homo sapiens
gaggtgcctggcgatgtctctg

SEQ ID NO: 8049616 - DNA, 22 bp, Homo sapiens
gaggtctgtgtcactttagtgc

SEQ ID NO: 8049617 - DNA, 22 bp, Homo sapiens
gagggtgcaggaggatggtagt

SEQ ID NO: 8049618 - DNA, 22 bp, Homo sapiens
gagggtctcttaatgccagggg

SEQ ID NO: 8049619 - DNA, 22 bp, Homo sapiens
gagggtggcctttagagcccat

SEQ ID NO: 8049620 - DNA, 22 bp, Homo sapiens
gagggtggctcctccctgggcc

SEQ ID NO: 8049621 - DNA, 22 bp, Homo sapiens
gaggtctgagtgcggaaagcct

SEQ ID NO: 8049622 - DNA, 22 bp, Homo sapiens
gagggtgggtacaccagccctc

SEQ ID NO: 8049623 - DNA, 22 bp, Homo sapiens
gagggccacgttcagggctctc

SEQ ID NO: 8049624 - DNA, 22 bp, Homo sapiens
gagggctgataaatgcgcatgg

SEQ ID NO: 8049625 - DNA, 22 bp, Homo sapiens
gagggctgaagtgttttatgag

SEQ ID NO: 8049626 - DNA, 22 bp, Homo sapiens
gagggcctctgtgggtgctcac

SEQ ID NO: 8049627 - DNA, 22 bp, Homo sapiens
gagggccagcagcctcagcatg

SEQ ID NO: 8049628 - DNA, 22 bp, Homo sapiens
gaggctcaaacctggacagagc

SEQ ID NO: 8049629 - DNA, 22 bp, Homo sapiens
gaggctggggtctgcctttctg

SEQ ID NO: 8049630 - DNA, 22 bp, Homo sapiens
gaggcctgtagtcatggatgta

SEQ ID NO: 8049631 - DNA, 22 bp, Homo sapiens
gaggcctgtcgctaggcctctg

SEQ ID NO: 8049632 - DNA, 22 bp, Homo sapiens
gaggcctggtgtgtctcccgct

SEQ ID NO: 8049633 - DNA, 22 bp, Homo sapiens
gaggcctggtgctgtgtccaca

SEQ ID NO: 8049634 - DNA, 22 bp, Homo sapiens
gaggcctggtctatgagatgtt

SEQ ID NO: 8049635 - DNA, 22 bp, Homo sapiens
gaggcctggtctatgagatgtt

SEQ ID NO: 8049636 - DNA, 22 bp, Homo sapiens
gaggcctggtttgcatgagaat

SEQ ID NO: 8049637 - DNA, 22 bp, Homo sapiens
gaggcctgtagtcatggatgta

SEQ ID NO: 8049638 - DNA, 22 bp, Homo sapiens
gaggcctggtttgcatgagaat

SEQ ID NO: 8049639 - DNA, 22 bp, Homo sapiens
gaggcctggtttccagcatcct

SEQ ID NO: 8049640 - DNA, 22 bp, Homo sapiens
gaggcctggtttccagcatcct

SEQ ID NO: 8049641 - DNA, 22 bp, Homo sapiens
gaggatggaggcagttagggcc

SEQ ID NO: 8049642 - DNA, 18 bp, Homo sapiens
gaggatggaaggagatgc

SEQ ID NO: 8049643 - DNA, 18 bp, Homo sapiens
gaggatggaaggagatgc

SEQ ID NO: 8049644 - DNA, 22 bp, Homo sapiens
gaggagtgtattccacaccact

SEQ ID NO: 8049645 - DNA, 20 bp, Homo sapiens
gaggatgcagacagagggca

SEQ ID NO: 8049646 - DNA, 22 bp, Homo sapiens
gaggagtctttttagggcctga

SEQ ID NO: 8049647 - DNA, 22 bp, Homo sapiens
gaggaggttccgggtggagaag

SEQ ID NO: 8049648 - DNA, 22 bp, Homo sapiens
gaggacagtgtgatctgccagc

SEQ ID NO: 8049649 - DNA, 22 bp, Homo sapiens
gaggacagtgtgatctgccagc

SEQ ID NO: 8049650 - DNA, 22 bp, Homo sapiens
gaggagagaacattcctccata

SEQ ID NO: 8049651 - DNA, 22 bp, Homo sapiens
gaggagagaagctaacggtgct

SEQ ID NO: 8049652 - DNA, 22 bp, Homo sapiens
gaggatggtatgaggcaagcaa

SEQ ID NO: 8049653 - DNA, 22 bp, Homo sapiens
gaggatggaggtgtgagctatg

SEQ ID NO: 8049654 - DNA, 22 bp, Homo sapiens
gaggatggtgagcaggacccag

SEQ ID NO: 8049655 - DNA, 22 bp, Homo sapiens
gaggcaacaatgatggtgtgta

SEQ ID NO: 8049656 - DNA, 22 bp, Homo sapiens
gaggcaacacatttggaaagca

SEQ ID NO: 8049657 - DNA, 22 bp, Homo sapiens
gaggcatgcagagctggagcag

SEQ ID NO: 8049658 - DNA, 22 bp, Homo sapiens
gaggcatggcctgaggctagga

SEQ ID NO: 8049659 - DNA, 22 bp, Homo sapiens
gaggccagaatgagtctctggg

SEQ ID NO: 8049660 - DNA, 22 bp, Homo sapiens
gaggccagaatgagctgaatgc

SEQ ID NO: 8049661 - DNA, 22 bp, Homo sapiens
gaggccagaagtgcctcgggct

SEQ ID NO: 8049662 - DNA, 22 bp, Homo sapiens
gaggccagaagtgcctcgggct

SEQ ID NO: 8049663 - DNA, 22 bp, Homo sapiens
gaggccacttcctactggagga

SEQ ID NO: 8049664 - DNA, 22 bp, Homo sapiens
gaggccagaagtctgagatcag

SEQ ID NO: 8049665 - DNA, 22 bp, Homo sapiens
gaggccagaagtctgagatcag

SEQ ID NO: 8049666 - DNA, 22 bp, Homo sapiens
gaggccagagttccccgagtca

SEQ ID NO: 8049667 - DNA, 22 bp, Homo sapiens
gaggccagatactctcttctgc

SEQ ID NO: 8049668 - DNA, 22 bp, Homo sapiens
gaggcctggagccgcctaggcg

SEQ ID NO: 8049669 - DNA, 22 bp, Homo sapiens
gaggcctgggttggaggtgcat

SEQ ID NO: 8049670 - DNA, 22 bp, Homo sapiens
gaggcctggaccagccacagag

SEQ ID NO: 8049671 - DNA, 22 bp, Homo sapiens
gaggcctggaccagccacagag

SEQ ID NO: 8049672 - DNA, 22 bp, Homo sapiens
gaggacaggagactcactgttt

SEQ ID NO: 8049673 - DNA, 17 bp, Homo sapiens
gaggacagggaagtagg

SEQ ID NO: 8049674 - DNA, 17 bp, Homo sapiens
gaggacagggaagtagg

SEQ ID NO: 8049675 - DNA, 22 bp, Homo sapiens
gagctgtgacacgcagcccagg

SEQ ID NO: 8049676 - DNA, 22 bp, Homo sapiens
gagctgtgattggtgtctcact

SEQ ID NO: 8049677 - DNA, 22 bp, Homo sapiens
gagctgggtatatggctttatg

SEQ ID NO: 8049678 - DNA, 22 bp, Homo sapiens
gagctgggcacacgccacttga

SEQ ID NO: 8049679 - DNA, 22 bp, Homo sapiens
gagctctaaccagggacaatta

SEQ ID NO: 8049680 - DNA, 22 bp, Homo sapiens
gagcaggcattctagtggctga

SEQ ID NO: 8049681 - DNA, 22 bp, Homo sapiens
gagcaggcattctagtggctga

SEQ ID NO: 8049682 - DNA, 22 bp, Homo sapiens
gagcaggatgggagctggggcc

SEQ ID NO: 8049683 - DNA, 22 bp, Homo sapiens
gagcaggcaactctgcagtgcc

SEQ ID NO: 8049684 - DNA, 22 bp, Homo sapiens
gagcaggcaactctgcagtgcc

SEQ ID NO: 8049685 - DNA, 22 bp, Homo sapiens
gagcaggcaaagatgaaaggag

SEQ ID NO: 8049686 - DNA, 22 bp, Homo sapiens
gagcaggcctggggtgaggcct

SEQ ID NO: 8049687 - DNA, 22 bp, Homo sapiens
gagcaggccagcaatggaaggg

SEQ ID NO: 8049688 - DNA, 22 bp, Homo sapiens
gagcaggccagcaatggaaggg

SEQ ID NO: 8049689 - DNA, 22 bp, Homo sapiens
gagcaggcctggggtgaggcct

SEQ ID NO: 8049690 - DNA, 22 bp, Homo sapiens
gagcaggctctgcctgtgtgtc

SEQ ID NO: 8049691 - DNA, 22 bp, Homo sapiens
gagctcaggagcatcagaagaa

SEQ ID NO: 8049692 - DNA, 22 bp, Homo sapiens
gagctcagcaaaggtctgtgtg

SEQ ID NO: 8049693 - DNA, 22 bp, Homo sapiens
gagctcagattctggtgtcaga

SEQ ID NO: 8049694 - DNA, 22 bp, Homo sapiens
gagctcagtgtagtcatggctt

SEQ ID NO: 8049695 - DNA, 22 bp, Homo sapiens
gagctcagggcattgagcaaga

SEQ ID NO: 8049696 - DNA, 22 bp, Homo sapiens
ctgtgaggcgggtggagtggag

SEQ ID NO: 8049697 - DNA, 22 bp, Homo sapiens
ctgtccctcagttctgggcaaa

SEQ ID NO: 8049698 - DNA, 21 bp, Homo sapiens
ctgtccccagtgagcaccccc

SEQ ID NO: 8049699 - DNA, 19 bp, Homo sapiens
ctgtgggcggaggaggggc

SEQ ID NO: 8049700 - DNA, 22 bp, Homo sapiens
ctgtgggctcctgcagctcagg

SEQ ID NO: 8049701 - DNA, 22 bp, Homo sapiens
ctgtgggcgcctgtcagcctca

SEQ ID NO: 8049702 - DNA, 20 bp, Homo sapiens
ctgtgggcctcacttggggt

SEQ ID NO: 8049703 - DNA, 22 bp, Homo sapiens
ctgtgggcctagtctggcctag

SEQ ID NO: 8049704 - DNA, 22 bp, Homo sapiens
ctgtgggcatttgagtgtgggt

SEQ ID NO: 8049705 - DNA, 22 bp, Homo sapiens
ctgtggcatttagaggttgcgt

SEQ ID NO: 8049706 - DNA, 17 bp, Homo sapiens
ctgtggccacctggatg

SEQ ID NO: 8049707 - DNA, 22 bp, Homo sapiens
ctgtgggagggaaggcgcggcc

SEQ ID NO: 8049708 - DNA, 20 bp, Homo sapiens
ctgtggcatctgtcatggtg

SEQ ID NO: 8049709 - DNA, 22 bp, Homo sapiens
ctgtggcagggaagaggccatg

SEQ ID NO: 8049710 - DNA, 22 bp, Homo sapiens
ctgtggcattgtgaggactgca

SEQ ID NO: 8049711 - DNA, 22 bp, Homo sapiens
ctgtggcattgccgaggctggc

SEQ ID NO: 8049712 - DNA, 20 bp, Homo sapiens
ctgtggcatcttgaaggagg

SEQ ID NO: 8049713 - DNA, 20 bp, Homo sapiens
ctgtggcatcttgaaggagg

SEQ ID NO: 8049714 - DNA, 22 bp, Homo sapiens
ctgtggcaagtctgcctgtcac

SEQ ID NO: 8049715 - DNA, 22 bp, Homo sapiens
ctgtggcacatgtggcaaggcc

SEQ ID NO: 8049716 - DNA, 22 bp, Homo sapiens
ctgtggcactcaagaagcctcc

SEQ ID NO: 8049717 - DNA, 22 bp, Homo sapiens
ctgtggcagaggtgacacctct

SEQ ID NO: 8049718 - DNA, 22 bp, Homo sapiens
ctgtggcaggaagggactagca

SEQ ID NO: 8049719 - DNA, 23 bp, Homo sapiens
ctgtggcaagtcctgcacctgcc

SEQ ID NO: 8049720 - DNA, 22 bp, Homo sapiens
ctgtggcaaatgatacctccca

SEQ ID NO: 8049721 - DNA, 22 bp, Homo sapiens
ctgtgggcttgaggttagacag

SEQ ID NO: 8049722 - DNA, 18 bp, Homo sapiens
ctgtgggctggtgcatga

SEQ ID NO: 8049723 - DNA, 19 bp, Homo sapiens
ctgtgggtgtgcaagggtg

SEQ ID NO: 8049724 - DNA, 22 bp, Homo sapiens
ctgtgtttctaagtaaaggagc

SEQ ID NO: 8049725 - DNA, 22 bp, Homo sapiens
ctgggtgtcaggagacatgatg

SEQ ID NO: 8049726 - DNA, 22 bp, Homo sapiens
ctggtgtggcggcgccctgtag

SEQ ID NO: 8049727 - DNA, 22 bp, Homo sapiens
ctggtgttggagcaaatgcagg

SEQ ID NO: 8049728 - DNA, 22 bp, Homo sapiens
ctggtgtgattgagcccaggtg

SEQ ID NO: 8049729 - DNA, 22 bp, Homo sapiens
ctggtgcctcctccctgtgctt

SEQ ID NO: 8049730 - DNA, 22 bp, Homo sapiens
ctggtgggtagagggcatcagg

SEQ ID NO: 8049731 - DNA, 22 bp, Homo sapiens
ctggtgggtagagggcatcagg

SEQ ID NO: 8049732 - DNA, 18 bp, Homo sapiens
ctgggctcgagagatcct

SEQ ID NO: 8049733 - DNA, 22 bp, Homo sapiens
ctgggctcctaaccatccaggt

SEQ ID NO: 8049734 - DNA, 20 bp, Homo sapiens
ctgggctcggtggccctggc

SEQ ID NO: 8049735 - DNA, 22 bp, Homo sapiens
ctgggggcagcaagaagccatg

SEQ ID NO: 8049736 - DNA, 22 bp, Homo sapiens
ctgggctctagaaaggaaagaa

SEQ ID NO: 8049737 - DNA, 22 bp, Homo sapiens
ctggggtggtgcaggcctcatg

SEQ ID NO: 8049738 - DNA, 22 bp, Homo sapiens
ctgggtggaaagtgctgagaat

SEQ ID NO: 8049739 - DNA, 22 bp, Homo sapiens
ctggggtggatgggtccaagtt

SEQ ID NO: 8049740 - DNA, 22 bp, Homo sapiens
ctgggggtgagcagcagcgacg

SEQ ID NO: 8049741 - DNA, 22 bp, Homo sapiens
ctggggggctactgacagagga

SEQ ID NO: 8049742 - DNA, 22 bp, Homo sapiens
ctggggggctactgacagagga

SEQ ID NO: 8049743 - DNA, 22 bp, Homo sapiens
ctgggcctccagctctgccagc

SEQ ID NO: 8049744 - DNA, 22 bp, Homo sapiens
ctgggcctccacgggccatcac

SEQ ID NO: 8049745 - DNA, 22 bp, Homo sapiens
ctgggcctccacgggccatcac

SEQ ID NO: 8049746 - DNA, 22 bp, Homo sapiens
ctgggctcaaatcctggccctg

SEQ ID NO: 8049747 - DNA, 22 bp, Homo sapiens
ctgggctcaagaagtcttccct

SEQ ID NO: 8049748 - DNA, 22 bp, Homo sapiens
ctgggctcagtggctcatggct

SEQ ID NO: 8049749 - DNA, 22 bp, Homo sapiens
ctgggctccactcccacagtgt

SEQ ID NO: 8049750 - DNA, 22 bp, Homo sapiens
ctgggctccctcatgtgtctgc

SEQ ID NO: 8049751 - DNA, 22 bp, Homo sapiens
ctgggctccactcccacagtgt

SEQ ID NO: 8049752 - DNA, 22 bp, Homo sapiens
ctgggctccactacttgctaac

SEQ ID NO: 8049753 - DNA, 22 bp, Homo sapiens
ctgggctccactacttgctaac

SEQ ID NO: 8049754 - DNA, 21 bp, Homo sapiens
ctgggctcatggtgttacaga

SEQ ID NO: 8049755 - DNA, 22 bp, Homo sapiens
ctgggcctagcaacagaggagt

SEQ ID NO: 8049756 - DNA, 22 bp, Homo sapiens
ctgggcctaacccacagcgttt

SEQ ID NO: 8049757 - DNA, 22 bp, Homo sapiens
ctgggcctcatccccagagttt

SEQ ID NO: 8049758 - DNA, 22 bp, Homo sapiens
ctgggagtgttctaggtcacat

SEQ ID NO: 8049759 - DNA, 22 bp, Homo sapiens
ctgggccaggaccagggttgaa

SEQ ID NO: 8049760 - DNA, 22 bp, Homo sapiens
ctgggccaggaccagggttgaa

SEQ ID NO: 8049761 - DNA, 22 bp, Homo sapiens
ctgggcccacgagggctctggg

SEQ ID NO: 8049762 - DNA, 22 bp, Homo sapiens
ctgggccagcaactgcaatgga

SEQ ID NO: 8049763 - DNA, 22 bp, Homo sapiens
ctggagctctccagagccccgt

SEQ ID NO: 8049764 - DNA, 22 bp, Homo sapiens
ctgggaggcggaggttgcagtg

SEQ ID NO: 8049765 - DNA, 22 bp, Homo sapiens
ctgggaggcggaggttgcagtg

SEQ ID NO: 8049766 - DNA, 22 bp, Homo sapiens
ctggagccttcaccaggggaaa

SEQ ID NO: 8049767 - DNA, 22 bp, Homo sapiens
gaagaaattgaattcatgagct

SEQ ID NO: 8049768 - DNA, 20 bp, Homo sapiens
gaaattctcgtattagttta

SEQ ID NO: 8049769 - DNA, 22 bp, Homo sapiens
cttttttcctaaggcaacatga

SEQ ID NO: 8049770 - DNA, 22 bp, Homo sapiens
gaaacttcttgtctcacagttc

SEQ ID NO: 8049771 - DNA, 20 bp, Homo sapiens
ctttttctccagctctgagc

SEQ ID NO: 8049772 - DNA, 20 bp, Homo sapiens
ctttggcaatgagaacaggg

SEQ ID NO: 8049773 - DNA, 22 bp, Homo sapiens
cttttgttaggagaaaacatca

SEQ ID NO: 8049774 - DNA, 22 bp, Homo sapiens
cttccctgataagagcctcaga

SEQ ID NO: 8049775 - DNA, 22 bp, Homo sapiens
cttccctgagctttctcaggct

SEQ ID NO: 8049776 - DNA, 22 bp, Homo sapiens
cttcccagaccttagagtgcag

SEQ ID NO: 8049777 - DNA, 22 bp, Homo sapiens
cttcccagaccttagagtgcag

SEQ ID NO: 8049778 - DNA, 22 bp, Homo sapiens
cttcccaggtgctcttagcatg

SEQ ID NO: 8049779 - DNA, 22 bp, Homo sapiens
cttcagaaactagtaacagcta

SEQ ID NO: 8049780 - DNA, 22 bp, Homo sapiens
cttccaggtaggcctaaggcag

SEQ ID NO: 8049781 - DNA, 22 bp, Homo sapiens
cttccagggtccaggaagagcc

SEQ ID NO: 8049782 - DNA, 22 bp, Homo sapiens
cttcacagccaacatgggcaca

SEQ ID NO: 8049783 - DNA, 22 bp, Homo sapiens
cttcacagatgctgagagggct

SEQ ID NO: 8049784 - DNA, 22 bp, Homo sapiens
cttgcctccctcagctcacagc

SEQ ID NO: 8049785 - DNA, 22 bp, Homo sapiens
cttcttcttcccccttcagggg

SEQ ID NO: 8049786 - DNA, 22 bp, Homo sapiens
ctgccccatggtccctggtggg

SEQ ID NO: 8049787 - DNA, 22 bp, Homo sapiens
ctgcccctgccaggcagctgtc

SEQ ID NO: 8049788 - DNA, 22 bp, Homo sapiens
ctgcccctgccaggcagctgtc

SEQ ID NO: 8049789 - DNA, 22 bp, Homo sapiens
ctgccccagtgccaggcaggtg

SEQ ID NO: 8049790 - DNA, 22 bp, Homo sapiens
ctgccccaggcctccttttctt

SEQ ID NO: 8049791 - DNA, 22 bp, Homo sapiens
ctgccccaggacctcttctgga

SEQ ID NO: 8049792 - DNA, 22 bp, Homo sapiens
ctgcccagattttaccacctgc

SEQ ID NO: 8049793 - DNA, 22 bp, Homo sapiens
ctgcaggaggatcctgagagtg

SEQ ID NO: 8049794 - DNA, 22 bp, Homo sapiens
ctgcaggaggatcctgagagtg

SEQ ID NO: 8049795 - DNA, 22 bp, Homo sapiens
ctgcaggagtgaaagcaggcct

SEQ ID NO: 8049796 - DNA, 22 bp, Homo sapiens
ctgcaggagggctggggaagcc

SEQ ID NO: 8049797 - DNA, 22 bp, Homo sapiens
ctgcaggagtgaaagcaggcct

SEQ ID NO: 8049798 - DNA, 22 bp, Homo sapiens
ctgcaggacagggaggagcaag

SEQ ID NO: 8049799 - DNA, 22 bp, Homo sapiens
ctgcaggacagggaggagcaag

SEQ ID NO: 8049800 - DNA, 22 bp, Homo sapiens
ctgcaggaatctgtgctaggtg

SEQ ID NO: 8049801 - DNA, 22 bp, Homo sapiens
ctgcaggaatctgtgctaggtg

SEQ ID NO: 8049802 - DNA, 22 bp, Homo sapiens
ctgcagctgtgagtgctggatg

SEQ ID NO: 8049803 - DNA, 22 bp, Homo sapiens
ctgagcagtggttcttgagcgc

SEQ ID NO: 8049804 - DNA, 22 bp, Homo sapiens
ctgagcagtctgactcaagcta

SEQ ID NO: 8049805 - DNA, 22 bp, Homo sapiens
ctgagcagtgctttgcagtggg

SEQ ID NO: 8049806 - DNA, 22 bp, Homo sapiens
ctgagcagtctagccaggtgtt

SEQ ID NO: 8049807 - DNA, 19 bp, Homo sapiens
ctgagcaggcaggtaggat

SEQ ID NO: 8049808 - DNA, 22 bp, Homo sapiens
ctgagcagaccatggcagaggt

SEQ ID NO: 8049809 - DNA, 22 bp, Homo sapiens
ctgagcaggacagtgggagacc

SEQ ID NO: 8049810 - DNA, 22 bp, Homo sapiens
ctgagcagcgtggggagctggc

SEQ ID NO: 8049811 - DNA, 22 bp, Homo sapiens
ttttggaacacagacattagaa

SEQ ID NO: 8049812 - DNA, 22 bp, Homo sapiens
ctgaggccgttggtgggcctta

SEQ ID NO: 8049813 - DNA, 22 bp, Homo sapiens
ctgaggcctgggggcgtggacg

SEQ ID NO: 8049814 - DNA, 22 bp, Homo sapiens
ctgaggcctgtgttggggcagt

SEQ ID NO: 8049815 - DNA, 22 bp, Homo sapiens
ctgaggctcaagggcaggtggg

SEQ ID NO: 8049816 - DNA, 18 bp, Homo sapiens
ctgaggctggcaggagcc

SEQ ID NO: 8049817 - DNA, 17 bp, Homo sapiens
ctgaggggagtgctgtg

SEQ ID NO: 8049818 - DNA, 22 bp, Homo sapiens
ctgccttcatctctgagctggg

SEQ ID NO: 8049819 - DNA, 18 bp, Homo sapiens
ctgcctgttgctgagagg

SEQ ID NO: 8049820 - DNA, 22 bp, Homo sapiens
ctgcctgtggacaccctggagg

SEQ ID NO: 8049821 - DNA, 22 bp, Homo sapiens
ctgcccctgctcatggctgtcc

SEQ ID NO: 8049822 - DNA, 22 bp, Homo sapiens
ctgcctggggaatgtgaggatt

SEQ ID NO: 8049823 - DNA, 22 bp, Homo sapiens
ctgcctgtgtgtgcctgcagaa

SEQ ID NO: 8049824 - DNA, 22 bp, Homo sapiens
ctgcctgtgggtacaagtggaa

SEQ ID NO: 8049825 - DNA, 22 bp, Homo sapiens
ctgcctttggaagtccagagct

SEQ ID NO: 8049826 - DNA, 22 bp, Homo sapiens
ctgcgcaggggtggcgccagaa

SEQ ID NO: 8049827 - DNA, 22 bp, Homo sapiens
ctgccttggtttctagcagggc

SEQ ID NO: 8049828 - DNA, 22 bp, Homo sapiens
ctgctctgttaattaaactttg

SEQ ID NO: 8049829 - DNA, 22 bp, Homo sapiens
ctgctctgtggtccatgagaca

SEQ ID NO: 8049830 - DNA, 22 bp, Homo sapiens
ctgctctgagaggctcttccta

SEQ ID NO: 8049831 - DNA, 22 bp, Homo sapiens
ctgctcttcacactacacccgt

SEQ ID NO: 8049832 - DNA, 22 bp, Homo sapiens
ctgctctgttcccccatcatct

SEQ ID NO: 8049833 - DNA, 22 bp, Homo sapiens
ctgctgagcatcagggctgccc

SEQ ID NO: 8049834 - DNA, 22 bp, Homo sapiens
ctgctgagatgccaggagctct

SEQ ID NO: 8049835 - DNA, 22 bp, Homo sapiens
ctgctgagagctgaaggctgta

SEQ ID NO: 8049836 - DNA, 20 bp, Homo sapiens
ctgctgagagcctggcttgc

SEQ ID NO: 8049837 - DNA, 22 bp, Homo sapiens
ctgctgagagccacgtggcaca

SEQ ID NO: 8049838 - DNA, 22 bp, Homo sapiens
ctgctgagactggctttgtgtc

SEQ ID NO: 8049839 - DNA, 22 bp, Homo sapiens
ctgctgagaaccagggagaatt

SEQ ID NO: 8049840 - DNA, 22 bp, Homo sapiens
ctgctgagaaaagactgaggga

SEQ ID NO: 8049841 - DNA, 19 bp, Homo sapiens
ctgctgggtgctgagggag

SEQ ID NO: 8049842 - DNA, 22 bp, Homo sapiens
ctgctgggcagaggctgcatga

SEQ ID NO: 8049843 - DNA, 22 bp, Homo sapiens
ctggagcagcaggtggccaggg

SEQ ID NO: 8049844 - DNA, 22 bp, Homo sapiens
ctggagaggctgggaacaggtt

SEQ ID NO: 8049845 - DNA, 17 bp, Homo sapiens
ctggagcctccaactcc

SEQ ID NO: 8049846 - DNA, 22 bp, Homo sapiens
ctggagccgcatggagcaggga

SEQ ID NO: 8049847 - DNA, 22 bp, Homo sapiens
ctggagccgcatggagcaggga

SEQ ID NO: 8049848 - DNA, 22 bp, Homo sapiens
ctggagcagcaggtggccaggg

SEQ ID NO: 8049849 - DNA, 22 bp, Homo sapiens
ctggagcaggtttaggagtccc

SEQ ID NO: 8049850 - DNA, 22 bp, Homo sapiens
ctggagccctgaatgggcagga

SEQ ID NO: 8049851 - DNA, 22 bp, Homo sapiens
ctggagccctgaatgggcagga

SEQ ID NO: 8049852 - DNA, 22 bp, Homo sapiens
ctggaaggctctgctgcctgtc

SEQ ID NO: 8049853 - DNA, 22 bp, Homo sapiens
ctggaagggtcagagtgatgag

SEQ ID NO: 8049854 - DNA, 22 bp, Homo sapiens
ctggaagggtctacttagcaga

SEQ ID NO: 8049855 - DNA, 22 bp, Homo sapiens
ctggagaaacatcaggcatagg

SEQ ID NO: 8049856 - DNA, 22 bp, Homo sapiens
ctggagaaaatccatgtgtatg

SEQ ID NO: 8049857 - DNA, 22 bp, Homo sapiens
ctgctgtgagtggttcttgcct

SEQ ID NO: 8049858 - DNA, 22 bp, Homo sapiens
ctctgcagaggcccaaggctga

SEQ ID NO: 8049859 - DNA, 22 bp, Homo sapiens
ctctgcagaatttgagctgctc

SEQ ID NO: 8049860 - DNA, 22 bp, Homo sapiens
ctctgcacccccggctcctcgt

SEQ ID NO: 8049861 - DNA, 22 bp, Homo sapiens
tttgaaaattagacacaggcta

SEQ ID NO: 8049862 - DNA, 22 bp, Homo sapiens
tttgaaaatttaagtgctacac

SEQ ID NO: 8049863 - DNA, 22 bp, Homo sapiens
tttgaaaatttaagtgctacac

SEQ ID NO: 8049864 - DNA, 22 bp, Homo sapiens
tttgaaaagaaccatcgcctta

SEQ ID NO: 8049865 - DNA, 22 bp, Homo sapiens
tttgaaaacttaatttggtcgt

SEQ ID NO: 8049866 - DNA, 22 bp, Homo sapiens
ctctggcctgcttcctcaggta

SEQ ID NO: 8049867 - DNA, 22 bp, Homo sapiens
ctctggcctggggcctgctccc

SEQ ID NO: 8049868 - DNA, 22 bp, Homo sapiens
ctctggccagagcctgcgggaa

SEQ ID NO: 8049869 - DNA, 22 bp, Homo sapiens
ctctggcagagctgtagacttc

SEQ ID NO: 8049870 - DNA, 22 bp, Homo sapiens
tttgagaagatgtaatgttaag

SEQ ID NO: 8049871 - DNA, 22 bp, Homo sapiens
tttgactttgggctctaactca

SEQ ID NO: 8049872 - DNA, 22 bp, Homo sapiens
ctctgggtgtgacagcacctgg

SEQ ID NO: 8049873 - DNA, 20 bp, Homo sapiens
ctctgggtcgagacagactt

SEQ ID NO: 8049874 - DNA, 22 bp, Homo sapiens
ctctgggtctataatgcagctg

SEQ ID NO: 8049875 - DNA, 22 bp, Homo sapiens
ctctgggtgtcttaggagctca

SEQ ID NO: 8049876 - DNA, 22 bp, Homo sapiens
ctctgggtgcagcgctgaccgg

SEQ ID NO: 8049877 - DNA, 22 bp, Homo sapiens
ctctgtgttccgggttgctgct

SEQ ID NO: 8049878 - DNA, 22 bp, Homo sapiens
ctctgtgggggagaggcagctg

SEQ ID NO: 8049879 - DNA, 22 bp, Homo sapiens
ctctgtgggaagctgggtgtga

SEQ ID NO: 8049880 - DNA, 22 bp, Homo sapiens
ctctgtgggccagagaggcccc

SEQ ID NO: 8049881 - DNA, 22 bp, Homo sapiens
ctctgtgggccagagaggcccc

SEQ ID NO: 8049882 - DNA, 22 bp, Homo sapiens
ctctgtgctcccatgctagtaa

SEQ ID NO: 8049883 - DNA, 22 bp, Homo sapiens
tttctacagaagatacactgct

SEQ ID NO: 8049884 - DNA, 22 bp, Homo sapiens
tttctacagaagatacactgct

SEQ ID NO: 8049885 - DNA, 22 bp, Homo sapiens
tttctcaagtactgcacatgaa

SEQ ID NO: 8049886 - DNA, 22 bp, Homo sapiens
tttctcaactgtattatgcaga

SEQ ID NO: 8049887 - DNA, 22 bp, Homo sapiens
tttctacatgtcaatccaaacc

SEQ ID NO: 8049888 - DNA, 22 bp, Homo sapiens
tttctcaaaattcagtggtatc

SEQ ID NO: 8049889 - DNA, 23 bp, Homo sapiens
tttctcaaagagtggcagcttca

SEQ ID NO: 8049890 - DNA, 22 bp, Homo sapiens
ctctgaaagagtttagtattat

SEQ ID NO: 8049891 - DNA, 22 bp, Homo sapiens
ctctgaaagacaagctctcatt

SEQ ID NO: 8049892 - DNA, 18 bp, Homo sapiens
ctctgaaagacacaccag

SEQ ID NO: 8049893 - DNA, 22 bp, Homo sapiens
ctctgaaagcaaaactagagaa

SEQ ID NO: 8049894 - DNA, 22 bp, Homo sapiens
ctctgaaaatgtggtggggaaa

SEQ ID NO: 8049895 - DNA, 22 bp, Homo sapiens
ctctgaaagcaaaactagagaa

SEQ ID NO: 8049896 - DNA, 22 bp, Homo sapiens
ctctgaaagttagagaaaatag

SEQ ID NO: 8049897 - DNA, 22 bp, Homo sapiens
ctctgaaattggccctcagcag

SEQ ID NO: 8049898 - DNA, 22 bp, Homo sapiens
ctctgaaactcctgcaccttct

SEQ ID NO: 8049899 - DNA, 22 bp, Homo sapiens
ctctgaaactccagccccaggt

SEQ ID NO: 8049900 - DNA, 22 bp, Homo sapiens
ctccaggccatggctgcggagg

SEQ ID NO: 8049901 - DNA, 22 bp, Homo sapiens
ctccaggcccctggccttctgc

SEQ ID NO: 8049902 - DNA, 22 bp, Homo sapiens
tttatgattattttaaagcagc

SEQ ID NO: 8049903 - DNA, 22 bp, Homo sapiens
tttcagaacagggattgggcct

SEQ ID NO: 8049904 - DNA, 22 bp, Homo sapiens
tttcagaacataatgtgagcat

SEQ ID NO: 8049905 - DNA, 22 bp, Homo sapiens
tttcagaagtcacagttgactg

SEQ ID NO: 8049906 - DNA, 22 bp, Homo sapiens
ctccttcccctactcagcatcc

SEQ ID NO: 8049907 - DNA, 22 bp, Homo sapiens
ctcactcagacatccagtgcag

SEQ ID NO: 8049908 - DNA, 22 bp, Homo sapiens
ctcacccatatctccatgactc

SEQ ID NO: 8049909 - DNA, 22 bp, Homo sapiens
ttctggccaaggctgccagatt

SEQ ID NO: 8049910 - DNA, 22 bp, Homo sapiens
ctcagaggcaagcaaggagctg

SEQ ID NO: 8049911 - DNA, 22 bp, Homo sapiens
ttctttctgaatacagttgagt

SEQ ID NO: 8049912 - DNA, 22 bp, Homo sapiens
ttctatttcttaatcttggctg

SEQ ID NO: 8049913 - DNA, 22 bp, Homo sapiens
ttctatttcttaatcttggctg

SEQ ID NO: 8049914 - DNA, 22 bp, Homo sapiens
ttctggaagagtaaaataagcc

SEQ ID NO: 8049915 - DNA, 22 bp, Homo sapiens
ttctggaagcttttggagagaa

SEQ ID NO: 8049916 - DNA, 23 bp, Homo sapiens
cgtgtccttcagggagagtgtgg

SEQ ID NO: 8049917 - DNA, 20 bp, Homo sapiens
cgtgtccttggcgggagagc

SEQ ID NO: 8049918 - DNA, 22 bp, Homo sapiens
cgtgtccttttagcttcaggtc

SEQ ID NO: 8049919 - DNA, 22 bp, Homo sapiens
ttgcccctggtcagaggaggct

SEQ ID NO: 8049920 - DNA, 18 bp, Homo sapiens
ttgcccctgggtgaggat

SEQ ID NO: 8049921 - DNA, 21 bp, Homo sapiens
ctcaggggattttgagattag

SEQ ID NO: 8049922 - DNA, 22 bp, Homo sapiens
ctcaggagtagttcagcagctg

SEQ ID NO: 8049923 - DNA, 22 bp, Homo sapiens
ctcaggaggtttcctgtctagg

SEQ ID NO: 8049924 - DNA, 22 bp, Homo sapiens
ctcaggaggatgactgccttgg

SEQ ID NO: 8049925 - DNA, 19 bp, Homo sapiens
ctcagctgtagctcatgtg

SEQ ID NO: 8049926 - DNA, 22 bp, Homo sapiens
ctcagccccaatttgccctctt

SEQ ID NO: 8049927 - DNA, 22 bp, Homo sapiens
ttggagggtcttccacagccat

SEQ ID NO: 8049928 - DNA, 22 bp, Homo sapiens
ttggaggggccactgcagagct

SEQ ID NO: 8049929 - DNA, 22 bp, Homo sapiens
ttggagggacagatggctaggc

SEQ ID NO: 8049930 - DNA, 22 bp, Homo sapiens
ttggagggactgagcttcagtc

SEQ ID NO: 8049931 - DNA, 22 bp, Homo sapiens
ccttaggggtgacagaaatacc

SEQ ID NO: 8049932 - DNA, 22 bp, Homo sapiens
ccttacctgattgctggcatcc

SEQ ID NO: 8049933 - DNA, 22 bp, Homo sapiens
ttaaattccagcctcataatag

SEQ ID NO: 8049934 - DNA, 22 bp, Homo sapiens
tgtcagatgtggtcggtttgat

SEQ ID NO: 8049935 - DNA, 22 bp, Homo sapiens
tgtcagatgtgtctccaagtgc

SEQ ID NO: 8049936 - DNA, 22 bp, Homo sapiens
ttacataacggtatgaaaaatg

SEQ ID NO: 8049937 - DNA, 22 bp, Homo sapiens
ttacataacggtatgaaaaatg

SEQ ID NO: 8049938 - DNA, 22 bp, Homo sapiens
ttacataactttaaaatgccgt

SEQ ID NO: 8049939 - DNA, 22 bp, Homo sapiens
ttacataaaagttcacgtaggc

SEQ ID NO: 8049940 - DNA, 22 bp, Homo sapiens
ccttgcagggaaactggaccca

SEQ ID NO: 8049941 - DNA, 22 bp, Homo sapiens
ccttgcaggggaacaggcagtg

SEQ ID NO: 8049942 - DNA, 22 bp, Homo sapiens
ccttgcagagcataggagccct

SEQ ID NO: 8049943 - DNA, 22 bp, Homo sapiens
ccttgcagcatatagagtccct

SEQ ID NO: 8049944 - DNA, 22 bp, Homo sapiens
ccttgcagttgttactgtagcc

SEQ ID NO: 8049945 - DNA, 22 bp, Homo sapiens
ccttgcagacatcagtagtggc

SEQ ID NO: 8049946 - DNA, 21 bp, Homo sapiens
ccttgaggcccaggccaggcc

SEQ ID NO: 8049947 - DNA, 22 bp, Homo sapiens
ccttgagccagggagctggcag

SEQ ID NO: 8049948 - DNA, 22 bp, Homo sapiens
ttagtttataattcatttctgt

SEQ ID NO: 8049949 - DNA, 22 bp, Homo sapiens
ttataacaacagtttactttaa

SEQ ID NO: 8049950 - DNA, 22 bp, Homo sapiens
ttatcacttatgagctttttgc

SEQ ID NO: 8049951 - DNA, 22 bp, Homo sapiens
ttatttattgtgtacctactgt

SEQ ID NO: 8049952 - DNA, 22 bp, Homo sapiens
cgctgccaggtcaccaggggta

SEQ ID NO: 8049953 - DNA, 22 bp, Homo sapiens
cgctgccaggatcccctgccgg

SEQ ID NO: 8049954 - DNA, 22 bp, Homo sapiens
cgctggcattagggcagtggcc

SEQ ID NO: 8049955 - DNA, 22 bp, Homo sapiens
cgctgggcaggtccacttgtta

SEQ ID NO: 8049956 - DNA, 22 bp, Homo sapiens
cgctctggagaatagtagcttt

SEQ ID NO: 8049957 - DNA, 22 bp, Homo sapiens
cgctctggcaggcacaggaggg

SEQ ID NO: 8049958 - DNA, 22 bp, Homo sapiens
cgctgataaacgtcacgttccc

SEQ ID NO: 8049959 - DNA, 22 bp, Homo sapiens
ccttttctaatcttaagaatgt

SEQ ID NO: 8049960 - DNA, 22 bp, Homo sapiens
ccttttctgaaccacttaaata

SEQ ID NO: 8049961 - DNA, 22 bp, Homo sapiens
ttattgagtatctgcttggtgt

SEQ ID NO: 8049962 - DNA, 16 bp, Homo sapiens
ttattgaggccaagga

SEQ ID NO: 8049963 - DNA, 23 bp, Homo sapiens
ttattgagggtgtagattggtgt

SEQ ID NO: 8049964 - DNA, 22 bp, Homo sapiens
ttattgagtttacagctttaga

SEQ ID NO: 8049965 - DNA, 22 bp, Homo sapiens
ttattgagttgtaagagctctt

SEQ ID NO: 8049966 - DNA, 22 bp, Homo sapiens
cggaggttgaggctgcagtgag

SEQ ID NO: 8049967 - DNA, 22 bp, Homo sapiens
cggcagggttggttttctctga

SEQ ID NO: 8049968 - DNA, 22 bp, Homo sapiens
cggcagggttggttttctctga

SEQ ID NO: 8049969 - DNA, 22 bp, Homo sapiens
cggcagggctccatgcatttct

SEQ ID NO: 8049970 - DNA, 22 bp, Homo sapiens
cggcagggctccatgcatttct

SEQ ID NO: 8049971 - DNA, 22 bp, Homo sapiens
cggggaggcttcggattaaagc

SEQ ID NO: 8049972 - DNA, 22 bp, Homo sapiens
cggggagggcagaggctccctc

SEQ ID NO: 8049973 - DNA, 22 bp, Homo sapiens
cggcaggtgtgctcactctgcc

SEQ ID NO: 8049974 - DNA, 22 bp, Homo sapiens
cggggcaggagtccctgtagag

SEQ ID NO: 8049975 - DNA, 22 bp, Homo sapiens
cggggcaggagtccctgtagag

SEQ ID NO: 8049976 - DNA, 22 bp, Homo sapiens
cggggccctggggctgaaggtc

SEQ ID NO: 8049977 - DNA, 22 bp, Homo sapiens
cggggccctggggctgaaggtc

SEQ ID NO: 8049978 - DNA, 22 bp, Homo sapiens
cgtgggaggaaaaatgggcttc

SEQ ID NO: 8049979 - DNA, 22 bp, Homo sapiens
cgtgggagtggtgggtgctcag

SEQ ID NO: 8049980 - DNA, 22 bp, Homo sapiens
cgtggggcgggtggacacttgc

SEQ ID NO: 8049981 - DNA, 22 bp, Homo sapiens
cccacaggtggaagcctcggaa

SEQ ID NO: 8049982 - DNA, 22 bp, Homo sapiens
cccacaggcaggtgcatgggct

SEQ ID NO: 8049983 - DNA, 22 bp, Homo sapiens
cccacactctgagaaatgctga

SEQ ID NO: 8049984 - DNA, 22 bp, Homo sapiens
cccacagaatgccaatgagacc

SEQ ID NO: 8049985 - DNA, 22 bp, Homo sapiens
cccacaggcaggggcagagaca

SEQ ID NO: 8049986 - DNA, 22 bp, Homo sapiens
cccacccagcctggctgagggg

SEQ ID NO: 8049987 - DNA, 22 bp, Homo sapiens
cccacccagctgagccgctcac

SEQ ID NO: 8049988 - DNA, 22 bp, Homo sapiens
cccacccactctgaccagaagc

SEQ ID NO: 8049989 - DNA, 22 bp, Homo sapiens
cccagcagaccgctgtgatggc

SEQ ID NO: 8049990 - DNA, 22 bp, Homo sapiens
cccagcagaccgctgtgatggc

SEQ ID NO: 8049991 - DNA, 23 bp, Homo sapiens
cccagcagagatgaggaggggtc

SEQ ID NO: 8049992 - DNA, 22 bp, Homo sapiens
cccagcagaatctgatgagggc

SEQ ID NO: 8049993 - DNA, 22 bp, Homo sapiens
cccagcagaatctgatgagggc

SEQ ID NO: 8049994 - DNA, 22 bp, Homo sapiens
tgcagcaggttccaaagggtta

SEQ ID NO: 8049995 - DNA, 22 bp, Homo sapiens
tgcagcaggtgacaacgagtgg

SEQ ID NO: 8049996 - DNA, 22 bp, Homo sapiens
tgcagcagtgttccttggcttg

SEQ ID NO: 8049997 - DNA, 22 bp, Homo sapiens
tgcagcagtcagtcaggcctgg

SEQ ID NO: 8049998 - DNA, 23 bp, Homo sapiens
cccagcagattgtaaagtgtcca

SEQ ID NO: 8049999 - DNA, 22 bp, Homo sapiens
cccagcagccagaatgaggagc

SEQ ID NO: 8050000 - DNA, 22 bp, Homo sapiens
cccagcagccagaatgaggagc

SEQ ID NO: 8050001 - DNA, 22 bp, Homo sapiens
tgatgaattggaaattctgatt

SEQ ID NO: 8050002 - DNA, 22 bp, Homo sapiens
tgatacataaaccatcattttg

SEQ ID NO: 8050003 - DNA, 22 bp, Homo sapiens
tgatgaggcatatgctacacat

SEQ ID NO: 8050004 - DNA, 22 bp, Homo sapiens
ccatggagcacctcacagaggc

SEQ ID NO: 8050005 - DNA, 22 bp, Homo sapiens
ccatggaagaactgatgtgcca

SEQ ID NO: 8050006 - DNA, 22 bp, Homo sapiens
ccatggcagcctggcctggctt

SEQ ID NO: 8050007 - DNA, 19 bp, Homo sapiens
ccattgtttgttgcccaag

SEQ ID NO: 8050008 - DNA, 22 bp, Homo sapiens
cccagctccgagctccgagccg

SEQ ID NO: 8050009 - DNA, 22 bp, Homo sapiens
cccagctcccatgttctccaat

SEQ ID NO: 8050010 - DNA, 22 bp, Homo sapiens
cccagctccagagccagaaaca

SEQ ID NO: 8050011 - DNA, 18 bp, Homo sapiens
cccagctccacttccctc

SEQ ID NO: 8050012 - DNA, 22 bp, Homo sapiens
tgcagtggcgccatctcagctc

SEQ ID NO: 8050013 - DNA, 22 bp, Homo sapiens
tgcagtggcgccatctcagctc

SEQ ID NO: 8050014 - DNA, 22 bp, Homo sapiens
tgcagtggaggccgtgagacag

SEQ ID NO: 8050015 - DNA, 22 bp, Homo sapiens
tgcagtggaggccgtgagacag

SEQ ID NO: 8050016 - DNA, 22 bp, Homo sapiens
tgcagtctggatgtcctcagat

SEQ ID NO: 8050017 - DNA, 22 bp, Homo sapiens
tgcaggtggacacgggagacgg

SEQ ID NO: 8050018 - DNA, 22 bp, Homo sapiens
tgcaggtggacacgggagacgg

SEQ ID NO: 8050019 - DNA, 22 bp, Homo sapiens
tgcagtggaaagactcagactt

SEQ ID NO: 8050020 - DNA, 22 bp, Homo sapiens
tgcagtggaaagactcagactt

SEQ ID NO: 8050021 - DNA, 22 bp, Homo sapiens
cccagcccagcgttcgaggggt

SEQ ID NO: 8050022 - DNA, 18 bp, Homo sapiens
cccagcccaccatttctc

SEQ ID NO: 8050023 - DNA, 22 bp, Homo sapiens
cccagcccccgagtgtctggaa

SEQ ID NO: 8050024 - DNA, 20 bp, Homo sapiens
cccagcccctacctgttgcc

SEQ ID NO: 8050025 - DNA, 22 bp, Homo sapiens
cccagcccccgagtgtctggaa

SEQ ID NO: 8050026 - DNA, 22 bp, Homo sapiens
cccagcatgcacgctgacactc

SEQ ID NO: 8050027 - DNA, 22 bp, Homo sapiens
cccagcagtaaccagtggaaat

SEQ ID NO: 8050028 - DNA, 22 bp, Homo sapiens
tgcagcattagtacaagtctca

SEQ ID NO: 8050029 - DNA, 22 bp, Homo sapiens
tgcagcattcttggccactact

SEQ ID NO: 8050030 - DNA, 22 bp, Homo sapiens
tgcagcattctggtaaaaggca

SEQ ID NO: 8050031 - DNA, 22 bp, Homo sapiens
cccagcaggtgccatcactctg

SEQ ID NO: 8050032 - DNA, 22 bp, Homo sapiens
tgcagcattttataccatcatt

SEQ ID NO: 8050033 - DNA, 22 bp, Homo sapiens
tgcagcatctccttgtgccatg

SEQ ID NO: 8050034 - DNA, 22 bp, Homo sapiens
tgcagcatgcaggagaggctct

SEQ ID NO: 8050035 - DNA, 22 bp, Homo sapiens
tgcagcagtttaatgcagggtt

SEQ ID NO: 8050036 - DNA, 17 bp, Homo sapiens
tgcagcagttcccatct

SEQ ID NO: 8050037 - DNA, 22 bp, Homo sapiens
tgcctcagtttcatctgcagaa

SEQ ID NO: 8050038 - DNA, 19 bp, Homo sapiens
tgccctgcacgctgtcctg

SEQ ID NO: 8050039 - DNA, 22 bp, Homo sapiens
tgcccaggatctggcgatgctc

SEQ ID NO: 8050040 - DNA, 21 bp, Homo sapiens
cccaggaggctgagaagagca

SEQ ID NO: 8050041 - DNA, 22 bp, Homo sapiens
cccaggaggcctgcctggccgg

SEQ ID NO: 8050042 - DNA, 22 bp, Homo sapiens
cccaggaggcagagcttgcagt

SEQ ID NO: 8050043 - DNA, 22 bp, Homo sapiens
ccagggccagtaagattggcat

SEQ ID NO: 8050044 - DNA, 22 bp, Homo sapiens
tgactttacagatatgtttcct

SEQ ID NO: 8050045 - DNA, 22 bp, Homo sapiens
tgagaaaactcaaagacagatc

SEQ ID NO: 8050046 - DNA, 22 bp, Homo sapiens
ccagggtggcgtagatgctggg

SEQ ID NO: 8050047 - DNA, 22 bp, Homo sapiens
tgacagactactgcctctattg

SEQ ID NO: 8050048 - DNA, 22 bp, Homo sapiens
tgacagactttacttctcctat

SEQ ID NO: 8050049 - DNA, 22 bp, Homo sapiens
ccagggcatgtaactaatggtg

SEQ ID NO: 8050050 - DNA, 22 bp, Homo sapiens
ccagggcatgtccaagacttag

SEQ ID NO: 8050051 - DNA, 22 bp, Homo sapiens
ccagggccaagagacctcgagg

SEQ ID NO: 8050052 - DNA, 22 bp, Homo sapiens
ccaggtctatcaagttgggctc

SEQ ID NO: 8050053 - DNA, 22 bp, Homo sapiens
tgagagtctcagacctcctggt

SEQ ID NO: 8050054 - DNA, 22 bp, Homo sapiens
tgagagtctgttcctcttgcag

SEQ ID NO: 8050055 - DNA, 22 bp, Homo sapiens
ccagggtggggtccaggaacca

SEQ ID NO: 8050056 - DNA, 22 bp, Homo sapiens
ccagggtgtagggattccagat

SEQ ID NO: 8050057 - DNA, 22 bp, Homo sapiens
ccagggtgtgagaaggaagtag

SEQ ID NO: 8050058 - DNA, 22 bp, Homo sapiens
ccagggtggggcaggcccactg

SEQ ID NO: 8050059 - DNA, 22 bp, Homo sapiens
ccaggtcaagctcccctgtggt

SEQ ID NO: 8050060 - DNA, 23 bp, Homo sapiens
tgagctggtattgtccatctcca

SEQ ID NO: 8050061 - DNA, 23 bp, Homo sapiens
tgagctgggcctgcaggggtctc

SEQ ID NO: 8050062 - DNA, 23 bp, Homo sapiens
tgagctgggcctgcaggggtctc

SEQ ID NO: 8050063 - DNA, 22 bp, Homo sapiens
tgaggacaatccctaactcaga

SEQ ID NO: 8050064 - DNA, 22 bp, Homo sapiens
tgaggacatgagtgggacagag

SEQ ID NO: 8050065 - DNA, 22 bp, Homo sapiens
tgaggacattaggaagtgaagg

SEQ ID NO: 8050066 - DNA, 22 bp, Homo sapiens
tgaggacattgagactggagac

SEQ ID NO: 8050067 - DNA, 22 bp, Homo sapiens
tgagctggcacttttcctggga

SEQ ID NO: 8050068 - DNA, 22 bp, Homo sapiens
tgagctggcaggggctcaggga

SEQ ID NO: 8050069 - DNA, 22 bp, Homo sapiens
tgagcccaggagttggaggctg

SEQ ID NO: 8050070 - DNA, 22 bp, Homo sapiens
ccagcccttgagatggaaggga

SEQ ID NO: 8050071 - DNA, 23 bp, Homo sapiens
tctgcagacgctgttctattgtc

SEQ ID NO: 8050072 - DNA, 21 bp, Homo sapiens
ccagcctcagatcagggagct

SEQ ID NO: 8050073 - DNA, 22 bp, Homo sapiens
ccaggctcagcgcgcacgtctg

SEQ ID NO: 8050074 - DNA, 22 bp, Homo sapiens
ccaggctcacctggagcccctg

SEQ ID NO: 8050075 - DNA, 22 bp, Homo sapiens
ccaggctcagctattaagaaac

SEQ ID NO: 8050076 - DNA, 22 bp, Homo sapiens
ccaggctcaggcctgctcgttg

SEQ ID NO: 8050077 - DNA, 17 bp, Homo sapiens
ccaggctccatcactgt

SEQ ID NO: 8050078 - DNA, 22 bp, Homo sapiens
ccaggctccccaggaggccctt

SEQ ID NO: 8050079 - DNA, 22 bp, Homo sapiens
tctttatttaagtctgttgtaa

SEQ ID NO: 8050080 - DNA, 22 bp, Homo sapiens
tctttatttctgaatcccccat

SEQ ID NO: 8050081 - DNA, 22 bp, Homo sapiens
tctttatttctgaatcccccat

SEQ ID NO: 8050082 - DNA, 22 bp, Homo sapiens
tctttattttatgcttgtgcaa

SEQ ID NO: 8050083 - DNA, 22 bp, Homo sapiens
tctttattttatgcttgtgcaa

SEQ ID NO: 8050084 - DNA, 22 bp, Homo sapiens
tctttattttatgcttgtgcaa

SEQ ID NO: 8050085 - DNA, 22 bp, Homo sapiens
tctttcaaagctgtagtagatt

SEQ ID NO: 8050086 - DNA, 19 bp, Homo sapiens
ccaggcctggcgtctccgc

SEQ ID NO: 8050087 - DNA, 22 bp, Homo sapiens
ccaggctagaaactgaggcaca

SEQ ID NO: 8050088 - DNA, 22 bp, Homo sapiens
tgaagatattttaaaatactga

SEQ ID NO: 8050089 - DNA, 22 bp, Homo sapiens
tgaagatcctatctgcaaatat

SEQ ID NO: 8050090 - DNA, 22 bp, Homo sapiens
tgaaggaaatgacggcagaaga

SEQ ID NO: 8050091 - DNA, 22 bp, Homo sapiens
ccaggctgcagtcaaggggcat

SEQ ID NO: 8050092 - DNA, 22 bp, Homo sapiens
ccaggctgctcacaagctgccc

SEQ ID NO: 8050093 - DNA, 22 bp, Homo sapiens
ccaggctgctgttggtgtccgc

SEQ ID NO: 8050094 - DNA, 21 bp, Homo sapiens
ccaggctcctgaggctggtca

SEQ ID NO: 8050095 - DNA, 22 bp, Homo sapiens
ccaggctcctcatgatcttgtt

SEQ ID NO: 8050096 - DNA, 22 bp, Homo sapiens
ccaggctccgcatagaccccac

SEQ ID NO: 8050097 - DNA, 22 bp, Homo sapiens
cctctggcagccagccagttgt

SEQ ID NO: 8050098 - DNA, 22 bp, Homo sapiens
cctctggccacatgggacatag

SEQ ID NO: 8050099 - DNA, 22 bp, Homo sapiens
cctctggcaacttcacagccca

SEQ ID NO: 8050100 - DNA, 22 bp, Homo sapiens
tgggagctcagaaagggaggtc

SEQ ID NO: 8050101 - DNA, 22 bp, Homo sapiens
tgggagctcagaaagggaggtc

SEQ ID NO: 8050102 - DNA, 22 bp, Homo sapiens
tgggagctcacaggcctggctc

SEQ ID NO: 8050103 - DNA, 23 bp, Homo sapiens
tgggagctcaagggaggctgccc

SEQ ID NO: 8050104 - DNA, 22 bp, Homo sapiens
tgggagcccaagggagctgccg

SEQ ID NO: 8050105 - DNA, 22 bp, Homo sapiens
cctccctgcgctcctgcggcgg

SEQ ID NO: 8050106 - DNA, 22 bp, Homo sapiens
tgggagcaggtgtgctagggaa

SEQ ID NO: 8050107 - DNA, 22 bp, Homo sapiens
tgggagcaggtgtgctagggaa

SEQ ID NO: 8050108 - DNA, 21 bp, Homo sapiens
tggctctgaaagagtgctgca

SEQ ID NO: 8050109 - DNA, 22 bp, Homo sapiens
tggctctgaccaggtagaggag

SEQ ID NO: 8050110 - DNA, 21 bp, Homo sapiens
tggctctgaaagagtgctgca

SEQ ID NO: 8050111 - DNA, 22 bp, Homo sapiens
tgggcagggagctggaaccaca

SEQ ID NO: 8050112 - DNA, 22 bp, Homo sapiens
tgggccacgtgacccttaccct

SEQ ID NO: 8050113 - DNA, 22 bp, Homo sapiens
tgggcagggagctggaaccaca

SEQ ID NO: 8050114 - DNA, 22 bp, Homo sapiens
tgggccactgctccaagtagct

SEQ ID NO: 8050115 - DNA, 22 bp, Homo sapiens
tgggccacttgaaagtggatgt

SEQ ID NO: 8050116 - DNA, 22 bp, Homo sapiens
tgggccactgagggtggtcatt

SEQ ID NO: 8050117 - DNA, 23 bp, Homo sapiens
tgggccactatagaaatctctca

SEQ ID NO: 8050118 - DNA, 22 bp, Homo sapiens
tgggccagatccatggcaataa

SEQ ID NO: 8050119 - DNA, 22 bp, Homo sapiens
tgggccagaggcatggagctat

SEQ ID NO: 8050120 - DNA, 22 bp, Homo sapiens
tgggccagcaattgctgctcag

SEQ ID NO: 8050121 - DNA, 22 bp, Homo sapiens
cctctttgactctcaggtcttt

SEQ ID NO: 8050122 - DNA, 22 bp, Homo sapiens
cctctttgttcaggctgctggc

SEQ ID NO: 8050123 - DNA, 22 bp, Homo sapiens
cctgactcctgggcaaaaccaa

SEQ ID NO: 8050124 - DNA, 22 bp, Homo sapiens
cctgactctggccaggccagct

SEQ ID NO: 8050125 - DNA, 22 bp, Homo sapiens
cctgacaggagaagcgcagcat

SEQ ID NO: 8050126 - DNA, 22 bp, Homo sapiens
cctgacaggagaagcgcagcat

SEQ ID NO: 8050127 - DNA, 22 bp, Homo sapiens
cctgacaggcggaggctgcagt

SEQ ID NO: 8050128 - DNA, 22 bp, Homo sapiens
cctgacagtggtagccttggca

SEQ ID NO: 8050129 - DNA, 22 bp, Homo sapiens
cctgagggaacatgcacccaat

SEQ ID NO: 8050130 - DNA, 22 bp, Homo sapiens
cctgagggagggtataggctgt

SEQ ID NO: 8050131 - DNA, 22 bp, Homo sapiens
cctgagggtcaaggagccctag

SEQ ID NO: 8050132 - DNA, 22 bp, Homo sapiens
cctgaggggctgcaggccagct

SEQ ID NO: 8050133 - DNA, 22 bp, Homo sapiens
cctgccaggccagtgagcttcc

SEQ ID NO: 8050134 - DNA, 22 bp, Homo sapiens
tgggggagagaggcattctttc

SEQ ID NO: 8050135 - DNA, 22 bp, Homo sapiens
tgggggtgtcctggtgcacaca

SEQ ID NO: 8050136 - DNA, 22 bp, Homo sapiens
tgggggtgtgccagggacctcc

SEQ ID NO: 8050137 - DNA, 22 bp, Homo sapiens
tgtaatgagaaagagagtgaat

SEQ ID NO: 8050138 - DNA, 22 bp, Homo sapiens
tgtaatgaaatggtacaactgt

SEQ ID NO: 8050139 - DNA, 22 bp, Homo sapiens
tgtaatgagtcacttaccttaa

SEQ ID NO: 8050140 - DNA, 22 bp, Homo sapiens
tgtaagtagtaatggaaggaca

SEQ ID NO: 8050141 - DNA, 22 bp, Homo sapiens
cctgctttggcaggcagctcct

SEQ ID NO: 8050142 - DNA, 22 bp, Homo sapiens
cctgctttgagatgggcagcag

SEQ ID NO: 8050143 - DNA, 22 bp, Homo sapiens
cctggagggcagcccattctgg

SEQ ID NO: 8050144 - DNA, 22 bp, Homo sapiens
cctggagggcgccgcacagtcc

SEQ ID NO: 8050145 - DNA, 22 bp, Homo sapiens
cctggagggcgccgcacagtcc

SEQ ID NO: 8050146 - DNA, 22 bp, Homo sapiens
cctggagggaccctggccctgt

SEQ ID NO: 8050147 - DNA, 22 bp, Homo sapiens
cctggagggaccctggccctgt

SEQ ID NO: 8050148 - DNA, 22 bp, Homo sapiens
cctggaggcggaggttgcagtg

SEQ ID NO: 8050149 - DNA, 22 bp, Homo sapiens
cctggaggctctgggagggcag

SEQ ID NO: 8050150 - DNA, 22 bp, Homo sapiens
cctggaggcagaaataggactt

SEQ ID NO: 8050151 - DNA, 22 bp, Homo sapiens
cctggagcttttccagttgaca

SEQ ID NO: 8050152 - DNA, 18 bp, Homo sapiens
cctggagctccacagcaa

SEQ ID NO: 8050153 - DNA, 22 bp, Homo sapiens
cctggagcttttccatcctgga

SEQ ID NO: 8050154 - DNA, 22 bp, Homo sapiens
cctggaggagcgctgaccagct

SEQ ID NO: 8050155 - DNA, 22 bp, Homo sapiens
cctggaggagcgctgaccagct

SEQ ID NO: 8050156 - DNA, 18 bp, Homo sapiens
cctggaggtcttcggggt

SEQ ID NO: 8050157 - DNA, 16 bp, Homo sapiens
cctggaggtcacttca

SEQ ID NO: 8050158 - DNA, 18 bp, Homo sapiens
cctggaggtcttcggggt

SEQ ID NO: 8050159 - DNA, 22 bp, Homo sapiens
cctggaggggaccaggaccagg

SEQ ID NO: 8050160 - DNA, 19 bp, Homo sapiens
cctggaggtgaaggttctc

SEQ ID NO: 8050161 - DNA, 22 bp, Homo sapiens
tgtcaaatagtagaaagatggc

SEQ ID NO: 8050162 - DNA, 22 bp, Homo sapiens
cctgctgtagggcccctggggc

SEQ ID NO: 8050163 - DNA, 22 bp, Homo sapiens
tgggtcagtttgggggccagcc

SEQ ID NO: 8050164 - DNA, 18 bp, Homo sapiens
cctgccagtctggagcag

SEQ ID NO: 8050165 - DNA, 22 bp, Homo sapiens
cctgccagggccttggaagaaa

SEQ ID NO: 8050166 - DNA, 22 bp, Homo sapiens
cctgccagggccagaggccagc

SEQ ID NO: 8050167 - DNA, 22 bp, Homo sapiens
cctgccaggcgagtctaggcca

SEQ ID NO: 8050168 - DNA, 22 bp, Homo sapiens
tgggtcagacagccagtgggcc

SEQ ID NO: 8050169 - DNA, 22 bp, Homo sapiens
tgggtcagacagccagtgggcc

SEQ ID NO: 8050170 - DNA, 22 bp, Homo sapiens
tgggtaggtgctggggattcag

SEQ ID NO: 8050171 - DNA, 21 bp, Homo sapiens
tggccctggccacggctgcca

SEQ ID NO: 8050172 - DNA, 19 bp, Homo sapiens
cctcaccctgcagaggagg

SEQ ID NO: 8050173 - DNA, 22 bp, Homo sapiens
cctcagctcccatgagatctgc

SEQ ID NO: 8050174 - DNA, 22 bp, Homo sapiens
cctcagctcttccctgtgcaca

SEQ ID NO: 8050175 - DNA, 22 bp, Homo sapiens
cctcagctgcttccctggagcc

SEQ ID NO: 8050176 - DNA, 22 bp, Homo sapiens
cctcagcccctgaatggagaga

SEQ ID NO: 8050177 - DNA, 22 bp, Homo sapiens
tggctcagctgactcggcttct

SEQ ID NO: 8050178 - DNA, 22 bp, Homo sapiens
tggctcagcggtggcagcagac

SEQ ID NO: 8050179 - DNA, 23 bp, Homo sapiens
tggctcagctagttttccatttc

SEQ ID NO: 8050180 - DNA, 22 bp, Homo sapiens
tggctcagcctggccctttcat

SEQ ID NO: 8050181 - DNA, 22 bp, Homo sapiens
tggctcagccattcgtgttgcc

SEQ ID NO: 8050182 - DNA, 22 bp, Homo sapiens
tggctcagcgcggcctggtctt

SEQ ID NO: 8050183 - DNA, 22 bp, Homo sapiens
tggctacagatttgctgacaat

SEQ ID NO: 8050184 - DNA, 22 bp, Homo sapiens
cctcacccactacactcaaggg

SEQ ID NO: 8050185 - DNA, 17 bp, Homo sapiens
cctcacagggaccagac

SEQ ID NO: 8050186 - DNA, 20 bp, Homo sapiens
cctcacagggcagagagggg

SEQ ID NO: 8050187 - DNA, 22 bp, Homo sapiens
ccctgggatggattggcaggaa

SEQ ID NO: 8050188 - DNA, 22 bp, Homo sapiens
ccctggaggaagaaacaatggc

SEQ ID NO: 8050189 - DNA, 22 bp, Homo sapiens
ccctggaggaaaatctgaggct

SEQ ID NO: 8050190 - DNA, 22 bp, Homo sapiens
ccctggaggaagaaacaatggc

SEQ ID NO: 8050191 - DNA, 22 bp, Homo sapiens
ccctggagctgcttgcatgttg

SEQ ID NO: 8050192 - DNA, 22 bp, Homo sapiens
ccctggaggaaaatctgaggct

SEQ ID NO: 8050193 - DNA, 22 bp, Homo sapiens
ccctggtggtacggcactggca

SEQ ID NO: 8050194 - DNA, 22 bp, Homo sapiens
ccctggtggtacggcactggca

SEQ ID NO: 8050195 - DNA, 22 bp, Homo sapiens
ccctgtggcaggaggaggagca

SEQ ID NO: 8050196 - DNA, 22 bp, Homo sapiens
ccctgtggaggaggagagcagt

SEQ ID NO: 8050197 - DNA, 20 bp, Homo sapiens
ccctaggaacgcagcaggag

SEQ ID NO: 8050198 - DNA, 19 bp, Homo sapiens
tggaaggctaagacacttg

SEQ ID NO: 8050199 - DNA, 22 bp, Homo sapiens
tggaagggaaagtttggggtcc

SEQ ID NO: 8050200 - DNA, 22 bp, Homo sapiens
tggaagggaacaggtgggtgtt

SEQ ID NO: 8050201 - DNA, 22 bp, Homo sapiens
tggaagaatgtttgccttataa

SEQ ID NO: 8050202 - DNA, 22 bp, Homo sapiens
tgcctccattcctgggtcattg

SEQ ID NO: 8050203 - DNA, 23 bp, Homo sapiens
tgcctccaccgagggccaggcat

SEQ ID NO: 8050204 - DNA, 22 bp, Homo sapiens
tgcctccatgtttcagcatcta

SEQ ID NO: 8050205 - DNA, 22 bp, Homo sapiens
tgcctccaggaggggcagctct

SEQ ID NO: 8050206 - DNA, 22 bp, Homo sapiens
tgcctccaccattgctcacttt

SEQ ID NO: 8050207 - DNA, 22 bp, Homo sapiens
tgcctcagtttctccatatgaa

SEQ ID NO: 8050208 - DNA, 22 bp, Homo sapiens
tgcctgctaggccctgctgggt

SEQ ID NO: 8050209 - DNA, 19 bp, Homo sapiens
tgcctgctcctggcttcca

SEQ ID NO: 8050210 - DNA, 22 bp, Homo sapiens
tgctttattttaaatatgccat

SEQ ID NO: 8050211 - DNA, 22 bp, Homo sapiens
tgctttatttataaaatagcaa

SEQ ID NO: 8050212 - DNA, 22 bp, Homo sapiens
tgctttattgcatcagtgtggg

SEQ ID NO: 8050213 - DNA, 22 bp, Homo sapiens
tgctttattggaacctcatcct

SEQ ID NO: 8050214 - DNA, 22 bp, Homo sapiens
tgctttcattcacaaaatagca

SEQ ID NO: 8050215 - DNA, 22 bp, Homo sapiens
tgctttcagctggtaaagaaac

SEQ ID NO: 8050216 - DNA, 22 bp, Homo sapiens
tgctttcacatgtatgcacaaa

SEQ ID NO: 8050217 - DNA, 22 bp, Homo sapiens
tggaggccaggaaggcagcgag

SEQ ID NO: 8050218 - DNA, 22 bp, Homo sapiens
tggaggggcaatggagcgcgga

SEQ ID NO: 8050219 - DNA, 22 bp, Homo sapiens
tggaggggcaatggagcgcgga

SEQ ID NO: 8050220 - DNA, 22 bp, Homo sapiens
tggaggggcaatggagcgcgga

SEQ ID NO: 8050221 - DNA, 22 bp, Homo sapiens
ccctgctgaatcccatggagtc

SEQ ID NO: 8050222 - DNA, 23 bp, Homo sapiens
ccctggagctagtctgagcagag

SEQ ID NO: 8050223 - DNA, 22 bp, Homo sapiens
ccctggagctgcttgcatgttg

SEQ ID NO: 8050224 - DNA, 23 bp, Homo sapiens
ccctggagctagtctgagcgggg

SEQ ID NO: 8050225 - DNA, 19 bp, Homo sapiens
tggaggggtttgaatgtgg

SEQ ID NO: 8050226 - DNA, 19 bp, Homo sapiens
tggaggggtttgaatgtgg

SEQ ID NO: 8050227 - DNA, 22 bp, Homo sapiens
ccctgcagtcctttcttggctc

SEQ ID NO: 8050228 - DNA, 22 bp, Homo sapiens
tggacatgagctgagtgggtgt

SEQ ID NO: 8050229 - DNA, 22 bp, Homo sapiens
tggacatgtaaaggctcaaggt

SEQ ID NO: 8050230 - DNA, 22 bp, Homo sapiens
tggacatgacctcgagcgagat

SEQ ID NO: 8050231 - DNA, 22 bp, Homo sapiens
tggacaggttgagtaggaggag

SEQ ID NO: 8050232 - DNA, 22 bp, Homo sapiens
tggacaggttgagtaggaggag

SEQ ID NO: 8050233 - DNA, 22 bp, Homo sapiens
ccctgcagatcagtgagaactt

SEQ ID NO: 8050234 - DNA, 22 bp, Homo sapiens
ccctgcagagggatgggggcag

SEQ ID NO: 8050235 - DNA, 22 bp, Homo sapiens
ccctgcagatctagggtccttc

SEQ ID NO: 8050236 - DNA, 22 bp, Homo sapiens
ccctgcagaaccacagacaaac

SEQ ID NO: 8050237 - DNA, 22 bp, Homo sapiens
ccctgcagaccaatgccataga

SEQ ID NO: 8050238 - DNA, 22 bp, Homo sapiens
ccctgcagacgtcttgatgcct

SEQ ID NO: 8050239 - DNA, 22 bp, Homo sapiens
ccctgcagagccagccctgacc

SEQ ID NO: 8050240 - DNA, 22 bp, Homo sapiens
ccctgcagagagtgcttttgtg

SEQ ID NO: 8050241 - DNA, 22 bp, Homo sapiens
tccacatagtcattaatttctg

SEQ ID NO: 8050242 - DNA, 22 bp, Homo sapiens
tccacatggctgggaggcctca

SEQ ID NO: 8050243 - DNA, 22 bp, Homo sapiens
tcattctgcatcactcttgctc

SEQ ID NO: 8050244 - DNA, 22 bp, Homo sapiens
tcatttatcatttgtgctgtag

SEQ ID NO: 8050245 - DNA, 22 bp, Homo sapiens
tcattcatctggtgttagtcct

SEQ ID NO: 8050246 - DNA, 22 bp, Homo sapiens
tcatcagtgtccttatcactta

SEQ ID NO: 8050247 - DNA, 22 bp, Homo sapiens
tcatcagtttagaaaaaatatg

SEQ ID NO: 8050248 - DNA, 22 bp, Homo sapiens
tccaggctccctcaggatgcac

SEQ ID NO: 8050249 - DNA, 21 bp, Homo sapiens
catgtgtcattggagagcaat

SEQ ID NO: 8050250 - DNA, 18 bp, Homo sapiens
tccaggctccaggctaac

SEQ ID NO: 8050251 - DNA, 22 bp, Homo sapiens
tccaggctcccctgcgtgctcc

SEQ ID NO: 8050252 - DNA, 22 bp, Homo sapiens
catgtgtccacccttgaacaca

SEQ ID NO: 8050253 - DNA, 20 bp, Homo sapiens
tccagctgggaacagctgat

SEQ ID NO: 8050254 - DNA, 22 bp, Homo sapiens
tccaggcagcccttcctgactc

SEQ ID NO: 8050255 - DNA, 22 bp, Homo sapiens
tccaggccccactgaagcccct

SEQ ID NO: 8050256 - DNA, 22 bp, Homo sapiens
tccaggcccatggagcagagct

SEQ ID NO: 8050257 - DNA, 22 bp, Homo sapiens
tccaggcccgagatgggctgga

SEQ ID NO: 8050258 - DNA, 22 bp, Homo sapiens
tccagctgaggtggcctctgtg

SEQ ID NO: 8050259 - DNA, 22 bp, Homo sapiens
tccagctgcaaggggcacagct

SEQ ID NO: 8050260 - DNA, 22 bp, Homo sapiens
tccagccctgtgtctgggagag

SEQ ID NO: 8050261 - DNA, 22 bp, Homo sapiens
tcctcagggaagatgagcctca

SEQ ID NO: 8050262 - DNA, 22 bp, Homo sapiens
tcctctccatgtctcacgccac

SEQ ID NO: 8050263 - DNA, 22 bp, Homo sapiens
tccctcagaaattctctctgaa

SEQ ID NO: 8050264 - DNA, 22 bp, Homo sapiens
cattgacttacctagtatcacc

SEQ ID NO: 8050265 - DNA, 22 bp, Homo sapiens
cattgaataatgtccttgcaaa

SEQ ID NO: 8050266 - DNA, 19 bp, Homo sapiens
tccccagcacctctgagtc

SEQ ID NO: 8050267 - DNA, 22 bp, Homo sapiens
tccccagattcatgtctgctgt

SEQ ID NO: 8050268 - DNA, 22 bp, Homo sapiens
tccccagaggtgaggcagcttt

SEQ ID NO: 8050269 - DNA, 22 bp, Homo sapiens
tccccagacagcgggaggcctg

SEQ ID NO: 8050270 - DNA, 22 bp, Homo sapiens
cattcattacactcataaggtt

SEQ ID NO: 8050271 - DNA, 22 bp, Homo sapiens
cattcattagaatagatatgta

SEQ ID NO: 8050272 - DNA, 22 bp, Homo sapiens
catgttctaacaatgagaaacc

SEQ ID NO: 8050273 - DNA, 22 bp, Homo sapiens
catgttctaatattgtgacata

SEQ ID NO: 8050274 - DNA, 22 bp, Homo sapiens
cattcatttactttcaacagct

SEQ ID NO: 8050275 - DNA, 22 bp, Homo sapiens
cattcattctgtaagtaactat

SEQ ID NO: 8050276 - DNA, 22 bp, Homo sapiens
cattcattcacattttgtctat

SEQ ID NO: 8050277 - DNA, 22 bp, Homo sapiens
cattcattcagcaactgttatt

SEQ ID NO: 8050278 - DNA, 22 bp, Homo sapiens
cattcatttatgaaatatctat

SEQ ID NO: 8050279 - DNA, 22 bp, Homo sapiens
tctcctggccgggctgtcccct

SEQ ID NO: 8050280 - DNA, 22 bp, Homo sapiens
tctcctggcctttaggttaagg

SEQ ID NO: 8050281 - DNA, 22 bp, Homo sapiens
tctcctggctcaccaggctgga

SEQ ID NO: 8050282 - DNA, 22 bp, Homo sapiens
tctcctggctcaccaggctgga

SEQ ID NO: 8050283 - DNA, 17 bp, Homo sapiens
tctcctggctctatcag

SEQ ID NO: 8050284 - DNA, 22 bp, Homo sapiens
tctcctggctctaaaaggctgt

SEQ ID NO: 8050285 - DNA, 23 bp, Homo sapiens
tctcctggctgcactgtggccac

SEQ ID NO: 8050286 - DNA, 22 bp, Homo sapiens
tctctgccacagcttctgcctt

SEQ ID NO: 8050287 - DNA, 22 bp, Homo sapiens
tctctgcccatcctcagtccac

SEQ ID NO: 8050288 - DNA, 22 bp, Homo sapiens
tctctgggacactgggtcagtt

SEQ ID NO: 8050289 - DNA, 22 bp, Homo sapiens
ccagcagcatcctgcagcactt

SEQ ID NO: 8050290 - DNA, 22 bp, Homo sapiens
ccagcagccagagaaggacctc

SEQ ID NO: 8050291 - DNA, 22 bp, Homo sapiens
ccagcagcgatagggtgagtgc

SEQ ID NO: 8050292 - DNA, 22 bp, Homo sapiens
ccagcagccctcttccaagact

SEQ ID NO: 8050293 - DNA, 22 bp, Homo sapiens
ccagcagcccacaggcgtccct

SEQ ID NO: 8050294 - DNA, 22 bp, Homo sapiens
ccagcagcaggccaggccctcc

SEQ ID NO: 8050295 - DNA, 22 bp, Homo sapiens
ccagcagcagcgtccaaggaga

SEQ ID NO: 8050296 - DNA, 22 bp, Homo sapiens
ccagcactgctctcagactgag

SEQ ID NO: 8050297 - DNA, 22 bp, Homo sapiens
ccagcactgctctcagactgag

SEQ ID NO: 8050298 - DNA, 22 bp, Homo sapiens
ccagcagctccctcagggtccg

SEQ ID NO: 8050299 - DNA, 22 bp, Homo sapiens
ccagcagctgacaccagtccca

SEQ ID NO: 8050300 - DNA, 22 bp, Homo sapiens
ccagcagctgcaaagcctgggt

SEQ ID NO: 8050301 - DNA, 22 bp, Homo sapiens
ccagcagctgctatgtggtttt

SEQ ID NO: 8050302 - DNA, 22 bp, Homo sapiens
ccagcagctttattggctctcc

SEQ ID NO: 8050303 - DNA, 22 bp, Homo sapiens
ccagcagggcagtgccctggac

SEQ ID NO: 8050304 - DNA, 22 bp, Homo sapiens
ccagcagggcagtgccctggac

SEQ ID NO: 8050305 - DNA, 22 bp, Homo sapiens
ccagcaggggaatatttttagg

SEQ ID NO: 8050306 - DNA, 22 bp, Homo sapiens
ccagccctgtcaccaactggag

SEQ ID NO: 8050307 - DNA, 22 bp, Homo sapiens
ccagccctgtcaccaactggag

SEQ ID NO: 8050308 - DNA, 22 bp, Homo sapiens
ccagccctgtaaggatgaggca

SEQ ID NO: 8050309 - DNA, 22 bp, Homo sapiens
ccagccctgtttatgtgtcact

SEQ ID NO: 8050310 - DNA, 22 bp, Homo sapiens
ccagccctgcctctcagggccc

SEQ ID NO: 8050311 - DNA, 22 bp, Homo sapiens
ccagccacgaagctcccttcat

SEQ ID NO: 8050312 - DNA, 22 bp, Homo sapiens
ccagcatgctcagtctaaattg

SEQ ID NO: 8050313 - DNA, 22 bp, Homo sapiens
ccagcatggcacctgagatgag

SEQ ID NO: 8050314 - DNA, 20 bp, Homo sapiens
ccagcatgtacacatgtgga

SEQ ID NO: 8050315 - DNA, 22 bp, Homo sapiens
ccagccacagcttccagctcct

SEQ ID NO: 8050316 - DNA, 21 bp, Homo sapiens
tctgatatatccccaagttac

SEQ ID NO: 8050317 - DNA, 22 bp, Homo sapiens
tctgatatgaatgtctagctct

SEQ ID NO: 8050318 - DNA, 22 bp, Homo sapiens
tctgaatatgtttatcatctct

SEQ ID NO: 8050319 - DNA, 22 bp, Homo sapiens
tctgaataatgtccttgtatca

SEQ ID NO: 8050320 - DNA, 18 bp, Homo sapiens
ccagcatgccagaggctg

SEQ ID NO: 8050321 - DNA, 22 bp, Homo sapiens
ccagcatgagacgatgatgaag

SEQ ID NO: 8050322 - DNA, 19 bp, Homo sapiens
ccagcaggttcatttcagg

SEQ ID NO: 8050323 - DNA, 22 bp, Homo sapiens
ccagcaggtgtagggctcatgg

SEQ ID NO: 8050324 - DNA, 22 bp, Homo sapiens
ccagcagggttggtttcttctg

SEQ ID NO: 8050325 - DNA, 22 bp, Homo sapiens
tctctgtgtgtgtgacagcatt

SEQ ID NO: 8050326 - DNA, 22 bp, Homo sapiens
tctctgttcatggcactatgtc

SEQ ID NO: 8050327 - DNA, 22 bp, Homo sapiens
tctccacactttctctcccagg

SEQ ID NO: 8050328 - DNA, 22 bp, Homo sapiens
ccacttttttctccatctctga

SEQ ID NO: 8050329 - DNA, 22 bp, Homo sapiens
ccacctcctcggccatgtgacg

SEQ ID NO: 8050330 - DNA, 22 bp, Homo sapiens
tctcaagctagtgtttatagta

SEQ ID NO: 8050331 - DNA, 22 bp, Homo sapiens
tctccaggaagccctccctgac

SEQ ID NO: 8050332 - DNA, 20 bp, Homo sapiens
tctccctgcccatctcagat

SEQ ID NO: 8050333 - DNA, 22 bp, Homo sapiens
tctccctgtggaggacccctta

SEQ ID NO: 8050334 - DNA, 22 bp, Homo sapiens
tctcctggccgggctgtcccct

SEQ ID NO: 8050335 - DNA, 22 bp, Homo sapiens
tcctctctgcactggccctgcc

SEQ ID NO: 8050336 - DNA, 22 bp, Homo sapiens
ccaccaggacagccctgagggg

SEQ ID NO: 8050337 - DNA, 23 bp, Homo sapiens
tcggtgggcgtggaggccgaggc

SEQ ID NO: 8050338 - DNA, 22 bp, Homo sapiens
ccaccctgtgcaggcgtgggta

SEQ ID NO: 8050339 - DNA, 22 bp, Homo sapiens
ccaccctggactcgaggcccga

SEQ ID NO: 8050340 - DNA, 22 bp, Homo sapiens
caggtggtcaggcagatgggct

SEQ ID NO: 8050341 - DNA, 22 bp, Homo sapiens
cagtagccactagacacatgta

SEQ ID NO: 8050342 - DNA, 22 bp, Homo sapiens
cagtagccttatttggatcatt

SEQ ID NO: 8050343 - DNA, 22 bp, Homo sapiens
cagtcccagaagagcctgggag

SEQ ID NO: 8050344 - DNA, 21 bp, Homo sapiens
tatttctttgactctctccct

SEQ ID NO: 8050345 - DNA, 20 bp, Homo sapiens
cagtcccaatccagggccag

SEQ ID NO: 8050346 - DNA, 22 bp, Homo sapiens
cagtccagagcccaccagagga

SEQ ID NO: 8050347 - DNA, 22 bp, Homo sapiens
tatttcttttcgtgacttattg

SEQ ID NO: 8050348 - DNA, 22 bp, Homo sapiens
cagtgagagtatttgtgctaag

SEQ ID NO: 8050349 - DNA, 22 bp, Homo sapiens
tcacagacctggtgggaggtgg

SEQ ID NO: 8050350 - DNA, 22 bp, Homo sapiens
tcacagactcaagggcatagga

SEQ ID NO: 8050351 - DNA, 22 bp, Homo sapiens
cagtgagcacggccagagggga

SEQ ID NO: 8050352 - DNA, 22 bp, Homo sapiens
cagtgagctcctgtctgtccct

SEQ ID NO: 8050353 - DNA, 22 bp, Homo sapiens
tcacagtgtggcaactcacaga

SEQ ID NO: 8050354 - DNA, 18 bp, Homo sapiens
tcacagacttactgggcc

SEQ ID NO: 8050355 - DNA, 22 bp, Homo sapiens
tcacagacttgtctccagggat

SEQ ID NO: 8050356 - DNA, 21 bp, Homo sapiens
tcacagactggtcagtgaggc

SEQ ID NO: 8050357 - DNA, 22 bp, Homo sapiens
cagtggggaggccaggatagaa

SEQ ID NO: 8050358 - DNA, 22 bp, Homo sapiens
cagtgggggtgaggccgaggta

SEQ ID NO: 8050359 - DNA, 22 bp, Homo sapiens
cagtgggatatgggggcagcat

SEQ ID NO: 8050360 - DNA, 23 bp, Homo sapiens
cagtgggaggactgagataaaac

SEQ ID NO: 8050361 - DNA, 22 bp, Homo sapiens
cagtgggagcaaatacactcat

SEQ ID NO: 8050362 - DNA, 22 bp, Homo sapiens
cagtgggattgggattggaacc

SEQ ID NO: 8050363 - DNA, 22 bp, Homo sapiens
cagtgggacatgggcactgggc

SEQ ID NO: 8050364 - DNA, 22 bp, Homo sapiens
cagtgggacatgggcactgggc

SEQ ID NO: 8050365 - DNA, 22 bp, Homo sapiens
cagtgggaatgaagtggaggcc

SEQ ID NO: 8050366 - DNA, 22 bp, Homo sapiens
cagtgggaatgaagtggaggcc

SEQ ID NO: 8050367 - DNA, 22 bp, Homo sapiens
cagtgggaagaatgcagcctcc

SEQ ID NO: 8050368 - DNA, 22 bp, Homo sapiens
cagtgggaagggcagaggcttt

SEQ ID NO: 8050369 - DNA, 22 bp, Homo sapiens
cagtggctgtgaccagggacct

SEQ ID NO: 8050370 - DNA, 22 bp, Homo sapiens
cagtggctggttagggacagga

SEQ ID NO: 8050371 - DNA, 22 bp, Homo sapiens
cagtggcttacaatgaactaga

SEQ ID NO: 8050372 - DNA, 22 bp, Homo sapiens
cagtggctgtttctggaaggca

SEQ ID NO: 8050373 - DNA, 22 bp, Homo sapiens
cagtggcttcttcctagagcca

SEQ ID NO: 8050374 - DNA, 22 bp, Homo sapiens
cagtggcttctcatgtcattca

SEQ ID NO: 8050375 - DNA, 22 bp, Homo sapiens
cagtgccatgatgcagagcaat

SEQ ID NO: 8050376 - DNA, 22 bp, Homo sapiens
cagtgccatgatgcagagcaat

SEQ ID NO: 8050377 - DNA, 22 bp, Homo sapiens
cagtggcaggggaagcaggtgt

SEQ ID NO: 8050378 - DNA, 21 bp, Homo sapiens
cagtgccagccacaggacgcc

SEQ ID NO: 8050379 - DNA, 22 bp, Homo sapiens
cagtgccaaggatggcctggga

SEQ ID NO: 8050380 - DNA, 22 bp, Homo sapiens
cagtgccacaggaatggccaat

SEQ ID NO: 8050381 - DNA, 22 bp, Homo sapiens
cagtgccacttaatgaggctgc

SEQ ID NO: 8050382 - DNA, 22 bp, Homo sapiens
cataaagttaagctgtaagtat

SEQ ID NO: 8050383 - DNA, 22 bp, Homo sapiens
cagtttatagctctagcagctt

SEQ ID NO: 8050384 - DNA, 22 bp, Homo sapiens
cagtttatatataagcacattg

SEQ ID NO: 8050385 - DNA, 22 bp, Homo sapiens
tcagctttgatctcaggcaatc

SEQ ID NO: 8050386 - DNA, 22 bp, Homo sapiens
tcagctttggtcacattgagtt

SEQ ID NO: 8050387 - DNA, 21 bp, Homo sapiens
tcagcagcatctgcctagagt

SEQ ID NO: 8050388 - DNA, 22 bp, Homo sapiens
tcagcagcagctcagcatgttt

SEQ ID NO: 8050389 - DNA, 22 bp, Homo sapiens
cagggctcagggactgcagaaa

SEQ ID NO: 8050390 - DNA, 22 bp, Homo sapiens
cagggctcagggactgcagaaa

SEQ ID NO: 8050391 - DNA, 22 bp, Homo sapiens
cagggctcagaagacagacctc

SEQ ID NO: 8050392 - DNA, 22 bp, Homo sapiens
cagggctcactcggctggcgtc

SEQ ID NO: 8050393 - DNA, 22 bp, Homo sapiens
cagggctcaggaaatcagacgt

SEQ ID NO: 8050394 - DNA, 22 bp, Homo sapiens
cagggcctgtcacgacgctcat

SEQ ID NO: 8050395 - DNA, 22 bp, Homo sapiens
cagggccttcgtaagtgtccgg

SEQ ID NO: 8050396 - DNA, 22 bp, Homo sapiens
cagggccttttagcatcttctc

SEQ ID NO: 8050397 - DNA, 22 bp, Homo sapiens
cagggccttgttcaggagtgaa

SEQ ID NO: 8050398 - DNA, 22 bp, Homo sapiens
cagggcctccccggcagtcttt

SEQ ID NO: 8050399 - DNA, 22 bp, Homo sapiens
cagggcctgcttccttcttgtt

SEQ ID NO: 8050400 - DNA, 22 bp, Homo sapiens
cagggcctggagctgggcctgc

SEQ ID NO: 8050401 - DNA, 19 bp, Homo sapiens
taggaccctggtggccccc

SEQ ID NO: 8050402 - DNA, 22 bp, Homo sapiens
taggagaagagtcagggcctaa

SEQ ID NO: 8050403 - DNA, 22 bp, Homo sapiens
tagctttaagatgagatgtgga

SEQ ID NO: 8050404 - DNA, 22 bp, Homo sapiens
cagggcagagggaaactccttt

SEQ ID NO: 8050405 - DNA, 22 bp, Homo sapiens
cagggcagccaggccccgtggg

SEQ ID NO: 8050406 - DNA, 22 bp, Homo sapiens
cagggcaggaatttgacattgc

SEQ ID NO: 8050407 - DNA, 22 bp, Homo sapiens
cagggcagcttcctttgttagg

SEQ ID NO: 8050408 - DNA, 22 bp, Homo sapiens
cagggcagccaggccccgtggg

SEQ ID NO: 8050409 - DNA, 22 bp, Homo sapiens
cagggcagccaggccccgtggg

SEQ ID NO: 8050410 - DNA, 22 bp, Homo sapiens
tagctcagcaggtgggacaggt

SEQ ID NO: 8050411 - DNA, 22 bp, Homo sapiens
tagctagaaagtttcagctgtg

SEQ ID NO: 8050412 - DNA, 22 bp, Homo sapiens
tatcatgtctggagatactttt

SEQ ID NO: 8050413 - DNA, 22 bp, Homo sapiens
tatcatttaacagaatcattgc

SEQ ID NO: 8050414 - DNA, 22 bp, Homo sapiens
cagggtggcaggcaccatggcc

SEQ ID NO: 8050415 - DNA, 22 bp, Homo sapiens
cagggtggcaggcaccatggcc

SEQ ID NO: 8050416 - DNA, 22 bp, Homo sapiens
tatcatgtccctaaagagagga

SEQ ID NO: 8050417 - DNA, 22 bp, Homo sapiens
tatcagtgtggtttctggactg

SEQ ID NO: 8050418 - DNA, 22 bp, Homo sapiens
tatcagtgtgcatctctgaatg

SEQ ID NO: 8050419 - DNA, 22 bp, Homo sapiens
caggggagttttatgcaacaga

SEQ ID NO: 8050420 - DNA, 22 bp, Homo sapiens
caggggagttttatgcaacaga

SEQ ID NO: 8050421 - DNA, 22 bp, Homo sapiens
caggggcaagaatgctgtcagc

SEQ ID NO: 8050422 - DNA, 22 bp, Homo sapiens
tagtgataatgtttatgctttt

SEQ ID NO: 8050423 - DNA, 22 bp, Homo sapiens
tagggctccactcccagagatt

SEQ ID NO: 8050424 - DNA, 22 bp, Homo sapiens
tagggcagtttcatgttatctt

SEQ ID NO: 8050425 - DNA, 22 bp, Homo sapiens
tagggcaggggaggaatctgaa

SEQ ID NO: 8050426 - DNA, 22 bp, Homo sapiens
tagggcagttataacattagtg

SEQ ID NO: 8050427 - DNA, 22 bp, Homo sapiens
tagggcaggtgaagaaaagcta

SEQ ID NO: 8050428 - DNA, 21 bp, Homo sapiens
tagggcaggcattggaagaga

SEQ ID NO: 8050429 - DNA, 22 bp, Homo sapiens
caggggacattaaagctccata

SEQ ID NO: 8050430 - DNA, 22 bp, Homo sapiens
cagggctttgaacaggcatcaa

SEQ ID NO: 8050431 - DNA, 22 bp, Homo sapiens
cagggctttcccttgtagaaat

SEQ ID NO: 8050432 - DNA, 22 bp, Homo sapiens
caggctggagtgcaatggcaca

SEQ ID NO: 8050433 - DNA, 22 bp, Homo sapiens
caggctggagtgcaatggtgct

SEQ ID NO: 8050434 - DNA, 22 bp, Homo sapiens
caggctggagtgcagtggcgcc

SEQ ID NO: 8050435 - DNA, 22 bp, Homo sapiens
caggctggagtgcagtggcgcc

SEQ ID NO: 8050436 - DNA, 22 bp, Homo sapiens
caggctggagtgagtgtagtgg

SEQ ID NO: 8050437 - DNA, 22 bp, Homo sapiens
caggctggagtgagtgtagtgg

SEQ ID NO: 8050438 - DNA, 16 bp, Homo sapiens
tactgtggagcaaggc

SEQ ID NO: 8050439 - DNA, 22 bp, Homo sapiens
caggctgcctggaagaggactg

SEQ ID NO: 8050440 - DNA, 22 bp, Homo sapiens
tagaatatacactacagcttaa

SEQ ID NO: 8050441 - DNA, 22 bp, Homo sapiens
caggctggagtgcagtggtgcc

SEQ ID NO: 8050442 - DNA, 22 bp, Homo sapiens
caggctggagtgcagtggggcg

SEQ ID NO: 8050443 - DNA, 22 bp, Homo sapiens
caggctggagtgcagtggggcg

SEQ ID NO: 8050444 - DNA, 22 bp, Homo sapiens
caggctggagtgcagtggggcg

SEQ ID NO: 8050445 - DNA, 22 bp, Homo sapiens
caggctggagtgcagtggcgct

SEQ ID NO: 8050446 - DNA, 22 bp, Homo sapiens
caggctggagtgcagtggcgct

SEQ ID NO: 8050447 - DNA, 22 bp, Homo sapiens
cagccctgtgcggagggccctg

SEQ ID NO: 8050448 - DNA, 22 bp, Homo sapiens
gtgagggcagaacccccaggcc

SEQ ID NO: 8050449 - DNA, 22 bp, Homo sapiens
gtgaggggagtaaagccatgtt

SEQ ID NO: 8050450 - DNA, 22 bp, Homo sapiens
gtgaggggccaagagtagggca

SEQ ID NO: 8050451 - DNA, 20 bp, Homo sapiens
tactcacaaatggtttagca

SEQ ID NO: 8050452 - DNA, 22 bp, Homo sapiens
cagggcagagccaggatttcaa

SEQ ID NO: 8050453 - DNA, 22 bp, Homo sapiens
cagggatggcgctggctgcccg

SEQ ID NO: 8050454 - DNA, 22 bp, Homo sapiens
cagggcagaaggcactctactc

SEQ ID NO: 8050455 - DNA, 22 bp, Homo sapiens
cagggcagaacatatagatagt

SEQ ID NO: 8050456 - DNA, 22 bp, Homo sapiens
caggctgggctccggagataaa

SEQ ID NO: 8050457 - DNA, 22 bp, Homo sapiens
tagaatatgtggtgtatacttt

SEQ ID NO: 8050458 - DNA, 18 bp, Homo sapiens
tagaatcaaatattttac

SEQ ID NO: 8050459 - DNA, 22 bp, Homo sapiens
caggctgggctccggagataaa

SEQ ID NO: 8050460 - DNA, 22 bp, Homo sapiens
caggctggtcccagagcattgc

SEQ ID NO: 8050461 - DNA, 22 bp, Homo sapiens
tttgtaaaattagggaattcaa

SEQ ID NO: 8050462 - DNA, 22 bp, Homo sapiens
tttgtaaaaggaggaagcatgg

SEQ ID NO: 8050463 - DNA, 22 bp, Homo sapiens
tttgtgttttcccatactattg

SEQ ID NO: 8050464 - DNA, 22 bp, Homo sapiens
tttgtgttttcactagcagtgt

SEQ ID NO: 8050465 - DNA, 22 bp, Homo sapiens
tttgtgttggaagaaatgctac

SEQ ID NO: 8050466 - DNA, 22 bp, Homo sapiens
tttgtgttttagctggtgaggc

SEQ ID NO: 8050467 - DNA, 22 bp, Homo sapiens
tttgtgtttgtacaatgcacta

SEQ ID NO: 8050468 - DNA, 22 bp, Homo sapiens
tttgtgtttaatacaaggacct

SEQ ID NO: 8050469 - DNA, 22 bp, Homo sapiens
tttgtgtttatgaagttattct

SEQ ID NO: 8050470 - DNA, 22 bp, Homo sapiens
tttgtgttgttttaagccacta

SEQ ID NO: 8050471 - DNA, 22 bp, Homo sapiens
tttgtgttgtacttctgtgcat

SEQ ID NO: 8050472 - DNA, 22 bp, Homo sapiens
tttgtgttctgatccaaaggcc

SEQ ID NO: 8050473 - DNA, 22 bp, Homo sapiens
tttgtgttaaatgttaaattca

SEQ ID NO: 8050474 - DNA, 18 bp, Homo sapiens
ttttaatttcaggggtgg

SEQ ID NO: 8050475 - DNA, 22 bp, Homo sapiens
ttttaattgcaattatggtccc

SEQ ID NO: 8050476 - DNA, 22 bp, Homo sapiens
ttttaatgggcgactattatgg

SEQ ID NO: 8050477 - DNA, 22 bp, Homo sapiens
ttttaagaaatgtatgactgtc

SEQ ID NO: 8050478 - DNA, 22 bp, Homo sapiens
ttttaacttaaaatacatagat

SEQ ID NO: 8050479 - DNA, 22 bp, Homo sapiens
ttttaaaggctgtatgaccaag

SEQ ID NO: 8050480 - DNA, 22 bp, Homo sapiens
ttttaaagagatgctgtgcata

SEQ ID NO: 8050481 - DNA, 22 bp, Homo sapiens
ttttaaaggatagctctggttg

SEQ ID NO: 8050482 - DNA, 22 bp, Homo sapiens
ttttaaaggatactcttgtcta

SEQ ID NO: 8050483 - DNA, 22 bp, Homo sapiens
ttttcatttttgtagatgcaag

SEQ ID NO: 8050484 - DNA, 19 bp, Homo sapiens
ttttctcagcttctagcgg

SEQ ID NO: 8050485 - DNA, 22 bp, Homo sapiens
ttttctcaagatccaatgcact

SEQ ID NO: 8050486 - DNA, 20 bp, Homo sapiens
ttttctgtgccaagaaaact

SEQ ID NO: 8050487 - DNA, 22 bp, Homo sapiens
ttttctgaagtttaagacattt

SEQ ID NO: 8050488 - DNA, 22 bp, Homo sapiens
ttttcattgagcacctgagtaa

SEQ ID NO: 8050489 - DNA, 22 bp, Homo sapiens
ttttcattgtaaatcaggaaac

SEQ ID NO: 8050490 - DNA, 22 bp, Homo sapiens
ttttcattgttcctcgagcatt

SEQ ID NO: 8050491 - DNA, 22 bp, Homo sapiens
ttttcacacaaggtgataagtt

SEQ ID NO: 8050492 - DNA, 22 bp, Homo sapiens
ttttattggagtgataccaagc

SEQ ID NO: 8050493 - DNA, 22 bp, Homo sapiens
ttttattatctttgaatgggac

SEQ ID NO: 8050494 - DNA, 22 bp, Homo sapiens
ttttattgcaataaagtgtgta

SEQ ID NO: 8050495 - DNA, 21 bp, Homo sapiens
tttgaaagccctatgttttca

SEQ ID NO: 8050496 - DNA, 17 bp, Homo sapiens
tttgaaaggatgtcagt

SEQ ID NO: 8050497 - DNA, 22 bp, Homo sapiens
tttgaaaaaggcctttggtatg

SEQ ID NO: 8050498 - DNA, 21 bp, Homo sapiens
tttgaaagccctatgttttca

SEQ ID NO: 8050499 - DNA, 22 bp, Homo sapiens
tttgaagagccacagtgaaatt

SEQ ID NO: 8050500 - DNA, 22 bp, Homo sapiens
tttgaagattatgccagagtga

SEQ ID NO: 8050501 - DNA, 22 bp, Homo sapiens
tttgaagataaatatggagaaa

SEQ ID NO: 8050502 - DNA, 19 bp, Homo sapiens
tttgaatataatgcagcta

SEQ ID NO: 8050503 - DNA, 22 bp, Homo sapiens
tttgaatgacatgattcaggca

SEQ ID NO: 8050504 - DNA, 22 bp, Homo sapiens
tttgacaaatccttcagcaatg

SEQ ID NO: 8050505 - DNA, 22 bp, Homo sapiens
tttcccttctttcctgagtaat

SEQ ID NO: 8050506 - DNA, 22 bp, Homo sapiens
tttccctgaggcctggacatta

SEQ ID NO: 8050507 - DNA, 22 bp, Homo sapiens
tttcttttgaatagtgtgtggt

SEQ ID NO: 8050508 - DNA, 19 bp, Homo sapiens
tttcttttcccctcagcac

SEQ ID NO: 8050509 - DNA, 22 bp, Homo sapiens
tttcttttccaatatccctact

SEQ ID NO: 8050510 - DNA, 22 bp, Homo sapiens
tttcttttccaatatccctact

SEQ ID NO: 8050511 - DNA, 19 bp, Homo sapiens
tttcttttcccctcagcac

SEQ ID NO: 8050512 - DNA, 22 bp, Homo sapiens
tttcttttgctgagaggggcac

SEQ ID NO: 8050513 - DNA, 22 bp, Homo sapiens
tttcttttgctgagaggggcac

SEQ ID NO: 8050514 - DNA, 22 bp, Homo sapiens
tttcttttgaatagtgtgtggt

SEQ ID NO: 8050515 - DNA, 22 bp, Homo sapiens
tttcttttgccctgtgggttag

SEQ ID NO: 8050516 - DNA, 22 bp, Homo sapiens
tttcttttgccctgtgggttag

SEQ ID NO: 8050517 - DNA, 21 bp, Homo sapiens
tttctttctggctctcacagt

SEQ ID NO: 8050518 - DNA, 22 bp, Homo sapiens
tttcttttacagtgtggctatt

SEQ ID NO: 8050519 - DNA, 22 bp, Homo sapiens
tttcttttacagtgtggctatt

SEQ ID NO: 8050520 - DNA, 22 bp, Homo sapiens
tttggaaatttcatcaatagcc

SEQ ID NO: 8050521 - DNA, 22 bp, Homo sapiens
tttggaaagacacacagtttta

SEQ ID NO: 8050522 - DNA, 22 bp, Homo sapiens
tttggaaacatctcagaaaata

SEQ ID NO: 8050523 - DNA, 22 bp, Homo sapiens
tttggaaaaagcctgaacatag

SEQ ID NO: 8050524 - DNA, 22 bp, Homo sapiens
tttggaaaaagcctgaacatag

SEQ ID NO: 8050525 - DNA, 22 bp, Homo sapiens
tttggtattgcacactgtcttc

SEQ ID NO: 8050526 - DNA, 21 bp, Homo sapiens
tttgatgattgattctctggc

SEQ ID NO: 8050527 - DNA, 22 bp, Homo sapiens
tttgatgagtttaataacagcc

SEQ ID NO: 8050528 - DNA, 22 bp, Homo sapiens
tttgatgacctgtatctttttc

SEQ ID NO: 8050529 - DNA, 18 bp, Homo sapiens
tttgattgctgtcatcca

SEQ ID NO: 8050530 - DNA, 22 bp, Homo sapiens
tttgatttactataagcagcac

SEQ ID NO: 8050531 - DNA, 22 bp, Homo sapiens
tttgatttactggatattctca

SEQ ID NO: 8050532 - DNA, 18 bp, Homo sapiens
tttgctttccttcttcag

SEQ ID NO: 8050533 - DNA, 22 bp, Homo sapiens
tttgctttgactgtcagcaagt

SEQ ID NO: 8050534 - DNA, 22 bp, Homo sapiens
tttgctttcttgattcagatta

SEQ ID NO: 8050535 - DNA, 22 bp, Homo sapiens
tttttataactcttttgtgaca

SEQ ID NO: 8050536 - DNA, 22 bp, Homo sapiens
ttttgtttgtgtccactgcagt

SEQ ID NO: 8050537 - DNA, 22 bp, Homo sapiens
ttattagtgttgatattaggat

SEQ ID NO: 8050538 - DNA, 22 bp, Homo sapiens
ttattagggtggtttatgttct

SEQ ID NO: 8050539 - DNA, 22 bp, Homo sapiens
ttattaggttattctctgtact

SEQ ID NO: 8050540 - DNA, 22 bp, Homo sapiens
ttattaggtttacataaaggtt

SEQ ID NO: 8050541 - DNA, 22 bp, Homo sapiens
ttattaggaaaaggtcagatgt

SEQ ID NO: 8050542 - DNA, 22 bp, Homo sapiens
ttattaggaactcaggattttt

SEQ ID NO: 8050543 - DNA, 22 bp, Homo sapiens
ttattgagcacctactatgtgt

SEQ ID NO: 8050544 - DNA, 22 bp, Homo sapiens
ttattgtaggcctattgtagaa

SEQ ID NO: 8050545 - DNA, 22 bp, Homo sapiens
ttattgaaatggaagctataac

SEQ ID NO: 8050546 - DNA, 22 bp, Homo sapiens
ttattgagagctgttttatggc

SEQ ID NO: 8050547 - DNA, 22 bp, Homo sapiens
ttattgagcaactctggggctc

SEQ ID NO: 8050548 - DNA, 22 bp, Homo sapiens
ttattgagcacatagtatgtgg

SEQ ID NO: 8050549 - DNA, 21 bp, Homo sapiens
ttattgagacatttgtggaaa

SEQ ID NO: 8050550 - DNA, 22 bp, Homo sapiens
ttattgagaccgtaagtcaggt

SEQ ID NO: 8050551 - DNA, 22 bp, Homo sapiens
ttattgactgatcagagaggga

SEQ ID NO: 8050552 - DNA, 20 bp, Homo sapiens
ttagctttggcaatagtgac

SEQ ID NO: 8050553 - DNA, 22 bp, Homo sapiens
ttcattttctttcacgctgctg

SEQ ID NO: 8050554 - DNA, 22 bp, Homo sapiens
ttcatttttaccgcgtgtcaaa

SEQ ID NO: 8050555 - DNA, 22 bp, Homo sapiens
ttcatttgtgtgcctgatgcaa

SEQ ID NO: 8050556 - DNA, 23 bp, Homo sapiens
ttcatttgtctacttcacttgtt

SEQ ID NO: 8050557 - DNA, 22 bp, Homo sapiens
ttcatttgtccaaatactatgt

SEQ ID NO: 8050558 - DNA, 22 bp, Homo sapiens
ttcatttgtctgctatagatcc

SEQ ID NO: 8050559 - DNA, 22 bp, Homo sapiens
ttcatttgtggttatttacaat

SEQ ID NO: 8050560 - DNA, 19 bp, Homo sapiens
ttcatttgtatctgctcac

SEQ ID NO: 8050561 - DNA, 22 bp, Homo sapiens
ttcatttgtaactctgttaggg

SEQ ID NO: 8050562 - DNA, 22 bp, Homo sapiens
ttcatttaatcagaatctctaa

SEQ ID NO: 8050563 - DNA, 22 bp, Homo sapiens
ttcatttattcagcaggtattt

SEQ ID NO: 8050564 - DNA, 22 bp, Homo sapiens
ttcatttgagtttatagttgct

SEQ ID NO: 8050565 - DNA, 23 bp, Homo sapiens
ttcatttaggagttcataagagc

SEQ ID NO: 8050566 - DNA, 22 bp, Homo sapiens
ttcatttaatttgtgtattaac

SEQ ID NO: 8050567 - DNA, 22 bp, Homo sapiens
ttcacaatgccttgttgatggt

SEQ ID NO: 8050568 - DNA, 22 bp, Homo sapiens
ttcacagagagaactcaaacca

SEQ ID NO: 8050569 - DNA, 22 bp, Homo sapiens
ttcacagctccttttactcaac

SEQ ID NO: 8050570 - DNA, 22 bp, Homo sapiens
ttcacagattgactggattcct

SEQ ID NO: 8050571 - DNA, 22 bp, Homo sapiens
ttgaaatatttgggagtgtttg

SEQ ID NO: 8050572 - DNA, 22 bp, Homo sapiens
ttgaaatccaattatcatatgt

SEQ ID NO: 8050573 - DNA, 22 bp, Homo sapiens
ttgaaatgctctttggaatcta

SEQ ID NO: 8050574 - DNA, 22 bp, Homo sapiens
ttgaaatgagactaattgattg

SEQ ID NO: 8050575 - DNA, 22 bp, Homo sapiens
ttcttttgcaagactattgatt

SEQ ID NO: 8050576 - DNA, 22 bp, Homo sapiens
ttcttttctttaggcattgtgt

SEQ ID NO: 8050577 - DNA, 22 bp, Homo sapiens
ttgaacattggcaatttcatat

SEQ ID NO: 8050578 - DNA, 22 bp, Homo sapiens
ttgaagaaattattttatatag

SEQ ID NO: 8050579 - DNA, 19 bp, Homo sapiens
ttgaattgttttgagtagg

SEQ ID NO: 8050580 - DNA, 22 bp, Homo sapiens
ttcttttaatgttctgaagttt

SEQ ID NO: 8050581 - DNA, 22 bp, Homo sapiens
ttcttttaatgtctggctttca

SEQ ID NO: 8050582 - DNA, 22 bp, Homo sapiens
ttcttttaaaagagagcagaaa

SEQ ID NO: 8050583 - DNA, 22 bp, Homo sapiens
ttcttttaatagagatcctgtg

SEQ ID NO: 8050584 - DNA, 22 bp, Homo sapiens
ttcttttcttggcaggagtaga

SEQ ID NO: 8050585 - DNA, 22 bp, Homo sapiens
ttcttttaattgtgggggagtg

SEQ ID NO: 8050586 - DNA, 22 bp, Homo sapiens
ttctgtggaggtttggaacatt

SEQ ID NO: 8050587 - DNA, 22 bp, Homo sapiens
ttcttagtagcatagctatatt

SEQ ID NO: 8050588 - DNA, 22 bp, Homo sapiens
ttcttataagttaatatttcca

SEQ ID NO: 8050589 - DNA, 22 bp, Homo sapiens
ttctggaatgcctgttctaatt

SEQ ID NO: 8050590 - DNA, 22 bp, Homo sapiens
ttctggaatcctcaaaacatga

SEQ ID NO: 8050591 - DNA, 22 bp, Homo sapiens
ttctggaaatgggtatagagca

SEQ ID NO: 8050592 - DNA, 22 bp, Homo sapiens
ttctggaacatagcaagaagtt

SEQ ID NO: 8050593 - DNA, 21 bp, Homo sapiens
ttcctggggacttccgtggga

SEQ ID NO: 8050594 - DNA, 22 bp, Homo sapiens
ttcctgcacagcccttcctgag

SEQ ID NO: 8050595 - DNA, 22 bp, Homo sapiens
ttcctgcagcaaggagaagctg

SEQ ID NO: 8050596 - DNA, 22 bp, Homo sapiens
ttcctgaggaggaccaggacca

SEQ ID NO: 8050597 - DNA, 22 bp, Homo sapiens
ttcctggtgacctcactggtag

SEQ ID NO: 8050598 - DNA, 21 bp, Homo sapiens
ttctctccatatgcccagccc

SEQ ID NO: 8050599 - DNA, 22 bp, Homo sapiens
ttctcctctgttggccttccct

SEQ ID NO: 8050600 - DNA, 22 bp, Homo sapiens
ttctcagggtctggatggcctg

SEQ ID NO: 8050601 - DNA, 17 bp, Homo sapiens
ttccttgggtgctgggt

SEQ ID NO: 8050602 - DNA, 22 bp, Homo sapiens
ttggccatgacaggacaggaag

SEQ ID NO: 8050603 - DNA, 22 bp, Homo sapiens
ttgggaagtttaatgacagact

SEQ ID NO: 8050604 - DNA, 22 bp, Homo sapiens
ttggccatctaagcccagccac

SEQ ID NO: 8050605 - DNA, 22 bp, Homo sapiens
ttgggagcaaataggaaagagg

SEQ ID NO: 8050606 - DNA, 22 bp, Homo sapiens
ttgggacatctggcatacagtt

SEQ ID NO: 8050607 - DNA, 20 bp, Homo sapiens
ttgggccacactgattcagc

SEQ ID NO: 8050608 - DNA, 22 bp, Homo sapiens
ttgggccactttagtttcctta

SEQ ID NO: 8050609 - DNA, 22 bp, Homo sapiens
ttgggccaaagatgtccttgtt

SEQ ID NO: 8050610 - DNA, 22 bp, Homo sapiens
ttgggccaaatagctatttact

SEQ ID NO: 8050611 - DNA, 22 bp, Homo sapiens
ttgggccaaggcagatctccaa

SEQ ID NO: 8050612 - DNA, 22 bp, Homo sapiens
ttgggcaggtgaagagagggct

SEQ ID NO: 8050613 - DNA, 22 bp, Homo sapiens
ttggagatatcacaccttcaca

SEQ ID NO: 8050614 - DNA, 22 bp, Homo sapiens
ttggagatatcacaccttcaca

SEQ ID NO: 8050615 - DNA, 22 bp, Homo sapiens
ttggcagggcatcagacacgtg

SEQ ID NO: 8050616 - DNA, 22 bp, Homo sapiens
ttggcaggatgatagctttgtg

SEQ ID NO: 8050617 - DNA, 22 bp, Homo sapiens
ttggcaggaatattgcagaggt

SEQ ID NO: 8050618 - DNA, 23 bp, Homo sapiens
ttgtgtctacttcctatctaggg

SEQ ID NO: 8050619 - DNA, 22 bp, Homo sapiens
ttgtgtctatggtttgagcatc

SEQ ID NO: 8050620 - DNA, 22 bp, Homo sapiens
ttgtgtcctaacatctagttaa

SEQ ID NO: 8050621 - DNA, 22 bp, Homo sapiens
ttgtgtcctaagcaccagatgg

SEQ ID NO: 8050622 - DNA, 22 bp, Homo sapiens
ttgtgtcctatatgcatgttct

SEQ ID NO: 8050623 - DNA, 22 bp, Homo sapiens
ttgtgtccctgcggctgaggag

SEQ ID NO: 8050624 - DNA, 22 bp, Homo sapiens
ttgtgtccctggagcttctgtg

SEQ ID NO: 8050625 - DNA, 22 bp, Homo sapiens
ttgtgtccctgtaagacaaagc

SEQ ID NO: 8050626 - DNA, 22 bp, Homo sapiens
ttgtgtcctgatttgacacaat

SEQ ID NO: 8050627 - DNA, 22 bp, Homo sapiens
ttgtgtcctctaatctcaccac

SEQ ID NO: 8050628 - DNA, 21 bp, Homo sapiens
ttgtgtccttctaaagggcca

SEQ ID NO: 8050629 - DNA, 22 bp, Homo sapiens
ttgtgtccccctttgagagcca

SEQ ID NO: 8050630 - DNA, 22 bp, Homo sapiens
ttgtgtcccctgttctacctgt

SEQ ID NO: 8050631 - DNA, 22 bp, Homo sapiens
ttgtgtccaaggctatggtgat

SEQ ID NO: 8050632 - DNA, 22 bp, Homo sapiens
ttgtgtccatttgagtcatgtg

SEQ ID NO: 8050633 - DNA, 23 bp, Homo sapiens
ttgtcctctggatcggtttggtt

SEQ ID NO: 8050634 - DNA, 22 bp, Homo sapiens
ttgtaaactgctgcaggagtgc

SEQ ID NO: 8050635 - DNA, 23 bp, Homo sapiens
ttggaaatggggagaacagattc

SEQ ID NO: 8050636 - DNA, 22 bp, Homo sapiens
ttggaaacgtcaccttttcctt

SEQ ID NO: 8050637 - DNA, 22 bp, Homo sapiens
ttgctttccgtcatgtgctaat

SEQ ID NO: 8050638 - DNA, 23 bp, Homo sapiens
ttgctttcatcatgagatgctcc

SEQ ID NO: 8050639 - DNA, 22 bp, Homo sapiens
ttgcattgttgcaatgaagtat

SEQ ID NO: 8050640 - DNA, 22 bp, Homo sapiens
ttgctctcggggaggctgcagg

SEQ ID NO: 8050641 - DNA, 22 bp, Homo sapiens
ttgctctccagaggctcacagc

SEQ ID NO: 8050642 - DNA, 22 bp, Homo sapiens
ttgcattgcttggtcttcaaga

SEQ ID NO: 8050643 - DNA, 22 bp, Homo sapiens
ttgcattgatgttccttcttgc

SEQ ID NO: 8050644 - DNA, 22 bp, Homo sapiens
ttgcattgatcccagcttgggc

SEQ ID NO: 8050645 - DNA, 22 bp, Homo sapiens
ttgcattgatgtctatacgctg

SEQ ID NO: 8050646 - DNA, 22 bp, Homo sapiens
ttgcattgaaaatatattttaa

SEQ ID NO: 8050647 - DNA, 22 bp, Homo sapiens
ttgcattgaatgcacattttta

SEQ ID NO: 8050648 - DNA, 20 bp, Homo sapiens
ttgcattggatgtgcaggtg

SEQ ID NO: 8050649 - DNA, 22 bp, Homo sapiens
ttgcattgggagtgaggagacc

SEQ ID NO: 8050650 - DNA, 22 bp, Homo sapiens
ttgcattgtaggatgttagaag

SEQ ID NO: 8050651 - DNA, 19 bp, Homo sapiens
ttgcattgtagttggactg

SEQ ID NO: 8050652 - DNA, 22 bp, Homo sapiens
ttgcattgtgattacagaggtg

SEQ ID NO: 8050653 - DNA, 22 bp, Homo sapiens
ttgcaattgctatggagagcgt

SEQ ID NO: 8050654 - DNA, 22 bp, Homo sapiens
ttgcagggaaatagaaataaac

SEQ ID NO: 8050655 - DNA, 22 bp, Homo sapiens
ttgcaggggaaggagcagagct

SEQ ID NO: 8050656 - DNA, 22 bp, Homo sapiens
ttgcagggtcctgtggctctcc

SEQ ID NO: 8050657 - DNA, 22 bp, Homo sapiens
ttgcaggggagaggaacaaaca

SEQ ID NO: 8050658 - DNA, 22 bp, Homo sapiens
tttatattgggagtcgttttga

SEQ ID NO: 8050659 - DNA, 22 bp, Homo sapiens
tttagatgctgtatgttatttc

SEQ ID NO: 8050660 - DNA, 22 bp, Homo sapiens
tttaatgtagcgtgaaatgatt

SEQ ID NO: 8050661 - DNA, 22 bp, Homo sapiens
tttaatgatagctgtttcacat

SEQ ID NO: 8050662 - DNA, 22 bp, Homo sapiens
tttaatgaataattcaaatctg

SEQ ID NO: 8050663 - DNA, 23 bp, Homo sapiens
tttaatgaccaatagaaggaaca

SEQ ID NO: 8050664 - DNA, 22 bp, Homo sapiens
tttaatgatagtcttacgaaaa

SEQ ID NO: 8050665 - DNA, 19 bp, Homo sapiens
tttaagcatagaggccaga

SEQ ID NO: 8050666 - DNA, 22 bp, Homo sapiens
tttaaaggccttgctgagccac

SEQ ID NO: 8050667 - DNA, 22 bp, Homo sapiens
tttaaagtggtccatttcagaa

SEQ ID NO: 8050668 - DNA, 22 bp, Homo sapiens
tttattgaacacttgcactggc

SEQ ID NO: 8050669 - DNA, 22 bp, Homo sapiens
tttattgaattgtaaccctatt

SEQ ID NO: 8050670 - DNA, 22 bp, Homo sapiens
tttattgagtatctactatgtg

SEQ ID NO: 8050671 - DNA, 22 bp, Homo sapiens
tttattgagcacccgttgtgcg

SEQ ID NO: 8050672 - DNA, 20 bp, Homo sapiens
tttattgagcacgtactgtg

SEQ ID NO: 8050673 - DNA, 22 bp, Homo sapiens
tttattgacttcagtgagtctt

SEQ ID NO: 8050674 - DNA, 22 bp, Homo sapiens
tttattgacccaaagcgagagt

SEQ ID NO: 8050675 - DNA, 22 bp, Homo sapiens
tttcacagatataagatttcac

SEQ ID NO: 8050676 - DNA, 22 bp, Homo sapiens
tttcacagatgttttggagtct

SEQ ID NO: 8050677 - DNA, 22 bp, Homo sapiens
tttcacagagaaatataacagg

SEQ ID NO: 8050678 - DNA, 22 bp, Homo sapiens
tttcacagaactcactaaggag

SEQ ID NO: 8050679 - DNA, 22 bp, Homo sapiens
tttcacagaaagaagctagttt

SEQ ID NO: 8050680 - DNA, 22 bp, Homo sapiens
tttcacagaaaggataacatta

SEQ ID NO: 8050681 - DNA, 22 bp, Homo sapiens
tttcaagaacaacattcattca

SEQ ID NO: 8050682 - DNA, 22 bp, Homo sapiens
tttcccagttagtgaagacatg

SEQ ID NO: 8050683 - DNA, 22 bp, Homo sapiens
tttcccagttccctgctctata

SEQ ID NO: 8050684 - DNA, 19 bp, Homo sapiens
tttcccagcccttgctgtg

SEQ ID NO: 8050685 - DNA, 19 bp, Homo sapiens
tttcccagtcccaggagtg

SEQ ID NO: 8050686 - DNA, 22 bp, Homo sapiens
tttcccaggccctcagggctgc

SEQ ID NO: 8050687 - DNA, 18 bp, Homo sapiens
tttcattgagtgtgatat

SEQ ID NO: 8050688 - DNA, 22 bp, Homo sapiens
tttcattgagactatagacatc

SEQ ID NO: 8050689 - DNA, 22 bp, Homo sapiens
tttcagaaagctgaacatatga

SEQ ID NO: 8050690 - DNA, 22 bp, Homo sapiens
tttcagaaacgattatgaacac

SEQ ID NO: 8050691 - DNA, 18 bp, Homo sapiens
tttcacagattcatgact

SEQ ID NO: 8050692 - DNA, 22 bp, Homo sapiens
tttcacagctgggaagagatat

SEQ ID NO: 8050693 - DNA, 22 bp, Homo sapiens
tttcacattttatacttaagcc

SEQ ID NO: 8050694 - DNA, 20 bp, Homo sapiens
cactgccctccagcctgagc

SEQ ID NO: 8050695 - DNA, 22 bp, Homo sapiens
cactgcccttacatgccctgca

SEQ ID NO: 8050696 - DNA, 22 bp, Homo sapiens
cactgcccaggcacccatcttg

SEQ ID NO: 8050697 - DNA, 22 bp, Homo sapiens
cactgcccaggacctgccaccc

SEQ ID NO: 8050698 - DNA, 19 bp, Homo sapiens
ggctcctgtggctgcagcc

SEQ ID NO: 8050699 - DNA, 22 bp, Homo sapiens
ggctcctgtggcaagacagctt

SEQ ID NO: 8050700 - DNA, 22 bp, Homo sapiens
ggctcctgtcctcctggagctc

SEQ ID NO: 8050701 - DNA, 20 bp, Homo sapiens
ggcgcctggcctcatggctg

SEQ ID NO: 8050702 - DNA, 22 bp, Homo sapiens
ggcgctggccacggtggctctg

SEQ ID NO: 8050703 - DNA, 22 bp, Homo sapiens
cactgagggcggagcccaggga

SEQ ID NO: 8050704 - DNA, 22 bp, Homo sapiens
ggctgcagccctcgcctagcca

SEQ ID NO: 8050705 - DNA, 22 bp, Homo sapiens
ggctgcagcagagggactcacg

SEQ ID NO: 8050706 - DNA, 22 bp, Homo sapiens
cactgtccctgtttcctggaaa

SEQ ID NO: 8050707 - DNA, 22 bp, Homo sapiens
cactgtccatgcttgctaaccc

SEQ ID NO: 8050708 - DNA, 22 bp, Homo sapiens
ggctgcagcggattggggattg

SEQ ID NO: 8050709 - DNA, 22 bp, Homo sapiens
cactgtccaatagatacataat

SEQ ID NO: 8050710 - DNA, 22 bp, Homo sapiens
ggctgaggctcatgccatcttg

SEQ ID NO: 8050711 - DNA, 22 bp, Homo sapiens
ggctgcagattgtagtctgtta

SEQ ID NO: 8050712 - DNA, 22 bp, Homo sapiens
ggctgctcggagcctcctgtga

SEQ ID NO: 8050713 - DNA, 22 bp, Homo sapiens
ggctgcggatctaaggctggga

SEQ ID NO: 8050714 - DNA, 20 bp, Homo sapiens
ggctgctggtttggctctgt

SEQ ID NO: 8050715 - DNA, 20 bp, Homo sapiens
ggctgctggtttggctctgt

SEQ ID NO: 8050716 - DNA, 22 bp, Homo sapiens
ggctgctgtactgatgtcagtt

SEQ ID NO: 8050717 - DNA, 22 bp, Homo sapiens
ggctgctggtggaatggtaggc

SEQ ID NO: 8050718 - DNA, 22 bp, Homo sapiens
ggctgctggtaggggtaggaag

SEQ ID NO: 8050719 - DNA, 21 bp, Homo sapiens
ggctgctgtcaccgctgtcac

SEQ ID NO: 8050720 - DNA, 22 bp, Homo sapiens
ggctggctttctctccgcacct

SEQ ID NO: 8050721 - DNA, 22 bp, Homo sapiens
cagaacagacttaacagggctg

SEQ ID NO: 8050722 - DNA, 23 bp, Homo sapiens
ggctgggagctccgggtgcacgt

SEQ ID NO: 8050723 - DNA, 23 bp, Homo sapiens
ggctgggagctccgggtgcacgt

SEQ ID NO: 8050724 - DNA, 22 bp, Homo sapiens
ggcttctttgtaacgtgccagc

SEQ ID NO: 8050725 - DNA, 22 bp, Homo sapiens
ggcttcttctctgtgtccagca

SEQ ID NO: 8050726 - DNA, 22 bp, Homo sapiens
ggcttcttgtgtgtcaggctct

SEQ ID NO: 8050727 - DNA, 20 bp, Homo sapiens
ggcttctttacatctgtgtt

SEQ ID NO: 8050728 - DNA, 22 bp, Homo sapiens
ggcttcttcctggctcctatta

SEQ ID NO: 8050729 - DNA, 22 bp, Homo sapiens
ggcttcaggggcccagtcagca

SEQ ID NO: 8050730 - DNA, 22 bp, Homo sapiens
cagaacagagtcaaaagtatgt

SEQ ID NO: 8050731 - DNA, 22 bp, Homo sapiens
cacccaggacaggccagatgtg

SEQ ID NO: 8050732 - DNA, 22 bp, Homo sapiens
cacccaggcaggtggctgagaa

SEQ ID NO: 8050733 - DNA, 22 bp, Homo sapiens
ggccagggcctggggactgtcc

SEQ ID NO: 8050734 - DNA, 22 bp, Homo sapiens
cacccagccttcacacaggagt

SEQ ID NO: 8050735 - DNA, 22 bp, Homo sapiens
ggccagccctcctccctgggtt

SEQ ID NO: 8050736 - DNA, 18 bp, Homo sapiens
ggccagccccaggccagc

SEQ ID NO: 8050737 - DNA, 18 bp, Homo sapiens
ggccagccccaggccagc

SEQ ID NO: 8050738 - DNA, 22 bp, Homo sapiens
ggccagcctggggctcccagac

SEQ ID NO: 8050739 - DNA, 22 bp, Homo sapiens
ggccagcctggggctcccagac

SEQ ID NO: 8050740 - DNA, 19 bp, Homo sapiens
caccaagatggctctagtc

SEQ ID NO: 8050741 - DNA, 20 bp, Homo sapiens
caccacagaattggggacag

SEQ ID NO: 8050742 - DNA, 21 bp, Homo sapiens
ggccccagcccatgggttctc

SEQ ID NO: 8050743 - DNA, 22 bp, Homo sapiens
ggcccagcatcttgtgaagttt

SEQ ID NO: 8050744 - DNA, 22 bp, Homo sapiens
ggcccagcccgagtcagccttc

SEQ ID NO: 8050745 - DNA, 22 bp, Homo sapiens
ggcccagcacagtgcttggggg

SEQ ID NO: 8050746 - DNA, 22 bp, Homo sapiens
ggcgcaggccttggatcctggt

SEQ ID NO: 8050747 - DNA, 22 bp, Homo sapiens
ggcgccccatgatgagggctag

SEQ ID NO: 8050748 - DNA, 22 bp, Homo sapiens
ggaggtggaggttgcagtgagc

SEQ ID NO: 8050749 - DNA, 22 bp, Homo sapiens
ggagtgactcacagctgggaca

SEQ ID NO: 8050750 - DNA, 20 bp, Homo sapiens
ggcaggacccggtagggagc

SEQ ID NO: 8050751 - DNA, 22 bp, Homo sapiens
ggcaggactcttctgtgggccg

SEQ ID NO: 8050752 - DNA, 22 bp, Homo sapiens
ggcaggactcttctgtgggccg

SEQ ID NO: 8050753 - DNA, 22 bp, Homo sapiens
ggcaggactgatcagtgggatg

SEQ ID NO: 8050754 - DNA, 22 bp, Homo sapiens
ggcaggtgtggtgaccagagat

SEQ ID NO: 8050755 - DNA, 22 bp, Homo sapiens
ggcaggtgtggtgaccagagat

SEQ ID NO: 8050756 - DNA, 22 bp, Homo sapiens
ggcaggtgtttttatattaaag

SEQ ID NO: 8050757 - DNA, 22 bp, Homo sapiens
ggcaggtgtgagctgtaaagga

SEQ ID NO: 8050758 - DNA, 19 bp, Homo sapiens
ggcaggtgtgcttatgctt

SEQ ID NO: 8050759 - DNA, 22 bp, Homo sapiens
ggcaggtgtggagtgttatttt

SEQ ID NO: 8050760 - DNA, 22 bp, Homo sapiens
ggcaggtgtggtgaccagagat

SEQ ID NO: 8050761 - DNA, 22 bp, Homo sapiens
ggcaggtgcgcatgttgcatta

SEQ ID NO: 8050762 - DNA, 19 bp, Homo sapiens
ggacacagaaagctgcatt

SEQ ID NO: 8050763 - DNA, 22 bp, Homo sapiens
ggacaaaggtctggggaacctg

SEQ ID NO: 8050764 - DNA, 22 bp, Homo sapiens
ggacaagcctgtgagtgggttt

SEQ ID NO: 8050765 - DNA, 22 bp, Homo sapiens
ggacagcattctactgtaggca

SEQ ID NO: 8050766 - DNA, 22 bp, Homo sapiens
ggacagcatatcagcagggcag

SEQ ID NO: 8050767 - DNA, 22 bp, Homo sapiens
ggagatatttgtattctgtctc

SEQ ID NO: 8050768 - DNA, 22 bp, Homo sapiens
cacagagaatgatgagtcactg

SEQ ID NO: 8050769 - DNA, 22 bp, Homo sapiens
cacagagacagaagcacttatg

SEQ ID NO: 8050770 - DNA, 22 bp, Homo sapiens
cacagcagtctttcactaaata

SEQ ID NO: 8050771 - DNA, 21 bp, Homo sapiens
cacagcagggttcctgggctc

SEQ ID NO: 8050772 - DNA, 21 bp, Homo sapiens
cacagcagggttcctgggctc

SEQ ID NO: 8050773 - DNA, 22 bp, Homo sapiens
cacagccctgcgccccagtttg

SEQ ID NO: 8050774 - DNA, 22 bp, Homo sapiens
cacagccatgtcctcattcttc

SEQ ID NO: 8050775 - DNA, 22 bp, Homo sapiens
ggagcagcttgcatgctcaggg

SEQ ID NO: 8050776 - DNA, 22 bp, Homo sapiens
ggaggggatggtttgaccctgg

SEQ ID NO: 8050777 - DNA, 22 bp, Homo sapiens
ggaggggatggtttgaccctgg

SEQ ID NO: 8050778 - DNA, 22 bp, Homo sapiens
ggaggggatttagtagatgcta

SEQ ID NO: 8050779 - DNA, 22 bp, Homo sapiens
ggaggggatttagtagatgcta

SEQ ID NO: 8050780 - DNA, 22 bp, Homo sapiens
cacagctgaagtagccatgtgg

SEQ ID NO: 8050781 - DNA, 22 bp, Homo sapiens
cacagcctccttcagagagcat

SEQ ID NO: 8050782 - DNA, 22 bp, Homo sapiens
cacagctaactttcactgagca

SEQ ID NO: 8050783 - DNA, 22 bp, Homo sapiens
ggaggggcagccatggaactcc

SEQ ID NO: 8050784 - DNA, 22 bp, Homo sapiens
cacaggagaggttaatgggggc

SEQ ID NO: 8050785 - DNA, 18 bp, Homo sapiens
cacaggagatgacctgac

SEQ ID NO: 8050786 - DNA, 22 bp, Homo sapiens
ggaaaatttccttcaaaatgtg

SEQ ID NO: 8050787 - DNA, 22 bp, Homo sapiens
ggaaatcttccttcactctttc

SEQ ID NO: 8050788 - DNA, 22 bp, Homo sapiens
ggaacacaaatgggagagctgg

SEQ ID NO: 8050789 - DNA, 22 bp, Homo sapiens
caatggctggagacaatctgct

SEQ ID NO: 8050790 - DNA, 22 bp, Homo sapiens
gctgggctcaccaggccactag

SEQ ID NO: 8050791 - DNA, 22 bp, Homo sapiens
gctggcagagctctgggctggg

SEQ ID NO: 8050792 - DNA, 20 bp, Homo sapiens
gctggcagatgtcttgagat

SEQ ID NO: 8050793 - DNA, 22 bp, Homo sapiens
gctggcagcattagaccctggg

SEQ ID NO: 8050794 - DNA, 19 bp, Homo sapiens
gctggcagatgtggccgtg

SEQ ID NO: 8050795 - DNA, 22 bp, Homo sapiens
gctggcagccaagtgaagaggg

SEQ ID NO: 8050796 - DNA, 22 bp, Homo sapiens
gctggccagtgtggtgaccacc

SEQ ID NO: 8050797 - DNA, 22 bp, Homo sapiens
gctggcccagcgcccagggcag

SEQ ID NO: 8050798 - DNA, 22 bp, Homo sapiens
gctggcccagcgcccagggcag

SEQ ID NO: 8050799 - DNA, 22 bp, Homo sapiens
gctggccatggcctgcgccatc

SEQ ID NO: 8050800 - DNA, 22 bp, Homo sapiens
gctgggagcaagtactcatctt

SEQ ID NO: 8050801 - DNA, 19 bp, Homo sapiens
gctgggagcagaccctccc

SEQ ID NO: 8050802 - DNA, 22 bp, Homo sapiens
gctgggagccccgagccagcgc

SEQ ID NO: 8050803 - DNA, 21 bp, Homo sapiens
gctgggcctgtacttgccctg

SEQ ID NO: 8050804 - DNA, 20 bp, Homo sapiens
gctgggctaccactggccct

SEQ ID NO: 8050805 - DNA, 22 bp, Homo sapiens
gctgggccgacctgggctgcag

SEQ ID NO: 8050806 - DNA, 22 bp, Homo sapiens
gctgggccctgggtgccctagc

SEQ ID NO: 8050807 - DNA, 22 bp, Homo sapiens
gctgggccccatccctcgagca

SEQ ID NO: 8050808 - DNA, 22 bp, Homo sapiens
gctgggcccagatcccaggatc

SEQ ID NO: 8050809 - DNA, 22 bp, Homo sapiens
gctgggccagccagacatgtga

SEQ ID NO: 8050810 - DNA, 22 bp, Homo sapiens
gctgggaggaatttggggaata

SEQ ID NO: 8050811 - DNA, 22 bp, Homo sapiens
gctgggaggaatttggggaata

SEQ ID NO: 8050812 - DNA, 22 bp, Homo sapiens
gctgggagccgtacctgtcacg

SEQ ID NO: 8050813 - DNA, 22 bp, Homo sapiens
cagctcctctggccagccctgc

SEQ ID NO: 8050814 - DNA, 22 bp, Homo sapiens
cagctcctcagccctgccttgg

SEQ ID NO: 8050815 - DNA, 22 bp, Homo sapiens
cagctcctctgttagccctggg

SEQ ID NO: 8050816 - DNA, 22 bp, Homo sapiens
cagctcctgaggactgctggga

SEQ ID NO: 8050817 - DNA, 22 bp, Homo sapiens
cagctcctgcagctggctccca

SEQ ID NO: 8050818 - DNA, 17 bp, Homo sapiens
cagctctgcagacttcc

SEQ ID NO: 8050819 - DNA, 22 bp, Homo sapiens
cagcccttggcccagggcacag

SEQ ID NO: 8050820 - DNA, 22 bp, Homo sapiens
cagccctgttgcgcttccggcg

SEQ ID NO: 8050821 - DNA, 22 bp, Homo sapiens
gtgcctgggacacagcagatac

SEQ ID NO: 8050822 - DNA, 22 bp, Homo sapiens
gtgcctgggacacagcagatac

SEQ ID NO: 8050823 - DNA, 22 bp, Homo sapiens
gtgcctgggggtaatgtaggat

SEQ ID NO: 8050824 - DNA, 22 bp, Homo sapiens
gtgcctggggttgagctatgaa

SEQ ID NO: 8050825 - DNA, 21 bp, Homo sapiens
cagctccactaaagcagctgt

SEQ ID NO: 8050826 - DNA, 22 bp, Homo sapiens
cagctcaggaaggaaggccggc

SEQ ID NO: 8050827 - DNA, 17 bp, Homo sapiens
gtgcctgttgtcctgga

SEQ ID NO: 8050828 - DNA, 22 bp, Homo sapiens
gtgcctggtatgtaggtagcgg

SEQ ID NO: 8050829 - DNA, 22 bp, Homo sapiens
cagcatgcagcccctggcagct

SEQ ID NO: 8050830 - DNA, 22 bp, Homo sapiens
cagcatgcaagtccagatgtgg

SEQ ID NO: 8050831 - DNA, 22 bp, Homo sapiens
gtcctctgtgtaggctgcagac

SEQ ID NO: 8050832 - DNA, 22 bp, Homo sapiens
gtcctctgtttccatctgactt

SEQ ID NO: 8050833 - DNA, 22 bp, Homo sapiens
gtcctctgttagaaatgtgctt

SEQ ID NO: 8050834 - DNA, 22 bp, Homo sapiens
gtcctgagtcaagtgtgggcag

SEQ ID NO: 8050835 - DNA, 22 bp, Homo sapiens
cagcaggtgtctagcaagggtc

SEQ ID NO: 8050836 - DNA, 22 bp, Homo sapiens
cagcagagctgtgtgggaaggg

SEQ ID NO: 8050837 - DNA, 22 bp, Homo sapiens
cagcagagctgtgtgggaaggg

SEQ ID NO: 8050838 - DNA, 22 bp, Homo sapiens
cagcagggaagctgtgctgttt

SEQ ID NO: 8050839 - DNA, 22 bp, Homo sapiens
cagcagggaagctgtgctgttt

SEQ ID NO: 8050840 - DNA, 22 bp, Homo sapiens
gtgcagctgtggtggagccagg

SEQ ID NO: 8050841 - DNA, 22 bp, Homo sapiens
gtgcagctgaaggctggccagc

SEQ ID NO: 8050842 - DNA, 22 bp, Homo sapiens
gtctcatatgatataaatgcag

SEQ ID NO: 8050843 - DNA, 18 bp, Homo sapiens
gtctcaggagtggcacgt

SEQ ID NO: 8050844 - DNA, 22 bp, Homo sapiens
gtctcagggactgcttctgggg

SEQ ID NO: 8050845 - DNA, 18 bp, Homo sapiens
gtctctgtgggaattggc

SEQ ID NO: 8050846 - DNA, 22 bp, Homo sapiens
cagaggaagggtgctgcgaaag

SEQ ID NO: 8050847 - DNA, 22 bp, Homo sapiens
gggggaggtgaatgcaataagg

SEQ ID NO: 8050848 - DNA, 22 bp, Homo sapiens
gggggaggtgaatgcaataagg

SEQ ID NO: 8050849 - DNA, 22 bp, Homo sapiens
ggggcggggctctgagaagcat

SEQ ID NO: 8050850 - DNA, 22 bp, Homo sapiens
gggggcagtaaggatatggaaa

SEQ ID NO: 8050851 - DNA, 22 bp, Homo sapiens
gggggatgctcaggaggctgct

SEQ ID NO: 8050852 - DNA, 22 bp, Homo sapiens
gggggatgctcaggaggctgct

SEQ ID NO: 8050853 - DNA, 22 bp, Homo sapiens
cagaggcaggaagatgggcagt

SEQ ID NO: 8050854 - DNA, 21 bp, Homo sapiens
gggctctgccctcctggagct

SEQ ID NO: 8050855 - DNA, 20 bp, Homo sapiens
gggctctgcatccatcagcc

SEQ ID NO: 8050856 - DNA, 22 bp, Homo sapiens
gggctctgcgctcagctccagc

SEQ ID NO: 8050857 - DNA, 22 bp, Homo sapiens
gggctcagtcggcaagcccctt

SEQ ID NO: 8050858 - DNA, 22 bp, Homo sapiens
gggctcagtctgcggcgcgcgg

SEQ ID NO: 8050859 - DNA, 22 bp, Homo sapiens
gggctcagtctggcgtggaatg

SEQ ID NO: 8050860 - DNA, 21 bp, Homo sapiens
gggctcagtggaaaagagtgt

SEQ ID NO: 8050861 - DNA, 22 bp, Homo sapiens
gggctctgcagagaactggctc

SEQ ID NO: 8050862 - DNA, 22 bp, Homo sapiens
gggctctgcagagaactggctc

SEQ ID NO: 8050863 - DNA, 22 bp, Homo sapiens
gggctctgcagtgacttgaggg

SEQ ID NO: 8050864 - DNA, 22 bp, Homo sapiens
gggctctgcagtgacttgaggg

SEQ ID NO: 8050865 - DNA, 21 bp, Homo sapiens
gggctcagtggaaaagagtgt

SEQ ID NO: 8050866 - DNA, 18 bp, Homo sapiens
gggctctgatccttcacc

SEQ ID NO: 8050867 - DNA, 18 bp, Homo sapiens
gggctctgatccttcacc

SEQ ID NO: 8050868 - DNA, 22 bp, Homo sapiens
gggctcaggcctggcctctcac

SEQ ID NO: 8050869 - DNA, 22 bp, Homo sapiens
gggctcaggagtttgaggctgc

SEQ ID NO: 8050870 - DNA, 22 bp, Homo sapiens
gggctcaggtcagggcatcagc

SEQ ID NO: 8050871 - DNA, 22 bp, Homo sapiens
gggctcagggacacatgtgtgt

SEQ ID NO: 8050872 - DNA, 22 bp, Homo sapiens
gggctcagtcctggttctaccc

SEQ ID NO: 8050873 - DNA, 22 bp, Homo sapiens
cagaagcagaacactagattta

SEQ ID NO: 8050874 - DNA, 18 bp, Homo sapiens
cagaagcaggcagtgcag

SEQ ID NO: 8050875 - DNA, 22 bp, Homo sapiens
cagaagcacatgtttacatgta

SEQ ID NO: 8050876 - DNA, 22 bp, Homo sapiens
cagaagcaagggccaaagtctt

SEQ ID NO: 8050877 - DNA, 22 bp, Homo sapiens
cagaagcaaatgccttgctgag

SEQ ID NO: 8050878 - DNA, 22 bp, Homo sapiens
gggccaggagtggagatatggg

SEQ ID NO: 8050879 - DNA, 22 bp, Homo sapiens
gggccagctctgtgatgtaggg

SEQ ID NO: 8050880 - DNA, 22 bp, Homo sapiens
gggccctgcgtccggaagtctg

SEQ ID NO: 8050881 - DNA, 22 bp, Homo sapiens
gggccctggacgtggcggcaga

SEQ ID NO: 8050882 - DNA, 22 bp, Homo sapiens
gggccctggatttaagcatgga

SEQ ID NO: 8050883 - DNA, 22 bp, Homo sapiens
gggccctggccgaatccctctg

SEQ ID NO: 8050884 - DNA, 22 bp, Homo sapiens
cagagcagcagagcttccatgg

SEQ ID NO: 8050885 - DNA, 22 bp, Homo sapiens
gggccctgggattcagagcaag

SEQ ID NO: 8050886 - DNA, 22 bp, Homo sapiens
cagagcaggcccactgccctcc

SEQ ID NO: 8050887 - DNA, 22 bp, Homo sapiens
gggcgctgggtgtcgagactca

SEQ ID NO: 8050888 - DNA, 21 bp, Homo sapiens
cagagcagcgttctgctgtgg

SEQ ID NO: 8050889 - DNA, 22 bp, Homo sapiens
cagcagagacggtaagcagaac

SEQ ID NO: 8050890 - DNA, 22 bp, Homo sapiens
cagcagactggagtaggcagtg

SEQ ID NO: 8050891 - DNA, 20 bp, Homo sapiens
cagcagagacccatggggag

SEQ ID NO: 8050892 - DNA, 22 bp, Homo sapiens
ggtgtccttgtcctttggtacc

SEQ ID NO: 8050893 - DNA, 22 bp, Homo sapiens
ggtgtcctttgggggctccgag

SEQ ID NO: 8050894 - DNA, 22 bp, Homo sapiens
ggtgtccttgttgaacgaaaat

SEQ ID NO: 8050895 - DNA, 22 bp, Homo sapiens
ggtggcagtagcactgggcctg

SEQ ID NO: 8050896 - DNA, 18 bp, Homo sapiens
ggtggcaggtcagatgcc

SEQ ID NO: 8050897 - DNA, 18 bp, Homo sapiens
ggtggcaggtcagatgcc

SEQ ID NO: 8050898 - DNA, 22 bp, Homo sapiens
ggtggcagtagcactgggcctg

SEQ ID NO: 8050899 - DNA, 22 bp, Homo sapiens
ggtggcagtcttaagagatctt

SEQ ID NO: 8050900 - DNA, 22 bp, Homo sapiens
ggtggcagtggtctctgacaga

SEQ ID NO: 8050901 - DNA, 22 bp, Homo sapiens
ggtgcagctgcagcctgggagc

SEQ ID NO: 8050902 - DNA, 22 bp, Homo sapiens
ggtgcagaaggaagggagctgg

SEQ ID NO: 8050903 - DNA, 22 bp, Homo sapiens
ggtgcaagagctccaggccctg

SEQ ID NO: 8050904 - DNA, 22 bp, Homo sapiens
cagagtgtttctttgggtgggt

SEQ ID NO: 8050905 - DNA, 22 bp, Homo sapiens
cagagtggtgcaagggcagtgt

SEQ ID NO: 8050906 - DNA, 22 bp, Homo sapiens
ggggtctgctgcggagcagaga

SEQ ID NO: 8050907 - DNA, 22 bp, Homo sapiens
ggggtctgggttgctcggcctt

SEQ ID NO: 8050908 - DNA, 23 bp, Homo sapiens
ggggtcttggaacaggtggccct

SEQ ID NO: 8050909 - DNA, 21 bp, Homo sapiens
cagaggctgagagggcaatct

SEQ ID NO: 8050910 - DNA, 22 bp, Homo sapiens
cagaggctgatggctgtagcca

SEQ ID NO: 8050911 - DNA, 22 bp, Homo sapiens
ggggtaggtcatagcccctcta

SEQ ID NO: 8050912 - DNA, 22 bp, Homo sapiens
atgaatacaaaagagttgagga

SEQ ID NO: 8050913 - DNA, 22 bp, Homo sapiens
atcttcccaggctggggagagg

SEQ ID NO: 8050914 - DNA, 22 bp, Homo sapiens
gaaaatagcagatagaccaatg

SEQ ID NO: 8050915 - DNA, 22 bp, Homo sapiens
atgaatgtacctgaaatagcct

SEQ ID NO: 8050916 - DNA, 19 bp, Homo sapiens
atgaattgagcacttacta

SEQ ID NO: 8050917 - DNA, 22 bp, Homo sapiens
atgaattgaggaaaacagtcgt

SEQ ID NO: 8050918 - DNA, 22 bp, Homo sapiens
atgaatgattttatgtaaatga

SEQ ID NO: 8050919 - DNA, 22 bp, Homo sapiens
atgaatgcagcactgtttttct

SEQ ID NO: 8050920 - DNA, 22 bp, Homo sapiens
atgaatgcatgcttattttgca

SEQ ID NO: 8050921 - DNA, 22 bp, Homo sapiens
atgaatgcatacatttgtcaag

SEQ ID NO: 8050922 - DNA, 22 bp, Homo sapiens
gaacattcttgggcaagttact

SEQ ID NO: 8050923 - DNA, 22 bp, Homo sapiens
gaacataattaaatgtcctggg

SEQ ID NO: 8050924 - DNA, 22 bp, Homo sapiens
gaacataactattgtgaatagt

SEQ ID NO: 8050925 - DNA, 22 bp, Homo sapiens
gaaatgattttagtttatcatg

SEQ ID NO: 8050926 - DNA, 22 bp, Homo sapiens
gaaaatgcctctggcattaaac

SEQ ID NO: 8050927 - DNA, 22 bp, Homo sapiens
gaaatctgaacaacagctgtca

SEQ ID NO: 8050928 - DNA, 22 bp, Homo sapiens
gaaatctgtctttgtttgaata

SEQ ID NO: 8050929 - DNA, 22 bp, Homo sapiens
gaaatctgcttcttgcatagta

SEQ ID NO: 8050930 - DNA, 22 bp, Homo sapiens
gaaatctgcccagtgcactggt

SEQ ID NO: 8050931 - DNA, 22 bp, Homo sapiens
gaaatctgcggtgaggcctgag

SEQ ID NO: 8050932 - DNA, 22 bp, Homo sapiens
gaaatctgaatcttctgttggt

SEQ ID NO: 8050933 - DNA, 22 bp, Homo sapiens
gaaatctgaactctgtatcctt

SEQ ID NO: 8050934 - DNA, 22 bp, Homo sapiens
gaaatgaactgattatcattgc

SEQ ID NO: 8050935 - DNA, 22 bp, Homo sapiens
gacagtggttccaaggcagctt

SEQ ID NO: 8050936 - DNA, 23 bp, Homo sapiens
gacagggctgacttggcagctgc

SEQ ID NO: 8050937 - DNA, 22 bp, Homo sapiens
gacagggccaaaccggctgatc

SEQ ID NO: 8050938 - DNA, 22 bp, Homo sapiens
gacagggccgcagatggagact

SEQ ID NO: 8050939 - DNA, 22 bp, Homo sapiens
gaccctggaactttcagcagag

SEQ ID NO: 8050940 - DNA, 22 bp, Homo sapiens
gactgggggcagccgcaccagt

SEQ ID NO: 8050941 - DNA, 22 bp, Homo sapiens
gacccggctccaggcccagcag

SEQ ID NO: 8050942 - DNA, 22 bp, Homo sapiens
gaatgtaatagtcagtagaaca

SEQ ID NO: 8050943 - DNA, 22 bp, Homo sapiens
gaagcactgccataattcagac

SEQ ID NO: 8050944 - DNA, 22 bp, Homo sapiens
gaagcacattagatgtgtcttc

SEQ ID NO: 8050945 - DNA, 22 bp, Homo sapiens
gaagcacaaagtgtagttccga

SEQ ID NO: 8050946 - DNA, 22 bp, Homo sapiens
gaagcacagaatggttaacatg

SEQ ID NO: 8050947 - DNA, 22 bp, Homo sapiens
gaagcaatgtgttttcaacatt

SEQ ID NO: 8050948 - DNA, 22 bp, Homo sapiens
gaagcaatttagaatcagaagc

SEQ ID NO: 8050949 - DNA, 22 bp, Homo sapiens
gaagcaattaagtttgtgatct

SEQ ID NO: 8050950 - DNA, 22 bp, Homo sapiens
atgcccacaacactgcactttt

SEQ ID NO: 8050951 - DNA, 22 bp, Homo sapiens
atgcccagaaccccctggatgg

SEQ ID NO: 8050952 - DNA, 22 bp, Homo sapiens
gacagggaggaaagagactgct

SEQ ID NO: 8050953 - DNA, 22 bp, Homo sapiens
gagaggtggaggttgcagtgag

SEQ ID NO: 8050954 - DNA, 22 bp, Homo sapiens
gagaggtgaaggctgccctggg

SEQ ID NO: 8050955 - DNA, 22 bp, Homo sapiens
gagcagctaaaattctcatgca

SEQ ID NO: 8050956 - DNA, 22 bp, Homo sapiens
gagcagctcgagaaggaagcag

SEQ ID NO: 8050957 - DNA, 22 bp, Homo sapiens
gagcagctcagaggactagtgt

SEQ ID NO: 8050958 - DNA, 22 bp, Homo sapiens
gagaggctctgaggactggggt

SEQ ID NO: 8050959 - DNA, 22 bp, Homo sapiens
gagaggctctgaggactggggt

SEQ ID NO: 8050960 - DNA, 22 bp, Homo sapiens
gagccctcttccctagtgatcg

SEQ ID NO: 8050961 - DNA, 22 bp, Homo sapiens
gagccctgaacaacagcaggaa

SEQ ID NO: 8050962 - DNA, 22 bp, Homo sapiens
gagcagggccacttctgtacct

SEQ ID NO: 8050963 - DNA, 22 bp, Homo sapiens
gagcaggtctttcatggtgcat

SEQ ID NO: 8050964 - DNA, 22 bp, Homo sapiens
gagcagctgagctggaatgaga

SEQ ID NO: 8050965 - DNA, 22 bp, Homo sapiens
gagcagctgagctggaatgaga

SEQ ID NO: 8050966 - DNA, 22 bp, Homo sapiens
gagcagctctgggtgacccagt

SEQ ID NO: 8050967 - DNA, 17 bp, Homo sapiens
gagcagggatgcggttc

SEQ ID NO: 8050968 - DNA, 22 bp, Homo sapiens
gagcagggagacaactctggtg

SEQ ID NO: 8050969 - DNA, 22 bp, Homo sapiens
gagcctggcctcctgcctcagc

SEQ ID NO: 8050970 - DNA, 20 bp, Homo sapiens
gagcctgggaagtctaaggt

SEQ ID NO: 8050971 - DNA, 22 bp, Homo sapiens
gagcctgggactgggggtcatg

SEQ ID NO: 8050972 - DNA, 22 bp, Homo sapiens
gagcctgggtccttccctggga

SEQ ID NO: 8050973 - DNA, 22 bp, Homo sapiens
gagcctggggaccctcctgagt

SEQ ID NO: 8050974 - DNA, 23 bp, Homo sapiens
gagctctgcactaggccctggga

SEQ ID NO: 8050975 - DNA, 22 bp, Homo sapiens
gagctctgccatggctcccacc

SEQ ID NO: 8050976 - DNA, 18 bp, Homo sapiens
gagctctgcctcccagtc

SEQ ID NO: 8050977 - DNA, 18 bp, Homo sapiens
atgtcacagagggctgaa

SEQ ID NO: 8050978 - DNA, 22 bp, Homo sapiens
atgtcacagtgttgctggaagt

SEQ ID NO: 8050979 - DNA, 17 bp, Homo sapiens
atgtaagaagaaagcag

SEQ ID NO: 8050980 - DNA, 22 bp, Homo sapiens
atgtaagactttaagaacctaa

SEQ ID NO: 8050981 - DNA, 22 bp, Homo sapiens
atgtaatgattgcaatgctgct

SEQ ID NO: 8050982 - DNA, 22 bp, Homo sapiens
gagctggggcggatactcagct

SEQ ID NO: 8050983 - DNA, 22 bp, Homo sapiens
gagctctggcagggcaggtctg

SEQ ID NO: 8050984 - DNA, 22 bp, Homo sapiens
gagctctgggaaacaaagtgta

SEQ ID NO: 8050985 - DNA, 22 bp, Homo sapiens
gagctctgctactcaaagtatg

SEQ ID NO: 8050986 - DNA, 22 bp, Homo sapiens
gagctttagctgagacctgctt

SEQ ID NO: 8050987 - DNA, 22 bp, Homo sapiens
gagctttaggagaaggaggtca

SEQ ID NO: 8050988 - DNA, 17 bp, Homo sapiens
gagtgcagacacaagca

SEQ ID NO: 8050989 - DNA, 23 bp, Homo sapiens
gagtgcagaatagacatgcagtg

SEQ ID NO: 8050990 - DNA, 22 bp, Homo sapiens
gagtgcagatgaacagaagatt

SEQ ID NO: 8050991 - DNA, 22 bp, Homo sapiens
gagtgcagatgccagccccagt

SEQ ID NO: 8050992 - DNA, 22 bp, Homo sapiens
gagtgcaggcctgagcaccatc

SEQ ID NO: 8050993 - DNA, 23 bp, Homo sapiens
gagtgcagaatagacatgcagtg

SEQ ID NO: 8050994 - DNA, 22 bp, Homo sapiens
gagtccagttagtgaggctggg

SEQ ID NO: 8050995 - DNA, 22 bp, Homo sapiens
atgtttcaggcgaactaacatg

SEQ ID NO: 8050996 - DNA, 22 bp, Homo sapiens
atgtttcagatacagatcaaat

SEQ ID NO: 8050997 - DNA, 22 bp, Homo sapiens
gagggatgtgcctgaaggcagg

SEQ ID NO: 8050998 - DNA, 22 bp, Homo sapiens
gagggatgtcaggggaccttgg

SEQ ID NO: 8050999 - DNA, 22 bp, Homo sapiens
gagggatggtgtgagaggctca

SEQ ID NO: 8051000 - DNA, 22 bp, Homo sapiens
gaggcttttagtatggggactg

SEQ ID NO: 8051001 - DNA, 22 bp, Homo sapiens
gaggctttggttataaaagatc

SEQ ID NO: 8051002 - DNA, 23 bp, Homo sapiens
gaggccacattcccctgcttgag

SEQ ID NO: 8051003 - DNA, 22 bp, Homo sapiens
gagggcaccagaagagccagat

SEQ ID NO: 8051004 - DNA, 22 bp, Homo sapiens
gagggcagaaaattatgcggtg

SEQ ID NO: 8051005 - DNA, 19 bp, Homo sapiens
gaggggaggaattgacaag

SEQ ID NO: 8051006 - DNA, 19 bp, Homo sapiens
gaggggaggaattgacaag

SEQ ID NO: 8051007 - DNA, 22 bp, Homo sapiens
gagggggcgtgcaaggctccgc

SEQ ID NO: 8051008 - DNA, 22 bp, Homo sapiens
gagggggctccctgaagccagt

SEQ ID NO: 8051009 - DNA, 22 bp, Homo sapiens
gagggggctccctgaagccagt

SEQ ID NO: 8051010 - DNA, 22 bp, Homo sapiens
gagggggctagcgcagtgccca

SEQ ID NO: 8051011 - DNA, 22 bp, Homo sapiens
gagggggctagcgcagtgccca

SEQ ID NO: 8051012 - DNA, 22 bp, Homo sapiens
gaggggggcgccctgcagtgca

SEQ ID NO: 8051013 - DNA, 22 bp, Homo sapiens
gaggggggcgccctgcagtgca

SEQ ID NO: 8051014 - DNA, 22 bp, Homo sapiens
gagggggctctgccaacctgtc

SEQ ID NO: 8051015 - DNA, 22 bp, Homo sapiens
gagtccaggatttgagctctgt

SEQ ID NO: 8051016 - DNA, 22 bp, Homo sapiens
gaggggtcacatgggctggctt

SEQ ID NO: 8051017 - DNA, 23 bp, Homo sapiens
gctcaggcatcattcttcctggc

SEQ ID NO: 8051018 - DNA, 22 bp, Homo sapiens
gctcagggctaaggctgagggg

SEQ ID NO: 8051019 - DNA, 22 bp, Homo sapiens
gcgtggggtaggtagacatgga

SEQ ID NO: 8051020 - DNA, 22 bp, Homo sapiens
gcgcaggagccgcggagggccg

SEQ ID NO: 8051021 - DNA, 22 bp, Homo sapiens
gcctggctcctaaggactggct

SEQ ID NO: 8051022 - DNA, 22 bp, Homo sapiens
gcctggctcctaaggactggct

SEQ ID NO: 8051023 - DNA, 22 bp, Homo sapiens
gctcaggggaatgggctgccgt

SEQ ID NO: 8051024 - DNA, 22 bp, Homo sapiens
gctcagggtcccttggtgctgg

SEQ ID NO: 8051025 - DNA, 22 bp, Homo sapiens
gctcaggtgttacctcctctag

SEQ ID NO: 8051026 - DNA, 20 bp, Homo sapiens
gctcaggtgacagtcaggag

SEQ ID NO: 8051027 - DNA, 23 bp, Homo sapiens
gctcaggtggctcagggactgat

SEQ ID NO: 8051028 - DNA, 22 bp, Homo sapiens
gctctaggagaggggcagtcca

SEQ ID NO: 8051029 - DNA, 22 bp, Homo sapiens
gctcgcttagattttcctctga

SEQ ID NO: 8051030 - DNA, 22 bp, Homo sapiens
gctctgagaggtgcagcagtaa

SEQ ID NO: 8051031 - DNA, 19 bp, Homo sapiens
gctctgagaggggcatggg

SEQ ID NO: 8051032 - DNA, 22 bp, Homo sapiens
gctctgagacagtagagatggc

SEQ ID NO: 8051033 - DNA, 22 bp, Homo sapiens
gctctgagagctacacagggta

SEQ ID NO: 8051034 - DNA, 22 bp, Homo sapiens
gctctgagaggatgctgagcag

SEQ ID NO: 8051035 - DNA, 22 bp, Homo sapiens
gctctgggtgaatggcagattg

SEQ ID NO: 8051036 - DNA, 22 bp, Homo sapiens
caaatgaagaaccttctcacct

SEQ ID NO: 8051037 - DNA, 22 bp, Homo sapiens
gctctgggtgaacttggagcaa

SEQ ID NO: 8051038 - DNA, 22 bp, Homo sapiens
caaatgtgttttttcttctaca

SEQ ID NO: 8051039 - DNA, 22 bp, Homo sapiens
gcctggctcctaagagcacaac

SEQ ID NO: 8051040 - DNA, 22 bp, Homo sapiens
attttgaaatacttgaaggaaa

SEQ ID NO: 8051041 - DNA, 18 bp, Homo sapiens
attttgaacaatgctgta

SEQ ID NO: 8051042 - DNA, 22 bp, Homo sapiens
attttgaagggaattgaagttc

SEQ ID NO: 8051043 - DNA, 22 bp, Homo sapiens
attttgaagggaattgaagttc

SEQ ID NO: 8051044 - DNA, 22 bp, Homo sapiens
gcctgcccacggggctggcata

SEQ ID NO: 8051045 - DNA, 22 bp, Homo sapiens
attttactaagtggatatctgt

SEQ ID NO: 8051046 - DNA, 22 bp, Homo sapiens
gcctgccccttcctgggcaggg

SEQ ID NO: 8051047 - DNA, 22 bp, Homo sapiens
atttgattagctgtgtaatttt

SEQ ID NO: 8051048 - DNA, 22 bp, Homo sapiens
gccctgccctgagccgtagacc

SEQ ID NO: 8051049 - DNA, 23 bp, Homo sapiens
gccctccctcccaggtgggtgtt

SEQ ID NO: 8051050 - DNA, 22 bp, Homo sapiens
gccctcccctctgggtggtgag

SEQ ID NO: 8051051 - DNA, 22 bp, Homo sapiens
gccctccatgagacacagtgta

SEQ ID NO: 8051052 - DNA, 22 bp, Homo sapiens
gcccaggagttgaagggctgac

SEQ ID NO: 8051053 - DNA, 22 bp, Homo sapiens
gcccaggagttcaagtctagtg

SEQ ID NO: 8051054 - DNA, 22 bp, Homo sapiens
gcccaggagttcaaggctgcag

SEQ ID NO: 8051055 - DNA, 22 bp, Homo sapiens
gcccaggaggttgggctgtgca

SEQ ID NO: 8051056 - DNA, 22 bp, Homo sapiens
gcccagcccctgggtggacgtg

SEQ ID NO: 8051057 - DNA, 22 bp, Homo sapiens
gcccaggaggtggaggtgcagt

SEQ ID NO: 8051058 - DNA, 22 bp, Homo sapiens
gcccagccagagctgtgtgatg

SEQ ID NO: 8051059 - DNA, 22 bp, Homo sapiens
gcccagccacagtcactttcat

SEQ ID NO: 8051060 - DNA, 22 bp, Homo sapiens
gcccagccagagctgtgtgatg

SEQ ID NO: 8051061 - DNA, 22 bp, Homo sapiens
gcccagcccctgggtggacgtg

SEQ ID NO: 8051062 - DNA, 22 bp, Homo sapiens
gcccagcaggggatggcagctc

SEQ ID NO: 8051063 - DNA, 22 bp, Homo sapiens
gcccagccacagtcactttcat

SEQ ID NO: 8051064 - DNA, 22 bp, Homo sapiens
gcccagccacagtcactttcat

SEQ ID NO: 8051065 - DNA, 22 bp, Homo sapiens
gcattcatcttcctccatgcag

SEQ ID NO: 8051066 - DNA, 22 bp, Homo sapiens
gcattcatcaaaaatgttcctc

SEQ ID NO: 8051067 - DNA, 22 bp, Homo sapiens
gcattcattcattcattaggta

SEQ ID NO: 8051068 - DNA, 22 bp, Homo sapiens
gccactggacccagaaagggaa

SEQ ID NO: 8051069 - DNA, 21 bp, Homo sapiens
gccactgcactccagcctggg

SEQ ID NO: 8051070 - DNA, 22 bp, Homo sapiens
gccactgattattcagcagaca

SEQ ID NO: 8051071 - DNA, 22 bp, Homo sapiens
attgttttgtagaatgaccctt

SEQ ID NO: 8051072 - DNA, 23 bp, Homo sapiens
attgtttttggctctcagggaat

SEQ ID NO: 8051073 - DNA, 22 bp, Homo sapiens
attgttttgtttcccagtgact

SEQ ID NO: 8051074 - DNA, 22 bp, Homo sapiens
attgttttattaaatgagccct

SEQ ID NO: 8051075 - DNA, 22 bp, Homo sapiens
attgttttaattccattgtgaa

SEQ ID NO: 8051076 - DNA, 22 bp, Homo sapiens
gcagtgccacaagatgggagga

SEQ ID NO: 8051077 - DNA, 18 bp, Homo sapiens
gcagtgccagcctctcct

SEQ ID NO: 8051078 - DNA, 22 bp, Homo sapiens
gcagtgctagcctcacagggtc

SEQ ID NO: 8051079 - DNA, 20 bp, Homo sapiens
gcagtgctggtgcctctgct

SEQ ID NO: 8051080 - DNA, 22 bp, Homo sapiens
attgttgccacaaggcaattct

SEQ ID NO: 8051081 - DNA, 22 bp, Homo sapiens
attgttgctaggattcaatgag

SEQ ID NO: 8051082 - DNA, 20 bp, Homo sapiens
attgttgctgctgctgttga

SEQ ID NO: 8051083 - DNA, 22 bp, Homo sapiens
gcattattaatagctgcatgag

SEQ ID NO: 8051084 - DNA, 22 bp, Homo sapiens
attgtaaagtactgtgtacaat

SEQ ID NO: 8051085 - DNA, 14 bp, Homo sapiens
gcaggtggatcacc

SEQ ID NO: 8051086 - DNA, 22 bp, Homo sapiens
gcaggtggatcaccacgtcagg

SEQ ID NO: 8051087 - DNA, 22 bp, Homo sapiens
gcaggtggatcaccacgtcagg

SEQ ID NO: 8051088 - DNA, 22 bp, Homo sapiens
gcaggtggatattgctacttga

SEQ ID NO: 8051089 - DNA, 22 bp, Homo sapiens
gcaggtggatattgctacttga

SEQ ID NO: 8051090 - DNA, 22 bp, Homo sapiens
gcaggtggatcacctgaggtca

SEQ ID NO: 8051091 - DNA, 16 bp, Homo sapiens
gcaggtggatcacctg

SEQ ID NO: 8051092 - DNA, 22 bp, Homo sapiens
gcaggtggatcacctgaggtca

SEQ ID NO: 8051093 - DNA, 14 bp, Homo sapiens
gcaggtggatcact

SEQ ID NO: 8051094 - DNA, 15 bp, Homo sapiens
gcaggtggatcactt

SEQ ID NO: 8051095 - DNA, 22 bp, Homo sapiens
gcaggtggatcacctgaggtca

SEQ ID NO: 8051096 - DNA, 22 bp, Homo sapiens
gcagggtccatggaggcagccc

SEQ ID NO: 8051097 - DNA, 22 bp, Homo sapiens
gcagggtcttgagaggcagcca

SEQ ID NO: 8051098 - DNA, 22 bp, Homo sapiens
gcaggggtggaggctgtcctgt

SEQ ID NO: 8051099 - DNA, 22 bp, Homo sapiens
gcaggggtagagattgctggtg

SEQ ID NO: 8051100 - DNA, 22 bp, Homo sapiens
gcagggctgggatttgagccca

SEQ ID NO: 8051101 - DNA, 22 bp, Homo sapiens
gcagggaggtttgctgacctgg

SEQ ID NO: 8051102 - DNA, 22 bp, Homo sapiens
gcaggatgaactaacacctgca

SEQ ID NO: 8051103 - DNA, 22 bp, Homo sapiens
gcaggagccacttcagggatgc

SEQ ID NO: 8051104 - DNA, 22 bp, Homo sapiens
gcaggagcaaactgcagtgtgg

SEQ ID NO: 8051105 - DNA, 22 bp, Homo sapiens
gcaggagcaatggcctatcaga

SEQ ID NO: 8051106 - DNA, 22 bp, Homo sapiens
gcaggagcagtcaggggcagct

SEQ ID NO: 8051107 - DNA, 22 bp, Homo sapiens
gcaggagcagtcaggggcagct

SEQ ID NO: 8051108 - DNA, 22 bp, Homo sapiens
gcaggatgggagcttcactttg

SEQ ID NO: 8051109 - DNA, 22 bp, Homo sapiens
gcaggatgggagcttcactctg

SEQ ID NO: 8051110 - DNA, 22 bp, Homo sapiens
gcaggatgccagggcagcagcg

SEQ ID NO: 8051111 - DNA, 22 bp, Homo sapiens
gcaggatgaaggcagaggctga

SEQ ID NO: 8051112 - DNA, 22 bp, Homo sapiens
gcaggatgagtgagtacattta

SEQ ID NO: 8051113 - DNA, 21 bp, Homo sapiens
gcaggatgcatcttggtgtct

SEQ ID NO: 8051114 - DNA, 22 bp, Homo sapiens
gcaggatgcaacagcttgtagt

SEQ ID NO: 8051115 - DNA, 22 bp, Homo sapiens
gcaggatggtgccctttctgcc

SEQ ID NO: 8051116 - DNA, 22 bp, Homo sapiens
gcaggatggtggaaggcctgct

SEQ ID NO: 8051117 - DNA, 22 bp, Homo sapiens
gcaggatgggtgtagcccagca

SEQ ID NO: 8051118 - DNA, 22 bp, Homo sapiens
gcaggcggatcactggaagtca

SEQ ID NO: 8051119 - DNA, 22 bp, Homo sapiens
gcaggctgtggtatgttgggca

SEQ ID NO: 8051120 - DNA, 22 bp, Homo sapiens
gcaggctgtgaggctcagatgg

SEQ ID NO: 8051121 - DNA, 22 bp, Homo sapiens
gcaggctgtggtatgttgggca

SEQ ID NO: 8051122 - DNA, 22 bp, Homo sapiens
gcagggaggaagagatgcttcc

SEQ ID NO: 8051123 - DNA, 22 bp, Homo sapiens
gcacagaggaagcacagactct

SEQ ID NO: 8051124 - DNA, 22 bp, Homo sapiens
gcacagagctggccctccaggc

SEQ ID NO: 8051125 - DNA, 22 bp, Homo sapiens
gcacagagcctggtaccgagaa

SEQ ID NO: 8051126 - DNA, 22 bp, Homo sapiens
gcacaggctctcttggggacac

SEQ ID NO: 8051127 - DNA, 22 bp, Homo sapiens
gcacagaggatgaggcagctct

SEQ ID NO: 8051128 - DNA, 22 bp, Homo sapiens
gcacagggagacagccgtggcc

SEQ ID NO: 8051129 - DNA, 22 bp, Homo sapiens
gcactgtgaatatactagcaaa

SEQ ID NO: 8051130 - DNA, 22 bp, Homo sapiens
gcactgtgacagcaagagtgag

SEQ ID NO: 8051131 - DNA, 22 bp, Homo sapiens
gcactggggtcatagcctccag

SEQ ID NO: 8051132 - DNA, 22 bp, Homo sapiens
gcactgggggcagcagtgaggg

SEQ ID NO: 8051133 - DNA, 22 bp, Homo sapiens
gcacagggccctgtgcgtaggt

SEQ ID NO: 8051134 - DNA, 22 bp, Homo sapiens
gcaacattgcttctgaacatag

SEQ ID NO: 8051135 - DNA, 22 bp, Homo sapiens
gcaacagcccaggttctgtgtg

SEQ ID NO: 8051136 - DNA, 20 bp, Homo sapiens
gcaaaataggctctgttggt

SEQ ID NO: 8051137 - DNA, 22 bp, Homo sapiens
gcaaaattaaacttagcatcat

SEQ ID NO: 8051138 - DNA, 22 bp, Homo sapiens
gcaaaagtacagccggatttct

SEQ ID NO: 8051139 - DNA, 22 bp, Homo sapiens
atgtttctacagcgtccactga

SEQ ID NO: 8051140 - DNA, 22 bp, Homo sapiens
gcagaggcctgaaggtggcggg

SEQ ID NO: 8051141 - DNA, 22 bp, Homo sapiens
gcagaattgaaatgtgtcactt

SEQ ID NO: 8051142 - DNA, 22 bp, Homo sapiens
gcagaggcctaggtggaaggcc

SEQ ID NO: 8051143 - DNA, 22 bp, Homo sapiens
gcactgtgatcaaggctaagca

SEQ ID NO: 8051144 - DNA, 22 bp, Homo sapiens
gcactgtgacccagagcaggtg

SEQ ID NO: 8051145 - DNA, 22 bp, Homo sapiens
gcagcctgggcaacagagtgag

SEQ ID NO: 8051146 - DNA, 22 bp, Homo sapiens
gcagccaggtttgaggaccact

SEQ ID NO: 8051147 - DNA, 22 bp, Homo sapiens
gcagcctgggcaacagagtgag

SEQ ID NO: 8051148 - DNA, 22 bp, Homo sapiens
gcagcctgttgtaccagcctgt

SEQ ID NO: 8051149 - DNA, 18 bp, Homo sapiens
gcaggagatgggtggggt

SEQ ID NO: 8051150 - DNA, 22 bp, Homo sapiens
gcaggagagtctgtgccaggtt

SEQ ID NO: 8051151 - DNA, 22 bp, Homo sapiens
gcagctttaaacattggaaata

SEQ ID NO: 8051152 - DNA, 22 bp, Homo sapiens
gcagctttaaaggaggctctga

SEQ ID NO: 8051153 - DNA, 22 bp, Homo sapiens
gcagctttctaagctttattgc

SEQ ID NO: 8051154 - DNA, 22 bp, Homo sapiens
gcagcaggtccgcatcatcatc

SEQ ID NO: 8051155 - DNA, 22 bp, Homo sapiens
gcagccaggaagcctttccctc

SEQ ID NO: 8051156 - DNA, 21 bp, Homo sapiens
gcagccaggactttgggctgg

SEQ ID NO: 8051157 - DNA, 22 bp, Homo sapiens
gcagccagggagagaaccaggg

SEQ ID NO: 8051158 - DNA, 22 bp, Homo sapiens
gcagccagggagagaaccaggg

SEQ ID NO: 8051159 - DNA, 22 bp, Homo sapiens
gcagccaggctacagcgggctt

SEQ ID NO: 8051160 - DNA, 22 bp, Homo sapiens
gcagccagggctaagctgggga

SEQ ID NO: 8051161 - DNA, 22 bp, Homo sapiens
gcagccagggctaagctgggga

SEQ ID NO: 8051162 - DNA, 22 bp, Homo sapiens
gcagccagggttaattatattt

SEQ ID NO: 8051163 - DNA, 19 bp, Homo sapiens
gcagccaggtgctctacct

SEQ ID NO: 8051164 - DNA, 22 bp, Homo sapiens
gcagccaggggctgtgacctgt

SEQ ID NO: 8051165 - DNA, 22 bp, Homo sapiens
gcagccaggtttgaggaccact

SEQ ID NO: 8051166 - DNA, 22 bp, Homo sapiens
cccaggaggtggagcttgcagt

SEQ ID NO: 8051167 - DNA, 22 bp, Homo sapiens
cccaggaggtcaaggctgcagt

SEQ ID NO: 8051168 - DNA, 22 bp, Homo sapiens
cccaggctgatgggatgggcca

SEQ ID NO: 8051169 - DNA, 22 bp, Homo sapiens
cccaggctgatgttcagcgggt

SEQ ID NO: 8051170 - DNA, 22 bp, Homo sapiens
cccaggctgcatgagtccatgg

SEQ ID NO: 8051171 - DNA, 22 bp, Homo sapiens
cccaggctggaattccaggcct

SEQ ID NO: 8051172 - DNA, 22 bp, Homo sapiens
cccaggcttttctcttgcccca

SEQ ID NO: 8051173 - DNA, 22 bp, Homo sapiens
cccatcaggaacccaggagccc

SEQ ID NO: 8051174 - DNA, 22 bp, Homo sapiens
cccaggaggtcaaggctgcagt

SEQ ID NO: 8051175 - DNA, 22 bp, Homo sapiens
aggctgtgacagggtcatggag

SEQ ID NO: 8051176 - DNA, 22 bp, Homo sapiens
ccctgccccaggcggcttcact

SEQ ID NO: 8051177 - DNA, 22 bp, Homo sapiens
ccctgctgccttcacccaggac

SEQ ID NO: 8051178 - DNA, 22 bp, Homo sapiens
ccctgctgcatggcctccacga

SEQ ID NO: 8051179 - DNA, 22 bp, Homo sapiens
ccctgctgtcaggtgctgggag

SEQ ID NO: 8051180 - DNA, 22 bp, Homo sapiens
ccctgctgtccctcagtcctgc

SEQ ID NO: 8051181 - DNA, 22 bp, Homo sapiens
ccctgctgtgtcccacctggaa

SEQ ID NO: 8051182 - DNA, 22 bp, Homo sapiens
ccctccattaaaacagacctat

SEQ ID NO: 8051183 - DNA, 22 bp, Homo sapiens
ccctgatgttttctctgccttt

SEQ ID NO: 8051184 - DNA, 22 bp, Homo sapiens
ccctgccagatgtgcttcagtt

SEQ ID NO: 8051185 - DNA, 18 bp, Homo sapiens
ccctgccagctcccagca

SEQ ID NO: 8051186 - DNA, 22 bp, Homo sapiens
ccctgccaatcccgtctctctg

SEQ ID NO: 8051187 - DNA, 22 bp, Homo sapiens
ccccacttgctcagcatgtcca

SEQ ID NO: 8051188 - DNA, 22 bp, Homo sapiens
ccccagaaggggacagagggta

SEQ ID NO: 8051189 - DNA, 22 bp, Homo sapiens
ccccactttgagtagcacttga

SEQ ID NO: 8051190 - DNA, 22 bp, Homo sapiens
ccccagagtgagggattgagtg

SEQ ID NO: 8051191 - DNA, 22 bp, Homo sapiens
ccctaggggcaatgatggtgct

SEQ ID NO: 8051192 - DNA, 22 bp, Homo sapiens
ccctaggggcaatgatggtgct

SEQ ID NO: 8051193 - DNA, 22 bp, Homo sapiens
ccccagcactctgactcttacc

SEQ ID NO: 8051194 - DNA, 22 bp, Homo sapiens
cctgaagaaaattccacgagaa

SEQ ID NO: 8051195 - DNA, 22 bp, Homo sapiens
cctgagagccctagccaggcgc

SEQ ID NO: 8051196 - DNA, 22 bp, Homo sapiens
cctgagagccagtgcctgccca

SEQ ID NO: 8051197 - DNA, 22 bp, Homo sapiens
aggggaggcagcgataaacctg

SEQ ID NO: 8051198 - DNA, 22 bp, Homo sapiens
aggggatgatcctcccgcagcg

SEQ ID NO: 8051199 - DNA, 22 bp, Homo sapiens
aggggaggtgtccccaaatctc

SEQ ID NO: 8051200 - DNA, 22 bp, Homo sapiens
agggctggctaggtgcgttccc

SEQ ID NO: 8051201 - DNA, 22 bp, Homo sapiens
aggggatgcctgaggatctgta

SEQ ID NO: 8051202 - DNA, 22 bp, Homo sapiens
aggggatggagctggaaggcag

SEQ ID NO: 8051203 - DNA, 22 bp, Homo sapiens
aggggcactagaatgggagact

SEQ ID NO: 8051204 - DNA, 22 bp, Homo sapiens
aggggcacgagtagagctctag

SEQ ID NO: 8051205 - DNA, 22 bp, Homo sapiens
aggggcagcctcacaatcctct

SEQ ID NO: 8051206 - DNA, 18 bp, Homo sapiens
aggggcagcttgtgtgga

SEQ ID NO: 8051207 - DNA, 22 bp, Homo sapiens
aggggcacttctcaggctgtgg

SEQ ID NO: 8051208 - DNA, 23 bp, Homo sapiens
aggggcagcaagttttggtgtta

SEQ ID NO: 8051209 - DNA, 19 bp, Homo sapiens
agggcggggcccaggcaca

SEQ ID NO: 8051210 - DNA, 22 bp, Homo sapiens
agggcgggctcatcacatgctc

SEQ ID NO: 8051211 - DNA, 22 bp, Homo sapiens
agggcgtggtggtgctggagca

SEQ ID NO: 8051212 - DNA, 22 bp, Homo sapiens
agggcgtggtggtgctggagca

SEQ ID NO: 8051213 - DNA, 22 bp, Homo sapiens
agggctggagccacagctggga

SEQ ID NO: 8051214 - DNA, 22 bp, Homo sapiens
agggctggagccacagctggga

SEQ ID NO: 8051215 - DNA, 22 bp, Homo sapiens
agggcctggaactgtgggcagg

SEQ ID NO: 8051216 - DNA, 22 bp, Homo sapiens
agggcctggaactgtgggcagg

SEQ ID NO: 8051217 - DNA, 22 bp, Homo sapiens
agggcctggaactggagaccac

SEQ ID NO: 8051218 - DNA, 20 bp, Homo sapiens
agggcctgctctgtggtgtc

SEQ ID NO: 8051219 - DNA, 20 bp, Homo sapiens
agggcctgctctgtggtgtc

SEQ ID NO: 8051220 - DNA, 22 bp, Homo sapiens
agggcctggaactggagaccac

SEQ ID NO: 8051221 - DNA, 22 bp, Homo sapiens
ccctgctttcaaccttctagct

SEQ ID NO: 8051222 - DNA, 22 bp, Homo sapiens
ccctggaaatgaggcatgtgcg

SEQ ID NO: 8051223 - DNA, 22 bp, Homo sapiens
ccctggaacccatggccagtgt

SEQ ID NO: 8051224 - DNA, 22 bp, Homo sapiens
ccctggaactgccaagcctcag

SEQ ID NO: 8051225 - DNA, 22 bp, Homo sapiens
ccctggaaggagatgggacatg

SEQ ID NO: 8051226 - DNA, 22 bp, Homo sapiens
agggcctgagctggctgacctc

SEQ ID NO: 8051227 - DNA, 22 bp, Homo sapiens
agggcctgagctggctgacctc

SEQ ID NO: 8051228 - DNA, 22 bp, Homo sapiens
agggcctgaggctgacggggag

SEQ ID NO: 8051229 - DNA, 22 bp, Homo sapiens
agggcctgaggctgacggggag

SEQ ID NO: 8051230 - DNA, 22 bp, Homo sapiens
agggcctgaggctgacggggag

SEQ ID NO: 8051231 - DNA, 22 bp, Homo sapiens
agggcctgcatcaggagcttgg

SEQ ID NO: 8051232 - DNA, 22 bp, Homo sapiens
agggcctgcatcaggagcttgg

SEQ ID NO: 8051233 - DNA, 19 bp, Homo sapiens
agggcctgcagctcaagct

SEQ ID NO: 8051234 - DNA, 22 bp, Homo sapiens
ccaggctgggctacaagttgag

SEQ ID NO: 8051235 - DNA, 22 bp, Homo sapiens
ccaggctgggcggggaacctgg

SEQ ID NO: 8051236 - DNA, 22 bp, Homo sapiens
ccaggctgggcggggaacctgg

SEQ ID NO: 8051237 - DNA, 22 bp, Homo sapiens
ccaggctgggctacaagttgag

SEQ ID NO: 8051238 - DNA, 22 bp, Homo sapiens
ccaggctggagtatagtggcgc

SEQ ID NO: 8051239 - DNA, 22 bp, Homo sapiens
ccaggctggagtatagtggcgc

SEQ ID NO: 8051240 - DNA, 22 bp, Homo sapiens
ccaggctggagtgcaatggcat

SEQ ID NO: 8051241 - DNA, 22 bp, Homo sapiens
ccaggctgctttattactctgt

SEQ ID NO: 8051242 - DNA, 22 bp, Homo sapiens
aggcgtggttgaggcgagcata

SEQ ID NO: 8051243 - DNA, 22 bp, Homo sapiens
aggctacaataattcccatgca

SEQ ID NO: 8051244 - DNA, 22 bp, Homo sapiens
aggctagaggcttctggcttca

SEQ ID NO: 8051245 - DNA, 22 bp, Homo sapiens
ccagggctccattgctcatcct

SEQ ID NO: 8051246 - DNA, 19 bp, Homo sapiens
ccagggctccaagctgagt

SEQ ID NO: 8051247 - DNA, 22 bp, Homo sapiens
ccagggctcaggctcccagtgg

SEQ ID NO: 8051248 - DNA, 20 bp, Homo sapiens
ccagggctggctcctgggat

SEQ ID NO: 8051249 - DNA, 22 bp, Homo sapiens
ccagggctggaccagtgcttgg

SEQ ID NO: 8051250 - DNA, 22 bp, Homo sapiens
ccaggctgtaaacaccttcaaa

SEQ ID NO: 8051251 - DNA, 22 bp, Homo sapiens
ccagggcaggagaaagactcac

SEQ ID NO: 8051252 - DNA, 22 bp, Homo sapiens
ccagggcctgagggcgacgccc

SEQ ID NO: 8051253 - DNA, 22 bp, Homo sapiens
ccagggctgggtttgtcggtgt

SEQ ID NO: 8051254 - DNA, 22 bp, Homo sapiens
ccagggctggtggctgcagagg

SEQ ID NO: 8051255 - DNA, 22 bp, Homo sapiens
ccagggctggtgggagatgctg

SEQ ID NO: 8051256 - DNA, 22 bp, Homo sapiens
aggctgctcagtagatggagct

SEQ ID NO: 8051257 - DNA, 22 bp, Homo sapiens
aggctgcttccttacgtggctg

SEQ ID NO: 8051258 - DNA, 22 bp, Homo sapiens
aggctgcttccttacgtggctg

SEQ ID NO: 8051259 - DNA, 22 bp, Homo sapiens
aggctgcttcttgtccttggca

SEQ ID NO: 8051260 - DNA, 22 bp, Homo sapiens
aggctgctttcatggccgcccc

SEQ ID NO: 8051261 - DNA, 22 bp, Homo sapiens
aggctgctttttatttacaggt

SEQ ID NO: 8051262 - DNA, 19 bp, Homo sapiens
aggctggagacaccaggcc

SEQ ID NO: 8051263 - DNA, 22 bp, Homo sapiens
aggctggaaagggaccagagtg

SEQ ID NO: 8051264 - DNA, 22 bp, Homo sapiens
ccaggtctggcactggccagtc

SEQ ID NO: 8051265 - DNA, 22 bp, Homo sapiens
ccaggtgaggtaggtatggtag

SEQ ID NO: 8051266 - DNA, 22 bp, Homo sapiens
aggctggagtgtagcagtgcag

SEQ ID NO: 8051267 - DNA, 22 bp, Homo sapiens
aggctggagcaagggggcatat

SEQ ID NO: 8051268 - DNA, 22 bp, Homo sapiens
aggctggagcaagggggcatat

SEQ ID NO: 8051269 - DNA, 22 bp, Homo sapiens
aggctggagtacagtggctatt

SEQ ID NO: 8051270 - DNA, 22 bp, Homo sapiens
aggctggagacccgccaagaaa

SEQ ID NO: 8051271 - DNA, 22 bp, Homo sapiens
aggctggagagtgcagtggcgt

SEQ ID NO: 8051272 - DNA, 22 bp, Homo sapiens
aggctggggaattgaatttgct

SEQ ID NO: 8051273 - DNA, 20 bp, Homo sapiens
aggctggggtgttttgccca

SEQ ID NO: 8051274 - DNA, 22 bp, Homo sapiens
aggctgggtacctgtcatatgc

SEQ ID NO: 8051275 - DNA, 22 bp, Homo sapiens
aggctgggcaccgttttgatcc

SEQ ID NO: 8051276 - DNA, 22 bp, Homo sapiens
aggctgggctccgcccaactcc

SEQ ID NO: 8051277 - DNA, 22 bp, Homo sapiens
aggctggggaattgaatttgct

SEQ ID NO: 8051278 - DNA, 22 bp, Homo sapiens
aggctgggaaggtaaagttgta

SEQ ID NO: 8051279 - DNA, 22 bp, Homo sapiens
aggctgggaaggtaaagttgta

SEQ ID NO: 8051280 - DNA, 22 bp, Homo sapiens
aggctggcggtgactgctctga

SEQ ID NO: 8051281 - DNA, 22 bp, Homo sapiens
aggctggcgacatctggcgggc

SEQ ID NO: 8051282 - DNA, 22 bp, Homo sapiens
aggctggcgacatctggcgggc

SEQ ID NO: 8051283 - DNA, 17 bp, Homo sapiens
aggctggccttcacagt

SEQ ID NO: 8051284 - DNA, 22 bp, Homo sapiens
aggctggccctactggctgcct

SEQ ID NO: 8051285 - DNA, 22 bp, Homo sapiens
aggccacagtcagtgggtgctg

SEQ ID NO: 8051286 - DNA, 22 bp, Homo sapiens
aggccacaagaactaccccatc

SEQ ID NO: 8051287 - DNA, 22 bp, Homo sapiens
aggccacagttgaggccagcaa

SEQ ID NO: 8051288 - DNA, 22 bp, Homo sapiens
aggccacagttgaggccagcaa

SEQ ID NO: 8051289 - DNA, 22 bp, Homo sapiens
ccagaccctttcttggcatgtg

SEQ ID NO: 8051290 - DNA, 22 bp, Homo sapiens
ccagacctgcaaggctgagagg

SEQ ID NO: 8051291 - DNA, 22 bp, Homo sapiens
ccagaccctgctctggggctct

SEQ ID NO: 8051292 - DNA, 22 bp, Homo sapiens
ccactgggggctgcaggcactc

SEQ ID NO: 8051293 - DNA, 18 bp, Homo sapiens
aggcaggctggagtgact

SEQ ID NO: 8051294 - DNA, 18 bp, Homo sapiens
aggcaggctggagtgact

SEQ ID NO: 8051295 - DNA, 22 bp, Homo sapiens
ccagagctccagggctacagaa

SEQ ID NO: 8051296 - DNA, 22 bp, Homo sapiens
aggccacatagcttgcatgtag

SEQ ID NO: 8051297 - DNA, 22 bp, Homo sapiens
aggccagaaaaagacagctcca

SEQ ID NO: 8051298 - DNA, 22 bp, Homo sapiens
aggccacattgtgattcccgca

SEQ ID NO: 8051299 - DNA, 21 bp, Homo sapiens
ccagagcctgctgagccccct

SEQ ID NO: 8051300 - DNA, 22 bp, Homo sapiens
ccagagcctggcatctgcataa

SEQ ID NO: 8051301 - DNA, 23 bp, Homo sapiens
aggcccaactctgtgagggctgc

SEQ ID NO: 8051302 - DNA, 22 bp, Homo sapiens
aggccatgaggtcatgggagat

SEQ ID NO: 8051303 - DNA, 22 bp, Homo sapiens
aggcccagagagccagttagtg

SEQ ID NO: 8051304 - DNA, 22 bp, Homo sapiens
ccagcaggaaagtgacgtttga

SEQ ID NO: 8051305 - DNA, 22 bp, Homo sapiens
ccagcaggactttggaaatatg

SEQ ID NO: 8051306 - DNA, 22 bp, Homo sapiens
ccagcaggactttggaaatatg

SEQ ID NO: 8051307 - DNA, 22 bp, Homo sapiens
aggccaggttcctcaatcttga

SEQ ID NO: 8051308 - DNA, 22 bp, Homo sapiens
aggccaggatagcatggatcag

SEQ ID NO: 8051309 - DNA, 22 bp, Homo sapiens
aggccaggcaacattctgaagt

SEQ ID NO: 8051310 - DNA, 22 bp, Homo sapiens
aggcctggcctttatgttcaag

SEQ ID NO: 8051311 - DNA, 22 bp, Homo sapiens
aggcctggcctgggcggcattg

SEQ ID NO: 8051312 - DNA, 22 bp, Homo sapiens
aggcctggcatgagacctgaga

SEQ ID NO: 8051313 - DNA, 22 bp, Homo sapiens
aggcctgggacgggagccgtga

SEQ ID NO: 8051314 - DNA, 22 bp, Homo sapiens
aggcggtgctgtggacagtgac

SEQ ID NO: 8051315 - DNA, 22 bp, Homo sapiens
aggcggtgtgctttgcagagca

SEQ ID NO: 8051316 - DNA, 22 bp, Homo sapiens
aggcgctgcgctggggccagaa

SEQ ID NO: 8051317 - DNA, 22 bp, Homo sapiens
aggcgctgcatgtgaaggagtt

SEQ ID NO: 8051318 - DNA, 22 bp, Homo sapiens
ccaggacaagccagagggacag

SEQ ID NO: 8051319 - DNA, 22 bp, Homo sapiens
ccagcaggagactagcaacata

SEQ ID NO: 8051320 - DNA, 22 bp, Homo sapiens
ccagcaggagagaacatttccc

SEQ ID NO: 8051321 - DNA, 22 bp, Homo sapiens
ccagcaggagatgcctgtgtct

SEQ ID NO: 8051322 - DNA, 23 bp, Homo sapiens
ccagctccgtgagcctcgggctc

SEQ ID NO: 8051323 - DNA, 21 bp, Homo sapiens
ccagctctgcctccagttggt

SEQ ID NO: 8051324 - DNA, 22 bp, Homo sapiens
ccagcaggcagtcatatccttt

SEQ ID NO: 8051325 - DNA, 22 bp, Homo sapiens
ccagcaggcagtcatatccttt

SEQ ID NO: 8051326 - DNA, 22 bp, Homo sapiens
ccagctctgcttgcccagtcag

SEQ ID NO: 8051327 - DNA, 22 bp, Homo sapiens
ccagctggcccagctgtgctcc

SEQ ID NO: 8051328 - DNA, 22 bp, Homo sapiens
ccagctggagccaaggtggact

SEQ ID NO: 8051329 - DNA, 22 bp, Homo sapiens
caggtcctggcatcaggcaggt

SEQ ID NO: 8051330 - DNA, 22 bp, Homo sapiens
aggaagggttctttgtgaaaga

SEQ ID NO: 8051331 - DNA, 17 bp, Homo sapiens
caggtcccagggtctct

SEQ ID NO: 8051332 - DNA, 22 bp, Homo sapiens
cagggtggtaccagcatctagt

SEQ ID NO: 8051333 - DNA, 22 bp, Homo sapiens
aggaagatgtgtttagcaggtt

SEQ ID NO: 8051334 - DNA, 20 bp, Homo sapiens
agcttctgctgcctttcggc

SEQ ID NO: 8051335 - DNA, 22 bp, Homo sapiens
agcttctgttcatcttccaggc

SEQ ID NO: 8051336 - DNA, 22 bp, Homo sapiens
agctttatttgtcattcacggc

SEQ ID NO: 8051337 - DNA, 22 bp, Homo sapiens
agctttatttgtcattcacggc

SEQ ID NO: 8051338 - DNA, 22 bp, Homo sapiens
agctttattcatgatttcaggg

SEQ ID NO: 8051339 - DNA, 22 bp, Homo sapiens
agctttattcatgatttcaggg

SEQ ID NO: 8051340 - DNA, 22 bp, Homo sapiens
agctttatatttaatgaattct

SEQ ID NO: 8051341 - DNA, 22 bp, Homo sapiens
agctttatatttaatgaattct

SEQ ID NO: 8051342 - DNA, 22 bp, Homo sapiens
agctttattaactctccaggtg

SEQ ID NO: 8051343 - DNA, 22 bp, Homo sapiens
caggcttcttttctttccagac

SEQ ID NO: 8051344 - DNA, 22 bp, Homo sapiens
aggaaaatgaaacagcaactgt

SEQ ID NO: 8051345 - DNA, 20 bp, Homo sapiens
cagggacagtggcagattca

SEQ ID NO: 8051346 - DNA, 22 bp, Homo sapiens
agctttctccctgacgctttgg

SEQ ID NO: 8051347 - DNA, 22 bp, Homo sapiens
agctttctctcagccaggctgc

SEQ ID NO: 8051348 - DNA, 20 bp, Homo sapiens
agctttctccttggagctcc

SEQ ID NO: 8051349 - DNA, 22 bp, Homo sapiens
agctttctggttacagtcttca

SEQ ID NO: 8051350 - DNA, 22 bp, Homo sapiens
agctttctggttacagtcttca

SEQ ID NO: 8051351 - DNA, 22 bp, Homo sapiens
agctgctgggagaagtgagcca

SEQ ID NO: 8051352 - DNA, 22 bp, Homo sapiens
agctgcctgccatgccgctggt

SEQ ID NO: 8051353 - DNA, 21 bp, Homo sapiens
agctgcctgctctggacctgg

SEQ ID NO: 8051354 - DNA, 22 bp, Homo sapiens
agctgcctgcttatgagctcca

SEQ ID NO: 8051355 - DNA, 22 bp, Homo sapiens
agctgcctccctgtgcttgtcc

SEQ ID NO: 8051356 - DNA, 22 bp, Homo sapiens
agctgcctcctggtgccccatc

SEQ ID NO: 8051357 - DNA, 22 bp, Homo sapiens
agctgccctgggctggagatgg

SEQ ID NO: 8051358 - DNA, 22 bp, Homo sapiens
agctgccctggcggagctgctc

SEQ ID NO: 8051359 - DNA, 22 bp, Homo sapiens
agctgccagatgacagtgctat

SEQ ID NO: 8051360 - DNA, 22 bp, Homo sapiens
agctgccctttatgatgctgaa

SEQ ID NO: 8051361 - DNA, 22 bp, Homo sapiens
agctgccctgtggggagggttg

SEQ ID NO: 8051362 - DNA, 21 bp, Homo sapiens
agctgcctccacttctgaggc

SEQ ID NO: 8051363 - DNA, 22 bp, Homo sapiens
agctgcctcagtcactcatggc

SEQ ID NO: 8051364 - DNA, 22 bp, Homo sapiens
agctctttggcactgagcagca

SEQ ID NO: 8051365 - DNA, 22 bp, Homo sapiens
agctcttttatcatgaggagag

SEQ ID NO: 8051366 - DNA, 22 bp, Homo sapiens
caggaagaaagaggtgaggtgt

SEQ ID NO: 8051367 - DNA, 22 bp, Homo sapiens
caggaagaccagggctgtggct

SEQ ID NO: 8051368 - DNA, 22 bp, Homo sapiens
caggaagaccagggctgtggct

SEQ ID NO: 8051369 - DNA, 22 bp, Homo sapiens
agctgggctccaagagggatct

SEQ ID NO: 8051370 - DNA, 22 bp, Homo sapiens
agctgggcgcagtggctggtga

SEQ ID NO: 8051371 - DNA, 22 bp, Homo sapiens
agctgggcgcagtggctggtga

SEQ ID NO: 8051372 - DNA, 22 bp, Homo sapiens
agctgggctggagctccaagcg

SEQ ID NO: 8051373 - DNA, 22 bp, Homo sapiens
agctgggctgatgactcatgtt

SEQ ID NO: 8051374 - DNA, 22 bp, Homo sapiens
agctgggctgatgactcatgtt

SEQ ID NO: 8051375 - DNA, 22 bp, Homo sapiens
agctgggcctgagctggaagct

SEQ ID NO: 8051376 - DNA, 22 bp, Homo sapiens
agctgggcagtgcttggattca

SEQ ID NO: 8051377 - DNA, 23 bp, Homo sapiens
agctgggccaggtggtcagacct

SEQ ID NO: 8051378 - DNA, 23 bp, Homo sapiens
agctgggccaggtggtcagacct

SEQ ID NO: 8051379 - DNA, 21 bp, Homo sapiens
agctgggcctcagcctgcagt

SEQ ID NO: 8051380 - DNA, 21 bp, Homo sapiens
agctgggcctcagcctgcagt

SEQ ID NO: 8051381 - DNA, 22 bp, Homo sapiens
agctgggcaccccgctgcgtct

SEQ ID NO: 8051382 - DNA, 19 bp, Homo sapiens
agctggagattggagggca

SEQ ID NO: 8051383 - DNA, 22 bp, Homo sapiens
agctggagccagtgtgaggctt

SEQ ID NO: 8051384 - DNA, 22 bp, Homo sapiens
agctggagagtttccaggaagg

SEQ ID NO: 8051385 - DNA, 22 bp, Homo sapiens
caggcagagtgagaagcccttg

SEQ ID NO: 8051386 - DNA, 22 bp, Homo sapiens
agctgggtggagggcccacggt

SEQ ID NO: 8051387 - DNA, 22 bp, Homo sapiens
agctgggtgtagggctggacaa

SEQ ID NO: 8051388 - DNA, 22 bp, Homo sapiens
caggcagagtgaggtggtctaa

SEQ ID NO: 8051389 - DNA, 19 bp, Homo sapiens
agctggggcggtgtgtgtt

SEQ ID NO: 8051390 - DNA, 22 bp, Homo sapiens
agctgggtgcccgaagccacgt

SEQ ID NO: 8051391 - DNA, 22 bp, Homo sapiens
agctgggtgcggtggctcatgc

SEQ ID NO: 8051392 - DNA, 22 bp, Homo sapiens
agctggtccttccctgccctgt

SEQ ID NO: 8051393 - DNA, 22 bp, Homo sapiens
agctgggtttctggcaggctta

SEQ ID NO: 8051394 - DNA, 22 bp, Homo sapiens
agctgggtttctggcaggctta

SEQ ID NO: 8051395 - DNA, 22 bp, Homo sapiens
agctgggtgttcttgggcctaa

SEQ ID NO: 8051396 - DNA, 17 bp, Homo sapiens
agctgggttctcaggaa

SEQ ID NO: 8051397 - DNA, 22 bp, Homo sapiens
agctgggttcagaggcacatgg

SEQ ID NO: 8051398 - DNA, 22 bp, Homo sapiens
catgtgtcctagctattctcct

SEQ ID NO: 8051399 - DNA, 21 bp, Homo sapiens
catgtgtcttgtgttactgct

SEQ ID NO: 8051400 - DNA, 22 bp, Homo sapiens
catgtgtctttatggagccaca

SEQ ID NO: 8051401 - DNA, 22 bp, Homo sapiens
catgtgtctaatctactaatat

SEQ ID NO: 8051402 - DNA, 22 bp, Homo sapiens
catgtgtcttgctgccctccat

SEQ ID NO: 8051403 - DNA, 22 bp, Homo sapiens
aggcacagggatgcggagccag

SEQ ID NO: 8051404 - DNA, 22 bp, Homo sapiens
aggcacagtggctcacacctgt

SEQ ID NO: 8051405 - DNA, 22 bp, Homo sapiens
aggcacagtggctcacacctgt

SEQ ID NO: 8051406 - DNA, 19 bp, Homo sapiens
aggcacaggttgtctggac

SEQ ID NO: 8051407 - DNA, 19 bp, Homo sapiens
aggcacaggttgtctggac

SEQ ID NO: 8051408 - DNA, 22 bp, Homo sapiens
aggcactgaaaggtggccagag

SEQ ID NO: 8051409 - DNA, 22 bp, Homo sapiens
aggcactgaagtggtaaatgta

SEQ ID NO: 8051410 - DNA, 22 bp, Homo sapiens
aggcactgaatatccagtaaaa

SEQ ID NO: 8051411 - DNA, 22 bp, Homo sapiens
aggcactgactcaagggagcca

SEQ ID NO: 8051412 - DNA, 22 bp, Homo sapiens
aggcactgactcaagggagcca

SEQ ID NO: 8051413 - DNA, 22 bp, Homo sapiens
aggcagaggagaatgatcttcc

SEQ ID NO: 8051414 - DNA, 23 bp, Homo sapiens
aggcagctgggtagcatctttct

SEQ ID NO: 8051415 - DNA, 22 bp, Homo sapiens
aggcagcgtagcaaggctagta

SEQ ID NO: 8051416 - DNA, 22 bp, Homo sapiens
ccaaaataacagcccaattcac

SEQ ID NO: 8051417 - DNA, 22 bp, Homo sapiens
aggcaggccctgggccatcccg

SEQ ID NO: 8051418 - DNA, 18 bp, Homo sapiens
aggcaggcggatcacaag

SEQ ID NO: 8051419 - DNA, 22 bp, Homo sapiens
aggcaggcctacacaatgggag

SEQ ID NO: 8051420 - DNA, 22 bp, Homo sapiens
aggcaggcctacacaatgggag

SEQ ID NO: 8051421 - DNA, 22 bp, Homo sapiens
aggcaggctctgggtatgtgca

SEQ ID NO: 8051422 - DNA, 22 bp, Homo sapiens
aggcaggctgctatggagtaga

SEQ ID NO: 8051423 - DNA, 22 bp, Homo sapiens
aggcaggctgctatggagtaga

SEQ ID NO: 8051424 - DNA, 22 bp, Homo sapiens
aggcaggctcaatgcccagtct

SEQ ID NO: 8051425 - DNA, 22 bp, Homo sapiens
aggcaggctagtcgcttgagcc

SEQ ID NO: 8051426 - DNA, 22 bp, Homo sapiens
ccaaaatattagtgcttaagta

SEQ ID NO: 8051427 - DNA, 22 bp, Homo sapiens
aggcaggccctctggaaaggta

SEQ ID NO: 8051428 - DNA, 22 bp, Homo sapiens
aggagccacctaggagctgttt

SEQ ID NO: 8051429 - DNA, 22 bp, Homo sapiens
aggagctggcctagaaaggaga

SEQ ID NO: 8051430 - DNA, 22 bp, Homo sapiens
aggagctgggagaaggactaaa

SEQ ID NO: 8051431 - DNA, 22 bp, Homo sapiens
aggagctgggcccaaggatgct

SEQ ID NO: 8051432 - DNA, 22 bp, Homo sapiens
aggagctgggctgctgctggga

SEQ ID NO: 8051433 - DNA, 22 bp, Homo sapiens
aggagctgggcccaaggatgct

SEQ ID NO: 8051434 - DNA, 17 bp, Homo sapiens
aggagctgggggtggtg

SEQ ID NO: 8051435 - DNA, 22 bp, Homo sapiens
aggaattcaagaccagctgggc

SEQ ID NO: 8051436 - DNA, 22 bp, Homo sapiens
cagtgcagccaaggacaggcac

SEQ ID NO: 8051437 - DNA, 22 bp, Homo sapiens
cagtgcaggctgggggccctgc

SEQ ID NO: 8051438 - DNA, 22 bp, Homo sapiens
cagtgcaggaagtgagatgcct

SEQ ID NO: 8051439 - DNA, 22 bp, Homo sapiens
catcagaacaaatcggttaaga

SEQ ID NO: 8051440 - DNA, 22 bp, Homo sapiens
catcagaaggaaggacgattat

SEQ ID NO: 8051441 - DNA, 22 bp, Homo sapiens
aggaggctgcaaccctgaggcc

SEQ ID NO: 8051442 - DNA, 22 bp, Homo sapiens
aggaggctgggcacagtggcct

SEQ ID NO: 8051443 - DNA, 22 bp, Homo sapiens
aggaggctgcaaccctgaggcc

SEQ ID NO: 8051444 - DNA, 22 bp, Homo sapiens
catcatgtctgcaggaatgtgt

SEQ ID NO: 8051445 - DNA, 22 bp, Homo sapiens
aggagtggtgcaggacctgcca

SEQ ID NO: 8051446 - DNA, 22 bp, Homo sapiens
aggaggctggttcaggccatat

SEQ ID NO: 8051447 - DNA, 22 bp, Homo sapiens
aggaggctggttcaggccatat

SEQ ID NO: 8051448 - DNA, 22 bp, Homo sapiens
aggagggttctctggacagagg

SEQ ID NO: 8051449 - DNA, 22 bp, Homo sapiens
ctggcctctctgagcagggagc

SEQ ID NO: 8051450 - DNA, 19 bp, Homo sapiens
ctggcctgtgtcctgtgct

SEQ ID NO: 8051451 - DNA, 22 bp, Homo sapiens
ctggcctttcgtgagagctggg

SEQ ID NO: 8051452 - DNA, 22 bp, Homo sapiens
ctggctcacaggtgagatgcat

SEQ ID NO: 8051453 - DNA, 22 bp, Homo sapiens
ctggcgtgaaggtggccatgag

SEQ ID NO: 8051454 - DNA, 22 bp, Homo sapiens
atatacactccactgatacagg

SEQ ID NO: 8051455 - DNA, 22 bp, Homo sapiens
ctggctgcaaaatctattcact

SEQ ID NO: 8051456 - DNA, 19 bp, Homo sapiens
ctggctgcaatgccagggt

SEQ ID NO: 8051457 - DNA, 22 bp, Homo sapiens
atatacacatgtgtatacattt

SEQ ID NO: 8051458 - DNA, 22 bp, Homo sapiens
atatacttggagactatcattg

SEQ ID NO: 8051459 - DNA, 22 bp, Homo sapiens
ctgggagaggctgctccgctct

SEQ ID NO: 8051460 - DNA, 22 bp, Homo sapiens
ctgggagaggctgctccgctct

SEQ ID NO: 8051461 - DNA, 22 bp, Homo sapiens
ctgggagctggaatgggagaag

SEQ ID NO: 8051462 - DNA, 22 bp, Homo sapiens
ctgggagctggatgccctgccc

SEQ ID NO: 8051463 - DNA, 22 bp, Homo sapiens
ctgggagctgtcaggagcgtgt

SEQ ID NO: 8051464 - DNA, 22 bp, Homo sapiens
ctgggagctgtcaggagcgtgt

SEQ ID NO: 8051465 - DNA, 22 bp, Homo sapiens
ctgggagctgtcaggagcgtgt

SEQ ID NO: 8051466 - DNA, 22 bp, Homo sapiens
ctgggagcttgttaggaatgca

SEQ ID NO: 8051467 - DNA, 22 bp, Homo sapiens
ctgggagcttgttaggaatgca

SEQ ID NO: 8051468 - DNA, 22 bp, Homo sapiens
atatacctcattctttgagtgc

SEQ ID NO: 8051469 - DNA, 22 bp, Homo sapiens
atatacatgggaatatgtggag

SEQ ID NO: 8051470 - DNA, 20 bp, Homo sapiens
atacacatgcagacagatgc

SEQ ID NO: 8051471 - DNA, 22 bp, Homo sapiens
ctggagtgcagtggcatgatca

SEQ ID NO: 8051472 - DNA, 20 bp, Homo sapiens
atacacattcatagaaaaat

SEQ ID NO: 8051473 - DNA, 22 bp, Homo sapiens
ctggcacagccactgcaggcag

SEQ ID NO: 8051474 - DNA, 22 bp, Homo sapiens
ctggcacacgtggcagggtagg

SEQ ID NO: 8051475 - DNA, 22 bp, Homo sapiens
ctggcacacagtaggcaccaat

SEQ ID NO: 8051476 - DNA, 22 bp, Homo sapiens
ctggcacacagcaggctctcag

SEQ ID NO: 8051477 - DNA, 17 bp, Homo sapiens
atacatgtaaagtgctt

SEQ ID NO: 8051478 - DNA, 22 bp, Homo sapiens
atacatgattttttgagggtgg

SEQ ID NO: 8051479 - DNA, 22 bp, Homo sapiens
ctggcacagcttgggccccatc

SEQ ID NO: 8051480 - DNA, 22 bp, Homo sapiens
ctggcacagttaacatatgcta

SEQ ID NO: 8051481 - DNA, 22 bp, Homo sapiens
atacatgtgggtctaaacatat

SEQ ID NO: 8051482 - DNA, 22 bp, Homo sapiens
atacatgtacataaatgtagca

SEQ ID NO: 8051483 - DNA, 22 bp, Homo sapiens
atacatgtgtgagcgaagatgt

SEQ ID NO: 8051484 - DNA, 22 bp, Homo sapiens
ctggcctcagagggtcatggtg

SEQ ID NO: 8051485 - DNA, 22 bp, Homo sapiens
ctggccagactacacatgtgtg

SEQ ID NO: 8051486 - DNA, 22 bp, Homo sapiens
ctggccagaggttcctctgccc

SEQ ID NO: 8051487 - DNA, 22 bp, Homo sapiens
ctggccctatgagcctcctgat

SEQ ID NO: 8051488 - DNA, 22 bp, Homo sapiens
ctggccactgcgggcctctgcc

SEQ ID NO: 8051489 - DNA, 22 bp, Homo sapiens
ctggcaggtttggtgtctggtg

SEQ ID NO: 8051490 - DNA, 22 bp, Homo sapiens
ctggccactggaggtggcaccc

SEQ ID NO: 8051491 - DNA, 20 bp, Homo sapiens
ctggccagaacgcctacaca

SEQ ID NO: 8051492 - DNA, 20 bp, Homo sapiens
ctggccagaacgcctacaca

SEQ ID NO: 8051493 - DNA, 22 bp, Homo sapiens
ctggcaggtggatggggactcc

SEQ ID NO: 8051494 - DNA, 22 bp, Homo sapiens
ctggcaggttatagagctgccc

SEQ ID NO: 8051495 - DNA, 22 bp, Homo sapiens
ctggcaggttatagagctgccc

SEQ ID NO: 8051496 - DNA, 22 bp, Homo sapiens
ctggcaggtctcgctgacgtgt

SEQ ID NO: 8051497 - DNA, 22 bp, Homo sapiens
ctggcaggtctcgctgacgtgt

SEQ ID NO: 8051498 - DNA, 22 bp, Homo sapiens
ctggcaggtggaggttgcagtg

SEQ ID NO: 8051499 - DNA, 22 bp, Homo sapiens
ctgcctgtgccaccgcctcatt

SEQ ID NO: 8051500 - DNA, 22 bp, Homo sapiens
ctgcctgtaactttctgaagca

SEQ ID NO: 8051501 - DNA, 22 bp, Homo sapiens
ctgcctgggttcaagtcctgtt

SEQ ID NO: 8051502 - DNA, 22 bp, Homo sapiens
ctgcctggaaggagcaagggga

SEQ ID NO: 8051503 - DNA, 22 bp, Homo sapiens
ctgcctggtctcaggcatgggg

SEQ ID NO: 8051504 - DNA, 19 bp, Homo sapiens
ctgctcaggtcagtctgtc

SEQ ID NO: 8051505 - DNA, 19 bp, Homo sapiens
ctgctcagagcagctccag

SEQ ID NO: 8051506 - DNA, 22 bp, Homo sapiens
ctgctgggctcctcatgtgact

SEQ ID NO: 8051507 - DNA, 22 bp, Homo sapiens
ctgctgcccagtgtgcattggg

SEQ ID NO: 8051508 - DNA, 22 bp, Homo sapiens
atacacatctatttaagagaca

SEQ ID NO: 8051509 - DNA, 22 bp, Homo sapiens
atacacatatgtgtgtatatgt

SEQ ID NO: 8051510 - DNA, 21 bp, Homo sapiens
atacacatacacataaatgtg

SEQ ID NO: 8051511 - DNA, 22 bp, Homo sapiens
ctgctggggtcagagcactggg

SEQ ID NO: 8051512 - DNA, 22 bp, Homo sapiens
ctgctgtgggcagggtagctgg

SEQ ID NO: 8051513 - DNA, 22 bp, Homo sapiens
ataaaatctttatgtgctctgc

SEQ ID NO: 8051514 - DNA, 22 bp, Homo sapiens
ctgcagggagaggggacagcct

SEQ ID NO: 8051515 - DNA, 22 bp, Homo sapiens
ctgcagggaccacaagcaggtt

SEQ ID NO: 8051516 - DNA, 22 bp, Homo sapiens
ctgcagggaactgaggcccaga

SEQ ID NO: 8051517 - DNA, 22 bp, Homo sapiens
ataaaagatcccttctgagctc

SEQ ID NO: 8051518 - DNA, 22 bp, Homo sapiens
ataaaagaagttttggtacttg

SEQ ID NO: 8051519 - DNA, 22 bp, Homo sapiens
ctgcaggctgagcgcctgccgg

SEQ ID NO: 8051520 - DNA, 22 bp, Homo sapiens
atctcctcccgcgccgagctcg

SEQ ID NO: 8051521 - DNA, 23 bp, Homo sapiens
atctcctgagaacccacagtggt

SEQ ID NO: 8051522 - DNA, 22 bp, Homo sapiens
cttctgagcagacctcctgggg

SEQ ID NO: 8051523 - DNA, 22 bp, Homo sapiens
atctgtaaatgcaaatgtagct

SEQ ID NO: 8051524 - DNA, 22 bp, Homo sapiens
atctggttcttcttaggcatca

SEQ ID NO: 8051525 - DNA, 22 bp, Homo sapiens
atctgtggctggtgagaggcag

SEQ ID NO: 8051526 - DNA, 22 bp, Homo sapiens
cttcacaaaatatttcattata

SEQ ID NO: 8051527 - DNA, 22 bp, Homo sapiens
cttccttctgaagcatagaagc

SEQ ID NO: 8051528 - DNA, 22 bp, Homo sapiens
cttccttccttccccgaaatgc

SEQ ID NO: 8051529 - DNA, 21 bp, Homo sapiens
cttattcactgttatttatca

SEQ ID NO: 8051530 - DNA, 22 bp, Homo sapiens
cttaatgaaaggttgcacatgg

SEQ ID NO: 8051531 - DNA, 22 bp, Homo sapiens
atcatcagggacatttctgtgc

SEQ ID NO: 8051532 - DNA, 22 bp, Homo sapiens
ctgtaaatatgaagaatatatg

SEQ ID NO: 8051533 - DNA, 22 bp, Homo sapiens
atcacagagctcccttccactg

SEQ ID NO: 8051534 - DNA, 22 bp, Homo sapiens
atcacagagattgcttttaaaa

SEQ ID NO: 8051535 - DNA, 22 bp, Homo sapiens
atcacaatgtacgttaaaatgt

SEQ ID NO: 8051536 - DNA, 22 bp, Homo sapiens
ctgtctcctccactgcatggga

SEQ ID NO: 8051537 - DNA, 22 bp, Homo sapiens
ctgtctccgccctcttggtagg

SEQ ID NO: 8051538 - DNA, 22 bp, Homo sapiens
ctgtctcctcctttgttcttaa

SEQ ID NO: 8051539 - DNA, 23 bp, Homo sapiens
ctgtctcctgggctaggtggaat

SEQ ID NO: 8051540 - DNA, 22 bp, Homo sapiens
ctgtcgcctggtcctctctgga

SEQ ID NO: 8051541 - DNA, 22 bp, Homo sapiens
ctgtctccagggcaggtgcagg

SEQ ID NO: 8051542 - DNA, 22 bp, Homo sapiens
ctgtctcaagactgcaggcact

SEQ ID NO: 8051543 - DNA, 22 bp, Homo sapiens
ctgggagcttgttaggaatgca

SEQ ID NO: 8051544 - DNA, 22 bp, Homo sapiens
ctgggagcttttagaaatgcag

SEQ ID NO: 8051545 - DNA, 22 bp, Homo sapiens
ctgggaggacaacttggagctc

SEQ ID NO: 8051546 - DNA, 22 bp, Homo sapiens
ctgggaggtggaggttgcattg

SEQ ID NO: 8051547 - DNA, 22 bp, Homo sapiens
ctgggaggtgaacagaaaaact

SEQ ID NO: 8051548 - DNA, 19 bp, Homo sapiens
ctgggaggtgttcagagaa

SEQ ID NO: 8051549 - DNA, 23 bp, Homo sapiens
ctggggctttcaaatctgggcag

SEQ ID NO: 8051550 - DNA, 22 bp, Homo sapiens
atattattctagtaacagtgat

SEQ ID NO: 8051551 - DNA, 18 bp, Homo sapiens
ctggtcagggcaatgggc

SEQ ID NO: 8051552 - DNA, 22 bp, Homo sapiens
ctggtcagggtagtgttgcaga

SEQ ID NO: 8051553 - DNA, 22 bp, Homo sapiens
ctgggtggcgtctggggccagt

SEQ ID NO: 8051554 - DNA, 22 bp, Homo sapiens
ctgggtggctgtccagccagcc

SEQ ID NO: 8051555 - DNA, 22 bp, Homo sapiens
ctgggtggctgtccagccagcc

SEQ ID NO: 8051556 - DNA, 22 bp, Homo sapiens
atattcacactgtttagttaca

SEQ ID NO: 8051557 - DNA, 18 bp, Homo sapiens
ctgggtctccaggctgcc

SEQ ID NO: 8051558 - DNA, 20 bp, Homo sapiens
ctgggtggcaagcaaggggg

SEQ ID NO: 8051559 - DNA, 22 bp, Homo sapiens
ctgggtggatcgcagccccagg

SEQ ID NO: 8051560 - DNA, 22 bp, Homo sapiens
ctgggtggcagagcctgcagtg

SEQ ID NO: 8051561 - DNA, 20 bp, Homo sapiens
ctgggtggcaagcaaggggg

SEQ ID NO: 8051562 - DNA, 22 bp, Homo sapiens
agtgtcctctattatgacttta

SEQ ID NO: 8051563 - DNA, 22 bp, Homo sapiens
agtgtcctcctctgggagccag

SEQ ID NO: 8051564 - DNA, 22 bp, Homo sapiens
agtgtcctacagctcctgcctg

SEQ ID NO: 8051565 - DNA, 22 bp, Homo sapiens
agtgtcctcatctgtaaaatga

SEQ ID NO: 8051566 - DNA, 22 bp, Homo sapiens
agtgtcctcaggctttgttcct

SEQ ID NO: 8051567 - DNA, 22 bp, Homo sapiens
agtgtcctagcaagccggtcct

SEQ ID NO: 8051568 - DNA, 19 bp, Homo sapiens
agtgtcctagtcatttgcc

SEQ ID NO: 8051569 - DNA, 22 bp, Homo sapiens
agtgtgagattaaaccgaatca

SEQ ID NO: 8051570 - DNA, 22 bp, Homo sapiens
agtggggccgcggtcctgccct

SEQ ID NO: 8051571 - DNA, 22 bp, Homo sapiens
agtggctcttgggtcactgggc

SEQ ID NO: 8051572 - DNA, 22 bp, Homo sapiens
agtggctctccaagaagtcaca

SEQ ID NO: 8051573 - DNA, 22 bp, Homo sapiens
agtggctctccaagaagtcaca

SEQ ID NO: 8051574 - DNA, 22 bp, Homo sapiens
agtggctccaaaccgtagtcat

SEQ ID NO: 8051575 - DNA, 21 bp, Homo sapiens
agtggctctcagcttgctaag

SEQ ID NO: 8051576 - DNA, 22 bp, Homo sapiens
agtggccatggcaggtgagcat

SEQ ID NO: 8051577 - DNA, 22 bp, Homo sapiens
agtggccagtgaaggcggcagc

SEQ ID NO: 8051578 - DNA, 22 bp, Homo sapiens
agtggccagtgctgctctgggg

SEQ ID NO: 8051579 - DNA, 22 bp, Homo sapiens
agtggccatccctcaggtaggc

SEQ ID NO: 8051580 - DNA, 22 bp, Homo sapiens
agtggcggggattagcagtgtt

SEQ ID NO: 8051581 - DNA, 22 bp, Homo sapiens
agtggctcagagtctattgagg

SEQ ID NO: 8051582 - DNA, 22 bp, Homo sapiens
ctctggagtgtctggccagggt

SEQ ID NO: 8051583 - DNA, 22 bp, Homo sapiens
ctctggagttctcatgaggaac

SEQ ID NO: 8051584 - DNA, 20 bp, Homo sapiens
ctctggagttggggaacatt

SEQ ID NO: 8051585 - DNA, 21 bp, Homo sapiens
ctctggagtttgaaggctggg

SEQ ID NO: 8051586 - DNA, 22 bp, Homo sapiens
agtgtggccaatgaggatgggc

SEQ ID NO: 8051587 - DNA, 22 bp, Homo sapiens
agtgtgcccagtaattggctga

SEQ ID NO: 8051588 - DNA, 22 bp, Homo sapiens
ctgagcagccccaccagccatt

SEQ ID NO: 8051589 - DNA, 22 bp, Homo sapiens
ctgagcagccccaccagccatt

SEQ ID NO: 8051590 - DNA, 19 bp, Homo sapiens
ctgagcagcggcagcactt

SEQ ID NO: 8051591 - DNA, 19 bp, Homo sapiens
ctgagcagcggcagcactt

SEQ ID NO: 8051592 - DNA, 22 bp, Homo sapiens
ctgagccactgcttgttcagtg

SEQ ID NO: 8051593 - DNA, 22 bp, Homo sapiens
ctgagccaccggcagggacatc

SEQ ID NO: 8051594 - DNA, 22 bp, Homo sapiens
ctgagccagagggagtcgggtc

SEQ ID NO: 8051595 - DNA, 22 bp, Homo sapiens
ctgagccagcgggctcactttt

SEQ ID NO: 8051596 - DNA, 22 bp, Homo sapiens
ctgagccagctggcatgtgcta

SEQ ID NO: 8051597 - DNA, 22 bp, Homo sapiens
ctgagccagctggcatgtgcta

SEQ ID NO: 8051598 - DNA, 22 bp, Homo sapiens
ctgagctgctcccgctgcagcg

SEQ ID NO: 8051599 - DNA, 22 bp, Homo sapiens
agtggaattgctgattgaaata

SEQ ID NO: 8051600 - DNA, 21 bp, Homo sapiens
agtggaacccttagggtcagg

SEQ ID NO: 8051601 - DNA, 22 bp, Homo sapiens
agtggaacactacattgttgtt

SEQ ID NO: 8051602 - DNA, 22 bp, Homo sapiens
agtggaggttacagctgtacat

SEQ ID NO: 8051603 - DNA, 22 bp, Homo sapiens
agtggaggttacagctgtacat

SEQ ID NO: 8051604 - DNA, 22 bp, Homo sapiens
agtggagaagaggatggtctcc

SEQ ID NO: 8051605 - DNA, 22 bp, Homo sapiens
agtggcagtggggcagggccct

SEQ ID NO: 8051606 - DNA, 22 bp, Homo sapiens
agtggccaccatgccagctctc

SEQ ID NO: 8051607 - DNA, 22 bp, Homo sapiens
agtggccactagaagctcagct

SEQ ID NO: 8051608 - DNA, 22 bp, Homo sapiens
agtggccaggaaaggtccagcc

SEQ ID NO: 8051609 - DNA, 22 bp, Homo sapiens
agtggcagtggggcagggccct

SEQ ID NO: 8051610 - DNA, 22 bp, Homo sapiens
agtgcccagttaggttggagca

SEQ ID NO: 8051611 - DNA, 20 bp, Homo sapiens
agtgccagggcaggtgagag

SEQ ID NO: 8051612 - DNA, 23 bp, Homo sapiens
agtgccagggagatcaggacgga

SEQ ID NO: 8051613 - DNA, 22 bp, Homo sapiens
agtgcctggaccccatgacata

SEQ ID NO: 8051614 - DNA, 22 bp, Homo sapiens
agtgcctggaccccatgacata

SEQ ID NO: 8051615 - DNA, 22 bp, Homo sapiens
agtgccagctccacacagcagc

SEQ ID NO: 8051616 - DNA, 22 bp, Homo sapiens
ctcacagttggctcattaatga

SEQ ID NO: 8051617 - DNA, 22 bp, Homo sapiens
ctcacagtctctccctaatttt

SEQ ID NO: 8051618 - DNA, 22 bp, Homo sapiens
agtgacttctccgtggcaggat

SEQ ID NO: 8051619 - DNA, 22 bp, Homo sapiens
agtgacttcttaaaccatggtc

SEQ ID NO: 8051620 - DNA, 22 bp, Homo sapiens
agtgatcagtgagtgaagcagg

SEQ ID NO: 8051621 - DNA, 19 bp, Homo sapiens
agtgagtggggaaggccct

SEQ ID NO: 8051622 - DNA, 22 bp, Homo sapiens
agtgagggactagtgctgggga

SEQ ID NO: 8051623 - DNA, 22 bp, Homo sapiens
aggtaattactagagttattta

SEQ ID NO: 8051624 - DNA, 22 bp, Homo sapiens
agggttaggtcacgctgcctgg

SEQ ID NO: 8051625 - DNA, 22 bp, Homo sapiens
agggttagtctttgcagctagg

SEQ ID NO: 8051626 - DNA, 18 bp, Homo sapiens
cctgaggtgggaggaagg

SEQ ID NO: 8051627 - DNA, 22 bp, Homo sapiens
cctgggagggcaagtgctgatg

SEQ ID NO: 8051628 - DNA, 22 bp, Homo sapiens
cctgggagggcaagtgctgatg

SEQ ID NO: 8051629 - DNA, 22 bp, Homo sapiens
cctgggaggctgtgggtctgct

SEQ ID NO: 8051630 - DNA, 22 bp, Homo sapiens
cctgggaggctgtttccagcct

SEQ ID NO: 8051631 - DNA, 22 bp, Homo sapiens
cctgggaggtggaggttgcagt

SEQ ID NO: 8051632 - DNA, 22 bp, Homo sapiens
cctgggaggtggaggttgcagc

SEQ ID NO: 8051633 - DNA, 21 bp, Homo sapiens
cctgggagaattgggtgtggc

SEQ ID NO: 8051634 - DNA, 22 bp, Homo sapiens
cctgggaggctgtgggtctgct

SEQ ID NO: 8051635 - DNA, 22 bp, Homo sapiens
cctgtgggcgcagctggagtca

SEQ ID NO: 8051636 - DNA, 22 bp, Homo sapiens
cctgtgggaggttctgtgagtc

SEQ ID NO: 8051637 - DNA, 22 bp, Homo sapiens
cctgtgggaggggcctggcgcg

SEQ ID NO: 8051638 - DNA, 22 bp, Homo sapiens
cctgtgggaggggcctggcgcg

SEQ ID NO: 8051639 - DNA, 22 bp, Homo sapiens
aggtggcagagtgacaggctga

SEQ ID NO: 8051640 - DNA, 22 bp, Homo sapiens
aggtggcagagtgacaggctga

SEQ ID NO: 8051641 - DNA, 22 bp, Homo sapiens
aggtggcagaggactcctcctg

SEQ ID NO: 8051642 - DNA, 22 bp, Homo sapiens
aggtggcagagctggcccagcg

SEQ ID NO: 8051643 - DNA, 22 bp, Homo sapiens
aggtggcaaggggcgcctctct

SEQ ID NO: 8051644 - DNA, 22 bp, Homo sapiens
aggtggcagcagcctggtgaaa

SEQ ID NO: 8051645 - DNA, 22 bp, Homo sapiens
aggtggcagcagcctggtgaaa

SEQ ID NO: 8051646 - DNA, 22 bp, Homo sapiens
aggtggcagcaggagatgtgga

SEQ ID NO: 8051647 - DNA, 22 bp, Homo sapiens
aggtggcagatgggggtgctcg

SEQ ID NO: 8051648 - DNA, 22 bp, Homo sapiens
ccttcattcagctatagcatcc

SEQ ID NO: 8051649 - DNA, 22 bp, Homo sapiens
aggtggcaggaggtcagagaaa

SEQ ID NO: 8051650 - DNA, 22 bp, Homo sapiens
ccttccagggctctccagaacc

SEQ ID NO: 8051651 - DNA, 22 bp, Homo sapiens
ccttccagggctctccagaacc

SEQ ID NO: 8051652 - DNA, 22 bp, Homo sapiens
ccttccagggagcaggcagtgt

SEQ ID NO: 8051653 - DNA, 22 bp, Homo sapiens
ccttccaggagtctctgcaggt

SEQ ID NO: 8051654 - DNA, 22 bp, Homo sapiens
ccttccaggagtctctgcaggt

SEQ ID NO: 8051655 - DNA, 22 bp, Homo sapiens
ccttccagagttcagtctgccc

SEQ ID NO: 8051656 - DNA, 22 bp, Homo sapiens
ccttccagaggcgtgacaccct

SEQ ID NO: 8051657 - DNA, 22 bp, Homo sapiens
ccttccagaaagcacttagtta

SEQ ID NO: 8051658 - DNA, 22 bp, Homo sapiens
cctggggtcacttgcagccgca

SEQ ID NO: 8051659 - DNA, 18 bp, Homo sapiens
aggtgcagcctctgaggc

SEQ ID NO: 8051660 - DNA, 22 bp, Homo sapiens
aggtgcagctggtggagtctgg

SEQ ID NO: 8051661 - DNA, 22 bp, Homo sapiens
aggtgcagctggtggagtctgg

SEQ ID NO: 8051662 - DNA, 22 bp, Homo sapiens
ctattgaggacataaggactct

SEQ ID NO: 8051663 - DNA, 22 bp, Homo sapiens
agtcaggatatgccttgtgggc

SEQ ID NO: 8051664 - DNA, 22 bp, Homo sapiens
agtcaggaagctggagctgggg

SEQ ID NO: 8051665 - DNA, 22 bp, Homo sapiens
agtcaggaacctcagcaagtct

SEQ ID NO: 8051666 - DNA, 22 bp, Homo sapiens
agtcagctgcagcagctttggt

SEQ ID NO: 8051667 - DNA, 22 bp, Homo sapiens
ctaggcagactgagctctaggg

SEQ ID NO: 8051668 - DNA, 22 bp, Homo sapiens
ctagctgacgggttgataggtg

SEQ ID NO: 8051669 - DNA, 22 bp, Homo sapiens
agtatttctgaatattatcata

SEQ ID NO: 8051670 - DNA, 22 bp, Homo sapiens
ccttccagggtttttgccaatc

SEQ ID NO: 8051671 - DNA, 22 bp, Homo sapiens
ccttccaggttttggctccatt

SEQ ID NO: 8051672 - DNA, 18 bp, Homo sapiens
agtaaatgttaaatattg

SEQ ID NO: 8051673 - DNA, 22 bp, Homo sapiens
agtagcttggccctttgttctt

SEQ ID NO: 8051674 - DNA, 22 bp, Homo sapiens
actgccaggtaagtgctcctgc

SEQ ID NO: 8051675 - DNA, 22 bp, Homo sapiens
actgccaggatggcactagagg

SEQ ID NO: 8051676 - DNA, 23 bp, Homo sapiens
actgccagttttaccacagacgg

SEQ ID NO: 8051677 - DNA, 22 bp, Homo sapiens
actgccaatggtagtttgatgg

SEQ ID NO: 8051678 - DNA, 22 bp, Homo sapiens
actgccaatggtagtttgatgg

SEQ ID NO: 8051679 - DNA, 21 bp, Homo sapiens
actggccaccactggcagggg

SEQ ID NO: 8051680 - DNA, 22 bp, Homo sapiens
actgggcctacccagattggca

SEQ ID NO: 8051681 - DNA, 22 bp, Homo sapiens
actgggccggtgcagagtagtt

SEQ ID NO: 8051682 - DNA, 22 bp, Homo sapiens
actgggccgaaatggacagaat

SEQ ID NO: 8051683 - DNA, 22 bp, Homo sapiens
actgggccgcgctgcagagggc

SEQ ID NO: 8051684 - DNA, 22 bp, Homo sapiens
actgggcccatatactcagtct

SEQ ID NO: 8051685 - DNA, 22 bp, Homo sapiens
actgggcctggattggcgtgtc

SEQ ID NO: 8051686 - DNA, 22 bp, Homo sapiens
actgggcctgattgggtcggag

SEQ ID NO: 8051687 - DNA, 20 bp, Homo sapiens
actgggcctaggggaggcat

SEQ ID NO: 8051688 - DNA, 22 bp, Homo sapiens
actgggccttgccatggcagcc

SEQ ID NO: 8051689 - DNA, 22 bp, Homo sapiens
actgggcccagtggtgtggctg

SEQ ID NO: 8051690 - DNA, 22 bp, Homo sapiens
actgggccaggtgtgggtgagt

SEQ ID NO: 8051691 - DNA, 23 bp, Homo sapiens
actgggccagctacttagcactg

SEQ ID NO: 8051692 - DNA, 18 bp, Homo sapiens
actgggccagcaggcagg

SEQ ID NO: 8051693 - DNA, 22 bp, Homo sapiens
actgggccagacactgattccc

SEQ ID NO: 8051694 - DNA, 20 bp, Homo sapiens
actgggcatacctgtcctgt

SEQ ID NO: 8051695 - DNA, 22 bp, Homo sapiens
actgggcatgatgagtcaccta

SEQ ID NO: 8051696 - DNA, 22 bp, Homo sapiens
agtgtcctgtgtcccagactgt

SEQ ID NO: 8051697 - DNA, 22 bp, Homo sapiens
agtgtcctggggccctaaggcc

SEQ ID NO: 8051698 - DNA, 22 bp, Homo sapiens
agtgtccttagttagctttggg

SEQ ID NO: 8051699 - DNA, 22 bp, Homo sapiens
agtgtccttgaggttcctagga

SEQ ID NO: 8051700 - DNA, 21 bp, Homo sapiens
agtgtccttgatcttgccttg

SEQ ID NO: 8051701 - DNA, 22 bp, Homo sapiens
agtgtccttgattcctgttgtt

SEQ ID NO: 8051702 - DNA, 22 bp, Homo sapiens
agtgtccttgttattactgctc

SEQ ID NO: 8051703 - DNA, 22 bp, Homo sapiens
agtgtcctttctgttccagcca

SEQ ID NO: 8051704 - DNA, 21 bp, Homo sapiens
agtgtccttttactgtgaata

SEQ ID NO: 8051705 - DNA, 22 bp, Homo sapiens
actgggaggcaaagagcaagga

SEQ ID NO: 8051706 - DNA, 22 bp, Homo sapiens
actgggcagggaaggagaccga

SEQ ID NO: 8051707 - DNA, 22 bp, Homo sapiens
actctgcctttcagcagatgaa

SEQ ID NO: 8051708 - DNA, 22 bp, Homo sapiens
actctgaattaattgctctcaa

SEQ ID NO: 8051709 - DNA, 22 bp, Homo sapiens
actctgaagaagacttccagac

SEQ ID NO: 8051710 - DNA, 22 bp, Homo sapiens
agtgaacagtttggaacacatg

SEQ ID NO: 8051711 - DNA, 22 bp, Homo sapiens
actgagccttgaagctagatag

SEQ ID NO: 8051712 - DNA, 22 bp, Homo sapiens
actgagcctgtgccctcatcag

SEQ ID NO: 8051713 - DNA, 22 bp, Homo sapiens
actgagcctctcttcccacctc

SEQ ID NO: 8051714 - DNA, 22 bp, Homo sapiens
actgagagtcaagatagcatgg

SEQ ID NO: 8051715 - DNA, 22 bp, Homo sapiens
actgcactcctgcctgggtaac

SEQ ID NO: 8051716 - DNA, 22 bp, Homo sapiens
actgcacttcaccctgggtgac

SEQ ID NO: 8051717 - DNA, 22 bp, Homo sapiens
actgcactccagcctgggtgat

SEQ ID NO: 8051718 - DNA, 22 bp, Homo sapiens
agtgaagtaaaagatgtgcatc

SEQ ID NO: 8051719 - DNA, 22 bp, Homo sapiens
actgcacttcagcctgggtgac

SEQ ID NO: 8051720 - DNA, 22 bp, Homo sapiens
agtgctctgtcattggtgggat

SEQ ID NO: 8051721 - DNA, 22 bp, Homo sapiens
actcctgggtgctgaccagcgt

SEQ ID NO: 8051722 - DNA, 22 bp, Homo sapiens
agtcactgtcaaagccacacac

SEQ ID NO: 8051723 - DNA, 22 bp, Homo sapiens
agtcactgttctgtcatgtcaa

SEQ ID NO: 8051724 - DNA, 22 bp, Homo sapiens
agtatacaaataaatgtgtaat

SEQ ID NO: 8051725 - DNA, 22 bp, Homo sapiens
agtatacagtaatgacatatct

SEQ ID NO: 8051726 - DNA, 22 bp, Homo sapiens
agtatacagtaatgacatatct

SEQ ID NO: 8051727 - DNA, 21 bp, Homo sapiens
aggtgggcaggtggagtggcc

SEQ ID NO: 8051728 - DNA, 22 bp, Homo sapiens
aggtgggcccagtgggctccag

SEQ ID NO: 8051729 - DNA, 22 bp, Homo sapiens
aggtgggcggattcatgaggtc

SEQ ID NO: 8051730 - DNA, 22 bp, Homo sapiens
aggtggggaaaccagcgatccc

SEQ ID NO: 8051731 - DNA, 22 bp, Homo sapiens
acccttccaaatgagcttatta

SEQ ID NO: 8051732 - DNA, 22 bp, Homo sapiens
aggtcaagagtaaatttgggta

SEQ ID NO: 8051733 - DNA, 20 bp, Homo sapiens
aggtcaacacctagtaagtg

SEQ ID NO: 8051734 - DNA, 22 bp, Homo sapiens
acgaataagagataaagcaagg

SEQ ID NO: 8051735 - DNA, 22 bp, Homo sapiens
acgaataaatctatttcacaca

SEQ ID NO: 8051736 - DNA, 22 bp, Homo sapiens
aggtgggcactccgctcgaggt

SEQ ID NO: 8051737 - DNA, 22 bp, Homo sapiens
aggtgggcaccaggcttgtggt

SEQ ID NO: 8051738 - DNA, 22 bp, Homo sapiens
actagaaaattcctagaaacta

SEQ ID NO: 8051739 - DNA, 22 bp, Homo sapiens
atacatcatgctccatatattt

SEQ ID NO: 8051740 - DNA, 22 bp, Homo sapiens
atacatctagagtcataaaaac

SEQ ID NO: 8051741 - DNA, 22 bp, Homo sapiens
atagatacattgttatatttgt

SEQ ID NO: 8051742 - DNA, 23 bp, Homo sapiens
acttttcaattagctatgcttaa

SEQ ID NO: 8051743 - DNA, 22 bp, Homo sapiens
atagatattagcaaaattttat

SEQ ID NO: 8051744 - DNA, 22 bp, Homo sapiens
atagatatttgagttgtttcca

SEQ ID NO: 8051745 - DNA, 20 bp, Homo sapiens
atagatatcatctttagaag

SEQ ID NO: 8051746 - DNA, 21 bp, Homo sapiens
actttacaatttacatagtga

SEQ ID NO: 8051747 - DNA, 22 bp, Homo sapiens
actgggccttgtgtgtctcatc

SEQ ID NO: 8051748 - DNA, 22 bp, Homo sapiens
agtttttgagaatttactatgt

SEQ ID NO: 8051749 - DNA, 22 bp, Homo sapiens
agtttttgctgatagcatgctt

SEQ ID NO: 8051750 - DNA, 22 bp, Homo sapiens
ataaagtagccactggaaagct

SEQ ID NO: 8051751 - DNA, 22 bp, Homo sapiens
acttaaaaagaatcttttcacg

SEQ ID NO: 8051752 - DNA, 22 bp, Homo sapiens
acttaaaaacagatccagcagg

SEQ ID NO: 8051753 - DNA, 22 bp, Homo sapiens
acttttgaagaattatgcaaaa

SEQ ID NO: 8051754 - DNA, 22 bp, Homo sapiens
atatttttccatgtgggactct

SEQ ID NO: 8051755 - DNA, 21 bp, Homo sapiens
atatttttgtttggactgtca

SEQ ID NO: 8051756 - DNA, 22 bp, Homo sapiens
atcagtagtgtgaaaacagact

SEQ ID NO: 8051757 - DNA, 22 bp, Homo sapiens
atcagtatacaggggacattca

SEQ ID NO: 8051758 - DNA, 19 bp, Homo sapiens
atcagtgcatgagtgctgt

SEQ ID NO: 8051759 - DNA, 22 bp, Homo sapiens
agaagccacaggcctcgtctgg

SEQ ID NO: 8051760 - DNA, 22 bp, Homo sapiens
agaagccaatccttgtctctct

SEQ ID NO: 8051761 - DNA, 22 bp, Homo sapiens
agaacagtcgtggtgagagaaa

SEQ ID NO: 8051762 - DNA, 22 bp, Homo sapiens
atccccacgatatagccaaagc

SEQ ID NO: 8051763 - DNA, 22 bp, Homo sapiens
atcccacacccctacaacatat

SEQ ID NO: 8051764 - DNA, 22 bp, Homo sapiens
agaaatctatgttttggttaga

SEQ ID NO: 8051765 - DNA, 22 bp, Homo sapiens
agaaatcttatcaagaaatgcc

SEQ ID NO: 8051766 - DNA, 22 bp, Homo sapiens
acccactgtagccactctgggt

SEQ ID NO: 8051767 - DNA, 22 bp, Homo sapiens
agggcctgagctctcctccagt

SEQ ID NO: 8051768 - DNA, 22 bp, Homo sapiens
agggcctgacacccttgccagc

SEQ ID NO: 8051769 - DNA, 22 bp, Homo sapiens
agggcctgagaccgtggcttga

SEQ ID NO: 8051770 - DNA, 19 bp, Homo sapiens
agggcctgagcagatgttg

SEQ ID NO: 8051771 - DNA, 20 bp, Homo sapiens
accccacagagtccattgca

SEQ ID NO: 8051772 - DNA, 22 bp, Homo sapiens
accctgggttcccgcagcacca

SEQ ID NO: 8051773 - DNA, 22 bp, Homo sapiens
accctgggggtggccagtgcca

SEQ ID NO: 8051774 - DNA, 22 bp, Homo sapiens
accctgggtcatatacagtgtg

SEQ ID NO: 8051775 - DNA, 22 bp, Homo sapiens
accagggcccgggagagctctc

SEQ ID NO: 8051776 - DNA, 22 bp, Homo sapiens
accaggggtgtcaacagcattt

SEQ ID NO: 8051777 - DNA, 22 bp, Homo sapiens
accagtttgtaacctgttttca

SEQ ID NO: 8051778 - DNA, 23 bp, Homo sapiens
agggcccaagcctggacagcagg

SEQ ID NO: 8051779 - DNA, 22 bp, Homo sapiens
accagtcttgttgccatgtctg

SEQ ID NO: 8051780 - DNA, 20 bp, Homo sapiens
accaggagatggaggcaggg

SEQ ID NO: 8051781 - DNA, 22 bp, Homo sapiens
accaaggagaaggtgcaagctt

SEQ ID NO: 8051782 - DNA, 22 bp, Homo sapiens
accaaggaagagattctcagtt

SEQ ID NO: 8051783 - DNA, 22 bp, Homo sapiens
acatgaaactgttgcattagaa

SEQ ID NO: 8051784 - DNA, 22 bp, Homo sapiens
aggccaggtggtcatgcttgct

SEQ ID NO: 8051785 - DNA, 22 bp, Homo sapiens
aggccaggtggtcatgcttgct

SEQ ID NO: 8051786 - DNA, 22 bp, Homo sapiens
aggcccagcttgaagtgggaag

SEQ ID NO: 8051787 - DNA, 21 bp, Homo sapiens
aggcccagctttcctcttgct

SEQ ID NO: 8051788 - DNA, 22 bp, Homo sapiens
aggcccagggctgctctctgaa

SEQ ID NO: 8051789 - DNA, 21 bp, Homo sapiens
aggcccaggaatatgcatttt

SEQ ID NO: 8051790 - DNA, 22 bp, Homo sapiens
aggccctgagcatccgagggca

SEQ ID NO: 8051791 - DNA, 22 bp, Homo sapiens
aggccctgatccgaatccagat

SEQ ID NO: 8051792 - DNA, 22 bp, Homo sapiens
aggcccagtagtcgacggcgct

SEQ ID NO: 8051793 - DNA, 22 bp, Homo sapiens
aggccctgagaaaatccctgca

SEQ ID NO: 8051794 - DNA, 22 bp, Homo sapiens
aggccagcctcaggcagggacc

SEQ ID NO: 8051795 - DNA, 22 bp, Homo sapiens
aggccagcattctctctccagg

SEQ ID NO: 8051796 - DNA, 22 bp, Homo sapiens
aggccagccctgggctgagaga

SEQ ID NO: 8051797 - DNA, 22 bp, Homo sapiens
aggccagccctcacctgtgttc

SEQ ID NO: 8051798 - DNA, 22 bp, Homo sapiens
acatacatgggattaaaaaatt

SEQ ID NO: 8051799 - DNA, 22 bp, Homo sapiens
aggcatgggtagaagagaagcc

SEQ ID NO: 8051800 - DNA, 22 bp, Homo sapiens
aggcatggggctgcagtcaggt

SEQ ID NO: 8051801 - DNA, 22 bp, Homo sapiens
aggcatggggctgcagtcaggt

SEQ ID NO: 8051802 - DNA, 20 bp, Homo sapiens
aggcatgggatgcccagatt

SEQ ID NO: 8051803 - DNA, 19 bp, Homo sapiens
aggcatgggaagagaagtc

SEQ ID NO: 8051804 - DNA, 22 bp, Homo sapiens
aggcatggctttaggcaggcgt

SEQ ID NO: 8051805 - DNA, 22 bp, Homo sapiens
aggcatggctttaggcaggcgt

SEQ ID NO: 8051806 - DNA, 22 bp, Homo sapiens
aggccacacaactcttagagat

SEQ ID NO: 8051807 - DNA, 22 bp, Homo sapiens
aggccacaatttgatttggttt

SEQ ID NO: 8051808 - DNA, 18 bp, Homo sapiens
aggccacactccagaaca

SEQ ID NO: 8051809 - DNA, 22 bp, Homo sapiens
aggccacagagagtgcatgtgc

SEQ ID NO: 8051810 - DNA, 18 bp, Homo sapiens
aggcatggtggtgcgcac

SEQ ID NO: 8051811 - DNA, 18 bp, Homo sapiens
aggcatggtggtgcgcac

SEQ ID NO: 8051812 - DNA, 18 bp, Homo sapiens
aggcatggtggtgcgcac

SEQ ID NO: 8051813 - DNA, 17 bp, Homo sapiens
aggcatggtctggggtg

SEQ ID NO: 8051814 - DNA, 22 bp, Homo sapiens
aggccagcacgacagccgcagg

SEQ ID NO: 8051815 - DNA, 22 bp, Homo sapiens
aggccacaggtggaagccagag

SEQ ID NO: 8051816 - DNA, 22 bp, Homo sapiens
aggccacaggtggaagccagag

SEQ ID NO: 8051817 - DNA, 22 bp, Homo sapiens
aggccacaggcaccctgtgttc

SEQ ID NO: 8051818 - DNA, 22 bp, Homo sapiens
aggccacaggattgcacagcat

SEQ ID NO: 8051819 - DNA, 22 bp, Homo sapiens
aggccacaggattgcacagcat

SEQ ID NO: 8051820 - DNA, 22 bp, Homo sapiens
aggccacagcctgggaggtgac

SEQ ID NO: 8051821 - DNA, 22 bp, Homo sapiens
aggctccagtctcctctggcag

SEQ ID NO: 8051822 - DNA, 22 bp, Homo sapiens
acattgaagggaatgcaaagat

SEQ ID NO: 8051823 - DNA, 22 bp, Homo sapiens
acattgaacagtacaaatgatc

SEQ ID NO: 8051824 - DNA, 22 bp, Homo sapiens
acattgaaccagtagacacaaa

SEQ ID NO: 8051825 - DNA, 22 bp, Homo sapiens
acattgaactacttgtaatgag

SEQ ID NO: 8051826 - DNA, 22 bp, Homo sapiens
aggctccagcccaaggctgcag

SEQ ID NO: 8051827 - DNA, 22 bp, Homo sapiens
aggctccagcagccagaggaag

SEQ ID NO: 8051828 - DNA, 22 bp, Homo sapiens
aggccctgcattgtactgaggg

SEQ ID NO: 8051829 - DNA, 22 bp, Homo sapiens
aggccctgcaggagtggggaca

SEQ ID NO: 8051830 - DNA, 22 bp, Homo sapiens
aggccctgcaggaagcaggatg

SEQ ID NO: 8051831 - DNA, 22 bp, Homo sapiens
aggccctgcaggaagcaggatg

SEQ ID NO: 8051832 - DNA, 20 bp, Homo sapiens
aggccctgccagggacggag

SEQ ID NO: 8051833 - DNA, 22 bp, Homo sapiens
acattctaacattgtacagata

SEQ ID NO: 8051834 - DNA, 19 bp, Homo sapiens
acattcccatcagcaatgt

SEQ ID NO: 8051835 - DNA, 22 bp, Homo sapiens
acatacatatgtttaaatgcat

SEQ ID NO: 8051836 - DNA, 21 bp, Homo sapiens
acatacataccttaccacctt

SEQ ID NO: 8051837 - DNA, 23 bp, Homo sapiens
acatacatggagataaagtgatg

SEQ ID NO: 8051838 - DNA, 23 bp, Homo sapiens
acatacatggagataaagtgatg

SEQ ID NO: 8051839 - DNA, 22 bp, Homo sapiens
acatacacaagcgtacatgaac

SEQ ID NO: 8051840 - DNA, 22 bp, Homo sapiens
acatacagacctgcagggcagc

SEQ ID NO: 8051841 - DNA, 22 bp, Homo sapiens
acatacacatgaatatattttt

SEQ ID NO: 8051842 - DNA, 23 bp, Homo sapiens
acatacataagcaccacattttg

SEQ ID NO: 8051843 - DNA, 22 bp, Homo sapiens
acataaatttcactgttccgtg

SEQ ID NO: 8051844 - DNA, 18 bp, Homo sapiens
aggcacagagcatacata

SEQ ID NO: 8051845 - DNA, 22 bp, Homo sapiens
aggcacagaatggcattcagtg

SEQ ID NO: 8051846 - DNA, 22 bp, Homo sapiens
aggcacagagaatgccctccat

SEQ ID NO: 8051847 - DNA, 22 bp, Homo sapiens
aggcaacatgggccaggcagaa

SEQ ID NO: 8051848 - DNA, 22 bp, Homo sapiens
aggcaacaggaaaccacatgat

SEQ ID NO: 8051849 - DNA, 22 bp, Homo sapiens
aggcacacagaccccagcaagt

SEQ ID NO: 8051850 - DNA, 22 bp, Homo sapiens
aggcaactaggcctctgcctca

SEQ ID NO: 8051851 - DNA, 22 bp, Homo sapiens
aggaggcttttgcaggtgccac

SEQ ID NO: 8051852 - DNA, 21 bp, Homo sapiens
aggaggggtctttcccactga

SEQ ID NO: 8051853 - DNA, 22 bp, Homo sapiens
aggaggggcatagaaatgtaat

SEQ ID NO: 8051854 - DNA, 22 bp, Homo sapiens
aggatggcttgcaggaggctgt

SEQ ID NO: 8051855 - DNA, 23 bp, Homo sapiens
aggcaaacctataaaataggaat

SEQ ID NO: 8051856 - DNA, 22 bp, Homo sapiens
aggaggggttctcgggtgctga

SEQ ID NO: 8051857 - DNA, 22 bp, Homo sapiens
aggaggggttctcgggtgctga

SEQ ID NO: 8051858 - DNA, 22 bp, Homo sapiens
aggagctgcagattctgccttg

SEQ ID NO: 8051859 - DNA, 22 bp, Homo sapiens
aggagctgctttggtgcggttt

SEQ ID NO: 8051860 - DNA, 22 bp, Homo sapiens
aggagctgcaaaaccggccgct

SEQ ID NO: 8051861 - DNA, 22 bp, Homo sapiens
aggagcctggctggcccacagg

SEQ ID NO: 8051862 - DNA, 22 bp, Homo sapiens
aggagcctgaatcagagggtga

SEQ ID NO: 8051863 - DNA, 20 bp, Homo sapiens
aggagccattgactgcagca

SEQ ID NO: 8051864 - DNA, 22 bp, Homo sapiens
aggagccattgcaggatggcag

SEQ ID NO: 8051865 - DNA, 22 bp, Homo sapiens
aggagccattttccaagggcga

SEQ ID NO: 8051866 - DNA, 22 bp, Homo sapiens
acagggggtcccatggcctgga

SEQ ID NO: 8051867 - DNA, 22 bp, Homo sapiens
aggagacatactataggaatat

SEQ ID NO: 8051868 - DNA, 22 bp, Homo sapiens
aggagacatctaactgtaggtt

SEQ ID NO: 8051869 - DNA, 22 bp, Homo sapiens
acaggggctccgaaggtgaggg

SEQ ID NO: 8051870 - DNA, 22 bp, Homo sapiens
aggaagggatacataggatagt

SEQ ID NO: 8051871 - DNA, 22 bp, Homo sapiens
agctggccttcggtgtcactgg

SEQ ID NO: 8051872 - DNA, 22 bp, Homo sapiens
acagcctgatttatggagcagt

SEQ ID NO: 8051873 - DNA, 22 bp, Homo sapiens
agctggcctgttagagctgagt

SEQ ID NO: 8051874 - DNA, 20 bp, Homo sapiens
agctggcctgtcctaggcct

SEQ ID NO: 8051875 - DNA, 20 bp, Homo sapiens
agctggcctgtcctaggcct

SEQ ID NO: 8051876 - DNA, 22 bp, Homo sapiens
agctgctgtggccacatctggc

SEQ ID NO: 8051877 - DNA, 22 bp, Homo sapiens
agctgctgtcctaggcactgta

SEQ ID NO: 8051878 - DNA, 22 bp, Homo sapiens
agctgctggtttaagggatggg

SEQ ID NO: 8051879 - DNA, 22 bp, Homo sapiens
acagcccaggactccagtgggc

SEQ ID NO: 8051880 - DNA, 22 bp, Homo sapiens
acagcccaggactccagtgggc

SEQ ID NO: 8051881 - DNA, 22 bp, Homo sapiens
acagcccagaaagcctaagggg

SEQ ID NO: 8051882 - DNA, 22 bp, Homo sapiens
acagcccagaaagcctaagggg

SEQ ID NO: 8051883 - DNA, 22 bp, Homo sapiens
acagcccagctctttctctgca

SEQ ID NO: 8051884 - DNA, 22 bp, Homo sapiens
acagccagtaaggaaagaccca

SEQ ID NO: 8051885 - DNA, 22 bp, Homo sapiens
acagccaggtaaaggcatggca

SEQ ID NO: 8051886 - DNA, 22 bp, Homo sapiens
acagccaggtaaaggcatggca

SEQ ID NO: 8051887 - DNA, 22 bp, Homo sapiens
acagccagtcctcccacagggt

SEQ ID NO: 8051888 - DNA, 22 bp, Homo sapiens
acagccagtgactgcagaccct

SEQ ID NO: 8051889 - DNA, 22 bp, Homo sapiens
acagccagtaatctacccctgt

SEQ ID NO: 8051890 - DNA, 22 bp, Homo sapiens
acagccagtcatctcagcaggg

SEQ ID NO: 8051891 - DNA, 22 bp, Homo sapiens
agctccaggtgcaagtcatggt

SEQ ID NO: 8051892 - DNA, 22 bp, Homo sapiens
acagccagaggtggtcctgggt

SEQ ID NO: 8051893 - DNA, 22 bp, Homo sapiens
acagcccaagtcacctgcagga

SEQ ID NO: 8051894 - DNA, 22 bp, Homo sapiens
acagcccaagtcacctgcagga

SEQ ID NO: 8051895 - DNA, 23 bp, Homo sapiens
acagccagttcacctctccttgg

SEQ ID NO: 8051896 - DNA, 22 bp, Homo sapiens
acagccagtgactggacaagct

SEQ ID NO: 8051897 - DNA, 22 bp, Homo sapiens
acagccagtgctccgtgaggac

SEQ ID NO: 8051898 - DNA, 22 bp, Homo sapiens
agctgctcaggagagccaggtc

SEQ ID NO: 8051899 - DNA, 22 bp, Homo sapiens
agctgctcattactttctgttg

SEQ ID NO: 8051900 - DNA, 22 bp, Homo sapiens
agctgcaggcccatgctcagtc

SEQ ID NO: 8051901 - DNA, 22 bp, Homo sapiens
agctgggcaaaatgtgaggttg

SEQ ID NO: 8051902 - DNA, 22 bp, Homo sapiens
agctgggatgataacctcagtc

SEQ ID NO: 8051903 - DNA, 22 bp, Homo sapiens
agctgggcaaaatgtgaggttg

SEQ ID NO: 8051904 - DNA, 21 bp, Homo sapiens
agctgtggcgaggggaacatg

SEQ ID NO: 8051905 - DNA, 22 bp, Homo sapiens
agctgtgggatttgggtgtgcc

SEQ ID NO: 8051906 - DNA, 22 bp, Homo sapiens
agctgtgggcctgggagagctg

SEQ ID NO: 8051907 - DNA, 22 bp, Homo sapiens
agctgggagcagagccacagcc

SEQ ID NO: 8051908 - DNA, 22 bp, Homo sapiens
agctgggagctgaaggctgatt

SEQ ID NO: 8051909 - DNA, 22 bp, Homo sapiens
agctgggaggtgggcagtgaga

SEQ ID NO: 8051910 - DNA, 21 bp, Homo sapiens
agctgtggttttacatctttt

SEQ ID NO: 8051911 - DNA, 22 bp, Homo sapiens
agctgtggttctgggcagcgac

SEQ ID NO: 8051912 - DNA, 22 bp, Homo sapiens
agctgtggtgttttcaagccct

SEQ ID NO: 8051913 - DNA, 22 bp, Homo sapiens
agctgtggtcttcaagttgcct

SEQ ID NO: 8051914 - DNA, 22 bp, Homo sapiens
agctgtggggaggaggctagca

SEQ ID NO: 8051915 - DNA, 22 bp, Homo sapiens
agctgtggggcaggcagcgagg

SEQ ID NO: 8051916 - DNA, 19 bp, Homo sapiens
agctgtggggcctagcacc

SEQ ID NO: 8051917 - DNA, 22 bp, Homo sapiens
agcttattatcttatcaagctt

SEQ ID NO: 8051918 - DNA, 22 bp, Homo sapiens
agcttagcacacacaggcaggt

SEQ ID NO: 8051919 - DNA, 23 bp, Homo sapiens
agcttttaggtggaaatggcact

SEQ ID NO: 8051920 - DNA, 22 bp, Homo sapiens
agctttatggtgcctcacttga

SEQ ID NO: 8051921 - DNA, 22 bp, Homo sapiens
agctttatggtgcctcacttga

SEQ ID NO: 8051922 - DNA, 23 bp, Homo sapiens
agctttgtgaaagcagacatggg

SEQ ID NO: 8051923 - DNA, 22 bp, Homo sapiens
agctttattaactctccaggtg

SEQ ID NO: 8051924 - DNA, 22 bp, Homo sapiens
agatcactggttacttaatgaa

SEQ ID NO: 8051925 - DNA, 22 bp, Homo sapiens
agatattaatcgtacataaggt

SEQ ID NO: 8051926 - DNA, 22 bp, Homo sapiens
agatattaccagcagtctatgc

SEQ ID NO: 8051927 - DNA, 22 bp, Homo sapiens
agatattaggaggattcataat

SEQ ID NO: 8051928 - DNA, 22 bp, Homo sapiens
agagtggcagcaagtcaggtag

SEQ ID NO: 8051929 - DNA, 22 bp, Homo sapiens
agagtggcagcaagtcaggtag

SEQ ID NO: 8051930 - DNA, 22 bp, Homo sapiens
attggccatttgcatgtattat

SEQ ID NO: 8051931 - DNA, 21 bp, Homo sapiens
attggcctgtttacagagtga

SEQ ID NO: 8051932 - DNA, 22 bp, Homo sapiens
agatgcagaaaaactaagtgat

SEQ ID NO: 8051933 - DNA, 22 bp, Homo sapiens
agatgcaatgctgaatttgagt

SEQ ID NO: 8051934 - DNA, 22 bp, Homo sapiens
caaaggcaggtcatggccactt

SEQ ID NO: 8051935 - DNA, 20 bp, Homo sapiens
agcaagagtaaggacagcga

SEQ ID NO: 8051936 - DNA, 22 bp, Homo sapiens
agcaacctcatgagagtgaaat

SEQ ID NO: 8051937 - DNA, 22 bp, Homo sapiens
agcaacctgccaccacaggcaa

SEQ ID NO: 8051938 - DNA, 17 bp, Homo sapiens
agcaacctcctcttcct

SEQ ID NO: 8051939 - DNA, 19 bp, Homo sapiens
agcaacctgggccaatgta

SEQ ID NO: 8051940 - DNA, 22 bp, Homo sapiens
agcaacctgccagtcactcagt

SEQ ID NO: 8051941 - DNA, 22 bp, Homo sapiens
agcaacctggatcatggtgaaa

SEQ ID NO: 8051942 - DNA, 19 bp, Homo sapiens
agcaacctgtcagagatgc

SEQ ID NO: 8051943 - DNA, 22 bp, Homo sapiens
attttagtacctcaagtatcca

SEQ ID NO: 8051944 - DNA, 22 bp, Homo sapiens
agatgggcgccctggactgagg

SEQ ID NO: 8051945 - DNA, 22 bp, Homo sapiens
attttagttttagcatccatgc

SEQ ID NO: 8051946 - DNA, 22 bp, Homo sapiens
agaggctgcacttgctcatgat

SEQ ID NO: 8051947 - DNA, 22 bp, Homo sapiens
agaggccactttgcctgtgatg

SEQ ID NO: 8051948 - DNA, 22 bp, Homo sapiens
agaggccagcactgcagggaag

SEQ ID NO: 8051949 - DNA, 20 bp, Homo sapiens
agagctgggaagctccctat

SEQ ID NO: 8051950 - DNA, 22 bp, Homo sapiens
agaggcaccatctggaacagcc

SEQ ID NO: 8051951 - DNA, 22 bp, Homo sapiens
agaggcacagaggcagtcccct

SEQ ID NO: 8051952 - DNA, 22 bp, Homo sapiens
agaggcaccgtctgcagcgtgc

SEQ ID NO: 8051953 - DNA, 22 bp, Homo sapiens
agaggcacccgcgcgcggccat

SEQ ID NO: 8051954 - DNA, 22 bp, Homo sapiens
agaggcactaagggaagagcag

SEQ ID NO: 8051955 - DNA, 22 bp, Homo sapiens
attacacaggctggctctttga

SEQ ID NO: 8051956 - DNA, 22 bp, Homo sapiens
agagtctgaggcagctgcagcc

SEQ ID NO: 8051957 - DNA, 22 bp, Homo sapiens
agagtcccagggacactccaga

SEQ ID NO: 8051958 - DNA, 22 bp, Homo sapiens
agagggcttccctaggagtgag

SEQ ID NO: 8051959 - DNA, 22 bp, Homo sapiens
agagggctgggatgtgctgtgt

SEQ ID NO: 8051960 - DNA, 22 bp, Homo sapiens
agagggctggacgcaggttgga

SEQ ID NO: 8051961 - DNA, 22 bp, Homo sapiens
agaggggaaggatgtgatgtga

SEQ ID NO: 8051962 - DNA, 22 bp, Homo sapiens
agaggggaagtaatgaatgata

SEQ ID NO: 8051963 - DNA, 22 bp, Homo sapiens
agaggggacagccacctgcccg

SEQ ID NO: 8051964 - DNA, 22 bp, Homo sapiens
agaggggagagctaagcaattc

SEQ ID NO: 8051965 - DNA, 23 bp, Homo sapiens
agaggggagcatctgctggctga

SEQ ID NO: 8051966 - DNA, 23 bp, Homo sapiens
agaggggagcatctgctggctga

SEQ ID NO: 8051967 - DNA, 22 bp, Homo sapiens
agaggggaggcgaaccagagtc

SEQ ID NO: 8051968 - DNA, 22 bp, Homo sapiens
agaggggctcaagcagtggtct

SEQ ID NO: 8051969 - DNA, 18 bp, Homo sapiens
agaggggaggtaagtctg

SEQ ID NO: 8051970 - DNA, 22 bp, Homo sapiens
agaggggagtcctaatctgatt

SEQ ID NO: 8051971 - DNA, 22 bp, Homo sapiens
atgcatttttgagtatgaatga

SEQ ID NO: 8051972 - DNA, 22 bp, Homo sapiens
atgcatttgtaaaatataatcg

SEQ ID NO: 8051973 - DNA, 20 bp, Homo sapiens
agacagaatcagagataaag

SEQ ID NO: 8051974 - DNA, 22 bp, Homo sapiens
agacagacacatggtaacagat

SEQ ID NO: 8051975 - DNA, 22 bp, Homo sapiens
agacagacagagaatttaaata

SEQ ID NO: 8051976 - DNA, 22 bp, Homo sapiens
agacagacaaaattcctgcctg

SEQ ID NO: 8051977 - DNA, 18 bp, Homo sapiens
agacagacaggtttgtgc

SEQ ID NO: 8051978 - DNA, 15 bp, Homo sapiens
agacagacagtggga

SEQ ID NO: 8051979 - DNA, 22 bp, Homo sapiens
agacagacatagaaattagtaa

SEQ ID NO: 8051980 - DNA, 22 bp, Homo sapiens
atgatacatcttgtttatttca

SEQ ID NO: 8051981 - DNA, 22 bp, Homo sapiens
atgatacattgcaaaattttaa

SEQ ID NO: 8051982 - DNA, 22 bp, Homo sapiens
atgatatagagagtagattaaa

SEQ ID NO: 8051983 - DNA, 22 bp, Homo sapiens
atgatacattgcaaaattttaa

SEQ ID NO: 8051984 - DNA, 22 bp, Homo sapiens
atgatatacttcctagaacagt

SEQ ID NO: 8051985 - DNA, 22 bp, Homo sapiens
atgatatacttcctagaacagt

SEQ ID NO: 8051986 - DNA, 22 bp, Homo sapiens
atgatatacttcctagaacagt

SEQ ID NO: 8051987 - DNA, 22 bp, Homo sapiens
atgcctggtatgaagcaaggaa

SEQ ID NO: 8051988 - DNA, 22 bp, Homo sapiens
agacgagggcccccaggacagc

SEQ ID NO: 8051989 - DNA, 22 bp, Homo sapiens
agacctggagtggggcctcagg

SEQ ID NO: 8051990 - DNA, 22 bp, Homo sapiens
agacaaatttcctgcaatgaag

SEQ ID NO: 8051991 - DNA, 22 bp, Homo sapiens
atgaagggtgtccctgtgagca

SEQ ID NO: 8051992 - DNA, 22 bp, Homo sapiens
agaatatatgactgcaagacta

SEQ ID NO: 8051993 - DNA, 22 bp, Homo sapiens
agagcagcctcagctccctgtg

SEQ ID NO: 8051994 - DNA, 22 bp, Homo sapiens
agagcccagtgacatcagcaca

SEQ ID NO: 8051995 - DNA, 22 bp, Homo sapiens
agagcccatcagtggcagtgga

SEQ ID NO: 8051996 - DNA, 20 bp, Homo sapiens
agagcccagatgtctgtatt

SEQ ID NO: 8051997 - DNA, 22 bp, Homo sapiens
agagcccagaaagtatgtcata

SEQ ID NO: 8051998 - DNA, 22 bp, Homo sapiens
agagcccaggtcctggagaggg

SEQ ID NO: 8051999 - DNA, 22 bp, Homo sapiens
agagcagagggctctgggacaa

SEQ ID NO: 8052000 - DNA, 22 bp, Homo sapiens
agagcagatggagctggaagag

SEQ ID NO: 8052001 - DNA, 23 bp, Homo sapiens
agagcctgaaagacttctggcac

SEQ ID NO: 8052002 - DNA, 22 bp, Homo sapiens
agagcctgaggccctgagaggg

SEQ ID NO: 8052003 - DNA, 22 bp, Homo sapiens
agagcctgaggccctgagaggg

SEQ ID NO: 8052004 - DNA, 22 bp, Homo sapiens
agagcctgaggtctaacagggg

SEQ ID NO: 8052005 - DNA, 22 bp, Homo sapiens
agagcctgcagctgtgaagaaa

SEQ ID NO: 8052006 - DNA, 22 bp, Homo sapiens
agagcctgaggccaggaaaatg

SEQ ID NO: 8052007 - DNA, 22 bp, Homo sapiens
agagcctgaggatgtcccagct

SEQ ID NO: 8052008 - DNA, 22 bp, Homo sapiens
agagcctgagcctgatcttgaa

SEQ ID NO: 8052009 - DNA, 22 bp, Homo sapiens
agagcctgagaggataatgggg

SEQ ID NO: 8052010 - DNA, 21 bp, Homo sapiens
agagcctgagatcttccagca

SEQ ID NO: 8052011 - DNA, 22 bp, Homo sapiens
agagcctgagcctgaaagccct

SEQ ID NO: 8052012 - DNA, 22 bp, Homo sapiens
agagctggcagcagcttctcct

SEQ ID NO: 8052013 - DNA, 22 bp, Homo sapiens
agagctggctggtagccctgat

SEQ ID NO: 8052014 - DNA, 22 bp, Homo sapiens
agagctggccagggatcactct

SEQ ID NO: 8052015 - DNA, 22 bp, Homo sapiens
agactgtgagaagatggctgcg

SEQ ID NO: 8052016 - DNA, 22 bp, Homo sapiens
agacttctcagttttattagta

SEQ ID NO: 8052017 - DNA, 22 bp, Homo sapiens
agacttctaaatagcagcttct

SEQ ID NO: 8052018 - DNA, 22 bp, Homo sapiens
agacttctcttggctatattat

SEQ ID NO: 8052019 - DNA, 22 bp, Homo sapiens
agacttctcttggctatattat

SEQ ID NO: 8052020 - DNA, 22 bp, Homo sapiens
agacttctttgtgagcattttc

SEQ ID NO: 8052021 - DNA, 22 bp, Homo sapiens
agagaagggtgtagcctgggcc

SEQ ID NO: 8052022 - DNA, 20 bp, Homo sapiens
agagaattccctttggagat

SEQ ID NO: 8052023 - DNA, 22 bp, Homo sapiens
agagaattctggtgctaacaag

SEQ ID NO: 8052024 - DNA, 19 bp, Homo sapiens
agagaggctgtgtgaggga

SEQ ID NO: 8052025 - DNA, 22 bp, Homo sapiens
agagaggctgctggactatatg

SEQ ID NO: 8052026 - DNA, 22 bp, Homo sapiens
agagaggcattcggtgatccca

SEQ ID NO: 8052027 - DNA, 22 bp, Homo sapiens
caaaggcatgtgagtatatgtg

SEQ ID NO: 8052028 - DNA, 22 bp, Homo sapiens
agcactcctgtctttccccttt

SEQ ID NO: 8052029 - DNA, 23 bp, Homo sapiens
agcacgggtacagcctggccagg

SEQ ID NO: 8052030 - DNA, 22 bp, Homo sapiens
agcagagaggaggtggccctgt

SEQ ID NO: 8052031 - DNA, 22 bp, Homo sapiens
agcactgtgatttataacattt

SEQ ID NO: 8052032 - DNA, 22 bp, Homo sapiens
agcagagctgcagtggcctgct

SEQ ID NO: 8052033 - DNA, 22 bp, Homo sapiens
agcagagctttttggactcaga

SEQ ID NO: 8052034 - DNA, 22 bp, Homo sapiens
agcagagctgggatcctgggtc

SEQ ID NO: 8052035 - DNA, 22 bp, Homo sapiens
agcagctggaacatatgaagaa

SEQ ID NO: 8052036 - DNA, 22 bp, Homo sapiens
cacagagcaggtgctgggaaga

SEQ ID NO: 8052037 - DNA, 22 bp, Homo sapiens
cacagagcaggtgctgggaaga

SEQ ID NO: 8052038 - DNA, 17 bp, Homo sapiens
agcagctggcacaggag

SEQ ID NO: 8052039 - DNA, 19 bp, Homo sapiens
agcagctggaggtggagtg

SEQ ID NO: 8052040 - DNA, 22 bp, Homo sapiens
agcagctggcagcttcttctct

SEQ ID NO: 8052041 - DNA, 21 bp, Homo sapiens
agcagccttgtgtgccaggca

SEQ ID NO: 8052042 - DNA, 22 bp, Homo sapiens
agcagcctcccagggagcagcc

SEQ ID NO: 8052043 - DNA, 21 bp, Homo sapiens
agcagccttgtgtgccaggca

SEQ ID NO: 8052044 - DNA, 22 bp, Homo sapiens
agcagccctagggattgctgtt

SEQ ID NO: 8052045 - DNA, 22 bp, Homo sapiens
agcagcccagttgtactgagtg

SEQ ID NO: 8052046 - DNA, 22 bp, Homo sapiens
agcagccagagaatgatgcagt

SEQ ID NO: 8052047 - DNA, 20 bp, Homo sapiens
agcagcagatgttggaggtg

SEQ ID NO: 8052048 - DNA, 22 bp, Homo sapiens
caatactgagtttacattcatc

SEQ ID NO: 8052049 - DNA, 22 bp, Homo sapiens
agcagcagagctctggtctgca

SEQ ID NO: 8052050 - DNA, 19 bp, Homo sapiens
agcagcagaagtgtgcctt

SEQ ID NO: 8052051 - DNA, 19 bp, Homo sapiens
agcagcagaagtgtgcctt

SEQ ID NO: 8052052 - DNA, 22 bp, Homo sapiens
agcagcagatccaaaaaatgtg

SEQ ID NO: 8052053 - DNA, 21 bp, Homo sapiens
agcagcagatctggtgagggc

SEQ ID NO: 8052054 - DNA, 21 bp, Homo sapiens
agcagcagatctggtgagggc

SEQ ID NO: 8052055 - DNA, 22 bp, Homo sapiens
agcagcagaggtcagaaaggta

SEQ ID NO: 8052056 - DNA, 22 bp, Homo sapiens
agcagcagagctctggtctgca

SEQ ID NO: 8052057 - DNA, 22 bp, Homo sapiens
agcagcagaggtcagaaaggta

SEQ ID NO: 8052058 - DNA, 22 bp, Homo sapiens
agcagcagatcaaacaggcttg

SEQ ID NO: 8052059 - DNA, 18 bp, Homo sapiens
agcaggttctcacagcca

SEQ ID NO: 8052060 - DNA, 22 bp, Homo sapiens
agcagggctggggcacgagcca

SEQ ID NO: 8052061 - DNA, 22 bp, Homo sapiens
agcagggctggatttggcaaga

SEQ ID NO: 8052062 - DNA, 22 bp, Homo sapiens
agcagggctggatttggcaaga

SEQ ID NO: 8052063 - DNA, 19 bp, Homo sapiens
agcaggtgggtaagaaaat

SEQ ID NO: 8052064 - DNA, 22 bp, Homo sapiens
agcagggctggggcacgagcca

SEQ ID NO: 8052065 - DNA, 22 bp, Homo sapiens
agcaggtgggcatgaaagctga

SEQ ID NO: 8052066 - DNA, 22 bp, Homo sapiens
agcagggctggggcacgagcca

SEQ ID NO: 8052067 - DNA, 22 bp, Homo sapiens
agcaggtgttggctgggccatc

SEQ ID NO: 8052068 - DNA, 22 bp, Homo sapiens
agcaggtgtttgtatcataagg

SEQ ID NO: 8052069 - DNA, 18 bp, Homo sapiens
agcaggtgtgcagaatgt

SEQ ID NO: 8052070 - DNA, 22 bp, Homo sapiens
agcaggtgttagggatccaatg

SEQ ID NO: 8052071 - DNA, 22 bp, Homo sapiens
agcaggtgtcggcgagggtctt

SEQ ID NO: 8052072 - DNA, 18 bp, Homo sapiens
agcatgagagaggctgtg

SEQ ID NO: 8052073 - DNA, 19 bp, Homo sapiens
agcagtggagccatgcctg

SEQ ID NO: 8052074 - DNA, 22 bp, Homo sapiens
agcagtgagtgggaggaccatg

SEQ ID NO: 8052075 - DNA, 22 bp, Homo sapiens
agcagtgcccattctgccccct

SEQ ID NO: 8052076 - DNA, 22 bp, Homo sapiens
agcatggcattattggaaggac

SEQ ID NO: 8052077 - DNA, 22 bp, Homo sapiens
agcatggcattattggaaggac

SEQ ID NO: 8052078 - DNA, 22 bp, Homo sapiens
agcatggccacgggggtaggta

SEQ ID NO: 8052079 - DNA, 22 bp, Homo sapiens
agcatggcactcaaggctcctg

SEQ ID NO: 8052080 - DNA, 22 bp, Homo sapiens
agcatggacagtggcagcagtg

SEQ ID NO: 8052081 - DNA, 18 bp, Homo sapiens
agcatggcacaggctccc

SEQ ID NO: 8052082 - DNA, 22 bp, Homo sapiens
agcatggcctcccgggcctggc

SEQ ID NO: 8052083 - DNA, 22 bp, Homo sapiens
agcatggcctgcagcggccacc

SEQ ID NO: 8052084 - DNA, 22 bp, Homo sapiens
agcatggccatctgggccgtcc

SEQ ID NO: 8052085 - DNA, 22 bp, Homo sapiens
agcatggggcaatgcatgtgct

SEQ ID NO: 8052086 - DNA, 22 bp, Homo sapiens
agcatggctttggaggatagca

SEQ ID NO: 8052087 - DNA, 22 bp, Homo sapiens
agcatggctttggaggatagca

SEQ ID NO: 8052088 - DNA, 22 bp, Homo sapiens
agcatggggctccgcaatgaac

SEQ ID NO: 8052089 - DNA, 22 bp, Homo sapiens
cactgtgggcctgtcgtgggtg

SEQ ID NO: 8052090 - DNA, 17 bp, Homo sapiens
cactgtgggggcattta

SEQ ID NO: 8052091 - DNA, 22 bp, Homo sapiens
cactgtggtgccaaacctggag

SEQ ID NO: 8052092 - DNA, 19 bp, Homo sapiens
cactgtggtccttcactgc

SEQ ID NO: 8052093 - DNA, 22 bp, Homo sapiens
cactgtgggtcccagactggag

SEQ ID NO: 8052094 - DNA, 22 bp, Homo sapiens
cactgtggggtttggctggaac

SEQ ID NO: 8052095 - DNA, 22 bp, Homo sapiens
cactgtggttattatcactgtt

SEQ ID NO: 8052096 - DNA, 22 bp, Homo sapiens
cactgtggtgtgagggctgatg

SEQ ID NO: 8052097 - DNA, 22 bp, Homo sapiens
agcagggcagctgatgcgcacg

SEQ ID NO: 8052098 - DNA, 22 bp, Homo sapiens
agcagggcagctgatgcgcacg

SEQ ID NO: 8052099 - DNA, 22 bp, Homo sapiens
agcagggcagctgatgcgcacg

SEQ ID NO: 8052100 - DNA, 22 bp, Homo sapiens
agcagggcactggaaggcactg

SEQ ID NO: 8052101 - DNA, 19 bp, Homo sapiens
agcagggagtggttgtggg

SEQ ID NO: 8052102 - DNA, 22 bp, Homo sapiens
agcagggcaaagtcaggctaac

SEQ ID NO: 8052103 - DNA, 22 bp, Homo sapiens
agcagggcaaagtcaggctaac

SEQ ID NO: 8052104 - DNA, 22 bp, Homo sapiens
agcagggcaaagtcaggctaac

SEQ ID NO: 8052105 - DNA, 22 bp, Homo sapiens
caccactgtatccctagcactt

SEQ ID NO: 8052106 - DNA, 22 bp, Homo sapiens
agcagggcagtgatcagaaagg

SEQ ID NO: 8052107 - DNA, 22 bp, Homo sapiens
agcagggcaggtaaggatcaga

SEQ ID NO: 8052108 - DNA, 22 bp, Homo sapiens
agcagggcaggtaaggatcaga

SEQ ID NO: 8052109 - DNA, 22 bp, Homo sapiens
agcagggcagcttttttcagaa

SEQ ID NO: 8052110 - DNA, 22 bp, Homo sapiens
agcagggcaggtaaggatcaga

SEQ ID NO: 8052111 - DNA, 22 bp, Homo sapiens
caccagccagagtgacagctcc

SEQ ID NO: 8052112 - DNA, 22 bp, Homo sapiens
agcagggctgcagtgtgtcttt

SEQ ID NO: 8052113 - DNA, 22 bp, Homo sapiens
agcagggctgcggccccaccac

SEQ ID NO: 8052114 - DNA, 22 bp, Homo sapiens
agcagggctctgtggagggtgg

SEQ ID NO: 8052115 - DNA, 22 bp, Homo sapiens
agcagggctctgtggagggtgg

SEQ ID NO: 8052116 - DNA, 22 bp, Homo sapiens
agcagggctctgtggagggtgg

SEQ ID NO: 8052117 - DNA, 22 bp, Homo sapiens
cacagcagacagggaggcggct

SEQ ID NO: 8052118 - DNA, 22 bp, Homo sapiens
cacagcagagggagccattgaa

SEQ ID NO: 8052119 - DNA, 22 bp, Homo sapiens
cacagcagagggagccattgaa

SEQ ID NO: 8052120 - DNA, 22 bp, Homo sapiens
cacagcagaaagtgtaggagga

SEQ ID NO: 8052121 - DNA, 22 bp, Homo sapiens
cacagcagaaatatgaaggcag

SEQ ID NO: 8052122 - DNA, 22 bp, Homo sapiens
agcagggaggcggtgtgctggc

SEQ ID NO: 8052123 - DNA, 22 bp, Homo sapiens
agcaggacacgatgcggcagga

SEQ ID NO: 8052124 - DNA, 18 bp, Homo sapiens
agcaggactgtggggtgg

SEQ ID NO: 8052125 - DNA, 22 bp, Homo sapiens
agcaggaccaagaaggggaaaa

SEQ ID NO: 8052126 - DNA, 22 bp, Homo sapiens
agcaggaaggggatgatgggca

SEQ ID NO: 8052127 - DNA, 22 bp, Homo sapiens
agcagcttgagctggggctggc

SEQ ID NO: 8052128 - DNA, 22 bp, Homo sapiens
agcagcttgaggctggattcca

SEQ ID NO: 8052129 - DNA, 22 bp, Homo sapiens
agcagcttctttcactcctgga

SEQ ID NO: 8052130 - DNA, 22 bp, Homo sapiens
agccctgctcatctggatcccg

SEQ ID NO: 8052131 - DNA, 23 bp, Homo sapiens
agccctgctgagacccagctccc

SEQ ID NO: 8052132 - DNA, 22 bp, Homo sapiens
agccccagttccctggaagtct

SEQ ID NO: 8052133 - DNA, 22 bp, Homo sapiens
agccccagttccctggaagtct

SEQ ID NO: 8052134 - DNA, 22 bp, Homo sapiens
agccctggattctgaggtccaa

SEQ ID NO: 8052135 - DNA, 22 bp, Homo sapiens
agccctggagcaaaggtgtctt

SEQ ID NO: 8052136 - DNA, 22 bp, Homo sapiens
agccctgggaggccagcttgta

SEQ ID NO: 8052137 - DNA, 22 bp, Homo sapiens
agccctggcccggctgtgcttt

SEQ ID NO: 8052138 - DNA, 22 bp, Homo sapiens
agccctggctcccagcagcgct

SEQ ID NO: 8052139 - DNA, 22 bp, Homo sapiens
agccctggctcccagcagcgct

SEQ ID NO: 8052140 - DNA, 22 bp, Homo sapiens
agccctgggcagccaaggaagc

SEQ ID NO: 8052141 - DNA, 22 bp, Homo sapiens
agccctgggcgttactgggatg

SEQ ID NO: 8052142 - DNA, 22 bp, Homo sapiens
cagatgaagtaggtgacgagca

SEQ ID NO: 8052143 - DNA, 22 bp, Homo sapiens
cagatggccagaggcagctgca

SEQ ID NO: 8052144 - DNA, 20 bp, Homo sapiens
cagatgggacgtggaggagt

SEQ ID NO: 8052145 - DNA, 22 bp, Homo sapiens
agcccatgcaacaggcctagcg

SEQ ID NO: 8052146 - DNA, 22 bp, Homo sapiens
agcccatgcaaatactcggtga

SEQ ID NO: 8052147 - DNA, 22 bp, Homo sapiens
agcccatggtgtactctgtggc

SEQ ID NO: 8052148 - DNA, 22 bp, Homo sapiens
agcccaggttgaggctgcagtg

SEQ ID NO: 8052149 - DNA, 22 bp, Homo sapiens
agccccaggatgggccgcagga

SEQ ID NO: 8052150 - DNA, 22 bp, Homo sapiens
agccccaggcccggacgcctct

SEQ ID NO: 8052151 - DNA, 22 bp, Homo sapiens
agcccagggacagggcggatgt

SEQ ID NO: 8052152 - DNA, 22 bp, Homo sapiens
agcccagggagttgattagcat

SEQ ID NO: 8052153 - DNA, 22 bp, Homo sapiens
agcccaggttctaaagccaaac

SEQ ID NO: 8052154 - DNA, 22 bp, Homo sapiens
agcccaggttgaggctgcagtg

SEQ ID NO: 8052155 - DNA, 22 bp, Homo sapiens
agccagtttaagcaggaggggt

SEQ ID NO: 8052156 - DNA, 22 bp, Homo sapiens
agccagttgtggggctagccct

SEQ ID NO: 8052157 - DNA, 23 bp, Homo sapiens
agccagttgtagccacagaactc

SEQ ID NO: 8052158 - DNA, 22 bp, Homo sapiens
agcccagggacagggcggatgt

SEQ ID NO: 8052159 - DNA, 22 bp, Homo sapiens
agccagtttccagatattaact

SEQ ID NO: 8052160 - DNA, 22 bp, Homo sapiens
agccagttggctatgaggagga

SEQ ID NO: 8052161 - DNA, 19 bp, Homo sapiens
agccagttggtaagaggct

SEQ ID NO: 8052162 - DNA, 22 bp, Homo sapiens
agccagttctctagtgatattt

SEQ ID NO: 8052163 - DNA, 22 bp, Homo sapiens
agccagttgatgggtttccaat

SEQ ID NO: 8052164 - DNA, 19 bp, Homo sapiens
agccagttctagacaatgg

SEQ ID NO: 8052165 - DNA, 22 bp, Homo sapiens
agccagtggaattcccaggggt

SEQ ID NO: 8052166 - DNA, 22 bp, Homo sapiens
agccagttcaagttatggcgtt

SEQ ID NO: 8052167 - DNA, 17 bp, Homo sapiens
agccagttcatagcact

SEQ ID NO: 8052168 - DNA, 22 bp, Homo sapiens
agccagttccagcacaccactg

SEQ ID NO: 8052169 - DNA, 22 bp, Homo sapiens
agccagtggaattcccaggggt

SEQ ID NO: 8052170 - DNA, 22 bp, Homo sapiens
agccagtgggattagagcctct

SEQ ID NO: 8052171 - DNA, 17 bp, Homo sapiens
agccaggcatatgaagt

SEQ ID NO: 8052172 - DNA, 21 bp, Homo sapiens
cagagcctgtgttgacagttg

SEQ ID NO: 8052173 - DNA, 22 bp, Homo sapiens
agccaggccttttctcaaggtt

SEQ ID NO: 8052174 - DNA, 22 bp, Homo sapiens
agccaggccttagggagaggca

SEQ ID NO: 8052175 - DNA, 22 bp, Homo sapiens
agccaggccttagggagaggca

SEQ ID NO: 8052176 - DNA, 22 bp, Homo sapiens
cagagccttagttctcctagaa

SEQ ID NO: 8052177 - DNA, 18 bp, Homo sapiens
cagagctcctggatgcag

SEQ ID NO: 8052178 - DNA, 17 bp, Homo sapiens
agccagcagtagctggt

SEQ ID NO: 8052179 - DNA, 20 bp, Homo sapiens
agccagccacttcctgctcc

SEQ ID NO: 8052180 - DNA, 22 bp, Homo sapiens
agccagccagttcactaggaaa

SEQ ID NO: 8052181 - DNA, 19 bp, Homo sapiens
agccagccagcaggtatgc

SEQ ID NO: 8052182 - DNA, 22 bp, Homo sapiens
agccagcccctgactgtgtcct

SEQ ID NO: 8052183 - DNA, 22 bp, Homo sapiens
agccagcccctgactgtgtcct

SEQ ID NO: 8052184 - DNA, 22 bp, Homo sapiens
agccagcctgatctcttcttgc

SEQ ID NO: 8052185 - DNA, 22 bp, Homo sapiens
agccagccgggggaccacagtg

SEQ ID NO: 8052186 - DNA, 22 bp, Homo sapiens
agccagagatccatccctagga

SEQ ID NO: 8052187 - DNA, 19 bp, Homo sapiens
agccagcagcgtagcatct

SEQ ID NO: 8052188 - DNA, 22 bp, Homo sapiens
agccagcacggcgccatggagt

SEQ ID NO: 8052189 - DNA, 19 bp, Homo sapiens
cactttatttctgttttgt

SEQ ID NO: 8052190 - DNA, 22 bp, Homo sapiens
cactttattataaatttgagag

SEQ ID NO: 8052191 - DNA, 22 bp, Homo sapiens
cactttatgggaagcaaaaatt

SEQ ID NO: 8052192 - DNA, 22 bp, Homo sapiens
cactttatattctaagacggcc

SEQ ID NO: 8052193 - DNA, 22 bp, Homo sapiens
cactttataaaattggtgtgag

SEQ ID NO: 8052194 - DNA, 22 bp, Homo sapiens
cactttataaaattggtgtgag

SEQ ID NO: 8052195 - DNA, 22 bp, Homo sapiens
cactttatatgcattacctcat

SEQ ID NO: 8052196 - DNA, 22 bp, Homo sapiens
agctctttctacaagcaggcag

SEQ ID NO: 8052197 - DNA, 22 bp, Homo sapiens
agctctttgagaaggcagtgtg

SEQ ID NO: 8052198 - DNA, 22 bp, Homo sapiens
agctctttgctggcagtaggct

SEQ ID NO: 8052199 - DNA, 22 bp, Homo sapiens
agctctttgagcaaggcagctc

SEQ ID NO: 8052200 - DNA, 22 bp, Homo sapiens
agctctttatgtggaagaggca

SEQ ID NO: 8052201 - DNA, 22 bp, Homo sapiens
agctctggtttagaaggggaaa

SEQ ID NO: 8052202 - DNA, 22 bp, Homo sapiens
agctctgggccaggaaccctaa

SEQ ID NO: 8052203 - DNA, 22 bp, Homo sapiens
agctcctgtctcaagggagcct

SEQ ID NO: 8052204 - DNA, 19 bp, Homo sapiens
agctcctgattgtgcctcg

SEQ ID NO: 8052205 - DNA, 22 bp, Homo sapiens
agctcctggacgaacagggagt

SEQ ID NO: 8052206 - DNA, 22 bp, Homo sapiens
agctcctggaggtgcgcactcg

SEQ ID NO: 8052207 - DNA, 20 bp, Homo sapiens
agctaggagaaagcatggag

SEQ ID NO: 8052208 - DNA, 22 bp, Homo sapiens
agctcaggccggagctacaggc

SEQ ID NO: 8052209 - DNA, 19 bp, Homo sapiens
agctcaggcccatcgtccc

SEQ ID NO: 8052210 - DNA, 23 bp, Homo sapiens
agctccagaacatagcacaggaa

SEQ ID NO: 8052211 - DNA, 22 bp, Homo sapiens
agctagccatgtggctcctgtg

SEQ ID NO: 8052212 - DNA, 22 bp, Homo sapiens
agcctggggcacttctccaaac

SEQ ID NO: 8052213 - DNA, 20 bp, Homo sapiens
agcctggggaattccacccc

SEQ ID NO: 8052214 - DNA, 22 bp, Homo sapiens
agcctgggggcgcagaaaccgg

SEQ ID NO: 8052215 - DNA, 21 bp, Homo sapiens
agcctgggtatcctttgagga

SEQ ID NO: 8052216 - DNA, 22 bp, Homo sapiens
agcctgggccctgcctcttctc

SEQ ID NO: 8052217 - DNA, 18 bp, Homo sapiens
agcctgggctctgcctgg

SEQ ID NO: 8052218 - DNA, 22 bp, Homo sapiens
agcctgggcctggcttcccgcc

SEQ ID NO: 8052219 - DNA, 22 bp, Homo sapiens
agcctgggttagggttcttccc

SEQ ID NO: 8052220 - DNA, 22 bp, Homo sapiens
agcctgggtttttattaaggag

SEQ ID NO: 8052221 - DNA, 21 bp, Homo sapiens
agcctgggaggcggaggttgc

SEQ ID NO: 8052222 - DNA, 22 bp, Homo sapiens
agcctgggagacactaagttgt

SEQ ID NO: 8052223 - DNA, 22 bp, Homo sapiens
agcctgggaatttagagttcgg

SEQ ID NO: 8052224 - DNA, 22 bp, Homo sapiens
agcctgggcatgggacgggagg

SEQ ID NO: 8052225 - DNA, 22 bp, Homo sapiens
agcctgggcaactccattcact

SEQ ID NO: 8052226 - DNA, 22 bp, Homo sapiens
agcctgggcaacagagcaaaac

SEQ ID NO: 8052227 - DNA, 22 bp, Homo sapiens
agcctggccactcagggcctga

SEQ ID NO: 8052228 - DNA, 17 bp, Homo sapiens
agcctgggaaggagtga

SEQ ID NO: 8052229 - DNA, 17 bp, Homo sapiens
agcctgggaaggagtga

SEQ ID NO: 8052230 - DNA, 19 bp, Homo sapiens
agcctggctttgctctgct

SEQ ID NO: 8052231 - DNA, 22 bp, Homo sapiens
aagtggcagttcaggaagcaga

SEQ ID NO: 8052232 - DNA, 22 bp, Homo sapiens
aagtttgtgtcagagctgttac

SEQ ID NO: 8052233 - DNA, 22 bp, Homo sapiens
actcatcagtggttttaatcaa

SEQ ID NO: 8052234 - DNA, 22 bp, Homo sapiens
actcatgtcctaggagtaaagc

SEQ ID NO: 8052235 - DNA, 18 bp, Homo sapiens
aagtggcacaggagtgca

SEQ ID NO: 8052236 - DNA, 22 bp, Homo sapiens
aagtggcagaatagtggcagga

SEQ ID NO: 8052237 - DNA, 22 bp, Homo sapiens
aataaaatggtcagttttctca

SEQ ID NO: 8052238 - DNA, 22 bp, Homo sapiens
actgagaaatttccagacttgc

SEQ ID NO: 8052239 - DNA, 20 bp, Homo sapiens
actgacagggaactaaggct

SEQ ID NO: 8052240 - DNA, 22 bp, Homo sapiens
aataaagtagcgtttaaggtgc

SEQ ID NO: 8052241 - DNA, 22 bp, Homo sapiens
aagtgatttagtcttataaagg

SEQ ID NO: 8052242 - DNA, 22 bp, Homo sapiens
aagtgattcattgatgatgagg

SEQ ID NO: 8052243 - DNA, 22 bp, Homo sapiens
aagtgatgctacgactttgaca

SEQ ID NO: 8052244 - DNA, 22 bp, Homo sapiens
aagtgagtgaaaatgcagaata

SEQ ID NO: 8052245 - DNA, 22 bp, Homo sapiens
actgtggcaaagaagcaggctc

SEQ ID NO: 8052246 - DNA, 22 bp, Homo sapiens
actgtggcaaagaagcaggctc

SEQ ID NO: 8052247 - DNA, 22 bp, Homo sapiens
actgtggcgtcaggaagaaatt

SEQ ID NO: 8052248 - DNA, 22 bp, Homo sapiens
actgtgggacatccctccctat

SEQ ID NO: 8052249 - DNA, 22 bp, Homo sapiens
actgtgggagcgcagtggcagc

SEQ ID NO: 8052250 - DNA, 22 bp, Homo sapiens
actgtggctcatcaggctggtg

SEQ ID NO: 8052251 - DNA, 22 bp, Homo sapiens
actgtggggtgcgaggcagtga

SEQ ID NO: 8052252 - DNA, 21 bp, Homo sapiens
actgtggggttcaactggcag

SEQ ID NO: 8052253 - DNA, 23 bp, Homo sapiens
actgtgggcaccacagagagtgt

SEQ ID NO: 8052254 - DNA, 22 bp, Homo sapiens
actgtgggcagcttctgggaac

SEQ ID NO: 8052255 - DNA, 22 bp, Homo sapiens
actgtgggcctttcctttgacc

SEQ ID NO: 8052256 - DNA, 22 bp, Homo sapiens
actgtgggggagccagtcccat

SEQ ID NO: 8052257 - DNA, 22 bp, Homo sapiens
actgtggggtgaggcccaagaa

SEQ ID NO: 8052258 - DNA, 22 bp, Homo sapiens
actgtggggggctttgctcagt

SEQ ID NO: 8052259 - DNA, 22 bp, Homo sapiens
acttatactaaagtattatttg

SEQ ID NO: 8052260 - DNA, 22 bp, Homo sapiens
aatatcagctctgtcacttact

SEQ ID NO: 8052261 - DNA, 22 bp, Homo sapiens
aatatcagtatattgtatcagt

SEQ ID NO: 8052262 - DNA, 20 bp, Homo sapiens
aatatgctgggagtttatat

SEQ ID NO: 8052263 - DNA, 18 bp, Homo sapiens
aatatgtctagttacagc

SEQ ID NO: 8052264 - DNA, 22 bp, Homo sapiens
aatatggcttgttactatgttt

SEQ ID NO: 8052265 - DNA, 22 bp, Homo sapiens
aatattatacagtcaacctctt

SEQ ID NO: 8052266 - DNA, 22 bp, Homo sapiens
agaaaattactccagagacaag

SEQ ID NO: 8052267 - DNA, 21 bp, Homo sapiens
agaaaatggcgttttagattt

SEQ ID NO: 8052268 - DNA, 22 bp, Homo sapiens
aatctcaaagatggccagaaga

SEQ ID NO: 8052269 - DNA, 22 bp, Homo sapiens
acaggtccttataagagcactc

SEQ ID NO: 8052270 - DNA, 22 bp, Homo sapiens
acaggtcctcaagtcagctggg

SEQ ID NO: 8052271 - DNA, 22 bp, Homo sapiens
acaggtcctcaagtcagctggg

SEQ ID NO: 8052272 - DNA, 22 bp, Homo sapiens
acaggcttttacggatatcttt

SEQ ID NO: 8052273 - DNA, 22 bp, Homo sapiens
acaggctgacttcctgccatgt

SEQ ID NO: 8052274 - DNA, 22 bp, Homo sapiens
acaggtgtccaacatttacctt

SEQ ID NO: 8052275 - DNA, 22 bp, Homo sapiens
acaggtgtcctcacagggggtg

SEQ ID NO: 8052276 - DNA, 22 bp, Homo sapiens
acaggtgtctaaggcagacagc

SEQ ID NO: 8052277 - DNA, 22 bp, Homo sapiens
acaggtgtctgcaagttactgg

SEQ ID NO: 8052278 - DNA, 22 bp, Homo sapiens
acaggtgtggggctgtggtact

SEQ ID NO: 8052279 - DNA, 22 bp, Homo sapiens
acaggtgtgggctgggctctga

SEQ ID NO: 8052280 - DNA, 22 bp, Homo sapiens
acaggtgtgagaacatgccttg

SEQ ID NO: 8052281 - DNA, 22 bp, Homo sapiens
acaggtgtgcggaaagctgtga

SEQ ID NO: 8052282 - DNA, 22 bp, Homo sapiens
acaggtgtagcaggagcatcaa

SEQ ID NO: 8052283 - DNA, 22 bp, Homo sapiens
acaggtgtaggtacatttgcat

SEQ ID NO: 8052284 - DNA, 22 bp, Homo sapiens
acaggtgtatgaatatgttcca

SEQ ID NO: 8052285 - DNA, 22 bp, Homo sapiens
acaggtgtagaaaacagattat

SEQ ID NO: 8052286 - DNA, 22 bp, Homo sapiens
acaggccagcctggggtaaggt

SEQ ID NO: 8052287 - DNA, 22 bp, Homo sapiens
acaggcagagagtggcggactc

SEQ ID NO: 8052288 - DNA, 22 bp, Homo sapiens
acaggcagagtcaggttgggtt

SEQ ID NO: 8052289 - DNA, 22 bp, Homo sapiens
acaggagcccaggatgggcgga

SEQ ID NO: 8052290 - DNA, 22 bp, Homo sapiens
acaggagccaaacacatgccag

SEQ ID NO: 8052291 - DNA, 22 bp, Homo sapiens
acaggagctctagggacagcac

SEQ ID NO: 8052292 - DNA, 22 bp, Homo sapiens
acaggcactgtcaagtcatgaa

SEQ ID NO: 8052293 - DNA, 19 bp, Homo sapiens
acaggcagaattgggtgtg

SEQ ID NO: 8052294 - DNA, 21 bp, Homo sapiens
acaggagaccgcctggcagtc

SEQ ID NO: 8052295 - DNA, 22 bp, Homo sapiens
acaggaaattggcatatcagtt

SEQ ID NO: 8052296 - DNA, 22 bp, Homo sapiens
acagcttttatgggaccagcca

SEQ ID NO: 8052297 - DNA, 22 bp, Homo sapiens
acagctttgtgttaatgggaag

SEQ ID NO: 8052298 - DNA, 22 bp, Homo sapiens
acagctttagtgtgggtggtgc

SEQ ID NO: 8052299 - DNA, 22 bp, Homo sapiens
acagatgagagacaatgtgcta

SEQ ID NO: 8052300 - DNA, 22 bp, Homo sapiens
acagctggcaggggggcatgaa

SEQ ID NO: 8052301 - DNA, 22 bp, Homo sapiens
acagctggagtgttggtgaggt

SEQ ID NO: 8052302 - DNA, 22 bp, Homo sapiens
acagatttttggtaaataattt

SEQ ID NO: 8052303 - DNA, 22 bp, Homo sapiens
acataatggacaataatgcatc

SEQ ID NO: 8052304 - DNA, 22 bp, Homo sapiens
acataatgagctctttataaat

SEQ ID NO: 8052305 - DNA, 22 bp, Homo sapiens
acataatgaaatgcagaaatca

SEQ ID NO: 8052306 - DNA, 22 bp, Homo sapiens
acataagttatggataaaatgt

SEQ ID NO: 8052307 - DNA, 22 bp, Homo sapiens
acataagtgcacaataaatatt

SEQ ID NO: 8052308 - DNA, 23 bp, Homo sapiens
acatagaacagaatatatttgtg

SEQ ID NO: 8052309 - DNA, 22 bp, Homo sapiens
acatacttctttacattccata

SEQ ID NO: 8052310 - DNA, 22 bp, Homo sapiens
acatacttagagtaaacaagta

SEQ ID NO: 8052311 - DNA, 22 bp, Homo sapiens
acatacttaacattaaagtcat

SEQ ID NO: 8052312 - DNA, 22 bp, Homo sapiens
acatgggatcaatgaggcaggc

SEQ ID NO: 8052313 - DNA, 19 bp, Homo sapiens
acatggctctccagtctgg

SEQ ID NO: 8052314 - DNA, 22 bp, Homo sapiens
aaggccagctggagggatgagg

SEQ ID NO: 8052315 - DNA, 22 bp, Homo sapiens
aaggccagcttgtagggctggt

SEQ ID NO: 8052316 - DNA, 22 bp, Homo sapiens
acatgtgttaaaattctcacca

SEQ ID NO: 8052317 - DNA, 22 bp, Homo sapiens
acatgtgttttcctacttatga

SEQ ID NO: 8052318 - DNA, 22 bp, Homo sapiens
aaggccaggcctagcacggagg

SEQ ID NO: 8052319 - DNA, 22 bp, Homo sapiens
aaggccaggccagatgacagtc

SEQ ID NO: 8052320 - DNA, 22 bp, Homo sapiens
aaggccaggcagggagctgtga

SEQ ID NO: 8052321 - DNA, 22 bp, Homo sapiens
acattacctggcatttgatctt

SEQ ID NO: 8052322 - DNA, 22 bp, Homo sapiens
acattagaacattaatattggg

SEQ ID NO: 8052323 - DNA, 22 bp, Homo sapiens
aagggcagcttaaattggtagc

SEQ ID NO: 8052324 - DNA, 22 bp, Homo sapiens
aagggcagcctgactcacggtc

SEQ ID NO: 8052325 - DNA, 22 bp, Homo sapiens
aagggcagctattatcgtcatc

SEQ ID NO: 8052326 - DNA, 22 bp, Homo sapiens
aagggcagctgacagatgctta

SEQ ID NO: 8052327 - DNA, 22 bp, Homo sapiens
accagctgtgtcctggctgcag

SEQ ID NO: 8052328 - DNA, 22 bp, Homo sapiens
accagctggcccatgagcacgt

SEQ ID NO: 8052329 - DNA, 22 bp, Homo sapiens
accagctggtcacctgggcact

SEQ ID NO: 8052330 - DNA, 22 bp, Homo sapiens
accagctgttaggcttggtgct

SEQ ID NO: 8052331 - DNA, 22 bp, Homo sapiens
accagctgtgtgacctgaggca

SEQ ID NO: 8052332 - DNA, 22 bp, Homo sapiens
accaggcatgatgtggagcaca

SEQ ID NO: 8052333 - DNA, 21 bp, Homo sapiens
accaggccaggaggctggcac

SEQ ID NO: 8052334 - DNA, 22 bp, Homo sapiens
aaggtgtcactgggacaggaaa

SEQ ID NO: 8052335 - DNA, 22 bp, Homo sapiens
accaggcatgatgtggagcaca

SEQ ID NO: 8052336 - DNA, 22 bp, Homo sapiens
aaggtgtcactgtttctggcct

SEQ ID NO: 8052337 - DNA, 22 bp, Homo sapiens
agcccctgtttttccagtcaga

SEQ ID NO: 8052338 - DNA, 22 bp, Homo sapiens
agcccctgtcctctctgatgac

SEQ ID NO: 8052339 - DNA, 22 bp, Homo sapiens
agccctgcacaggtctgtggct

SEQ ID NO: 8052340 - DNA, 22 bp, Homo sapiens
agcccctgtcctctctgatgac

SEQ ID NO: 8052341 - DNA, 22 bp, Homo sapiens
agccctgccctgccatgtggca

SEQ ID NO: 8052342 - DNA, 22 bp, Homo sapiens
agccctggggctggtcttggaa

SEQ ID NO: 8052343 - DNA, 22 bp, Homo sapiens
agcctggccctgctgaactctg

SEQ ID NO: 8052344 - DNA, 21 bp, Homo sapiens
agcctggcccagggggaggct

SEQ ID NO: 8052345 - DNA, 22 bp, Homo sapiens
agcctggccaggcctgcccagg

SEQ ID NO: 8052346 - DNA, 22 bp, Homo sapiens
agccctgggtcccagtcctggc

SEQ ID NO: 8052347 - DNA, 22 bp, Homo sapiens
agccctgggttagggtgggagc

SEQ ID NO: 8052348 - DNA, 22 bp, Homo sapiens
agcctgtgaaatctctgccact

SEQ ID NO: 8052349 - DNA, 22 bp, Homo sapiens
agcctggcttaatcctcctttt

SEQ ID NO: 8052350 - DNA, 22 bp, Homo sapiens
agcctggctgtaacctcatggt

SEQ ID NO: 8052351 - DNA, 22 bp, Homo sapiens
agcctggctgggaagagcctct

SEQ ID NO: 8052352 - DNA, 22 bp, Homo sapiens
agcctgtgtgctttggacaggg

SEQ ID NO: 8052353 - DNA, 22 bp, Homo sapiens
agcctgtgtcctcatctgcagc

SEQ ID NO: 8052354 - DNA, 21 bp, Homo sapiens
agcctgttggtttactgctca

SEQ ID NO: 8052355 - DNA, 22 bp, Homo sapiens
agctcaggctctgcagggacta

SEQ ID NO: 8052356 - DNA, 22 bp, Homo sapiens
agctcagggcaaagactcaaat

SEQ ID NO: 8052357 - DNA, 22 bp, Homo sapiens
agctcagggctccaggaccgct

SEQ ID NO: 8052358 - DNA, 22 bp, Homo sapiens
agctcagggccatcggcccttt

SEQ ID NO: 8052359 - DNA, 22 bp, Homo sapiens
agctcagggcgatctgtctcgg

SEQ ID NO: 8052360 - DNA, 22 bp, Homo sapiens
agctccaggtcagtgcacccct

SEQ ID NO: 8052361 - DNA, 22 bp, Homo sapiens
agctcaggtcattccagggatg

SEQ ID NO: 8052362 - DNA, 22 bp, Homo sapiens
agctcaggtagactcagcatct

SEQ ID NO: 8052363 - DNA, 22 bp, Homo sapiens
agctcaggtctcaggaggtgtc

SEQ ID NO: 8052364 - DNA, 22 bp, Homo sapiens
agcattgacctagggaaaggac

SEQ ID NO: 8052365 - DNA, 22 bp, Homo sapiens
agcattgaaccagatgttacat

SEQ ID NO: 8052366 - DNA, 22 bp, Homo sapiens
agcattctgtggtcttctatgg

SEQ ID NO: 8052367 - DNA, 20 bp, Homo sapiens
agcattctactagacttttc

SEQ ID NO: 8052368 - DNA, 22 bp, Homo sapiens
agcattccacactgaagtctgc

SEQ ID NO: 8052369 - DNA, 22 bp, Homo sapiens
agccaggcggggcaggtttcct

SEQ ID NO: 8052370 - DNA, 22 bp, Homo sapiens
agccaggcgcagtggcttatgc

SEQ ID NO: 8052371 - DNA, 22 bp, Homo sapiens
agccaggctactccttgctgac

SEQ ID NO: 8052372 - DNA, 22 bp, Homo sapiens
agccaggctaaatgagccatga

SEQ ID NO: 8052373 - DNA, 20 bp, Homo sapiens
agccaggctcaagctccccc

SEQ ID NO: 8052374 - DNA, 20 bp, Homo sapiens
agccaggctcaagctccccc

SEQ ID NO: 8052375 - DNA, 22 bp, Homo sapiens
agcccagggctaataggaacca

SEQ ID NO: 8052376 - DNA, 22 bp, Homo sapiens
agcccaggtccagttcactgca

SEQ ID NO: 8052377 - DNA, 22 bp, Homo sapiens
agcccaggtctcaaagtacagg

SEQ ID NO: 8052378 - DNA, 22 bp, Homo sapiens
acagaacttcagtagtattccc

SEQ ID NO: 8052379 - DNA, 22 bp, Homo sapiens
acagacagtatggtggggctga

SEQ ID NO: 8052380 - DNA, 22 bp, Homo sapiens
acagacagtaaatagtgtggct

SEQ ID NO: 8052381 - DNA, 21 bp, Homo sapiens
acagacagtccagagaaaaga

SEQ ID NO: 8052382 - DNA, 22 bp, Homo sapiens
agcccaggtctggcccagcctg

SEQ ID NO: 8052383 - DNA, 22 bp, Homo sapiens
agcccaggtctggcccagcctg

SEQ ID NO: 8052384 - DNA, 22 bp, Homo sapiens
agcccaggtggagtgtgtgggg

SEQ ID NO: 8052385 - DNA, 21 bp, Homo sapiens
acagacagggccagtgtcccc

SEQ ID NO: 8052386 - DNA, 22 bp, Homo sapiens
agcccaggtggagtgtgtgggg

SEQ ID NO: 8052387 - DNA, 22 bp, Homo sapiens
agcccaggtgaggggttcgaaa

SEQ ID NO: 8052388 - DNA, 19 bp, Homo sapiens
agcagccatcgaccatgga

SEQ ID NO: 8052389 - DNA, 21 bp, Homo sapiens
agcagccatggatggtatgta

SEQ ID NO: 8052390 - DNA, 21 bp, Homo sapiens
agcagccatttcacagagact

SEQ ID NO: 8052391 - DNA, 22 bp, Homo sapiens
agcagccagttctctgtggtag

SEQ ID NO: 8052392 - DNA, 22 bp, Homo sapiens
agcagctgaccagtgagtcctg

SEQ ID NO: 8052393 - DNA, 22 bp, Homo sapiens
agcagctgagatggtaagattc

SEQ ID NO: 8052394 - DNA, 22 bp, Homo sapiens
agcagctgagccccagctgtga

SEQ ID NO: 8052395 - DNA, 21 bp, Homo sapiens
agcaggaggcagtcacagctc

SEQ ID NO: 8052396 - DNA, 19 bp, Homo sapiens
agcaggcaggtggcccagg

SEQ ID NO: 8052397 - DNA, 22 bp, Homo sapiens
agcaggagggttttgtagagtc

SEQ ID NO: 8052398 - DNA, 22 bp, Homo sapiens
agcaggagggttttgtagagtc

SEQ ID NO: 8052399 - DNA, 23 bp, Homo sapiens
agcaggcatctgtggcacaaggc

SEQ ID NO: 8052400 - DNA, 22 bp, Homo sapiens
agcaggcatagagtagcactca

SEQ ID NO: 8052401 - DNA, 22 bp, Homo sapiens
agcaggcagtgtagagccttca

SEQ ID NO: 8052402 - DNA, 21 bp, Homo sapiens
agcaggcagtgggctggattt

SEQ ID NO: 8052403 - DNA, 19 bp, Homo sapiens
agcaggccacagggccagc

SEQ ID NO: 8052404 - DNA, 22 bp, Homo sapiens
agcagggcctctggcactggtc

SEQ ID NO: 8052405 - DNA, 22 bp, Homo sapiens
agcagggcctctggcactggtc

SEQ ID NO: 8052406 - DNA, 22 bp, Homo sapiens
agcagggctgtgtaggtaatga

SEQ ID NO: 8052407 - DNA, 22 bp, Homo sapiens
agcagggctgtgtaggtaatga

SEQ ID NO: 8052408 - DNA, 22 bp, Homo sapiens
agcagggcttctgtgcctgtgc

SEQ ID NO: 8052409 - DNA, 22 bp, Homo sapiens
agcagggcttctgtgcctgtgc

SEQ ID NO: 8052410 - DNA, 22 bp, Homo sapiens
agcagggcttgccgcttgtcct

SEQ ID NO: 8052411 - DNA, 22 bp, Homo sapiens
agcagggcttgccgcttgtcct

SEQ ID NO: 8052412 - DNA, 22 bp, Homo sapiens
agcagggctttgcagacttggg

SEQ ID NO: 8052413 - DNA, 22 bp, Homo sapiens
agcagggctttgcagacttggg

SEQ ID NO: 8052414 - DNA, 22 bp, Homo sapiens
agcagggctttggctggctttc

SEQ ID NO: 8052415 - DNA, 22 bp, Homo sapiens
agcaggtgagcacagccaggct

SEQ ID NO: 8052416 - DNA, 20 bp, Homo sapiens
agcaggtgacggggcctgct

SEQ ID NO: 8052417 - DNA, 22 bp, Homo sapiens
agcaggtgacccaagcaggctg

SEQ ID NO: 8052418 - DNA, 22 bp, Homo sapiens
agcaggtgacagggctgtggtg

SEQ ID NO: 8052419 - DNA, 22 bp, Homo sapiens
agcaggtgacagggctgtggtg

SEQ ID NO: 8052420 - DNA, 22 bp, Homo sapiens
agcaggtgacccaagcaggctg

SEQ ID NO: 8052421 - DNA, 22 bp, Homo sapiens
agcagggctttgtctctgtgaa

SEQ ID NO: 8052422 - DNA, 22 bp, Homo sapiens
agcagggctttgtctctgtgaa

SEQ ID NO: 8052423 - DNA, 21 bp, Homo sapiens
agcaggtgaacctccagtaca

SEQ ID NO: 8052424 - DNA, 22 bp, Homo sapiens
agcaggtgaattcctggatgtg

SEQ ID NO: 8052425 - DNA, 22 bp, Homo sapiens
acacacatggtattgttcagaa

SEQ ID NO: 8052426 - DNA, 22 bp, Homo sapiens
acacacatgcctttcctaagta

SEQ ID NO: 8052427 - DNA, 21 bp, Homo sapiens
acacactgagttttccactgt

SEQ ID NO: 8052428 - DNA, 21 bp, Homo sapiens
acacactctgagtcttctatt

SEQ ID NO: 8052429 - DNA, 22 bp, Homo sapiens
acacactcaattgcataagcac

SEQ ID NO: 8052430 - DNA, 21 bp, Homo sapiens
acacactctgagtcttctatt

SEQ ID NO: 8052431 - DNA, 22 bp, Homo sapiens
acacacatggtattgttcagaa

SEQ ID NO: 8052432 - DNA, 22 bp, Homo sapiens
agcagcatagaagctgggagga

SEQ ID NO: 8052433 - DNA, 22 bp, Homo sapiens
agcagcagttgctgacgttcta

SEQ ID NO: 8052434 - DNA, 22 bp, Homo sapiens
agcagccaggaatctgcagagc

SEQ ID NO: 8052435 - DNA, 22 bp, Homo sapiens
agcagccaggaatctgcagagc

SEQ ID NO: 8052436 - DNA, 22 bp, Homo sapiens
agcagcagctcattcttcctgt

SEQ ID NO: 8052437 - DNA, 22 bp, Homo sapiens
acacactggcccccagtactga

SEQ ID NO: 8052438 - DNA, 22 bp, Homo sapiens
acacactgttgctcatccaggc

SEQ ID NO: 8052439 - DNA, 22 bp, Homo sapiens
acacactgtaaggactatcact

SEQ ID NO: 8052440 - DNA, 22 bp, Homo sapiens
acacactttaaattaaacctct

SEQ ID NO: 8052441 - DNA, 22 bp, Homo sapiens
agcagcagccgtagccttatta

SEQ ID NO: 8052442 - DNA, 22 bp, Homo sapiens
agcagcagctcagttctcagct

SEQ ID NO: 8052443 - DNA, 22 bp, Homo sapiens
agcagcagctcagttctcagct

SEQ ID NO: 8052444 - DNA, 23 bp, Homo sapiens
agcagcagcaattaagtggatat

SEQ ID NO: 8052445 - DNA, 19 bp, Homo sapiens
agcagcagcaccagggatt

SEQ ID NO: 8052446 - DNA, 21 bp, Homo sapiens
agcagcagcagtggggcttct

SEQ ID NO: 8052447 - DNA, 22 bp, Homo sapiens
agcagcagattcagcaggaatg

SEQ ID NO: 8052448 - DNA, 22 bp, Homo sapiens
agcagcagattatggtctacat

SEQ ID NO: 8052449 - DNA, 22 bp, Homo sapiens
agcagcagattcagcaggaatg

SEQ ID NO: 8052450 - DNA, 22 bp, Homo sapiens
aatgtactaataagcaacattt

SEQ ID NO: 8052451 - DNA, 22 bp, Homo sapiens
aatgtacactgaaagcctatca

SEQ ID NO: 8052452 - DNA, 22 bp, Homo sapiens
aatggaatgcctcacatgtatt

SEQ ID NO: 8052453 - DNA, 22 bp, Homo sapiens
agacactgaatgtttggtggtc

SEQ ID NO: 8052454 - DNA, 22 bp, Homo sapiens
aatgtataaccataggaaattt

SEQ ID NO: 8052455 - DNA, 22 bp, Homo sapiens
aatgtataaccataggaaattt

SEQ ID NO: 8052456 - DNA, 22 bp, Homo sapiens
agactggggttctggcaaggag

SEQ ID NO: 8052457 - DNA, 19 bp, Homo sapiens
agactctgtgtgagacttt

SEQ ID NO: 8052458 - DNA, 22 bp, Homo sapiens
agagaaatagattggtccagaa

SEQ ID NO: 8052459 - DNA, 20 bp, Homo sapiens
agagagttgtcagtagcttc

SEQ ID NO: 8052460 - DNA, 22 bp, Homo sapiens
aattatgtagccatatgaaaca

SEQ ID NO: 8052461 - DNA, 22 bp, Homo sapiens
aattcacttgtgcacgctatgg

SEQ ID NO: 8052462 - DNA, 22 bp, Homo sapiens
aattcactccacttctgtgtct

SEQ ID NO: 8052463 - DNA, 22 bp, Homo sapiens
aattcacagttctgcaccttac

SEQ ID NO: 8052464 - DNA, 22 bp, Homo sapiens
agagcagctgacagcctgccat

SEQ ID NO: 8052465 - DNA, 22 bp, Homo sapiens
agagcagctgcattcagcacct

SEQ ID NO: 8052466 - DNA, 22 bp, Homo sapiens
agagcagcgtttgtggaacact

SEQ ID NO: 8052467 - DNA, 22 bp, Homo sapiens
agagcagcttttcggaaccact

SEQ ID NO: 8052468 - DNA, 22 bp, Homo sapiens
agagcagctgtgacatggacag

SEQ ID NO: 8052469 - DNA, 22 bp, Homo sapiens
agaggcaacatggggaacagat

SEQ ID NO: 8052470 - DNA, 22 bp, Homo sapiens
agagcaggtggcaactctggga

SEQ ID NO: 8052471 - DNA, 22 bp, Homo sapiens
agagcaggggcaatgtgttgca

SEQ ID NO: 8052472 - DNA, 22 bp, Homo sapiens
agaggccaagccagactgtgca

SEQ ID NO: 8052473 - DNA, 22 bp, Homo sapiens
aatttatttcctgccagtacac

SEQ ID NO: 8052474 - DNA, 22 bp, Homo sapiens
aatttattatatcctaggggaa

SEQ ID NO: 8052475 - DNA, 22 bp, Homo sapiens
aatttattcccgtctctgggct

SEQ ID NO: 8052476 - DNA, 22 bp, Homo sapiens
agagggctaactgggaagcagg

SEQ ID NO: 8052477 - DNA, 17 bp, Homo sapiens
agagggctcaaggcatc

SEQ ID NO: 8052478 - DNA, 22 bp, Homo sapiens
agagggctgcctcagtcagcta

SEQ ID NO: 8052479 - DNA, 21 bp, Homo sapiens
aattttgaaggaagattaagg

SEQ ID NO: 8052480 - DNA, 22 bp, Homo sapiens
aattttgttcttggaaatcagg

SEQ ID NO: 8052481 - DNA, 22 bp, Homo sapiens
acaaaaagctccattactgtcc

SEQ ID NO: 8052482 - DNA, 22 bp, Homo sapiens
agaggtgggagcctggtcacat

SEQ ID NO: 8052483 - DNA, 22 bp, Homo sapiens
agataatgttctgatccatttc

SEQ ID NO: 8052484 - DNA, 22 bp, Homo sapiens
agagtactgcctcagttatgaa

SEQ ID NO: 8052485 - DNA, 22 bp, Homo sapiens
agatatctgatgaaaatactct

SEQ ID NO: 8052486 - DNA, 22 bp, Homo sapiens
agatatgtccctgtctaatatt

SEQ ID NO: 8052487 - DNA, 22 bp, Homo sapiens
agatatgtttgtatatatttgt

SEQ ID NO: 8052488 - DNA, 22 bp, Homo sapiens
aagcaccttccagatttgcacg

SEQ ID NO: 8052489 - DNA, 22 bp, Homo sapiens
aagcacctgcagttgacaaaaa

SEQ ID NO: 8052490 - DNA, 22 bp, Homo sapiens
aagaggagacttcagcaacttg

SEQ ID NO: 8052491 - DNA, 22 bp, Homo sapiens
aagcagcaacaaactggataaa

SEQ ID NO: 8052492 - DNA, 22 bp, Homo sapiens
aagcagcaagtttatttctatc

SEQ ID NO: 8052493 - DNA, 22 bp, Homo sapiens
aagcagcacgctttgccaacaa

SEQ ID NO: 8052494 - DNA, 22 bp, Homo sapiens
aagcagcacagtaatattggtg

SEQ ID NO: 8052495 - DNA, 22 bp, Homo sapiens
aagcagcacagcaatgactcta

SEQ ID NO: 8052496 - DNA, 15 bp, Homo sapiens
aagcagcaatatata

SEQ ID NO: 8052497 - DNA, 22 bp, Homo sapiens
aagcagcagcaggattaaagag

SEQ ID NO: 8052498 - DNA, 22 bp, Homo sapiens
aagcagcagacctgattttgaa

SEQ ID NO: 8052499 - DNA, 22 bp, Homo sapiens
aagcagcataattgctatttta

SEQ ID NO: 8052500 - DNA, 22 bp, Homo sapiens
aagcatggtggatgatacagtg

SEQ ID NO: 8052501 - DNA, 22 bp, Homo sapiens
aagcagcagccatcccccaagg

SEQ ID NO: 8052502 - DNA, 22 bp, Homo sapiens
aagcagcagcctgaagtacgtc

SEQ ID NO: 8052503 - DNA, 23 bp, Homo sapiens
aagcatggttcacagttagtact

SEQ ID NO: 8052504 - DNA, 22 bp, Homo sapiens
aagaaagtgggtaatatgattt

SEQ ID NO: 8052505 - DNA, 22 bp, Homo sapiens
aactttcttgtgacatttgggg

SEQ ID NO: 8052506 - DNA, 22 bp, Homo sapiens
aagacactttctaaatagaagt

SEQ ID NO: 8052507 - DNA, 17 bp, Homo sapiens
aagacagaagccatgag

SEQ ID NO: 8052508 - DNA, 22 bp, Homo sapiens
aagagagagttcctaggcaaaa

SEQ ID NO: 8052509 - DNA, 22 bp, Homo sapiens
aacaggaactatttgtattcca

SEQ ID NO: 8052510 - DNA, 22 bp, Homo sapiens
aacagtatatgaaatgttagga

SEQ ID NO: 8052511 - DNA, 22 bp, Homo sapiens
aacagtattggttgaactcaag

SEQ ID NO: 8052512 - DNA, 22 bp, Homo sapiens
aacagtatcttttatcagaaat

SEQ ID NO: 8052513 - DNA, 22 bp, Homo sapiens
aacagtatctacgggaactatt

SEQ ID NO: 8052514 - DNA, 22 bp, Homo sapiens
aactcaaagatgcatgacgctt

SEQ ID NO: 8052515 - DNA, 20 bp, Homo sapiens
aactatagccgatctgctgg

SEQ ID NO: 8052516 - DNA, 22 bp, Homo sapiens
aactatcacaaacagagtgtct

SEQ ID NO: 8052517 - DNA, 17 bp, Homo sapiens
aaatggtcctagggatt

SEQ ID NO: 8052518 - DNA, 22 bp, Homo sapiens
aacagcttttttggtcagcatt

SEQ ID NO: 8052519 - DNA, 22 bp, Homo sapiens
aacacatatttatatatgcaca

SEQ ID NO: 8052520 - DNA, 21 bp, Homo sapiens
aacacatccagagtatttgac

SEQ ID NO: 8052521 - DNA, 22 bp, Homo sapiens
aacacataggcagagcatgaca

SEQ ID NO: 8052522 - DNA, 22 bp, Homo sapiens
aaaaagacttccaactcaggag

SEQ ID NO: 8052523 - DNA, 22 bp, Homo sapiens
aaaagtctacaagcttcaacaa

SEQ ID NO: 8052524 - DNA, 22 bp, Homo sapiens
aaaagtctgctctcatttcaga

SEQ ID NO: 8052525 - DNA, 22 bp, Homo sapiens
aaaatagatgaaaggaagtctg

SEQ ID NO: 8052526 - DNA, 19 bp, Homo sapiens
aaagaactttgggctaggc

SEQ ID NO: 8052527 - DNA, 22 bp, Homo sapiens
aaacttgatctgtgaccttgct

SEQ ID NO: 8052528 - DNA, 23 bp, Homo sapiens
aaacttgctatggctgaaatcat

SEQ ID NO: 8052529 - DNA, 22 bp, Homo sapiens
aaacttgaaaggtactgttggt

SEQ ID NO: 8052530 - DNA, 22 bp, Homo sapiens
aaatatgtaaccaaggtgaagt

SEQ ID NO: 8052531 - DNA, 22 bp, Homo sapiens
aaatacagattctgactcagag

SEQ ID NO: 8052532 - DNA, 22 bp, Homo sapiens
aaatccagtgggtcctcatgag

SEQ ID NO: 8052533 - DNA, 22 bp, Homo sapiens
aaatgcctcccattctactgac

SEQ ID NO: 8052534 - DNA, 23 bp, Homo sapiens
aaagtgcagttgaggaatcatag

SEQ ID NO: 8052535 - DNA, 22 bp, Homo sapiens
aaaggccttaaagagcatgcct

SEQ ID NO: 8052536 - DNA, 22 bp, Homo sapiens
aaaggcctctgtcctagtgcct

SEQ ID NO: 8052537 - DNA, 22 bp, Homo sapiens
aaaggcctgtgcttctaatgtg

SEQ ID NO: 8052538 - DNA, 22 bp, Homo sapiens
acaactccttcttgggtcctgg

SEQ ID NO: 8052539 - DNA, 22 bp, Homo sapiens
acaagaataaggataagagatt

SEQ ID NO: 8052540 - DNA, 22 bp, Homo sapiens
aagaatttaaactaaccatatg

SEQ ID NO: 8052541 - DNA, 22 bp, Homo sapiens
aagaattattgcaatactagat

SEQ ID NO: 8052542 - DNA, 22 bp, Homo sapiens
aattcaatctaagaaatgatca

SEQ ID NO: 8052543 - DNA, 22 bp, Homo sapiens
aattcaaattacaatagttgtt

SEQ ID NO: 8052544 - DNA, 22 bp, Homo sapiens
aattagctaattaattgtagcc

SEQ ID NO: 8052545 - DNA, 22 bp, Homo sapiens
aattagcatttcccatataaat

SEQ ID NO: 8052546 - DNA, 22 bp, Homo sapiens
aattagaagctgttagcaaaat

SEQ ID NO: 8052547 - DNA, 22 bp, Homo sapiens
aattacttaagagaaactttga

SEQ ID NO: 8052548 - DNA, 22 bp, Homo sapiens
aactttctctacggcatttgtt

SEQ ID NO: 8052549 - DNA, 22 bp, Homo sapiens
aactttctctggatggcttcct

SEQ ID NO: 8052550 - DNA, 22 bp, Homo sapiens
aactttctataggttgggattt

SEQ ID NO: 8052551 - DNA, 22 bp, Homo sapiens
aactttctccagtgccaactat

SEQ ID NO: 8052552 - DNA, 22 bp, Homo sapiens
aactttatcggaacaggtactc

SEQ ID NO: 8052553 - DNA, 22 bp, Homo sapiens
aactttattgttaggggctaaa

SEQ ID NO: 8052554 - DNA, 22 bp, Homo sapiens
aactttctaaagtcaaattggt

SEQ ID NO: 8052555 - DNA, 22 bp, Homo sapiens
aatgtcaagtagccaatgcttc

SEQ ID NO: 8052556 - DNA, 22 bp, Homo sapiens
aatgtattctgggaaaatgtta

SEQ ID NO: 8052557 - DNA, 22 bp, Homo sapiens
acacctggtctttgcatgagca

SEQ ID NO: 8052558 - DNA, 22 bp, Homo sapiens
acacacatgcatgcttgccatt

SEQ ID NO: 8052559 - DNA, 22 bp, Homo sapiens
acacacatgcatgcttgccatt

SEQ ID NO: 8052560 - DNA, 22 bp, Homo sapiens
acacacaggtaaaggagcctgg

SEQ ID NO: 8052561 - DNA, 22 bp, Homo sapiens
aagaggcatctcagcttcctct

SEQ ID NO: 8052562 - DNA, 22 bp, Homo sapiens
acacacagaaggaagccccact

SEQ ID NO: 8052563 - DNA, 22 bp, Homo sapiens
acacacagagtttatacaggca

SEQ ID NO: 8052564 - DNA, 22 bp, Homo sapiens
acacacagcgcctaccatgtgc

SEQ ID NO: 8052565 - DNA, 22 bp, Homo sapiens
aagacatttatttgaatcaatt

SEQ ID NO: 8052566 - DNA, 22 bp, Homo sapiens
aagaggaggattgatgtgggag

SEQ ID NO: 8052567 - DNA, 22 bp, Homo sapiens
aagaggcagcccgctgaggctg

SEQ ID NO: 8052568 - DNA, 22 bp, Homo sapiens
aagaggcagaaatatcgctgaa

SEQ ID NO: 8052569 - DNA, 19 bp, Homo sapiens
aagaggcaaccctcgagcc

SEQ ID NO: 8052570 - DNA, 22 bp, Homo sapiens
aagattttctcaactgtatttg

SEQ ID NO: 8052571 - DNA, 22 bp, Homo sapiens
acagaagagctggctctgtgct

SEQ ID NO: 8052572 - DNA, 22 bp, Homo sapiens
acagaagacagagtgttcatct

SEQ ID NO: 8052573 - DNA, 22 bp, Homo sapiens
acagaagaccaagaaagcttcc

SEQ ID NO: 8052574 - DNA, 22 bp, Homo sapiens
aagatatagataaaactatgca

SEQ ID NO: 8052575 - DNA, 22 bp, Homo sapiens
aagatataataactgttgtcat

SEQ ID NO: 8052576 - DNA, 22 bp, Homo sapiens
acagaggaaggctgagctgccc

SEQ ID NO: 8052577 - DNA, 22 bp, Homo sapiens
acagaggacaactaggcgctca

SEQ ID NO: 8052578 - DNA, 17 bp, Homo sapiens
acagagcacatcaagat

SEQ ID NO: 8052579 - DNA, 22 bp, Homo sapiens
acagatgaattttaattgtgtt

SEQ ID NO: 8052580 - DNA, 22 bp, Homo sapiens
aactcccactcagcttcttaat

SEQ ID NO: 8052581 - DNA, 20 bp, Homo sapiens
aactcctagcctcaagtgat

SEQ ID NO: 8052582 - DNA, 22 bp, Homo sapiens
aaccaggtgactcatggtgagc

SEQ ID NO: 8052583 - DNA, 22 bp, Homo sapiens
aagtatttctggcctgtgaaag

SEQ ID NO: 8052584 - DNA, 18 bp, Homo sapiens
aagttgagtgcctgtcat

SEQ ID NO: 8052585 - DNA, 21 bp, Homo sapiens
aagggagataggaatcaggcc

SEQ ID NO: 8052586 - DNA, 22 bp, Homo sapiens
aagggagcaaatggacagacgg

SEQ ID NO: 8052587 - DNA, 22 bp, Homo sapiens
aaggggagatgtcatgggccct

SEQ ID NO: 8052588 - DNA, 22 bp, Homo sapiens
aaggggcatgcttttgccagga

SEQ ID NO: 8052589 - DNA, 22 bp, Homo sapiens
aaggggcctcacagatgggctt

SEQ ID NO: 8052590 - DNA, 21 bp, Homo sapiens
aaggggcaaacccaggacacc

SEQ ID NO: 8052591 - DNA, 21 bp, Homo sapiens
aaggggcaaacccaggacacc

SEQ ID NO: 8052592 - DNA, 22 bp, Homo sapiens
aagggagacagttgtgtgagga

SEQ ID NO: 8052593 - DNA, 22 bp, Homo sapiens
aacaataattgcggttctctat

SEQ ID NO: 8052594 - DNA, 23 bp, Homo sapiens
aaggccagaatttcaatggtgcc

SEQ ID NO: 8052595 - DNA, 22 bp, Homo sapiens
aagccagttagcacatcattgc

SEQ ID NO: 8052596 - DNA, 18 bp, Homo sapiens
aagctgggaaggagacag

SEQ ID NO: 8052597 - DNA, 22 bp, Homo sapiens
aagctttatgatctctcagcta

SEQ ID NO: 8052598 - DNA, 22 bp, Homo sapiens
aagctgggagggagcccagagt

SEQ ID NO: 8052599 - DNA, 22 bp, Homo sapiens
aagctgggacttagcgcagata

SEQ ID NO: 8052600 - DNA, 20 bp, Homo sapiens
aagctgggtaggagaggagc

SEQ ID NO: 8052601 - DNA, 20 bp, Homo sapiens
aagctgggtaggagaggagc

SEQ ID NO: 8052602 - DNA, 22 bp, Homo sapiens
aagctttagagatgagttcctt

SEQ ID NO: 8052603 - DNA, 22 bp, Homo sapiens
aagctttatgacttggagacag

SEQ ID NO: 8052604 - DNA, 22 bp, Homo sapiens
aaggactctccagctagcaaat

SEQ ID NO: 8052605 - DNA, 22 bp, Homo sapiens
tccaccatgtaacaagctctgt

SEQ ID NO: 8052606 - DNA, 22 bp, Homo sapiens
tcatgtgtctgccagtgtttat

SEQ ID NO: 8052607 - DNA, 21 bp, Homo sapiens
tcatgtgtaacttttgaccac

SEQ ID NO: 8052608 - DNA, 22 bp, Homo sapiens
tcatgtgtcctagttcatataa

SEQ ID NO: 8052609 - DNA, 22 bp, Homo sapiens
tcatgtgtgtttcatgtatgga

SEQ ID NO: 8052610 - DNA, 20 bp, Homo sapiens
tcatgtgtgtcctacagaga

SEQ ID NO: 8052611 - DNA, 22 bp, Homo sapiens
tcatgtgtctgctgcagctgtt

SEQ ID NO: 8052612 - DNA, 22 bp, Homo sapiens
tcatgtgttaaactccaagata

SEQ ID NO: 8052613 - DNA, 22 bp, Homo sapiens
tcatgtgttgcactgaggacct

SEQ ID NO: 8052614 - DNA, 22 bp, Homo sapiens
tcattacaagatttccaatttg

SEQ ID NO: 8052615 - DNA, 22 bp, Homo sapiens
tccacacacatttctatgtgca

SEQ ID NO: 8052616 - DNA, 22 bp, Homo sapiens
tccacagcacaaagccagtgtg

SEQ ID NO: 8052617 - DNA, 22 bp, Homo sapiens
tccaggagaaggccatccagcg

SEQ ID NO: 8052618 - DNA, 22 bp, Homo sapiens
tccagccttctcaaggctggct

SEQ ID NO: 8052619 - DNA, 22 bp, Homo sapiens
tccagccctcctgggatcacag

SEQ ID NO: 8052620 - DNA, 22 bp, Homo sapiens
tccagcccgactgggcctgccg

SEQ ID NO: 8052621 - DNA, 20 bp, Homo sapiens
tccagcccctgcatgttgct

SEQ ID NO: 8052622 - DNA, 20 bp, Homo sapiens
tccagccctcatgtcgctca

SEQ ID NO: 8052623 - DNA, 22 bp, Homo sapiens
tccagccctcagccaagtggaa

SEQ ID NO: 8052624 - DNA, 22 bp, Homo sapiens
tccagcccgggggcaggtgacc

SEQ ID NO: 8052625 - DNA, 22 bp, Homo sapiens
tccagcccctcctgagccaagc

SEQ ID NO: 8052626 - DNA, 22 bp, Homo sapiens
tccagcccatccctagcctggg

SEQ ID NO: 8052627 - DNA, 22 bp, Homo sapiens
tccaggccagggtaagaggaga

SEQ ID NO: 8052628 - DNA, 21 bp, Homo sapiens
tccaggccatggtggggaggc

SEQ ID NO: 8052629 - DNA, 22 bp, Homo sapiens
tccaggcccactcagctgaaat

SEQ ID NO: 8052630 - DNA, 22 bp, Homo sapiens
tccaggcccagacggggtgagg

SEQ ID NO: 8052631 - DNA, 22 bp, Homo sapiens
tccaggcccatagacacttctc

SEQ ID NO: 8052632 - DNA, 22 bp, Homo sapiens
tccaggccctgggatgggagca

SEQ ID NO: 8052633 - DNA, 22 bp, Homo sapiens
tccaggccgcaggggcagcccc

SEQ ID NO: 8052634 - DNA, 22 bp, Homo sapiens
tccaggcctaggccaagtgatt

SEQ ID NO: 8052635 - DNA, 21 bp, Homo sapiens
tccaggcctcaggaagggatg

SEQ ID NO: 8052636 - DNA, 22 bp, Homo sapiens
tccagtgcctcactgaggattc

SEQ ID NO: 8052637 - DNA, 22 bp, Homo sapiens
tcccagattcctgctcttatat

SEQ ID NO: 8052638 - DNA, 22 bp, Homo sapiens
tcccagctcacatatggtaact

SEQ ID NO: 8052639 - DNA, 22 bp, Homo sapiens
tcccagctgtgtggaggagatg

SEQ ID NO: 8052640 - DNA, 22 bp, Homo sapiens
tcccacagtggtacagccctga

SEQ ID NO: 8052641 - DNA, 22 bp, Homo sapiens
tcccacatatgcaatcctgaat

SEQ ID NO: 8052642 - DNA, 22 bp, Homo sapiens
tcccactgagcccctgctggtg

SEQ ID NO: 8052643 - DNA, 19 bp, Homo sapiens
tcccaggcaaaggcttctc

SEQ ID NO: 8052644 - DNA, 23 bp, Homo sapiens
tccctgggcccgtgccagcggtg

SEQ ID NO: 8052645 - DNA, 22 bp, Homo sapiens
tccctgcagacgtcctgcgggt

SEQ ID NO: 8052646 - DNA, 22 bp, Homo sapiens
tccctgcacccttgctgggccc

SEQ ID NO: 8052647 - DNA, 22 bp, Homo sapiens
tccctgcacagccgagccatgc

SEQ ID NO: 8052648 - DNA, 22 bp, Homo sapiens
tccctgcagtaggcagccctcc

SEQ ID NO: 8052649 - DNA, 22 bp, Homo sapiens
tccctgcagcccctgagccttc

SEQ ID NO: 8052650 - DNA, 22 bp, Homo sapiens
tccctgcagctgtaggccggcg

SEQ ID NO: 8052651 - DNA, 22 bp, Homo sapiens
tccctgcaggtggggtggccag

SEQ ID NO: 8052652 - DNA, 22 bp, Homo sapiens
tccctgtgggcagaggctgcct

SEQ ID NO: 8052653 - DNA, 22 bp, Homo sapiens
tcccttcctcataggcagaagg

SEQ ID NO: 8052654 - DNA, 19 bp, Homo sapiens
tcccttcctgtcgggctcc

SEQ ID NO: 8052655 - DNA, 22 bp, Homo sapiens
tccctgggcctatcttagctcc

SEQ ID NO: 8052656 - DNA, 22 bp, Homo sapiens
tccctgggcttctccagacttg

SEQ ID NO: 8052657 - DNA, 22 bp, Homo sapiens
tccctggggcagtggctcggag

SEQ ID NO: 8052658 - DNA, 22 bp, Homo sapiens
tcctccctgggagcttctgagt

SEQ ID NO: 8052659 - DNA, 22 bp, Homo sapiens
tcctcccctgcccatgaggagg

SEQ ID NO: 8052660 - DNA, 22 bp, Homo sapiens
tcctccagaaactgaggcagaa

SEQ ID NO: 8052661 - DNA, 22 bp, Homo sapiens
tcatctaagagtcttacattta

SEQ ID NO: 8052662 - DNA, 22 bp, Homo sapiens
tcatccctaaggacagctctgc

SEQ ID NO: 8052663 - DNA, 22 bp, Homo sapiens
tcatccctctgccaggcccagg

SEQ ID NO: 8052664 - DNA, 22 bp, Homo sapiens
tcatccagtaccatggaaggca

SEQ ID NO: 8052665 - DNA, 22 bp, Homo sapiens
tcagtttttgtttgccagatag

SEQ ID NO: 8052666 - DNA, 22 bp, Homo sapiens
tcagtttctttactcatagaat

SEQ ID NO: 8052667 - DNA, 22 bp, Homo sapiens
tcagttcctgttgcacagcatc

SEQ ID NO: 8052668 - DNA, 22 bp, Homo sapiens
tcagtgcttatattctgagcct

SEQ ID NO: 8052669 - DNA, 22 bp, Homo sapiens
tcagtgcttgacagctctggga

SEQ ID NO: 8052670 - DNA, 22 bp, Homo sapiens
tcagtgcttgcctctggaggag

SEQ ID NO: 8052671 - DNA, 22 bp, Homo sapiens
tcaggtggaattaattaagaga

SEQ ID NO: 8052672 - DNA, 22 bp, Homo sapiens
tcaggtggagacctccttggcc

SEQ ID NO: 8052673 - DNA, 21 bp, Homo sapiens
tcagggcagctgctcttcaga

SEQ ID NO: 8052674 - DNA, 22 bp, Homo sapiens
tcagggcactgtcacctgatat

SEQ ID NO: 8052675 - DNA, 22 bp, Homo sapiens
tcagggcacgtttctgcaatgc

SEQ ID NO: 8052676 - DNA, 22 bp, Homo sapiens
tcagggcagaatccaaagaatt

SEQ ID NO: 8052677 - DNA, 22 bp, Homo sapiens
tcagggcagcctaaggcacctc

SEQ ID NO: 8052678 - DNA, 16 bp, Homo sapiens
tcagggcagaatggca

SEQ ID NO: 8052679 - DNA, 22 bp, Homo sapiens
tcaggctccctgctgggctctg

SEQ ID NO: 8052680 - DNA, 18 bp, Homo sapiens
tcaggctctctggctaga

SEQ ID NO: 8052681 - DNA, 22 bp, Homo sapiens
tcaggctgaaggaggcctatct

SEQ ID NO: 8052682 - DNA, 22 bp, Homo sapiens
tcaggctctgggtacacctgac

SEQ ID NO: 8052683 - DNA, 22 bp, Homo sapiens
tcagggcacattctgcagtggc

SEQ ID NO: 8052684 - DNA, 22 bp, Homo sapiens
tcagggcacaggcctgtgggtt

SEQ ID NO: 8052685 - DNA, 22 bp, Homo sapiens
tcagggcaccaaaaaagatgcc

SEQ ID NO: 8052686 - DNA, 22 bp, Homo sapiens
tcagggcaagtctcagaaggtt

SEQ ID NO: 8052687 - DNA, 22 bp, Homo sapiens
tcagggcaatgtccctcagaag

SEQ ID NO: 8052688 - DNA, 22 bp, Homo sapiens
tcagggcaagattggttaataa

SEQ ID NO: 8052689 - DNA, 22 bp, Homo sapiens
tcagggcaaagggcagagtttg

SEQ ID NO: 8052690 - DNA, 22 bp, Homo sapiens
tcagggcaaaagggaaaccatt

SEQ ID NO: 8052691 - DNA, 22 bp, Homo sapiens
tcaggagctcttccctggtgtg

SEQ ID NO: 8052692 - DNA, 22 bp, Homo sapiens
tcaggagctcaggctgatggaa

SEQ ID NO: 8052693 - DNA, 22 bp, Homo sapiens
tcaggagctgcactgggcccac

SEQ ID NO: 8052694 - DNA, 22 bp, Homo sapiens
tcaggagcctgaaagaggtcta

SEQ ID NO: 8052695 - DNA, 22 bp, Homo sapiens
tcaggagggtgacaggccctgg

SEQ ID NO: 8052696 - DNA, 22 bp, Homo sapiens
tcaggagggattgttgcctatt

SEQ ID NO: 8052697 - DNA, 22 bp, Homo sapiens
tcagctttctcagaggcctaac

SEQ ID NO: 8052698 - DNA, 22 bp, Homo sapiens
tcagctttctctcgccatcagg

SEQ ID NO: 8052699 - DNA, 21 bp, Homo sapiens
tcaggcaggcgcagagggaag

SEQ ID NO: 8052700 - DNA, 22 bp, Homo sapiens
tcaggcaggcagagggcaaatg

SEQ ID NO: 8052701 - DNA, 22 bp, Homo sapiens
tcaggcaggaagggaggacttg

SEQ ID NO: 8052702 - DNA, 22 bp, Homo sapiens
tcaggcagcattaaacttcagc

SEQ ID NO: 8052703 - DNA, 22 bp, Homo sapiens
tcaggcagatgcagggatggat

SEQ ID NO: 8052704 - DNA, 22 bp, Homo sapiens
tcaggaggtaggacatactggt

SEQ ID NO: 8052705 - DNA, 22 bp, Homo sapiens
tcaggaggtgtaacgaatacag

SEQ ID NO: 8052706 - DNA, 22 bp, Homo sapiens
tcagccagtgccttgatcttgc

SEQ ID NO: 8052707 - DNA, 22 bp, Homo sapiens
tcagccagtgccttgatcttgc

SEQ ID NO: 8052708 - DNA, 22 bp, Homo sapiens
tcagccagtatttgagtgctca

SEQ ID NO: 8052709 - DNA, 22 bp, Homo sapiens
tcagccagggggagagaatgga

SEQ ID NO: 8052710 - DNA, 22 bp, Homo sapiens
tcagccagggggagagaatgga

SEQ ID NO: 8052711 - DNA, 22 bp, Homo sapiens
tcagccaggtaatgtggagatg

SEQ ID NO: 8052712 - DNA, 22 bp, Homo sapiens
tcagccaggtaatgtggagatg

SEQ ID NO: 8052713 - DNA, 22 bp, Homo sapiens
tcagccaggccctaagagattg

SEQ ID NO: 8052714 - DNA, 22 bp, Homo sapiens
tcagccaggccctaagagattg

SEQ ID NO: 8052715 - DNA, 22 bp, Homo sapiens
tcagccaggccctaagagattg

SEQ ID NO: 8052716 - DNA, 22 bp, Homo sapiens
tcagccagggcagagcaggtga

SEQ ID NO: 8052717 - DNA, 22 bp, Homo sapiens
tcagccagggcagagcaggtga

SEQ ID NO: 8052718 - DNA, 22 bp, Homo sapiens
tcagccagggcagagcaggtga

SEQ ID NO: 8052719 - DNA, 22 bp, Homo sapiens
tcagccagggctctggcctcag

SEQ ID NO: 8052720 - DNA, 22 bp, Homo sapiens
tcagccagggctctggcctcag

SEQ ID NO: 8052721 - DNA, 22 bp, Homo sapiens
tcagcttcagatcagctagaga

SEQ ID NO: 8052722 - DNA, 18 bp, Homo sapiens
tcagcttccagcatgttt

SEQ ID NO: 8052723 - DNA, 23 bp, Homo sapiens
tcagcttcattgtcttctatggc

SEQ ID NO: 8052724 - DNA, 19 bp, Homo sapiens
tcagcttctgtgtattgta

SEQ ID NO: 8052725 - DNA, 22 bp, Homo sapiens
tcagcttccctatctgaccata

SEQ ID NO: 8052726 - DNA, 22 bp, Homo sapiens
tcagcttctcaaaatggcttag

SEQ ID NO: 8052727 - DNA, 22 bp, Homo sapiens
tcagcttcctctgtggttccag

SEQ ID NO: 8052728 - DNA, 22 bp, Homo sapiens
tcagcccagcccagcaagtgca

SEQ ID NO: 8052729 - DNA, 22 bp, Homo sapiens
tcagcccagcccagcaagtgca

SEQ ID NO: 8052730 - DNA, 18 bp, Homo sapiens
tcagcccagagcccagtt

SEQ ID NO: 8052731 - DNA, 18 bp, Homo sapiens
tcagcccagagcccagtt

SEQ ID NO: 8052732 - DNA, 22 bp, Homo sapiens
tcagcccaggaatgagccttct

SEQ ID NO: 8052733 - DNA, 22 bp, Homo sapiens
tcagccagtttgtttattccgg

SEQ ID NO: 8052734 - DNA, 22 bp, Homo sapiens
tcagccagttgccccagttagt

SEQ ID NO: 8052735 - DNA, 22 bp, Homo sapiens
tcagccagttgccccagttagt

SEQ ID NO: 8052736 - DNA, 22 bp, Homo sapiens
tcagccagtttgattctatttg

SEQ ID NO: 8052737 - DNA, 22 bp, Homo sapiens
tcagccagtgtgcacctggagt

SEQ ID NO: 8052738 - DNA, 22 bp, Homo sapiens
tcagccagtgtgcacctggagt

SEQ ID NO: 8052739 - DNA, 22 bp, Homo sapiens
tcagccagttaaggcttagaca

SEQ ID NO: 8052740 - DNA, 22 bp, Homo sapiens
tcagccagttaaggcttagaca

SEQ ID NO: 8052741 - DNA, 22 bp, Homo sapiens
tcagccagttaagtcaagaaat

SEQ ID NO: 8052742 - DNA, 22 bp, Homo sapiens
tcagcccagaccacctcattgc

SEQ ID NO: 8052743 - DNA, 22 bp, Homo sapiens
tcagcccaccttcaggggagtt

SEQ ID NO: 8052744 - DNA, 22 bp, Homo sapiens
tcagcccacctggtgtggggct

SEQ ID NO: 8052745 - DNA, 22 bp, Homo sapiens
tcagcccaaccctgcacaagga

SEQ ID NO: 8052746 - DNA, 23 bp, Homo sapiens
tcagcccacatctagtcattagc

SEQ ID NO: 8052747 - DNA, 22 bp, Homo sapiens
tcagcccaaccctgcacaagga

SEQ ID NO: 8052748 - DNA, 22 bp, Homo sapiens
tcacccaggtaatagcagtttg

SEQ ID NO: 8052749 - DNA, 22 bp, Homo sapiens
tcactgggtaggacatgctgat

SEQ ID NO: 8052750 - DNA, 22 bp, Homo sapiens
tcactgtgattctgtatggatt

SEQ ID NO: 8052751 - DNA, 22 bp, Homo sapiens
tcactgtgcacatatgataggt

SEQ ID NO: 8052752 - DNA, 21 bp, Homo sapiens
tcactgtgcaaatgttgatgg

SEQ ID NO: 8052753 - DNA, 22 bp, Homo sapiens
tcactgtgaatgttatcatctt

SEQ ID NO: 8052754 - DNA, 20 bp, Homo sapiens
tcagagagagggtgccactt

SEQ ID NO: 8052755 - DNA, 22 bp, Homo sapiens
tcagaagccaccttttgttggg

SEQ ID NO: 8052756 - DNA, 16 bp, Homo sapiens
tcacatacttccttgc

SEQ ID NO: 8052757 - DNA, 22 bp, Homo sapiens
tcacagcaggcagatattgttg

SEQ ID NO: 8052758 - DNA, 22 bp, Homo sapiens
tcacagcaccaggatctctcca

SEQ ID NO: 8052759 - DNA, 22 bp, Homo sapiens
tcacagcatttttagaaagatt

SEQ ID NO: 8052760 - DNA, 22 bp, Homo sapiens
tcacagcattgagtgtactaga

SEQ ID NO: 8052761 - DNA, 19 bp, Homo sapiens
tcacagcatctgtctgaac

SEQ ID NO: 8052762 - DNA, 22 bp, Homo sapiens
tcacagcaaatgctgcttctca

SEQ ID NO: 8052763 - DNA, 22 bp, Homo sapiens
tcacagacatggtgaggtaaca

SEQ ID NO: 8052764 - DNA, 22 bp, Homo sapiens
tcacagacacattaaacatgtg

SEQ ID NO: 8052765 - DNA, 22 bp, Homo sapiens
tcacagacagaagggatgggat

SEQ ID NO: 8052766 - DNA, 22 bp, Homo sapiens
tcacacagctgctctgttttat

SEQ ID NO: 8052767 - DNA, 22 bp, Homo sapiens
tcacacagctgacagagccttt

SEQ ID NO: 8052768 - DNA, 22 bp, Homo sapiens
tcacacagctgacagagccttt

SEQ ID NO: 8052769 - DNA, 22 bp, Homo sapiens
tcacacagctcctttccttagt

SEQ ID NO: 8052770 - DNA, 22 bp, Homo sapiens
tcacacacatggatagtatttt

SEQ ID NO: 8052771 - DNA, 22 bp, Homo sapiens
tcacacacatttgctgtctgat

SEQ ID NO: 8052772 - DNA, 22 bp, Homo sapiens
tcacacagattggtagagctga

SEQ ID NO: 8052773 - DNA, 21 bp, Homo sapiens
tcacacacgtttccaagggca

SEQ ID NO: 8052774 - DNA, 22 bp, Homo sapiens
tcacacacataatctaagatta

SEQ ID NO: 8052775 - DNA, 22 bp, Homo sapiens
tcaaaatttcagcactagccct

SEQ ID NO: 8052776 - DNA, 18 bp, Homo sapiens
tcaaaatatttctgtgga

SEQ ID NO: 8052777 - DNA, 20 bp, Homo sapiens
tcaaaataggtgtgggcgga

SEQ ID NO: 8052778 - DNA, 22 bp, Homo sapiens
tcaaaaatggtctttgagctgc

SEQ ID NO: 8052779 - DNA, 22 bp, Homo sapiens
tagtgtatgataaaaaattctt

SEQ ID NO: 8052780 - DNA, 22 bp, Homo sapiens
tagtcaatcagtatgtattgga

SEQ ID NO: 8052781 - DNA, 22 bp, Homo sapiens
tagtcacaggaagtttcaatgt

SEQ ID NO: 8052782 - DNA, 22 bp, Homo sapiens
taggctgctcaccaggctcaga

SEQ ID NO: 8052783 - DNA, 20 bp, Homo sapiens
taggtgtctttgccagcttt

SEQ ID NO: 8052784 - DNA, 22 bp, Homo sapiens
tagtatatctttagtacatagt

SEQ ID NO: 8052785 - DNA, 22 bp, Homo sapiens
tagtatatctttagtacatagt

SEQ ID NO: 8052786 - DNA, 22 bp, Homo sapiens
taggctaggctgaaggttttgg

SEQ ID NO: 8052787 - DNA, 22 bp, Homo sapiens
taggcctggatctctgggagca

SEQ ID NO: 8052788 - DNA, 22 bp, Homo sapiens
taggacaggtgaggggctgtgg

SEQ ID NO: 8052789 - DNA, 20 bp, Homo sapiens
taggacaggcagccgagggg

SEQ ID NO: 8052790 - DNA, 21 bp, Homo sapiens
taggacagcccccctgccctc

SEQ ID NO: 8052791 - DNA, 22 bp, Homo sapiens
tagcccagagtcccaattccag

SEQ ID NO: 8052792 - DNA, 22 bp, Homo sapiens
tagcccagatgattgaaccatg

SEQ ID NO: 8052793 - DNA, 22 bp, Homo sapiens
tagagcagccttcagagcagtt

SEQ ID NO: 8052794 - DNA, 22 bp, Homo sapiens
tagaatcagaagatttgactgt

SEQ ID NO: 8052795 - DNA, 19 bp, Homo sapiens
tagaagcactaggcaaact

SEQ ID NO: 8052796 - DNA, 22 bp, Homo sapiens
tagaagcagtaatagaaatagg

SEQ ID NO: 8052797 - DNA, 22 bp, Homo sapiens
tactttgaagacaatatctgga

SEQ ID NO: 8052798 - DNA, 22 bp, Homo sapiens
tactttcttgttcctttcataa

SEQ ID NO: 8052799 - DNA, 22 bp, Homo sapiens
tactttctagctctccccagtt

SEQ ID NO: 8052800 - DNA, 22 bp, Homo sapiens
tactttctaagacatacaactt

SEQ ID NO: 8052801 - DNA, 22 bp, Homo sapiens
tactttctaagacatacaactt

SEQ ID NO: 8052802 - DNA, 22 bp, Homo sapiens
tagcaaaaactgcagttacttt

SEQ ID NO: 8052803 - DNA, 22 bp, Homo sapiens
tagcacagacagaatggtcata

SEQ ID NO: 8052804 - DNA, 22 bp, Homo sapiens
tagatgtagccactgctaaaag

SEQ ID NO: 8052805 - DNA, 22 bp, Homo sapiens
tagatgtaagcagaagaacagc

SEQ ID NO: 8052806 - DNA, 22 bp, Homo sapiens
tagatttgtttccttctctcca

SEQ ID NO: 8052807 - DNA, 22 bp, Homo sapiens
tagattttgcatttctaacaag

SEQ ID NO: 8052808 - DNA, 22 bp, Homo sapiens
tagccaggcaattatgggtgat

SEQ ID NO: 8052809 - DNA, 23 bp, Homo sapiens
tagccaggcccagcatggacacc

SEQ ID NO: 8052810 - DNA, 22 bp, Homo sapiens
tagccaggcgaggtcagtgtcg

SEQ ID NO: 8052811 - DNA, 22 bp, Homo sapiens
tagccaggctggaagcaaaagg

SEQ ID NO: 8052812 - DNA, 22 bp, Homo sapiens
tatatgtttcttacaaaatatt

SEQ ID NO: 8052813 - DNA, 22 bp, Homo sapiens
tatattaaatgaccagttttaa

SEQ ID NO: 8052814 - DNA, 22 bp, Homo sapiens
tatagatagtcacttgttgcta

SEQ ID NO: 8052815 - DNA, 22 bp, Homo sapiens
tatatgatgccaaataacctgt

SEQ ID NO: 8052816 - DNA, 22 bp, Homo sapiens
tatactgtaggtgcagaaagaa

SEQ ID NO: 8052817 - DNA, 22 bp, Homo sapiens
tatacttatgctaaaaaatgtt

SEQ ID NO: 8052818 - DNA, 22 bp, Homo sapiens
tatactttcctgcaactttgat

SEQ ID NO: 8052819 - DNA, 22 bp, Homo sapiens
tatacagatatctaagatgtaa

SEQ ID NO: 8052820 - DNA, 17 bp, Homo sapiens
tatctgtgttcctggct

SEQ ID NO: 8052821 - DNA, 22 bp, Homo sapiens
tatgcatacaatgagatattcc

SEQ ID NO: 8052822 - DNA, 22 bp, Homo sapiens
tattcactttgggagagccatt

SEQ ID NO: 8052823 - DNA, 22 bp, Homo sapiens
tattcactttgggagagccatt

SEQ ID NO: 8052824 - DNA, 22 bp, Homo sapiens
tattcactgtaactcagcaata

SEQ ID NO: 8052825 - DNA, 22 bp, Homo sapiens
tattgagaaccctcaggaggca

SEQ ID NO: 8052826 - DNA, 22 bp, Homo sapiens
tattcacaggcacgaaatattg

SEQ ID NO: 8052827 - DNA, 22 bp, Homo sapiens
tattcacaggctggagtgatgt

SEQ ID NO: 8052828 - DNA, 22 bp, Homo sapiens
tattcacaggttctggggatca

SEQ ID NO: 8052829 - DNA, 22 bp, Homo sapiens
tattcacatgtacatatgctca

SEQ ID NO: 8052830 - DNA, 22 bp, Homo sapiens
tattcacattaataagtcttca

SEQ ID NO: 8052831 - DNA, 22 bp, Homo sapiens
tattcacatgaaaacaaatttt

SEQ ID NO: 8052832 - DNA, 22 bp, Homo sapiens
tatgttgaatagatgaatggca

SEQ ID NO: 8052833 - DNA, 22 bp, Homo sapiens
tatgcctacctccaaaatatat

SEQ ID NO: 8052834 - DNA, 22 bp, Homo sapiens
tatgctagatggaaaaatattg

SEQ ID NO: 8052835 - DNA, 22 bp, Homo sapiens
tatgctactagaaataaaatgg

SEQ ID NO: 8052836 - DNA, 22 bp, Homo sapiens
tatttctaagagatatctgtac

SEQ ID NO: 8052837 - DNA, 22 bp, Homo sapiens
tattgcatattattctagtggc

SEQ ID NO: 8052838 - DNA, 22 bp, Homo sapiens
tattgcatcagtaatttagtgt

SEQ ID NO: 8052839 - DNA, 22 bp, Homo sapiens
tactgcaaaactactcagtaat

SEQ ID NO: 8052840 - DNA, 19 bp, Homo sapiens
tacattccacacaatctct

SEQ ID NO: 8052841 - DNA, 22 bp, Homo sapiens
tacccagagggagagcaactat

SEQ ID NO: 8052842 - DNA, 22 bp, Homo sapiens
tactgacacaaagccaatccct

SEQ ID NO: 8052843 - DNA, 22 bp, Homo sapiens
tacataattaatctttaagttc

SEQ ID NO: 8052844 - DNA, 22 bp, Homo sapiens
tacaggaaccagattgttcagc

SEQ ID NO: 8052845 - DNA, 22 bp, Homo sapiens
tacaggaaagaaatttgaactc

SEQ ID NO: 8052846 - DNA, 22 bp, Homo sapiens
tacagcagagtgggatgcatct

SEQ ID NO: 8052847 - DNA, 22 bp, Homo sapiens
tacattatcttgttatctttca

SEQ ID NO: 8052848 - DNA, 22 bp, Homo sapiens
tacatacacaaatatactgttt

SEQ ID NO: 8052849 - DNA, 22 bp, Homo sapiens
tacatgtgataaattgattaaa

SEQ ID NO: 8052850 - DNA, 22 bp, Homo sapiens
taagttcctagcctttacatag

SEQ ID NO: 8052851 - DNA, 22 bp, Homo sapiens
taagcaatgagataatcatggg

SEQ ID NO: 8052852 - DNA, 22 bp, Homo sapiens
taatgctaacatcatatcactg

SEQ ID NO: 8052853 - DNA, 22 bp, Homo sapiens
taatggaagttaaatatggtat

SEQ ID NO: 8052854 - DNA, 22 bp, Homo sapiens
taatgatgtgtgcaaactgaat

SEQ ID NO: 8052855 - DNA, 22 bp, Homo sapiens
taatgaatgagaatataacaga

SEQ ID NO: 8052856 - DNA, 22 bp, Homo sapiens
taatgaataaacttgagagtca

SEQ ID NO: 8052857 - DNA, 22 bp, Homo sapiens
tacaatatgtggccttttgtga

SEQ ID NO: 8052858 - DNA, 22 bp, Homo sapiens
tacacatgctcagattcctgtg

SEQ ID NO: 8052859 - DNA, 22 bp, Homo sapiens
tacacatccatgttttgacttt

SEQ ID NO: 8052860 - DNA, 22 bp, Homo sapiens
tacacatcccagactcccagga

SEQ ID NO: 8052861 - DNA, 22 bp, Homo sapiens
tacacatctctgtcagtagtga

SEQ ID NO: 8052862 - DNA, 22 bp, Homo sapiens
tacacatcactgtatctttcag

SEQ ID NO: 8052863 - DNA, 22 bp, Homo sapiens
taagataatccattataatgtt

SEQ ID NO: 8052864 - DNA, 22 bp, Homo sapiens
taagcaacaagtggctggagga

SEQ ID NO: 8052865 - DNA, 22 bp, Homo sapiens
taagatggcagatgagcttgtt

SEQ ID NO: 8052866 - DNA, 22 bp, Homo sapiens
taagaaactaatgcaataagag

SEQ ID NO: 8052867 - DNA, 22 bp, Homo sapiens
taagaaactgtcacagtactat

SEQ ID NO: 8052868 - DNA, 22 bp, Homo sapiens
taagaaactattgtctctgaac

SEQ ID NO: 8052869 - DNA, 22 bp, Homo sapiens
taactgtaatataaatatgagt

SEQ ID NO: 8052870 - DNA, 22 bp, Homo sapiens
taaagaatagatgggtagggag

SEQ ID NO: 8052871 - DNA, 22 bp, Homo sapiens
gttagaaatgcagaaacttgac

SEQ ID NO: 8052872 - DNA, 22 bp, Homo sapiens
gttcattttactgtaaatagca

SEQ ID NO: 8052873 - DNA, 22 bp, Homo sapiens
gttcattttactgtaaatagca

SEQ ID NO: 8052874 - DNA, 22 bp, Homo sapiens
gttccaaagtctctgagctgag

SEQ ID NO: 8052875 - DNA, 22 bp, Homo sapiens
gttcatttttccctaatgagta

SEQ ID NO: 8052876 - DNA, 22 bp, Homo sapiens
gttcatttttccctaatgagta

SEQ ID NO: 8052877 - DNA, 22 bp, Homo sapiens
gttcatttttagaatgctagta

SEQ ID NO: 8052878 - DNA, 23 bp, Homo sapiens
gttcattttattgtctgattgct

SEQ ID NO: 8052879 - DNA, 22 bp, Homo sapiens
gttcatttttactttgatctac

SEQ ID NO: 8052880 - DNA, 22 bp, Homo sapiens
gtgtgttcagcaagaggtaagg

SEQ ID NO: 8052881 - DNA, 22 bp, Homo sapiens
gtgttactgcttttatctacca

SEQ ID NO: 8052882 - DNA, 22 bp, Homo sapiens
gtgtgttccatggggacaacag

SEQ ID NO: 8052883 - DNA, 23 bp, Homo sapiens
gtgtgttcccggagtagctcccg

SEQ ID NO: 8052884 - DNA, 22 bp, Homo sapiens
gtgtgttcccgtttccttcact

SEQ ID NO: 8052885 - DNA, 22 bp, Homo sapiens
gtgtgttcgtatcaacagagga

SEQ ID NO: 8052886 - DNA, 22 bp, Homo sapiens
gtgtgtcctgttttaaaatagt

SEQ ID NO: 8052887 - DNA, 22 bp, Homo sapiens
gtgtgtcctcataagatggagg

SEQ ID NO: 8052888 - DNA, 22 bp, Homo sapiens
gtgtgtcctcttaactattatg

SEQ ID NO: 8052889 - DNA, 22 bp, Homo sapiens
gtgtgtccttgggcctctgcag

SEQ ID NO: 8052890 - DNA, 22 bp, Homo sapiens
gtttctgagagccacacacagc

SEQ ID NO: 8052891 - DNA, 20 bp, Homo sapiens
gtttctgattcagtaggtct

SEQ ID NO: 8052892 - DNA, 22 bp, Homo sapiens
gtttctaattggaactttgagg

SEQ ID NO: 8052893 - DNA, 22 bp, Homo sapiens
gtttctcaacatgctttctaac

SEQ ID NO: 8052894 - DNA, 22 bp, Homo sapiens
gtttctcaaattatttcagctt

SEQ ID NO: 8052895 - DNA, 22 bp, Homo sapiens
gtttctcagcaactatatgact

SEQ ID NO: 8052896 - DNA, 20 bp, Homo sapiens
gttcccaggaattgaagacc

SEQ ID NO: 8052897 - DNA, 22 bp, Homo sapiens
gttccaggtggtcacagagctc

SEQ ID NO: 8052898 - DNA, 22 bp, Homo sapiens
gcctcaggcctatagctgctgt

SEQ ID NO: 8052899 - DNA, 22 bp, Homo sapiens
gcctcagggataggatgagcat

SEQ ID NO: 8052900 - DNA, 22 bp, Homo sapiens
gcctcagggggagaggccagct

SEQ ID NO: 8052901 - DNA, 22 bp, Homo sapiens
gcctggctgctagccagaggca

SEQ ID NO: 8052902 - DNA, 22 bp, Homo sapiens
gcctggctgccggccttggcaa

SEQ ID NO: 8052903 - DNA, 23 bp, Homo sapiens
gcctggcttccaaggtaggggag

SEQ ID NO: 8052904 - DNA, 22 bp, Homo sapiens
gcctggcttcccttggagcatt

SEQ ID NO: 8052905 - DNA, 22 bp, Homo sapiens
gcctggcttgccagccctggcg

SEQ ID NO: 8052906 - DNA, 22 bp, Homo sapiens
gcctggctggtagagggggctc

SEQ ID NO: 8052907 - DNA, 22 bp, Homo sapiens
gcctggctgtctggcaaggttc

SEQ ID NO: 8052908 - DNA, 22 bp, Homo sapiens
gccttcaggaaatcagtccttg

SEQ ID NO: 8052909 - DNA, 23 bp, Homo sapiens
gccttcagctcgggaaggctccc

SEQ ID NO: 8052910 - DNA, 22 bp, Homo sapiens
gccttcaggtgctgccaggcta

SEQ ID NO: 8052911 - DNA, 22 bp, Homo sapiens
gccttcagtagtatcctcatga

SEQ ID NO: 8052912 - DNA, 22 bp, Homo sapiens
gccttcaggtgtccctgtgggc

SEQ ID NO: 8052913 - DNA, 22 bp, Homo sapiens
gccttcagtagtgtcagctgta

SEQ ID NO: 8052914 - DNA, 18 bp, Homo sapiens
gccttcagactgcatgct

SEQ ID NO: 8052915 - DNA, 22 bp, Homo sapiens
gccttcagcggccgctcgctgc

SEQ ID NO: 8052916 - DNA, 22 bp, Homo sapiens
gccttcagagtaccatgtcctc

SEQ ID NO: 8052917 - DNA, 22 bp, Homo sapiens
gcctggtgtccagaggcgagtg

SEQ ID NO: 8052918 - DNA, 22 bp, Homo sapiens
gcctggtgctatgagggccagc

SEQ ID NO: 8052919 - DNA, 22 bp, Homo sapiens
gcctggtggacactgggcatca

SEQ ID NO: 8052920 - DNA, 22 bp, Homo sapiens
gcctggtggtatcctggcaaga

SEQ ID NO: 8052921 - DNA, 22 bp, Homo sapiens
gcctgggtgagggtctccttca

SEQ ID NO: 8052922 - DNA, 22 bp, Homo sapiens
gcctgggttccatgatctccag

SEQ ID NO: 8052923 - DNA, 22 bp, Homo sapiens
gcctggtgaaaggcagagagcg

SEQ ID NO: 8052924 - DNA, 22 bp, Homo sapiens
gcctggtgataagcagtgacct

SEQ ID NO: 8052925 - DNA, 22 bp, Homo sapiens
gcctggggtctctgactcacag

SEQ ID NO: 8052926 - DNA, 22 bp, Homo sapiens
gccttgagaagtcctgcagtga

SEQ ID NO: 8052927 - DNA, 22 bp, Homo sapiens
gcgcctggcacacagcaagggc

SEQ ID NO: 8052928 - DNA, 22 bp, Homo sapiens
gcgggccaccttggagagcgct

SEQ ID NO: 8052929 - DNA, 22 bp, Homo sapiens
gcgggccaccttggagagcgct

SEQ ID NO: 8052930 - DNA, 18 bp, Homo sapiens
gcgggcggtgcagtgggc

SEQ ID NO: 8052931 - DNA, 22 bp, Homo sapiens
gcggggcacagtgatggagcac

SEQ ID NO: 8052932 - DNA, 22 bp, Homo sapiens
gctcacagccggctggcagggg

SEQ ID NO: 8052933 - DNA, 22 bp, Homo sapiens
gctcacagcccaggccagcgtg

SEQ ID NO: 8052934 - DNA, 22 bp, Homo sapiens
gctcacaggtctgtggctattg

SEQ ID NO: 8052935 - DNA, 22 bp, Homo sapiens
gctcaggcccagcggctggtgt

SEQ ID NO: 8052936 - DNA, 18 bp, Homo sapiens
gctcaggccctagtcagt

SEQ ID NO: 8052937 - DNA, 22 bp, Homo sapiens
gctcaccaagcagagactctgg

SEQ ID NO: 8052938 - DNA, 22 bp, Homo sapiens
gctcaagatgtggcctctgaag

SEQ ID NO: 8052939 - DNA, 22 bp, Homo sapiens
gctcaagccttctgcccacctc

SEQ ID NO: 8052940 - DNA, 22 bp, Homo sapiens
gctcacagaacttctcttccca

SEQ ID NO: 8052941 - DNA, 22 bp, Homo sapiens
gctatattttgaaggagagcca

SEQ ID NO: 8052942 - DNA, 22 bp, Homo sapiens
gcgggggcagactgggcagttc

SEQ ID NO: 8052943 - DNA, 22 bp, Homo sapiens
gcggggggaggaacatcttgca

SEQ ID NO: 8052944 - DNA, 21 bp, Homo sapiens
gctcctggtgctgcgtggcgc

SEQ ID NO: 8052945 - DNA, 19 bp, Homo sapiens
gctcaggctgtgtgtgggg

SEQ ID NO: 8052946 - DNA, 19 bp, Homo sapiens
gctcaggctgtgtgtgggg

SEQ ID NO: 8052947 - DNA, 22 bp, Homo sapiens
gctcaggctggattgcagtggc

SEQ ID NO: 8052948 - DNA, 22 bp, Homo sapiens
gctcaggcctggcccatgggac

SEQ ID NO: 8052949 - DNA, 22 bp, Homo sapiens
gctcaggcctccagaggggcaa

SEQ ID NO: 8052950 - DNA, 22 bp, Homo sapiens
gctcaggctctcccaggggaat

SEQ ID NO: 8052951 - DNA, 21 bp, Homo sapiens
gctcaggctcttgacagagca

SEQ ID NO: 8052952 - DNA, 22 bp, Homo sapiens
gctcaggctctcccaggggaat

SEQ ID NO: 8052953 - DNA, 22 bp, Homo sapiens
gctctggctactgtggctaccg

SEQ ID NO: 8052954 - DNA, 22 bp, Homo sapiens
gctctggctactccaccctgtt

SEQ ID NO: 8052955 - DNA, 23 bp, Homo sapiens
gctctggcagcttgtgtcagcac

SEQ ID NO: 8052956 - DNA, 22 bp, Homo sapiens
gctctggccagaccctcagtgg

SEQ ID NO: 8052957 - DNA, 17 bp, Homo sapiens
gctctgcctctcccacc

SEQ ID NO: 8052958 - DNA, 22 bp, Homo sapiens
gctctgccccaggaactcagcc

SEQ ID NO: 8052959 - DNA, 17 bp, Homo sapiens
gctctgccccagcctct

SEQ ID NO: 8052960 - DNA, 18 bp, Homo sapiens
gctctgcccaggctgccc

SEQ ID NO: 8052961 - DNA, 21 bp, Homo sapiens
gctctccagggccagcccagg

SEQ ID NO: 8052962 - DNA, 23 bp, Homo sapiens
gctgcagctgtggatgttctcag

SEQ ID NO: 8052963 - DNA, 22 bp, Homo sapiens
gctgcaggagctggagctgtgg

SEQ ID NO: 8052964 - DNA, 22 bp, Homo sapiens
gctgcaggagattttgagagtc

SEQ ID NO: 8052965 - DNA, 22 bp, Homo sapiens
gctgcaggttgggcaacagagt

SEQ ID NO: 8052966 - DNA, 22 bp, Homo sapiens
gctgcaggatgaggctctgctc

SEQ ID NO: 8052967 - DNA, 22 bp, Homo sapiens
gctgccagaatgggaaatctga

SEQ ID NO: 8052968 - DNA, 22 bp, Homo sapiens
gctgcaggtttgtctagtctgg

SEQ ID NO: 8052969 - DNA, 22 bp, Homo sapiens
gctgccaggacggagaggagcg

SEQ ID NO: 8052970 - DNA, 22 bp, Homo sapiens
gctgccagctttccttggctga

SEQ ID NO: 8052971 - DNA, 22 bp, Homo sapiens
gctgccagggaggtggtggagg

SEQ ID NO: 8052972 - DNA, 22 bp, Homo sapiens
gctgccagcgtcagacctgggg

SEQ ID NO: 8052973 - DNA, 22 bp, Homo sapiens
gctgccagccctcggggtctga

SEQ ID NO: 8052974 - DNA, 22 bp, Homo sapiens
gctgccagctgcggcccacgcg

SEQ ID NO: 8052975 - DNA, 20 bp, Homo sapiens
gctgccagggcggagacatc

SEQ ID NO: 8052976 - DNA, 22 bp, Homo sapiens
gctgccaggggcagctgtctca

SEQ ID NO: 8052977 - DNA, 22 bp, Homo sapiens
gctgccagtagttggagctcca

SEQ ID NO: 8052978 - DNA, 20 bp, Homo sapiens
gctgccagtgcctgatgctt

SEQ ID NO: 8052979 - DNA, 22 bp, Homo sapiens
gctgccagtgtggcatgatgca

SEQ ID NO: 8052980 - DNA, 22 bp, Homo sapiens
gctgccagttccttcttactcc

SEQ ID NO: 8052981 - DNA, 22 bp, Homo sapiens
gctgaagggagtgctgagtctg

SEQ ID NO: 8052982 - DNA, 19 bp, Homo sapiens
gctgaaggaggtgcctgca

SEQ ID NO: 8052983 - DNA, 22 bp, Homo sapiens
gctgatgggagctggctcaccc

SEQ ID NO: 8052984 - DNA, 22 bp, Homo sapiens
gcttcctgagagagacagttcc

SEQ ID NO: 8052985 - DNA, 22 bp, Homo sapiens
gcttcctgagaaacaatctgat

SEQ ID NO: 8052986 - DNA, 22 bp, Homo sapiens
ggaaatcaaggggacaaattgt

SEQ ID NO: 8052987 - DNA, 22 bp, Homo sapiens
ggaaaggctaacagtcatggaa

SEQ ID NO: 8052988 - DNA, 22 bp, Homo sapiens
ggaagccaggccaatgagaaca

SEQ ID NO: 8052989 - DNA, 22 bp, Homo sapiens
ggaagcaggaggctggggtaaa

SEQ ID NO: 8052990 - DNA, 23 bp, Homo sapiens
ggacacatttatttcagaattca

SEQ ID NO: 8052991 - DNA, 22 bp, Homo sapiens
ggagaggaaatgccagcacttc

SEQ ID NO: 8052992 - DNA, 19 bp, Homo sapiens
ggagaggctggagggatgc

SEQ ID NO: 8052993 - DNA, 19 bp, Homo sapiens
ggagaggctggagggatgc

SEQ ID NO: 8052994 - DNA, 19 bp, Homo sapiens
ggagaggctggagggatgc

SEQ ID NO: 8052995 - DNA, 22 bp, Homo sapiens
ggagaggcttccagagtcgtgc

SEQ ID NO: 8052996 - DNA, 22 bp, Homo sapiens
ggagaggcgatgagtcacagcc

SEQ ID NO: 8052997 - DNA, 22 bp, Homo sapiens
ggagaggcgatgagtcacagcc

SEQ ID NO: 8052998 - DNA, 22 bp, Homo sapiens
ggacggggagctggaaagggga

SEQ ID NO: 8052999 - DNA, 19 bp, Homo sapiens
ggacagacgcagagatctg

SEQ ID NO: 8053000 - DNA, 22 bp, Homo sapiens
ggacagacaaaaatagtaagca

SEQ ID NO: 8053001 - DNA, 22 bp, Homo sapiens
ggacagacagtgtgagtgaggc

SEQ ID NO: 8053002 - DNA, 22 bp, Homo sapiens
ggacagactttacagccccggg

SEQ ID NO: 8053003 - DNA, 22 bp, Homo sapiens
ggacagagccctggtggcctaa

SEQ ID NO: 8053004 - DNA, 22 bp, Homo sapiens
ggacactgttcatggggagggg

SEQ ID NO: 8053005 - DNA, 22 bp, Homo sapiens
ggacagagggcaggagcccaga

SEQ ID NO: 8053006 - DNA, 21 bp, Homo sapiens
ggacagaggagaaggcaccct

SEQ ID NO: 8053007 - DNA, 22 bp, Homo sapiens
ggacagagggcaggagcccaga

SEQ ID NO: 8053008 - DNA, 22 bp, Homo sapiens
ggacccagctctgagaccctgc

SEQ ID NO: 8053009 - DNA, 22 bp, Homo sapiens
ggaccctgggcagctggctgct

SEQ ID NO: 8053010 - DNA, 23 bp, Homo sapiens
ggaccctgtggagggtgagagtc

SEQ ID NO: 8053011 - DNA, 22 bp, Homo sapiens
gctggcagacttcctctggaac

SEQ ID NO: 8053012 - DNA, 22 bp, Homo sapiens
gctggcagactgggggcagaac

SEQ ID NO: 8053013 - DNA, 19 bp, Homo sapiens
gctggcagaattttgaacc

SEQ ID NO: 8053014 - DNA, 22 bp, Homo sapiens
gctggcagaatttcttcttgct

SEQ ID NO: 8053015 - DNA, 22 bp, Homo sapiens
gctggcagaagagctggttcaa

SEQ ID NO: 8053016 - DNA, 22 bp, Homo sapiens
gctggcacatggctcagggcct

SEQ ID NO: 8053017 - DNA, 22 bp, Homo sapiens
gctggcacctatttggacctgg

SEQ ID NO: 8053018 - DNA, 22 bp, Homo sapiens
gctggcacaggtggatgctggc

SEQ ID NO: 8053019 - DNA, 22 bp, Homo sapiens
gctggcactgggaaggactgag

SEQ ID NO: 8053020 - DNA, 22 bp, Homo sapiens
gctggcacctatttggacctgg

SEQ ID NO: 8053021 - DNA, 22 bp, Homo sapiens
gctggcagggacagctgcgtgt

SEQ ID NO: 8053022 - DNA, 22 bp, Homo sapiens
gctggctccaaaagcaggggct

SEQ ID NO: 8053023 - DNA, 22 bp, Homo sapiens
gctggcaggatagaagtctaat

SEQ ID NO: 8053024 - DNA, 22 bp, Homo sapiens
gctggcaggataacttctaagc

SEQ ID NO: 8053025 - DNA, 22 bp, Homo sapiens
gctggcaggagcctttcccttt

SEQ ID NO: 8053026 - DNA, 22 bp, Homo sapiens
gctggcaggagaccatacccta

SEQ ID NO: 8053027 - DNA, 22 bp, Homo sapiens
gctggcagagagctggtgagga

SEQ ID NO: 8053028 - DNA, 22 bp, Homo sapiens
gctggcagagacaagaagacta

SEQ ID NO: 8053029 - DNA, 22 bp, Homo sapiens
gctggcaggagaaacggggtgc

SEQ ID NO: 8053030 - DNA, 22 bp, Homo sapiens
gctggcagctggaagttgggct

SEQ ID NO: 8053031 - DNA, 22 bp, Homo sapiens
gctggctgcacaggggctcact

SEQ ID NO: 8053032 - DNA, 22 bp, Homo sapiens
gctggctctgcacccaggcctc

SEQ ID NO: 8053033 - DNA, 22 bp, Homo sapiens
gctggctcgggaagcaggggat

SEQ ID NO: 8053034 - DNA, 22 bp, Homo sapiens
gctgggacaggcttggccctgt

SEQ ID NO: 8053035 - DNA, 22 bp, Homo sapiens
gctgggagacagacttggaacc

SEQ ID NO: 8053036 - DNA, 22 bp, Homo sapiens
gctgggagacagacttggaacc

SEQ ID NO: 8053037 - DNA, 22 bp, Homo sapiens
gctgggagcaaagccatgcata

SEQ ID NO: 8053038 - DNA, 19 bp, Homo sapiens
gctgggtggggtccacagc

SEQ ID NO: 8053039 - DNA, 22 bp, Homo sapiens
gctgggtgtcacggggctcgtg

SEQ ID NO: 8053040 - DNA, 22 bp, Homo sapiens
gctgggtctggatgctcaggtg

SEQ ID NO: 8053041 - DNA, 22 bp, Homo sapiens
gctgggtctctccctggtcctg

SEQ ID NO: 8053042 - DNA, 22 bp, Homo sapiens
gctgggtcctatgctggtagag

SEQ ID NO: 8053043 - DNA, 22 bp, Homo sapiens
gctgggtctggctgtgagccgg

SEQ ID NO: 8053044 - DNA, 22 bp, Homo sapiens
gctgggtttccagcaggcagga

SEQ ID NO: 8053045 - DNA, 22 bp, Homo sapiens
gctggggtctgtgaggagggct

SEQ ID NO: 8053046 - DNA, 22 bp, Homo sapiens
gctgggtcctatgctggtagag

SEQ ID NO: 8053047 - DNA, 20 bp, Homo sapiens
gctgggggtgtgctgagtga

SEQ ID NO: 8053048 - DNA, 22 bp, Homo sapiens
gctgggagtcgcgtctgtggcc

SEQ ID NO: 8053049 - DNA, 16 bp, Homo sapiens
gctgggagggagaggt

SEQ ID NO: 8053050 - DNA, 22 bp, Homo sapiens
gctgggagtcgcgtctgtggcc

SEQ ID NO: 8053051 - DNA, 22 bp, Homo sapiens
gctgtgcagccaagtgcctctg

SEQ ID NO: 8053052 - DNA, 22 bp, Homo sapiens
gctgtgcccagccattctagat

SEQ ID NO: 8053053 - DNA, 22 bp, Homo sapiens
gctgtgcccagctccagctctg

SEQ ID NO: 8053054 - DNA, 22 bp, Homo sapiens
gctgtgcccatattctgctgac

SEQ ID NO: 8053055 - DNA, 22 bp, Homo sapiens
gctgtgcccagctccagctctg

SEQ ID NO: 8053056 - DNA, 22 bp, Homo sapiens
gcttcattttgccctctggtgg

SEQ ID NO: 8053057 - DNA, 20 bp, Homo sapiens
gcttcatttgcaagtctagt

SEQ ID NO: 8053058 - DNA, 22 bp, Homo sapiens
gccagtcagctggccaggctgg

SEQ ID NO: 8053059 - DNA, 22 bp, Homo sapiens
gccagtctgataggggagaagt

SEQ ID NO: 8053060 - DNA, 18 bp, Homo sapiens
gccagtgccctggctcac

SEQ ID NO: 8053061 - DNA, 22 bp, Homo sapiens
gccagtgcctgctgctcagggc

SEQ ID NO: 8053062 - DNA, 22 bp, Homo sapiens
gccagtgcttgtggagctggca

SEQ ID NO: 8053063 - DNA, 22 bp, Homo sapiens
gcccacagtacgaggctcaggc

SEQ ID NO: 8053064 - DNA, 18 bp, Homo sapiens
gcccagaggtctgggccc

SEQ ID NO: 8053065 - DNA, 23 bp, Homo sapiens
gcccagagaggctcaccaggaat

SEQ ID NO: 8053066 - DNA, 22 bp, Homo sapiens
gcccagagtgagtcctgggccc

SEQ ID NO: 8053067 - DNA, 22 bp, Homo sapiens
gcccactggctggagtgctggt

SEQ ID NO: 8053068 - DNA, 22 bp, Homo sapiens
gccaggtggtctggctccagag

SEQ ID NO: 8053069 - DNA, 22 bp, Homo sapiens
gccaggtgtagtggccacacct

SEQ ID NO: 8053070 - DNA, 22 bp, Homo sapiens
gccaggtggctgagtgactgag

SEQ ID NO: 8053071 - DNA, 22 bp, Homo sapiens
gccaggcacagttctaggtgct

SEQ ID NO: 8053072 - DNA, 23 bp, Homo sapiens
gccaggcacatggtggacacgca

SEQ ID NO: 8053073 - DNA, 22 bp, Homo sapiens
gccaggagttcagatgcatgtt

SEQ ID NO: 8053074 - DNA, 22 bp, Homo sapiens
gccaggcaaattaaggaatgca

SEQ ID NO: 8053075 - DNA, 22 bp, Homo sapiens
gccaggagagctccttcaggtt

SEQ ID NO: 8053076 - DNA, 22 bp, Homo sapiens
gccaggagccctgggcaagttc

SEQ ID NO: 8053077 - DNA, 22 bp, Homo sapiens
gccaggacggtgaatgggctac

SEQ ID NO: 8053078 - DNA, 22 bp, Homo sapiens
gccaggactagagggaggtgag

SEQ ID NO: 8053079 - DNA, 22 bp, Homo sapiens
gccaggactgagaatgggagca

SEQ ID NO: 8053080 - DNA, 19 bp, Homo sapiens
gccaggacatcctcctgct

SEQ ID NO: 8053081 - DNA, 22 bp, Homo sapiens
gccaggaccctggagggcatct

SEQ ID NO: 8053082 - DNA, 22 bp, Homo sapiens
gccaggacctcagatgcagggc

SEQ ID NO: 8053083 - DNA, 22 bp, Homo sapiens
gccctctggggcacacagagga

SEQ ID NO: 8053084 - DNA, 23 bp, Homo sapiens
gcccatggagtctggatctggcc

SEQ ID NO: 8053085 - DNA, 22 bp, Homo sapiens
gcccatgcactttctgtgatgg

SEQ ID NO: 8053086 - DNA, 22 bp, Homo sapiens
gcccatgaggtggaggctgcag

SEQ ID NO: 8053087 - DNA, 20 bp, Homo sapiens
gcccatgaggactgcagctg

SEQ ID NO: 8053088 - DNA, 22 bp, Homo sapiens
gcccatgcccctccttctggca

SEQ ID NO: 8053089 - DNA, 22 bp, Homo sapiens
gcccaggctggagttcagtggt

SEQ ID NO: 8053090 - DNA, 22 bp, Homo sapiens
gcccagggctgcaagtggacgc

SEQ ID NO: 8053091 - DNA, 22 bp, Homo sapiens
gcccagcaaggaccaagggccg

SEQ ID NO: 8053092 - DNA, 22 bp, Homo sapiens
gcccaggctggagtgcagtggt

SEQ ID NO: 8053093 - DNA, 22 bp, Homo sapiens
gcccagagttcaaggctgcagt

SEQ ID NO: 8053094 - DNA, 22 bp, Homo sapiens
gcctcaggccgccctgctgctc

SEQ ID NO: 8053095 - DNA, 22 bp, Homo sapiens
gcctcagagggccctagggaca

SEQ ID NO: 8053096 - DNA, 19 bp, Homo sapiens
gccctgagtaagctaggag

SEQ ID NO: 8053097 - DNA, 22 bp, Homo sapiens
gcctcagaaagtggcaggtagg

SEQ ID NO: 8053098 - DNA, 22 bp, Homo sapiens
gcctagcattgatcagcctgct

SEQ ID NO: 8053099 - DNA, 22 bp, Homo sapiens
gccctgaacgaggggtctggag

SEQ ID NO: 8053100 - DNA, 22 bp, Homo sapiens
gccctgaaggcagaggtggagc

SEQ ID NO: 8053101 - DNA, 22 bp, Homo sapiens
gccctgaataatagagtgggga

SEQ ID NO: 8053102 - DNA, 22 bp, Homo sapiens
gccctgaattcctcaggctgtg

SEQ ID NO: 8053103 - DNA, 22 bp, Homo sapiens
gccctgagactgagcatgggtt

SEQ ID NO: 8053104 - DNA, 22 bp, Homo sapiens
gccctgagcactgctgctgggg

SEQ ID NO: 8053105 - DNA, 22 bp, Homo sapiens
gccctgagcctatgagcctctc

SEQ ID NO: 8053106 - DNA, 22 bp, Homo sapiens
gccaagggaactgagccggagg

SEQ ID NO: 8053107 - DNA, 22 bp, Homo sapiens
gccagagcacaggctggtagta

SEQ ID NO: 8053108 - DNA, 22 bp, Homo sapiens
gccagagcatgcactgcctgca

SEQ ID NO: 8053109 - DNA, 21 bp, Homo sapiens
gccagagcagtacaatgaggt

SEQ ID NO: 8053110 - DNA, 22 bp, Homo sapiens
gccagagcagaatagagtggcc

SEQ ID NO: 8053111 - DNA, 22 bp, Homo sapiens
gccagagctgagacacgagtcc

SEQ ID NO: 8053112 - DNA, 22 bp, Homo sapiens
gccagagccggcttcacaggat

SEQ ID NO: 8053113 - DNA, 22 bp, Homo sapiens
gccaaggataccagctgtgaga

SEQ ID NO: 8053114 - DNA, 22 bp, Homo sapiens
gccaaggcctctgcaggatgag

SEQ ID NO: 8053115 - DNA, 22 bp, Homo sapiens
gccaaggcctgcagcacctcat

SEQ ID NO: 8053116 - DNA, 22 bp, Homo sapiens
gcatttttctctcctataggag

SEQ ID NO: 8053117 - DNA, 22 bp, Homo sapiens
gcatttttgatcccactaggat

SEQ ID NO: 8053118 - DNA, 22 bp, Homo sapiens
gcatttttcatccctcttgggt

SEQ ID NO: 8053119 - DNA, 22 bp, Homo sapiens
gcatttttctaatcattggcat

SEQ ID NO: 8053120 - DNA, 23 bp, Homo sapiens
gccagagctgcctgcccttgctg

SEQ ID NO: 8053121 - DNA, 22 bp, Homo sapiens
gccagagcttcccccgagtgtg

SEQ ID NO: 8053122 - DNA, 22 bp, Homo sapiens
gccagagctgagtgaggttctt

SEQ ID NO: 8053123 - DNA, 22 bp, Homo sapiens
gccagaggcccaaggacagctg

SEQ ID NO: 8053124 - DNA, 22 bp, Homo sapiens
gccagaggcccaaggacagctg

SEQ ID NO: 8053125 - DNA, 22 bp, Homo sapiens
gccagcagggcggagccatcta

SEQ ID NO: 8053126 - DNA, 22 bp, Homo sapiens
gccagcagggcggagccatcta

SEQ ID NO: 8053127 - DNA, 22 bp, Homo sapiens
gccagcaggtggagagatcaag

SEQ ID NO: 8053128 - DNA, 22 bp, Homo sapiens
gccagcaggtggagagatcaag

SEQ ID NO: 8053129 - DNA, 22 bp, Homo sapiens
gccagcagtatgtcctggcagt

SEQ ID NO: 8053130 - DNA, 22 bp, Homo sapiens
gccagcaggttgtcaaggagct

SEQ ID NO: 8053131 - DNA, 22 bp, Homo sapiens
gccagcccagctccaggggaaa

SEQ ID NO: 8053132 - DNA, 22 bp, Homo sapiens
gccagccccttagggctctccc

SEQ ID NO: 8053133 - DNA, 22 bp, Homo sapiens
gccagccccttagggctctccc

SEQ ID NO: 8053134 - DNA, 22 bp, Homo sapiens
gccagcccctccatcctgttca

SEQ ID NO: 8053135 - DNA, 22 bp, Homo sapiens
gccagcagtcctgctgtgtgcc

SEQ ID NO: 8053136 - DNA, 22 bp, Homo sapiens
gccagcagtcctgctgtgtgcc

SEQ ID NO: 8053137 - DNA, 22 bp, Homo sapiens
gccagcagtggccaccaccagg

SEQ ID NO: 8053138 - DNA, 22 bp, Homo sapiens
gccagcagtggccaccaccagg

SEQ ID NO: 8053139 - DNA, 22 bp, Homo sapiens
gccagccaagattgagaaggta

SEQ ID NO: 8053140 - DNA, 22 bp, Homo sapiens
gcatgaggttcttggccagcat

SEQ ID NO: 8053141 - DNA, 22 bp, Homo sapiens
gcatttggtgatgcaccgttta

SEQ ID NO: 8053142 - DNA, 22 bp, Homo sapiens
gcatttctgtgcatacacatga

SEQ ID NO: 8053143 - DNA, 19 bp, Homo sapiens
gcagggctctcccagatgc

SEQ ID NO: 8053144 - DNA, 22 bp, Homo sapiens
gcagggctctgctgtagtccta

SEQ ID NO: 8053145 - DNA, 22 bp, Homo sapiens
gcagggctcattgccaggcatt

SEQ ID NO: 8053146 - DNA, 22 bp, Homo sapiens
gcagggctccccaggcccgagg

SEQ ID NO: 8053147 - DNA, 22 bp, Homo sapiens
gcagggctccactgtggccaag

SEQ ID NO: 8053148 - DNA, 22 bp, Homo sapiens
gcagggctcagccgctcccacc

SEQ ID NO: 8053149 - DNA, 22 bp, Homo sapiens
gcagggctcaacaggacacccc

SEQ ID NO: 8053150 - DNA, 22 bp, Homo sapiens
gcagtctttttcttctagctaa

SEQ ID NO: 8053151 - DNA, 22 bp, Homo sapiens
gcacctgggcaaggattcagag

SEQ ID NO: 8053152 - DNA, 22 bp, Homo sapiens
gcacaggccatgggaggacagc

SEQ ID NO: 8053153 - DNA, 22 bp, Homo sapiens
gcactgagcaccagccacagat

SEQ ID NO: 8053154 - DNA, 22 bp, Homo sapiens
gcactgagcaccagccacagat

SEQ ID NO: 8053155 - DNA, 22 bp, Homo sapiens
gcactgagtctgtcatgctgca

SEQ ID NO: 8053156 - DNA, 22 bp, Homo sapiens
gcactgagctttggaggagcag

SEQ ID NO: 8053157 - DNA, 22 bp, Homo sapiens
gcactgggaatgagggcagctt

SEQ ID NO: 8053158 - DNA, 22 bp, Homo sapiens
gcactggccgcacgcgtagggc

SEQ ID NO: 8053159 - DNA, 22 bp, Homo sapiens
gcactgggaagaatgagcctgt

SEQ ID NO: 8053160 - DNA, 23 bp, Homo sapiens
gcactgccatgtgctctgcaggc

SEQ ID NO: 8053161 - DNA, 22 bp, Homo sapiens
gcactgccacataatctcagca

SEQ ID NO: 8053162 - DNA, 22 bp, Homo sapiens
gcagaggagcaagctggacacc

SEQ ID NO: 8053163 - DNA, 22 bp, Homo sapiens
gcagaggacacaggagggcaag

SEQ ID NO: 8053164 - DNA, 22 bp, Homo sapiens
gcacttgatcattgttacagat

SEQ ID NO: 8053165 - DNA, 22 bp, Homo sapiens
gcacttgaagaattgaactgga

SEQ ID NO: 8053166 - DNA, 22 bp, Homo sapiens
gcacttgaggacgactcagctg

SEQ ID NO: 8053167 - DNA, 22 bp, Homo sapiens
gcacttgaaaagatcaggtgca

SEQ ID NO: 8053168 - DNA, 22 bp, Homo sapiens
gcactgtgctaggtatcaggga

SEQ ID NO: 8053169 - DNA, 22 bp, Homo sapiens
gcactgtgcttagttcactatt

SEQ ID NO: 8053170 - DNA, 22 bp, Homo sapiens
gcactgtgctagaagccagggg

SEQ ID NO: 8053171 - DNA, 22 bp, Homo sapiens
gcactgggaatgctgatgggct

SEQ ID NO: 8053172 - DNA, 22 bp, Homo sapiens
gcactgggaatgtgagcagctg

SEQ ID NO: 8053173 - DNA, 22 bp, Homo sapiens
gcactgggctccaggaaggagg

SEQ ID NO: 8053174 - DNA, 23 bp, Homo sapiens
gcactgggctctcagcaaggtgt

SEQ ID NO: 8053175 - DNA, 22 bp, Homo sapiens
gcactgtgctaaacatgtatca

SEQ ID NO: 8053176 - DNA, 22 bp, Homo sapiens
gcacaggatgatgggttgaggg

SEQ ID NO: 8053177 - DNA, 22 bp, Homo sapiens
gcacaggcacagagggccactg

SEQ ID NO: 8053178 - DNA, 22 bp, Homo sapiens
gcacaggcacagagggccactg

SEQ ID NO: 8053179 - DNA, 19 bp, Homo sapiens
gcacaggacatctgatgga

SEQ ID NO: 8053180 - DNA, 22 bp, Homo sapiens
gcacagccctggtcggggcccc

SEQ ID NO: 8053181 - DNA, 22 bp, Homo sapiens
gcacagccttgccctgtgccct

SEQ ID NO: 8053182 - DNA, 22 bp, Homo sapiens
gcacagcctgtccctgtcctgg

SEQ ID NO: 8053183 - DNA, 22 bp, Homo sapiens
gcacagccactgagtgagaacc

SEQ ID NO: 8053184 - DNA, 22 bp, Homo sapiens
gcacagccacgtaatgtggtca

SEQ ID NO: 8053185 - DNA, 22 bp, Homo sapiens
gcacagccagcatctgagggat

SEQ ID NO: 8053186 - DNA, 22 bp, Homo sapiens
gcaagcagatctccggagggaa

SEQ ID NO: 8053187 - DNA, 22 bp, Homo sapiens
gcaagacctatctagttgctgt

SEQ ID NO: 8053188 - DNA, 22 bp, Homo sapiens
gaggggctgggtagggcaaccc

SEQ ID NO: 8053189 - DNA, 22 bp, Homo sapiens
gagggggaaagtccctggagtc

SEQ ID NO: 8053190 - DNA, 22 bp, Homo sapiens
gagggggagatgtgcacacact

SEQ ID NO: 8053191 - DNA, 22 bp, Homo sapiens
gagggggacgtatcctggtatg

SEQ ID NO: 8053192 - DNA, 22 bp, Homo sapiens
gaggggtgtggagccatcagtt

SEQ ID NO: 8053193 - DNA, 22 bp, Homo sapiens
gaggggtgtggagccatcagtt

SEQ ID NO: 8053194 - DNA, 22 bp, Homo sapiens
gagggggcgaacagaagcaagg

SEQ ID NO: 8053195 - DNA, 22 bp, Homo sapiens
gcagcagccgacatggattgca

SEQ ID NO: 8053196 - DNA, 22 bp, Homo sapiens
gcagcagcggggcccctgcgcg

SEQ ID NO: 8053197 - DNA, 22 bp, Homo sapiens
gcagcagctctgaatgggcccc

SEQ ID NO: 8053198 - DNA, 22 bp, Homo sapiens
gcagcagctctgaatgggcccc

SEQ ID NO: 8053199 - DNA, 22 bp, Homo sapiens
gcagcagctgacagtgggtgcc

SEQ ID NO: 8053200 - DNA, 22 bp, Homo sapiens
gcagcagctccctatccaggct

SEQ ID NO: 8053201 - DNA, 22 bp, Homo sapiens
gcagcagctcagccgggcactg

SEQ ID NO: 8053202 - DNA, 22 bp, Homo sapiens
gcagcagctcagccgggcactg

SEQ ID NO: 8053203 - DNA, 22 bp, Homo sapiens
gcagcagctcagttctgggagg

SEQ ID NO: 8053204 - DNA, 22 bp, Homo sapiens
gcagcaggatggccaattgcca

SEQ ID NO: 8053205 - DNA, 22 bp, Homo sapiens
gcagcaggcacggtctcgacat

SEQ ID NO: 8053206 - DNA, 22 bp, Homo sapiens
gcagcaggcacggtctcgacat

SEQ ID NO: 8053207 - DNA, 22 bp, Homo sapiens
gcagcaggcacttaccgttgct

SEQ ID NO: 8053208 - DNA, 22 bp, Homo sapiens
gcagcaggcacttaccgttgct

SEQ ID NO: 8053209 - DNA, 22 bp, Homo sapiens
gcagcaggtctgtcaatgtcat

SEQ ID NO: 8053210 - DNA, 22 bp, Homo sapiens
gcagcaggagagtaatagcggt

SEQ ID NO: 8053211 - DNA, 22 bp, Homo sapiens
gcagcaggactgccgttaaagt

SEQ ID NO: 8053212 - DNA, 22 bp, Homo sapiens
gcagcaggagagtttgtcctgc

SEQ ID NO: 8053213 - DNA, 22 bp, Homo sapiens
gcagcaggaatttaaatttata

SEQ ID NO: 8053214 - DNA, 22 bp, Homo sapiens
gcagcaggaataggataagcaa

SEQ ID NO: 8053215 - DNA, 22 bp, Homo sapiens
gcagctgccgtgagctcacgcc

SEQ ID NO: 8053216 - DNA, 22 bp, Homo sapiens
gcagctgcaagcacttctggca

SEQ ID NO: 8053217 - DNA, 22 bp, Homo sapiens
gcagctgcagaccctcagtgct

SEQ ID NO: 8053218 - DNA, 22 bp, Homo sapiens
gcagcatgttgaaagggccaca

SEQ ID NO: 8053219 - DNA, 22 bp, Homo sapiens
gcagcatgttgaaagggccaca

SEQ ID NO: 8053220 - DNA, 22 bp, Homo sapiens
gcagcatggagttgtggaatga

SEQ ID NO: 8053221 - DNA, 22 bp, Homo sapiens
gcagcatggagttgtggaatga

SEQ ID NO: 8053222 - DNA, 22 bp, Homo sapiens
gcagcatcaggttcactgcgtg

SEQ ID NO: 8053223 - DNA, 22 bp, Homo sapiens
gcagcaggtgtgcttttaatga

SEQ ID NO: 8053224 - DNA, 22 bp, Homo sapiens
gcaggctgatgactggagttgg

SEQ ID NO: 8053225 - DNA, 22 bp, Homo sapiens
gcagggccttagcagcggctgc

SEQ ID NO: 8053226 - DNA, 22 bp, Homo sapiens
gcaggctgccaccttctgagtt

SEQ ID NO: 8053227 - DNA, 22 bp, Homo sapiens
gcagggctaatggggcaagtag

SEQ ID NO: 8053228 - DNA, 22 bp, Homo sapiens
gcagggcggcccagagcaggcc

SEQ ID NO: 8053229 - DNA, 22 bp, Homo sapiens
gcagggctaggtcttctagggc

SEQ ID NO: 8053230 - DNA, 22 bp, Homo sapiens
gcaggctgatagaggattccat

SEQ ID NO: 8053231 - DNA, 22 bp, Homo sapiens
gcaggctgagttgggaaaccaa

SEQ ID NO: 8053232 - DNA, 19 bp, Homo sapiens
gcaggcctcttgggaatta

SEQ ID NO: 8053233 - DNA, 22 bp, Homo sapiens
gcaggcctctgttgagggcctt

SEQ ID NO: 8053234 - DNA, 22 bp, Homo sapiens
gcaggcctctgttgagggcctt

SEQ ID NO: 8053235 - DNA, 22 bp, Homo sapiens
gcaggaggttgagccaggactg

SEQ ID NO: 8053236 - DNA, 22 bp, Homo sapiens
gcaggagctttgcttactgctg

SEQ ID NO: 8053237 - DNA, 22 bp, Homo sapiens
gcaggagctttgcttactgctg

SEQ ID NO: 8053238 - DNA, 22 bp, Homo sapiens
gcagctggccctgacacgcaga

SEQ ID NO: 8053239 - DNA, 22 bp, Homo sapiens
gcaggagctggaaagtgatgtt

SEQ ID NO: 8053240 - DNA, 22 bp, Homo sapiens
gcagctggagaaataccaccct

SEQ ID NO: 8053241 - DNA, 22 bp, Homo sapiens
gcagctggagcatcttctcatc

SEQ ID NO: 8053242 - DNA, 22 bp, Homo sapiens
gcagctgcctattcagggcttg

SEQ ID NO: 8053243 - DNA, 22 bp, Homo sapiens
gcagctggagccagccagacac

SEQ ID NO: 8053244 - DNA, 22 bp, Homo sapiens
gtgcccaggtgtccctgagaag

SEQ ID NO: 8053245 - DNA, 22 bp, Homo sapiens
gtgccctgatcgctaggctccc

SEQ ID NO: 8053246 - DNA, 22 bp, Homo sapiens
gtgattttcatgccctgctagg

SEQ ID NO: 8053247 - DNA, 22 bp, Homo sapiens
gtgattttgagacctatatagt

SEQ ID NO: 8053248 - DNA, 22 bp, Homo sapiens
gtgctgggggtttctgtaggtc

SEQ ID NO: 8053249 - DNA, 22 bp, Homo sapiens
gtgctggggagataggaagaga

SEQ ID NO: 8053250 - DNA, 22 bp, Homo sapiens
gtgctgggattacaggtgtgag

SEQ ID NO: 8053251 - DNA, 22 bp, Homo sapiens
gtgctgggtgctgcagacaggt

SEQ ID NO: 8053252 - DNA, 22 bp, Homo sapiens
gtgccctggctcacagtgtctc

SEQ ID NO: 8053253 - DNA, 22 bp, Homo sapiens
gtgccctggtccccagcatata

SEQ ID NO: 8053254 - DNA, 22 bp, Homo sapiens
gtgccctgttgcacacttgagg

SEQ ID NO: 8053255 - DNA, 22 bp, Homo sapiens
gtgcctgaaagccatgctcact

SEQ ID NO: 8053256 - DNA, 22 bp, Homo sapiens
gtgcctgaaagccatgctcact

SEQ ID NO: 8053257 - DNA, 22 bp, Homo sapiens
gtgcctgagccagctgcagctc

SEQ ID NO: 8053258 - DNA, 22 bp, Homo sapiens
gtgctgggattacaggtgtgag

SEQ ID NO: 8053259 - DNA, 22 bp, Homo sapiens
gtgcctcagcaccgcctgcagc

SEQ ID NO: 8053260 - DNA, 22 bp, Homo sapiens
gtgagtaaaggttcattgaatt

SEQ ID NO: 8053261 - DNA, 22 bp, Homo sapiens
gtctcctgcccccggtgcttgg

SEQ ID NO: 8053262 - DNA, 22 bp, Homo sapiens
gtctcctgctagcaagcaccac

SEQ ID NO: 8053263 - DNA, 22 bp, Homo sapiens
gtctcctggaaatatgcccata

SEQ ID NO: 8053264 - DNA, 22 bp, Homo sapiens
gtctcctggctgcagctaagac

SEQ ID NO: 8053265 - DNA, 22 bp, Homo sapiens
gtctcctggcctccagtttctc

SEQ ID NO: 8053266 - DNA, 22 bp, Homo sapiens
gtctcctgagactgcagtcacc

SEQ ID NO: 8053267 - DNA, 22 bp, Homo sapiens
gtctcctgagccttgactgcaa

SEQ ID NO: 8053268 - DNA, 22 bp, Homo sapiens
gtctcctgccacactcagtccc

SEQ ID NO: 8053269 - DNA, 22 bp, Homo sapiens
gtctcctgaggcatccattgaa

SEQ ID NO: 8053270 - DNA, 22 bp, Homo sapiens
gtctggggtccttttggcttta

SEQ ID NO: 8053271 - DNA, 22 bp, Homo sapiens
gtctcctggcttttgtcccagt

SEQ ID NO: 8053272 - DNA, 22 bp, Homo sapiens
gtctcctgtcctgcaggatgga

SEQ ID NO: 8053273 - DNA, 22 bp, Homo sapiens
gtcctctccaggaggctctgat

SEQ ID NO: 8053274 - DNA, 22 bp, Homo sapiens
gtcctctgaaagatgaaccatg

SEQ ID NO: 8053275 - DNA, 22 bp, Homo sapiens
gtcctctgaagttgtgcaatgc

SEQ ID NO: 8053276 - DNA, 22 bp, Homo sapiens
gtcctctgatttctaggtatat

SEQ ID NO: 8053277 - DNA, 22 bp, Homo sapiens
gtcctctgagggggctgcacgc

SEQ ID NO: 8053278 - DNA, 22 bp, Homo sapiens
gtcctctgcccaggtcaaggtt

SEQ ID NO: 8053279 - DNA, 22 bp, Homo sapiens
gtcctctgactcagccttggga

SEQ ID NO: 8053280 - DNA, 22 bp, Homo sapiens
gtccctggagctgagcagtgct

SEQ ID NO: 8053281 - DNA, 21 bp, Homo sapiens
gtcctcagctgatgggagctg

SEQ ID NO: 8053282 - DNA, 22 bp, Homo sapiens
gtcctcagggaatgtggcgggt

SEQ ID NO: 8053283 - DNA, 22 bp, Homo sapiens
gtcaccaggtctgatgcagcca

SEQ ID NO: 8053284 - DNA, 22 bp, Homo sapiens
gtaatgaatgaaagaaactggg

SEQ ID NO: 8053285 - DNA, 20 bp, Homo sapiens
gtaatgaatgtaaacagtaa

SEQ ID NO: 8053286 - DNA, 22 bp, Homo sapiens
gtaatgaatagatggtggcagg

SEQ ID NO: 8053287 - DNA, 22 bp, Homo sapiens
gtaatgaatcaacattaatgat

SEQ ID NO: 8053288 - DNA, 22 bp, Homo sapiens
ggtgggcagctcttggcaggca

SEQ ID NO: 8053289 - DNA, 22 bp, Homo sapiens
ggtgggcagctcttggcaggca

SEQ ID NO: 8053290 - DNA, 22 bp, Homo sapiens
ggtgggcacccgagactggatc

SEQ ID NO: 8053291 - DNA, 22 bp, Homo sapiens
gtagatattaaaaatggcagtg

SEQ ID NO: 8053292 - DNA, 22 bp, Homo sapiens
gtagcaggtattctggtgtgag

SEQ ID NO: 8053293 - DNA, 22 bp, Homo sapiens
gtagcccacctggggagggcga

SEQ ID NO: 8053294 - DNA, 22 bp, Homo sapiens
gtagcccacctggggagggcga

SEQ ID NO: 8053295 - DNA, 22 bp, Homo sapiens
gtagcccacctggggagggcga

SEQ ID NO: 8053296 - DNA, 22 bp, Homo sapiens
ggtcagcagtttctttgaattt

SEQ ID NO: 8053297 - DNA, 22 bp, Homo sapiens
ggtagggcaaagtagggcacct

SEQ ID NO: 8053298 - DNA, 22 bp, Homo sapiens
ggtcagcatctggttgagggca

SEQ ID NO: 8053299 - DNA, 22 bp, Homo sapiens
ggtagctgcagcaggctggcaa

SEQ ID NO: 8053300 - DNA, 22 bp, Homo sapiens
ggtccaggatcaaggcatcacc

SEQ ID NO: 8053301 - DNA, 22 bp, Homo sapiens
ggtcagggggatctgtgaggta

SEQ ID NO: 8053302 - DNA, 22 bp, Homo sapiens
gggtccagatggtgagagttaa

SEQ ID NO: 8053303 - DNA, 22 bp, Homo sapiens
ggtaattctagtcattgcatca

SEQ ID NO: 8053304 - DNA, 22 bp, Homo sapiens
ggtacccagggttgcttcaagt

SEQ ID NO: 8053305 - DNA, 22 bp, Homo sapiens
gggtcaggctcagcagggcagc

SEQ ID NO: 8053306 - DNA, 22 bp, Homo sapiens
gggtcaggcctcaaggtgggct

SEQ ID NO: 8053307 - DNA, 22 bp, Homo sapiens
gggtccagactatgaagaactt

SEQ ID NO: 8053308 - DNA, 22 bp, Homo sapiens
ggtgcctgatggtgatgaggtc

SEQ ID NO: 8053309 - DNA, 22 bp, Homo sapiens
ggtgcctgtatttggggcacag

SEQ ID NO: 8053310 - DNA, 22 bp, Homo sapiens
ggtggctctgttgtcaactgat

SEQ ID NO: 8053311 - DNA, 22 bp, Homo sapiens
ggtgccttcctgccagccgcaa

SEQ ID NO: 8053312 - DNA, 22 bp, Homo sapiens
ggtgcctttggcccctggctag

SEQ ID NO: 8053313 - DNA, 21 bp, Homo sapiens
ggtgcctttgagtcatgtaac

SEQ ID NO: 8053314 - DNA, 22 bp, Homo sapiens
ggtgccagatgaggcccgcgat

SEQ ID NO: 8053315 - DNA, 22 bp, Homo sapiens
ggtgccagtgggtctcaggata

SEQ ID NO: 8053316 - DNA, 22 bp, Homo sapiens
ggtgccaggctgtagtcagggt

SEQ ID NO: 8053317 - DNA, 22 bp, Homo sapiens
ggtgccagtgggtctcaggata

SEQ ID NO: 8053318 - DNA, 22 bp, Homo sapiens
ggtgccaggctcccagctcagg

SEQ ID NO: 8053319 - DNA, 22 bp, Homo sapiens
ggtgccaggctgtagtcagggt

SEQ ID NO: 8053320 - DNA, 23 bp, Homo sapiens
ggtgggagattatccagaattat

SEQ ID NO: 8053321 - DNA, 23 bp, Homo sapiens
ggtgggagattatccagaattat

SEQ ID NO: 8053322 - DNA, 22 bp, Homo sapiens
ggtgggagagcttgctttgatg

SEQ ID NO: 8053323 - DNA, 22 bp, Homo sapiens
ggtgggagagcttgctttgatg

SEQ ID NO: 8053324 - DNA, 22 bp, Homo sapiens
ggtgggagggctgcgttcctct

SEQ ID NO: 8053325 - DNA, 22 bp, Homo sapiens
ggtgggagggctgcgttcctct

SEQ ID NO: 8053326 - DNA, 22 bp, Homo sapiens
ggtgggaggactgtttgaggca

SEQ ID NO: 8053327 - DNA, 22 bp, Homo sapiens
ggtgggaggcaggctgctccca

SEQ ID NO: 8053328 - DNA, 22 bp, Homo sapiens
ggtgggagccaacacccttctg

SEQ ID NO: 8053329 - DNA, 22 bp, Homo sapiens
ggtgggaggactgtttgaggca

SEQ ID NO: 8053330 - DNA, 22 bp, Homo sapiens
ggtgggagtgggcacagttacg

SEQ ID NO: 8053331 - DNA, 22 bp, Homo sapiens
ggtgggagtgggcacagttacg

SEQ ID NO: 8053332 - DNA, 22 bp, Homo sapiens
ggtgggagtggaacgtggaaga

SEQ ID NO: 8053333 - DNA, 16 bp, Homo sapiens
ggtgggaggtgaggtg

SEQ ID NO: 8053334 - DNA, 22 bp, Homo sapiens
ggtgcagggagaggcaggcccc

SEQ ID NO: 8053335 - DNA, 22 bp, Homo sapiens
ggtgcagggagaggcaggcccc

SEQ ID NO: 8053336 - DNA, 20 bp, Homo sapiens
ggtgcaggtaacgctgtgct

SEQ ID NO: 8053337 - DNA, 22 bp, Homo sapiens
gggggaagactgggctagtgat

SEQ ID NO: 8053338 - DNA, 22 bp, Homo sapiens
ggggcaggaggtgttctctttt

SEQ ID NO: 8053339 - DNA, 22 bp, Homo sapiens
ggggcaggaggtgttctctttt

SEQ ID NO: 8053340 - DNA, 22 bp, Homo sapiens
ggggcttttgcacgtgggaggc

SEQ ID NO: 8053341 - DNA, 22 bp, Homo sapiens
ggggcagctcccgagggcagga

SEQ ID NO: 8053342 - DNA, 22 bp, Homo sapiens
ggggcaggagcccttcttcagc

SEQ ID NO: 8053343 - DNA, 22 bp, Homo sapiens
gggtcaaggctacatggagacc

SEQ ID NO: 8053344 - DNA, 22 bp, Homo sapiens
gggtcagagttcaggtcgaggg

SEQ ID NO: 8053345 - DNA, 23 bp, Homo sapiens
gggggcgtgtcatggagggccac

SEQ ID NO: 8053346 - DNA, 22 bp, Homo sapiens
gggggcgggagacagcagtgac

SEQ ID NO: 8053347 - DNA, 20 bp, Homo sapiens
gggggccagcagcagacgcc

SEQ ID NO: 8053348 - DNA, 22 bp, Homo sapiens
gggggccagtgtctcttccttg

SEQ ID NO: 8053349 - DNA, 22 bp, Homo sapiens
gggggccagtcatctcccaaga

SEQ ID NO: 8053350 - DNA, 22 bp, Homo sapiens
gggggcggagcacgtgaccacg

SEQ ID NO: 8053351 - DNA, 22 bp, Homo sapiens
gggggcgccccatggaggtgag

SEQ ID NO: 8053352 - DNA, 22 bp, Homo sapiens
gggggcgcacagtcaccacaaa

SEQ ID NO: 8053353 - DNA, 22 bp, Homo sapiens
gggggccatcttcaaggatgtg

SEQ ID NO: 8053354 - DNA, 22 bp, Homo sapiens
gggctgggatggcttgaagatt

SEQ ID NO: 8053355 - DNA, 22 bp, Homo sapiens
gggctgggaatggctaagtatg

SEQ ID NO: 8053356 - DNA, 22 bp, Homo sapiens
gggctgggcatggtgttccctc

SEQ ID NO: 8053357 - DNA, 22 bp, Homo sapiens
gggctgggcatggtgttccctc

SEQ ID NO: 8053358 - DNA, 22 bp, Homo sapiens
gggctgggattgcttgctgtga

SEQ ID NO: 8053359 - DNA, 22 bp, Homo sapiens
gggctgggattgcttgctgtga

SEQ ID NO: 8053360 - DNA, 22 bp, Homo sapiens
gggctggggctcaataatttgt

SEQ ID NO: 8053361 - DNA, 22 bp, Homo sapiens
ggggatggtagaccggtgacgt

SEQ ID NO: 8053362 - DNA, 22 bp, Homo sapiens
ggggatggtagaccggtgacgt

SEQ ID NO: 8053363 - DNA, 22 bp, Homo sapiens
ggggatggtggcatttgtaaaa

SEQ ID NO: 8053364 - DNA, 22 bp, Homo sapiens
ggggatggaatgtagtagtgat

SEQ ID NO: 8053365 - DNA, 22 bp, Homo sapiens
ggggcagctcccgagggcagga

SEQ ID NO: 8053366 - DNA, 22 bp, Homo sapiens
ggggcagctaccggaagtaggg

SEQ ID NO: 8053367 - DNA, 22 bp, Homo sapiens
ggggcactttactgcctcatct

SEQ ID NO: 8053368 - DNA, 22 bp, Homo sapiens
ggggcacacttttggtagatat

SEQ ID NO: 8053369 - DNA, 22 bp, Homo sapiens
ggggcacttggcacctctgcag

SEQ ID NO: 8053370 - DNA, 22 bp, Homo sapiens
gggctcctgcctcctggcacct

SEQ ID NO: 8053371 - DNA, 22 bp, Homo sapiens
gggctctcgattagaccctggg

SEQ ID NO: 8053372 - DNA, 22 bp, Homo sapiens
gggctggctcccaggtgttgaa

SEQ ID NO: 8053373 - DNA, 22 bp, Homo sapiens
gggctctgaatcccaggtctgc

SEQ ID NO: 8053374 - DNA, 20 bp, Homo sapiens
gggctggcgcatggggaaag

SEQ ID NO: 8053375 - DNA, 22 bp, Homo sapiens
gggctccacagcagtgagtgga

SEQ ID NO: 8053376 - DNA, 17 bp, Homo sapiens
gggctcctcccctgggg

SEQ ID NO: 8053377 - DNA, 22 bp, Homo sapiens
gggctccaggcaggcaggaaat

SEQ ID NO: 8053378 - DNA, 22 bp, Homo sapiens
gggcctggtgcttctgactcct

SEQ ID NO: 8053379 - DNA, 21 bp, Homo sapiens
gggcctggctgcgcaggacgg

SEQ ID NO: 8053380 - DNA, 22 bp, Homo sapiens
gggcctggcatgcagccccgtt

SEQ ID NO: 8053381 - DNA, 22 bp, Homo sapiens
gggcctgctccccatcgctgct

SEQ ID NO: 8053382 - DNA, 22 bp, Homo sapiens
gggcctgccattgctgccccag

SEQ ID NO: 8053383 - DNA, 22 bp, Homo sapiens
gggcctgcaggttctgagaggc

SEQ ID NO: 8053384 - DNA, 22 bp, Homo sapiens
gggcctgcaggttctgagaggc

SEQ ID NO: 8053385 - DNA, 20 bp, Homo sapiens
gggcagttcaatgccactct

SEQ ID NO: 8053386 - DNA, 22 bp, Homo sapiens
gggcatgcaggactgtggcaga

SEQ ID NO: 8053387 - DNA, 22 bp, Homo sapiens
gggcatgacttttggagtggga

SEQ ID NO: 8053388 - DNA, 22 bp, Homo sapiens
gggcctcatgatggctcaggaa

SEQ ID NO: 8053389 - DNA, 22 bp, Homo sapiens
gggcctcaggccttgctctgtg

SEQ ID NO: 8053390 - DNA, 22 bp, Homo sapiens
gggcctcagctctgctctgcaa

SEQ ID NO: 8053391 - DNA, 22 bp, Homo sapiens
gggcctcagctggagtctgcct

SEQ ID NO: 8053392 - DNA, 22 bp, Homo sapiens
gggcctccggggtgagctgtgg

SEQ ID NO: 8053393 - DNA, 22 bp, Homo sapiens
gggcctccgtgtgctggtgctc

SEQ ID NO: 8053394 - DNA, 18 bp, Homo sapiens
ggcactggtgatgcagag

SEQ ID NO: 8053395 - DNA, 19 bp, Homo sapiens
ggcagaaggtgtaggggga

SEQ ID NO: 8053396 - DNA, 19 bp, Homo sapiens
ggcagaaggtgtaggggga

SEQ ID NO: 8053397 - DNA, 22 bp, Homo sapiens
ggcagcagcaaggttggagctg

SEQ ID NO: 8053398 - DNA, 22 bp, Homo sapiens
ggcagcagcaaggttggagctg

SEQ ID NO: 8053399 - DNA, 22 bp, Homo sapiens
ggcagcaggagccatctggtag

SEQ ID NO: 8053400 - DNA, 16 bp, Homo sapiens
ggcagcagctccgtgc

SEQ ID NO: 8053401 - DNA, 22 bp, Homo sapiens
ggcagcaggagccatctggtag

SEQ ID NO: 8053402 - DNA, 20 bp, Homo sapiens
ggcagcaggagtttcctctt

SEQ ID NO: 8053403 - DNA, 20 bp, Homo sapiens
ggcagcttgggcagcagtta

SEQ ID NO: 8053404 - DNA, 23 bp, Homo sapiens
ggcagcttgttcctttgcttcca

SEQ ID NO: 8053405 - DNA, 22 bp, Homo sapiens
ggcagctttcaatagggttatg

SEQ ID NO: 8053406 - DNA, 22 bp, Homo sapiens
ggcagctttggattcgcggctg

SEQ ID NO: 8053407 - DNA, 22 bp, Homo sapiens
ggcagctttcacctgtcttcct

SEQ ID NO: 8053408 - DNA, 22 bp, Homo sapiens
ggcagctttccttatcctaggg

SEQ ID NO: 8053409 - DNA, 22 bp, Homo sapiens
ggcagcttacgttttgctagtg

SEQ ID NO: 8053410 - DNA, 22 bp, Homo sapiens
ggcagcttcctgagccagcagc

SEQ ID NO: 8053411 - DNA, 22 bp, Homo sapiens
ggcagcttgccctggtctcaac

SEQ ID NO: 8053412 - DNA, 22 bp, Homo sapiens
ggcagcttctcccaggctgttt

SEQ ID NO: 8053413 - DNA, 22 bp, Homo sapiens
ggcagcttcggacggcttataa

SEQ ID NO: 8053414 - DNA, 22 bp, Homo sapiens
ggcagcagtccatggcccaagg

SEQ ID NO: 8053415 - DNA, 22 bp, Homo sapiens
ggcagcagtccatggcccaagg

SEQ ID NO: 8053416 - DNA, 22 bp, Homo sapiens
ggcagcagtaggagctaatctt

SEQ ID NO: 8053417 - DNA, 22 bp, Homo sapiens
ggcagcagggctgtctccctac

SEQ ID NO: 8053418 - DNA, 20 bp, Homo sapiens
ggcagcaggagtttcctctt

SEQ ID NO: 8053419 - DNA, 22 bp, Homo sapiens
ggcagccagcaatgagaagttt

SEQ ID NO: 8053420 - DNA, 22 bp, Homo sapiens
ggcagccagcaatgagaagttt

SEQ ID NO: 8053421 - DNA, 22 bp, Homo sapiens
ggcagccagcgggtggacgcgc

SEQ ID NO: 8053422 - DNA, 22 bp, Homo sapiens
ggcagccatgctccaggtgcag

SEQ ID NO: 8053423 - DNA, 22 bp, Homo sapiens
ggatgaggaagattactgagaa

SEQ ID NO: 8053424 - DNA, 19 bp, Homo sapiens
ggatgagggtcaggcatag

SEQ ID NO: 8053425 - DNA, 22 bp, Homo sapiens
ggatgaggaaaccacagtgtcc

SEQ ID NO: 8053426 - DNA, 22 bp, Homo sapiens
ggagttggtgagcaccaggctt

SEQ ID NO: 8053427 - DNA, 22 bp, Homo sapiens
ggagcagagctgggcttggctg

SEQ ID NO: 8053428 - DNA, 22 bp, Homo sapiens
ggagcagatgtcttcatggcct

SEQ ID NO: 8053429 - DNA, 22 bp, Homo sapiens
ggagttggaggctccagggaac

SEQ ID NO: 8053430 - DNA, 21 bp, Homo sapiens
ggagatgggtatcgcctgggc

SEQ ID NO: 8053431 - DNA, 22 bp, Homo sapiens
ggagatggtggaagctggtgca

SEQ ID NO: 8053432 - DNA, 22 bp, Homo sapiens
ggagatggctggcaggtagatg

SEQ ID NO: 8053433 - DNA, 22 bp, Homo sapiens
ggagatggcaagaagttattag

SEQ ID NO: 8053434 - DNA, 22 bp, Homo sapiens
ggagcaagtcccaggcactagt

SEQ ID NO: 8053435 - DNA, 22 bp, Homo sapiens
ggagcaaatgccaagtgggagg

SEQ ID NO: 8053436 - DNA, 22 bp, Homo sapiens
ggagatggtggaagctggtgca

SEQ ID NO: 8053437 - DNA, 22 bp, Homo sapiens
ggatgcatgtgcattttgaaaa

SEQ ID NO: 8053438 - DNA, 22 bp, Homo sapiens
ggatgctgactttggagcatgg

SEQ ID NO: 8053439 - DNA, 22 bp, Homo sapiens
ggatggagatgaccatggtgac

SEQ ID NO: 8053440 - DNA, 22 bp, Homo sapiens
ggatggagatgaccatggtgac

SEQ ID NO: 8053441 - DNA, 22 bp, Homo sapiens
ggatggcagtctgcatgagaaa

SEQ ID NO: 8053442 - DNA, 22 bp, Homo sapiens
ggatggcatgttgggctctgtt

SEQ ID NO: 8053443 - DNA, 22 bp, Homo sapiens
ggatgggaacttggtagggcat

SEQ ID NO: 8053444 - DNA, 22 bp, Homo sapiens
ggcaggtaggccccctctccag

SEQ ID NO: 8053445 - DNA, 17 bp, Homo sapiens
ggcaggtgacagacacc

SEQ ID NO: 8053446 - DNA, 17 bp, Homo sapiens
ggcaggtgacagacacc

SEQ ID NO: 8053447 - DNA, 22 bp, Homo sapiens
ggcaggtgacctggcctcccag

SEQ ID NO: 8053448 - DNA, 22 bp, Homo sapiens
ggcaggtgacctggcctcccag

SEQ ID NO: 8053449 - DNA, 22 bp, Homo sapiens
ggcagtgggttccccaaggcac

SEQ ID NO: 8053450 - DNA, 22 bp, Homo sapiens
ggcagtgggttccccaaggcac

SEQ ID NO: 8053451 - DNA, 22 bp, Homo sapiens
ggcaggtgagagctctttgaaa

SEQ ID NO: 8053452 - DNA, 22 bp, Homo sapiens
ggcaggtgacggggatgagtat

SEQ ID NO: 8053453 - DNA, 22 bp, Homo sapiens
ggcagggtaaaccgaggtaagt

SEQ ID NO: 8053454 - DNA, 22 bp, Homo sapiens
ggcaggaggaagagttagcacc

SEQ ID NO: 8053455 - DNA, 22 bp, Homo sapiens
ggccagctttgagctgcaggaa

SEQ ID NO: 8053456 - DNA, 22 bp, Homo sapiens
ggccagctgtaagctgctgaat

SEQ ID NO: 8053457 - DNA, 22 bp, Homo sapiens
ggcatgcaaatgtgggtgacct

SEQ ID NO: 8053458 - DNA, 22 bp, Homo sapiens
ggcatgagtggcagtgggcagt

SEQ ID NO: 8053459 - DNA, 22 bp, Homo sapiens
ggcatgagaggtcctggggatt

SEQ ID NO: 8053460 - DNA, 20 bp, Homo sapiens
ggcatgagatgtgagggagg

SEQ ID NO: 8053461 - DNA, 21 bp, Homo sapiens
ggcatgagggcagtgagcaga

SEQ ID NO: 8053462 - DNA, 22 bp, Homo sapiens
ggcagtggtgggaggctcgctc

SEQ ID NO: 8053463 - DNA, 19 bp, Homo sapiens
ggcgggtggactggagccc

SEQ ID NO: 8053464 - DNA, 22 bp, Homo sapiens
ggcctggctggttcagtaccct

SEQ ID NO: 8053465 - DNA, 22 bp, Homo sapiens
ggcctggcctcccttcctagcg

SEQ ID NO: 8053466 - DNA, 22 bp, Homo sapiens
ggcctggcatggggactaaggg

SEQ ID NO: 8053467 - DNA, 22 bp, Homo sapiens
ggcctggcctccagatgtgggc

SEQ ID NO: 8053468 - DNA, 22 bp, Homo sapiens
ggcctggcctccagatgtgggc

SEQ ID NO: 8053469 - DNA, 19 bp, Homo sapiens
ggcctggatttagggctcc

SEQ ID NO: 8053470 - DNA, 22 bp, Homo sapiens
ggcctggagtttggggaataga

SEQ ID NO: 8053471 - DNA, 22 bp, Homo sapiens
ggcctggagtcagggaaagcaa

SEQ ID NO: 8053472 - DNA, 22 bp, Homo sapiens
ggcctggagcagagactaggga

SEQ ID NO: 8053473 - DNA, 22 bp, Homo sapiens
ggcctggagcagagactaggga

SEQ ID NO: 8053474 - DNA, 22 bp, Homo sapiens
ggcctggagaaggcccagggag

SEQ ID NO: 8053475 - DNA, 22 bp, Homo sapiens
ggcctggagaaggcccagggag

SEQ ID NO: 8053476 - DNA, 22 bp, Homo sapiens
ggcctcagaccggagctggcca

SEQ ID NO: 8053477 - DNA, 22 bp, Homo sapiens
ggcctggacaaatgcaccaagg

SEQ ID NO: 8053478 - DNA, 22 bp, Homo sapiens
ggcctggaatgctttcctacca

SEQ ID NO: 8053479 - DNA, 22 bp, Homo sapiens
ggcctggacacctgaggtctta

SEQ ID NO: 8053480 - DNA, 22 bp, Homo sapiens
ggcctggacaaatgcaccaagg

SEQ ID NO: 8053481 - DNA, 22 bp, Homo sapiens
ggcctggaaggacagcgtgatg

SEQ ID NO: 8053482 - DNA, 22 bp, Homo sapiens
ggcctggaagaggacagagaaa

SEQ ID NO: 8053483 - DNA, 22 bp, Homo sapiens
ggcctggaagaggacagagaaa

SEQ ID NO: 8053484 - DNA, 22 bp, Homo sapiens
ggccaggagcaagccaggctct

SEQ ID NO: 8053485 - DNA, 22 bp, Homo sapiens
ggccaggagaggagggcactga

SEQ ID NO: 8053486 - DNA, 22 bp, Homo sapiens
ggccaggaggcaggggctcaat

SEQ ID NO: 8053487 - DNA, 22 bp, Homo sapiens
ggccaggaggcaggggctcaat

SEQ ID NO: 8053488 - DNA, 22 bp, Homo sapiens
ggccaggagctgcacagggctc

SEQ ID NO: 8053489 - DNA, 22 bp, Homo sapiens
ggccctggcagccacgaaagcc

SEQ ID NO: 8053490 - DNA, 22 bp, Homo sapiens
ggccctgctcaggctgcgatga

SEQ ID NO: 8053491 - DNA, 22 bp, Homo sapiens
ggccaggcactgtgtgagatat

SEQ ID NO: 8053492 - DNA, 22 bp, Homo sapiens
ggccaggcactgtgtgagatat

SEQ ID NO: 8053493 - DNA, 22 bp, Homo sapiens
ggccctggtcctaggggtggaa

SEQ ID NO: 8053494 - DNA, 22 bp, Homo sapiens
ggccctgggcagaggagtgggc

SEQ ID NO: 8053495 - DNA, 22 bp, Homo sapiens
ggccctgggatgctcagcagtg

SEQ ID NO: 8053496 - DNA, 22 bp, Homo sapiens
ggccctgggatgctcagcagtg

SEQ ID NO: 8053497 - DNA, 22 bp, Homo sapiens
ggcctagggcttggtcatggca

SEQ ID NO: 8053498 - DNA, 22 bp, Homo sapiens
ggctttgcagtcatgttttgct

SEQ ID NO: 8053499 - DNA, 22 bp, Homo sapiens
ggctttattttgcatgaatgct

SEQ ID NO: 8053500 - DNA, 22 bp, Homo sapiens
gggaaggctgcctgagggatgg

SEQ ID NO: 8053501 - DNA, 22 bp, Homo sapiens
gggaaggccttgtcagcggatt

SEQ ID NO: 8053502 - DNA, 22 bp, Homo sapiens
gggaagggacttgtttaaggtc

SEQ ID NO: 8053503 - DNA, 22 bp, Homo sapiens
gggaagggagggcctccagtca

SEQ ID NO: 8053504 - DNA, 22 bp, Homo sapiens
gggaagggagggacctcagtct

SEQ ID NO: 8053505 - DNA, 22 bp, Homo sapiens
gggaagggagggacctcagtct

SEQ ID NO: 8053506 - DNA, 22 bp, Homo sapiens
ggctttattaagcagggtaagt

SEQ ID NO: 8053507 - DNA, 22 bp, Homo sapiens
ggctttattaactcatccgtaa

SEQ ID NO: 8053508 - DNA, 22 bp, Homo sapiens
ggctttatgtttttcatgtggt

SEQ ID NO: 8053509 - DNA, 21 bp, Homo sapiens
ggctttatgctcacccagcct

SEQ ID NO: 8053510 - DNA, 21 bp, Homo sapiens
ggctttatgctcacccagcct

SEQ ID NO: 8053511 - DNA, 22 bp, Homo sapiens
ggctttatttgcagccattgtt

SEQ ID NO: 8053512 - DNA, 22 bp, Homo sapiens
ggctttatttgcagccattgtt

SEQ ID NO: 8053513 - DNA, 22 bp, Homo sapiens
ggctttattttgcatgaatgct

SEQ ID NO: 8053514 - DNA, 22 bp, Homo sapiens
ggctttattatgtggccatgtg

SEQ ID NO: 8053515 - DNA, 22 bp, Homo sapiens
ggctttattatgtggccatgtg

SEQ ID NO: 8053516 - DNA, 22 bp, Homo sapiens
ggctttatttcactgtaccata

SEQ ID NO: 8053517 - DNA, 22 bp, Homo sapiens
ggctttatcaaatgagaccctg

SEQ ID NO: 8053518 - DNA, 22 bp, Homo sapiens
ggctttatcaaatgagaccctg

SEQ ID NO: 8053519 - DNA, 22 bp, Homo sapiens
ggctttatgcacagcagatggt

SEQ ID NO: 8053520 - DNA, 22 bp, Homo sapiens
ggctttatgcacagcagatggt

SEQ ID NO: 8053521 - DNA, 22 bp, Homo sapiens
ggctttatgcagggatagaaat

SEQ ID NO: 8053522 - DNA, 22 bp, Homo sapiens
ggctgtgcgggcagccgtggga

SEQ ID NO: 8053523 - DNA, 22 bp, Homo sapiens
ggctttatattgtttgagcaga

SEQ ID NO: 8053524 - DNA, 22 bp, Homo sapiens
ggctgtgcctcaaggctactca

SEQ ID NO: 8053525 - DNA, 19 bp, Homo sapiens
gggagctgaggtctttggt

SEQ ID NO: 8053526 - DNA, 22 bp, Homo sapiens
gggagctggagctggaagactc

SEQ ID NO: 8053527 - DNA, 22 bp, Homo sapiens
gggagctggagctggaagactc

SEQ ID NO: 8053528 - DNA, 22 bp, Homo sapiens
gggagctgaggagccccgtcgg

SEQ ID NO: 8053529 - DNA, 22 bp, Homo sapiens
gggagctgagggacctctgtgg

SEQ ID NO: 8053530 - DNA, 22 bp, Homo sapiens
gggagctgagctctgagccacg

SEQ ID NO: 8053531 - DNA, 22 bp, Homo sapiens
gggagctgagctctgagccacg

SEQ ID NO: 8053532 - DNA, 22 bp, Homo sapiens
gggagctgagctggaagagaat

SEQ ID NO: 8053533 - DNA, 22 bp, Homo sapiens
gggagctgagctggaagagaat

SEQ ID NO: 8053534 - DNA, 21 bp, Homo sapiens
gggagctgacagcagcacggc

SEQ ID NO: 8053535 - DNA, 21 bp, Homo sapiens
gggagctgacagcagcacggc

SEQ ID NO: 8053536 - DNA, 22 bp, Homo sapiens
gggaagtgatggagccaggatt

SEQ ID NO: 8053537 - DNA, 21 bp, Homo sapiens
gggagggatggaaatgatgtt

SEQ ID NO: 8053538 - DNA, 22 bp, Homo sapiens
gggagggccaggctcacccagg

SEQ ID NO: 8053539 - DNA, 22 bp, Homo sapiens
gggaggttgaggctgcagtgag

SEQ ID NO: 8053540 - DNA, 22 bp, Homo sapiens
gggaggtgttccagtgttggta

SEQ ID NO: 8053541 - DNA, 22 bp, Homo sapiens
gggaggtgttctgccaacgcgg

SEQ ID NO: 8053542 - DNA, 22 bp, Homo sapiens
gggagctggagttgtgttgcct

SEQ ID NO: 8053543 - DNA, 22 bp, Homo sapiens
gggagctggatcgcgcgcccgg

SEQ ID NO: 8053544 - DNA, 22 bp, Homo sapiens
gggagctggcggattccccagg

SEQ ID NO: 8053545 - DNA, 22 bp, Homo sapiens
gggagctggatgattgaggcaa

SEQ ID NO: 8053546 - DNA, 22 bp, Homo sapiens
gggagggaggtgctggttcacg

SEQ ID NO: 8053547 - DNA, 22 bp, Homo sapiens
gggagggaggtgatgcttggct

SEQ ID NO: 8053548 - DNA, 22 bp, Homo sapiens
gggcaggttggcatcccgggca

SEQ ID NO: 8053549 - DNA, 23 bp, Homo sapiens
gggcaggtttttataggcttcag

SEQ ID NO: 8053550 - DNA, 22 bp, Homo sapiens
gggcaggttattggagtaggga

SEQ ID NO: 8053551 - DNA, 22 bp, Homo sapiens
gggcagtcacagtgctggagca

SEQ ID NO: 8053552 - DNA, 22 bp, Homo sapiens
gggcagtgaatattggtgggaa

SEQ ID NO: 8053553 - DNA, 19 bp, Homo sapiens
gggcagtggcactagggag

SEQ ID NO: 8053554 - DNA, 22 bp, Homo sapiens
gggcagtgacaaaggggatgaa

SEQ ID NO: 8053555 - DNA, 22 bp, Homo sapiens
gggcactggaaggctctcaggc

SEQ ID NO: 8053556 - DNA, 22 bp, Homo sapiens
gggcacctggctagtgacagtg

SEQ ID NO: 8053557 - DNA, 22 bp, Homo sapiens
gggcacctggctagtgacagtg

SEQ ID NO: 8053558 - DNA, 22 bp, Homo sapiens
gggcaccttgggtctcaggcaa

SEQ ID NO: 8053559 - DNA, 22 bp, Homo sapiens
gggcaccttgggtctcaggcaa

SEQ ID NO: 8053560 - DNA, 22 bp, Homo sapiens
gggcacagtctaaagttgggcc

SEQ ID NO: 8053561 - DNA, 22 bp, Homo sapiens
ggctaggctcacctggagagtt

SEQ ID NO: 8053562 - DNA, 22 bp, Homo sapiens
ggctaggcgggcacatggtgga

SEQ ID NO: 8053563 - DNA, 22 bp, Homo sapiens
ggctcccaggagggcctggagg

SEQ ID NO: 8053564 - DNA, 22 bp, Homo sapiens
ggctacagaggccgtgagcctg

SEQ ID NO: 8053565 - DNA, 22 bp, Homo sapiens
ggcgtgggaagtggggcttctg

SEQ ID NO: 8053566 - DNA, 22 bp, Homo sapiens
ggcggtggcgtgaaggtggctg

SEQ ID NO: 8053567 - DNA, 22 bp, Homo sapiens
ggcggtggttgagaggacggcg

SEQ ID NO: 8053568 - DNA, 22 bp, Homo sapiens
ggctagcttagagtcatgctag

SEQ ID NO: 8053569 - DNA, 22 bp, Homo sapiens
ggctctggttgaccatgatggc

SEQ ID NO: 8053570 - DNA, 22 bp, Homo sapiens
ggctctgggttctgcaatgcgt

SEQ ID NO: 8053571 - DNA, 22 bp, Homo sapiens
ggctctgggtgtgaccttgggt

SEQ ID NO: 8053572 - DNA, 23 bp, Homo sapiens
ggctctgtgctgggcctgcagga

SEQ ID NO: 8053573 - DNA, 22 bp, Homo sapiens
ggctgagccatgggcactgcag

SEQ ID NO: 8053574 - DNA, 22 bp, Homo sapiens
ggctctggggggaagtctgttg

SEQ ID NO: 8053575 - DNA, 22 bp, Homo sapiens
ggctctggggcctcctcccttg

SEQ ID NO: 8053576 - DNA, 22 bp, Homo sapiens
ggctctggggaagctctcttca

SEQ ID NO: 8053577 - DNA, 22 bp, Homo sapiens
ggctctgggtctgtggggagcg

SEQ ID NO: 8053578 - DNA, 22 bp, Homo sapiens
ggctcctgaggaccaggcacag

SEQ ID NO: 8053579 - DNA, 22 bp, Homo sapiens
ggctcctgataggagaatgcgg

SEQ ID NO: 8053580 - DNA, 22 bp, Homo sapiens
ggctggactttctgctgggctc

SEQ ID NO: 8053581 - DNA, 22 bp, Homo sapiens
ggctgggtcccagctgggagga

SEQ ID NO: 8053582 - DNA, 21 bp, Homo sapiens
ggctgggtcatgcagctggcc

SEQ ID NO: 8053583 - DNA, 21 bp, Homo sapiens
ggctgggtcatgcagctggcc

SEQ ID NO: 8053584 - DNA, 22 bp, Homo sapiens
ggctgtgccctcacatggggca

SEQ ID NO: 8053585 - DNA, 20 bp, Homo sapiens
ggctgtgcccttccgtggcc

SEQ ID NO: 8053586 - DNA, 22 bp, Homo sapiens
ggctgtgccctcacatggggca

SEQ ID NO: 8053587 - DNA, 17 bp, Homo sapiens
ggctgtgccaggtgaga

SEQ ID NO: 8053588 - DNA, 17 bp, Homo sapiens
ggctgtgccaggtgaga

SEQ ID NO: 8053589 - DNA, 22 bp, Homo sapiens
ggctgtgcaccatccacctccc

SEQ ID NO: 8053590 - DNA, 22 bp, Homo sapiens
ggctgtgattggtggatgtgaa

SEQ ID NO: 8053591 - DNA, 22 bp, Homo sapiens
ggctgaggtgtggggaactata

SEQ ID NO: 8053592 - DNA, 18 bp, Homo sapiens
ggctgaggttgactagaa

SEQ ID NO: 8053593 - DNA, 22 bp, Homo sapiens
ggctgaggggcccagaggaaca

SEQ ID NO: 8053594 - DNA, 22 bp, Homo sapiens
ggctgagggccagggctagtct

SEQ ID NO: 8053595 - DNA, 21 bp, Homo sapiens
ggctggacatcccaggagact

SEQ ID NO: 8053596 - DNA, 20 bp, Homo sapiens
ggctgctgtgggcagagagg

SEQ ID NO: 8053597 - DNA, 22 bp, Homo sapiens
ttccaaattaaaatgtacaatg

SEQ ID NO: 8053598 - DNA, 22 bp, Homo sapiens
cgggaaggtggaggttgcagtg

SEQ ID NO: 8053599 - DNA, 22 bp, Homo sapiens
ttccacattccttacattcata

SEQ ID NO: 8053600 - DNA, 22 bp, Homo sapiens
cggctgggttcggctgcaggcc

SEQ ID NO: 8053601 - DNA, 22 bp, Homo sapiens
ttcagtttccacttacatttaa

SEQ ID NO: 8053602 - DNA, 20 bp, Homo sapiens
cgcagcagtggaagtggaat

SEQ ID NO: 8053603 - DNA, 17 bp, Homo sapiens
ttcctctcacatttttt

SEQ ID NO: 8053604 - DNA, 22 bp, Homo sapiens
cgtcctcagaggccatccgaaa

SEQ ID NO: 8053605 - DNA, 22 bp, Homo sapiens
ttccttttgcaaggtcctctag

SEQ ID NO: 8053606 - DNA, 22 bp, Homo sapiens
ttctccttcctggttttcaggc

SEQ ID NO: 8053607 - DNA, 19 bp, Homo sapiens
ctagggcttggcagcaggc

SEQ ID NO: 8053608 - DNA, 22 bp, Homo sapiens
ctcagccccaattctccccatt

SEQ ID NO: 8053609 - DNA, 22 bp, Homo sapiens
ctcagcccagcccaggaccagg

SEQ ID NO: 8053610 - DNA, 22 bp, Homo sapiens
ctcagccatggggtggatcagc

SEQ ID NO: 8053611 - DNA, 22 bp, Homo sapiens
ctcagccatgtcatgcctacct

SEQ ID NO: 8053612 - DNA, 22 bp, Homo sapiens
ctcagccatgcaacatgctggg

SEQ ID NO: 8053613 - DNA, 22 bp, Homo sapiens
ctcagccagtgatctttccttt

SEQ ID NO: 8053614 - DNA, 22 bp, Homo sapiens
ctcagccagacatgacccagtc

SEQ ID NO: 8053615 - DNA, 22 bp, Homo sapiens
ctcagccagacatgacccagtc

SEQ ID NO: 8053616 - DNA, 22 bp, Homo sapiens
ctcaggcctgagtggcagtccc

SEQ ID NO: 8053617 - DNA, 22 bp, Homo sapiens
ctcaggcccacagcagacccac

SEQ ID NO: 8053618 - DNA, 22 bp, Homo sapiens
ctcaggccattcttccagctgc

SEQ ID NO: 8053619 - DNA, 22 bp, Homo sapiens
ctcaggagttggaggctacagt

SEQ ID NO: 8053620 - DNA, 22 bp, Homo sapiens
ttgatttttccagcttctagag

SEQ ID NO: 8053621 - DNA, 22 bp, Homo sapiens
ttgatttttttctactatgcgc

SEQ ID NO: 8053622 - DNA, 22 bp, Homo sapiens
ctcagcagtgacaagagagtat

SEQ ID NO: 8053623 - DNA, 22 bp, Homo sapiens
ttgcaaaaccatcctaagtaaa

SEQ ID NO: 8053624 - DNA, 22 bp, Homo sapiens
ctcaggctaagaaggccaagtg

SEQ ID NO: 8053625 - DNA, 22 bp, Homo sapiens
ttgctgggtcagaagccaggag

SEQ ID NO: 8053626 - DNA, 18 bp, Homo sapiens
ctcaggcctttccctgtg

SEQ ID NO: 8053627 - DNA, 22 bp, Homo sapiens
ttgccgccgtctgctcgccccg

SEQ ID NO: 8053628 - DNA, 22 bp, Homo sapiens
ttgaagtagtatcttaaggaca

SEQ ID NO: 8053629 - DNA, 22 bp, Homo sapiens
ttgaaatatggattgaccttga

SEQ ID NO: 8053630 - DNA, 22 bp, Homo sapiens
ttgaagtatagagtttaagaac

SEQ ID NO: 8053631 - DNA, 21 bp, Homo sapiens
ttcttcagtttaatataaaat

SEQ ID NO: 8053632 - DNA, 22 bp, Homo sapiens
ttcttcagtttggtaaatgtaa

SEQ ID NO: 8053633 - DNA, 22 bp, Homo sapiens
ctcactggcaagactacaggtg

SEQ ID NO: 8053634 - DNA, 22 bp, Homo sapiens
ttgaataggactcagcagtgat

SEQ ID NO: 8053635 - DNA, 22 bp, Homo sapiens
ttgaatagtgttttcagtatac

SEQ ID NO: 8053636 - DNA, 22 bp, Homo sapiens
ttgaatagttttggatagcata

SEQ ID NO: 8053637 - DNA, 22 bp, Homo sapiens
ttctgaaaggcatgtcaggtag

SEQ ID NO: 8053638 - DNA, 22 bp, Homo sapiens
ttctgaaagtctttttaagtta

SEQ ID NO: 8053639 - DNA, 22 bp, Homo sapiens
ttctgaaagccaattcattgaa

SEQ ID NO: 8053640 - DNA, 22 bp, Homo sapiens
ttctgaaagccaattcattgaa

SEQ ID NO: 8053641 - DNA, 22 bp, Homo sapiens
ttctgaaaggcaggttgtttgc

SEQ ID NO: 8053642 - DNA, 22 bp, Homo sapiens
ttctgaaataggagatagctgt

SEQ ID NO: 8053643 - DNA, 22 bp, Homo sapiens
ttctgaaattcgactatccaat

SEQ ID NO: 8053644 - DNA, 22 bp, Homo sapiens
ttctgaaatgagatataaggta

SEQ ID NO: 8053645 - DNA, 22 bp, Homo sapiens
ttctgaaatttcaactttacta

SEQ ID NO: 8053646 - DNA, 22 bp, Homo sapiens
ttctgaaatttcaactttacta

SEQ ID NO: 8053647 - DNA, 22 bp, Homo sapiens
ttctgaaatttctgtagatctt

SEQ ID NO: 8053648 - DNA, 20 bp, Homo sapiens
ttctgaaagcagcagaggga

SEQ ID NO: 8053649 - DNA, 22 bp, Homo sapiens
ttctgaaaccttcagtatgaag

SEQ ID NO: 8053650 - DNA, 22 bp, Homo sapiens
ttctgaaaccactgaccaacta

SEQ ID NO: 8053651 - DNA, 22 bp, Homo sapiens
ttctgaaaattgggtcatactt

SEQ ID NO: 8053652 - DNA, 23 bp, Homo sapiens
ttctgaaaatagatagtggctcc

SEQ ID NO: 8053653 - DNA, 22 bp, Homo sapiens
ttctgaaaacacactttgcagc

SEQ ID NO: 8053654 - DNA, 22 bp, Homo sapiens
tgttttctcttgaaaagcagtc

SEQ ID NO: 8053655 - DNA, 22 bp, Homo sapiens
cctgtggaccaggaggcagccc

SEQ ID NO: 8053656 - DNA, 22 bp, Homo sapiens
cctgtgcttggccagagaggtt

SEQ ID NO: 8053657 - DNA, 22 bp, Homo sapiens
ttaatgaaaggcagtttggaac

SEQ ID NO: 8053658 - DNA, 22 bp, Homo sapiens
ttaatgaatatgacaggagagg

SEQ ID NO: 8053659 - DNA, 22 bp, Homo sapiens
ttaatgaaacattgactatgat

SEQ ID NO: 8053660 - DNA, 22 bp, Homo sapiens
ttaatgaatgtgtgctaacgtt

SEQ ID NO: 8053661 - DNA, 17 bp, Homo sapiens
tgttttcattcattgct

SEQ ID NO: 8053662 - DNA, 17 bp, Homo sapiens
tgttttcattcattgct

SEQ ID NO: 8053663 - DNA, 22 bp, Homo sapiens
tgttttcatttgatgtaacaaa

SEQ ID NO: 8053664 - DNA, 22 bp, Homo sapiens
cctggggattctgacacggagt

SEQ ID NO: 8053665 - DNA, 22 bp, Homo sapiens
tgttgcattgtactgaaaagcc

SEQ ID NO: 8053666 - DNA, 22 bp, Homo sapiens
tgttgattagtgtttagactta

SEQ ID NO: 8053667 - DNA, 22 bp, Homo sapiens
tgttcccacaccagcctcagcc

SEQ ID NO: 8053668 - DNA, 22 bp, Homo sapiens
ttatgtaagtggagtcatatag

SEQ ID NO: 8053669 - DNA, 22 bp, Homo sapiens
cgcaccactgaattccagcctg

SEQ ID NO: 8053670 - DNA, 22 bp, Homo sapiens
cgcaccactgaattccagcctg

SEQ ID NO: 8053671 - DNA, 22 bp, Homo sapiens
cgcaactcagcaacttaactgc

SEQ ID NO: 8053672 - DNA, 22 bp, Homo sapiens
cgcaacctgacagagccacgtc

SEQ ID NO: 8053673 - DNA, 17 bp, Homo sapiens
cgagggcttgctggctc

SEQ ID NO: 8053674 - DNA, 21 bp, Homo sapiens
cgcagagcgaacttgcggcgc

SEQ ID NO: 8053675 - DNA, 21 bp, Homo sapiens
cgcagagcgaacttgcggcgc

SEQ ID NO: 8053676 - DNA, 22 bp, Homo sapiens
cgcagcagccccgtggtaggtg

SEQ ID NO: 8053677 - DNA, 22 bp, Homo sapiens
ttatttttaaaagttcacacag

SEQ ID NO: 8053678 - DNA, 17 bp, Homo sapiens
ttattttttgggctgag

SEQ ID NO: 8053679 - DNA, 22 bp, Homo sapiens
ttcaaaaaggtatgttcaagtc

SEQ ID NO: 8053680 - DNA, 22 bp, Homo sapiens
ccttggcttgtgggctgcagcc

SEQ ID NO: 8053681 - DNA, 22 bp, Homo sapiens
ccttgggcttgggcatagcttt

SEQ ID NO: 8053682 - DNA, 22 bp, Homo sapiens
ccttggtgatctgggctggaag

SEQ ID NO: 8053683 - DNA, 22 bp, Homo sapiens
cctttacacatggaatgggtct

SEQ ID NO: 8053684 - DNA, 22 bp, Homo sapiens
cctttacacgtaaggctgttga

SEQ ID NO: 8053685 - DNA, 21 bp, Homo sapiens
cctttacaattttgcattcct

SEQ ID NO: 8053686 - DNA, 22 bp, Homo sapiens
cctttacagtagcccttttgaa

SEQ ID NO: 8053687 - DNA, 22 bp, Homo sapiens
cctttacaaagttcttcatggg

SEQ ID NO: 8053688 - DNA, 22 bp, Homo sapiens
ccttctggagggtgtacgagag

SEQ ID NO: 8053689 - DNA, 22 bp, Homo sapiens
ccttcttctgtgtggcccaaga

SEQ ID NO: 8053690 - DNA, 22 bp, Homo sapiens
ttacctctagctctttgcttgt

SEQ ID NO: 8053691 - DNA, 22 bp, Homo sapiens
ctctggagtgcagcctggtggc

SEQ ID NO: 8053692 - DNA, 22 bp, Homo sapiens
ttttctcaggtgcttatctaag

SEQ ID NO: 8053693 - DNA, 22 bp, Homo sapiens
tttttctagctcaaagattcta

SEQ ID NO: 8053694 - DNA, 22 bp, Homo sapiens
ctgaaaaatatgttttggagaa

SEQ ID NO: 8053695 - DNA, 22 bp, Homo sapiens
ctgaaaaacgggatttggctgg

SEQ ID NO: 8053696 - DNA, 22 bp, Homo sapiens
ctgagaggggaccagggtgttt

SEQ ID NO: 8053697 - DNA, 22 bp, Homo sapiens
ctgagaggtgctggtggctgca

SEQ ID NO: 8053698 - DNA, 22 bp, Homo sapiens
ctgagagatcaagccacaggat

SEQ ID NO: 8053699 - DNA, 22 bp, Homo sapiens
ctgaggaatgagtgaggagcca

SEQ ID NO: 8053700 - DNA, 22 bp, Homo sapiens
ctgagggccctgaagcttggca

SEQ ID NO: 8053701 - DNA, 18 bp, Homo sapiens
ctgagggcaacagaggct

SEQ ID NO: 8053702 - DNA, 22 bp, Homo sapiens
ctgagggagttcctgagcccac

SEQ ID NO: 8053703 - DNA, 22 bp, Homo sapiens
ctgagggatgggctgggccgcc

SEQ ID NO: 8053704 - DNA, 22 bp, Homo sapiens
ctgagggagacagtgcggacta

SEQ ID NO: 8053705 - DNA, 22 bp, Homo sapiens
ctgagggagaagtcacgggcag

SEQ ID NO: 8053706 - DNA, 22 bp, Homo sapiens
ctgagggagagaatggggcaaa

SEQ ID NO: 8053707 - DNA, 22 bp, Homo sapiens
ctgagggagctgctggccttgg

SEQ ID NO: 8053708 - DNA, 22 bp, Homo sapiens
ctgagggaccctgtgagtacct

SEQ ID NO: 8053709 - DNA, 22 bp, Homo sapiens
ctgcctctattcactgaggcag

SEQ ID NO: 8053710 - DNA, 22 bp, Homo sapiens
ctgcctctattcactgaggcag

SEQ ID NO: 8053711 - DNA, 22 bp, Homo sapiens
ctgcctctggcctcaggcccag

SEQ ID NO: 8053712 - DNA, 22 bp, Homo sapiens
ctgccctgcttgtttccagtgg

SEQ ID NO: 8053713 - DNA, 22 bp, Homo sapiens
ctgccctgcagctccacggact

SEQ ID NO: 8053714 - DNA, 22 bp, Homo sapiens
ctgcccctggctggtgaagcag

SEQ ID NO: 8053715 - DNA, 22 bp, Homo sapiens
ctgcccctggtgatggacgcca

SEQ ID NO: 8053716 - DNA, 18 bp, Homo sapiens
ctgccccttctctgagat

SEQ ID NO: 8053717 - DNA, 18 bp, Homo sapiens
ctgccccttctctgagat

SEQ ID NO: 8053718 - DNA, 22 bp, Homo sapiens
ctgccctgcccaggccttgggc

SEQ ID NO: 8053719 - DNA, 22 bp, Homo sapiens
ctgcccctgctcatggctgtcc

SEQ ID NO: 8053720 - DNA, 22 bp, Homo sapiens
ctgcagtgcctgccactgagcc

SEQ ID NO: 8053721 - DNA, 23 bp, Homo sapiens
ctgcagtcgccggcctgggtgcc

SEQ ID NO: 8053722 - DNA, 21 bp, Homo sapiens
ctgagggccgcagctgggctc

SEQ ID NO: 8053723 - DNA, 22 bp, Homo sapiens
ctgcaggttgagcagccaggtt

SEQ ID NO: 8053724 - DNA, 22 bp, Homo sapiens
ctgcaggggctggagttggctt

SEQ ID NO: 8053725 - DNA, 22 bp, Homo sapiens
ctgctcctctgaggtagccaca

SEQ ID NO: 8053726 - DNA, 22 bp, Homo sapiens
ctgctcctggtcatcctccact

SEQ ID NO: 8053727 - DNA, 22 bp, Homo sapiens
ctgctcctggtcatcctccact

SEQ ID NO: 8053728 - DNA, 22 bp, Homo sapiens
ctgctcctccccatcaggcagc

SEQ ID NO: 8053729 - DNA, 22 bp, Homo sapiens
ctgcctgccttggcctccagga

SEQ ID NO: 8053730 - DNA, 22 bp, Homo sapiens
ctgcctgccacgttcagctgta

SEQ ID NO: 8053731 - DNA, 22 bp, Homo sapiens
ctgcctgcatgctgccatagct

SEQ ID NO: 8053732 - DNA, 22 bp, Homo sapiens
ctgcctgcaggacacctcgcta

SEQ ID NO: 8053733 - DNA, 22 bp, Homo sapiens
ctgcctgcactgcctggctcca

SEQ ID NO: 8053734 - DNA, 22 bp, Homo sapiens
ctgcctgcactgcctggctcca

SEQ ID NO: 8053735 - DNA, 22 bp, Homo sapiens
ctgcctctgttgggcatggtct

SEQ ID NO: 8053736 - DNA, 22 bp, Homo sapiens
ctgctgctgagagctcagcctg

SEQ ID NO: 8053737 - DNA, 22 bp, Homo sapiens
ctgctgctgtaaggcagaatta

SEQ ID NO: 8053738 - DNA, 22 bp, Homo sapiens
ctgctgcttagcatagcagagg

SEQ ID NO: 8053739 - DNA, 22 bp, Homo sapiens
ctgctgctcagtgtcatcatgt

SEQ ID NO: 8053740 - DNA, 22 bp, Homo sapiens
ctgctgctcgaccagtcccagg

SEQ ID NO: 8053741 - DNA, 22 bp, Homo sapiens
ctgctgctgagaatgcctcagg

SEQ ID NO: 8053742 - DNA, 22 bp, Homo sapiens
ctgctggaatctttaagctgga

SEQ ID NO: 8053743 - DNA, 22 bp, Homo sapiens
ctgctggaagtttgctgtggat

SEQ ID NO: 8053744 - DNA, 20 bp, Homo sapiens
ctgctgccctgtcagcctct

SEQ ID NO: 8053745 - DNA, 22 bp, Homo sapiens
ctgctgagccctggcacaggtg

SEQ ID NO: 8053746 - DNA, 22 bp, Homo sapiens
ctgctcctgtgggccagtggcc

SEQ ID NO: 8053747 - DNA, 22 bp, Homo sapiens
ctgctgagcatttgcagggaca

SEQ ID NO: 8053748 - DNA, 22 bp, Homo sapiens
ctcccttcaggagaggctcaca

SEQ ID NO: 8053749 - DNA, 22 bp, Homo sapiens
ctcctcaggaagtagcatgtgt

SEQ ID NO: 8053750 - DNA, 21 bp, Homo sapiens
ctcctcaggaccagccacagg

SEQ ID NO: 8053751 - DNA, 20 bp, Homo sapiens
ctcctcagttccatgggagg

SEQ ID NO: 8053752 - DNA, 22 bp, Homo sapiens
ctccctgcttgtttcccttcag

SEQ ID NO: 8053753 - DNA, 22 bp, Homo sapiens
ctcaggctgccctgacagcccc

SEQ ID NO: 8053754 - DNA, 22 bp, Homo sapiens
ctcaggcttgggaggaggccca

SEQ ID NO: 8053755 - DNA, 18 bp, Homo sapiens
ctccccagctgcccccag

SEQ ID NO: 8053756 - DNA, 22 bp, Homo sapiens
ttgtttcaaatatttcagaata

SEQ ID NO: 8053757 - DNA, 22 bp, Homo sapiens
ctcctggttcctgtcttaaata

SEQ ID NO: 8053758 - DNA, 22 bp, Homo sapiens
ctcctcagttgtcccatggaga

SEQ ID NO: 8053759 - DNA, 22 bp, Homo sapiens
ctcctggagcagcaggcgcagg

SEQ ID NO: 8053760 - DNA, 23 bp, Homo sapiens
ctcctggagggtccggccctgcc

SEQ ID NO: 8053761 - DNA, 22 bp, Homo sapiens
ctcctggatgcaggctgtctgc

SEQ ID NO: 8053762 - DNA, 22 bp, Homo sapiens
ctctgctgtctcagatgggcca

SEQ ID NO: 8053763 - DNA, 22 bp, Homo sapiens
tttcttgagcccaggaggtgga

SEQ ID NO: 8053764 - DNA, 22 bp, Homo sapiens
tttgaagggcacgacaatagtt

SEQ ID NO: 8053765 - DNA, 23 bp, Homo sapiens
tttgaagcattttgtatcttagt

SEQ ID NO: 8053766 - DNA, 22 bp, Homo sapiens
ctctggagtcaggcagccctgg

SEQ ID NO: 8053767 - DNA, 22 bp, Homo sapiens
ctctggagtaagagctatgaaa

SEQ ID NO: 8053768 - DNA, 21 bp, Homo sapiens
ctctggaggcaagggagagtg

SEQ ID NO: 8053769 - DNA, 22 bp, Homo sapiens
ctctggagggaggctgagctgg

SEQ ID NO: 8053770 - DNA, 19 bp, Homo sapiens
tttctgcagctcagagaag

SEQ ID NO: 8053771 - DNA, 22 bp, Homo sapiens
tttctgcagtctctcagaagcc

SEQ ID NO: 8053772 - DNA, 22 bp, Homo sapiens
tttctgcatctctacagttgtt

SEQ ID NO: 8053773 - DNA, 22 bp, Homo sapiens
ctctgagggctcgagggacgcg

SEQ ID NO: 8053774 - DNA, 22 bp, Homo sapiens
ctctgagctgaaacatgagcat

SEQ ID NO: 8053775 - DNA, 22 bp, Homo sapiens
ctctgagctcgtgcagtacttc

SEQ ID NO: 8053776 - DNA, 22 bp, Homo sapiens
ctctctggcccatcctgttgcc

SEQ ID NO: 8053777 - DNA, 22 bp, Homo sapiens
ctctctggatatttgtatgctg

SEQ ID NO: 8053778 - DNA, 20 bp, Homo sapiens
ctctctggaaggtgggagcc

SEQ ID NO: 8053779 - DNA, 22 bp, Homo sapiens
ctctctggacctcaactatttt

SEQ ID NO: 8053780 - DNA, 23 bp, Homo sapiens
tttctctgagaagcagttctcta

SEQ ID NO: 8053781 - DNA, 22 bp, Homo sapiens
ctctaggccatccagggccatt

SEQ ID NO: 8053782 - DNA, 22 bp, Homo sapiens
gagccctgtagcaagtcatgtc

SEQ ID NO: 8053783 - DNA, 18 bp, Homo sapiens
gagccctgagtctgcaca

SEQ ID NO: 8053784 - DNA, 22 bp, Homo sapiens
gagccctgcttccaagggggca

SEQ ID NO: 8053785 - DNA, 22 bp, Homo sapiens
gagctgagcctgggtggaccgc

SEQ ID NO: 8053786 - DNA, 22 bp, Homo sapiens
gagctgaggctgaggcctcact

SEQ ID NO: 8053787 - DNA, 22 bp, Homo sapiens
gagctgagggtctaggagggtt

SEQ ID NO: 8053788 - DNA, 22 bp, Homo sapiens
gagctgctggttgctggtgcct

SEQ ID NO: 8053789 - DNA, 22 bp, Homo sapiens
gagctgctggaagtggagccct

SEQ ID NO: 8053790 - DNA, 22 bp, Homo sapiens
gaggagagagggactgtctgca

SEQ ID NO: 8053791 - DNA, 22 bp, Homo sapiens
gagcagtggtcacagggaggga

SEQ ID NO: 8053792 - DNA, 22 bp, Homo sapiens
gagcagtgtttgtggacctgga

SEQ ID NO: 8053793 - DNA, 22 bp, Homo sapiens
gagcatcgctgagatcccagac

SEQ ID NO: 8053794 - DNA, 22 bp, Homo sapiens
gagcatggatagaaggtgggat

SEQ ID NO: 8053795 - DNA, 22 bp, Homo sapiens
gagcatggatagaaggtgggat

SEQ ID NO: 8053796 - DNA, 22 bp, Homo sapiens
gagcatggatcatgtgctgggt

SEQ ID NO: 8053797 - DNA, 22 bp, Homo sapiens
gagcatggatcatgtgctgggt

SEQ ID NO: 8053798 - DNA, 22 bp, Homo sapiens
gagcatggatcatgtgctgggt

SEQ ID NO: 8053799 - DNA, 18 bp, Homo sapiens
gagcatgggcagtgggga

SEQ ID NO: 8053800 - DNA, 18 bp, Homo sapiens
gagcatgggcagtgggga

SEQ ID NO: 8053801 - DNA, 22 bp, Homo sapiens
gagcatggtgcttcagtgaagg

SEQ ID NO: 8053802 - DNA, 16 bp, Homo sapiens
gagcatggtggcgggc

SEQ ID NO: 8053803 - DNA, 21 bp, Homo sapiens
gagcatggcttacatcagcag

SEQ ID NO: 8053804 - DNA, 22 bp, Homo sapiens
gagcatggctgcctccctgtgc

SEQ ID NO: 8053805 - DNA, 22 bp, Homo sapiens
gagcatggcagctgagggcagg

SEQ ID NO: 8053806 - DNA, 22 bp, Homo sapiens
gagaggggcgcgcagctcgcga

SEQ ID NO: 8053807 - DNA, 22 bp, Homo sapiens
gagaggggcccaagccacatag

SEQ ID NO: 8053808 - DNA, 22 bp, Homo sapiens
gagagggctgcctggtgtgagg

SEQ ID NO: 8053809 - DNA, 22 bp, Homo sapiens
gagagggctggaaacttcctgg

SEQ ID NO: 8053810 - DNA, 22 bp, Homo sapiens
gagcaggcttgcagagaagggg

SEQ ID NO: 8053811 - DNA, 22 bp, Homo sapiens
gagcaggcttgcagagaagggg

SEQ ID NO: 8053812 - DNA, 19 bp, Homo sapiens
gagcagtgaggaccaccag

SEQ ID NO: 8053813 - DNA, 22 bp, Homo sapiens
gagcagggagacaactctggtg

SEQ ID NO: 8053814 - DNA, 22 bp, Homo sapiens
gagccctgacactgagggagtt

SEQ ID NO: 8053815 - DNA, 22 bp, Homo sapiens
gagcccagtctgctcctgcgcc

SEQ ID NO: 8053816 - DNA, 22 bp, Homo sapiens
gagcccagtaggcaaagctgca

SEQ ID NO: 8053817 - DNA, 22 bp, Homo sapiens
gagcccaggttctgcttccagc

SEQ ID NO: 8053818 - DNA, 22 bp, Homo sapiens
gagcccagggcaggcaaggcag

SEQ ID NO: 8053819 - DNA, 22 bp, Homo sapiens
gagcccagggtgaaatagcagc

SEQ ID NO: 8053820 - DNA, 22 bp, Homo sapiens
gagcccaggctggggttcagag

SEQ ID NO: 8053821 - DNA, 22 bp, Homo sapiens
gagcccaggagtttgatgctgc

SEQ ID NO: 8053822 - DNA, 22 bp, Homo sapiens
gagcccaggaagtggaggctga

SEQ ID NO: 8053823 - DNA, 22 bp, Homo sapiens
gagcccagcttgcacatggagc

SEQ ID NO: 8053824 - DNA, 22 bp, Homo sapiens
gagcccaggaagtggaggctga

SEQ ID NO: 8053825 - DNA, 22 bp, Homo sapiens
gagcccagctgtccttggcaaa

SEQ ID NO: 8053826 - DNA, 22 bp, Homo sapiens
gagcccagctgtccttggcaaa

SEQ ID NO: 8053827 - DNA, 22 bp, Homo sapiens
gagcccagctgcggccctcagc

SEQ ID NO: 8053828 - DNA, 22 bp, Homo sapiens
gagcccagcccagagccatatg

SEQ ID NO: 8053829 - DNA, 22 bp, Homo sapiens
gagcccagctctacctcagact

SEQ ID NO: 8053830 - DNA, 22 bp, Homo sapiens
gagcatggttccataggttggt

SEQ ID NO: 8053831 - DNA, 22 bp, Homo sapiens
gaggctcagttatgtcatcagg

SEQ ID NO: 8053832 - DNA, 22 bp, Homo sapiens
gaggcagttcctgagtgacaag

SEQ ID NO: 8053833 - DNA, 22 bp, Homo sapiens
gaggctcacctagggagcactg

SEQ ID NO: 8053834 - DNA, 22 bp, Homo sapiens
gaggcaggcactgttatcagca

SEQ ID NO: 8053835 - DNA, 22 bp, Homo sapiens
gaggagccatagatagtgctgc

SEQ ID NO: 8053836 - DNA, 22 bp, Homo sapiens
gaggcagcttggggctgtgggt

SEQ ID NO: 8053837 - DNA, 22 bp, Homo sapiens
gaggcagcttggggctgtgggt

SEQ ID NO: 8053838 - DNA, 22 bp, Homo sapiens
gaggagccaaggtatgtgtgtt

SEQ ID NO: 8053839 - DNA, 22 bp, Homo sapiens
gaggagagcctgcactttgacc

SEQ ID NO: 8053840 - DNA, 22 bp, Homo sapiens
gaggagaggctggacgcggtga

SEQ ID NO: 8053841 - DNA, 22 bp, Homo sapiens
gaggagagggctgcgggcccac

SEQ ID NO: 8053842 - DNA, 22 bp, Homo sapiens
gaggctgcactggctaaaggct

SEQ ID NO: 8053843 - DNA, 22 bp, Homo sapiens
gaggctgcattcttcccactgc

SEQ ID NO: 8053844 - DNA, 22 bp, Homo sapiens
gagggaggggagctccaccctc

SEQ ID NO: 8053845 - DNA, 22 bp, Homo sapiens
gagggagctggagcagacgccg

SEQ ID NO: 8053846 - DNA, 22 bp, Homo sapiens
gagggagctatgaatagaagaa

SEQ ID NO: 8053847 - DNA, 22 bp, Homo sapiens
gagggctgcaatgagacagaga

SEQ ID NO: 8053848 - DNA, 22 bp, Homo sapiens
gagggctgatgttgccacctca

SEQ ID NO: 8053849 - DNA, 22 bp, Homo sapiens
gagggctgctgccagatatgcc

SEQ ID NO: 8053850 - DNA, 22 bp, Homo sapiens
gagggctgccacgttgggcgag

SEQ ID NO: 8053851 - DNA, 22 bp, Homo sapiens
gagggctgccacgttgggcgag

SEQ ID NO: 8053852 - DNA, 22 bp, Homo sapiens
gagggctgatgttgccacctca

SEQ ID NO: 8053853 - DNA, 18 bp, Homo sapiens
gagggagtagctgaggtt

SEQ ID NO: 8053854 - DNA, 22 bp, Homo sapiens
gagggagtaacgtactacagtg

SEQ ID NO: 8053855 - DNA, 22 bp, Homo sapiens
gagggaggtgatactgaacgta

SEQ ID NO: 8053856 - DNA, 22 bp, Homo sapiens
gagggcttgtaagtgggtggag

SEQ ID NO: 8053857 - DNA, 22 bp, Homo sapiens
gaggggctggcacgatggctgc

SEQ ID NO: 8053858 - DNA, 22 bp, Homo sapiens
gagggctgtgaaggagcgggtt

SEQ ID NO: 8053859 - DNA, 22 bp, Homo sapiens
gagggctggggcttaggcttag

SEQ ID NO: 8053860 - DNA, 22 bp, Homo sapiens
gagggctgtggggcatgaccag

SEQ ID NO: 8053861 - DNA, 22 bp, Homo sapiens
gagggctgtggggcatgaccag

SEQ ID NO: 8053862 - DNA, 22 bp, Homo sapiens
gagggcttccatggggagcccc

SEQ ID NO: 8053863 - DNA, 22 bp, Homo sapiens
gagggctgtgaaggagcgggtt

SEQ ID NO: 8053864 - DNA, 18 bp, Homo sapiens
gagaaagcagggaatgtt

SEQ ID NO: 8053865 - DNA, 22 bp, Homo sapiens
gagaaagctaataggaatccta

SEQ ID NO: 8053866 - DNA, 20 bp, Homo sapiens
gagacagcaaaagcctctcc

SEQ ID NO: 8053867 - DNA, 22 bp, Homo sapiens
gagaccaggaagtacagcagcc

SEQ ID NO: 8053868 - DNA, 22 bp, Homo sapiens
gagaaacctgtaaggaaggaag

SEQ ID NO: 8053869 - DNA, 22 bp, Homo sapiens
gactgcatgatgttccagagga

SEQ ID NO: 8053870 - DNA, 22 bp, Homo sapiens
gactgcagtaagcctcatgact

SEQ ID NO: 8053871 - DNA, 22 bp, Homo sapiens
gactgaggtgcccagaggtgac

SEQ ID NO: 8053872 - DNA, 22 bp, Homo sapiens
gagactttaaaaaacattaaga

SEQ ID NO: 8053873 - DNA, 22 bp, Homo sapiens
gagacggggccctggccaggcg

SEQ ID NO: 8053874 - DNA, 22 bp, Homo sapiens
gagacctcttggtatcgctagg

SEQ ID NO: 8053875 - DNA, 22 bp, Homo sapiens
gagacgtggcctttgcctgagc

SEQ ID NO: 8053876 - DNA, 20 bp, Homo sapiens
gagactggatctggagagac

SEQ ID NO: 8053877 - DNA, 22 bp, Homo sapiens
gagagggcaaacttgtagctaa

SEQ ID NO: 8053878 - DNA, 22 bp, Homo sapiens
gagagggctctgtgtgggtact

SEQ ID NO: 8053879 - DNA, 22 bp, Homo sapiens
gagagggctctgtgtgggtact

SEQ ID NO: 8053880 - DNA, 22 bp, Homo sapiens
gagagggccgggggccagctcc

SEQ ID NO: 8053881 - DNA, 21 bp, Homo sapiens
gagagggcattataggaagtg

SEQ ID NO: 8053882 - DNA, 22 bp, Homo sapiens
gagagggcaaggtagatgctac

SEQ ID NO: 8053883 - DNA, 21 bp, Homo sapiens
gagagggcattataggaagtg

SEQ ID NO: 8053884 - DNA, 22 bp, Homo sapiens
gacagacatttcctgatccaat

SEQ ID NO: 8053885 - DNA, 22 bp, Homo sapiens
gacagcagatgaagcctgcaga

SEQ ID NO: 8053886 - DNA, 22 bp, Homo sapiens
gactctgggctgagccagggcc

SEQ ID NO: 8053887 - DNA, 22 bp, Homo sapiens
gactctggtgtcagaagtgccc

SEQ ID NO: 8053888 - DNA, 22 bp, Homo sapiens
gactctggtgtcagaagtgccc

SEQ ID NO: 8053889 - DNA, 22 bp, Homo sapiens
gactctagattcatggtggagt

SEQ ID NO: 8053890 - DNA, 22 bp, Homo sapiens
gactccagggattggaagatgt

SEQ ID NO: 8053891 - DNA, 22 bp, Homo sapiens
gaccaggctagttcagagcttc

SEQ ID NO: 8053892 - DNA, 22 bp, Homo sapiens
gaccagaaagtcatgagtcagt

SEQ ID NO: 8053893 - DNA, 22 bp, Homo sapiens
gaccagaaatgattctccagct

SEQ ID NO: 8053894 - DNA, 22 bp, Homo sapiens
gaatgaatctgtaagtgacaag

SEQ ID NO: 8053895 - DNA, 22 bp, Homo sapiens
gaatgaataggtgtccagatgg

SEQ ID NO: 8053896 - DNA, 22 bp, Homo sapiens
gaatgaattcagcacatggaat

SEQ ID NO: 8053897 - DNA, 22 bp, Homo sapiens
gaatgaattttggatggtgaag

SEQ ID NO: 8053898 - DNA, 22 bp, Homo sapiens
gacacttcacctttcccagcct

SEQ ID NO: 8053899 - DNA, 22 bp, Homo sapiens
gacagacactgtgtcctcactt

SEQ ID NO: 8053900 - DNA, 22 bp, Homo sapiens
gacagacagagaatgggcttga

SEQ ID NO: 8053901 - DNA, 22 bp, Homo sapiens
gacagacaggaggcattcaggg

SEQ ID NO: 8053902 - DNA, 22 bp, Homo sapiens
gacagacaggagctcacaggca

SEQ ID NO: 8053903 - DNA, 22 bp, Homo sapiens
gacagacaggtgtggtaggcac

SEQ ID NO: 8053904 - DNA, 22 bp, Homo sapiens
gacagacatgggacttcatact

SEQ ID NO: 8053905 - DNA, 22 bp, Homo sapiens
gacagacaggggttctcctgga

SEQ ID NO: 8053906 - DNA, 22 bp, Homo sapiens
gacagacaggaggccacctgct

SEQ ID NO: 8053907 - DNA, 22 bp, Homo sapiens
gacagacacaattgatccatga

SEQ ID NO: 8053908 - DNA, 22 bp, Homo sapiens
gacagacaaatgtttttaactt

SEQ ID NO: 8053909 - DNA, 22 bp, Homo sapiens
gacagacactattggtatgcct

SEQ ID NO: 8053910 - DNA, 22 bp, Homo sapiens
gacagacacctggggggttgct

SEQ ID NO: 8053911 - DNA, 22 bp, Homo sapiens
gacagacacagggccatgattg

SEQ ID NO: 8053912 - DNA, 22 bp, Homo sapiens
gacagaaggcatctagggcacg

SEQ ID NO: 8053913 - DNA, 22 bp, Homo sapiens
gaagggctgcaggtctgggccc

SEQ ID NO: 8053914 - DNA, 20 bp, Homo sapiens
gaaaggagtgtccctgtgag

SEQ ID NO: 8053915 - DNA, 22 bp, Homo sapiens
gaagcaatctggctcccagcca

SEQ ID NO: 8053916 - DNA, 18 bp, Homo sapiens
gaaaggagagacagtagg

SEQ ID NO: 8053917 - DNA, 22 bp, Homo sapiens
gaaggagctaaagggagccctg

SEQ ID NO: 8053918 - DNA, 16 bp, Homo sapiens
gaaggagattcagaaa

SEQ ID NO: 8053919 - DNA, 22 bp, Homo sapiens
gaaggccatttttaggtagaat

SEQ ID NO: 8053920 - DNA, 22 bp, Homo sapiens
gaaggccagttttgagataggt

SEQ ID NO: 8053921 - DNA, 22 bp, Homo sapiens
gaaggcagtaaatggctgtttt

SEQ ID NO: 8053922 - DNA, 22 bp, Homo sapiens
ctggggagaagcgactcggctg

SEQ ID NO: 8053923 - DNA, 22 bp, Homo sapiens
ctggggacgtcgggcagtgttc

SEQ ID NO: 8053924 - DNA, 20 bp, Homo sapiens
ctggggagcctcgcggtggc

SEQ ID NO: 8053925 - DNA, 20 bp, Homo sapiens
ctggggagctgctcccacga

SEQ ID NO: 8053926 - DNA, 23 bp, Homo sapiens
ctggtcagaggctgctggaaggg

SEQ ID NO: 8053927 - DNA, 22 bp, Homo sapiens
ctggtcagctgaagccccacac

SEQ ID NO: 8053928 - DNA, 22 bp, Homo sapiens
ctggtgccctgtgtggcaggag

SEQ ID NO: 8053929 - DNA, 22 bp, Homo sapiens
ctggtgcatgtggccttgctct

SEQ ID NO: 8053930 - DNA, 22 bp, Homo sapiens
ctggtgccattctgtggcctag

SEQ ID NO: 8053931 - DNA, 22 bp, Homo sapiens
ctggtgcaggaaggagctggca

SEQ ID NO: 8053932 - DNA, 22 bp, Homo sapiens
ctggtgcactacagcctggaac

SEQ ID NO: 8053933 - DNA, 22 bp, Homo sapiens
ctggtgcacgtggctgcagtcg

SEQ ID NO: 8053934 - DNA, 22 bp, Homo sapiens
ctggtgcacattcgctctcata

SEQ ID NO: 8053935 - DNA, 22 bp, Homo sapiens
ctggtgagactcagggatgctt

SEQ ID NO: 8053936 - DNA, 22 bp, Homo sapiens
ctggtgcaaggctttggaatcc

SEQ ID NO: 8053937 - DNA, 22 bp, Homo sapiens
ctggtgcacatgaaagagaagg

SEQ ID NO: 8053938 - DNA, 22 bp, Homo sapiens
ctggtgcaagattccctgcttc

SEQ ID NO: 8053939 - DNA, 22 bp, Homo sapiens
ctggtgcaaaagtaattgtggt

SEQ ID NO: 8053940 - DNA, 22 bp, Homo sapiens
ctgtagccagaagcagaaggcc

SEQ ID NO: 8053941 - DNA, 22 bp, Homo sapiens
ctgtctgccaataatctatggc

SEQ ID NO: 8053942 - DNA, 22 bp, Homo sapiens
ctgtcagtaggctcccatcatt

SEQ ID NO: 8053943 - DNA, 22 bp, Homo sapiens
ctgtcagtagaccccaagctag

SEQ ID NO: 8053944 - DNA, 22 bp, Homo sapiens
ctgtattttttaagtgatctgg

SEQ ID NO: 8053945 - DNA, 22 bp, Homo sapiens
ctgtctggtcaacaactgagtg

SEQ ID NO: 8053946 - DNA, 21 bp, Homo sapiens
ctgtctggccgcgggctccgc

SEQ ID NO: 8053947 - DNA, 22 bp, Homo sapiens
ctgtctgctagaacatctatac

SEQ ID NO: 8053948 - DNA, 22 bp, Homo sapiens
ctgtgctctggcatcgctgcaa

SEQ ID NO: 8053949 - DNA, 22 bp, Homo sapiens
ctgtgctgattcagcacaggcc

SEQ ID NO: 8053950 - DNA, 22 bp, Homo sapiens
ctgtgcttacctgcccaggtga

SEQ ID NO: 8053951 - DNA, 22 bp, Homo sapiens
ctgggacatattgctagtgttg

SEQ ID NO: 8053952 - DNA, 22 bp, Homo sapiens
ctgggacagttcaggtagggca

SEQ ID NO: 8053953 - DNA, 22 bp, Homo sapiens
ctgggacagttcaggtagggca

SEQ ID NO: 8053954 - DNA, 22 bp, Homo sapiens
ctgggacatggtgctgtcttta

SEQ ID NO: 8053955 - DNA, 23 bp, Homo sapiens
ctgggacatggtaggggcacaac

SEQ ID NO: 8053956 - DNA, 23 bp, Homo sapiens
ctgggacatggtaggggcacaac

SEQ ID NO: 8053957 - DNA, 22 bp, Homo sapiens
ctgggacccacacctggaatct

SEQ ID NO: 8053958 - DNA, 22 bp, Homo sapiens
ctgggagatgactcagagcagg

SEQ ID NO: 8053959 - DNA, 22 bp, Homo sapiens
ctgggagatctgttgggactgg

SEQ ID NO: 8053960 - DNA, 22 bp, Homo sapiens
ctgggagattgaggccatggtg

SEQ ID NO: 8053961 - DNA, 22 bp, Homo sapiens
ctgggagatatgaggatctgga

SEQ ID NO: 8053962 - DNA, 22 bp, Homo sapiens
ctgggagatctcctgagggcag

SEQ ID NO: 8053963 - DNA, 22 bp, Homo sapiens
ctgggacacccagagctgcaga

SEQ ID NO: 8053964 - DNA, 22 bp, Homo sapiens
ctgggacagagcagcagtgggg

SEQ ID NO: 8053965 - DNA, 22 bp, Homo sapiens
ctgggacagagcagcagtgggg

SEQ ID NO: 8053966 - DNA, 22 bp, Homo sapiens
ctgggacagagcagcagtgggg

SEQ ID NO: 8053967 - DNA, 22 bp, Homo sapiens
ctgctgtgcagacagactctct

SEQ ID NO: 8053968 - DNA, 22 bp, Homo sapiens
ctgggcgcgtcccctgaggcgg

SEQ ID NO: 8053969 - DNA, 22 bp, Homo sapiens
ctgggccttggattgacactgt

SEQ ID NO: 8053970 - DNA, 22 bp, Homo sapiens
ctgggcttagcagctcctggtc

SEQ ID NO: 8053971 - DNA, 22 bp, Homo sapiens
ctgggccttgcatcccagagcc

SEQ ID NO: 8053972 - DNA, 22 bp, Homo sapiens
ctgggccttgccttgcccacag

SEQ ID NO: 8053973 - DNA, 22 bp, Homo sapiens
ctgggcactttggggagcctac

SEQ ID NO: 8053974 - DNA, 22 bp, Homo sapiens
ctgggcagaattttaggatggc

SEQ ID NO: 8053975 - DNA, 22 bp, Homo sapiens
ctgggcagagtccggaagatgg

SEQ ID NO: 8053976 - DNA, 22 bp, Homo sapiens
ctgggcagagctaacacctgag

SEQ ID NO: 8053977 - DNA, 22 bp, Homo sapiens
ctgggcagcctcacacaatgtt

SEQ ID NO: 8053978 - DNA, 22 bp, Homo sapiens
ctgggcagctgtatcagggagt

SEQ ID NO: 8053979 - DNA, 22 bp, Homo sapiens
ctgggcagctgtatcagggagt

SEQ ID NO: 8053980 - DNA, 22 bp, Homo sapiens
ctgggcagctaccaccactgct

SEQ ID NO: 8053981 - DNA, 22 bp, Homo sapiens
ctgggagcaagtcaggaaaggt

SEQ ID NO: 8053982 - DNA, 22 bp, Homo sapiens
ctgggagcaagaggctgcaaat

SEQ ID NO: 8053983 - DNA, 22 bp, Homo sapiens
ctgggagcgcagcaggcacaac

SEQ ID NO: 8053984 - DNA, 22 bp, Homo sapiens
ctgggagcgcagcaggcacaac

SEQ ID NO: 8053985 - DNA, 22 bp, Homo sapiens
ctgggcactgcagcaggcatca

SEQ ID NO: 8053986 - DNA, 22 bp, Homo sapiens
ctgggcacttgctcacagctct

SEQ ID NO: 8053987 - DNA, 22 bp, Homo sapiens
gaaaatttagaactgaacttct

SEQ ID NO: 8053988 - DNA, 22 bp, Homo sapiens
ctttgattccaggcacatgttt

SEQ ID NO: 8053989 - DNA, 22 bp, Homo sapiens
ctttgatttctctggtccaatc

SEQ ID NO: 8053990 - DNA, 22 bp, Homo sapiens
ctttgattcagagagaattagc

SEQ ID NO: 8053991 - DNA, 22 bp, Homo sapiens
ctttgattatcggtgtgaatgt

SEQ ID NO: 8053992 - DNA, 22 bp, Homo sapiens
cttttgattgagcagtttcaaa

SEQ ID NO: 8053993 - DNA, 22 bp, Homo sapiens
cttgttttggctagtatgatgt

SEQ ID NO: 8053994 - DNA, 22 bp, Homo sapiens
cttgttttggaacagagtgaat

SEQ ID NO: 8053995 - DNA, 22 bp, Homo sapiens
cttctgaagaggttatcataga

SEQ ID NO: 8053996 - DNA, 22 bp, Homo sapiens
ctttgaaacctgctctgcagaa

SEQ ID NO: 8053997 - DNA, 22 bp, Homo sapiens
ctttgaaattcttcagctgaag

SEQ ID NO: 8053998 - DNA, 22 bp, Homo sapiens
ctttgattcagactttgtcggc

SEQ ID NO: 8053999 - DNA, 22 bp, Homo sapiens
ctttgaaaaatggtttcctaga

SEQ ID NO: 8054000 - DNA, 22 bp, Homo sapiens
ctttgaaaacacacgaatagac

SEQ ID NO: 8054001 - DNA, 22 bp, Homo sapiens
ctttctcttcagcacccagccc

SEQ ID NO: 8054002 - DNA, 22 bp, Homo sapiens
cttaaaatctggcagttagcta

SEQ ID NO: 8054003 - DNA, 20 bp, Homo sapiens
cttaaaacctctttttctgt

SEQ ID NO: 8054004 - DNA, 22 bp, Homo sapiens
ctgttttccctggagttcagca

SEQ ID NO: 8054005 - DNA, 22 bp, Homo sapiens
ctgttttcaaagagagagaatg

SEQ ID NO: 8054006 - DNA, 22 bp, Homo sapiens
ctgttttcctgggttccatgag

SEQ ID NO: 8054007 - DNA, 22 bp, Homo sapiens
ctgtggaaagagcctttggagg

SEQ ID NO: 8054008 - DNA, 22 bp, Homo sapiens
cttacacagtctggcacttctt

SEQ ID NO: 8054009 - DNA, 22 bp, Homo sapiens
cttagaaatgcagattctcagg

SEQ ID NO: 8054010 - DNA, 22 bp, Homo sapiens
cttcatttggagaactgtgctt

SEQ ID NO: 8054011 - DNA, 22 bp, Homo sapiens
cttcatttggcaggctggcctc

SEQ ID NO: 8054012 - DNA, 18 bp, Homo sapiens
cttcatttgtagagttcc

SEQ ID NO: 8054013 - DNA, 22 bp, Homo sapiens
cttcatttccatccaactggga

SEQ ID NO: 8054014 - DNA, 22 bp, Homo sapiens
cttcatttcaggctgaagaata

SEQ ID NO: 8054015 - DNA, 22 bp, Homo sapiens
cttatacaccctcttcccaggc

SEQ ID NO: 8054016 - DNA, 22 bp, Homo sapiens
cttcctggtttgaagctcgccg

SEQ ID NO: 8054017 - DNA, 22 bp, Homo sapiens
cttccaggacaccagggtagta

SEQ ID NO: 8054018 - DNA, 22 bp, Homo sapiens
cttccttccacaccttcagaat

SEQ ID NO: 8054019 - DNA, 22 bp, Homo sapiens
cttccagaggaactctgcagtg

SEQ ID NO: 8054020 - DNA, 23 bp, Homo sapiens
cttctcagaagtctgtgccagga

SEQ ID NO: 8054021 - DNA, 22 bp, Homo sapiens
cccttgctgccacagctgccca

SEQ ID NO: 8054022 - DNA, 22 bp, Homo sapiens
tggcagggagccaccggtcatg

SEQ ID NO: 8054023 - DNA, 22 bp, Homo sapiens
tggcagggagccaccggtcatg

SEQ ID NO: 8054024 - DNA, 19 bp, Homo sapiens
tggcagggagagtttgaag

SEQ ID NO: 8054025 - DNA, 19 bp, Homo sapiens
tggcagggagagtttgaag

SEQ ID NO: 8054026 - DNA, 22 bp, Homo sapiens
tggcagggaatacagatgttta

SEQ ID NO: 8054027 - DNA, 22 bp, Homo sapiens
cccttggggtggaggttgcagt

SEQ ID NO: 8054028 - DNA, 22 bp, Homo sapiens
tggcaggtagtcagaggcgaca

SEQ ID NO: 8054029 - DNA, 19 bp, Homo sapiens
tggcaggcccaggatggac

SEQ ID NO: 8054030 - DNA, 22 bp, Homo sapiens
tggcaggcgggagccatagagg

SEQ ID NO: 8054031 - DNA, 22 bp, Homo sapiens
tggcaggctgagttggcctggt

SEQ ID NO: 8054032 - DNA, 22 bp, Homo sapiens
tggcaggctctgagtagcacct

SEQ ID NO: 8054033 - DNA, 22 bp, Homo sapiens
tggcagggaatacagatgttta

SEQ ID NO: 8054034 - DNA, 22 bp, Homo sapiens
tggcaggctgagttggcctggt

SEQ ID NO: 8054035 - DNA, 22 bp, Homo sapiens
ccctggcttggcactctccact

SEQ ID NO: 8054036 - DNA, 22 bp, Homo sapiens
ccctggaggtcagaggcctggg

SEQ ID NO: 8054037 - DNA, 22 bp, Homo sapiens
ccctggaggtggaggttgcagg

SEQ ID NO: 8054038 - DNA, 22 bp, Homo sapiens
ccctggaggtcagaggcctggg

SEQ ID NO: 8054039 - DNA, 22 bp, Homo sapiens
ccctggagggcagacagatgcc

SEQ ID NO: 8054040 - DNA, 22 bp, Homo sapiens
ccctggagggcagacagatgcc

SEQ ID NO: 8054041 - DNA, 22 bp, Homo sapiens
ccctggaggttgaggctgcagt

SEQ ID NO: 8054042 - DNA, 22 bp, Homo sapiens
ccctggaggttgaggctgcagt

SEQ ID NO: 8054043 - DNA, 22 bp, Homo sapiens
ccctggaggtggaggttgcagg

SEQ ID NO: 8054044 - DNA, 22 bp, Homo sapiens
ccctggagtagcactgggtcgc

SEQ ID NO: 8054045 - DNA, 23 bp, Homo sapiens
ccctggagtaaattcttggaagg

SEQ ID NO: 8054046 - DNA, 22 bp, Homo sapiens
ccctggagtagcactgggtcgc

SEQ ID NO: 8054047 - DNA, 22 bp, Homo sapiens
ccctggagtcaggttggcctgg

SEQ ID NO: 8054048 - DNA, 22 bp, Homo sapiens
ccctggagtgccggaatcaaga

SEQ ID NO: 8054049 - DNA, 22 bp, Homo sapiens
ccctggagtccggagctcacct

SEQ ID NO: 8054050 - DNA, 22 bp, Homo sapiens
ccctggagtcctggcagttgat

SEQ ID NO: 8054051 - DNA, 22 bp, Homo sapiens
ccctggagtcctggcagttgat

SEQ ID NO: 8054052 - DNA, 22 bp, Homo sapiens
tggcacagtcctgggtgcctgc

SEQ ID NO: 8054053 - DNA, 22 bp, Homo sapiens
ccctggagtgtgacgaggcatt

SEQ ID NO: 8054054 - DNA, 22 bp, Homo sapiens
tggcacagtgctggatggtgct

SEQ ID NO: 8054055 - DNA, 22 bp, Homo sapiens
tggcagagaacacacatgattc

SEQ ID NO: 8054056 - DNA, 22 bp, Homo sapiens
ccctggctgcttgtagtctggc

SEQ ID NO: 8054057 - DNA, 22 bp, Homo sapiens
tggcagagaacacacatgattc

SEQ ID NO: 8054058 - DNA, 22 bp, Homo sapiens
tggaggacaggactggacagcc

SEQ ID NO: 8054059 - DNA, 22 bp, Homo sapiens
ccctggaggaccccaatgtggc

SEQ ID NO: 8054060 - DNA, 22 bp, Homo sapiens
ccctggagggatttctcaatca

SEQ ID NO: 8054061 - DNA, 22 bp, Homo sapiens
tggaggcatcagagtgcttggc

SEQ ID NO: 8054062 - DNA, 22 bp, Homo sapiens
tggaggcataggcctgggccct

SEQ ID NO: 8054063 - DNA, 22 bp, Homo sapiens
tggaggagaactccctggctac

SEQ ID NO: 8054064 - DNA, 22 bp, Homo sapiens
tggaaactaggatggaagaaat

SEQ ID NO: 8054065 - DNA, 22 bp, Homo sapiens
tggaaactatagtcacaataga

SEQ ID NO: 8054066 - DNA, 22 bp, Homo sapiens
tggaaactaagactagagagac

SEQ ID NO: 8054067 - DNA, 22 bp, Homo sapiens
ccctcctcaactctggcttcca

SEQ ID NO: 8054068 - DNA, 22 bp, Homo sapiens
tggacatgtccggccagacaat

SEQ ID NO: 8054069 - DNA, 22 bp, Homo sapiens
tggacatgtcttctccaagaaa

SEQ ID NO: 8054070 - DNA, 22 bp, Homo sapiens
tggagaattctatgttgagggg

SEQ ID NO: 8054071 - DNA, 22 bp, Homo sapiens
tgcttccctgctctgcacacct

SEQ ID NO: 8054072 - DNA, 22 bp, Homo sapiens
tgctgtttcacctcccagcgat

SEQ ID NO: 8054073 - DNA, 22 bp, Homo sapiens
cccagtggggaaatagctagct

SEQ ID NO: 8054074 - DNA, 22 bp, Homo sapiens
cccagtggtgctggcatctgtg

SEQ ID NO: 8054075 - DNA, 22 bp, Homo sapiens
tgctgggcactgtctaggtact

SEQ ID NO: 8054076 - DNA, 22 bp, Homo sapiens
tgctgggcaccagtgcctgcag

SEQ ID NO: 8054077 - DNA, 23 bp, Homo sapiens
tgctggggtagtttgtggcacag

SEQ ID NO: 8054078 - DNA, 23 bp, Homo sapiens
tgctggggtagtttgtggcacag

SEQ ID NO: 8054079 - DNA, 18 bp, Homo sapiens
tgctggggtagaatccac

SEQ ID NO: 8054080 - DNA, 22 bp, Homo sapiens
ccccagctgcatacttgccaag

SEQ ID NO: 8054081 - DNA, 22 bp, Homo sapiens
ccccagctcagtgcagggacat

SEQ ID NO: 8054082 - DNA, 22 bp, Homo sapiens
tgctgggggctttctggatacc

SEQ ID NO: 8054083 - DNA, 22 bp, Homo sapiens
tgctgggggtagctctgcgtag

SEQ ID NO: 8054084 - DNA, 22 bp, Homo sapiens
tgctgggggttcagatgagtaa

SEQ ID NO: 8054085 - DNA, 22 bp, Homo sapiens
tgctgggggtgtctcaccaggc

SEQ ID NO: 8054086 - DNA, 22 bp, Homo sapiens
tgctgggggtgtctcaccaggc

SEQ ID NO: 8054087 - DNA, 22 bp, Homo sapiens
tgctcagggacaatggagaggg

SEQ ID NO: 8054088 - DNA, 22 bp, Homo sapiens
tgctcaggccctgggccatcct

SEQ ID NO: 8054089 - DNA, 22 bp, Homo sapiens
tgctcaggaggaggctgtgagg

SEQ ID NO: 8054090 - DNA, 19 bp, Homo sapiens
tgctcaggccaaggagccc

SEQ ID NO: 8054091 - DNA, 22 bp, Homo sapiens
tgctcaggaaataatgtctgtg

SEQ ID NO: 8054092 - DNA, 22 bp, Homo sapiens
tgccttctcttccctgggagct

SEQ ID NO: 8054093 - DNA, 22 bp, Homo sapiens
tgcaggtgctgtgtcaagagag

SEQ ID NO: 8054094 - DNA, 22 bp, Homo sapiens
tgcaggtgcgttttcaagcctc

SEQ ID NO: 8054095 - DNA, 22 bp, Homo sapiens
tgcaggtgctacaagaactcac

SEQ ID NO: 8054096 - DNA, 22 bp, Homo sapiens
tgcaggtgctccgggggtgccc

SEQ ID NO: 8054097 - DNA, 22 bp, Homo sapiens
tgcaggtgctgatacctactcc

SEQ ID NO: 8054098 - DNA, 22 bp, Homo sapiens
tgcaggtgctccgggggtgccc

SEQ ID NO: 8054099 - DNA, 22 bp, Homo sapiens
tgcaggtgccatcgctgctcat

SEQ ID NO: 8054100 - DNA, 22 bp, Homo sapiens
tgcaggtgccatcgctgctcat

SEQ ID NO: 8054101 - DNA, 22 bp, Homo sapiens
tgcaggtgcctcttgagcttgt

SEQ ID NO: 8054102 - DNA, 22 bp, Homo sapiens
tgcagggctacaggactacaac

SEQ ID NO: 8054103 - DNA, 22 bp, Homo sapiens
cccaggtctgtgccagctctga

SEQ ID NO: 8054104 - DNA, 22 bp, Homo sapiens
tgctcaggtgccttggctgctg

SEQ ID NO: 8054105 - DNA, 22 bp, Homo sapiens
tgctctgattggagtctgttgc

SEQ ID NO: 8054106 - DNA, 22 bp, Homo sapiens
tgctctgcacatccctcacaaa

SEQ ID NO: 8054107 - DNA, 19 bp, Homo sapiens
tgctctggagccagctctc

SEQ ID NO: 8054108 - DNA, 20 bp, Homo sapiens
tgctctggaaatggtctgag

SEQ ID NO: 8054109 - DNA, 22 bp, Homo sapiens
tgctctggacgctgagtggttt

SEQ ID NO: 8054110 - DNA, 22 bp, Homo sapiens
cctgccctgtcactggctaggg

SEQ ID NO: 8054111 - DNA, 22 bp, Homo sapiens
cctgcctgcaccttctctgggg

SEQ ID NO: 8054112 - DNA, 22 bp, Homo sapiens
tgggtggcagcttcagcatgtt

SEQ ID NO: 8054113 - DNA, 22 bp, Homo sapiens
cctgcatgtggtcagcactcct

SEQ ID NO: 8054114 - DNA, 22 bp, Homo sapiens
cctgccagacgcaccagggggc

SEQ ID NO: 8054115 - DNA, 22 bp, Homo sapiens
cctgcaggttgcagaggcggaa

SEQ ID NO: 8054116 - DNA, 17 bp, Homo sapiens
cctgcagtgcctgtcgg

SEQ ID NO: 8054117 - DNA, 22 bp, Homo sapiens
cctgcagggtgctgccacagat

SEQ ID NO: 8054118 - DNA, 22 bp, Homo sapiens
cctgcaggggagagacttctag

SEQ ID NO: 8054119 - DNA, 19 bp, Homo sapiens
cctgcagggatgagaggtt

SEQ ID NO: 8054120 - DNA, 22 bp, Homo sapiens
cctgcaggtccccggatgcgca

SEQ ID NO: 8054121 - DNA, 22 bp, Homo sapiens
cctgcagggtgctgccacagat

SEQ ID NO: 8054122 - DNA, 22 bp, Homo sapiens
tgggcctggccctgtggaggag

SEQ ID NO: 8054123 - DNA, 22 bp, Homo sapiens
tgggcctggccctgtggaggag

SEQ ID NO: 8054124 - DNA, 22 bp, Homo sapiens
tgggctcagtgggagaaagggc

SEQ ID NO: 8054125 - DNA, 22 bp, Homo sapiens
tgggctcatggcccagcactgg

SEQ ID NO: 8054126 - DNA, 22 bp, Homo sapiens
tgggcctgggagggcagacgct

SEQ ID NO: 8054127 - DNA, 19 bp, Homo sapiens
tgggctcattcaggtggtt

SEQ ID NO: 8054128 - DNA, 22 bp, Homo sapiens
tgggctcatgtttctttgagga

SEQ ID NO: 8054129 - DNA, 22 bp, Homo sapiens
tgggctccggcggcctcaggct

SEQ ID NO: 8054130 - DNA, 22 bp, Homo sapiens
tgggccgggcactgtactgggc

SEQ ID NO: 8054131 - DNA, 22 bp, Homo sapiens
tgggcctggagccctggagagt

SEQ ID NO: 8054132 - DNA, 22 bp, Homo sapiens
tgggcctggagccctggagagt

SEQ ID NO: 8054133 - DNA, 22 bp, Homo sapiens
tgggcaggcaagtgaatacctt

SEQ ID NO: 8054134 - DNA, 22 bp, Homo sapiens
tgggcaggatgcgttgattctt

SEQ ID NO: 8054135 - DNA, 22 bp, Homo sapiens
tgggcaggataatatctcatgt

SEQ ID NO: 8054136 - DNA, 22 bp, Homo sapiens
cctgcaggctgcaggccagttc

SEQ ID NO: 8054137 - DNA, 22 bp, Homo sapiens
cctgcagggaatcgaggcagaa

SEQ ID NO: 8054138 - DNA, 22 bp, Homo sapiens
cctgcaggctgcaggccagttc

SEQ ID NO: 8054139 - DNA, 22 bp, Homo sapiens
tggggagcacggtagggaaatg

SEQ ID NO: 8054140 - DNA, 19 bp, Homo sapiens
tggcaggtagtgagcagtc

SEQ ID NO: 8054141 - DNA, 22 bp, Homo sapiens
cctccagggcagacggggagca

SEQ ID NO: 8054142 - DNA, 23 bp, Homo sapiens
tggccaagataatctcagttttc

SEQ ID NO: 8054143 - DNA, 22 bp, Homo sapiens
cctcctctgtgcagctgtgggt

SEQ ID NO: 8054144 - DNA, 22 bp, Homo sapiens
cctcctggcctgtgcagagccc

SEQ ID NO: 8054145 - DNA, 22 bp, Homo sapiens
cctcctggggtgaaggatggga

SEQ ID NO: 8054146 - DNA, 22 bp, Homo sapiens
tgggaaggcagtcactgtccta

SEQ ID NO: 8054147 - DNA, 22 bp, Homo sapiens
tgggacagagtgagctttggcc

SEQ ID NO: 8054148 - DNA, 22 bp, Homo sapiens
tgggacagagtgagctttggcc

SEQ ID NO: 8054149 - DNA, 22 bp, Homo sapiens
cctctcccacgtggcagaggct

SEQ ID NO: 8054150 - DNA, 22 bp, Homo sapiens
tggcttgcttccccattctcat

SEQ ID NO: 8054151 - DNA, 21 bp, Homo sapiens
tgggagagcgttgctgtcctc

SEQ ID NO: 8054152 - DNA, 22 bp, Homo sapiens
tgggcagaaatcagtatcagat

SEQ ID NO: 8054153 - DNA, 22 bp, Homo sapiens
tgggcagaaggaagagccacct

SEQ ID NO: 8054154 - DNA, 22 bp, Homo sapiens
tgggcagaaggaagagccacct

SEQ ID NO: 8054155 - DNA, 22 bp, Homo sapiens
tgggacagattataagtctgca

SEQ ID NO: 8054156 - DNA, 22 bp, Homo sapiens
tgggacaggaggcctctggaga

SEQ ID NO: 8054157 - DNA, 22 bp, Homo sapiens
tgggacaggatgaccagaaggt

SEQ ID NO: 8054158 - DNA, 22 bp, Homo sapiens
tgggagagaattctggtgactg

SEQ ID NO: 8054159 - DNA, 23 bp, Homo sapiens
cccaagcctgtgccctctgactc

SEQ ID NO: 8054160 - DNA, 22 bp, Homo sapiens
cccaaggacacgggcagggaca

SEQ ID NO: 8054161 - DNA, 22 bp, Homo sapiens
tgcagagaagaggacagttcta

SEQ ID NO: 8054162 - DNA, 22 bp, Homo sapiens
tgcagagagacccctgggccag

SEQ ID NO: 8054163 - DNA, 22 bp, Homo sapiens
tgcagagagatcctcagggttt

SEQ ID NO: 8054164 - DNA, 19 bp, Homo sapiens
cccagaggaatgcctggaa

SEQ ID NO: 8054165 - DNA, 18 bp, Homo sapiens
cccagaggaatgcctgga

SEQ ID NO: 8054166 - DNA, 18 bp, Homo sapiens
cccagaggaatgcctgga

SEQ ID NO: 8054167 - DNA, 22 bp, Homo sapiens
cccagagctgattgttggagcc

SEQ ID NO: 8054168 - DNA, 22 bp, Homo sapiens
tgcagctgattaaagggcagac

SEQ ID NO: 8054169 - DNA, 22 bp, Homo sapiens
tgcagctgcaagtccaggtcag

SEQ ID NO: 8054170 - DNA, 23 bp, Homo sapiens
tgcagctgcctctggcgggccgg

SEQ ID NO: 8054171 - DNA, 22 bp, Homo sapiens
tgcagctgctcattctctcagt

SEQ ID NO: 8054172 - DNA, 22 bp, Homo sapiens
tgcaggcagtaggccagctcca

SEQ ID NO: 8054173 - DNA, 21 bp, Homo sapiens
tgcaggcaggcagagatgctg

SEQ ID NO: 8054174 - DNA, 22 bp, Homo sapiens
tgcaggcaggggatgagcagcc

SEQ ID NO: 8054175 - DNA, 22 bp, Homo sapiens
tgcaggcctcacacctggcacc

SEQ ID NO: 8054176 - DNA, 22 bp, Homo sapiens
tgcaggcctatggtggggcccc

SEQ ID NO: 8054177 - DNA, 22 bp, Homo sapiens
tgcaggccggccctaggcctca

SEQ ID NO: 8054178 - DNA, 22 bp, Homo sapiens
tgcaggcccagtgtagaggctc

SEQ ID NO: 8054179 - DNA, 22 bp, Homo sapiens
cccagcagcttgcacagtgctg

SEQ ID NO: 8054180 - DNA, 22 bp, Homo sapiens
cccagcagcttgcacagtgctg

SEQ ID NO: 8054181 - DNA, 22 bp, Homo sapiens
tgcagggatcctagctgaagag

SEQ ID NO: 8054182 - DNA, 22 bp, Homo sapiens
cccagcagggtctctgtgtcta

SEQ ID NO: 8054183 - DNA, 22 bp, Homo sapiens
cccagcagggtctctgtgtcta

SEQ ID NO: 8054184 - DNA, 22 bp, Homo sapiens
cccagcaggaggaggttgcagt

SEQ ID NO: 8054185 - DNA, 22 bp, Homo sapiens
cccagcaggcatgttgggagga

SEQ ID NO: 8054186 - DNA, 22 bp, Homo sapiens
cccagcaggcatgttgggagga

SEQ ID NO: 8054187 - DNA, 22 bp, Homo sapiens
tgcagggccttgggtctttctt

SEQ ID NO: 8054188 - DNA, 22 bp, Homo sapiens
tgcagggctaagtcagagcctg

SEQ ID NO: 8054189 - DNA, 22 bp, Homo sapiens
tgcagggctaagtcagagcctg

SEQ ID NO: 8054190 - DNA, 22 bp, Homo sapiens
tgcagggccttgttgatgtgct

SEQ ID NO: 8054191 - DNA, 22 bp, Homo sapiens
tgcagggccttgttgatgtgct

SEQ ID NO: 8054192 - DNA, 20 bp, Homo sapiens
tgcagggcctaaaaagggaa

SEQ ID NO: 8054193 - DNA, 22 bp, Homo sapiens
tgcagggccttctagaccatgg

SEQ ID NO: 8054194 - DNA, 22 bp, Homo sapiens
tgcagggccttctagaccatgg

SEQ ID NO: 8054195 - DNA, 22 bp, Homo sapiens
tgcagggccttgggatgtgtcc

SEQ ID NO: 8054196 - DNA, 22 bp, Homo sapiens
ccagtcccagctctgccatgct

SEQ ID NO: 8054197 - DNA, 22 bp, Homo sapiens
tgagcccagagcccttgtaggg

SEQ ID NO: 8054198 - DNA, 22 bp, Homo sapiens
tgagcccagagatctgagctat

SEQ ID NO: 8054199 - DNA, 22 bp, Homo sapiens
tgagcccagcgtcccgttctgt

SEQ ID NO: 8054200 - DNA, 22 bp, Homo sapiens
tgagcccaggaggcagaggttg

SEQ ID NO: 8054201 - DNA, 22 bp, Homo sapiens
tgagcccaggagtatgaggctg

SEQ ID NO: 8054202 - DNA, 23 bp, Homo sapiens
tgagcccaggaggtcaaggctgc

SEQ ID NO: 8054203 - DNA, 22 bp, Homo sapiens
tgagcccaggagttggagaccg

SEQ ID NO: 8054204 - DNA, 22 bp, Homo sapiens
ccagtgcccagtctccctggtc

SEQ ID NO: 8054205 - DNA, 22 bp, Homo sapiens
ccagtgcccagctgcccaggca

SEQ ID NO: 8054206 - DNA, 17 bp, Homo sapiens
ccagtgcctgtggcaac

SEQ ID NO: 8054207 - DNA, 19 bp, Homo sapiens
ccagtgccggcgctgggga

SEQ ID NO: 8054208 - DNA, 22 bp, Homo sapiens
ccagtggccatgcacgagcagc

SEQ ID NO: 8054209 - DNA, 22 bp, Homo sapiens
ccagggctgctgtgggactcca

SEQ ID NO: 8054210 - DNA, 22 bp, Homo sapiens
ccagggctgctgggggagttga

SEQ ID NO: 8054211 - DNA, 22 bp, Homo sapiens
ccagggctgctcattggctggt

SEQ ID NO: 8054212 - DNA, 21 bp, Homo sapiens
tgagcaggtgcagggaagtgg

SEQ ID NO: 8054213 - DNA, 21 bp, Homo sapiens
tgagcaggtgctgcttttatg

SEQ ID NO: 8054214 - DNA, 22 bp, Homo sapiens
ccagtcagggcaggagcctggt

SEQ ID NO: 8054215 - DNA, 22 bp, Homo sapiens
ccagtcagtcagttgctggcat

SEQ ID NO: 8054216 - DNA, 22 bp, Homo sapiens
ccagtcagccaagctgcagcgg

SEQ ID NO: 8054217 - DNA, 20 bp, Homo sapiens
ccagtccacctgagacatgt

SEQ ID NO: 8054218 - DNA, 22 bp, Homo sapiens
ccaggtggataaggtttctgga

SEQ ID NO: 8054219 - DNA, 22 bp, Homo sapiens
ccaggtggccctgccctactct

SEQ ID NO: 8054220 - DNA, 22 bp, Homo sapiens
ccaggtggacttgatttgaata

SEQ ID NO: 8054221 - DNA, 22 bp, Homo sapiens
ccaggtggaggtgtgaggtcct

SEQ ID NO: 8054222 - DNA, 22 bp, Homo sapiens
ccaggtgtgtcaccattgccca

SEQ ID NO: 8054223 - DNA, 22 bp, Homo sapiens
ccaggtgtgtcaccattgccca

SEQ ID NO: 8054224 - DNA, 17 bp, Homo sapiens
ccaggtgggaggtgggg

SEQ ID NO: 8054225 - DNA, 22 bp, Homo sapiens
ccaggtgggaggaaagcagaga

SEQ ID NO: 8054226 - DNA, 22 bp, Homo sapiens
ccaggtggcttctgcccgatgt

SEQ ID NO: 8054227 - DNA, 22 bp, Homo sapiens
ccaggtggcttctgcccgatgt

SEQ ID NO: 8054228 - DNA, 22 bp, Homo sapiens
ccatacacacaccaaatttgta

SEQ ID NO: 8054229 - DNA, 17 bp, Homo sapiens
ccatactgacatattga

SEQ ID NO: 8054230 - DNA, 22 bp, Homo sapiens
ccatcacagtccccatcgtgat

SEQ ID NO: 8054231 - DNA, 18 bp, Homo sapiens
ccatcaccctaactagtg

SEQ ID NO: 8054232 - DNA, 22 bp, Homo sapiens
tgaggctgaaactggcgataga

SEQ ID NO: 8054233 - DNA, 22 bp, Homo sapiens
tgaggccagggattccatcatt

SEQ ID NO: 8054234 - DNA, 22 bp, Homo sapiens
tgaggccatgcccgtgccggcc

SEQ ID NO: 8054235 - DNA, 17 bp, Homo sapiens
tgaggccatggcaccat

SEQ ID NO: 8054236 - DNA, 19 bp, Homo sapiens
ccaggcctctggggcctgt

SEQ ID NO: 8054237 - DNA, 22 bp, Homo sapiens
ccaggcctctggctgcttagtc

SEQ ID NO: 8054238 - DNA, 23 bp, Homo sapiens
ccaggcctctcagagggtgtgcc

SEQ ID NO: 8054239 - DNA, 22 bp, Homo sapiens
ccaggcctgattgggaatcttg

SEQ ID NO: 8054240 - DNA, 22 bp, Homo sapiens
ccaggcctgcatctgctgcgca

SEQ ID NO: 8054241 - DNA, 19 bp, Homo sapiens
tcttgcagccccagcaggc

SEQ ID NO: 8054242 - DNA, 22 bp, Homo sapiens
tcttttgtcatcccttgtacat

SEQ ID NO: 8054243 - DNA, 22 bp, Homo sapiens
tcttttgtcggtgtatcatgga

SEQ ID NO: 8054244 - DNA, 22 bp, Homo sapiens
tcttttgtagctaacacattca

SEQ ID NO: 8054245 - DNA, 22 bp, Homo sapiens
tcttttgtactcagtattgaca

SEQ ID NO: 8054246 - DNA, 22 bp, Homo sapiens
tcttttctgtaactcagtgtct

SEQ ID NO: 8054247 - DNA, 22 bp, Homo sapiens
tcttttcttcttaatggttaat

SEQ ID NO: 8054248 - DNA, 22 bp, Homo sapiens
ccaggctgtaagagtgatgttg

SEQ ID NO: 8054249 - DNA, 22 bp, Homo sapiens
ccaggctgttttcaaacttggg

SEQ ID NO: 8054250 - DNA, 22 bp, Homo sapiens
ccaggctgttttcaaacttggg

SEQ ID NO: 8054251 - DNA, 22 bp, Homo sapiens
tcttttgtggatgaagaaatgg

SEQ ID NO: 8054252 - DNA, 22 bp, Homo sapiens
tcttttgtgccaagtaatgaat

SEQ ID NO: 8054253 - DNA, 21 bp, Homo sapiens
ccaggctgggagggcagttcc

SEQ ID NO: 8054254 - DNA, 17 bp, Homo sapiens
ccagggaggggccgcgc

SEQ ID NO: 8054255 - DNA, 22 bp, Homo sapiens
ccagggagggtcctgtggcttc

SEQ ID NO: 8054256 - DNA, 23 bp, Homo sapiens
ccagggagtgctactatcaagcc

SEQ ID NO: 8054257 - DNA, 23 bp, Homo sapiens
ccagggagtgctactatcaagcc

SEQ ID NO: 8054258 - DNA, 18 bp, Homo sapiens
ccagggatgcatggtccc

SEQ ID NO: 8054259 - DNA, 22 bp, Homo sapiens
ccagggcacgttgggacagtac

SEQ ID NO: 8054260 - DNA, 22 bp, Homo sapiens
ccagggcagggaccacgtgtct

SEQ ID NO: 8054261 - DNA, 22 bp, Homo sapiens
ccagggcagtgggagaaggtgc

SEQ ID NO: 8054262 - DNA, 22 bp, Homo sapiens
ccagggcaggggctggagttca

SEQ ID NO: 8054263 - DNA, 22 bp, Homo sapiens
ccagggcaattatttggagggt

SEQ ID NO: 8054264 - DNA, 22 bp, Homo sapiens
ccagggcaataggaacactttt

SEQ ID NO: 8054265 - DNA, 22 bp, Homo sapiens
ccagggcaaatgagatcatagc

SEQ ID NO: 8054266 - DNA, 22 bp, Homo sapiens
ccagggcaacgctgtctcagag

SEQ ID NO: 8054267 - DNA, 22 bp, Homo sapiens
ccagggcaacgctgtctcagag

SEQ ID NO: 8054268 - DNA, 22 bp, Homo sapiens
ccagggctctgcttctgccatg

SEQ ID NO: 8054269 - DNA, 22 bp, Homo sapiens
ccagggctgccgcatccctggt

SEQ ID NO: 8054270 - DNA, 22 bp, Homo sapiens
ccagggctgagctgtgaccatg

SEQ ID NO: 8054271 - DNA, 22 bp, Homo sapiens
ccagggctcgggtgcttagtca

SEQ ID NO: 8054272 - DNA, 22 bp, Homo sapiens
ccagggctctatgagggtggag

SEQ ID NO: 8054273 - DNA, 22 bp, Homo sapiens
ccagggctccccagaagtaccc

SEQ ID NO: 8054274 - DNA, 22 bp, Homo sapiens
ccagggcatcctcacatcgcag

SEQ ID NO: 8054275 - DNA, 22 bp, Homo sapiens
ccagggcatcacatccagtgtt

SEQ ID NO: 8054276 - DNA, 22 bp, Homo sapiens
ccagggcatgggaagaactgaa

SEQ ID NO: 8054277 - DNA, 22 bp, Homo sapiens
ccagggcatgggaagaactgaa

SEQ ID NO: 8054278 - DNA, 22 bp, Homo sapiens
tgaagtctctgttttctcattt

SEQ ID NO: 8054279 - DNA, 22 bp, Homo sapiens
tcttagaagttcatgttccagc

SEQ ID NO: 8054280 - DNA, 22 bp, Homo sapiens
ccaggcaggcgatggtgcagtg

SEQ ID NO: 8054281 - DNA, 22 bp, Homo sapiens
ccaggcaggcgatggtgcagtg

SEQ ID NO: 8054282 - DNA, 22 bp, Homo sapiens
ccaggcctcctgtgagtggacc

SEQ ID NO: 8054283 - DNA, 19 bp, Homo sapiens
ccaggcctcctgggaggtc

SEQ ID NO: 8054284 - DNA, 22 bp, Homo sapiens
ccaggcccccgagcagaagaca

SEQ ID NO: 8054285 - DNA, 22 bp, Homo sapiens
ccaggcagagggatccccatcc

SEQ ID NO: 8054286 - DNA, 22 bp, Homo sapiens
ccaggcagagggatccccatcc

SEQ ID NO: 8054287 - DNA, 22 bp, Homo sapiens
ccaggcagagggaatagcaagt

SEQ ID NO: 8054288 - DNA, 22 bp, Homo sapiens
tctggggagggagccacaggtc

SEQ ID NO: 8054289 - DNA, 22 bp, Homo sapiens
tctggggagcagccctggtgag

SEQ ID NO: 8054290 - DNA, 22 bp, Homo sapiens
ccaggagcaacttgaaggcaag

SEQ ID NO: 8054291 - DNA, 22 bp, Homo sapiens
ccaggagcaacttgaaggcaag

SEQ ID NO: 8054292 - DNA, 22 bp, Homo sapiens
ccaggagcaccaggcctgtgcc

SEQ ID NO: 8054293 - DNA, 22 bp, Homo sapiens
tctgggcctcagtttcttcatc

SEQ ID NO: 8054294 - DNA, 22 bp, Homo sapiens
tctgggcctgtctcagagctgg

SEQ ID NO: 8054295 - DNA, 22 bp, Homo sapiens
tctgggaggctgggtcccgtcc

SEQ ID NO: 8054296 - DNA, 22 bp, Homo sapiens
tctgggccggagccgacggcag

SEQ ID NO: 8054297 - DNA, 22 bp, Homo sapiens
ccaggagcaggagctggacaga

SEQ ID NO: 8054298 - DNA, 22 bp, Homo sapiens
ccaggagcattaagagaacata

SEQ ID NO: 8054299 - DNA, 22 bp, Homo sapiens
ccaggagccactcaggcccaca

SEQ ID NO: 8054300 - DNA, 22 bp, Homo sapiens
ccaggagccctgccacaatggt

SEQ ID NO: 8054301 - DNA, 22 bp, Homo sapiens
ccaggagcagggctggctgcac

SEQ ID NO: 8054302 - DNA, 19 bp, Homo sapiens
ccaggagcagtggtgagct

SEQ ID NO: 8054303 - DNA, 22 bp, Homo sapiens
tcctggagccatgattcccctc

SEQ ID NO: 8054304 - DNA, 22 bp, Homo sapiens
tcctggagccaggacccttccc

SEQ ID NO: 8054305 - DNA, 22 bp, Homo sapiens
tcctggagccaggacccttccc

SEQ ID NO: 8054306 - DNA, 22 bp, Homo sapiens
tcctggagccacggagctttca

SEQ ID NO: 8054307 - DNA, 22 bp, Homo sapiens
tcctgaggtgctcagccaggaa

SEQ ID NO: 8054308 - DNA, 21 bp, Homo sapiens
ccaagagcaatgctaaggaga

SEQ ID NO: 8054309 - DNA, 22 bp, Homo sapiens
tcctggaggaataagttttcca

SEQ ID NO: 8054310 - DNA, 22 bp, Homo sapiens
tcctggaggacagaggcatctc

SEQ ID NO: 8054311 - DNA, 22 bp, Homo sapiens
tcctggagcttccttcatggta

SEQ ID NO: 8054312 - DNA, 20 bp, Homo sapiens
tcctggagctgcttgaattc

SEQ ID NO: 8054313 - DNA, 20 bp, Homo sapiens
tcctggagctgcttgaattc

SEQ ID NO: 8054314 - DNA, 22 bp, Homo sapiens
tcctggagcctcattcaaacac

SEQ ID NO: 8054315 - DNA, 22 bp, Homo sapiens
tcctggagctgactccgtttga

SEQ ID NO: 8054316 - DNA, 22 bp, Homo sapiens
tcctggagcttcagtttccttt

SEQ ID NO: 8054317 - DNA, 22 bp, Homo sapiens
tcctggagctggtgtctttccc

SEQ ID NO: 8054318 - DNA, 22 bp, Homo sapiens
ccacaggctgctgcaggtcccg

SEQ ID NO: 8054319 - DNA, 22 bp, Homo sapiens
catttctagggatcataaagta

SEQ ID NO: 8054320 - DNA, 22 bp, Homo sapiens
cattttatgtttatggagtgct

SEQ ID NO: 8054321 - DNA, 22 bp, Homo sapiens
tcctgagggcgattcagcaggt

SEQ ID NO: 8054322 - DNA, 22 bp, Homo sapiens
cattttgtagcaatgactgttg

SEQ ID NO: 8054323 - DNA, 22 bp, Homo sapiens
catttcatagttgtcacaataa

SEQ ID NO: 8054324 - DNA, 22 bp, Homo sapiens
catttcattcctttgaaagtgg

SEQ ID NO: 8054325 - DNA, 22 bp, Homo sapiens
catttcacgcacactcattact

SEQ ID NO: 8054326 - DNA, 22 bp, Homo sapiens
catttattgagtggccacagtg

SEQ ID NO: 8054327 - DNA, 22 bp, Homo sapiens
tccatataatgggattccttat

SEQ ID NO: 8054328 - DNA, 19 bp, Homo sapiens
tccagtttggcaggaagac

SEQ ID NO: 8054329 - DNA, 18 bp, Homo sapiens
tccagttttcccagcatc

SEQ ID NO: 8054330 - DNA, 22 bp, Homo sapiens
ccaccaggcactcacagggaag

SEQ ID NO: 8054331 - DNA, 22 bp, Homo sapiens
ccaccccaaatgaagacctctc

SEQ ID NO: 8054332 - DNA, 22 bp, Homo sapiens
ccaccccaaatgaagacctctc

SEQ ID NO: 8054333 - DNA, 22 bp, Homo sapiens
ccaccctgccttgggccagtga

SEQ ID NO: 8054334 - DNA, 22 bp, Homo sapiens
ccaccctgagccgcaagagcag

SEQ ID NO: 8054335 - DNA, 22 bp, Homo sapiens
ccaccctgaggaatggtccggc

SEQ ID NO: 8054336 - DNA, 17 bp, Homo sapiens
tctagaagtgcttacat

SEQ ID NO: 8054337 - DNA, 22 bp, Homo sapiens
tctagaaagtttgtactgattt

SEQ ID NO: 8054338 - DNA, 22 bp, Homo sapiens
tctagaagatacctgctgccaa

SEQ ID NO: 8054339 - DNA, 18 bp, Homo sapiens
tctagaaacttctctcct

SEQ ID NO: 8054340 - DNA, 22 bp, Homo sapiens
tctagaaacatgacattgatct

SEQ ID NO: 8054341 - DNA, 22 bp, Homo sapiens
tctagaaagccaaattaggaat

SEQ ID NO: 8054342 - DNA, 22 bp, Homo sapiens
tctataaattatgcagtctcag

SEQ ID NO: 8054343 - DNA, 22 bp, Homo sapiens
ccagagggccctggtctcagct

SEQ ID NO: 8054344 - DNA, 22 bp, Homo sapiens
ccagagcctcgcccggagcctc

SEQ ID NO: 8054345 - DNA, 22 bp, Homo sapiens
ccagagcctcttatgaagatcg

SEQ ID NO: 8054346 - DNA, 22 bp, Homo sapiens
ccagagcctcgcccggagcctc

SEQ ID NO: 8054347 - DNA, 22 bp, Homo sapiens
ccagagcctaagatctgatcct

SEQ ID NO: 8054348 - DNA, 22 bp, Homo sapiens
ccagagcctcaacacaggtcct

SEQ ID NO: 8054349 - DNA, 22 bp, Homo sapiens
ccagagcccctgagcttccctg

SEQ ID NO: 8054350 - DNA, 22 bp, Homo sapiens
ccagagcccgggacctggactt

SEQ ID NO: 8054351 - DNA, 22 bp, Homo sapiens
ccagagcccgggacctggactt

SEQ ID NO: 8054352 - DNA, 22 bp, Homo sapiens
ccagagccggctccctcagctt

SEQ ID NO: 8054353 - DNA, 22 bp, Homo sapiens
ccagagcagggcagcagggctc

SEQ ID NO: 8054354 - DNA, 22 bp, Homo sapiens
ccagagcatgaagggcaatgac

SEQ ID NO: 8054355 - DNA, 22 bp, Homo sapiens
ccagagccagagaggtgcctgc

SEQ ID NO: 8054356 - DNA, 22 bp, Homo sapiens
ccagagcccagggtcatgcagg

SEQ ID NO: 8054357 - DNA, 22 bp, Homo sapiens
tcacttatatttcaggagatat

SEQ ID NO: 8054358 - DNA, 22 bp, Homo sapiens
tcacttcccagacggggtggca

SEQ ID NO: 8054359 - DNA, 22 bp, Homo sapiens
tcaggaggccgtgtgctcagtg

SEQ ID NO: 8054360 - DNA, 22 bp, Homo sapiens
tcaggcagaccaccgtgggcag

SEQ ID NO: 8054361 - DNA, 22 bp, Homo sapiens
tcaggcagagctgtggagctct

SEQ ID NO: 8054362 - DNA, 22 bp, Homo sapiens
tcaggcagaggatggggagcgt

SEQ ID NO: 8054363 - DNA, 22 bp, Homo sapiens
tcaggcagagggagaagccaag

SEQ ID NO: 8054364 - DNA, 22 bp, Homo sapiens
tcatcacatgtgtagtcatccc

SEQ ID NO: 8054365 - DNA, 22 bp, Homo sapiens
tcatcacaattttatgaccctc

SEQ ID NO: 8054366 - DNA, 22 bp, Homo sapiens
tcatcacatatgtcatgatttg

SEQ ID NO: 8054367 - DNA, 22 bp, Homo sapiens
catcaggcagaggaaaggactg

SEQ ID NO: 8054368 - DNA, 22 bp, Homo sapiens
catcagctgagggtgagcagaa

SEQ ID NO: 8054369 - DNA, 22 bp, Homo sapiens
catggtgcagggcacatgagga

SEQ ID NO: 8054370 - DNA, 20 bp, Homo sapiens
catggtggaggagcagggcc

SEQ ID NO: 8054371 - DNA, 22 bp, Homo sapiens
tccaagatctacagcagtttag

SEQ ID NO: 8054372 - DNA, 22 bp, Homo sapiens
catgccaggactctggaggctt

SEQ ID NO: 8054373 - DNA, 22 bp, Homo sapiens
tcatcagtccttttcattatga

SEQ ID NO: 8054374 - DNA, 22 bp, Homo sapiens
tcatcagggatattggcctgaa

SEQ ID NO: 8054375 - DNA, 22 bp, Homo sapiens
catgctctagattctctctaat

SEQ ID NO: 8054376 - DNA, 22 bp, Homo sapiens
tccaggctttggggcaggagcg

SEQ ID NO: 8054377 - DNA, 22 bp, Homo sapiens
catgtggctttggcatgtgccc

SEQ ID NO: 8054378 - DNA, 22 bp, Homo sapiens
catgtgtcacagccttttattg

SEQ ID NO: 8054379 - DNA, 20 bp, Homo sapiens
catgtgtcagttctcaccca

SEQ ID NO: 8054380 - DNA, 22 bp, Homo sapiens
catgtgtcaaatgatgtagctg

SEQ ID NO: 8054381 - DNA, 19 bp, Homo sapiens
catgtgtcaatactgtacc

SEQ ID NO: 8054382 - DNA, 22 bp, Homo sapiens
tccaggcttcacgtctgccctc

SEQ ID NO: 8054383 - DNA, 22 bp, Homo sapiens
cattacaaccccaaattacaaa

SEQ ID NO: 8054384 - DNA, 22 bp, Homo sapiens
cattaataaacatttcagaaga

SEQ ID NO: 8054385 - DNA, 22 bp, Homo sapiens
tccaggtcccagactgggcagc

SEQ ID NO: 8054386 - DNA, 21 bp, Homo sapiens
tccagggtcagaagttcagtg

SEQ ID NO: 8054387 - DNA, 22 bp, Homo sapiens
tccagggtcagaagtcacatac

SEQ ID NO: 8054388 - DNA, 22 bp, Homo sapiens
tccagggttgtgggcttcagca

SEQ ID NO: 8054389 - DNA, 22 bp, Homo sapiens
cagggagatcttggctcctggt

SEQ ID NO: 8054390 - DNA, 22 bp, Homo sapiens
cagggagaggcatcatagggaa

SEQ ID NO: 8054391 - DNA, 22 bp, Homo sapiens
tagacatattgtatttacttaa

SEQ ID NO: 8054392 - DNA, 22 bp, Homo sapiens
tagacatagtttttatgactta

SEQ ID NO: 8054393 - DNA, 22 bp, Homo sapiens
tagacaggagtcaggctagaat

SEQ ID NO: 8054394 - DNA, 22 bp, Homo sapiens
tagacagggtggcttagaaaca

SEQ ID NO: 8054395 - DNA, 22 bp, Homo sapiens
cagggagaagtctggtcagtcc

SEQ ID NO: 8054396 - DNA, 22 bp, Homo sapiens
tagaaatgtgataatagcttaa

SEQ ID NO: 8054397 - DNA, 22 bp, Homo sapiens
caggctgcaagaaaggcattca

SEQ ID NO: 8054398 - DNA, 22 bp, Homo sapiens
caggctgcagcagcagtggccc

SEQ ID NO: 8054399 - DNA, 22 bp, Homo sapiens
caggctgatcagggctgggatg

SEQ ID NO: 8054400 - DNA, 22 bp, Homo sapiens
caggctgattaggcctcgtcca

SEQ ID NO: 8054401 - DNA, 23 bp, Homo sapiens
cagggaggagatactgtgtatct

SEQ ID NO: 8054402 - DNA, 22 bp, Homo sapiens
cagggaggctgtcttatgcctg

SEQ ID NO: 8054403 - DNA, 22 bp, Homo sapiens
cagggatgagaaagctctctaa

SEQ ID NO: 8054404 - DNA, 22 bp, Homo sapiens
cagggatgaccagagggatgtg

SEQ ID NO: 8054405 - DNA, 22 bp, Homo sapiens
tagcagcaattcaggtgtgatg

SEQ ID NO: 8054406 - DNA, 22 bp, Homo sapiens
tagcagcaagaatgggatgtgt

SEQ ID NO: 8054407 - DNA, 22 bp, Homo sapiens
tagcagcaattacacagtccgt

SEQ ID NO: 8054408 - DNA, 22 bp, Homo sapiens
tagcagcaatttcagaagtttg

SEQ ID NO: 8054409 - DNA, 22 bp, Homo sapiens
cagggatgagcagatggagcaa

SEQ ID NO: 8054410 - DNA, 22 bp, Homo sapiens
cagggatgagagatggcacaga

SEQ ID NO: 8054411 - DNA, 22 bp, Homo sapiens
tagcataatttgtagaaaatca

SEQ ID NO: 8054412 - DNA, 22 bp, Homo sapiens
tagcataacaggtaagagtgag

SEQ ID NO: 8054413 - DNA, 20 bp, Homo sapiens
tagcagcagaaagaacttag

SEQ ID NO: 8054414 - DNA, 18 bp, Homo sapiens
tagcagcactggccgctt

SEQ ID NO: 8054415 - DNA, 22 bp, Homo sapiens
tagcagcaggggaaacagctgt

SEQ ID NO: 8054416 - DNA, 22 bp, Homo sapiens
tagcagcacctacacgtcagag

SEQ ID NO: 8054417 - DNA, 22 bp, Homo sapiens
cagggcaggacagatacattac

SEQ ID NO: 8054418 - DNA, 22 bp, Homo sapiens
tagcatggctgtggtttcttct

SEQ ID NO: 8054419 - DNA, 22 bp, Homo sapiens
tagcatggggagcagaaagtca

SEQ ID NO: 8054420 - DNA, 22 bp, Homo sapiens
tagcatgggtcgcgtctctgga

SEQ ID NO: 8054421 - DNA, 20 bp, Homo sapiens
tagcatgggtgagggtagag

SEQ ID NO: 8054422 - DNA, 22 bp, Homo sapiens
tagcatggtctgacatcctttg

SEQ ID NO: 8054423 - DNA, 22 bp, Homo sapiens
tagcatggtctggaattctcag

SEQ ID NO: 8054424 - DNA, 22 bp, Homo sapiens
cagggcagttttacttctctct

SEQ ID NO: 8054425 - DNA, 22 bp, Homo sapiens
cagggcataagatgaggctgta

SEQ ID NO: 8054426 - DNA, 22 bp, Homo sapiens
cagggccaagcccctttggctg

SEQ ID NO: 8054427 - DNA, 22 bp, Homo sapiens
cagggccaagctgcagcatctg

SEQ ID NO: 8054428 - DNA, 22 bp, Homo sapiens
cagggcagtaccgccctctggc

SEQ ID NO: 8054429 - DNA, 22 bp, Homo sapiens
cagggcagtaccgccctctggc

SEQ ID NO: 8054430 - DNA, 22 bp, Homo sapiens
cagggcagtgaagaacacacgt

SEQ ID NO: 8054431 - DNA, 22 bp, Homo sapiens
cagggcagtaccgccctctggc

SEQ ID NO: 8054432 - DNA, 22 bp, Homo sapiens
cagggcagtttgtgcctatgag

SEQ ID NO: 8054433 - DNA, 22 bp, Homo sapiens
cagggcagtttgtgcctatgag

SEQ ID NO: 8054434 - DNA, 22 bp, Homo sapiens
tacacagaacctggtgtacagt

SEQ ID NO: 8054435 - DNA, 22 bp, Homo sapiens
tacacagactcttcaattcaga

SEQ ID NO: 8054436 - DNA, 22 bp, Homo sapiens
tacacagatatgtgatcaatca

SEQ ID NO: 8054437 - DNA, 22 bp, Homo sapiens
tacacagatttcagtatcatca

SEQ ID NO: 8054438 - DNA, 22 bp, Homo sapiens
gtggagcataacacactagcct

SEQ ID NO: 8054439 - DNA, 22 bp, Homo sapiens
gtggagcaggactagctgagaa

SEQ ID NO: 8054440 - DNA, 22 bp, Homo sapiens
gtggagcaatcagagggtcagt

SEQ ID NO: 8054441 - DNA, 22 bp, Homo sapiens
cagctctgccacttcctagcta

SEQ ID NO: 8054442 - DNA, 17 bp, Homo sapiens
cagctctgcatcttcct

SEQ ID NO: 8054443 - DNA, 22 bp, Homo sapiens
cagctctgcctctggggctgag

SEQ ID NO: 8054444 - DNA, 22 bp, Homo sapiens
cagctctgctgggaggatgcag

SEQ ID NO: 8054445 - DNA, 22 bp, Homo sapiens
cagctctgctgggaggatgcag

SEQ ID NO: 8054446 - DNA, 22 bp, Homo sapiens
caggccaccagatacatgcccc

SEQ ID NO: 8054447 - DNA, 22 bp, Homo sapiens
caggccacgccccggcgtgtga

SEQ ID NO: 8054448 - DNA, 22 bp, Homo sapiens
caggcccaggggtctggcccac

SEQ ID NO: 8054449 - DNA, 22 bp, Homo sapiens
caggccctcaggcaagggctct

SEQ ID NO: 8054450 - DNA, 22 bp, Homo sapiens
caggccctgcacagtggtcctg

SEQ ID NO: 8054451 - DNA, 22 bp, Homo sapiens
caggccctgccttgagggacct

SEQ ID NO: 8054452 - DNA, 22 bp, Homo sapiens
caggccctgcactaggccctgg

SEQ ID NO: 8054453 - DNA, 22 bp, Homo sapiens
caggccctcctgtgatctgcct

SEQ ID NO: 8054454 - DNA, 22 bp, Homo sapiens
caggccctcgtggtgagctggg

SEQ ID NO: 8054455 - DNA, 22 bp, Homo sapiens
caggccctcgcccgcagcgacc

SEQ ID NO: 8054456 - DNA, 22 bp, Homo sapiens
tacagacatttactccactcct

SEQ ID NO: 8054457 - DNA, 22 bp, Homo sapiens
tacagacattcaattttgaccc

SEQ ID NO: 8054458 - DNA, 22 bp, Homo sapiens
caggccctgctgctgagacctt

SEQ ID NO: 8054459 - DNA, 22 bp, Homo sapiens
caggccctgccttggcatgtgt

SEQ ID NO: 8054460 - DNA, 22 bp, Homo sapiens
tacagcagggcgctgtgatgaa

SEQ ID NO: 8054461 - DNA, 22 bp, Homo sapiens
caggccttgaaggcctgcggga

SEQ ID NO: 8054462 - DNA, 22 bp, Homo sapiens
caggcctggagtgcaatggcac

SEQ ID NO: 8054463 - DNA, 22 bp, Homo sapiens
caggcctgtgagttgaggcccc

SEQ ID NO: 8054464 - DNA, 22 bp, Homo sapiens
caggcctgtgacaccgtgtctg

SEQ ID NO: 8054465 - DNA, 22 bp, Homo sapiens
caggcctgtgagttgaggcccc

SEQ ID NO: 8054466 - DNA, 22 bp, Homo sapiens
caggctcccgctccactgggca

SEQ ID NO: 8054467 - DNA, 22 bp, Homo sapiens
caggctcactgtaaggtcagct

SEQ ID NO: 8054468 - DNA, 22 bp, Homo sapiens
caggctctaggttagtaggaga

SEQ ID NO: 8054469 - DNA, 23 bp, Homo sapiens
caggctcccggaccaggatccgc

SEQ ID NO: 8054470 - DNA, 22 bp, Homo sapiens
caggctccctgcaggccagtga

SEQ ID NO: 8054471 - DNA, 22 bp, Homo sapiens
caggctccctaagtcagcagcc

SEQ ID NO: 8054472 - DNA, 22 bp, Homo sapiens
caggctccctgggcagtggcag

SEQ ID NO: 8054473 - DNA, 20 bp, Homo sapiens
caggctccgcaggactaggg

SEQ ID NO: 8054474 - DNA, 22 bp, Homo sapiens
tatgaagatatatctgatctct

SEQ ID NO: 8054475 - DNA, 22 bp, Homo sapiens
tatgatattctaaattgacacc

SEQ ID NO: 8054476 - DNA, 22 bp, Homo sapiens
tatgaagaagttctgtgaaatg

SEQ ID NO: 8054477 - DNA, 22 bp, Homo sapiens
tatgaagaagacaaatgacact

SEQ ID NO: 8054478 - DNA, 22 bp, Homo sapiens
tatgaagacaatgatagcatga

SEQ ID NO: 8054479 - DNA, 22 bp, Homo sapiens
tatgaagaaatctttgaaaatc

SEQ ID NO: 8054480 - DNA, 22 bp, Homo sapiens
tatgaagaagacaaatgacact

SEQ ID NO: 8054481 - DNA, 22 bp, Homo sapiens
caggtggcttattagggtcagt

SEQ ID NO: 8054482 - DNA, 22 bp, Homo sapiens
caggtgggcttgggagaacact

SEQ ID NO: 8054483 - DNA, 22 bp, Homo sapiens
caggtggggagagtgtggagca

SEQ ID NO: 8054484 - DNA, 22 bp, Homo sapiens
caggtggggcgccctcaggcag

SEQ ID NO: 8054485 - DNA, 22 bp, Homo sapiens
caggtggggcagctgtgggagc

SEQ ID NO: 8054486 - DNA, 22 bp, Homo sapiens
cagtacagtaaagcaagctgaa

SEQ ID NO: 8054487 - DNA, 22 bp, Homo sapiens
cagtacaggctgccttgtccaa

SEQ ID NO: 8054488 - DNA, 22 bp, Homo sapiens
cagtacagaatctattcctgca

SEQ ID NO: 8054489 - DNA, 21 bp, Homo sapiens
cagggccaatcctgacctcta

SEQ ID NO: 8054490 - DNA, 21 bp, Homo sapiens
cagggccaatcctgacctcta

SEQ ID NO: 8054491 - DNA, 22 bp, Homo sapiens
cagggctggatcctccagactc

SEQ ID NO: 8054492 - DNA, 22 bp, Homo sapiens
cagggctggatcctccagactc

SEQ ID NO: 8054493 - DNA, 22 bp, Homo sapiens
cagggctgctggccgtgccctc

SEQ ID NO: 8054494 - DNA, 22 bp, Homo sapiens
cagggctgagtcatatagcctt

SEQ ID NO: 8054495 - DNA, 22 bp, Homo sapiens
cagggctgagtcatatagcctt

SEQ ID NO: 8054496 - DNA, 22 bp, Homo sapiens
tagtaatgatattttgattatg

SEQ ID NO: 8054497 - DNA, 22 bp, Homo sapiens
tatatacaaggtaggtttaggt

SEQ ID NO: 8054498 - DNA, 22 bp, Homo sapiens
tatattcattttaaagccatct

SEQ ID NO: 8054499 - DNA, 22 bp, Homo sapiens
tattccctatttagtaattctg

SEQ ID NO: 8054500 - DNA, 20 bp, Homo sapiens
tcaaaggcaaaggtgggtgt

SEQ ID NO: 8054501 - DNA, 22 bp, Homo sapiens
tattcccattccacttatcaag

SEQ ID NO: 8054502 - DNA, 22 bp, Homo sapiens
tattcccagcctctttctatct

SEQ ID NO: 8054503 - DNA, 22 bp, Homo sapiens
cagtcccatgagcccagaacat

SEQ ID NO: 8054504 - DNA, 22 bp, Homo sapiens
cagtcccatctcccaggtggct

SEQ ID NO: 8054505 - DNA, 22 bp, Homo sapiens
cagtctggaggtcagctggctt

SEQ ID NO: 8054506 - DNA, 22 bp, Homo sapiens
cagtctctctccttgcaggcgt

SEQ ID NO: 8054507 - DNA, 22 bp, Homo sapiens
cagtctggcacagcacactgaa

SEQ ID NO: 8054508 - DNA, 22 bp, Homo sapiens
cagtctggcacagcacactgaa

SEQ ID NO: 8054509 - DNA, 22 bp, Homo sapiens
tcactcctcattgctgcccatt

SEQ ID NO: 8054510 - DNA, 22 bp, Homo sapiens
tcacatgtgtggcagtgcaagt

SEQ ID NO: 8054511 - DNA, 22 bp, Homo sapiens
cagtggcacccacgggctgggc

SEQ ID NO: 8054512 - DNA, 22 bp, Homo sapiens
cagtggcacgatctcagctcac

SEQ ID NO: 8054513 - DNA, 22 bp, Homo sapiens
cagtggcagagaacagagacct

SEQ ID NO: 8054514 - DNA, 22 bp, Homo sapiens
cagtggcagagaacagagacct

SEQ ID NO: 8054515 - DNA, 22 bp, Homo sapiens
cagtggcaggatttcagctcag

SEQ ID NO: 8054516 - DNA, 22 bp, Homo sapiens
tcacacatttctcaagtgtagg

SEQ ID NO: 8054517 - DNA, 20 bp, Homo sapiens
tcacacatggtaagctatga

SEQ ID NO: 8054518 - DNA, 22 bp, Homo sapiens
cagtgcagttggtggcaggggt

SEQ ID NO: 8054519 - DNA, 22 bp, Homo sapiens
cagtgcaggtttagggctgggg

SEQ ID NO: 8054520 - DNA, 22 bp, Homo sapiens
cagtggaggccttgggaccttt

SEQ ID NO: 8054521 - DNA, 22 bp, Homo sapiens
cagtggcaatgggacagagcac

SEQ ID NO: 8054522 - DNA, 22 bp, Homo sapiens
cagtgctgttgtaagctcattg

SEQ ID NO: 8054523 - DNA, 22 bp, Homo sapiens
tttgaaatatgtgatgagagag

SEQ ID NO: 8054524 - DNA, 22 bp, Homo sapiens
tttgaaatgtatcagtataggt

SEQ ID NO: 8054525 - DNA, 22 bp, Homo sapiens
tttctattgatctaataaacat

SEQ ID NO: 8054526 - DNA, 22 bp, Homo sapiens
tttctagtaaaagctaattacc

SEQ ID NO: 8054527 - DNA, 22 bp, Homo sapiens
tttctatagctttcttgggagt

SEQ ID NO: 8054528 - DNA, 22 bp, Homo sapiens
tttctagatgcttttgaaaatc

SEQ ID NO: 8054529 - DNA, 22 bp, Homo sapiens
tttgaacatgctgcatgataat

SEQ ID NO: 8054530 - DNA, 22 bp, Homo sapiens
tttgaactcagcttcagacaac

SEQ ID NO: 8054531 - DNA, 22 bp, Homo sapiens
tttgaagaccttatctctaaat

SEQ ID NO: 8054532 - DNA, 23 bp, Homo sapiens
tttgaagaagtgaatatcatata

SEQ ID NO: 8054533 - DNA, 22 bp, Homo sapiens
tttgaagaagctgacctatttt

SEQ ID NO: 8054534 - DNA, 22 bp, Homo sapiens
tttgaacttctccattctgatg

SEQ ID NO: 8054535 - DNA, 22 bp, Homo sapiens
tttgaacttctacctgtcatat

SEQ ID NO: 8054536 - DNA, 22 bp, Homo sapiens
tttgaagacagatcaatataag

SEQ ID NO: 8054537 - DNA, 22 bp, Homo sapiens
tttgaagacatattgttacata

SEQ ID NO: 8054538 - DNA, 22 bp, Homo sapiens
tttgaagacatttgaatacttt

SEQ ID NO: 8054539 - DNA, 22 bp, Homo sapiens
tttgcattagtttagatttcaa

SEQ ID NO: 8054540 - DNA, 22 bp, Homo sapiens
tttgcattcctgcctgcattca

SEQ ID NO: 8054541 - DNA, 22 bp, Homo sapiens
tttgcatttctcgtaaggaaac

SEQ ID NO: 8054542 - DNA, 22 bp, Homo sapiens
tttgcatttccagagtagcaga

SEQ ID NO: 8054543 - DNA, 22 bp, Homo sapiens
tttgcatttgttcaagtattga

SEQ ID NO: 8054544 - DNA, 22 bp, Homo sapiens
tttgcatttgcaaataatgaaa

SEQ ID NO: 8054545 - DNA, 22 bp, Homo sapiens
tttgcattgcctctgacttatg

SEQ ID NO: 8054546 - DNA, 22 bp, Homo sapiens
tttgcattgtttcaaaagtgaa

SEQ ID NO: 8054547 - DNA, 22 bp, Homo sapiens
tttgcattgtaatatttagttc

SEQ ID NO: 8054548 - DNA, 22 bp, Homo sapiens
tttgcattgcattaagtattct

SEQ ID NO: 8054549 - DNA, 22 bp, Homo sapiens
tttgcattgcatacaaggaact

SEQ ID NO: 8054550 - DNA, 22 bp, Homo sapiens
tttgcttcctagttgggtaata

SEQ ID NO: 8054551 - DNA, 16 bp, Homo sapiens
ttttattgtgacagcc

SEQ ID NO: 8054552 - DNA, 22 bp, Homo sapiens
ttttattgtctcccagttctgg

SEQ ID NO: 8054553 - DNA, 22 bp, Homo sapiens
ttttattgtcaatgaagacaga

SEQ ID NO: 8054554 - DNA, 22 bp, Homo sapiens
ttttattgtctgtattgcctat

SEQ ID NO: 8054555 - DNA, 22 bp, Homo sapiens
ttttacttaattcttggtcatg

SEQ ID NO: 8054556 - DNA, 22 bp, Homo sapiens
ttttattggtaatgataaaagt

SEQ ID NO: 8054557 - DNA, 22 bp, Homo sapiens
ttttattgggagtcctctactg

SEQ ID NO: 8054558 - DNA, 22 bp, Homo sapiens
ttttccttctagagcagatttc

SEQ ID NO: 8054559 - DNA, 22 bp, Homo sapiens
tttttgttctgattatactggt

SEQ ID NO: 8054560 - DNA, 22 bp, Homo sapiens
ttttttccaacttaagacttca

SEQ ID NO: 8054561 - DNA, 22 bp, Homo sapiens
ttttgtctaagaactttgcaaa

SEQ ID NO: 8054562 - DNA, 22 bp, Homo sapiens
tttttgtatagaaatgaactaa

SEQ ID NO: 8054563 - DNA, 22 bp, Homo sapiens
tttttgtagtcattagaagagg

SEQ ID NO: 8054564 - DNA, 17 bp, Homo sapiens
ttttgttcatcttcaaa

SEQ ID NO: 8054565 - DNA, 22 bp, Homo sapiens
ttttgtgatggcattacattta

SEQ ID NO: 8054566 - DNA, 23 bp, Homo sapiens
ttgaaaaatatagtcccattgtc

SEQ ID NO: 8054567 - DNA, 22 bp, Homo sapiens
ttgaaaaaattggtagaggatg

SEQ ID NO: 8054568 - DNA, 22 bp, Homo sapiens
ttgaaacagtagctcatagacc

SEQ ID NO: 8054569 - DNA, 22 bp, Homo sapiens
ttgaaagatatgttaatctttc

SEQ ID NO: 8054570 - DNA, 22 bp, Homo sapiens
ttgacatatagcataaggataa

SEQ ID NO: 8054571 - DNA, 22 bp, Homo sapiens
ttgacataggatgtatcagtca

SEQ ID NO: 8054572 - DNA, 22 bp, Homo sapiens
ttgaaagaactcttcagagata

SEQ ID NO: 8054573 - DNA, 22 bp, Homo sapiens
ttgaaagacattatttatatat

SEQ ID NO: 8054574 - DNA, 22 bp, Homo sapiens
ttgaaactcccttttgtctagt

SEQ ID NO: 8054575 - DNA, 19 bp, Homo sapiens
ttctttgagttcttctgag

SEQ ID NO: 8054576 - DNA, 22 bp, Homo sapiens
ttctcacagtacctaacatgta

SEQ ID NO: 8054577 - DNA, 22 bp, Homo sapiens
ttctcaaagggtggtttgcaaa

SEQ ID NO: 8054578 - DNA, 19 bp, Homo sapiens
ttctccagggacttaggga

SEQ ID NO: 8054579 - DNA, 22 bp, Homo sapiens
ttccctctgcgcattgaatttc

SEQ ID NO: 8054580 - DNA, 20 bp, Homo sapiens
ttcgctgggagtggccaggc

SEQ ID NO: 8054581 - DNA, 22 bp, Homo sapiens
ttcctttagtgtcatatacttt

SEQ ID NO: 8054582 - DNA, 22 bp, Homo sapiens
ttctaaagactcatggaagtgg

SEQ ID NO: 8054583 - DNA, 22 bp, Homo sapiens
ttctcttattctggatatgcag

SEQ ID NO: 8054584 - DNA, 21 bp, Homo sapiens
ttctcctccaagttgctcctg

SEQ ID NO: 8054585 - DNA, 22 bp, Homo sapiens
ttctgccatttacaaatttcat

SEQ ID NO: 8054586 - DNA, 22 bp, Homo sapiens
ttatgcttcctgattggactct

SEQ ID NO: 8054587 - DNA, 22 bp, Homo sapiens
ttagttgtaaaatggaatttgt

SEQ ID NO: 8054588 - DNA, 22 bp, Homo sapiens
ttagttgatgttctggaggtag

SEQ ID NO: 8054589 - DNA, 22 bp, Homo sapiens
ttagttatagtgaagaaatact

SEQ ID NO: 8054590 - DNA, 22 bp, Homo sapiens
tcctctccagcaaactggctat

SEQ ID NO: 8054591 - DNA, 22 bp, Homo sapiens
tcctcctgtttctcaggcctgg

SEQ ID NO: 8054592 - DNA, 21 bp, Homo sapiens
tcctccttcaagtcctggcct

SEQ ID NO: 8054593 - DNA, 22 bp, Homo sapiens
ttcaagaaggtacatttacatc

SEQ ID NO: 8054594 - DNA, 22 bp, Homo sapiens
ttatttaaaagtggtaagattc

SEQ ID NO: 8054595 - DNA, 22 bp, Homo sapiens
ttatttagtctagatgaatttt

SEQ ID NO: 8054596 - DNA, 22 bp, Homo sapiens
ttatttaatgtgatctgaagag

SEQ ID NO: 8054597 - DNA, 22 bp, Homo sapiens
ttatttatggcactgttggtgg

SEQ ID NO: 8054598 - DNA, 22 bp, Homo sapiens
ttcatagaagcagaaagtaaac

SEQ ID NO: 8054599 - DNA, 22 bp, Homo sapiens
ttcagacagtaagaaagaggtt

SEQ ID NO: 8054600 - DNA, 22 bp, Homo sapiens
ttcatagtgcttaatttgataa

SEQ ID NO: 8054601 - DNA, 21 bp, Homo sapiens
ttcatcagccagaaatcaagc

SEQ ID NO: 8054602 - DNA, 22 bp, Homo sapiens
ttcaagtacattgtgttttcct

SEQ ID NO: 8054603 - DNA, 22 bp, Homo sapiens
ttcagaaatgaatattggtatt

SEQ ID NO: 8054604 - DNA, 22 bp, Homo sapiens
ttcagaagttttcaaaactaag

SEQ ID NO: 8054605 - DNA, 22 bp, Homo sapiens
ttccatatttgtgtggcaaaag

SEQ ID NO: 8054606 - DNA, 17 bp, Homo sapiens
ttcccctgaccaagcct

SEQ ID NO: 8054607 - DNA, 21 bp, Homo sapiens
ttcccagcacctagcacaggt

SEQ ID NO: 8054608 - DNA, 21 bp, Homo sapiens
ttcatcagccagaaatcaagc

SEQ ID NO: 8054609 - DNA, 22 bp, Homo sapiens
ttcatcaggcatcatgctcaag

SEQ ID NO: 8054610 - DNA, 22 bp, Homo sapiens
ttccaacaatgtgttattgttc

SEQ ID NO: 8054611 - DNA, 22 bp, Homo sapiens
ttccataaaggtgatagtatac

SEQ ID NO: 8054612 - DNA, 22 bp, Homo sapiens
ttggggagttaatgccaaagat

SEQ ID NO: 8054613 - DNA, 22 bp, Homo sapiens
ttggggagaaatgaaatgaagt

SEQ ID NO: 8054614 - DNA, 23 bp, Homo sapiens
ttgggaaatagttaagacatgag

SEQ ID NO: 8054615 - DNA, 22 bp, Homo sapiens
ttgtatagcccagagagtgaga

SEQ ID NO: 8054616 - DNA, 19 bp, Homo sapiens
ttggggtgaatgccagaca

SEQ ID NO: 8054617 - DNA, 22 bp, Homo sapiens
ttgtgctccctcccgtctggcc

SEQ ID NO: 8054618 - DNA, 22 bp, Homo sapiens
ttgttcttacttaagagtgaat

SEQ ID NO: 8054619 - DNA, 22 bp, Homo sapiens
ttgttcttacttaagagtgaat

SEQ ID NO: 8054620 - DNA, 22 bp, Homo sapiens
ttgtgcttttgagctgagatga

SEQ ID NO: 8054621 - DNA, 22 bp, Homo sapiens
ttgtgctcctgtgagaatctag

SEQ ID NO: 8054622 - DNA, 22 bp, Homo sapiens
ttgtgctcctatgagaatctaa

SEQ ID NO: 8054623 - DNA, 22 bp, Homo sapiens
ttgtgctcttattgtgcaggga

SEQ ID NO: 8054624 - DNA, 22 bp, Homo sapiens
ttggaacatccaggacagatat

SEQ ID NO: 8054625 - DNA, 22 bp, Homo sapiens
ttggaacatgccggggtccagg

SEQ ID NO: 8054626 - DNA, 22 bp, Homo sapiens
ttggcactgtgcctggcacatt

SEQ ID NO: 8054627 - DNA, 22 bp, Homo sapiens
ttggcacagtaatctctcttca

SEQ ID NO: 8054628 - DNA, 22 bp, Homo sapiens
ttgctcagcactggagccagct

SEQ ID NO: 8054629 - DNA, 20 bp, Homo sapiens
ttgctagcttttgtgtcact

SEQ ID NO: 8054630 - DNA, 22 bp, Homo sapiens
ttgccaggagagccacttgcag

SEQ ID NO: 8054631 - DNA, 22 bp, Homo sapiens
ttgccagggaacagggagaggc

SEQ ID NO: 8054632 - DNA, 22 bp, Homo sapiens
ttgccagggctttggtggcatc

SEQ ID NO: 8054633 - DNA, 22 bp, Homo sapiens
ttgccagtgccagcccaggcag

SEQ ID NO: 8054634 - DNA, 22 bp, Homo sapiens
ttgccagtttccctggatgtgt

SEQ ID NO: 8054635 - DNA, 22 bp, Homo sapiens
ttgcatttgtttgagtagaatg

SEQ ID NO: 8054636 - DNA, 22 bp, Homo sapiens
ttgcatttcactttcagtaggc

SEQ ID NO: 8054637 - DNA, 22 bp, Homo sapiens
tttctaaggccagagactgctg

SEQ ID NO: 8054638 - DNA, 22 bp, Homo sapiens
tttctaaggctaggtcttaagg

SEQ ID NO: 8054639 - DNA, 22 bp, Homo sapiens
tttctaagatgtggtttcaagg

SEQ ID NO: 8054640 - DNA, 21 bp, Homo sapiens
tttcagtgtatgacagtgaaa

SEQ ID NO: 8054641 - DNA, 22 bp, Homo sapiens
tttcacattagatatgtcattt

SEQ ID NO: 8054642 - DNA, 22 bp, Homo sapiens
tttcacaggatgctgttttata

SEQ ID NO: 8054643 - DNA, 22 bp, Homo sapiens
tttcacaggattctgatgtagt

SEQ ID NO: 8054644 - DNA, 22 bp, Homo sapiens
tttcacatgtggaatgccaggt

SEQ ID NO: 8054645 - DNA, 23 bp, Homo sapiens
tttatttatttaggctgagggat

SEQ ID NO: 8054646 - DNA, 22 bp, Homo sapiens
tttatttataagccacttgctg

SEQ ID NO: 8054647 - DNA, 21 bp, Homo sapiens
tttatttatataggacacatg

SEQ ID NO: 8054648 - DNA, 22 bp, Homo sapiens
tttatttatccttctggattgc

SEQ ID NO: 8054649 - DNA, 22 bp, Homo sapiens
tttatttatccttctggattgc

SEQ ID NO: 8054650 - DNA, 22 bp, Homo sapiens
tttattggaacacagccatgac

SEQ ID NO: 8054651 - DNA, 22 bp, Homo sapiens
tttatttataagccacttgctg

SEQ ID NO: 8054652 - DNA, 22 bp, Homo sapiens
tttattgtgttgaaactgaatt

SEQ ID NO: 8054653 - DNA, 22 bp, Homo sapiens
tttagcttcatcttcaagctgg

SEQ ID NO: 8054654 - DNA, 22 bp, Homo sapiens
tttagcgtagctgacagctaat

SEQ ID NO: 8054655 - DNA, 22 bp, Homo sapiens
tttagcttaaatggagaaagag

SEQ ID NO: 8054656 - DNA, 22 bp, Homo sapiens
tttagcttaaattgtaagtgaa

SEQ ID NO: 8054657 - DNA, 22 bp, Homo sapiens
tttagcttttgtgtcagataag

SEQ ID NO: 8054658 - DNA, 22 bp, Homo sapiens
tttaagagctagtatgtcattt

SEQ ID NO: 8054659 - DNA, 22 bp, Homo sapiens
tttacactgcttgaacaatctc

SEQ ID NO: 8054660 - DNA, 19 bp, Homo sapiens
tttacaagttctttgtatg

SEQ ID NO: 8054661 - DNA, 22 bp, Homo sapiens
ttgttcttagtatgcattgttt

SEQ ID NO: 8054662 - DNA, 21 bp, Homo sapiens
ttgttcttccagaagcaaagt

SEQ ID NO: 8054663 - DNA, 22 bp, Homo sapiens
ttgttcttctctagagaagtgg

SEQ ID NO: 8054664 - DNA, 22 bp, Homo sapiens
ttgttcttgccaagacatgaag

SEQ ID NO: 8054665 - DNA, 22 bp, Homo sapiens
ttgttcttggagcaggcagaga

SEQ ID NO: 8054666 - DNA, 22 bp, Homo sapiens
ttgttcttttgcttagacagat

SEQ ID NO: 8054667 - DNA, 22 bp, Homo sapiens
ttgttgaatggataaataaatt

SEQ ID NO: 8054668 - DNA, 22 bp, Homo sapiens
ttgttgcaagggttaaatgaga

SEQ ID NO: 8054669 - DNA, 22 bp, Homo sapiens
ttgttgcagagatgaatgacat

SEQ ID NO: 8054670 - DNA, 22 bp, Homo sapiens
ttgttgcaagcctggaatctgg

SEQ ID NO: 8054671 - DNA, 22 bp, Homo sapiens
ttgttgcaacagacaccatatg

SEQ ID NO: 8054672 - DNA, 22 bp, Homo sapiens
ttgttgcatttcaagtatgaga

SEQ ID NO: 8054673 - DNA, 22 bp, Homo sapiens
ttgttgcataaagtaggaaata

SEQ ID NO: 8054674 - DNA, 22 bp, Homo sapiens
ttgttgttggagccaatatgca

SEQ ID NO: 8054675 - DNA, 22 bp, Homo sapiens
tttaacttaatctgcttgatga

SEQ ID NO: 8054676 - DNA, 22 bp, Homo sapiens
tttaacttagaagagatatcct

SEQ ID NO: 8054677 - DNA, 22 bp, Homo sapiens
tttaacttgatcagtagagcat

SEQ ID NO: 8054678 - DNA, 22 bp, Homo sapiens
tttaagaagttatgttataaat

SEQ ID NO: 8054679 - DNA, 23 bp, Homo sapiens
tttaactttccaataattcattg

SEQ ID NO: 8054680 - DNA, 22 bp, Homo sapiens
gctcaggatcagccacctcttt

SEQ ID NO: 8054681 - DNA, 22 bp, Homo sapiens
gctcaggagctgacagcctcaa

SEQ ID NO: 8054682 - DNA, 22 bp, Homo sapiens
gctcaggcaggagtgcagtggc

SEQ ID NO: 8054683 - DNA, 22 bp, Homo sapiens
caaactttcagttataacatga

SEQ ID NO: 8054684 - DNA, 22 bp, Homo sapiens
caaactttcagttataacatga

SEQ ID NO: 8054685 - DNA, 22 bp, Homo sapiens
caaacttttcctggaaaagatt

SEQ ID NO: 8054686 - DNA, 22 bp, Homo sapiens
gcgcagctcagtgagggaactt

SEQ ID NO: 8054687 - DNA, 22 bp, Homo sapiens
gcctgtgactcgtcttgggcca

SEQ ID NO: 8054688 - DNA, 22 bp, Homo sapiens
gcctgggagggcagcagtgtgg

SEQ ID NO: 8054689 - DNA, 22 bp, Homo sapiens
gcctgggagtgcacagtgaggt

SEQ ID NO: 8054690 - DNA, 22 bp, Homo sapiens
atttctcagtgtacattatgtt

SEQ ID NO: 8054691 - DNA, 22 bp, Homo sapiens
atttctcagtgaaatgacaggc

SEQ ID NO: 8054692 - DNA, 22 bp, Homo sapiens
atttctcagtaggtgcacagtg

SEQ ID NO: 8054693 - DNA, 22 bp, Homo sapiens
atttctcactcacagtccatgt

SEQ ID NO: 8054694 - DNA, 22 bp, Homo sapiens
atttctcacaaagttgcttatc

SEQ ID NO: 8054695 - DNA, 22 bp, Homo sapiens
atttctcagtaatctcagcaat

SEQ ID NO: 8054696 - DNA, 22 bp, Homo sapiens
gcctccccaagcagcagggatt

SEQ ID NO: 8054697 - DNA, 22 bp, Homo sapiens
gcctctctccttggcttgcagt

SEQ ID NO: 8054698 - DNA, 22 bp, Homo sapiens
gcctgctgaacctcatgcagtc

SEQ ID NO: 8054699 - DNA, 22 bp, Homo sapiens
gcctggagctcatgtgggcatt

SEQ ID NO: 8054700 - DNA, 22 bp, Homo sapiens
gcctggagctactggacactga

SEQ ID NO: 8054701 - DNA, 22 bp, Homo sapiens
gcctggagctactggacactga

SEQ ID NO: 8054702 - DNA, 22 bp, Homo sapiens
gcctggagctctccacttgggg

SEQ ID NO: 8054703 - DNA, 22 bp, Homo sapiens
gcctggagctcggctgagggcg

SEQ ID NO: 8054704 - DNA, 22 bp, Homo sapiens
gcctggagctcggctgagggcg

SEQ ID NO: 8054705 - DNA, 22 bp, Homo sapiens
gcctggagctcatgtgggcatt

SEQ ID NO: 8054706 - DNA, 22 bp, Homo sapiens
gcctggagctctccacttgggg

SEQ ID NO: 8054707 - DNA, 22 bp, Homo sapiens
gcctggctgaggtggggaggca

SEQ ID NO: 8054708 - DNA, 22 bp, Homo sapiens
gcctgggagcacatcggggtcc

SEQ ID NO: 8054709 - DNA, 22 bp, Homo sapiens
atttctcaaaggaatagagtga

SEQ ID NO: 8054710 - DNA, 22 bp, Homo sapiens
atttctagcctctgaagtagga

SEQ ID NO: 8054711 - DNA, 22 bp, Homo sapiens
atttcagagtgagagtgctcaa

SEQ ID NO: 8054712 - DNA, 22 bp, Homo sapiens
gccaggcctgcaagtgctggtg

SEQ ID NO: 8054713 - DNA, 22 bp, Homo sapiens
gccaggcctgcaagtgctggtg

SEQ ID NO: 8054714 - DNA, 22 bp, Homo sapiens
gccaggccactcccgggtcctg

SEQ ID NO: 8054715 - DNA, 19 bp, Homo sapiens
gccaggcctggacctgcag

SEQ ID NO: 8054716 - DNA, 22 bp, Homo sapiens
atttattgagacttaacaaccc

SEQ ID NO: 8054717 - DNA, 22 bp, Homo sapiens
atttattgagcctttcctatgt

SEQ ID NO: 8054718 - DNA, 22 bp, Homo sapiens
atttattgagagggaggggaat

SEQ ID NO: 8054719 - DNA, 22 bp, Homo sapiens
gccaggccactcccgggtcctg

SEQ ID NO: 8054720 - DNA, 22 bp, Homo sapiens
gccaggcatttgttaggtgctg

SEQ ID NO: 8054721 - DNA, 22 bp, Homo sapiens
gccaggcattctagaagtagtg

SEQ ID NO: 8054722 - DNA, 22 bp, Homo sapiens
atttattggatgcttacttggg

SEQ ID NO: 8054723 - DNA, 22 bp, Homo sapiens
atttattggtttgcatggtgaa

SEQ ID NO: 8054724 - DNA, 22 bp, Homo sapiens
gccaggagtgtgtggctatgtt

SEQ ID NO: 8054725 - DNA, 22 bp, Homo sapiens
gccaggaggcttaactggacag

SEQ ID NO: 8054726 - DNA, 22 bp, Homo sapiens
gccaggagggaaaggacaattt

SEQ ID NO: 8054727 - DNA, 22 bp, Homo sapiens
gccaggaggcttaactggacag

SEQ ID NO: 8054728 - DNA, 22 bp, Homo sapiens
atttaattttctcaacagtgct

SEQ ID NO: 8054729 - DNA, 22 bp, Homo sapiens
attggaatggctttgcatgtcc

SEQ ID NO: 8054730 - DNA, 22 bp, Homo sapiens
attggaaatactgagagataaa

SEQ ID NO: 8054731 - DNA, 22 bp, Homo sapiens
attggaaatacagtagaaaaat

SEQ ID NO: 8054732 - DNA, 22 bp, Homo sapiens
attggaaagttcttaagggata

SEQ ID NO: 8054733 - DNA, 22 bp, Homo sapiens
attgcttttcagacaatgaggc

SEQ ID NO: 8054734 - DNA, 22 bp, Homo sapiens
attgaagacttggtatccgtgg

SEQ ID NO: 8054735 - DNA, 22 bp, Homo sapiens
attgaagagaagctaaatagag

SEQ ID NO: 8054736 - DNA, 22 bp, Homo sapiens
attgaagaaacccaaataatgg

SEQ ID NO: 8054737 - DNA, 22 bp, Homo sapiens
attgaagatcagggaaagattc

SEQ ID NO: 8054738 - DNA, 22 bp, Homo sapiens
attgaagagttgattattatct

SEQ ID NO: 8054739 - DNA, 22 bp, Homo sapiens
attgaagattctgacatcagaa

SEQ ID NO: 8054740 - DNA, 22 bp, Homo sapiens
attgacattaactatattagcc

SEQ ID NO: 8054741 - DNA, 22 bp, Homo sapiens
attctcagctttcaaatagaca

SEQ ID NO: 8054742 - DNA, 22 bp, Homo sapiens
attctgtcatttcaagaaaaac

SEQ ID NO: 8054743 - DNA, 22 bp, Homo sapiens
attctgtctttttaaaataata

SEQ ID NO: 8054744 - DNA, 22 bp, Homo sapiens
attctgtcattacaaaaggcag

SEQ ID NO: 8054745 - DNA, 22 bp, Homo sapiens
attcttaattgccatgctgtat

SEQ ID NO: 8054746 - DNA, 22 bp, Homo sapiens
gcagcaggcatggccgccctgg

SEQ ID NO: 8054747 - DNA, 22 bp, Homo sapiens
gcagcaggcatggccgccctgg

SEQ ID NO: 8054748 - DNA, 22 bp, Homo sapiens
gcagcaggcttttcataccttg

SEQ ID NO: 8054749 - DNA, 22 bp, Homo sapiens
gcagcaggcttttcataccttg

SEQ ID NO: 8054750 - DNA, 22 bp, Homo sapiens
gcagcagggtgccagctttgca

SEQ ID NO: 8054751 - DNA, 22 bp, Homo sapiens
gcagcagggtgccagctttgca

SEQ ID NO: 8054752 - DNA, 22 bp, Homo sapiens
gcagcagggagcaggggtgtca

SEQ ID NO: 8054753 - DNA, 22 bp, Homo sapiens
gcagcagggagcaggggtgtca

SEQ ID NO: 8054754 - DNA, 22 bp, Homo sapiens
gcagcagggagcaggggtgtca

SEQ ID NO: 8054755 - DNA, 22 bp, Homo sapiens
attatttagaaatcgattgaaa

SEQ ID NO: 8054756 - DNA, 22 bp, Homo sapiens
atgttttcaaagtaaacttgta

SEQ ID NO: 8054757 - DNA, 22 bp, Homo sapiens
atgttttccccaaatgatcttc

SEQ ID NO: 8054758 - DNA, 22 bp, Homo sapiens
atgtgttaattggagcagcagg

SEQ ID NO: 8054759 - DNA, 22 bp, Homo sapiens
atgtgttaatgagcaatgacct

SEQ ID NO: 8054760 - DNA, 22 bp, Homo sapiens
attaaaattccaaggtatgcca

SEQ ID NO: 8054761 - DNA, 22 bp, Homo sapiens
gatgaggctgtgtctgcacaag

SEQ ID NO: 8054762 - DNA, 22 bp, Homo sapiens
attaaatgttggacgtatacat

SEQ ID NO: 8054763 - DNA, 22 bp, Homo sapiens
attaatgagcttctgcactcat

SEQ ID NO: 8054764 - DNA, 22 bp, Homo sapiens
attaatgacgcagataataatt

SEQ ID NO: 8054765 - DNA, 20 bp, Homo sapiens
attaatgaatacattttgat

SEQ ID NO: 8054766 - DNA, 22 bp, Homo sapiens
gcaaggctgggagatgaggcct

SEQ ID NO: 8054767 - DNA, 22 bp, Homo sapiens
attacaagtagactaactttca

SEQ ID NO: 8054768 - DNA, 22 bp, Homo sapiens
attagaagatagtgatttctgc

SEQ ID NO: 8054769 - DNA, 22 bp, Homo sapiens
attagaagcgtgaatcctttca

SEQ ID NO: 8054770 - DNA, 18 bp, Homo sapiens
gaaagatgaacttttttc

SEQ ID NO: 8054771 - DNA, 21 bp, Homo sapiens
atgaagatgacaatttgagag

SEQ ID NO: 8054772 - DNA, 22 bp, Homo sapiens
atgaagataatagcattggttg

SEQ ID NO: 8054773 - DNA, 22 bp, Homo sapiens
atgaagatttcccagagacatg

SEQ ID NO: 8054774 - DNA, 19 bp, Homo sapiens
atgaagattggtaaattca

SEQ ID NO: 8054775 - DNA, 22 bp, Homo sapiens
atgaagattctatttatcactt

SEQ ID NO: 8054776 - DNA, 22 bp, Homo sapiens
atgatttttcagcagaggatct

SEQ ID NO: 8054777 - DNA, 20 bp, Homo sapiens
atgattttgcactaacttca

SEQ ID NO: 8054778 - DNA, 22 bp, Homo sapiens
atgcaaaaactgcacttacgct

SEQ ID NO: 8054779 - DNA, 22 bp, Homo sapiens
atgcaaagcaccacactaagat

SEQ ID NO: 8054780 - DNA, 23 bp, Homo sapiens
atgcaaagtgctgtcatgtagac

SEQ ID NO: 8054781 - DNA, 22 bp, Homo sapiens
atgcaaagcacacacagaatcc

SEQ ID NO: 8054782 - DNA, 20 bp, Homo sapiens
atgcaaactcacaaaatacc

SEQ ID NO: 8054783 - DNA, 22 bp, Homo sapiens
atgcattgtatgaaaggaaata

SEQ ID NO: 8054784 - DNA, 22 bp, Homo sapiens
atgcattgtaacgatgtgcaca

SEQ ID NO: 8054785 - DNA, 22 bp, Homo sapiens
atgcattgaggatgacatgagt

SEQ ID NO: 8054786 - DNA, 22 bp, Homo sapiens
atgcattgctcaacagaataca

SEQ ID NO: 8054787 - DNA, 22 bp, Homo sapiens
atgcattgctgctttcaaaaca

SEQ ID NO: 8054788 - DNA, 22 bp, Homo sapiens
gacactgaagtcactaagcagg

SEQ ID NO: 8054789 - DNA, 22 bp, Homo sapiens
atgcatttatgtgtgtacattg

SEQ ID NO: 8054790 - DNA, 21 bp, Homo sapiens
atgcatggatttcagtgagag

SEQ ID NO: 8054791 - DNA, 22 bp, Homo sapiens
atgcagctgctgacagctttca

SEQ ID NO: 8054792 - DNA, 23 bp, Homo sapiens
atgcatcatgaaaactagagagc

SEQ ID NO: 8054793 - DNA, 22 bp, Homo sapiens
atctttttactaacactgctta

SEQ ID NO: 8054794 - DNA, 22 bp, Homo sapiens
atcttttactacaaatcaggtg

SEQ ID NO: 8054795 - DNA, 22 bp, Homo sapiens
atcttttatgagcgttctgaca

SEQ ID NO: 8054796 - DNA, 22 bp, Homo sapiens
atcttttacattactgcccaga

SEQ ID NO: 8054797 - DNA, 18 bp, Homo sapiens
cttgttcttctcttggcg

SEQ ID NO: 8054798 - DNA, 22 bp, Homo sapiens
atgaaacatgagaaatggagag

SEQ ID NO: 8054799 - DNA, 22 bp, Homo sapiens
cttgtgttgtacattctatggg

SEQ ID NO: 8054800 - DNA, 22 bp, Homo sapiens
cttttagtattctgatttgcca

SEQ ID NO: 8054801 - DNA, 22 bp, Homo sapiens
atgaaatgtattcagatatgta

SEQ ID NO: 8054802 - DNA, 22 bp, Homo sapiens
cttgcctttgtcttcaaaggct

SEQ ID NO: 8054803 - DNA, 22 bp, Homo sapiens
cttgctggaaactctctctgcc

SEQ ID NO: 8054804 - DNA, 22 bp, Homo sapiens
cttggcagggtggaggatgcag

SEQ ID NO: 8054805 - DNA, 22 bp, Homo sapiens
cttggcctcttctcagggtggg

SEQ ID NO: 8054806 - DNA, 22 bp, Homo sapiens
cttggcatgcagcaggcactca

SEQ ID NO: 8054807 - DNA, 22 bp, Homo sapiens
cttggtccgagggcgcctaggc

SEQ ID NO: 8054808 - DNA, 22 bp, Homo sapiens
cttggcctgacatgtggcaggg

SEQ ID NO: 8054809 - DNA, 22 bp, Homo sapiens
cttggcctgggccgcagccact

SEQ ID NO: 8054810 - DNA, 22 bp, Homo sapiens
cttggcctgtggctcaagaatt

SEQ ID NO: 8054811 - DNA, 20 bp, Homo sapiens
atcttcttggccagcttgct

SEQ ID NO: 8054812 - DNA, 22 bp, Homo sapiens
cttggtgcccagcaggtggctg

SEQ ID NO: 8054813 - DNA, 22 bp, Homo sapiens
atggaatgccaagttcactgct

SEQ ID NO: 8054814 - DNA, 22 bp, Homo sapiens
atggaataattgtttcacagaa

SEQ ID NO: 8054815 - DNA, 23 bp, Homo sapiens
atggaagtcactgttttcttgtc

SEQ ID NO: 8054816 - DNA, 22 bp, Homo sapiens
atgccacttcattccagcctcg

SEQ ID NO: 8054817 - DNA, 22 bp, Homo sapiens
atgccactgcgctctagcctgg

SEQ ID NO: 8054818 - DNA, 22 bp, Homo sapiens
gacagaggctggagcacctcct

SEQ ID NO: 8054819 - DNA, 22 bp, Homo sapiens
atgccactgcgctccagcctgg

SEQ ID NO: 8054820 - DNA, 22 bp, Homo sapiens
atggccagtgttgagatcaggc

SEQ ID NO: 8054821 - DNA, 22 bp, Homo sapiens
atggctgcctgggcgctggccg

SEQ ID NO: 8054822 - DNA, 22 bp, Homo sapiens
atggctgcctagaggtgagatg

SEQ ID NO: 8054823 - DNA, 19 bp, Homo sapiens
atggctgctgattggggat

SEQ ID NO: 8054824 - DNA, 22 bp, Homo sapiens
gagccagggagggtctggtata

SEQ ID NO: 8054825 - DNA, 22 bp, Homo sapiens
gagccagggctgtgagctgagc

SEQ ID NO: 8054826 - DNA, 22 bp, Homo sapiens
atggctgcccacgttggtgctt

SEQ ID NO: 8054827 - DNA, 22 bp, Homo sapiens
gagccaggcaccttctgtgttg

SEQ ID NO: 8054828 - DNA, 22 bp, Homo sapiens
gagccaggcccgtacttgctgt

SEQ ID NO: 8054829 - DNA, 22 bp, Homo sapiens
gagccaggagatacctaagggg

SEQ ID NO: 8054830 - DNA, 22 bp, Homo sapiens
gagccaggaagaaggccttact

SEQ ID NO: 8054831 - DNA, 22 bp, Homo sapiens
gagccaggaggcagagactgca

SEQ ID NO: 8054832 - DNA, 22 bp, Homo sapiens
gagccaggaggcagagactgca

SEQ ID NO: 8054833 - DNA, 22 bp, Homo sapiens
atggcagagggattgaacagct

SEQ ID NO: 8054834 - DNA, 22 bp, Homo sapiens
atggcaggcccaggtgttcatt

SEQ ID NO: 8054835 - DNA, 22 bp, Homo sapiens
atggcaggatacccagtccggc

SEQ ID NO: 8054836 - DNA, 22 bp, Homo sapiens
atggcaggatacccagtccggc

SEQ ID NO: 8054837 - DNA, 22 bp, Homo sapiens
gagagctgtggtttgaccaggc

SEQ ID NO: 8054838 - DNA, 22 bp, Homo sapiens
atggccagtctattcatggtta

SEQ ID NO: 8054839 - DNA, 22 bp, Homo sapiens
gaggctgctgttagccctgggc

SEQ ID NO: 8054840 - DNA, 22 bp, Homo sapiens
gaggctgctgagagccctgttt

SEQ ID NO: 8054841 - DNA, 22 bp, Homo sapiens
gaggctgctgagagccctgttt

SEQ ID NO: 8054842 - DNA, 20 bp, Homo sapiens
gaggctgcggactgctggac

SEQ ID NO: 8054843 - DNA, 22 bp, Homo sapiens
gaggcctggctgggaggaggtg

SEQ ID NO: 8054844 - DNA, 22 bp, Homo sapiens
gaggcctggctgggaggaggtg

SEQ ID NO: 8054845 - DNA, 22 bp, Homo sapiens
gaggcctgggagcctgtcctcc

SEQ ID NO: 8054846 - DNA, 22 bp, Homo sapiens
gaggcctggctgtcagtcccca

SEQ ID NO: 8054847 - DNA, 23 bp, Homo sapiens
gaggcctggccctgccacatctc

SEQ ID NO: 8054848 - DNA, 22 bp, Homo sapiens
gaggcctggctctgccctcctg

SEQ ID NO: 8054849 - DNA, 23 bp, Homo sapiens
gaggcctggccctgccacatctc

SEQ ID NO: 8054850 - DNA, 22 bp, Homo sapiens
gaggcctggagccgcctaggcg

SEQ ID NO: 8054851 - DNA, 22 bp, Homo sapiens
gaggcctgggcaagggggtctg

SEQ ID NO: 8054852 - DNA, 22 bp, Homo sapiens
gaggcctgggttacctactcgt

SEQ ID NO: 8054853 - DNA, 22 bp, Homo sapiens
gaggctgctttgatgacaggag

SEQ ID NO: 8054854 - DNA, 22 bp, Homo sapiens
atgtgtccaaggccacaatagc

SEQ ID NO: 8054855 - DNA, 22 bp, Homo sapiens
atgtgtccacaggtgtgagaga

SEQ ID NO: 8054856 - DNA, 22 bp, Homo sapiens
atgtgtccattatcagttctgg

SEQ ID NO: 8054857 - DNA, 22 bp, Homo sapiens
atgtgtcctctggcaggtttag

SEQ ID NO: 8054858 - DNA, 22 bp, Homo sapiens
atgtgtcctgctgtgtcacaca

SEQ ID NO: 8054859 - DNA, 22 bp, Homo sapiens
gaggggagaaggcactaaccag

SEQ ID NO: 8054860 - DNA, 22 bp, Homo sapiens
gaggggagcatgatctagattg

SEQ ID NO: 8054861 - DNA, 16 bp, Homo sapiens
gaggggagcagtaggc

SEQ ID NO: 8054862 - DNA, 22 bp, Homo sapiens
gaggggagacagggaaatcagt

SEQ ID NO: 8054863 - DNA, 22 bp, Homo sapiens
gaggggagacagggaaatcagt

SEQ ID NO: 8054864 - DNA, 22 bp, Homo sapiens
gaggggagaggcttatggatca

SEQ ID NO: 8054865 - DNA, 22 bp, Homo sapiens
gaggccaggagtgctgtaagtt

SEQ ID NO: 8054866 - DNA, 22 bp, Homo sapiens
gaggccaggggagtcagcgtcc

SEQ ID NO: 8054867 - DNA, 22 bp, Homo sapiens
gaggccagggatgcaatgagag

SEQ ID NO: 8054868 - DNA, 22 bp, Homo sapiens
gaggccagggtaccatcaacat

SEQ ID NO: 8054869 - DNA, 22 bp, Homo sapiens
gaggccagggtaccatcaacat

SEQ ID NO: 8054870 - DNA, 22 bp, Homo sapiens
gaggccaggggcctggagatga

SEQ ID NO: 8054871 - DNA, 17 bp, Homo sapiens
gaggagctccagtaggt

SEQ ID NO: 8054872 - DNA, 22 bp, Homo sapiens
atgtagaaagttattgtcactg

SEQ ID NO: 8054873 - DNA, 19 bp, Homo sapiens
atgtacccagtgtcaatcc

SEQ ID NO: 8054874 - DNA, 22 bp, Homo sapiens
atgtacatttagatcatttctg

SEQ ID NO: 8054875 - DNA, 21 bp, Homo sapiens
gagctgggcgaggctccgggg

SEQ ID NO: 8054876 - DNA, 21 bp, Homo sapiens
gagctgggcgaggctccgggg

SEQ ID NO: 8054877 - DNA, 22 bp, Homo sapiens
gagctgggcgagccggggaagt

SEQ ID NO: 8054878 - DNA, 21 bp, Homo sapiens
gagctgggcgaggctccgggg

SEQ ID NO: 8054879 - DNA, 22 bp, Homo sapiens
gagctggggcagcttaggagtg

SEQ ID NO: 8054880 - DNA, 22 bp, Homo sapiens
gagctgggcctgcgagtgctgc

SEQ ID NO: 8054881 - DNA, 22 bp, Homo sapiens
gagctgggcctgcgagtgctgc

SEQ ID NO: 8054882 - DNA, 22 bp, Homo sapiens
gagctgggcctcagaacacagt

SEQ ID NO: 8054883 - DNA, 21 bp, Homo sapiens
atggtcaattcattagaaaga

SEQ ID NO: 8054884 - DNA, 22 bp, Homo sapiens
atggtcaaggagaaacctggga

SEQ ID NO: 8054885 - DNA, 22 bp, Homo sapiens
atggctggcactggcctgggtt

SEQ ID NO: 8054886 - DNA, 22 bp, Homo sapiens
atggctggatttgatccatggg

SEQ ID NO: 8054887 - DNA, 22 bp, Homo sapiens
atggggctgttctctgccctgc

SEQ ID NO: 8054888 - DNA, 22 bp, Homo sapiens
ggatgggctgaaaggtagcccc

SEQ ID NO: 8054889 - DNA, 22 bp, Homo sapiens
ggatgggcccgggacggcgctg

SEQ ID NO: 8054890 - DNA, 22 bp, Homo sapiens
ggatgggcagacaggacggcac

SEQ ID NO: 8054891 - DNA, 22 bp, Homo sapiens
cacagggcaccagttggccatc

SEQ ID NO: 8054892 - DNA, 22 bp, Homo sapiens
cacagggcagagacctgggtgc

SEQ ID NO: 8054893 - DNA, 22 bp, Homo sapiens
ggagggagggctagaccaaaga

SEQ ID NO: 8054894 - DNA, 22 bp, Homo sapiens
ggaggcggaggctgcagtgagc

SEQ ID NO: 8054895 - DNA, 22 bp, Homo sapiens
ggaggcggaggctgcagtgagc

SEQ ID NO: 8054896 - DNA, 22 bp, Homo sapiens
ggatgggcagacaggacggcac

SEQ ID NO: 8054897 - DNA, 23 bp, Homo sapiens
ggatgggcaagcctagtgcctac

SEQ ID NO: 8054898 - DNA, 22 bp, Homo sapiens
cacactgactggaatcaaggat

SEQ ID NO: 8054899 - DNA, 22 bp, Homo sapiens
cacactgataggcttgacaggc

SEQ ID NO: 8054900 - DNA, 22 bp, Homo sapiens
cacagctgaccaccctgctccc

SEQ ID NO: 8054901 - DNA, 22 bp, Homo sapiens
cacactgtcaggtaaataacac

SEQ ID NO: 8054902 - DNA, 22 bp, Homo sapiens
cacagcttcagtttctgacttg

SEQ ID NO: 8054903 - DNA, 22 bp, Homo sapiens
ggaggcggagcttgcagtgagc

SEQ ID NO: 8054904 - DNA, 22 bp, Homo sapiens
ggaggcggagcttgcagtgagc

SEQ ID NO: 8054905 - DNA, 22 bp, Homo sapiens
ggaggcggacacaggtagtgtt

SEQ ID NO: 8054906 - DNA, 22 bp, Homo sapiens
ggaggcggaagttgcagtgagc

SEQ ID NO: 8054907 - DNA, 22 bp, Homo sapiens
ggaggcggaagttgcagtgagc

SEQ ID NO: 8054908 - DNA, 22 bp, Homo sapiens
ggaggccttgcctgcaggcaca

SEQ ID NO: 8054909 - DNA, 22 bp, Homo sapiens
ggaggccttgcctgcaggcaca

SEQ ID NO: 8054910 - DNA, 20 bp, Homo sapiens
cacagcttgccttttatgac

SEQ ID NO: 8054911 - DNA, 22 bp, Homo sapiens
cacagcttgggctctgacaata

SEQ ID NO: 8054912 - DNA, 22 bp, Homo sapiens
cacagcttgtttagtgactcac

SEQ ID NO: 8054913 - DNA, 22 bp, Homo sapiens
cacagcttctgtctgacccatg

SEQ ID NO: 8054914 - DNA, 22 bp, Homo sapiens
ggcacagggtgatgttgcagtt

SEQ ID NO: 8054915 - DNA, 22 bp, Homo sapiens
ggcacagggtgatgttgcagtt

SEQ ID NO: 8054916 - DNA, 22 bp, Homo sapiens
ggcacagggggctgaggactag

SEQ ID NO: 8054917 - DNA, 22 bp, Homo sapiens
ggcacagggggctgaggactag

SEQ ID NO: 8054918 - DNA, 22 bp, Homo sapiens
ggcacagggagccgcagttgca

SEQ ID NO: 8054919 - DNA, 22 bp, Homo sapiens
ggcacaggagtcacagcatttc

SEQ ID NO: 8054920 - DNA, 20 bp, Homo sapiens
ggcactggaagcacacagga

SEQ ID NO: 8054921 - DNA, 22 bp, Homo sapiens
ggcactggcaaagcaaagtctg

SEQ ID NO: 8054922 - DNA, 22 bp, Homo sapiens
ggcactgggaatgcagtgatga

SEQ ID NO: 8054923 - DNA, 22 bp, Homo sapiens
ggcactggcctggggccaagag

SEQ ID NO: 8054924 - DNA, 22 bp, Homo sapiens
ggcactggcctggggccaagag

SEQ ID NO: 8054925 - DNA, 22 bp, Homo sapiens
ggcagagccttctggagctcgc

SEQ ID NO: 8054926 - DNA, 22 bp, Homo sapiens
ggcagagcagccccagggtttg

SEQ ID NO: 8054927 - DNA, 22 bp, Homo sapiens
ggcactgggagaggtgagacgg

SEQ ID NO: 8054928 - DNA, 22 bp, Homo sapiens
ggcactgggcaccggctgaggg

SEQ ID NO: 8054929 - DNA, 17 bp, Homo sapiens
ggcagagctgacagggc

SEQ ID NO: 8054930 - DNA, 22 bp, Homo sapiens
ggcagagctgcatgagcactca

SEQ ID NO: 8054931 - DNA, 22 bp, Homo sapiens
ggcagagctagtggcttctctt

SEQ ID NO: 8054932 - DNA, 20 bp, Homo sapiens
ggcagagctatgtctgttgc

SEQ ID NO: 8054933 - DNA, 22 bp, Homo sapiens
cacagtgctcaaacacaagtgc

SEQ ID NO: 8054934 - DNA, 22 bp, Homo sapiens
ggcagagcttgcagtgagccga

SEQ ID NO: 8054935 - DNA, 22 bp, Homo sapiens
ggcagccaccctgggaggcaga

SEQ ID NO: 8054936 - DNA, 22 bp, Homo sapiens
ggcagcagtggctgctattgtc

SEQ ID NO: 8054937 - DNA, 22 bp, Homo sapiens
ggcagcagtggctgctattgtc

SEQ ID NO: 8054938 - DNA, 22 bp, Homo sapiens
ggcagcagttacaaatgtgcag

SEQ ID NO: 8054939 - DNA, 22 bp, Homo sapiens
cactgcctgctggctgtcactt

SEQ ID NO: 8054940 - DNA, 22 bp, Homo sapiens
cactggcagatttgggatctgg

SEQ ID NO: 8054941 - DNA, 22 bp, Homo sapiens
cactggcattagtcacgaggca

SEQ ID NO: 8054942 - DNA, 22 bp, Homo sapiens
cactggcattagtcacgaggca

SEQ ID NO: 8054943 - DNA, 22 bp, Homo sapiens
cactggcatctagtgggttgag

SEQ ID NO: 8054944 - DNA, 22 bp, Homo sapiens
ggctagggagacagagggcatg

SEQ ID NO: 8054945 - DNA, 22 bp, Homo sapiens
ggctatgggaagatggcagggg

SEQ ID NO: 8054946 - DNA, 22 bp, Homo sapiens
ggctatggaaatggcaggacat

SEQ ID NO: 8054947 - DNA, 22 bp, Homo sapiens
ggctcaagcagtctgcctgcct

SEQ ID NO: 8054948 - DNA, 22 bp, Homo sapiens
cactgagacccgaatacttcca

SEQ ID NO: 8054949 - DNA, 22 bp, Homo sapiens
cactgagaggtctcatttccaa

SEQ ID NO: 8054950 - DNA, 22 bp, Homo sapiens
cactgagcatgagtgggctgtg

SEQ ID NO: 8054951 - DNA, 23 bp, Homo sapiens
ggcctcctggtctaggctagact

SEQ ID NO: 8054952 - DNA, 22 bp, Homo sapiens
cactgcactccatcctgggaaa

SEQ ID NO: 8054953 - DNA, 23 bp, Homo sapiens
cactgcagcgtggtctggcagga

SEQ ID NO: 8054954 - DNA, 21 bp, Homo sapiens
cactgcagccttgacctgggc

SEQ ID NO: 8054955 - DNA, 17 bp, Homo sapiens
caccctggctagtctga

SEQ ID NO: 8054956 - DNA, 18 bp, Homo sapiens
caccctccgcggctgccc

SEQ ID NO: 8054957 - DNA, 22 bp, Homo sapiens
caccctggaaagaaggtctggg

SEQ ID NO: 8054958 - DNA, 22 bp, Homo sapiens
ggcagccagagggcagctggat

SEQ ID NO: 8054959 - DNA, 21 bp, Homo sapiens
ggcagctgaccgcgcggtgca

SEQ ID NO: 8054960 - DNA, 22 bp, Homo sapiens
ggcagctgacctagcaccatcc

SEQ ID NO: 8054961 - DNA, 22 bp, Homo sapiens
ggcagctgagcatggctacctt

SEQ ID NO: 8054962 - DNA, 22 bp, Homo sapiens
ggcagctgagatcatgctgttg

SEQ ID NO: 8054963 - DNA, 22 bp, Homo sapiens
cacccacattccatcactctgc

SEQ ID NO: 8054964 - DNA, 22 bp, Homo sapiens
cacccacatggaaattcacagt

SEQ ID NO: 8054965 - DNA, 22 bp, Homo sapiens
cacccagcacagagggaggcga

SEQ ID NO: 8054966 - DNA, 22 bp, Homo sapiens
cacccagcagcacttaagacta

SEQ ID NO: 8054967 - DNA, 22 bp, Homo sapiens
caatttctctttatatctcaca

SEQ ID NO: 8054968 - DNA, 22 bp, Homo sapiens
caatttctcgaactctaatcca

SEQ ID NO: 8054969 - DNA, 22 bp, Homo sapiens
gcttggccagcagccgggatgc

SEQ ID NO: 8054970 - DNA, 22 bp, Homo sapiens
gcttggcccattgatcagctgg

SEQ ID NO: 8054971 - DNA, 22 bp, Homo sapiens
gcttggccctgccgcctgggtc

SEQ ID NO: 8054972 - DNA, 22 bp, Homo sapiens
gctgtggcctccagcactcccc

SEQ ID NO: 8054973 - DNA, 20 bp, Homo sapiens
gctgtggccgtgccagactc

SEQ ID NO: 8054974 - DNA, 22 bp, Homo sapiens
gctgtggccgggcccaggccgc

SEQ ID NO: 8054975 - DNA, 22 bp, Homo sapiens
gctgtggccgtcagggaaatgg

SEQ ID NO: 8054976 - DNA, 22 bp, Homo sapiens
gctgtggcctggcgcagagctg

SEQ ID NO: 8054977 - DNA, 22 bp, Homo sapiens
gctgtctcatgggtgctagtcc

SEQ ID NO: 8054978 - DNA, 22 bp, Homo sapiens
gctgtctccatagctgtgtgtc

SEQ ID NO: 8054979 - DNA, 22 bp, Homo sapiens
caaggcagctattgtctccata

SEQ ID NO: 8054980 - DNA, 22 bp, Homo sapiens
caaggattaatagaatgaatca

SEQ ID NO: 8054981 - DNA, 20 bp, Homo sapiens
caaggcagaccagagtgagt

SEQ ID NO: 8054982 - DNA, 22 bp, Homo sapiens
caaggcagcgttcctttctgga

SEQ ID NO: 8054983 - DNA, 21 bp, Homo sapiens
gctgtctctggctcctgggaa

SEQ ID NO: 8054984 - DNA, 20 bp, Homo sapiens
gctgtggcaagtgctcactg

SEQ ID NO: 8054985 - DNA, 22 bp, Homo sapiens
gctgtggcccttggcatctgcg

SEQ ID NO: 8054986 - DNA, 22 bp, Homo sapiens
gctgtggccaacaaaccacttt

SEQ ID NO: 8054987 - DNA, 22 bp, Homo sapiens
cacaatgtatatgtatatcaaa

SEQ ID NO: 8054988 - DNA, 21 bp, Homo sapiens
ggaaaattcagagtgcaattt

SEQ ID NO: 8054989 - DNA, 22 bp, Homo sapiens
ggaaaattggcgcgtggggctg

SEQ ID NO: 8054990 - DNA, 21 bp, Homo sapiens
ggaaaattccatacacccacg

SEQ ID NO: 8054991 - DNA, 22 bp, Homo sapiens
cacaactttaggaaccacattc

SEQ ID NO: 8054992 - DNA, 22 bp, Homo sapiens
ggaaaagacagaattctagaat

SEQ ID NO: 8054993 - DNA, 23 bp, Homo sapiens
cacaaaggttccattctctcacc

SEQ ID NO: 8054994 - DNA, 22 bp, Homo sapiens
cacaaaggagaatgtcagcata

SEQ ID NO: 8054995 - DNA, 22 bp, Homo sapiens
cacaaaatatcaagcactttta

SEQ ID NO: 8054996 - DNA, 22 bp, Homo sapiens
cacaaaatctttctcgattatt

SEQ ID NO: 8054997 - DNA, 22 bp, Homo sapiens
cacaatttgtattttgcatcca

SEQ ID NO: 8054998 - DNA, 21 bp, Homo sapiens
cacaccaggcatgtcttgagc

SEQ ID NO: 8054999 - DNA, 22 bp, Homo sapiens
cacacatttcagatgctacaat

SEQ ID NO: 8055000 - DNA, 22 bp, Homo sapiens
cacacatttcagatgctacaat

SEQ ID NO: 8055001 - DNA, 22 bp, Homo sapiens
caaagtaactgcctttccaatt

SEQ ID NO: 8055002 - DNA, 17 bp, Homo sapiens
gctcctgcaggtcagga

SEQ ID NO: 8055003 - DNA, 22 bp, Homo sapiens
caacatttgagtaaagaaatgg

SEQ ID NO: 8055004 - DNA, 22 bp, Homo sapiens
gctgcagtgagccaagatcgtg

SEQ ID NO: 8055005 - DNA, 22 bp, Homo sapiens
gctgcagcctttgggaaggaca

SEQ ID NO: 8055006 - DNA, 22 bp, Homo sapiens
gctgccacattttcaggactaa

SEQ ID NO: 8055007 - DNA, 21 bp, Homo sapiens
caagatctcggcttgcttcct

SEQ ID NO: 8055008 - DNA, 22 bp, Homo sapiens
caagataagatcatttacacta

SEQ ID NO: 8055009 - DNA, 22 bp, Homo sapiens
caagaggctaaactgggctatt

SEQ ID NO: 8055010 - DNA, 22 bp, Homo sapiens
caaggagaaaacggcttctgaa

SEQ ID NO: 8055011 - DNA, 21 bp, Homo sapiens
caaggacaggttgcagggcaa

SEQ ID NO: 8055012 - DNA, 22 bp, Homo sapiens
caaggaggaagatgcaggggac

SEQ ID NO: 8055013 - DNA, 22 bp, Homo sapiens
caaggagagtaattgaatgaga

SEQ ID NO: 8055014 - DNA, 22 bp, Homo sapiens
caaggagataaaatgttgagct

SEQ ID NO: 8055015 - DNA, 22 bp, Homo sapiens
caagatgggtgttgtgatggtt

SEQ ID NO: 8055016 - DNA, 22 bp, Homo sapiens
gctgcctttagggggtgctcag

SEQ ID NO: 8055017 - DNA, 22 bp, Homo sapiens
gctgccttgaacttggcctggg

SEQ ID NO: 8055018 - DNA, 22 bp, Homo sapiens
caaccccactacacgttggaga

SEQ ID NO: 8055019 - DNA, 22 bp, Homo sapiens
caactaatcctttgaaaagaag

SEQ ID NO: 8055020 - DNA, 22 bp, Homo sapiens
gctgctggagagcgagactgtt

SEQ ID NO: 8055021 - DNA, 22 bp, Homo sapiens
gctgctggatgcgcttgatggt

SEQ ID NO: 8055022 - DNA, 22 bp, Homo sapiens
gctgctggcactggagtgagcc

SEQ ID NO: 8055023 - DNA, 22 bp, Homo sapiens
gctgctggccccacatgctcca

SEQ ID NO: 8055024 - DNA, 22 bp, Homo sapiens
gctgctggcactggagtgagcc

SEQ ID NO: 8055025 - DNA, 22 bp, Homo sapiens
gtatgaaaattgtaaagttctt

SEQ ID NO: 8055026 - DNA, 22 bp, Homo sapiens
cagcagcctcttgtgcctgtgg

SEQ ID NO: 8055027 - DNA, 22 bp, Homo sapiens
cagcagcctgccttgggagctt

SEQ ID NO: 8055028 - DNA, 22 bp, Homo sapiens
cagcagctacttggagcagcag

SEQ ID NO: 8055029 - DNA, 22 bp, Homo sapiens
cagcaggaccattgaggcatca

SEQ ID NO: 8055030 - DNA, 22 bp, Homo sapiens
cagcagctacttggagcagcag

SEQ ID NO: 8055031 - DNA, 22 bp, Homo sapiens
cagcagctacttggagcagcag

SEQ ID NO: 8055032 - DNA, 22 bp, Homo sapiens
cagcagctacctgctcttgtgg

SEQ ID NO: 8055033 - DNA, 22 bp, Homo sapiens
cagcagctacctgctcttgtgg

SEQ ID NO: 8055034 - DNA, 22 bp, Homo sapiens
cagcagcctggagggggccacg

SEQ ID NO: 8055035 - DNA, 22 bp, Homo sapiens
cagcagctaaggcatgttcctg

SEQ ID NO: 8055036 - DNA, 22 bp, Homo sapiens
cagcagctaaggcatgttcctg

SEQ ID NO: 8055037 - DNA, 22 bp, Homo sapiens
cagcagcctggcccctcctcgg

SEQ ID NO: 8055038 - DNA, 22 bp, Homo sapiens
cagcaggcaggtgggccaagtc

SEQ ID NO: 8055039 - DNA, 22 bp, Homo sapiens
cagcaggcaggtgggccaagtc

SEQ ID NO: 8055040 - DNA, 22 bp, Homo sapiens
cagcaggcaggtgggccaagtc

SEQ ID NO: 8055041 - DNA, 22 bp, Homo sapiens
cagcaggccatgctgcttttca

SEQ ID NO: 8055042 - DNA, 22 bp, Homo sapiens
cagcaggcagccatttcactgt

SEQ ID NO: 8055043 - DNA, 22 bp, Homo sapiens
cagcaggattggatacatctca

SEQ ID NO: 8055044 - DNA, 22 bp, Homo sapiens
cagcaggatttgaaaggaagag

SEQ ID NO: 8055045 - DNA, 22 bp, Homo sapiens
gtatttctggttaaatgtgcta

SEQ ID NO: 8055046 - DNA, 22 bp, Homo sapiens
gtatttctagtttcttccacag

SEQ ID NO: 8055047 - DNA, 22 bp, Homo sapiens
cagcaggcccaggtgctggtga

SEQ ID NO: 8055048 - DNA, 22 bp, Homo sapiens
cagcaggcccaggtgctggtga

SEQ ID NO: 8055049 - DNA, 22 bp, Homo sapiens
cagcaggcggcccgcgggcccg

SEQ ID NO: 8055050 - DNA, 22 bp, Homo sapiens
cagcaggcggcccgcgggcccg

SEQ ID NO: 8055051 - DNA, 22 bp, Homo sapiens
cagcagcagacatttgatcttc

SEQ ID NO: 8055052 - DNA, 22 bp, Homo sapiens
cagcagcactctgcgggtcccc

SEQ ID NO: 8055053 - DNA, 22 bp, Homo sapiens
cagcagcagagatactggtttc

SEQ ID NO: 8055054 - DNA, 22 bp, Homo sapiens
cagcagcaacaacggaagcctt

SEQ ID NO: 8055055 - DNA, 22 bp, Homo sapiens
cagcagcaaatctagaagagga

SEQ ID NO: 8055056 - DNA, 22 bp, Homo sapiens
cagcagcaacaatagcggtcac

SEQ ID NO: 8055057 - DNA, 22 bp, Homo sapiens
cagcagcaaggtgagggtggag

SEQ ID NO: 8055058 - DNA, 22 bp, Homo sapiens
gtaaacaacacaaatcatttga

SEQ ID NO: 8055059 - DNA, 22 bp, Homo sapiens
cagcaaggccattggatgcagt

SEQ ID NO: 8055060 - DNA, 22 bp, Homo sapiens
cagcaaggccattggatgcagt

SEQ ID NO: 8055061 - DNA, 22 bp, Homo sapiens
ggtggggctcagcaatctgtgt

SEQ ID NO: 8055062 - DNA, 22 bp, Homo sapiens
ggtggggctgcaagcagttcgg

SEQ ID NO: 8055063 - DNA, 22 bp, Homo sapiens
ggtgggggagacttggtcaaga

SEQ ID NO: 8055064 - DNA, 22 bp, Homo sapiens
ggtgggagagctctgtctccag

SEQ ID NO: 8055065 - DNA, 22 bp, Homo sapiens
ggtgggagagctctgtctccag

SEQ ID NO: 8055066 - DNA, 22 bp, Homo sapiens
cagcatgcccagactgagctaa

SEQ ID NO: 8055067 - DNA, 22 bp, Homo sapiens
gtatttgatgtaatttcagtgc

SEQ ID NO: 8055068 - DNA, 22 bp, Homo sapiens
cagccactctcagacagtccca

SEQ ID NO: 8055069 - DNA, 22 bp, Homo sapiens
cagccaatagcaagggaagctg

SEQ ID NO: 8055070 - DNA, 22 bp, Homo sapiens
cagccaagaaccacagacccag

SEQ ID NO: 8055071 - DNA, 22 bp, Homo sapiens
cagccaagaaagcagtgctcca

SEQ ID NO: 8055072 - DNA, 22 bp, Homo sapiens
cagccaagaaagcagtgctcca

SEQ ID NO: 8055073 - DNA, 21 bp, Homo sapiens
cagcccagcccattgacagtg

SEQ ID NO: 8055074 - DNA, 21 bp, Homo sapiens
cagcccagcccattgacagtg

SEQ ID NO: 8055075 - DNA, 22 bp, Homo sapiens
cagcccagcagggtctggccct

SEQ ID NO: 8055076 - DNA, 21 bp, Homo sapiens
cagcccagcccattgacagtg

SEQ ID NO: 8055077 - DNA, 22 bp, Homo sapiens
cagcccagcagggtctggccct

SEQ ID NO: 8055078 - DNA, 22 bp, Homo sapiens
cagcccagcagactgttaccac

SEQ ID NO: 8055079 - DNA, 22 bp, Homo sapiens
cagcccagagccagttcccgct

SEQ ID NO: 8055080 - DNA, 22 bp, Homo sapiens
cagagcccatcctatactctcc

SEQ ID NO: 8055081 - DNA, 22 bp, Homo sapiens
cagagccccccttctgatcaca

SEQ ID NO: 8055082 - DNA, 22 bp, Homo sapiens
cagagccaggcctgccctcttt

SEQ ID NO: 8055083 - DNA, 22 bp, Homo sapiens
gggcacagagggtcttgaagaa

SEQ ID NO: 8055084 - DNA, 22 bp, Homo sapiens
gggcacagagggtcttgaagaa

SEQ ID NO: 8055085 - DNA, 22 bp, Homo sapiens
gggcacagcccagtggggtccc

SEQ ID NO: 8055086 - DNA, 22 bp, Homo sapiens
cagagccctgtgtgccatgtga

SEQ ID NO: 8055087 - DNA, 22 bp, Homo sapiens
cagagccctgcatgctccatct

SEQ ID NO: 8055088 - DNA, 22 bp, Homo sapiens
cagagccctccgctccccggct

SEQ ID NO: 8055089 - DNA, 22 bp, Homo sapiens
cagagccctcaaggccgatgca

SEQ ID NO: 8055090 - DNA, 22 bp, Homo sapiens
cagagcccctgggttgggagct

SEQ ID NO: 8055091 - DNA, 22 bp, Homo sapiens
cagagccctagtcctgatggcc

SEQ ID NO: 8055092 - DNA, 22 bp, Homo sapiens
gggcgaggactgactctgggca

SEQ ID NO: 8055093 - DNA, 22 bp, Homo sapiens
gggccttgccatggagcctgag

SEQ ID NO: 8055094 - DNA, 22 bp, Homo sapiens
cagagcccttcctcccacgggg

SEQ ID NO: 8055095 - DNA, 22 bp, Homo sapiens
gggcgagggcgaaagcgagagc

SEQ ID NO: 8055096 - DNA, 21 bp, Homo sapiens
gggcgaggcctgatgtggctc

SEQ ID NO: 8055097 - DNA, 22 bp, Homo sapiens
gggctgtgtactatgaggaggg

SEQ ID NO: 8055098 - DNA, 22 bp, Homo sapiens
gggctgtgtgcagtacgggtcc

SEQ ID NO: 8055099 - DNA, 22 bp, Homo sapiens
gggctgtgtactatgaggaggg

SEQ ID NO: 8055100 - DNA, 21 bp, Homo sapiens
cagaggcaggctctgtgtgtg

SEQ ID NO: 8055101 - DNA, 21 bp, Homo sapiens
cagaggcctatcacagactcc

SEQ ID NO: 8055102 - DNA, 22 bp, Homo sapiens
cagaggcctatccagtgtccat

SEQ ID NO: 8055103 - DNA, 21 bp, Homo sapiens
cagaggcctcatgctctgtgc

SEQ ID NO: 8055104 - DNA, 22 bp, Homo sapiens
cagaggccagtggacaagggcc

SEQ ID NO: 8055105 - DNA, 22 bp, Homo sapiens
cagaggccaggctgcctgactg

SEQ ID NO: 8055106 - DNA, 22 bp, Homo sapiens
gggtgctgactggggcctgaaa

SEQ ID NO: 8055107 - DNA, 23 bp, Homo sapiens
gggtgctgcctgtagtcatgctg

SEQ ID NO: 8055108 - DNA, 22 bp, Homo sapiens
gggtgcggtccccacagcccgt

SEQ ID NO: 8055109 - DNA, 22 bp, Homo sapiens
gggtgcctgcctcaggcagtgt

SEQ ID NO: 8055110 - DNA, 22 bp, Homo sapiens
gggtgcctgagttagggcagaa

SEQ ID NO: 8055111 - DNA, 22 bp, Homo sapiens
gggtgcagggtctccagcagct

SEQ ID NO: 8055112 - DNA, 22 bp, Homo sapiens
gggtgcagggtctccagcagct

SEQ ID NO: 8055113 - DNA, 22 bp, Homo sapiens
gggtgcagtggttcacgcctgt

SEQ ID NO: 8055114 - DNA, 22 bp, Homo sapiens
gggtgcaggggaccctagggac

SEQ ID NO: 8055115 - DNA, 22 bp, Homo sapiens
gggtgcaggggaccctagggac

SEQ ID NO: 8055116 - DNA, 22 bp, Homo sapiens
cagaggcctggcttggacacct

SEQ ID NO: 8055117 - DNA, 22 bp, Homo sapiens
cagaggctttgccctggaaacc

SEQ ID NO: 8055118 - DNA, 22 bp, Homo sapiens
cagaggctgtgtaggcagactg

SEQ ID NO: 8055119 - DNA, 22 bp, Homo sapiens
cagaggctgggacctcaggcat

SEQ ID NO: 8055120 - DNA, 22 bp, Homo sapiens
cagacagggacctcgctccaga

SEQ ID NO: 8055121 - DNA, 17 bp, Homo sapiens
cagacaggctgtcaccc

SEQ ID NO: 8055122 - DNA, 22 bp, Homo sapiens
gggcaagcagtgaggacagcac

SEQ ID NO: 8055123 - DNA, 20 bp, Homo sapiens
gggatgagagtcctagctct

SEQ ID NO: 8055124 - DNA, 22 bp, Homo sapiens
cagacaggggtaaccttcctca

SEQ ID NO: 8055125 - DNA, 22 bp, Homo sapiens
cagacagggccctgtgatggta

SEQ ID NO: 8055126 - DNA, 22 bp, Homo sapiens
gggcaagctttgaacatcagca

SEQ ID NO: 8055127 - DNA, 20 bp, Homo sapiens
gggcaaggaaacagccccca

SEQ ID NO: 8055128 - DNA, 20 bp, Homo sapiens
gggcaaggaaacagccccca

SEQ ID NO: 8055129 - DNA, 22 bp, Homo sapiens
gggcaagctcttcagaagctct

SEQ ID NO: 8055130 - DNA, 18 bp, Homo sapiens
gggcaagcggctgtcacc

SEQ ID NO: 8055131 - DNA, 22 bp, Homo sapiens
gggcacaccttgtctgagcaca

SEQ ID NO: 8055132 - DNA, 22 bp, Homo sapiens
gggagggcttggacccagatgt

SEQ ID NO: 8055133 - DNA, 22 bp, Homo sapiens
gggagggcttggacccagatgt

SEQ ID NO: 8055134 - DNA, 22 bp, Homo sapiens
gggaggggttgcatgtttgagt

SEQ ID NO: 8055135 - DNA, 22 bp, Homo sapiens
gggaggggttgcatgtttgagt

SEQ ID NO: 8055136 - DNA, 22 bp, Homo sapiens
gggaggtgaaaggtcatgtgtg

SEQ ID NO: 8055137 - DNA, 22 bp, Homo sapiens
cagaagttctagatttgagtcc

SEQ ID NO: 8055138 - DNA, 22 bp, Homo sapiens
cagaagtttgacatgtttagct

SEQ ID NO: 8055139 - DNA, 22 bp, Homo sapiens
cagacaggaattctggcgtggt

SEQ ID NO: 8055140 - DNA, 22 bp, Homo sapiens
cagacaggctagccagactcac

SEQ ID NO: 8055141 - DNA, 22 bp, Homo sapiens
cagacaggcaggtgctgctttg

SEQ ID NO: 8055142 - DNA, 22 bp, Homo sapiens
cagacaggcaggtgagagctcc

SEQ ID NO: 8055143 - DNA, 22 bp, Homo sapiens
cagacaggaattctggcgtggt

SEQ ID NO: 8055144 - DNA, 22 bp, Homo sapiens
cagacaggagactggatcatgg

SEQ ID NO: 8055145 - DNA, 22 bp, Homo sapiens
cagacaggagactggatcatgg

SEQ ID NO: 8055146 - DNA, 22 bp, Homo sapiens
cagacaggcaggtgagagctcc

SEQ ID NO: 8055147 - DNA, 22 bp, Homo sapiens
gggagcaggagcctgcctgcca

SEQ ID NO: 8055148 - DNA, 22 bp, Homo sapiens
gggagcaggacataatagcaat

SEQ ID NO: 8055149 - DNA, 22 bp, Homo sapiens
gggagcactgagaggcaggtag

SEQ ID NO: 8055150 - DNA, 19 bp, Homo sapiens
gggagcaggaaagctgtgg

SEQ ID NO: 8055151 - DNA, 22 bp, Homo sapiens
gggacaatggaggcctctctcc

SEQ ID NO: 8055152 - DNA, 22 bp, Homo sapiens
gggaaggacattctgggctcag

SEQ ID NO: 8055153 - DNA, 22 bp, Homo sapiens
gggactggcacagggctgggag

SEQ ID NO: 8055154 - DNA, 22 bp, Homo sapiens
gggactggcacagggctgggag

SEQ ID NO: 8055155 - DNA, 22 bp, Homo sapiens
gggactggatagatgtgggtga

SEQ ID NO: 8055156 - DNA, 22 bp, Homo sapiens
gggactggagtagaggccggtg

SEQ ID NO: 8055157 - DNA, 19 bp, Homo sapiens
gggactggaggatgtggag

SEQ ID NO: 8055158 - DNA, 19 bp, Homo sapiens
gggactggaggatgtggag

SEQ ID NO: 8055159 - DNA, 22 bp, Homo sapiens
gggactggaactactggtgcag

SEQ ID NO: 8055160 - DNA, 22 bp, Homo sapiens
gggacagacccatgggccaggt

SEQ ID NO: 8055161 - DNA, 22 bp, Homo sapiens
gggacagacccatgggccaggt

SEQ ID NO: 8055162 - DNA, 22 bp, Homo sapiens
gggacagaaggaagtgagcaca

SEQ ID NO: 8055163 - DNA, 22 bp, Homo sapiens
gggacagaaggaagtgagcaca

SEQ ID NO: 8055164 - DNA, 22 bp, Homo sapiens
cagaagcagtgagagatgtgca

SEQ ID NO: 8055165 - DNA, 22 bp, Homo sapiens
cactgggacctaggactgagct

SEQ ID NO: 8055166 - DNA, 22 bp, Homo sapiens
cactgggaatctgggaaagaga

SEQ ID NO: 8055167 - DNA, 22 bp, Homo sapiens
cactggctgagcttctctaggg

SEQ ID NO: 8055168 - DNA, 22 bp, Homo sapiens
cactggcccagccaggcctgtt

SEQ ID NO: 8055169 - DNA, 22 bp, Homo sapiens
cactggcccataaaggcctggg

SEQ ID NO: 8055170 - DNA, 22 bp, Homo sapiens
ggcttttgctgtgttttccaga

SEQ ID NO: 8055171 - DNA, 22 bp, Homo sapiens
ctcagactggagccccaaggac

SEQ ID NO: 8055172 - DNA, 22 bp, Homo sapiens
ctcagaatctgccaagttcagg

SEQ ID NO: 8055173 - DNA, 22 bp, Homo sapiens
agtcccagcccagtcctgtaag

SEQ ID NO: 8055174 - DNA, 22 bp, Homo sapiens
agtcccagatgacccagctact

SEQ ID NO: 8055175 - DNA, 22 bp, Homo sapiens
ctcaaaatggttaattttaata

SEQ ID NO: 8055176 - DNA, 22 bp, Homo sapiens
agtcccagagaggtcggggcca

SEQ ID NO: 8055177 - DNA, 22 bp, Homo sapiens
agtgacaggggaggcaggtgtg

SEQ ID NO: 8055178 - DNA, 22 bp, Homo sapiens
agtgacaggaccaggtctggaa

SEQ ID NO: 8055179 - DNA, 22 bp, Homo sapiens
ctcagctccagccctcagcagc

SEQ ID NO: 8055180 - DNA, 22 bp, Homo sapiens
ctcagctcaaaattcacctttg

SEQ ID NO: 8055181 - DNA, 22 bp, Homo sapiens
ctcagctctttatactagctgt

SEQ ID NO: 8055182 - DNA, 22 bp, Homo sapiens
agtctcagccacacagacctat

SEQ ID NO: 8055183 - DNA, 22 bp, Homo sapiens
ctcagggaggccctgggaccct

SEQ ID NO: 8055184 - DNA, 22 bp, Homo sapiens
ctcaggccaataagctccagcc

SEQ ID NO: 8055185 - DNA, 22 bp, Homo sapiens
agtgggagagaagcaagtagta

SEQ ID NO: 8055186 - DNA, 22 bp, Homo sapiens
agtgggagaatgaataagggcc

SEQ ID NO: 8055187 - DNA, 22 bp, Homo sapiens
ctctgtatagaaaggaaacatt

SEQ ID NO: 8055188 - DNA, 22 bp, Homo sapiens
ctctgctgcaggaaggcgtgca

SEQ ID NO: 8055189 - DNA, 22 bp, Homo sapiens
ctctggagcaccgggctatcca

SEQ ID NO: 8055190 - DNA, 19 bp, Homo sapiens
ctctggagcagacactgga

SEQ ID NO: 8055191 - DNA, 22 bp, Homo sapiens
ctctggagaggttcccatggga

SEQ ID NO: 8055192 - DNA, 19 bp, Homo sapiens
ctcttgggtggcagaggcc

SEQ ID NO: 8055193 - DNA, 22 bp, Homo sapiens
ctctgtcctccacctgctttca

SEQ ID NO: 8055194 - DNA, 22 bp, Homo sapiens
ctcctgagggatgcttaggctt

SEQ ID NO: 8055195 - DNA, 22 bp, Homo sapiens
agtgctggagggaggcaggttc

SEQ ID NO: 8055196 - DNA, 22 bp, Homo sapiens
ctcctggttcagagagctgaga

SEQ ID NO: 8055197 - DNA, 22 bp, Homo sapiens
ctcgattgagtaggccagcact

SEQ ID NO: 8055198 - DNA, 18 bp, Homo sapiens
ctccttggagaagaggcc

SEQ ID NO: 8055199 - DNA, 22 bp, Homo sapiens
ctccttggtgtagtactgagca

SEQ ID NO: 8055200 - DNA, 22 bp, Homo sapiens
ctctcctttactgcagagagcg

SEQ ID NO: 8055201 - DNA, 22 bp, Homo sapiens
ctctccttgcagatggctgcct

SEQ ID NO: 8055202 - DNA, 22 bp, Homo sapiens
ctctcccagtcaggctcaggat

SEQ ID NO: 8055203 - DNA, 22 bp, Homo sapiens
agtgctgggattacaggcataa

SEQ ID NO: 8055204 - DNA, 22 bp, Homo sapiens
agtgctgggattgcaggcatga

SEQ ID NO: 8055205 - DNA, 22 bp, Homo sapiens
agtgctggcccatagctgctgg

SEQ ID NO: 8055206 - DNA, 22 bp, Homo sapiens
ctctccattccctacagttttc

SEQ ID NO: 8055207 - DNA, 22 bp, Homo sapiens
agtgctgggctatctactgcta

SEQ ID NO: 8055208 - DNA, 22 bp, Homo sapiens
ccttgctcaagctagtgacggg

SEQ ID NO: 8055209 - DNA, 22 bp, Homo sapiens
ccttggcaaaccagggcagctg

SEQ ID NO: 8055210 - DNA, 22 bp, Homo sapiens
aggtggggctgggaaagattcc

SEQ ID NO: 8055211 - DNA, 22 bp, Homo sapiens
aggtgggggctgtgtccttgac

SEQ ID NO: 8055212 - DNA, 22 bp, Homo sapiens
aggtgggacccgtggggtgcga

SEQ ID NO: 8055213 - DNA, 22 bp, Homo sapiens
aggtgggacccgtggggtgcga

SEQ ID NO: 8055214 - DNA, 22 bp, Homo sapiens
aggtggcttctggccaggtgtg

SEQ ID NO: 8055215 - DNA, 22 bp, Homo sapiens
aggtggcttctggccaggtgtg

SEQ ID NO: 8055216 - DNA, 22 bp, Homo sapiens
aggtggctggtccaggctgcag

SEQ ID NO: 8055217 - DNA, 22 bp, Homo sapiens
aggtggctgtattcagctgtaa

SEQ ID NO: 8055218 - DNA, 17 bp, Homo sapiens
aggtggctgctgcgcct

SEQ ID NO: 8055219 - DNA, 22 bp, Homo sapiens
cctgggaagttgtggctgcagt

SEQ ID NO: 8055220 - DNA, 22 bp, Homo sapiens
cctgggactcggccaggacaga

SEQ ID NO: 8055221 - DNA, 22 bp, Homo sapiens
cctgggacctcgcgggaagcgg

SEQ ID NO: 8055222 - DNA, 19 bp, Homo sapiens
cctgggacttaggctgggt

SEQ ID NO: 8055223 - DNA, 22 bp, Homo sapiens
aggtgcaggagctgtgcaggga

SEQ ID NO: 8055224 - DNA, 22 bp, Homo sapiens
cctgggagaactgctgggttgg

SEQ ID NO: 8055225 - DNA, 22 bp, Homo sapiens
aggtgcaggagctgtgcaggga

SEQ ID NO: 8055226 - DNA, 22 bp, Homo sapiens
aggtgccattgcttgccagttt

SEQ ID NO: 8055227 - DNA, 22 bp, Homo sapiens
aggtgcctatctggtctctgca

SEQ ID NO: 8055228 - DNA, 22 bp, Homo sapiens
aggtgcctgtcgtctctggtta

SEQ ID NO: 8055229 - DNA, 22 bp, Homo sapiens
aggtgctggagtctgggcagga

SEQ ID NO: 8055230 - DNA, 22 bp, Homo sapiens
aggtgctggcgccccaggagac

SEQ ID NO: 8055231 - DNA, 22 bp, Homo sapiens
aggtgctgggcagcagtcattg

SEQ ID NO: 8055232 - DNA, 22 bp, Homo sapiens
aggtgctgtgctatgcacttgt

SEQ ID NO: 8055233 - DNA, 22 bp, Homo sapiens
aggtgctgtttgtcagcagttt

SEQ ID NO: 8055234 - DNA, 20 bp, Homo sapiens
aggtggctcttcctgggctt

SEQ ID NO: 8055235 - DNA, 20 bp, Homo sapiens
aggtggctcttcctgggctt

SEQ ID NO: 8055236 - DNA, 22 bp, Homo sapiens
aggtggcatgagactgtaccag

SEQ ID NO: 8055237 - DNA, 20 bp, Homo sapiens
cggctcagcctctccctccc

SEQ ID NO: 8055238 - DNA, 22 bp, Homo sapiens
cggctcagacttcccaagaaca

SEQ ID NO: 8055239 - DNA, 22 bp, Homo sapiens
cggaggggtttgaacagaggag

SEQ ID NO: 8055240 - DNA, 22 bp, Homo sapiens
cggaggggatacattttctgaa

SEQ ID NO: 8055241 - DNA, 22 bp, Homo sapiens
cggaggggtttgaacagaggag

SEQ ID NO: 8055242 - DNA, 22 bp, Homo sapiens
cggaggggtttgaacagaggag

SEQ ID NO: 8055243 - DNA, 22 bp, Homo sapiens
cgagcatgatgacggctgtggc

SEQ ID NO: 8055244 - DNA, 22 bp, Homo sapiens
cgaggaaatatttacaactgat

SEQ ID NO: 8055245 - DNA, 22 bp, Homo sapiens
aggtggggtgagctgcagacta

SEQ ID NO: 8055246 - DNA, 22 bp, Homo sapiens
aggtggggttcagtctcagccg

SEQ ID NO: 8055247 - DNA, 22 bp, Homo sapiens
cctttattcaattagtcctaat

SEQ ID NO: 8055248 - DNA, 22 bp, Homo sapiens
aggtggggtgttggatgtttat

SEQ ID NO: 8055249 - DNA, 19 bp, Homo sapiens
cctctgccagcccgcctct

SEQ ID NO: 8055250 - DNA, 22 bp, Homo sapiens
cctgccaggacattgcttgaag

SEQ ID NO: 8055251 - DNA, 22 bp, Homo sapiens
cctgccctatgaccagcttcac

SEQ ID NO: 8055252 - DNA, 22 bp, Homo sapiens
cctctgcagcagagagccagag

SEQ ID NO: 8055253 - DNA, 22 bp, Homo sapiens
cctctgccacctcccacgaggc

SEQ ID NO: 8055254 - DNA, 22 bp, Homo sapiens
cctctctctcctgcacacacac

SEQ ID NO: 8055255 - DNA, 22 bp, Homo sapiens
cctctctccttcctttgccaaa

SEQ ID NO: 8055256 - DNA, 20 bp, Homo sapiens
agggtctgctgggtaggaca

SEQ ID NO: 8055257 - DNA, 22 bp, Homo sapiens
agggtctgtggatgcatctggg

SEQ ID NO: 8055258 - DNA, 22 bp, Homo sapiens
agggtccttctgttcctgagca

SEQ ID NO: 8055259 - DNA, 22 bp, Homo sapiens
agggtctcagagcctgagaacc

SEQ ID NO: 8055260 - DNA, 22 bp, Homo sapiens
agggtcaggttaagggagtcat

SEQ ID NO: 8055261 - DNA, 22 bp, Homo sapiens
cctggcagctaagtgctttgag

SEQ ID NO: 8055262 - DNA, 22 bp, Homo sapiens
cctggcagcgtgccgagctgcg

SEQ ID NO: 8055263 - DNA, 22 bp, Homo sapiens
cctggcagcctcagccaattct

SEQ ID NO: 8055264 - DNA, 22 bp, Homo sapiens
cctggcagcgccgaagctggcc

SEQ ID NO: 8055265 - DNA, 22 bp, Homo sapiens
cctggcagcccagagcgccgct

SEQ ID NO: 8055266 - DNA, 22 bp, Homo sapiens
cctggaagagctgaatcaggca

SEQ ID NO: 8055267 - DNA, 22 bp, Homo sapiens
cctggaaggtgatggtacagca

SEQ ID NO: 8055268 - DNA, 22 bp, Homo sapiens
cctggaaggcaggcatggattg

SEQ ID NO: 8055269 - DNA, 22 bp, Homo sapiens
cctggaaggcaggcatggattg

SEQ ID NO: 8055270 - DNA, 22 bp, Homo sapiens
cctggacagagggcagcggcca

SEQ ID NO: 8055271 - DNA, 22 bp, Homo sapiens
cctggacagagggcagcggcca

SEQ ID NO: 8055272 - DNA, 22 bp, Homo sapiens
cctggacagggccaggccatgc

SEQ ID NO: 8055273 - DNA, 22 bp, Homo sapiens
cctggacagggccaggccatgc

SEQ ID NO: 8055274 - DNA, 22 bp, Homo sapiens
cctggacaatgagatgtcaggg

SEQ ID NO: 8055275 - DNA, 22 bp, Homo sapiens
cctggaaagattgcagttgctg

SEQ ID NO: 8055276 - DNA, 22 bp, Homo sapiens
cctggaaatgcaaaagccatga

SEQ ID NO: 8055277 - DNA, 22 bp, Homo sapiens
cctggaaatgtcgcgtgtagaa

SEQ ID NO: 8055278 - DNA, 22 bp, Homo sapiens
cctgctgctatgaaggtgacag

SEQ ID NO: 8055279 - DNA, 19 bp, Homo sapiens
cctgctgcccaccctctgc

SEQ ID NO: 8055280 - DNA, 22 bp, Homo sapiens
cctggaaagaggaaggaagcct

SEQ ID NO: 8055281 - DNA, 22 bp, Homo sapiens
cctgctcttatagctgtttcca

SEQ ID NO: 8055282 - DNA, 19 bp, Homo sapiens
cctgctgcaccacttgtta

SEQ ID NO: 8055283 - DNA, 22 bp, Homo sapiens
cctgctctccatacactttcta

SEQ ID NO: 8055284 - DNA, 22 bp, Homo sapiens
cctgctctgccaagtcctcttt

SEQ ID NO: 8055285 - DNA, 22 bp, Homo sapiens
cctggcagctcctccccggcgg

SEQ ID NO: 8055286 - DNA, 22 bp, Homo sapiens
cctggcagctccgtggccttcc

SEQ ID NO: 8055287 - DNA, 22 bp, Homo sapiens
cctggcagctgtttggcttggc

SEQ ID NO: 8055288 - DNA, 22 bp, Homo sapiens
cctggccacagggctctgcatt

SEQ ID NO: 8055289 - DNA, 20 bp, Homo sapiens
cctggccaatgagataggaa

SEQ ID NO: 8055290 - DNA, 22 bp, Homo sapiens
cctggccagaggcgtgcctgtg

SEQ ID NO: 8055291 - DNA, 22 bp, Homo sapiens
cctggctggtggcagcgacaag

SEQ ID NO: 8055292 - DNA, 19 bp, Homo sapiens
cctggctgctgtgggatgc

SEQ ID NO: 8055293 - DNA, 22 bp, Homo sapiens
ctgccaggcagcagagggagaa

SEQ ID NO: 8055294 - DNA, 22 bp, Homo sapiens
ctgccaggcactgggctctgca

SEQ ID NO: 8055295 - DNA, 22 bp, Homo sapiens
ctgccaggcacgtgcagcatca

SEQ ID NO: 8055296 - DNA, 21 bp, Homo sapiens
ctgccaggatagcatgcaggc

SEQ ID NO: 8055297 - DNA, 22 bp, Homo sapiens
ctgccaggcagggagatggctg

SEQ ID NO: 8055298 - DNA, 22 bp, Homo sapiens
agtttggctcacatctttggct

SEQ ID NO: 8055299 - DNA, 22 bp, Homo sapiens
ctgcagctgctcatgttacttg

SEQ ID NO: 8055300 - DNA, 22 bp, Homo sapiens
ctgcagctgcagttctgagaga

SEQ ID NO: 8055301 - DNA, 22 bp, Homo sapiens
agtttgaattgaaatgcagatg

SEQ ID NO: 8055302 - DNA, 22 bp, Homo sapiens
ctgcagctcccctgagatcaag

SEQ ID NO: 8055303 - DNA, 22 bp, Homo sapiens
ctgcagctcctctctgtgcccc

SEQ ID NO: 8055304 - DNA, 23 bp, Homo sapiens
agttggcatattcaagcacagtc

SEQ ID NO: 8055305 - DNA, 22 bp, Homo sapiens
agttggcaaggtctggccagcg

SEQ ID NO: 8055306 - DNA, 22 bp, Homo sapiens
agttctttatatattagggata

SEQ ID NO: 8055307 - DNA, 22 bp, Homo sapiens
ctgaggcctcgttggctggaac

SEQ ID NO: 8055308 - DNA, 20 bp, Homo sapiens
ctgaggggtctgacttggac

SEQ ID NO: 8055309 - DNA, 22 bp, Homo sapiens
ctgagggtcaacttgattgtat

SEQ ID NO: 8055310 - DNA, 22 bp, Homo sapiens
ctgaggggataaaggtttgggt

SEQ ID NO: 8055311 - DNA, 22 bp, Homo sapiens
ctgagggaacttgggcaagtct

SEQ ID NO: 8055312 - DNA, 22 bp, Homo sapiens
ctggagccccaggctgtgcaga

SEQ ID NO: 8055313 - DNA, 22 bp, Homo sapiens
ctggagcccaggcctggtgtct

SEQ ID NO: 8055314 - DNA, 22 bp, Homo sapiens
ctggagccccagacagggagag

SEQ ID NO: 8055315 - DNA, 22 bp, Homo sapiens
ctggagccatgtatagcctatg

SEQ ID NO: 8055316 - DNA, 22 bp, Homo sapiens
ctggagcccaggcctggtgtct

SEQ ID NO: 8055317 - DNA, 22 bp, Homo sapiens
ctggagccagccagggccctct

SEQ ID NO: 8055318 - DNA, 22 bp, Homo sapiens
atacagatataagattgaggag

SEQ ID NO: 8055319 - DNA, 22 bp, Homo sapiens
atacagagcagtaatagaggag

SEQ ID NO: 8055320 - DNA, 22 bp, Homo sapiens
atacagataatgattgtatgtg

SEQ ID NO: 8055321 - DNA, 22 bp, Homo sapiens
ctggagggaggaggctgctatt

SEQ ID NO: 8055322 - DNA, 22 bp, Homo sapiens
ctggagggagttaggacccgga

SEQ ID NO: 8055323 - DNA, 22 bp, Homo sapiens
ctggagggatgtagggtgtatt

SEQ ID NO: 8055324 - DNA, 22 bp, Homo sapiens
ctggagggagattcaaaggagg

SEQ ID NO: 8055325 - DNA, 22 bp, Homo sapiens
ctggaggaaaacaactgcagac

SEQ ID NO: 8055326 - DNA, 22 bp, Homo sapiens
ctggagtgaagtctggcagctt

SEQ ID NO: 8055327 - DNA, 22 bp, Homo sapiens
ctggagggctgcagcgaggctg

SEQ ID NO: 8055328 - DNA, 22 bp, Homo sapiens
ctggagggctgcagcgaggctg

SEQ ID NO: 8055329 - DNA, 22 bp, Homo sapiens
atacttctagaaatactatgca

SEQ ID NO: 8055330 - DNA, 22 bp, Homo sapiens
atacttctttagcatattgaac

SEQ ID NO: 8055331 - DNA, 22 bp, Homo sapiens
atacttctttgatgttcacagg

SEQ ID NO: 8055332 - DNA, 22 bp, Homo sapiens
atactttagagctagattgcct

SEQ ID NO: 8055333 - DNA, 22 bp, Homo sapiens
ctggcagctctactcagagcct

SEQ ID NO: 8055334 - DNA, 22 bp, Homo sapiens
ctggcagctgcccgagatgccc

SEQ ID NO: 8055335 - DNA, 22 bp, Homo sapiens
ctggcagcggtttgcagcctgg

SEQ ID NO: 8055336 - DNA, 22 bp, Homo sapiens
ctggcagcggtttgcagcctgg

SEQ ID NO: 8055337 - DNA, 22 bp, Homo sapiens
ctggcagcgtgagcagcatcca

SEQ ID NO: 8055338 - DNA, 22 bp, Homo sapiens
ctggcagcgcagcatgaagtcg

SEQ ID NO: 8055339 - DNA, 22 bp, Homo sapiens
atacaagactcagcacagacgg

SEQ ID NO: 8055340 - DNA, 22 bp, Homo sapiens
ctgctttaactctgggaagcca

SEQ ID NO: 8055341 - DNA, 22 bp, Homo sapiens
ctgcccagaagcttagagctta

SEQ ID NO: 8055342 - DNA, 22 bp, Homo sapiens
ctgcccaccgtgtgcacgtgcg

SEQ ID NO: 8055343 - DNA, 22 bp, Homo sapiens
ataatacatggttgatcttttc

SEQ ID NO: 8055344 - DNA, 22 bp, Homo sapiens
ctgctctgtatatgagcaggaa

SEQ ID NO: 8055345 - DNA, 22 bp, Homo sapiens
ctgctctggggaagccagatgt

SEQ ID NO: 8055346 - DNA, 22 bp, Homo sapiens
ctgctctgcaaggcacagtgat

SEQ ID NO: 8055347 - DNA, 22 bp, Homo sapiens
ctgctctgctgatcagtgtctc

SEQ ID NO: 8055348 - DNA, 20 bp, Homo sapiens
ctgctctgctttgcaggtgg

SEQ ID NO: 8055349 - DNA, 22 bp, Homo sapiens
ctgctctgctgatcagtgtctc

SEQ ID NO: 8055350 - DNA, 19 bp, Homo sapiens
atatatgtatacaatgtgg

SEQ ID NO: 8055351 - DNA, 22 bp, Homo sapiens
atatgacagcggattcacatat

SEQ ID NO: 8055352 - DNA, 22 bp, Homo sapiens
ctgggcaggatacttcatggga

SEQ ID NO: 8055353 - DNA, 22 bp, Homo sapiens
atatggcagaccaattagaagc

SEQ ID NO: 8055354 - DNA, 22 bp, Homo sapiens
atatgggggggcgtgcagagga

SEQ ID NO: 8055355 - DNA, 22 bp, Homo sapiens
atatggctgttgcacatctaag

SEQ ID NO: 8055356 - DNA, 22 bp, Homo sapiens
atatttgaaattatcacaggaa

SEQ ID NO: 8055357 - DNA, 22 bp, Homo sapiens
atataatacaacctgctaagtg

SEQ ID NO: 8055358 - DNA, 20 bp, Homo sapiens
atataataaattttggttac

SEQ ID NO: 8055359 - DNA, 22 bp, Homo sapiens
atataacatacatacagaaaag

SEQ ID NO: 8055360 - DNA, 22 bp, Homo sapiens
atataactcttgttcttatagt

SEQ ID NO: 8055361 - DNA, 22 bp, Homo sapiens
ctggcagctggaggctagaggc

SEQ ID NO: 8055362 - DNA, 22 bp, Homo sapiens
ctggcagctggaggctagaggc

SEQ ID NO: 8055363 - DNA, 22 bp, Homo sapiens
ctggcagctgcccgagatgccc

SEQ ID NO: 8055364 - DNA, 22 bp, Homo sapiens
ctggcagcttagcactctggtt

SEQ ID NO: 8055365 - DNA, 22 bp, Homo sapiens
ctggcagcttagcactctggtt

SEQ ID NO: 8055366 - DNA, 22 bp, Homo sapiens
ctggcagctgtgtgaagaactg

SEQ ID NO: 8055367 - DNA, 22 bp, Homo sapiens
ctgggaagggacgccagtgcct

SEQ ID NO: 8055368 - DNA, 22 bp, Homo sapiens
ctgggacaagctctgtctagct

SEQ ID NO: 8055369 - DNA, 22 bp, Homo sapiens
ctgggaagtagaatcagatgag

SEQ ID NO: 8055370 - DNA, 22 bp, Homo sapiens
ctgggagacaagagagggctga

SEQ ID NO: 8055371 - DNA, 22 bp, Homo sapiens
ctgggagaatttgttgaaggat

SEQ ID NO: 8055372 - DNA, 22 bp, Homo sapiens
ctgggagacaagagagggctga

SEQ ID NO: 8055373 - DNA, 22 bp, Homo sapiens
ctgggagacgcagctggggatc

SEQ ID NO: 8055374 - DNA, 22 bp, Homo sapiens
ctgggagagaagcgaagctggg

SEQ ID NO: 8055375 - DNA, 22 bp, Homo sapiens
ctgggagaggaacctcgagggt

SEQ ID NO: 8055376 - DNA, 22 bp, Homo sapiens
atatatactttgacacattctg

SEQ ID NO: 8055377 - DNA, 22 bp, Homo sapiens
ctgggcacagcgttgggctctt

SEQ ID NO: 8055378 - DNA, 22 bp, Homo sapiens
ctgggcacagaccccctgggcc

SEQ ID NO: 8055379 - DNA, 22 bp, Homo sapiens
ctgggcacaagtggccctggat

SEQ ID NO: 8055380 - DNA, 22 bp, Homo sapiens
ctgggcacagtggctcacgcct

SEQ ID NO: 8055381 - DNA, 22 bp, Homo sapiens
ctgggcacctttgcagcaggct

SEQ ID NO: 8055382 - DNA, 22 bp, Homo sapiens
atatatattgcccaggctggtt

SEQ ID NO: 8055383 - DNA, 22 bp, Homo sapiens
atatatatgctgatggctgcca

SEQ ID NO: 8055384 - DNA, 22 bp, Homo sapiens
atcatgtacttgacaaatatgt

SEQ ID NO: 8055385 - DNA, 22 bp, Homo sapiens
atcatgtaccctaaaaatggaa

SEQ ID NO: 8055386 - DNA, 22 bp, Homo sapiens
atcatgtgtaatttcaagctac

SEQ ID NO: 8055387 - DNA, 22 bp, Homo sapiens
ctgtgcacttctctttatttgt

SEQ ID NO: 8055388 - DNA, 22 bp, Homo sapiens
ctgtgcaagcccaagataaaac

SEQ ID NO: 8055389 - DNA, 22 bp, Homo sapiens
atcacatatttaagaaacatgt

SEQ ID NO: 8055390 - DNA, 22 bp, Homo sapiens
atcacagtggcagggatttggg

SEQ ID NO: 8055391 - DNA, 22 bp, Homo sapiens
atcacagtgctaggctgaggga

SEQ ID NO: 8055392 - DNA, 22 bp, Homo sapiens
atcacagttactcaaataatga

SEQ ID NO: 8055393 - DNA, 22 bp, Homo sapiens
ctgtcctctgtcctcagcagga

SEQ ID NO: 8055394 - DNA, 22 bp, Homo sapiens
atcacagctcccttatacacag

SEQ ID NO: 8055395 - DNA, 22 bp, Homo sapiens
ctgtcctccagacgacagtccc

SEQ ID NO: 8055396 - DNA, 22 bp, Homo sapiens
ctgtcctccggccacctacagt

SEQ ID NO: 8055397 - DNA, 22 bp, Homo sapiens
ctgtcctccagacgacagtccc

SEQ ID NO: 8055398 - DNA, 21 bp, Homo sapiens
ctgtcctcagatgtggacgag

SEQ ID NO: 8055399 - DNA, 22 bp, Homo sapiens
ctgtcctcatctgccccaaggg

SEQ ID NO: 8055400 - DNA, 22 bp, Homo sapiens
ctgtcctcaccttggcaggggg

SEQ ID NO: 8055401 - DNA, 22 bp, Homo sapiens
ctgtcctcaacccatccttctc

SEQ ID NO: 8055402 - DNA, 22 bp, Homo sapiens
ctgggtagggcaaggaactggc

SEQ ID NO: 8055403 - DNA, 22 bp, Homo sapiens
atcctttaagttaataaaattc

SEQ ID NO: 8055404 - DNA, 22 bp, Homo sapiens
atcctctgtggattacacctag

SEQ ID NO: 8055405 - DNA, 22 bp, Homo sapiens
atcctctgaccgctgcagggag

SEQ ID NO: 8055406 - DNA, 22 bp, Homo sapiens
atcctcacatttgggcaggtga

SEQ ID NO: 8055407 - DNA, 22 bp, Homo sapiens
atccaaacatgtaccacactaa

SEQ ID NO: 8055408 - DNA, 22 bp, Homo sapiens
ctgtggagatgcagaccaggcc

SEQ ID NO: 8055409 - DNA, 22 bp, Homo sapiens
ctgtggagcagggcagggtcac

SEQ ID NO: 8055410 - DNA, 22 bp, Homo sapiens
ctgtggagcagggcagggtcac

SEQ ID NO: 8055411 - DNA, 22 bp, Homo sapiens
ctgtggagtgcttggctcagtg

SEQ ID NO: 8055412 - DNA, 22 bp, Homo sapiens
ctgtggagtgcttggctcagtg

SEQ ID NO: 8055413 - DNA, 22 bp, Homo sapiens
aggcctcatgtcaaagcagcaa

SEQ ID NO: 8055414 - DNA, 22 bp, Homo sapiens
aggcctcatagtagacctgccc

SEQ ID NO: 8055415 - DNA, 22 bp, Homo sapiens
aggcctcagtttgtcatctgta

SEQ ID NO: 8055416 - DNA, 22 bp, Homo sapiens
aggcctcaggaaggtaaagaag

SEQ ID NO: 8055417 - DNA, 22 bp, Homo sapiens
aggcctcagtgatcatcatcag

SEQ ID NO: 8055418 - DNA, 22 bp, Homo sapiens
aggcctcagttcttgccaggtg

SEQ ID NO: 8055419 - DNA, 22 bp, Homo sapiens
aggcctcagcctgccaggcctg

SEQ ID NO: 8055420 - DNA, 22 bp, Homo sapiens
aggcctcactctcagagcttct

SEQ ID NO: 8055421 - DNA, 22 bp, Homo sapiens
aggcctcacacaacagatgcat

SEQ ID NO: 8055422 - DNA, 22 bp, Homo sapiens
aggcctagaggaatggccaggg

SEQ ID NO: 8055423 - DNA, 22 bp, Homo sapiens
aggcctagaggaatggccaggg

SEQ ID NO: 8055424 - DNA, 22 bp, Homo sapiens
ccaggccagagtgcagtggcac

SEQ ID NO: 8055425 - DNA, 22 bp, Homo sapiens
ccaggccaaattcagtcagcag

SEQ ID NO: 8055426 - DNA, 22 bp, Homo sapiens
ccaggcattgtgagtgggcagg

SEQ ID NO: 8055427 - DNA, 22 bp, Homo sapiens
ccaggcagggctcaaggaacct

SEQ ID NO: 8055428 - DNA, 22 bp, Homo sapiens
ccaggctctgacatagatggga

SEQ ID NO: 8055429 - DNA, 22 bp, Homo sapiens
ccaggctctatccctccttctt

SEQ ID NO: 8055430 - DNA, 22 bp, Homo sapiens
aggctccattttcctgcagctg

SEQ ID NO: 8055431 - DNA, 22 bp, Homo sapiens
ccaggctctgcgctggacatgg

SEQ ID NO: 8055432 - DNA, 22 bp, Homo sapiens
ccaggctctgccaggcccttga

SEQ ID NO: 8055433 - DNA, 22 bp, Homo sapiens
ccaggcctagcccctgagggta

SEQ ID NO: 8055434 - DNA, 22 bp, Homo sapiens
aggctccatgcaaaggctgttt

SEQ ID NO: 8055435 - DNA, 22 bp, Homo sapiens
aggctccagtctgaaccttggg

SEQ ID NO: 8055436 - DNA, 22 bp, Homo sapiens
ccaggcctcacctgcccaccta

SEQ ID NO: 8055437 - DNA, 22 bp, Homo sapiens
aggctctgttattctagagggc

SEQ ID NO: 8055438 - DNA, 22 bp, Homo sapiens
aggctctgttattctagagggc

SEQ ID NO: 8055439 - DNA, 22 bp, Homo sapiens
aggctctgatcaggtggctgtg

SEQ ID NO: 8055440 - DNA, 22 bp, Homo sapiens
aggctctgagtctggtgtctgc

SEQ ID NO: 8055441 - DNA, 22 bp, Homo sapiens
aggctctgatcaggtggctgtg

SEQ ID NO: 8055442 - DNA, 19 bp, Homo sapiens
aggctctgagctcctggag

SEQ ID NO: 8055443 - DNA, 22 bp, Homo sapiens
aggctctgagtagagctgccag

SEQ ID NO: 8055444 - DNA, 22 bp, Homo sapiens
aggctctgcagtgctggaggac

SEQ ID NO: 8055445 - DNA, 22 bp, Homo sapiens
aggctctgcagtgctggaggac

SEQ ID NO: 8055446 - DNA, 22 bp, Homo sapiens
aggctctgcagtgctggaggac

SEQ ID NO: 8055447 - DNA, 22 bp, Homo sapiens
aggctctgcagaccccagctgt

SEQ ID NO: 8055448 - DNA, 22 bp, Homo sapiens
aggctctgcagtccatcccgtg

SEQ ID NO: 8055449 - DNA, 22 bp, Homo sapiens
aggcagtggagctggaataggc

SEQ ID NO: 8055450 - DNA, 22 bp, Homo sapiens
aggcagtgctcaagacagcagc

SEQ ID NO: 8055451 - DNA, 18 bp, Homo sapiens
aggcaggtgctaatattt

SEQ ID NO: 8055452 - DNA, 18 bp, Homo sapiens
aggcaggtgctggaagtc

SEQ ID NO: 8055453 - DNA, 22 bp, Homo sapiens
aggcaggtttactcttatttgg

SEQ ID NO: 8055454 - DNA, 22 bp, Homo sapiens
aggcagtctatctctggagcct

SEQ ID NO: 8055455 - DNA, 22 bp, Homo sapiens
aggcaggtttcccggctgtcaa

SEQ ID NO: 8055456 - DNA, 23 bp, Homo sapiens
aggcaggtttgggctcttcttgt

SEQ ID NO: 8055457 - DNA, 22 bp, Homo sapiens
aggcagccattaccaagggcat

SEQ ID NO: 8055458 - DNA, 22 bp, Homo sapiens
aggcagcccacaggacacagga

SEQ ID NO: 8055459 - DNA, 22 bp, Homo sapiens
aggcagccatctgcaggaagga

SEQ ID NO: 8055460 - DNA, 22 bp, Homo sapiens
aggcagccctgtgctggatgct

SEQ ID NO: 8055461 - DNA, 22 bp, Homo sapiens
ccactgctctgccaggagctgg

SEQ ID NO: 8055462 - DNA, 22 bp, Homo sapiens
aggcatggcatggggcagatgt

SEQ ID NO: 8055463 - DNA, 22 bp, Homo sapiens
aggcatggcatggggcagatgt

SEQ ID NO: 8055464 - DNA, 22 bp, Homo sapiens
aggcatggcatggggcagatgt

SEQ ID NO: 8055465 - DNA, 22 bp, Homo sapiens
aggcatggcatggggcagatgt

SEQ ID NO: 8055466 - DNA, 22 bp, Homo sapiens
aggcatcaggagtatagccaga

SEQ ID NO: 8055467 - DNA, 22 bp, Homo sapiens
aggcatcaggagtatagccaga

SEQ ID NO: 8055468 - DNA, 22 bp, Homo sapiens
aggccccaaagcagtgcaagta

SEQ ID NO: 8055469 - DNA, 22 bp, Homo sapiens
aggccccatcaggaaggaggcc

SEQ ID NO: 8055470 - DNA, 22 bp, Homo sapiens
aggcccagttatcctacttgtt

SEQ ID NO: 8055471 - DNA, 22 bp, Homo sapiens
aggcccagttatcctacttgtt

SEQ ID NO: 8055472 - DNA, 22 bp, Homo sapiens
aggccctggtcaggtctggctg

SEQ ID NO: 8055473 - DNA, 22 bp, Homo sapiens
aggcctagagctttggagggca

SEQ ID NO: 8055474 - DNA, 22 bp, Homo sapiens
aggccgtgtgagcatgtgtgag

SEQ ID NO: 8055475 - DNA, 22 bp, Homo sapiens
aggccctattcaatggggccca

SEQ ID NO: 8055476 - DNA, 22 bp, Homo sapiens
aggccctaatccaacatgactg

SEQ ID NO: 8055477 - DNA, 22 bp, Homo sapiens
aggccaggaccattagcccaga

SEQ ID NO: 8055478 - DNA, 22 bp, Homo sapiens
aggccagcttctaccctctgtt

SEQ ID NO: 8055479 - DNA, 22 bp, Homo sapiens
aggccaggaatccttgtcccag

SEQ ID NO: 8055480 - DNA, 22 bp, Homo sapiens
aggcccagtcctctgccgtctg

SEQ ID NO: 8055481 - DNA, 22 bp, Homo sapiens
aggcccagtgtggcttcctgga

SEQ ID NO: 8055482 - DNA, 22 bp, Homo sapiens
aggcccagtagtgctgccttta

SEQ ID NO: 8055483 - DNA, 22 bp, Homo sapiens
aggcccagctgggccaggaaca

SEQ ID NO: 8055484 - DNA, 22 bp, Homo sapiens
aggccaggatagcatggatcag

SEQ ID NO: 8055485 - DNA, 22 bp, Homo sapiens
aggccagctatgactctgctcc

SEQ ID NO: 8055486 - DNA, 22 bp, Homo sapiens
aggccacaagaaaatgcttcat

SEQ ID NO: 8055487 - DNA, 22 bp, Homo sapiens
aggccagctgccacccggtccg

SEQ ID NO: 8055488 - DNA, 22 bp, Homo sapiens
aggccagctctacccttggact

SEQ ID NO: 8055489 - DNA, 22 bp, Homo sapiens
aggccagctcaccctggctcct

SEQ ID NO: 8055490 - DNA, 22 bp, Homo sapiens
aggccagctgttactagagcca

SEQ ID NO: 8055491 - DNA, 22 bp, Homo sapiens
aggccacaaccaccctgtgccc

SEQ ID NO: 8055492 - DNA, 22 bp, Homo sapiens
aggccaagtgctgggacaggtg

SEQ ID NO: 8055493 - DNA, 22 bp, Homo sapiens
agggagccctgaaccagagggt

SEQ ID NO: 8055494 - DNA, 22 bp, Homo sapiens
agggagccagagttgggagctc

SEQ ID NO: 8055495 - DNA, 19 bp, Homo sapiens
ccccagggtaggctagggg

SEQ ID NO: 8055496 - DNA, 22 bp, Homo sapiens
ccccagggtcagtgtgtggagg

SEQ ID NO: 8055497 - DNA, 22 bp, Homo sapiens
agggaaggaaaagctgtcgctt

SEQ ID NO: 8055498 - DNA, 22 bp, Homo sapiens
agggaaggaggttagaacccac

SEQ ID NO: 8055499 - DNA, 22 bp, Homo sapiens
agggaaggcttttgacatttcc

SEQ ID NO: 8055500 - DNA, 19 bp, Homo sapiens
agggaaggattctgtcatt

SEQ ID NO: 8055501 - DNA, 22 bp, Homo sapiens
agggagaaggtttagctgtgag

SEQ ID NO: 8055502 - DNA, 22 bp, Homo sapiens
agggagaggttgaaacctcagt

SEQ ID NO: 8055503 - DNA, 22 bp, Homo sapiens
agggagagtagatatcaggtgt

SEQ ID NO: 8055504 - DNA, 22 bp, Homo sapiens
cccagcctggtgcactgtgggg

SEQ ID NO: 8055505 - DNA, 22 bp, Homo sapiens
cccagcctggtgcactgtgggg

SEQ ID NO: 8055506 - DNA, 22 bp, Homo sapiens
cccagctccttgtttgcatctc

SEQ ID NO: 8055507 - DNA, 22 bp, Homo sapiens
cccagcctctgtttgctcctct

SEQ ID NO: 8055508 - DNA, 22 bp, Homo sapiens
cccagcctctgtttgctcctct

SEQ ID NO: 8055509 - DNA, 22 bp, Homo sapiens
cccagctctgccatctacccac

SEQ ID NO: 8055510 - DNA, 22 bp, Homo sapiens
cccagcagttgttggtgcacat

SEQ ID NO: 8055511 - DNA, 22 bp, Homo sapiens
cccagcagttgttggtgcacat

SEQ ID NO: 8055512 - DNA, 22 bp, Homo sapiens
cccagcagtggttctcaaactt

SEQ ID NO: 8055513 - DNA, 22 bp, Homo sapiens
cccagcagtttgcttagagtga

SEQ ID NO: 8055514 - DNA, 22 bp, Homo sapiens
cccagcagtttgcttagagtga

SEQ ID NO: 8055515 - DNA, 22 bp, Homo sapiens
cccagcagtacccaagcccttg

SEQ ID NO: 8055516 - DNA, 22 bp, Homo sapiens
cccagcagtgacccagtgatac

SEQ ID NO: 8055517 - DNA, 22 bp, Homo sapiens
cccagcagtgacccagtgatac

SEQ ID NO: 8055518 - DNA, 22 bp, Homo sapiens
ccatctgactgccacccaggcc

SEQ ID NO: 8055519 - DNA, 22 bp, Homo sapiens
cccttcagggttaagtagaggg

SEQ ID NO: 8055520 - DNA, 22 bp, Homo sapiens
ccctgtggttgctagggcacag

SEQ ID NO: 8055521 - DNA, 22 bp, Homo sapiens
cctcagaccttgctagtagtct

SEQ ID NO: 8055522 - DNA, 22 bp, Homo sapiens
cctcagacacagtcaagctttt

SEQ ID NO: 8055523 - DNA, 22 bp, Homo sapiens
cctctctcagcttgctgcaact

SEQ ID NO: 8055524 - DNA, 22 bp, Homo sapiens
cctctctccaattttcacctca

SEQ ID NO: 8055525 - DNA, 22 bp, Homo sapiens
cctcgcggcactcgggccggat

SEQ ID NO: 8055526 - DNA, 22 bp, Homo sapiens
cctcagtcttgaattagccaga

SEQ ID NO: 8055527 - DNA, 19 bp, Homo sapiens
agggccaggattctggaac

SEQ ID NO: 8055528 - DNA, 22 bp, Homo sapiens
agggccaggatcacagccaaga

SEQ ID NO: 8055529 - DNA, 22 bp, Homo sapiens
agggccagctagagccctcgcc

SEQ ID NO: 8055530 - DNA, 22 bp, Homo sapiens
ccctgggcagtctgcacttcag

SEQ ID NO: 8055531 - DNA, 22 bp, Homo sapiens
ccctgggcaccaggcctggtaa

SEQ ID NO: 8055532 - DNA, 22 bp, Homo sapiens
ccctggggagcaggcgaaggag

SEQ ID NO: 8055533 - DNA, 22 bp, Homo sapiens
ccctggggctgagggatggccg

SEQ ID NO: 8055534 - DNA, 22 bp, Homo sapiens
ccctggggagcaggcgaaggag

SEQ ID NO: 8055535 - DNA, 22 bp, Homo sapiens
agggccaggctcccatgtcagg

SEQ ID NO: 8055536 - DNA, 22 bp, Homo sapiens
agggccagggaaacgatcagca

SEQ ID NO: 8055537 - DNA, 21 bp, Homo sapiens
ccctgggatgggcttggactt

SEQ ID NO: 8055538 - DNA, 22 bp, Homo sapiens
agggaggaccaatgtgtggtta

SEQ ID NO: 8055539 - DNA, 22 bp, Homo sapiens
agggcagccatgagccttcagg

SEQ ID NO: 8055540 - DNA, 22 bp, Homo sapiens
agggcagccatgagccttcagg

SEQ ID NO: 8055541 - DNA, 22 bp, Homo sapiens
agggcagccattgagggattct

SEQ ID NO: 8055542 - DNA, 22 bp, Homo sapiens
agggcagcccttctgggagggc

SEQ ID NO: 8055543 - DNA, 22 bp, Homo sapiens
agggcagcagctgtccctgaga

SEQ ID NO: 8055544 - DNA, 22 bp, Homo sapiens
agggcagctgtgagccactgtg

SEQ ID NO: 8055545 - DNA, 22 bp, Homo sapiens
agggcagctctcacctctggcc

SEQ ID NO: 8055546 - DNA, 22 bp, Homo sapiens
agggcagctggaaggtggcttc

SEQ ID NO: 8055547 - DNA, 22 bp, Homo sapiens
agggcagctaaggtgctgactg

SEQ ID NO: 8055548 - DNA, 22 bp, Homo sapiens
agggcagcctgagtgctggccc

SEQ ID NO: 8055549 - DNA, 22 bp, Homo sapiens
agggcagcctgagtgctggccc

SEQ ID NO: 8055550 - DNA, 22 bp, Homo sapiens
agggcagcctgagtgctggccc

SEQ ID NO: 8055551 - DNA, 22 bp, Homo sapiens
agggcagcctctcagcctaggt

SEQ ID NO: 8055552 - DNA, 22 bp, Homo sapiens
agggcagcctctcagcctaggt

SEQ ID NO: 8055553 - DNA, 22 bp, Homo sapiens
cattccacactgcaggaaatat

SEQ ID NO: 8055554 - DNA, 22 bp, Homo sapiens
cattcccacgtgttctttgctt

SEQ ID NO: 8055555 - DNA, 22 bp, Homo sapiens
cattcatttgcccagtaagtca

SEQ ID NO: 8055556 - DNA, 22 bp, Homo sapiens
aggcagcagaaaacaaatggtt

SEQ ID NO: 8055557 - DNA, 22 bp, Homo sapiens
cattatctcttctatatgctag

SEQ ID NO: 8055558 - DNA, 22 bp, Homo sapiens
catggctcggggacaggaggta

SEQ ID NO: 8055559 - DNA, 22 bp, Homo sapiens
catggccttgagtgactgcact

SEQ ID NO: 8055560 - DNA, 22 bp, Homo sapiens
catggcctcaaaggactgcaga

SEQ ID NO: 8055561 - DNA, 22 bp, Homo sapiens
catggcctgcctcctcctggtg

SEQ ID NO: 8055562 - DNA, 22 bp, Homo sapiens
aggcagccacatgagctcctga

SEQ ID NO: 8055563 - DNA, 22 bp, Homo sapiens
aggcagccagatggcagcctgc

SEQ ID NO: 8055564 - DNA, 21 bp, Homo sapiens
aggcagccagtcatgctccct

SEQ ID NO: 8055565 - DNA, 22 bp, Homo sapiens
aggcagccaatcagaggctgac

SEQ ID NO: 8055566 - DNA, 22 bp, Homo sapiens
aggcagcatttctgcttatcca

SEQ ID NO: 8055567 - DNA, 22 bp, Homo sapiens
aggcagcagtcatgaggaaaga

SEQ ID NO: 8055568 - DNA, 19 bp, Homo sapiens
aggcagcattctggggctt

SEQ ID NO: 8055569 - DNA, 22 bp, Homo sapiens
aggcagcagaaaacaaatggtt

SEQ ID NO: 8055570 - DNA, 22 bp, Homo sapiens
aggcagcagaggttgaggaaag

SEQ ID NO: 8055571 - DNA, 22 bp, Homo sapiens
aggcagcagcttgctggttgcc

SEQ ID NO: 8055572 - DNA, 22 bp, Homo sapiens
aggcacaggaatgtcatccagt

SEQ ID NO: 8055573 - DNA, 22 bp, Homo sapiens
catggccaggcccagggcccag

SEQ ID NO: 8055574 - DNA, 22 bp, Homo sapiens
aggcacaggcctcagcacccag

SEQ ID NO: 8055575 - DNA, 22 bp, Homo sapiens
aggcacaggcctcagcacccag

SEQ ID NO: 8055576 - DNA, 22 bp, Homo sapiens
aggcacagcctcccccaactcc

SEQ ID NO: 8055577 - DNA, 21 bp, Homo sapiens
catgcaggatttaacctagaa

SEQ ID NO: 8055578 - DNA, 22 bp, Homo sapiens
catgcaggaggaaaaagcagct

SEQ ID NO: 8055579 - DNA, 22 bp, Homo sapiens
catgcaggaggaaaaagcagct

SEQ ID NO: 8055580 - DNA, 22 bp, Homo sapiens
catgccagggcttgctgcctgg

SEQ ID NO: 8055581 - DNA, 22 bp, Homo sapiens
catgcaggcctatggagcagtg

SEQ ID NO: 8055582 - DNA, 22 bp, Homo sapiens
catgcaggcctatggagcagtg

SEQ ID NO: 8055583 - DNA, 22 bp, Homo sapiens
catgccaggattaggacccagc

SEQ ID NO: 8055584 - DNA, 17 bp, Homo sapiens
catgccccaggcttagc

SEQ ID NO: 8055585 - DNA, 22 bp, Homo sapiens
catgcccagagctccgggcgcc

SEQ ID NO: 8055586 - DNA, 22 bp, Homo sapiens
catgagtgctatatgtgaagag

SEQ ID NO: 8055587 - DNA, 22 bp, Homo sapiens
aggaggtggctgaacttgaggg

SEQ ID NO: 8055588 - DNA, 22 bp, Homo sapiens
cagtctctgtgccagatcctgg

SEQ ID NO: 8055589 - DNA, 22 bp, Homo sapiens
cagtctctgggaaagaggacag

SEQ ID NO: 8055590 - DNA, 22 bp, Homo sapiens
cagtctcttttcagctccatcc

SEQ ID NO: 8055591 - DNA, 21 bp, Homo sapiens
aggacaggaactggctgaata

SEQ ID NO: 8055592 - DNA, 22 bp, Homo sapiens
aggacagcccttgagagcacat

SEQ ID NO: 8055593 - DNA, 22 bp, Homo sapiens
aggacagcccccaacagcaaca

SEQ ID NO: 8055594 - DNA, 22 bp, Homo sapiens
aggacagcattttcagcatctc

SEQ ID NO: 8055595 - DNA, 22 bp, Homo sapiens
aggacagcagtgctggcacttg

SEQ ID NO: 8055596 - DNA, 22 bp, Homo sapiens
aggacagcatatgggaaccagt

SEQ ID NO: 8055597 - DNA, 22 bp, Homo sapiens
cagtcctgaatactggacggtg

SEQ ID NO: 8055598 - DNA, 22 bp, Homo sapiens
cagtcctgggcacagccctggg

SEQ ID NO: 8055599 - DNA, 20 bp, Homo sapiens
aggacagcagctgccacttg

SEQ ID NO: 8055600 - DNA, 20 bp, Homo sapiens
aggaaggaagtttgcatgga

SEQ ID NO: 8055601 - DNA, 18 bp, Homo sapiens
aggagcctttgcactgga

SEQ ID NO: 8055602 - DNA, 19 bp, Homo sapiens
aggagccttgagcagtgag

SEQ ID NO: 8055603 - DNA, 19 bp, Homo sapiens
aggagccttgagcagtgag

SEQ ID NO: 8055604 - DNA, 22 bp, Homo sapiens
aggagaggtctcccttccccag

SEQ ID NO: 8055605 - DNA, 22 bp, Homo sapiens
aggagcctggctggcccacagg

SEQ ID NO: 8055606 - DNA, 22 bp, Homo sapiens
aggagatagtcaaagcttcttg

SEQ ID NO: 8055607 - DNA, 22 bp, Homo sapiens
aggagccatgagcaggaggcaa

SEQ ID NO: 8055608 - DNA, 22 bp, Homo sapiens
aggagaggctctaactctgtgt

SEQ ID NO: 8055609 - DNA, 22 bp, Homo sapiens
aggagagcaggccagccgtccc

SEQ ID NO: 8055610 - DNA, 22 bp, Homo sapiens
aggagaggcatcaagaaaatcg

SEQ ID NO: 8055611 - DNA, 22 bp, Homo sapiens
aggagagaggttttaaatgggg

SEQ ID NO: 8055612 - DNA, 22 bp, Homo sapiens
aggagagagctgagctttgctg

SEQ ID NO: 8055613 - DNA, 22 bp, Homo sapiens
aggagagaattactgggtgtca

SEQ ID NO: 8055614 - DNA, 22 bp, Homo sapiens
aggagctgtgaatgggaggggt

SEQ ID NO: 8055615 - DNA, 21 bp, Homo sapiens
aggagctgtgtgcttcctttc

SEQ ID NO: 8055616 - DNA, 22 bp, Homo sapiens
aggagctgatagtctatggaga

SEQ ID NO: 8055617 - DNA, 22 bp, Homo sapiens
aggagctgatagtctatggaga

SEQ ID NO: 8055618 - DNA, 22 bp, Homo sapiens
aggagctgataaaagggggtca

SEQ ID NO: 8055619 - DNA, 22 bp, Homo sapiens
aggagctgagtcagcccgacag

SEQ ID NO: 8055620 - DNA, 22 bp, Homo sapiens
aggagctgagtcagcccgacag

SEQ ID NO: 8055621 - DNA, 22 bp, Homo sapiens
aggagctgagggagcgcccttg

SEQ ID NO: 8055622 - DNA, 20 bp, Homo sapiens
aggagctgaattagagggtt

SEQ ID NO: 8055623 - DNA, 20 bp, Homo sapiens
aggagctgaattagagggtt

SEQ ID NO: 8055624 - DNA, 20 bp, Homo sapiens
aggagctgaattagagggtt

SEQ ID NO: 8055625 - DNA, 22 bp, Homo sapiens
aggagctgaagtctctgcactc

SEQ ID NO: 8055626 - DNA, 22 bp, Homo sapiens
aggaggaggtgggacacagtga

SEQ ID NO: 8055627 - DNA, 22 bp, Homo sapiens
agctttatatgttgtttctcca

SEQ ID NO: 8055628 - DNA, 22 bp, Homo sapiens
agctttatagaaaggatcagtg

SEQ ID NO: 8055629 - DNA, 22 bp, Homo sapiens
agctttatataaaagagtacat

SEQ ID NO: 8055630 - DNA, 22 bp, Homo sapiens
agctttatataaaagagtacat

SEQ ID NO: 8055631 - DNA, 22 bp, Homo sapiens
agctttatatgttgtttctcca

SEQ ID NO: 8055632 - DNA, 22 bp, Homo sapiens
agctttatagaaaggatcagtg

SEQ ID NO: 8055633 - DNA, 22 bp, Homo sapiens
cagggccactgtagatgaggag

SEQ ID NO: 8055634 - DNA, 22 bp, Homo sapiens
cagggccagccgcagcatccac

SEQ ID NO: 8055635 - DNA, 22 bp, Homo sapiens
cagggccagagagggctggctg

SEQ ID NO: 8055636 - DNA, 22 bp, Homo sapiens
cagggccagccatcctgctggg

SEQ ID NO: 8055637 - DNA, 22 bp, Homo sapiens
cagggccagagagggctggctg

SEQ ID NO: 8055638 - DNA, 22 bp, Homo sapiens
cagggccagagagggctggctg

SEQ ID NO: 8055639 - DNA, 22 bp, Homo sapiens
aggaaataggaccagacaaagc

SEQ ID NO: 8055640 - DNA, 22 bp, Homo sapiens
aggaaccctgcgccatactttg

SEQ ID NO: 8055641 - DNA, 22 bp, Homo sapiens
aggaacccggtctgtcactgtg

SEQ ID NO: 8055642 - DNA, 22 bp, Homo sapiens
caggccccattcctcttgggac

SEQ ID NO: 8055643 - DNA, 21 bp, Homo sapiens
caggccgggtgagcaggcagc

SEQ ID NO: 8055644 - DNA, 21 bp, Homo sapiens
caggccccaggcctggggtgc

SEQ ID NO: 8055645 - DNA, 22 bp, Homo sapiens
agctgggaagagttttctgcag

SEQ ID NO: 8055646 - DNA, 22 bp, Homo sapiens
caggccggtgattctggatgta

SEQ ID NO: 8055647 - DNA, 22 bp, Homo sapiens
caggcctcaccagcggagctgc

SEQ ID NO: 8055648 - DNA, 22 bp, Homo sapiens
caggcctcagagagtggcgggg

SEQ ID NO: 8055649 - DNA, 22 bp, Homo sapiens
caggcctcaggggctcaggctg

SEQ ID NO: 8055650 - DNA, 22 bp, Homo sapiens
caggcctcagggctgtccgtag

SEQ ID NO: 8055651 - DNA, 22 bp, Homo sapiens
caggcctcatggtgtgtccttc

SEQ ID NO: 8055652 - DNA, 22 bp, Homo sapiens
caggcctccactccacgcagac

SEQ ID NO: 8055653 - DNA, 22 bp, Homo sapiens
caggcctcccggtgcacactga

SEQ ID NO: 8055654 - DNA, 22 bp, Homo sapiens
caggcctggcccccggcacacc

SEQ ID NO: 8055655 - DNA, 22 bp, Homo sapiens
caggcctggcccccggcacacc

SEQ ID NO: 8055656 - DNA, 22 bp, Homo sapiens
caggcctggctgcagctcgcct

SEQ ID NO: 8055657 - DNA, 22 bp, Homo sapiens
caggcctgggctgggtatcagg

SEQ ID NO: 8055658 - DNA, 22 bp, Homo sapiens
caggcctgggcttcggggctga

SEQ ID NO: 8055659 - DNA, 22 bp, Homo sapiens
agctgtggccagatgtgagcgg

SEQ ID NO: 8055660 - DNA, 22 bp, Homo sapiens
caggcctgggttcaaatccctt

SEQ ID NO: 8055661 - DNA, 22 bp, Homo sapiens
caggcctggggctggcttccag

SEQ ID NO: 8055662 - DNA, 22 bp, Homo sapiens
caggcctggttgagccctgaga

SEQ ID NO: 8055663 - DNA, 22 bp, Homo sapiens
agctgtggcagcagccgtggca

SEQ ID NO: 8055664 - DNA, 22 bp, Homo sapiens
agcttcttttaccaggaagttg

SEQ ID NO: 8055665 - DNA, 22 bp, Homo sapiens
agcttcttaagttcctgcagca

SEQ ID NO: 8055666 - DNA, 22 bp, Homo sapiens
agcttcttttacagctcatgct

SEQ ID NO: 8055667 - DNA, 22 bp, Homo sapiens
agctctggaactcccggctgct

SEQ ID NO: 8055668 - DNA, 22 bp, Homo sapiens
agctctgcagcccagcaggtgg

SEQ ID NO: 8055669 - DNA, 22 bp, Homo sapiens
cagctcctgcctgggcagctgt

SEQ ID NO: 8055670 - DNA, 22 bp, Homo sapiens
agctctggaagccctggtagtt

SEQ ID NO: 8055671 - DNA, 22 bp, Homo sapiens
cagctcctgttggtcttgagga

SEQ ID NO: 8055672 - DNA, 23 bp, Homo sapiens
agctctgaaatagggaaagagga

SEQ ID NO: 8055673 - DNA, 22 bp, Homo sapiens
agctctgatctttacaacaaag

SEQ ID NO: 8055674 - DNA, 22 bp, Homo sapiens
cagcttctgtctgattagcaag

SEQ ID NO: 8055675 - DNA, 22 bp, Homo sapiens
cagcttctgtcctagaaactgg

SEQ ID NO: 8055676 - DNA, 22 bp, Homo sapiens
cagcttctgtttattgtgtgcc

SEQ ID NO: 8055677 - DNA, 22 bp, Homo sapiens
cagcttctgtttctagcccctg

SEQ ID NO: 8055678 - DNA, 22 bp, Homo sapiens
cagcttctgctcatggaggggt

SEQ ID NO: 8055679 - DNA, 22 bp, Homo sapiens
cagcttctggcgtggagcctga

SEQ ID NO: 8055680 - DNA, 22 bp, Homo sapiens
cagcttcttacgagctggtact

SEQ ID NO: 8055681 - DNA, 22 bp, Homo sapiens
cagcttcttcagtcctggagct

SEQ ID NO: 8055682 - DNA, 22 bp, Homo sapiens
cagcttcttagtctttccttgt

SEQ ID NO: 8055683 - DNA, 22 bp, Homo sapiens
cagcttctttgggattctttat

SEQ ID NO: 8055684 - DNA, 21 bp, Homo sapiens
cagcttcttctgtgacctggt

SEQ ID NO: 8055685 - DNA, 22 bp, Homo sapiens
cagctctgacacagtacaaaat

SEQ ID NO: 8055686 - DNA, 23 bp, Homo sapiens
cagcttctttgggattctttata

SEQ ID NO: 8055687 - DNA, 22 bp, Homo sapiens
agctggcatactttgctaggaa

SEQ ID NO: 8055688 - DNA, 22 bp, Homo sapiens
agctggcatctgaagtcagggc

SEQ ID NO: 8055689 - DNA, 22 bp, Homo sapiens
agctggcattctccttgttatt

SEQ ID NO: 8055690 - DNA, 22 bp, Homo sapiens
agctggcattgaagaatggtta

SEQ ID NO: 8055691 - DNA, 22 bp, Homo sapiens
agctggcattacaggagcatgc

SEQ ID NO: 8055692 - DNA, 22 bp, Homo sapiens
agctggcattacaggagcatgc

SEQ ID NO: 8055693 - DNA, 22 bp, Homo sapiens
agctggccattgtgagtggcct

SEQ ID NO: 8055694 - DNA, 22 bp, Homo sapiens
agctggccagcacctccaggtc

SEQ ID NO: 8055695 - DNA, 22 bp, Homo sapiens
agctggcattgcagggagctgc

SEQ ID NO: 8055696 - DNA, 22 bp, Homo sapiens
agctggcattgcagggagctgc

SEQ ID NO: 8055697 - DNA, 22 bp, Homo sapiens
agctggccagcacctccaggtc

SEQ ID NO: 8055698 - DNA, 22 bp, Homo sapiens
caggaggtgccctctagtggca

SEQ ID NO: 8055699 - DNA, 22 bp, Homo sapiens
agctggctggccccttcctgcc

SEQ ID NO: 8055700 - DNA, 22 bp, Homo sapiens
agctggctttatggttggctaa

SEQ ID NO: 8055701 - DNA, 22 bp, Homo sapiens
agctggcttgcatgctaaggag

SEQ ID NO: 8055702 - DNA, 22 bp, Homo sapiens
agctggcttcacaggcagtgtg

SEQ ID NO: 8055703 - DNA, 22 bp, Homo sapiens
agctggctgggtgccagtctcc

SEQ ID NO: 8055704 - DNA, 22 bp, Homo sapiens
agctggcttctctgcagacatt

SEQ ID NO: 8055705 - DNA, 22 bp, Homo sapiens
agctgcctggccggagccactg

SEQ ID NO: 8055706 - DNA, 21 bp, Homo sapiens
agctgctccagggagctcagg

SEQ ID NO: 8055707 - DNA, 22 bp, Homo sapiens
agctgctcctttcctgcaggcg

SEQ ID NO: 8055708 - DNA, 22 bp, Homo sapiens
agctgctgaagtgagagaattg

SEQ ID NO: 8055709 - DNA, 22 bp, Homo sapiens
agctgctctttgaaggacactt

SEQ ID NO: 8055710 - DNA, 22 bp, Homo sapiens
agctgctgaatgacactgcaag

SEQ ID NO: 8055711 - DNA, 22 bp, Homo sapiens
agctgctgagccaggctgatgt

SEQ ID NO: 8055712 - DNA, 22 bp, Homo sapiens
caggacagacagaatgcctaac

SEQ ID NO: 8055713 - DNA, 22 bp, Homo sapiens
caggacagaaataaggaatata

SEQ ID NO: 8055714 - DNA, 22 bp, Homo sapiens
caggacagaaataaggaatata

SEQ ID NO: 8055715 - DNA, 19 bp, Homo sapiens
caggacagacttcaaagcc

SEQ ID NO: 8055716 - DNA, 22 bp, Homo sapiens
caggacagaccaagatcgtgct

SEQ ID NO: 8055717 - DNA, 22 bp, Homo sapiens
caggacagaccaagatcgtgct

SEQ ID NO: 8055718 - DNA, 22 bp, Homo sapiens
agctggcatactttgctaggaa

SEQ ID NO: 8055719 - DNA, 22 bp, Homo sapiens
agctggcagtcatcctagtgag

SEQ ID NO: 8055720 - DNA, 22 bp, Homo sapiens
caggacagagcccagactgtgt

SEQ ID NO: 8055721 - DNA, 22 bp, Homo sapiens
caggacagagcccagactgtgt

SEQ ID NO: 8055722 - DNA, 22 bp, Homo sapiens
agctggcagtatgactggtgac

SEQ ID NO: 8055723 - DNA, 22 bp, Homo sapiens
cactctggttctgaacaggatc

SEQ ID NO: 8055724 - DNA, 22 bp, Homo sapiens
agccacagagcaggagaccttt

SEQ ID NO: 8055725 - DNA, 22 bp, Homo sapiens
agccacagagcaggagaccttt

SEQ ID NO: 8055726 - DNA, 22 bp, Homo sapiens
agccacagagagggagctgcaa

SEQ ID NO: 8055727 - DNA, 22 bp, Homo sapiens
agccacagagagggagctgcaa

SEQ ID NO: 8055728 - DNA, 19 bp, Homo sapiens
agccacagaacttgcagga

SEQ ID NO: 8055729 - DNA, 19 bp, Homo sapiens
agccacagaacttgcagga

SEQ ID NO: 8055730 - DNA, 22 bp, Homo sapiens
agccacagcacattgtaagaaa

SEQ ID NO: 8055731 - DNA, 22 bp, Homo sapiens
agccacagcaacaagtgcaatt

SEQ ID NO: 8055732 - DNA, 22 bp, Homo sapiens
agccacagcacattgtaagaaa

SEQ ID NO: 8055733 - DNA, 22 bp, Homo sapiens
agccacagcccacaggactctt

SEQ ID NO: 8055734 - DNA, 23 bp, Homo sapiens
agccacagccagagctatctcca

SEQ ID NO: 8055735 - DNA, 22 bp, Homo sapiens
agccacagcccacaggactctt

SEQ ID NO: 8055736 - DNA, 22 bp, Homo sapiens
agccacagcctgacttaactgt

SEQ ID NO: 8055737 - DNA, 22 bp, Homo sapiens
agccaggcagggctctcgctct

SEQ ID NO: 8055738 - DNA, 22 bp, Homo sapiens
agccaggcagggctctcgctct

SEQ ID NO: 8055739 - DNA, 21 bp, Homo sapiens
agccaggcaagcacccccact

SEQ ID NO: 8055740 - DNA, 22 bp, Homo sapiens
agccaggacatctctagctgct

SEQ ID NO: 8055741 - DNA, 22 bp, Homo sapiens
cagaagaatggtgtctgagctc

SEQ ID NO: 8055742 - DNA, 22 bp, Homo sapiens
agccagtgcaacagcagtgaag

SEQ ID NO: 8055743 - DNA, 22 bp, Homo sapiens
agccagtgacatacgattggga

SEQ ID NO: 8055744 - DNA, 19 bp, Homo sapiens
agccagtgagcctctgggt

SEQ ID NO: 8055745 - DNA, 22 bp, Homo sapiens
agccagtcggggccatgctggg

SEQ ID NO: 8055746 - DNA, 22 bp, Homo sapiens
cagacagacctgcaagggcaca

SEQ ID NO: 8055747 - DNA, 22 bp, Homo sapiens
cagacagcgagcggaggggctt

SEQ ID NO: 8055748 - DNA, 23 bp, Homo sapiens
agccaggggatcttgggccctgg

SEQ ID NO: 8055749 - DNA, 22 bp, Homo sapiens
cagacagcaaatctgcttgcat

SEQ ID NO: 8055750 - DNA, 22 bp, Homo sapiens
cagacagagtcttcccatcagt

SEQ ID NO: 8055751 - DNA, 22 bp, Homo sapiens
agccaggggattcatcagggac

SEQ ID NO: 8055752 - DNA, 22 bp, Homo sapiens
agccaggggattcatcagggac

SEQ ID NO: 8055753 - DNA, 20 bp, Homo sapiens
agccagggttctggatgcac

SEQ ID NO: 8055754 - DNA, 18 bp, Homo sapiens
agccaggtggaatggaac

SEQ ID NO: 8055755 - DNA, 23 bp, Homo sapiens
cagagctggctcagagctgcctg

SEQ ID NO: 8055756 - DNA, 22 bp, Homo sapiens
agccctcatggaacagctccta

SEQ ID NO: 8055757 - DNA, 22 bp, Homo sapiens
agccccttggaacacagggctg

SEQ ID NO: 8055758 - DNA, 19 bp, Homo sapiens
agccccttggtactgtcct

SEQ ID NO: 8055759 - DNA, 22 bp, Homo sapiens
agccccttgctgccctctagag

SEQ ID NO: 8055760 - DNA, 22 bp, Homo sapiens
agcccaggaagttgaggcttgc

SEQ ID NO: 8055761 - DNA, 22 bp, Homo sapiens
agcccagctttgaaccatatca

SEQ ID NO: 8055762 - DNA, 22 bp, Homo sapiens
agcccaggaagttgaggcttgc

SEQ ID NO: 8055763 - DNA, 22 bp, Homo sapiens
agcccaggaatctgcatcttga

SEQ ID NO: 8055764 - DNA, 22 bp, Homo sapiens
agcccaggagcctttggagggt

SEQ ID NO: 8055765 - DNA, 22 bp, Homo sapiens
agcccaggagcctttggagggt

SEQ ID NO: 8055766 - DNA, 22 bp, Homo sapiens
agcccaggaggtggaggttgca

SEQ ID NO: 8055767 - DNA, 22 bp, Homo sapiens
agcccaggaggtggaggttgca

SEQ ID NO: 8055768 - DNA, 22 bp, Homo sapiens
agcccaggagtccttaaggacc

SEQ ID NO: 8055769 - DNA, 22 bp, Homo sapiens
agcccaggagtttgaggctgtg

SEQ ID NO: 8055770 - DNA, 22 bp, Homo sapiens
agcccaggagtttgaggctgtg

SEQ ID NO: 8055771 - DNA, 23 bp, Homo sapiens
agccttggaggttgaggctgcag

SEQ ID NO: 8055772 - DNA, 22 bp, Homo sapiens
agccttggccgtaaggtatgct

SEQ ID NO: 8055773 - DNA, 22 bp, Homo sapiens
agccttgggcaatttggacact

SEQ ID NO: 8055774 - DNA, 22 bp, Homo sapiens
agccttggtcccgcgtcagcca

SEQ ID NO: 8055775 - DNA, 22 bp, Homo sapiens
cagcaggacccaggaatcctgc

SEQ ID NO: 8055776 - DNA, 22 bp, Homo sapiens
cagcaggagcagtcagactcct

SEQ ID NO: 8055777 - DNA, 23 bp, Homo sapiens
cagcaggagggtgcctgggctgc

SEQ ID NO: 8055778 - DNA, 23 bp, Homo sapiens
cagcaggagggtgcctgggctgc

SEQ ID NO: 8055779 - DNA, 22 bp, Homo sapiens
cagcaggaggcatggcttccct

SEQ ID NO: 8055780 - DNA, 22 bp, Homo sapiens
cagcaggaggtgagtagcaggt

SEQ ID NO: 8055781 - DNA, 22 bp, Homo sapiens
cagcaggaggtgagtagcaggt

SEQ ID NO: 8055782 - DNA, 22 bp, Homo sapiens
agctaggagattttgtgaggct

SEQ ID NO: 8055783 - DNA, 22 bp, Homo sapiens
agctcagaacctcctcatccca

SEQ ID NO: 8055784 - DNA, 22 bp, Homo sapiens
agctcagaactgcagacatgtg

SEQ ID NO: 8055785 - DNA, 22 bp, Homo sapiens
cagccagagaaagggcactgcc

SEQ ID NO: 8055786 - DNA, 22 bp, Homo sapiens
cagccctggctagggcgagggc

SEQ ID NO: 8055787 - DNA, 22 bp, Homo sapiens
cagccctgggagttggggccga

SEQ ID NO: 8055788 - DNA, 22 bp, Homo sapiens
cagccctgggtccctgccctgg

SEQ ID NO: 8055789 - DNA, 22 bp, Homo sapiens
cagccagagaggaaggaatgca

SEQ ID NO: 8055790 - DNA, 22 bp, Homo sapiens
cagccagaggctgcgaggggcc

SEQ ID NO: 8055791 - DNA, 22 bp, Homo sapiens
cagccagctcaggaaggatttt

SEQ ID NO: 8055792 - DNA, 22 bp, Homo sapiens
cagccagatcagggcaggggtt

SEQ ID NO: 8055793 - DNA, 22 bp, Homo sapiens
cagccagcctctcaaccatgca

SEQ ID NO: 8055794 - DNA, 22 bp, Homo sapiens
cagccagctggcactgtgagta

SEQ ID NO: 8055795 - DNA, 22 bp, Homo sapiens
agccctccatctgtgctcaggc

SEQ ID NO: 8055796 - DNA, 22 bp, Homo sapiens
cagaggctcttcctcactgccc

SEQ ID NO: 8055797 - DNA, 22 bp, Homo sapiens
cagaggctcaccagcctttcac

SEQ ID NO: 8055798 - DNA, 22 bp, Homo sapiens
cagcacagtacaaggcacggat

SEQ ID NO: 8055799 - DNA, 22 bp, Homo sapiens
agcctcagcacgcagctctgtg

SEQ ID NO: 8055800 - DNA, 22 bp, Homo sapiens
cagcacagtacaaggcacggat

SEQ ID NO: 8055801 - DNA, 22 bp, Homo sapiens
cagcacagggcttgagaggtgt

SEQ ID NO: 8055802 - DNA, 22 bp, Homo sapiens
agcctcagggctctgcgcagac

SEQ ID NO: 8055803 - DNA, 22 bp, Homo sapiens
cagcacagctgaggggctgtct

SEQ ID NO: 8055804 - DNA, 22 bp, Homo sapiens
agcctcagtttcaggcctcctc

SEQ ID NO: 8055805 - DNA, 22 bp, Homo sapiens
agcctcagtgtcaccatctacc

SEQ ID NO: 8055806 - DNA, 22 bp, Homo sapiens
cagcagcagcttagtggtcccc

SEQ ID NO: 8055807 - DNA, 22 bp, Homo sapiens
cagcagcaggcgcacggccgtc

SEQ ID NO: 8055808 - DNA, 22 bp, Homo sapiens
cagcagcagtggctgcagaaca

SEQ ID NO: 8055809 - DNA, 22 bp, Homo sapiens
cagcagcatgaattcgagccac

SEQ ID NO: 8055810 - DNA, 22 bp, Homo sapiens
cagcagcatcaggtctgtggtt

SEQ ID NO: 8055811 - DNA, 22 bp, Homo sapiens
cagcagcattgctctggattcc

SEQ ID NO: 8055812 - DNA, 22 bp, Homo sapiens
agccttccaggtagatggcaca

SEQ ID NO: 8055813 - DNA, 22 bp, Homo sapiens
agcagacaattgcctggatgga

SEQ ID NO: 8055814 - DNA, 22 bp, Homo sapiens
agcagcagaaggtttgcaccca

SEQ ID NO: 8055815 - DNA, 22 bp, Homo sapiens
agcagcagaagggagacccagg

SEQ ID NO: 8055816 - DNA, 22 bp, Homo sapiens
agcagcagaagggagacccagg

SEQ ID NO: 8055817 - DNA, 22 bp, Homo sapiens
agcagcagaaagttgatggcag

SEQ ID NO: 8055818 - DNA, 22 bp, Homo sapiens
agcagcagaaagttgatggcag

SEQ ID NO: 8055819 - DNA, 22 bp, Homo sapiens
agcagcattcctggcttctatc

SEQ ID NO: 8055820 - DNA, 22 bp, Homo sapiens
agcagcaggtgacctcgatgcc

SEQ ID NO: 8055821 - DNA, 22 bp, Homo sapiens
agcagcagggtgtaattgggca

SEQ ID NO: 8055822 - DNA, 22 bp, Homo sapiens
caaggcagtccctactccctgc

SEQ ID NO: 8055823 - DNA, 22 bp, Homo sapiens
caaggcaggtctgaggaggttg

SEQ ID NO: 8055824 - DNA, 22 bp, Homo sapiens
caaggcaggtctgaggaggttg

SEQ ID NO: 8055825 - DNA, 22 bp, Homo sapiens
agcacagactggtcccaggtct

SEQ ID NO: 8055826 - DNA, 22 bp, Homo sapiens
agcacagagaaactaagacatt

SEQ ID NO: 8055827 - DNA, 23 bp, Homo sapiens
agcacagactagaaaggtctttc

SEQ ID NO: 8055828 - DNA, 22 bp, Homo sapiens
agcaatttttgattttcagtgt

SEQ ID NO: 8055829 - DNA, 22 bp, Homo sapiens
agcacagagagctctaggtaaa

SEQ ID NO: 8055830 - DNA, 22 bp, Homo sapiens
agcacagagttgcagagagcgt

SEQ ID NO: 8055831 - DNA, 22 bp, Homo sapiens
agcacagatgtgagtggaggct

SEQ ID NO: 8055832 - DNA, 22 bp, Homo sapiens
agcacagatgtactttgagggg

SEQ ID NO: 8055833 - DNA, 22 bp, Homo sapiens
agcacagataacatggagtgga

SEQ ID NO: 8055834 - DNA, 22 bp, Homo sapiens
agcacagcttagcacctggcac

SEQ ID NO: 8055835 - DNA, 22 bp, Homo sapiens
cacaggaagctgactgctggca

SEQ ID NO: 8055836 - DNA, 22 bp, Homo sapiens
cacaggaagcaagcctggggcc

SEQ ID NO: 8055837 - DNA, 22 bp, Homo sapiens
agcagcttctttcactcctgga

SEQ ID NO: 8055838 - DNA, 22 bp, Homo sapiens
agcagcttcctgctcttcgcct

SEQ ID NO: 8055839 - DNA, 22 bp, Homo sapiens
agcagcttctattttcttggtt

SEQ ID NO: 8055840 - DNA, 22 bp, Homo sapiens
agcagcttcctgtttgcaggca

SEQ ID NO: 8055841 - DNA, 22 bp, Homo sapiens
agcagcttcaattttctaagtg

SEQ ID NO: 8055842 - DNA, 22 bp, Homo sapiens
agcagcttcagaggcgggcgca

SEQ ID NO: 8055843 - DNA, 22 bp, Homo sapiens
agcagcttatcttggagaggca

SEQ ID NO: 8055844 - DNA, 22 bp, Homo sapiens
agcagcttagggaattctccct

SEQ ID NO: 8055845 - DNA, 22 bp, Homo sapiens
agcagcttacatgtggcctatc

SEQ ID NO: 8055846 - DNA, 19 bp, Homo sapiens
agcagcttaattttgtagc

SEQ ID NO: 8055847 - DNA, 22 bp, Homo sapiens
caatgaacacagcaatttcata

SEQ ID NO: 8055848 - DNA, 19 bp, Homo sapiens
agcagctgtagatagacac

SEQ ID NO: 8055849 - DNA, 22 bp, Homo sapiens
agcagctgggctcagagctggg

SEQ ID NO: 8055850 - DNA, 18 bp, Homo sapiens
agcagctgtgccacactg

SEQ ID NO: 8055851 - DNA, 22 bp, Homo sapiens
agcagctgtgggcaatatgtaa

SEQ ID NO: 8055852 - DNA, 18 bp, Homo sapiens
agcagctgtgccacactg

SEQ ID NO: 8055853 - DNA, 22 bp, Homo sapiens
cacagtatcttttgagtaagca

SEQ ID NO: 8055854 - DNA, 22 bp, Homo sapiens
cacagtatccctctttctcccc

SEQ ID NO: 8055855 - DNA, 22 bp, Homo sapiens
cacagggctttgatggctgagt

SEQ ID NO: 8055856 - DNA, 22 bp, Homo sapiens
cacagggccttgtgtgactgca

SEQ ID NO: 8055857 - DNA, 22 bp, Homo sapiens
cacaggagggagcgggcagcca

SEQ ID NO: 8055858 - DNA, 22 bp, Homo sapiens
cacaggaggttaggaagtggtc

SEQ ID NO: 8055859 - DNA, 22 bp, Homo sapiens
cacaggaggaggtgcccgggcc

SEQ ID NO: 8055860 - DNA, 22 bp, Homo sapiens
cacaggaggcaatggtaagatt

SEQ ID NO: 8055861 - DNA, 22 bp, Homo sapiens
cacaggaggaggccagagcgta

SEQ ID NO: 8055862 - DNA, 22 bp, Homo sapiens
agcaggagcatttccatgattc

SEQ ID NO: 8055863 - DNA, 22 bp, Homo sapiens
agcagggcagtgcttcagctct

SEQ ID NO: 8055864 - DNA, 22 bp, Homo sapiens
agcagggcctgagtgacctaac

SEQ ID NO: 8055865 - DNA, 22 bp, Homo sapiens
cacagtcacatatctatgtgtg

SEQ ID NO: 8055866 - DNA, 22 bp, Homo sapiens
agcagggctctgccatgggccc

SEQ ID NO: 8055867 - DNA, 22 bp, Homo sapiens
agcagggctctgccatgggccc

SEQ ID NO: 8055868 - DNA, 22 bp, Homo sapiens
agcagggctctgccatgggccc

SEQ ID NO: 8055869 - DNA, 22 bp, Homo sapiens
agcagggctccatttcactgcc

SEQ ID NO: 8055870 - DNA, 22 bp, Homo sapiens
agcagggctcctgaaagccgcg

SEQ ID NO: 8055871 - DNA, 22 bp, Homo sapiens
agcagggcctggcactcctggg

SEQ ID NO: 8055872 - DNA, 22 bp, Homo sapiens
agcagggcctgagtgacctaac

SEQ ID NO: 8055873 - DNA, 16 bp, Homo sapiens
agcagggcgggaagga

SEQ ID NO: 8055874 - DNA, 16 bp, Homo sapiens
agcagggcgggaagga

SEQ ID NO: 8055875 - DNA, 22 bp, Homo sapiens
agcagggctcacattagtggat

SEQ ID NO: 8055876 - DNA, 22 bp, Homo sapiens
cacatccctggagttacccagt

SEQ ID NO: 8055877 - DNA, 22 bp, Homo sapiens
agcaggtataggaggtatcctg

SEQ ID NO: 8055878 - DNA, 22 bp, Homo sapiens
agcaggtgatgtgagtctggaa

SEQ ID NO: 8055879 - DNA, 22 bp, Homo sapiens
agcaggtgcatggcgagcgcgg

SEQ ID NO: 8055880 - DNA, 22 bp, Homo sapiens
agcaggtgccaggtgtacccgc

SEQ ID NO: 8055881 - DNA, 22 bp, Homo sapiens
agcagtggcctggggctctgtg

SEQ ID NO: 8055882 - DNA, 22 bp, Homo sapiens
agcagttgagtgggaatcaggc

SEQ ID NO: 8055883 - DNA, 22 bp, Homo sapiens
agcaggtggacagaggaagaaa

SEQ ID NO: 8055884 - DNA, 21 bp, Homo sapiens
agcaggtgctgttggaggaaa

SEQ ID NO: 8055885 - DNA, 22 bp, Homo sapiens
agcaggtgcgttacttcactct

SEQ ID NO: 8055886 - DNA, 22 bp, Homo sapiens
agcaggtggaaaattcttatca

SEQ ID NO: 8055887 - DNA, 18 bp, Homo sapiens
agcaggtgctgtttcttt

SEQ ID NO: 8055888 - DNA, 22 bp, Homo sapiens
agcagttttatgcgattgtttc

SEQ ID NO: 8055889 - DNA, 22 bp, Homo sapiens
cactctggggatgcaaggagag

SEQ ID NO: 8055890 - DNA, 20 bp, Homo sapiens
cactctgagggagtccatgt

SEQ ID NO: 8055891 - DNA, 22 bp, Homo sapiens
agcataagttggtacagccact

SEQ ID NO: 8055892 - DNA, 22 bp, Homo sapiens
agcataagttggtacagccact

SEQ ID NO: 8055893 - DNA, 18 bp, Homo sapiens
atttaatgaactgaaagc

SEQ ID NO: 8055894 - DNA, 22 bp, Homo sapiens
agagtggcctggcctggggcat

SEQ ID NO: 8055895 - DNA, 22 bp, Homo sapiens
agagggtggtgaggcctggttc

SEQ ID NO: 8055896 - DNA, 22 bp, Homo sapiens
atttattattgtggttacttct

SEQ ID NO: 8055897 - DNA, 22 bp, Homo sapiens
atttattgaacactgactatgt

SEQ ID NO: 8055898 - DNA, 22 bp, Homo sapiens
atttattgaagcttattacgtt

SEQ ID NO: 8055899 - DNA, 22 bp, Homo sapiens
agatgggcgcgctgctctgatg

SEQ ID NO: 8055900 - DNA, 22 bp, Homo sapiens
agatgggcgccctggactgagg

SEQ ID NO: 8055901 - DNA, 20 bp, Homo sapiens
agcaaaatgcaagattttca

SEQ ID NO: 8055902 - DNA, 22 bp, Homo sapiens
agatgtgcctccaaggggtgca

SEQ ID NO: 8055903 - DNA, 22 bp, Homo sapiens
agagggtgggcacgtgatggat

SEQ ID NO: 8055904 - DNA, 22 bp, Homo sapiens
attctgtatggggaaactagag

SEQ ID NO: 8055905 - DNA, 22 bp, Homo sapiens
attctgtatttctaataagatc

SEQ ID NO: 8055906 - DNA, 22 bp, Homo sapiens
attctgtatttggatataaggg

SEQ ID NO: 8055907 - DNA, 22 bp, Homo sapiens
attctgtatggaaaagcactat

SEQ ID NO: 8055908 - DNA, 22 bp, Homo sapiens
attcagctaagtgcttcatgct

SEQ ID NO: 8055909 - DNA, 22 bp, Homo sapiens
attcagcaaacatttattatct

SEQ ID NO: 8055910 - DNA, 22 bp, Homo sapiens
attatacattttgtgtagagat

SEQ ID NO: 8055911 - DNA, 22 bp, Homo sapiens
attcacaattagaagtagataa

SEQ ID NO: 8055912 - DNA, 22 bp, Homo sapiens
atggcagatggctggagcaggt

SEQ ID NO: 8055913 - DNA, 22 bp, Homo sapiens
atggcagatggctggagcaggt

SEQ ID NO: 8055914 - DNA, 22 bp, Homo sapiens
atggcagcagtttggagtcttt

SEQ ID NO: 8055915 - DNA, 22 bp, Homo sapiens
atggctgggaggagagtatgat

SEQ ID NO: 8055916 - DNA, 21 bp, Homo sapiens
atggctggtggctcagcctcc

SEQ ID NO: 8055917 - DNA, 22 bp, Homo sapiens
agactcctcggaccaatcagcg

SEQ ID NO: 8055918 - DNA, 22 bp, Homo sapiens
atggacagtactgagtggacta

SEQ ID NO: 8055919 - DNA, 22 bp, Homo sapiens
agactcatgacacttcctatga

SEQ ID NO: 8055920 - DNA, 22 bp, Homo sapiens
agactcagccacacaagactac

SEQ ID NO: 8055921 - DNA, 22 bp, Homo sapiens
atgggaggatcacttgaggcca

SEQ ID NO: 8055922 - DNA, 22 bp, Homo sapiens
atgggaggcagcagagcccagc

SEQ ID NO: 8055923 - DNA, 22 bp, Homo sapiens
atgggaggcagcagagcccagc

SEQ ID NO: 8055924 - DNA, 22 bp, Homo sapiens
atgggaggatgctcgggtgctc

SEQ ID NO: 8055925 - DNA, 22 bp, Homo sapiens
atgggaggcagacactaagttc

SEQ ID NO: 8055926 - DNA, 22 bp, Homo sapiens
atgggaggcaaagatcgcagaa

SEQ ID NO: 8055927 - DNA, 22 bp, Homo sapiens
atgtacagccacttcacagtta

SEQ ID NO: 8055928 - DNA, 22 bp, Homo sapiens
atgtccaatttcagagtctcat

SEQ ID NO: 8055929 - DNA, 22 bp, Homo sapiens
agaagaatttctctcatgattt

SEQ ID NO: 8055930 - DNA, 22 bp, Homo sapiens
agaagaatacttgatgttcatg

SEQ ID NO: 8055931 - DNA, 22 bp, Homo sapiens
agaagcacaccagtagacaggg

SEQ ID NO: 8055932 - DNA, 22 bp, Homo sapiens
agaatacagtatgcaaaaagat

SEQ ID NO: 8055933 - DNA, 22 bp, Homo sapiens
agacaggcatgaggctggattg

SEQ ID NO: 8055934 - DNA, 22 bp, Homo sapiens
agacaggcagcagatggagtgt

SEQ ID NO: 8055935 - DNA, 22 bp, Homo sapiens
agacacataggaccacactgtg

SEQ ID NO: 8055936 - DNA, 22 bp, Homo sapiens
agacacagtctgtctggaggag

SEQ ID NO: 8055937 - DNA, 22 bp, Homo sapiens
atgcagggaggtaagaggtgcc

SEQ ID NO: 8055938 - DNA, 22 bp, Homo sapiens
atgcaggcagacactgtgggca

SEQ ID NO: 8055939 - DNA, 21 bp, Homo sapiens
atgcaggctgctcagaagcaa

SEQ ID NO: 8055940 - DNA, 22 bp, Homo sapiens
agacagtgcaagaagagcaggc

SEQ ID NO: 8055941 - DNA, 22 bp, Homo sapiens
agacagtgcaagaagagcaggc

SEQ ID NO: 8055942 - DNA, 17 bp, Homo sapiens
agacagtgagtgccttg

SEQ ID NO: 8055943 - DNA, 22 bp, Homo sapiens
agacagtgatggacaggcagac

SEQ ID NO: 8055944 - DNA, 22 bp, Homo sapiens
agacagtgatgtaagcaggagt

SEQ ID NO: 8055945 - DNA, 22 bp, Homo sapiens
agacagtgatggacaggcagac

SEQ ID NO: 8055946 - DNA, 17 bp, Homo sapiens
agacaggttatagttga

SEQ ID NO: 8055947 - DNA, 21 bp, Homo sapiens
agacaggtcagggagaggtga

SEQ ID NO: 8055948 - DNA, 22 bp, Homo sapiens
agacaggtgttttacaacttcg

SEQ ID NO: 8055949 - DNA, 22 bp, Homo sapiens
agacaggtgctcgcccaagtcc

SEQ ID NO: 8055950 - DNA, 22 bp, Homo sapiens
agaatgtaagaatgcaaagatt

SEQ ID NO: 8055951 - DNA, 22 bp, Homo sapiens
agacacagatggtacctgagcc

SEQ ID NO: 8055952 - DNA, 22 bp, Homo sapiens
agacacagatggtacctgagcc

SEQ ID NO: 8055953 - DNA, 22 bp, Homo sapiens
agacacagcaataactactgtt

SEQ ID NO: 8055954 - DNA, 22 bp, Homo sapiens
agaattacagcttttagaatag

SEQ ID NO: 8055955 - DNA, 22 bp, Homo sapiens
agaattctccacgctcagggtc

SEQ ID NO: 8055956 - DNA, 22 bp, Homo sapiens
acctggagcttccaactcaact

SEQ ID NO: 8055957 - DNA, 22 bp, Homo sapiens
acctggagatccatggtgtcga

SEQ ID NO: 8055958 - DNA, 20 bp, Homo sapiens
acctggagagattattacca

SEQ ID NO: 8055959 - DNA, 17 bp, Homo sapiens
acctggagaccaagtcc

SEQ ID NO: 8055960 - DNA, 20 bp, Homo sapiens
acctggagacagcactctgg

SEQ ID NO: 8055961 - DNA, 22 bp, Homo sapiens
acctggagaaagcctctccctg

SEQ ID NO: 8055962 - DNA, 22 bp, Homo sapiens
acctggacacctgctgtcatct

SEQ ID NO: 8055963 - DNA, 22 bp, Homo sapiens
aggtagcaagacacctgctttt

SEQ ID NO: 8055964 - DNA, 22 bp, Homo sapiens
aggtagcatattccagacttgt

SEQ ID NO: 8055965 - DNA, 21 bp, Homo sapiens
acctccctcgagcaaccagca

SEQ ID NO: 8055966 - DNA, 22 bp, Homo sapiens
acctccccgggagcagcctcct

SEQ ID NO: 8055967 - DNA, 22 bp, Homo sapiens
acctcccctcaccaatctggtt

SEQ ID NO: 8055968 - DNA, 22 bp, Homo sapiens
agggcttgcagaaatgagaaat

SEQ ID NO: 8055969 - DNA, 22 bp, Homo sapiens
agggcttgacaagggctggagc

SEQ ID NO: 8055970 - DNA, 22 bp, Homo sapiens
agggctgtttttggcacctggg

SEQ ID NO: 8055971 - DNA, 22 bp, Homo sapiens
agggctgtcagactgaggaggc

SEQ ID NO: 8055972 - DNA, 22 bp, Homo sapiens
agggctgtcagactgaggaggc

SEQ ID NO: 8055973 - DNA, 22 bp, Homo sapiens
agggctgtttttcagtgtgtga

SEQ ID NO: 8055974 - DNA, 22 bp, Homo sapiens
agggcttgtagggtggctgtag

SEQ ID NO: 8055975 - DNA, 22 bp, Homo sapiens
agggcttgttaacatagagatt

SEQ ID NO: 8055976 - DNA, 22 bp, Homo sapiens
agggcttgtggtcgtggctgtg

SEQ ID NO: 8055977 - DNA, 23 bp, Homo sapiens
acgggagggctgtttgcttggtg

SEQ ID NO: 8055978 - DNA, 22 bp, Homo sapiens
acgggccttctcttcaggcgag

SEQ ID NO: 8055979 - DNA, 22 bp, Homo sapiens
actattcacagattcagtgttc

SEQ ID NO: 8055980 - DNA, 22 bp, Homo sapiens
actattgcttagagcaatgggg

SEQ ID NO: 8055981 - DNA, 22 bp, Homo sapiens
actcatttaaacatttactgaa

SEQ ID NO: 8055982 - DNA, 22 bp, Homo sapiens
actcattgcagctccagcaaca

SEQ ID NO: 8055983 - DNA, 22 bp, Homo sapiens
actagtttatgctcagatgtct

SEQ ID NO: 8055984 - DNA, 22 bp, Homo sapiens
actatacattgaatgttaaggt

SEQ ID NO: 8055985 - DNA, 22 bp, Homo sapiens
actatatgtgaaggtagaattt

SEQ ID NO: 8055986 - DNA, 22 bp, Homo sapiens
actagtttattacagttccact

SEQ ID NO: 8055987 - DNA, 22 bp, Homo sapiens
actggcagccacaactggcagg

SEQ ID NO: 8055988 - DNA, 22 bp, Homo sapiens
actggcagcagcagcccttggg

SEQ ID NO: 8055989 - DNA, 22 bp, Homo sapiens
actggcagaggttggacaccat

SEQ ID NO: 8055990 - DNA, 22 bp, Homo sapiens
actggcagagggaaaaccattc

SEQ ID NO: 8055991 - DNA, 22 bp, Homo sapiens
actggcagaggatagcactaat

SEQ ID NO: 8055992 - DNA, 22 bp, Homo sapiens
actggcagaactggtgattgtc

SEQ ID NO: 8055993 - DNA, 22 bp, Homo sapiens
actggcagaacgtgatgcgggt

SEQ ID NO: 8055994 - DNA, 22 bp, Homo sapiens
actggcagaacgtgatgcgggt

SEQ ID NO: 8055995 - DNA, 22 bp, Homo sapiens
actggcagagaccctgatggcc

SEQ ID NO: 8055996 - DNA, 22 bp, Homo sapiens
actggcagaattgaatagttgt

SEQ ID NO: 8055997 - DNA, 22 bp, Homo sapiens
agtggctggaattgcaggtgcg

SEQ ID NO: 8055998 - DNA, 20 bp, Homo sapiens
actggacactgaggtgagct

SEQ ID NO: 8055999 - DNA, 22 bp, Homo sapiens
actggacagaggaaatatggag

SEQ ID NO: 8056000 - DNA, 22 bp, Homo sapiens
agtggctgctggagtggagatg

SEQ ID NO: 8056001 - DNA, 22 bp, Homo sapiens
actgctggaaacccagaatggt

SEQ ID NO: 8056002 - DNA, 22 bp, Homo sapiens
actgctctctttgcaggggcta

SEQ ID NO: 8056003 - DNA, 22 bp, Homo sapiens
agtggctgagtgactgtgactc

SEQ ID NO: 8056004 - DNA, 22 bp, Homo sapiens
agtggctgatgtaggcagtggg

SEQ ID NO: 8056005 - DNA, 22 bp, Homo sapiens
actgattgcattcatagggttt

SEQ ID NO: 8056006 - DNA, 22 bp, Homo sapiens
actgcacacttagcatctggga

SEQ ID NO: 8056007 - DNA, 22 bp, Homo sapiens
agtctctgaggttcagatgcct

SEQ ID NO: 8056008 - DNA, 22 bp, Homo sapiens
actccacaccacgggggccgcc

SEQ ID NO: 8056009 - DNA, 22 bp, Homo sapiens
actcatttgacactttaaactg

SEQ ID NO: 8056010 - DNA, 22 bp, Homo sapiens
actgaaatgaaatctatcatct

SEQ ID NO: 8056011 - DNA, 22 bp, Homo sapiens
agaaaattagattttactgtgt

SEQ ID NO: 8056012 - DNA, 22 bp, Homo sapiens
atatcttttagagcaagcttgt

SEQ ID NO: 8056013 - DNA, 22 bp, Homo sapiens
agaaaatttaaagagacacaca

SEQ ID NO: 8056014 - DNA, 22 bp, Homo sapiens
agaaaatttattcatgttagtt

SEQ ID NO: 8056015 - DNA, 22 bp, Homo sapiens
agaaaatttattcatgttagtt

SEQ ID NO: 8056016 - DNA, 22 bp, Homo sapiens
atatatttgagaatattcatga

SEQ ID NO: 8056017 - DNA, 22 bp, Homo sapiens
atatctgtggagggcttacaaa

SEQ ID NO: 8056018 - DNA, 22 bp, Homo sapiens
atatacacatctttttaaatat

SEQ ID NO: 8056019 - DNA, 22 bp, Homo sapiens
atatacacagagcttatggtga

SEQ ID NO: 8056020 - DNA, 22 bp, Homo sapiens
atataatagtttcataaaggct

SEQ ID NO: 8056021 - DNA, 22 bp, Homo sapiens
actttggtgaatcagttttgtt

SEQ ID NO: 8056022 - DNA, 22 bp, Homo sapiens
atcatttacaatgaaagcctga

SEQ ID NO: 8056023 - DNA, 22 bp, Homo sapiens
actggcagtttgagaatgcatt

SEQ ID NO: 8056024 - DNA, 22 bp, Homo sapiens
actggcagtgtcgtttacatga

SEQ ID NO: 8056025 - DNA, 19 bp, Homo sapiens
actggcagtttctgcatgg

SEQ ID NO: 8056026 - DNA, 22 bp, Homo sapiens
actggcagtagagggagcgcat

SEQ ID NO: 8056027 - DNA, 22 bp, Homo sapiens
actggcaggtccatcgcccttt

SEQ ID NO: 8056028 - DNA, 22 bp, Homo sapiens
actggcagggggagccccgaga

SEQ ID NO: 8056029 - DNA, 19 bp, Homo sapiens
actggcagggctgcggtgg

SEQ ID NO: 8056030 - DNA, 22 bp, Homo sapiens
actggcagtagagggagcgcat

SEQ ID NO: 8056031 - DNA, 22 bp, Homo sapiens
actggcagtggcagcagaaaga

SEQ ID NO: 8056032 - DNA, 22 bp, Homo sapiens
actggcagctgtaggatgcatg

SEQ ID NO: 8056033 - DNA, 22 bp, Homo sapiens
actggcagctgtaggatgcatg

SEQ ID NO: 8056034 - DNA, 20 bp, Homo sapiens
actggcagcctgcctgctgt

SEQ ID NO: 8056035 - DNA, 20 bp, Homo sapiens
actggcagcctgcctgctgt

SEQ ID NO: 8056036 - DNA, 22 bp, Homo sapiens
actggcaggctgctggccggcg

SEQ ID NO: 8056037 - DNA, 19 bp, Homo sapiens
actggcagctgtagtctgt

SEQ ID NO: 8056038 - DNA, 22 bp, Homo sapiens
agtttctaacatatagcattgg

SEQ ID NO: 8056039 - DNA, 22 bp, Homo sapiens
actgtgggtcccagctgtgtct

SEQ ID NO: 8056040 - DNA, 21 bp, Homo sapiens
actgtgggtctgaccacctgg

SEQ ID NO: 8056041 - DNA, 22 bp, Homo sapiens
actgtgagagtttttctaggag

SEQ ID NO: 8056042 - DNA, 22 bp, Homo sapiens
actgttatgggtgtcagcttaa

SEQ ID NO: 8056043 - DNA, 22 bp, Homo sapiens
acttcagaaaatgttgaatgtt

SEQ ID NO: 8056044 - DNA, 22 bp, Homo sapiens
acttcagagttagttatagacc

SEQ ID NO: 8056045 - DNA, 22 bp, Homo sapiens
acttcacagatatttatttggt

SEQ ID NO: 8056046 - DNA, 22 bp, Homo sapiens
acttcaaattttcagaagaaat

SEQ ID NO: 8056047 - DNA, 22 bp, Homo sapiens
acttcacagaaattttatgagg

SEQ ID NO: 8056048 - DNA, 22 bp, Homo sapiens
acttcacacagcaaatttatct

SEQ ID NO: 8056049 - DNA, 23 bp, Homo sapiens
acttggaagcagtgaacaacttt

SEQ ID NO: 8056050 - DNA, 22 bp, Homo sapiens
acttctttcacaatgtttctag

SEQ ID NO: 8056051 - DNA, 22 bp, Homo sapiens
acttcattgctaagaacaaggt

SEQ ID NO: 8056052 - DNA, 22 bp, Homo sapiens
acttcatttcatttgcacagtg

SEQ ID NO: 8056053 - DNA, 18 bp, Homo sapiens
acaggcctcagtcctgca

SEQ ID NO: 8056054 - DNA, 22 bp, Homo sapiens
acaggcctagctaatgctttcc

SEQ ID NO: 8056055 - DNA, 22 bp, Homo sapiens
acaggcctcaaatagggtgcct

SEQ ID NO: 8056056 - DNA, 22 bp, Homo sapiens
acaggcctagggtcaatttcct

SEQ ID NO: 8056057 - DNA, 22 bp, Homo sapiens
acaggcctgagattttgcattt

SEQ ID NO: 8056058 - DNA, 17 bp, Homo sapiens
acaggcctgcttgcact

SEQ ID NO: 8056059 - DNA, 22 bp, Homo sapiens
acaggcctggaaaggaaggagt

SEQ ID NO: 8056060 - DNA, 22 bp, Homo sapiens
acaggcctgacacacagagggc

SEQ ID NO: 8056061 - DNA, 22 bp, Homo sapiens
acaggcctcccatccggagccc

SEQ ID NO: 8056062 - DNA, 22 bp, Homo sapiens
acaggcctggtgctgctgacag

SEQ ID NO: 8056063 - DNA, 22 bp, Homo sapiens
acaggcctgggttcaaatttgg

SEQ ID NO: 8056064 - DNA, 22 bp, Homo sapiens
agctttatcagaggagtctcta

SEQ ID NO: 8056065 - DNA, 22 bp, Homo sapiens
agctttatcagaggagtctcta

SEQ ID NO: 8056066 - DNA, 22 bp, Homo sapiens
agctttatcacaatattggcta

SEQ ID NO: 8056067 - DNA, 22 bp, Homo sapiens
agctttatcacaatattggcta

SEQ ID NO: 8056068 - DNA, 22 bp, Homo sapiens
agctttatgcttcctacaagct

SEQ ID NO: 8056069 - DNA, 22 bp, Homo sapiens
agctttatgcttcctacaagct

SEQ ID NO: 8056070 - DNA, 22 bp, Homo sapiens
agctttatgaggagaccttagt

SEQ ID NO: 8056071 - DNA, 22 bp, Homo sapiens
agctttatgaggagaccttagt

SEQ ID NO: 8056072 - DNA, 22 bp, Homo sapiens
agctttatcccttgcccatcga

SEQ ID NO: 8056073 - DNA, 22 bp, Homo sapiens
agctttatcccttgcccatcga

SEQ ID NO: 8056074 - DNA, 22 bp, Homo sapiens
agctttatcttcacctgggaat

SEQ ID NO: 8056075 - DNA, 22 bp, Homo sapiens
agctttatcttcacctgggaat

SEQ ID NO: 8056076 - DNA, 22 bp, Homo sapiens
agctgggtgaaggcagatggct

SEQ ID NO: 8056077 - DNA, 22 bp, Homo sapiens
agctgggtgaaggcagatggct

SEQ ID NO: 8056078 - DNA, 22 bp, Homo sapiens
agctgggtcttgggccaggaga

SEQ ID NO: 8056079 - DNA, 23 bp, Homo sapiens
acagcttcctactttgctgctgc

SEQ ID NO: 8056080 - DNA, 22 bp, Homo sapiens
acagcttcacccattatccctg

SEQ ID NO: 8056081 - DNA, 22 bp, Homo sapiens
acaggccataaaggcaggccct

SEQ ID NO: 8056082 - DNA, 22 bp, Homo sapiens
acaggcctacgaagtcaggtgc

SEQ ID NO: 8056083 - DNA, 22 bp, Homo sapiens
acagcttcgaggatctcatccc

SEQ ID NO: 8056084 - DNA, 22 bp, Homo sapiens
aggaatggttatggggatagta

SEQ ID NO: 8056085 - DNA, 19 bp, Homo sapiens
aggaatggaattaattctg

SEQ ID NO: 8056086 - DNA, 22 bp, Homo sapiens
acaggctgggcgcttcctgcgg

SEQ ID NO: 8056087 - DNA, 22 bp, Homo sapiens
acaggctgctgggctccgtgct

SEQ ID NO: 8056088 - DNA, 22 bp, Homo sapiens
acaggctggtggtcctggccat

SEQ ID NO: 8056089 - DNA, 22 bp, Homo sapiens
acaggctctggggcaggatggc

SEQ ID NO: 8056090 - DNA, 22 bp, Homo sapiens
agctttatgggagcttagataa

SEQ ID NO: 8056091 - DNA, 22 bp, Homo sapiens
agctttatgggagcttagataa

SEQ ID NO: 8056092 - DNA, 22 bp, Homo sapiens
agctgggtccctctgctgatgg

SEQ ID NO: 8056093 - DNA, 22 bp, Homo sapiens
agctgggtactgatgtcttcag

SEQ ID NO: 8056094 - DNA, 22 bp, Homo sapiens
agctgggtacagcctgtgccta

SEQ ID NO: 8056095 - DNA, 22 bp, Homo sapiens
agctgggtacagcctgtgccta

SEQ ID NO: 8056096 - DNA, 22 bp, Homo sapiens
agctggggttgcacacattttg

SEQ ID NO: 8056097 - DNA, 22 bp, Homo sapiens
agctgggggttggataagggta

SEQ ID NO: 8056098 - DNA, 22 bp, Homo sapiens
agctgggggttggataagggta

SEQ ID NO: 8056099 - DNA, 22 bp, Homo sapiens
agctgggggtagtgagaaataa

SEQ ID NO: 8056100 - DNA, 22 bp, Homo sapiens
agctggggctgtggttgtgatt

SEQ ID NO: 8056101 - DNA, 22 bp, Homo sapiens
agctggggctgtggttgtgatt

SEQ ID NO: 8056102 - DNA, 23 bp, Homo sapiens
acagctgcacctggccgcctggc

SEQ ID NO: 8056103 - DNA, 20 bp, Homo sapiens
agctgggcaattatgactat

SEQ ID NO: 8056104 - DNA, 22 bp, Homo sapiens
agctggggctgcagagaacagg

SEQ ID NO: 8056105 - DNA, 17 bp, Homo sapiens
agctgccttgcttgagc

SEQ ID NO: 8056106 - DNA, 22 bp, Homo sapiens
agctgccttttgagaaagctca

SEQ ID NO: 8056107 - DNA, 22 bp, Homo sapiens
agctgcctgggcttgtacacct

SEQ ID NO: 8056108 - DNA, 22 bp, Homo sapiens
agctgcctgtaaaatgtgtgat

SEQ ID NO: 8056109 - DNA, 22 bp, Homo sapiens
agctgcctgtcctaggccatca

SEQ ID NO: 8056110 - DNA, 22 bp, Homo sapiens
agctgccccatgagaggcaggt

SEQ ID NO: 8056111 - DNA, 22 bp, Homo sapiens
agctgcccaggttcattgggcc

SEQ ID NO: 8056112 - DNA, 22 bp, Homo sapiens
agctgcccagataggaggaggc

SEQ ID NO: 8056113 - DNA, 22 bp, Homo sapiens
agctgccatctgaagaactgca

SEQ ID NO: 8056114 - DNA, 22 bp, Homo sapiens
agctgccatccgaggtgtcaga

SEQ ID NO: 8056115 - DNA, 22 bp, Homo sapiens
agctgccaggcccctgagaacc

SEQ ID NO: 8056116 - DNA, 17 bp, Homo sapiens
agctgccagggagtgtg

SEQ ID NO: 8056117 - DNA, 22 bp, Homo sapiens
acaggtggagtggttagcaggc

SEQ ID NO: 8056118 - DNA, 22 bp, Homo sapiens
acaggtggaggctttaggaggt

SEQ ID NO: 8056119 - DNA, 22 bp, Homo sapiens
acaggtggcagaagcatttact

SEQ ID NO: 8056120 - DNA, 22 bp, Homo sapiens
acaggtggcactgctgttactc

SEQ ID NO: 8056121 - DNA, 22 bp, Homo sapiens
acaggtggcataggcagtttga

SEQ ID NO: 8056122 - DNA, 22 bp, Homo sapiens
acaggtggccccgagggagtgg

SEQ ID NO: 8056123 - DNA, 22 bp, Homo sapiens
acaggtggaaacatggtgttgg

SEQ ID NO: 8056124 - DNA, 22 bp, Homo sapiens
acaggtggacacagcagcagtc

SEQ ID NO: 8056125 - DNA, 22 bp, Homo sapiens
acaggtggacacagcagcagtc

SEQ ID NO: 8056126 - DNA, 22 bp, Homo sapiens
acagggcacctgaggtaggaag

SEQ ID NO: 8056127 - DNA, 22 bp, Homo sapiens
acagggcaacctctgggagact

SEQ ID NO: 8056128 - DNA, 22 bp, Homo sapiens
acagggattatgactgacagcc

SEQ ID NO: 8056129 - DNA, 18 bp, Homo sapiens
acagggagggcgctgggg

SEQ ID NO: 8056130 - DNA, 22 bp, Homo sapiens
acaggtggtctttgctcctttt

SEQ ID NO: 8056131 - DNA, 22 bp, Homo sapiens
acaggtgtaaaacccaggatgg

SEQ ID NO: 8056132 - DNA, 22 bp, Homo sapiens
aggagctggccactaggatgca

SEQ ID NO: 8056133 - DNA, 22 bp, Homo sapiens
aggagctggagtccaggcaagt

SEQ ID NO: 8056134 - DNA, 22 bp, Homo sapiens
acaggtgtaatttgcccgaggt

SEQ ID NO: 8056135 - DNA, 22 bp, Homo sapiens
aggagctggagtccaggcaagt

SEQ ID NO: 8056136 - DNA, 22 bp, Homo sapiens
aggagctggagtccaggcaagt

SEQ ID NO: 8056137 - DNA, 22 bp, Homo sapiens
aggagctgttttgttcagcaaa

SEQ ID NO: 8056138 - DNA, 21 bp, Homo sapiens
aggagctgtgttagctggtcg

SEQ ID NO: 8056139 - DNA, 22 bp, Homo sapiens
acaggtggcttattggctgatt

SEQ ID NO: 8056140 - DNA, 22 bp, Homo sapiens
acaggtggcttccattttctaa

SEQ ID NO: 8056141 - DNA, 22 bp, Homo sapiens
acaggtgggcttaagagtcggc

SEQ ID NO: 8056142 - DNA, 22 bp, Homo sapiens
acaggtggtagagtggaaagag

SEQ ID NO: 8056143 - DNA, 22 bp, Homo sapiens
acaggtggtaaaatggactgtc

SEQ ID NO: 8056144 - DNA, 22 bp, Homo sapiens
acaggtggggcacttggagcct

SEQ ID NO: 8056145 - DNA, 22 bp, Homo sapiens
acaggtggggaggctgaggttc

SEQ ID NO: 8056146 - DNA, 21 bp, Homo sapiens
aggaggaacccgtggctgggc

SEQ ID NO: 8056147 - DNA, 22 bp, Homo sapiens
acagtacaagcaatgcattttt

SEQ ID NO: 8056148 - DNA, 22 bp, Homo sapiens
acagtgaggacagggactgtgt

SEQ ID NO: 8056149 - DNA, 22 bp, Homo sapiens
aggcaggcaaccacctgggaag

SEQ ID NO: 8056150 - DNA, 22 bp, Homo sapiens
aggcaggcactccggaagtgtc

SEQ ID NO: 8056151 - DNA, 22 bp, Homo sapiens
aggcaggcaagttcatatgagg

SEQ ID NO: 8056152 - DNA, 22 bp, Homo sapiens
aggcagcatgggccccagctcc

SEQ ID NO: 8056153 - DNA, 22 bp, Homo sapiens
aggcagcattcaggggtgatga

SEQ ID NO: 8056154 - DNA, 19 bp, Homo sapiens
acagtttgggaaatgagca

SEQ ID NO: 8056155 - DNA, 22 bp, Homo sapiens
aggcagcagtgataagatagga

SEQ ID NO: 8056156 - DNA, 19 bp, Homo sapiens
aggcagcacccagtccttg

SEQ ID NO: 8056157 - DNA, 22 bp, Homo sapiens
aggcagcatccagaggagaatg

SEQ ID NO: 8056158 - DNA, 22 bp, Homo sapiens
acagttagttgaggagtgtttg

SEQ ID NO: 8056159 - DNA, 22 bp, Homo sapiens
aggctggcaaggcagatgtgtg

SEQ ID NO: 8056160 - DNA, 19 bp, Homo sapiens
aggctggatgcccatctta

SEQ ID NO: 8056161 - DNA, 22 bp, Homo sapiens
aggctggatttatggggacttc

SEQ ID NO: 8056162 - DNA, 22 bp, Homo sapiens
acatttttactgggcatctgca

SEQ ID NO: 8056163 - DNA, 22 bp, Homo sapiens
acatttttctaggaggcaaggt

SEQ ID NO: 8056164 - DNA, 22 bp, Homo sapiens
acatttttcacatttgtagggt

SEQ ID NO: 8056165 - DNA, 22 bp, Homo sapiens
acatttttattcatcaaagcag

SEQ ID NO: 8056166 - DNA, 22 bp, Homo sapiens
acatttttgggttgatgtctga

SEQ ID NO: 8056167 - DNA, 19 bp, Homo sapiens
accaaaggagtggggtata

SEQ ID NO: 8056168 - DNA, 22 bp, Homo sapiens
aggctggagtgtgcagtggcgc

SEQ ID NO: 8056169 - DNA, 17 bp, Homo sapiens
agggacagcagtttagg

SEQ ID NO: 8056170 - DNA, 22 bp, Homo sapiens
agggacagatgaatgactgagt

SEQ ID NO: 8056171 - DNA, 22 bp, Homo sapiens
agggacagtatccatctcacag

SEQ ID NO: 8056172 - DNA, 20 bp, Homo sapiens
accaggccccgggccctgca

SEQ ID NO: 8056173 - DNA, 23 bp, Homo sapiens
agggagctaaaaggctggagcag

SEQ ID NO: 8056174 - DNA, 22 bp, Homo sapiens
accaggcctagcaagtacatta

SEQ ID NO: 8056175 - DNA, 19 bp, Homo sapiens
accaggcctcagaggccct

SEQ ID NO: 8056176 - DNA, 22 bp, Homo sapiens
acccacacatctctaattcagt

SEQ ID NO: 8056177 - DNA, 20 bp, Homo sapiens
agggcagcttgaggagccgg

SEQ ID NO: 8056178 - DNA, 22 bp, Homo sapiens
acccacacctccgtatatcact

SEQ ID NO: 8056179 - DNA, 22 bp, Homo sapiens
agggcatgaaatgggcagaagc

SEQ ID NO: 8056180 - DNA, 22 bp, Homo sapiens
agggcagtgtggtgggactgac

SEQ ID NO: 8056181 - DNA, 22 bp, Homo sapiens
acccaggcctgagagacaggag

SEQ ID NO: 8056182 - DNA, 22 bp, Homo sapiens
acccaggcctgagagacaggag

SEQ ID NO: 8056183 - DNA, 22 bp, Homo sapiens
agggcatgaagcagtggacagc

SEQ ID NO: 8056184 - DNA, 23 bp, Homo sapiens
agggcatgaagcagaggacgtgg

SEQ ID NO: 8056185 - DNA, 23 bp, Homo sapiens
agggcatgaagcagaggacgtgg

SEQ ID NO: 8056186 - DNA, 22 bp, Homo sapiens
agggagctctgggggcacacgg

SEQ ID NO: 8056187 - DNA, 22 bp, Homo sapiens
agggagctctaagtagagggac

SEQ ID NO: 8056188 - DNA, 18 bp, Homo sapiens
acccaggctcatggtcct

SEQ ID NO: 8056189 - DNA, 22 bp, Homo sapiens
agggcctgggaagaggaaccct

SEQ ID NO: 8056190 - DNA, 22 bp, Homo sapiens
acccaggctgcttctcagtggc

SEQ ID NO: 8056191 - DNA, 22 bp, Homo sapiens
accctagacattgaactagggt

SEQ ID NO: 8056192 - DNA, 22 bp, Homo sapiens
agggcctggttctgtgtaggga

SEQ ID NO: 8056193 - DNA, 22 bp, Homo sapiens
agggcctggggtagcttactgc

SEQ ID NO: 8056194 - DNA, 22 bp, Homo sapiens
agggcctggtgacctgggtcct

SEQ ID NO: 8056195 - DNA, 22 bp, Homo sapiens
agggcctggtgacctgggtcct

SEQ ID NO: 8056196 - DNA, 22 bp, Homo sapiens
agggcctggtgacctgggtcct

SEQ ID NO: 8056197 - DNA, 22 bp, Homo sapiens
acatgagatcacaaagataaat

SEQ ID NO: 8056198 - DNA, 22 bp, Homo sapiens
acatgagaggctgtggagtaca

SEQ ID NO: 8056199 - DNA, 22 bp, Homo sapiens
aggcaggggagctggaagggta

SEQ ID NO: 8056200 - DNA, 22 bp, Homo sapiens
aggcaggggagctggaagggta

SEQ ID NO: 8056201 - DNA, 22 bp, Homo sapiens
aggcagggctgggattagactc

SEQ ID NO: 8056202 - DNA, 22 bp, Homo sapiens
aggcagggctgggattagactc

SEQ ID NO: 8056203 - DNA, 22 bp, Homo sapiens
aggcaggggagctggaagggta

SEQ ID NO: 8056204 - DNA, 22 bp, Homo sapiens
acatgacttttctcttccagag

SEQ ID NO: 8056205 - DNA, 17 bp, Homo sapiens
aggcaggcagagcggga

SEQ ID NO: 8056206 - DNA, 22 bp, Homo sapiens
aggcaggcagctgtcaccactc

SEQ ID NO: 8056207 - DNA, 22 bp, Homo sapiens
aggcagggctcatttcttaggc

SEQ ID NO: 8056208 - DNA, 22 bp, Homo sapiens
aggcagggctcatttcttaggc

SEQ ID NO: 8056209 - DNA, 22 bp, Homo sapiens
aggcagggaccagttgttttct

SEQ ID NO: 8056210 - DNA, 22 bp, Homo sapiens
aggcagggaccagttgttttct

SEQ ID NO: 8056211 - DNA, 23 bp, Homo sapiens
aggcaggcagttcagctgttgtt

SEQ ID NO: 8056212 - DNA, 19 bp, Homo sapiens
acatggcatcccaggaggt

SEQ ID NO: 8056213 - DNA, 22 bp, Homo sapiens
aggccctgtaaggtgtggagat

SEQ ID NO: 8056214 - DNA, 22 bp, Homo sapiens
aggccctgcccagagctcctcg

SEQ ID NO: 8056215 - DNA, 22 bp, Homo sapiens
aggccctgttatgagccactgt

SEQ ID NO: 8056216 - DNA, 22 bp, Homo sapiens
aggccctgtccatggtgctgaa

SEQ ID NO: 8056217 - DNA, 20 bp, Homo sapiens
aggctgagttctatgcactt

SEQ ID NO: 8056218 - DNA, 22 bp, Homo sapiens
acatttattactcaggttgttg

SEQ ID NO: 8056219 - DNA, 22 bp, Homo sapiens
aggccttgtgagaagcagagaa

SEQ ID NO: 8056220 - DNA, 22 bp, Homo sapiens
aggcgctgagtaggcaaggagg

SEQ ID NO: 8056221 - DNA, 22 bp, Homo sapiens
aggctagctgtttcagggctag

SEQ ID NO: 8056222 - DNA, 22 bp, Homo sapiens
aggctagctgtttcagggctag

SEQ ID NO: 8056223 - DNA, 22 bp, Homo sapiens
aggctagctttggctcagtaaa

SEQ ID NO: 8056224 - DNA, 22 bp, Homo sapiens
aggctagctaatgagtactgtg

SEQ ID NO: 8056225 - DNA, 23 bp, Homo sapiens
aggcgagctcttctccagcacgt

SEQ ID NO: 8056226 - DNA, 22 bp, Homo sapiens
aatgaacaaatggtgctgcttg

SEQ ID NO: 8056227 - DNA, 22 bp, Homo sapiens
aatgaatgttttaaggcataaa

SEQ ID NO: 8056228 - DNA, 19 bp, Homo sapiens
aaccttgcatgtcattata

SEQ ID NO: 8056229 - DNA, 22 bp, Homo sapiens
aacatgtgtcttgcatttcttg

SEQ ID NO: 8056230 - DNA, 22 bp, Homo sapiens
aaccctgggaggcagctcagtt

SEQ ID NO: 8056231 - DNA, 22 bp, Homo sapiens
aacctcaggctctctggacaat

SEQ ID NO: 8056232 - DNA, 22 bp, Homo sapiens
aatgaattgcagtactgacttg

SEQ ID NO: 8056233 - DNA, 22 bp, Homo sapiens
aactagaaaaagactttctgag

SEQ ID NO: 8056234 - DNA, 19 bp, Homo sapiens
aactagaaaggttttgaga

SEQ ID NO: 8056235 - DNA, 22 bp, Homo sapiens
aatggctctttgaggacagaag

SEQ ID NO: 8056236 - DNA, 22 bp, Homo sapiens
aatggctctgatgttgttgtga

SEQ ID NO: 8056237 - DNA, 22 bp, Homo sapiens
aatggcttaccctggattgtgt

SEQ ID NO: 8056238 - DNA, 23 bp, Homo sapiens
aactagttgccatgaataaaagc

SEQ ID NO: 8056239 - DNA, 22 bp, Homo sapiens
aactagtttagctttttaagac

SEQ ID NO: 8056240 - DNA, 22 bp, Homo sapiens
aactagttttagccacagaaca

SEQ ID NO: 8056241 - DNA, 22 bp, Homo sapiens
aactagttttagctctagcaac

SEQ ID NO: 8056242 - DNA, 22 bp, Homo sapiens
aacatgtgtctggctagattgt

SEQ ID NO: 8056243 - DNA, 22 bp, Homo sapiens
aacatgtgagcaggttttttat

SEQ ID NO: 8056244 - DNA, 22 bp, Homo sapiens
aatagattcatggttaagagca

SEQ ID NO: 8056245 - DNA, 22 bp, Homo sapiens
aatagatctgtgtgcacatttg

SEQ ID NO: 8056246 - DNA, 19 bp, Homo sapiens
aacatctgtaactattttc

SEQ ID NO: 8056247 - DNA, 22 bp, Homo sapiens
aagtggtcagtcatgggagatt

SEQ ID NO: 8056248 - DNA, 22 bp, Homo sapiens
aacatatttggctgatattccc

SEQ ID NO: 8056249 - DNA, 21 bp, Homo sapiens
aaattcacctagtaaaacttc

SEQ ID NO: 8056250 - DNA, 21 bp, Homo sapiens
aaattcacctagtaaaacttc

SEQ ID NO: 8056251 - DNA, 22 bp, Homo sapiens
aaattcacaagagcattgcctg

SEQ ID NO: 8056252 - DNA, 22 bp, Homo sapiens
aaggctgggtaacctgtccact

SEQ ID NO: 8056253 - DNA, 22 bp, Homo sapiens
aaggcagcaggatttggtgact

SEQ ID NO: 8056254 - DNA, 22 bp, Homo sapiens
aaggaagagtctagaacaggca

SEQ ID NO: 8056255 - DNA, 22 bp, Homo sapiens
aaggaagactcgcaggtctatg

SEQ ID NO: 8056256 - DNA, 22 bp, Homo sapiens
aacagaatagttgatgtacagt

SEQ ID NO: 8056257 - DNA, 22 bp, Homo sapiens
aacagacaactcctgtggctca

SEQ ID NO: 8056258 - DNA, 22 bp, Homo sapiens
aacagacagaaaaatgtgatct

SEQ ID NO: 8056259 - DNA, 22 bp, Homo sapiens
aacagacatatttttaatatgc

SEQ ID NO: 8056260 - DNA, 22 bp, Homo sapiens
aacacagtcagttcctggatca

SEQ ID NO: 8056261 - DNA, 22 bp, Homo sapiens
aacacagatcaaaatatttcct

SEQ ID NO: 8056262 - DNA, 22 bp, Homo sapiens
aaatttctaagtcaagaagaac

SEQ ID NO: 8056263 - DNA, 22 bp, Homo sapiens
aagaaattaatgtgccattact

SEQ ID NO: 8056264 - DNA, 22 bp, Homo sapiens
aattctcaggtaaaagttaagt

SEQ ID NO: 8056265 - DNA, 22 bp, Homo sapiens
aagaaaatcagttctggtcagt

SEQ ID NO: 8056266 - DNA, 22 bp, Homo sapiens
aactggtcctcaaattttgatg

SEQ ID NO: 8056267 - DNA, 22 bp, Homo sapiens
aagagactatggtgtctatgaa

SEQ ID NO: 8056268 - DNA, 22 bp, Homo sapiens
acacaaaatcaaagtcctaggc

SEQ ID NO: 8056269 - DNA, 22 bp, Homo sapiens
aagcacctctatgattgctttt

SEQ ID NO: 8056270 - DNA, 22 bp, Homo sapiens
aagcagaggaccgacggaggga

SEQ ID NO: 8056271 - DNA, 22 bp, Homo sapiens
aagcagctttctttcctgtgaa

SEQ ID NO: 8056272 - DNA, 22 bp, Homo sapiens
acagccagggcattgtcgccga

SEQ ID NO: 8056273 - DNA, 22 bp, Homo sapiens
aagcaggaaggagcccagggca

SEQ ID NO: 8056274 - DNA, 22 bp, Homo sapiens
acagccagggtctcaggaggcg

SEQ ID NO: 8056275 - DNA, 22 bp, Homo sapiens
acagcctggactggctctctgc

SEQ ID NO: 8056276 - DNA, 22 bp, Homo sapiens
acacatcttagactgaaatatg

SEQ ID NO: 8056277 - DNA, 19 bp, Homo sapiens
acacatgctcctggagcct

SEQ ID NO: 8056278 - DNA, 22 bp, Homo sapiens
acacattgtcatttccatacta

SEQ ID NO: 8056279 - DNA, 22 bp, Homo sapiens
aagatgcttccactgcagtggc

SEQ ID NO: 8056280 - DNA, 22 bp, Homo sapiens
aactgcaaagccaatctcagga

SEQ ID NO: 8056281 - DNA, 22 bp, Homo sapiens
aaagcctcccaggttatgagta

SEQ ID NO: 8056282 - DNA, 22 bp, Homo sapiens
aactgtctgaaactggggtttc

SEQ ID NO: 8056283 - DNA, 22 bp, Homo sapiens
aactgtgggatgcattaattca

SEQ ID NO: 8056284 - DNA, 22 bp, Homo sapiens
aactgtggacttgagactgatg

SEQ ID NO: 8056285 - DNA, 22 bp, Homo sapiens
aactgtggagattcggaaggta

SEQ ID NO: 8056286 - DNA, 22 bp, Homo sapiens
aactgtggcatgttgaatttgt

SEQ ID NO: 8056287 - DNA, 22 bp, Homo sapiens
aactgtggccagggactggagt

SEQ ID NO: 8056288 - DNA, 22 bp, Homo sapiens
aactgtgggagaaggcgatgtg

SEQ ID NO: 8056289 - DNA, 22 bp, Homo sapiens
aagaacatgaacacaatgttta

SEQ ID NO: 8056290 - DNA, 22 bp, Homo sapiens
aagaacatgagttatgatgatt

SEQ ID NO: 8056291 - DNA, 22 bp, Homo sapiens
aaagtaattgtggttcttgcca

SEQ ID NO: 8056292 - DNA, 22 bp, Homo sapiens
aaagcagcaaatacttttgcac

SEQ ID NO: 8056293 - DNA, 22 bp, Homo sapiens
aaagccattgaactgtacttta

SEQ ID NO: 8056294 - DNA, 22 bp, Homo sapiens
aacatataaactcttaagttca

SEQ ID NO: 8056295 - DNA, 22 bp, Homo sapiens
aagacgggagtcaggtgagctc

SEQ ID NO: 8056296 - DNA, 22 bp, Homo sapiens
aaagtgactgccagtgctgggc

SEQ ID NO: 8056297 - DNA, 22 bp, Homo sapiens
aagaggggtggtctgtgaggat

SEQ ID NO: 8056298 - DNA, 22 bp, Homo sapiens
aaatactagaattcagagttga

SEQ ID NO: 8056299 - DNA, 22 bp, Homo sapiens
aaatactgctgctattcctttt

SEQ ID NO: 8056300 - DNA, 22 bp, Homo sapiens
aagagggaggtgcgggtgcaga

SEQ ID NO: 8056301 - DNA, 22 bp, Homo sapiens
aagagggcagcacaggtgggtc

SEQ ID NO: 8056302 - DNA, 22 bp, Homo sapiens
aaagttttagctgtccagttcc

SEQ ID NO: 8056303 - DNA, 22 bp, Homo sapiens
aagatattcaaagatttattag

SEQ ID NO: 8056304 - DNA, 22 bp, Homo sapiens
aagcaggcatcttggaggtcaa

SEQ ID NO: 8056305 - DNA, 22 bp, Homo sapiens
aagcaggcatgggaggccatcc

SEQ ID NO: 8056306 - DNA, 22 bp, Homo sapiens
aagcaggcagggtggagagttt

SEQ ID NO: 8056307 - DNA, 22 bp, Homo sapiens
aagcaggcaaggttgtggggca

SEQ ID NO: 8056308 - DNA, 22 bp, Homo sapiens
aagcaggagagcctgggtgagc

SEQ ID NO: 8056309 - DNA, 22 bp, Homo sapiens
aagcagcatagctcccttagtt

SEQ ID NO: 8056310 - DNA, 22 bp, Homo sapiens
aagcagcatatgacagcatcca

SEQ ID NO: 8056311 - DNA, 22 bp, Homo sapiens
aagcctggcacattggagtctg

SEQ ID NO: 8056312 - DNA, 22 bp, Homo sapiens
aagcaggcgagggcctggagca

SEQ ID NO: 8056313 - DNA, 22 bp, Homo sapiens
aaatctgagaaatattgtccag

SEQ ID NO: 8056314 - DNA, 22 bp, Homo sapiens
aagcccagatgggagcatttca

SEQ ID NO: 8056315 - DNA, 22 bp, Homo sapiens
aaagactagcatttatatgtac

SEQ ID NO: 8056316 - DNA, 22 bp, Homo sapiens
aaagactcaattgttccctaat

SEQ ID NO: 8056317 - DNA, 22 bp, Homo sapiens
aaagactcttaactccctagcg

SEQ ID NO: 8056318 - DNA, 22 bp, Homo sapiens
aaagagaaacttagaagcctga

SEQ ID NO: 8056319 - DNA, 22 bp, Homo sapiens
aaacttttcctgctcttgtcct

SEQ ID NO: 8056320 - DNA, 22 bp, Homo sapiens
aaagaaatacctttctcagctt

SEQ ID NO: 8056321 - DNA, 22 bp, Homo sapiens
aaacttttttaggttcataggc

SEQ ID NO: 8056322 - DNA, 22 bp, Homo sapiens
aaactttttattctaatgtcta

SEQ ID NO: 8056323 - DNA, 22 bp, Homo sapiens
aaacttttggtcctcatgggtt

SEQ ID NO: 8056324 - DNA, 22 bp, Homo sapiens
aaagaaatagatggcatttaaa

SEQ ID NO: 8056325 - DNA, 20 bp, Homo sapiens
aaacattcatgtacaagtga

SEQ ID NO: 8056326 - DNA, 22 bp, Homo sapiens
aaacattccatatataccttgt

SEQ ID NO: 8056327 - DNA, 22 bp, Homo sapiens
aaacattccatttctatgtaag

SEQ ID NO: 8056328 - DNA, 22 bp, Homo sapiens
aaaattcattcctcagactgcc

SEQ ID NO: 8056329 - DNA, 22 bp, Homo sapiens
aaaattctgtcattaaattgtg

SEQ ID NO: 8056330 - DNA, 22 bp, Homo sapiens
aaacagtaagttctagtattat

SEQ ID NO: 8056331 - DNA, 22 bp, Homo sapiens
aaacagtattatcaatatattt

SEQ ID NO: 8056332 - DNA, 22 bp, Homo sapiens
aaaaggaggacatggttacaga

SEQ ID NO: 8056333 - DNA, 18 bp, Homo sapiens
aaaaagtgctcaggccta

SEQ ID NO: 8056334 - DNA, 22 bp, Homo sapiens
aaaaggaggtcactttattcct

SEQ ID NO: 8056335 - DNA, 22 bp, Homo sapiens
aaaaggcagtgcaagagagggt

SEQ ID NO: 8056336 - DNA, 22 bp, Homo sapiens
acactcaccctcccactgcctg

SEQ ID NO: 8056337 - DNA, 22 bp, Homo sapiens
acactctgtaatgtcacactcc

SEQ ID NO: 8056338 - DNA, 22 bp, Homo sapiens
acactagtagaatagtgtttgc

SEQ ID NO: 8056339 - DNA, 22 bp, Homo sapiens
acactgaatgctgtttagaaat

SEQ ID NO: 8056340 - DNA, 21 bp, Homo sapiens
acactgacaaccatccacgag

SEQ ID NO: 8056341 - DNA, 17 bp, Homo sapiens
acactgacatgccacac

SEQ ID NO: 8056342 - DNA, 22 bp, Homo sapiens
acactgacacctgccctcaggt

SEQ ID NO: 8056343 - DNA, 22 bp, Homo sapiens
acactgactgggacagaagacc

SEQ ID NO: 8056344 - DNA, 22 bp, Homo sapiens
acactgactgggcagtatagtc

SEQ ID NO: 8056345 - DNA, 22 bp, Homo sapiens
acactgacgcttgacagtcacc

SEQ ID NO: 8056346 - DNA, 22 bp, Homo sapiens
acactgagattttcctgacacc

SEQ ID NO: 8056347 - DNA, 22 bp, Homo sapiens
acactgagctgagcattcttgt

SEQ ID NO: 8056348 - DNA, 22 bp, Homo sapiens
acactgagttttaccaggcaca

SEQ ID NO: 8056349 - DNA, 22 bp, Homo sapiens
agcagctgtactttcatctgtt

SEQ ID NO: 8056350 - DNA, 18 bp, Homo sapiens
acacaggctgacagcacc

SEQ ID NO: 8056351 - DNA, 20 bp, Homo sapiens
acacagagtgagtctgcttg

SEQ ID NO: 8056352 - DNA, 21 bp, Homo sapiens
acacagaggcatcatcacttt

SEQ ID NO: 8056353 - DNA, 22 bp, Homo sapiens
acacagagtatcttttgcctag

SEQ ID NO: 8056354 - DNA, 22 bp, Homo sapiens
agcagctggtaggagtggccac

SEQ ID NO: 8056355 - DNA, 17 bp, Homo sapiens
agcagctgggttgatct

SEQ ID NO: 8056356 - DNA, 22 bp, Homo sapiens
agcagctgagccccagctgtga

SEQ ID NO: 8056357 - DNA, 22 bp, Homo sapiens
acacagatgcattacacatcta

SEQ ID NO: 8056358 - DNA, 22 bp, Homo sapiens
agcagctggggcctgtgacgat

SEQ ID NO: 8056359 - DNA, 22 bp, Homo sapiens
acacagagtttgacacatggga

SEQ ID NO: 8056360 - DNA, 22 bp, Homo sapiens
agcagagcagaatgtgaaggtg

SEQ ID NO: 8056361 - DNA, 22 bp, Homo sapiens
agcctctgatgatcacaggggg

SEQ ID NO: 8056362 - DNA, 21 bp, Homo sapiens
acagagccgggcacaaagctg

SEQ ID NO: 8056363 - DNA, 22 bp, Homo sapiens
acagagccactttggtgcctac

SEQ ID NO: 8056364 - DNA, 22 bp, Homo sapiens
acagattcactgcactggccat

SEQ ID NO: 8056365 - DNA, 19 bp, Homo sapiens
agccagggtgagaaggagc

SEQ ID NO: 8056366 - DNA, 19 bp, Homo sapiens
agccagggtgagaaggagc

SEQ ID NO: 8056367 - DNA, 22 bp, Homo sapiens
agccagggtgagagggctttgt

SEQ ID NO: 8056368 - DNA, 22 bp, Homo sapiens
agccagggtctctcgctctgtt

SEQ ID NO: 8056369 - DNA, 19 bp, Homo sapiens
agccagggtccagacatgt

SEQ ID NO: 8056370 - DNA, 22 bp, Homo sapiens
acagactgtcatgacactatat

SEQ ID NO: 8056371 - DNA, 22 bp, Homo sapiens
acagactgtgagtatgcatagt

SEQ ID NO: 8056372 - DNA, 22 bp, Homo sapiens
acagacacaggcgtggagtcgc

SEQ ID NO: 8056373 - DNA, 22 bp, Homo sapiens
acagacagaggctccatgagga

SEQ ID NO: 8056374 - DNA, 22 bp, Homo sapiens
acagacagacagattgcatatg

SEQ ID NO: 8056375 - DNA, 22 bp, Homo sapiens
acagacagacagagaactattc

SEQ ID NO: 8056376 - DNA, 22 bp, Homo sapiens
acagacagattttgtctgatgt

SEQ ID NO: 8056377 - DNA, 22 bp, Homo sapiens
acagacagggcacctgcctcct

SEQ ID NO: 8056378 - DNA, 22 bp, Homo sapiens
agccaggggattcatcagggac

SEQ ID NO: 8056379 - DNA, 22 bp, Homo sapiens
acacttttagctatgagttaat

SEQ ID NO: 8056380 - DNA, 22 bp, Homo sapiens
acagaaagaaggtgtatttgag

SEQ ID NO: 8056381 - DNA, 22 bp, Homo sapiens
agaccctggggaaagtcacttc

SEQ ID NO: 8056382 - DNA, 22 bp, Homo sapiens
agaccctggtaaacactccagg

SEQ ID NO: 8056383 - DNA, 22 bp, Homo sapiens
agagccaggcggctgggcacct

SEQ ID NO: 8056384 - DNA, 22 bp, Homo sapiens
agagccaggctcccatggggca

SEQ ID NO: 8056385 - DNA, 22 bp, Homo sapiens
agagccaggtgtagtctcggag

SEQ ID NO: 8056386 - DNA, 22 bp, Homo sapiens
agagccagttacaactgtggag

SEQ ID NO: 8056387 - DNA, 22 bp, Homo sapiens
agagcctggcaaaaggtcctgc

SEQ ID NO: 8056388 - DNA, 22 bp, Homo sapiens
agagcctggacctgggctctga

SEQ ID NO: 8056389 - DNA, 22 bp, Homo sapiens
agagcctggacttttctgagcc

SEQ ID NO: 8056390 - DNA, 22 bp, Homo sapiens
agagcctggaggttctgctgaa

SEQ ID NO: 8056391 - DNA, 20 bp, Homo sapiens
agagcctggaaaaagacatc

SEQ ID NO: 8056392 - DNA, 22 bp, Homo sapiens
agagcctgctacctcattccag

SEQ ID NO: 8056393 - DNA, 22 bp, Homo sapiens
agagcctgctgtgtaagtcaca

SEQ ID NO: 8056394 - DNA, 22 bp, Homo sapiens
agagcctggacctgggctctga

SEQ ID NO: 8056395 - DNA, 22 bp, Homo sapiens
agagcctggacctgagctacaa

SEQ ID NO: 8056396 - DNA, 22 bp, Homo sapiens
agagcctgcatctagcctcaga

SEQ ID NO: 8056397 - DNA, 22 bp, Homo sapiens
agagccagttgttaagcactta

SEQ ID NO: 8056398 - DNA, 22 bp, Homo sapiens
aatggcaattcagtgaaattat

SEQ ID NO: 8056399 - DNA, 22 bp, Homo sapiens
aatggagaggctgtgagtgaga

SEQ ID NO: 8056400 - DNA, 22 bp, Homo sapiens
aatggcagaggcaaagatggta

SEQ ID NO: 8056401 - DNA, 22 bp, Homo sapiens
aatgtaaaatatcttgtacttg

SEQ ID NO: 8056402 - DNA, 22 bp, Homo sapiens
aatggtcagggcttttgtaggt

SEQ ID NO: 8056403 - DNA, 22 bp, Homo sapiens
agataatgattctgcatttcta

SEQ ID NO: 8056404 - DNA, 22 bp, Homo sapiens
agataatggagggatttgcatt

SEQ ID NO: 8056405 - DNA, 22 bp, Homo sapiens
agataacatttattgaatgtaa

SEQ ID NO: 8056406 - DNA, 22 bp, Homo sapiens
acaacacatgtgtatatgtgtg

SEQ ID NO: 8056407 - DNA, 22 bp, Homo sapiens
acaagatagcttagaagattca

SEQ ID NO: 8056408 - DNA, 22 bp, Homo sapiens
acaatgaagataatgttgcagt

SEQ ID NO: 8056409 - DNA, 22 bp, Homo sapiens
agaggctgttacactcccagat

SEQ ID NO: 8056410 - DNA, 22 bp, Homo sapiens
agagggggcagcggaccagtga

SEQ ID NO: 8056411 - DNA, 22 bp, Homo sapiens
agagggggaaaatagaggtgtt

SEQ ID NO: 8056412 - DNA, 22 bp, Homo sapiens
agagggggtgttccagaagcat

SEQ ID NO: 8056413 - DNA, 22 bp, Homo sapiens
agagggggtgttccagaagcat

SEQ ID NO: 8056414 - DNA, 22 bp, Homo sapiens
agagggggtgtcagcactgcag

SEQ ID NO: 8056415 - DNA, 22 bp, Homo sapiens
acaaaggcaggattgacttagt

SEQ ID NO: 8056416 - DNA, 22 bp, Homo sapiens
aattgcaaattcagacttaaga

SEQ ID NO: 8056417 - DNA, 22 bp, Homo sapiens
aattcttaatcccataaagtga

SEQ ID NO: 8056418 - DNA, 18 bp, Homo sapiens
agaggctcgatactagaa

SEQ ID NO: 8056419 - DNA, 22 bp, Homo sapiens
agaggctgaatgatgtcatcat

SEQ ID NO: 8056420 - DNA, 22 bp, Homo sapiens
agaggctgaatgatgtcatcat

SEQ ID NO: 8056421 - DNA, 22 bp, Homo sapiens
agaggctctttgagctgggaga

SEQ ID NO: 8056422 - DNA, 22 bp, Homo sapiens
agaggctctggtgggagttggt

SEQ ID NO: 8056423 - DNA, 22 bp, Homo sapiens
agaggctctggtgcagcatgca

SEQ ID NO: 8056424 - DNA, 22 bp, Homo sapiens
aagccaagtgctggccatgggc

SEQ ID NO: 8056425 - DNA, 22 bp, Homo sapiens
aagctatagagtgtaagatgat

SEQ ID NO: 8056426 - DNA, 21 bp, Homo sapiens
acagcctgtcatctcatggtc

SEQ ID NO: 8056427 - DNA, 22 bp, Homo sapiens
acagcctggcctgagttaaggc

SEQ ID NO: 8056428 - DNA, 22 bp, Homo sapiens
acagcctgtttgatctggtgct

SEQ ID NO: 8056429 - DNA, 22 bp, Homo sapiens
aagcatttgtgaaattcagatg

SEQ ID NO: 8056430 - DNA, 22 bp, Homo sapiens
aagcattttgccacttgaagtt

SEQ ID NO: 8056431 - DNA, 22 bp, Homo sapiens
acagggcagagtgaaatgctat

SEQ ID NO: 8056432 - DNA, 19 bp, Homo sapiens
acagggcagcaataggata

SEQ ID NO: 8056433 - DNA, 22 bp, Homo sapiens
acagggcagcaactttgtgcct

SEQ ID NO: 8056434 - DNA, 22 bp, Homo sapiens
acagggcagagggcagttggta

SEQ ID NO: 8056435 - DNA, 22 bp, Homo sapiens
acagggcagaaatgttgcatct

SEQ ID NO: 8056436 - DNA, 22 bp, Homo sapiens
acagggcagagaggcaggcttg

SEQ ID NO: 8056437 - DNA, 22 bp, Homo sapiens
aagctcagtgatgcctccaggg

SEQ ID NO: 8056438 - DNA, 22 bp, Homo sapiens
acagtctttctacattctgtgc

SEQ ID NO: 8056439 - DNA, 22 bp, Homo sapiens
aaggacaggctaacctgacatt

SEQ ID NO: 8056440 - DNA, 22 bp, Homo sapiens
aaggagagagctttgctggaac

SEQ ID NO: 8056441 - DNA, 22 bp, Homo sapiens
aaggagagtacaggagttggta

SEQ ID NO: 8056442 - DNA, 22 bp, Homo sapiens
aaggaggaatttcagggtgaat

SEQ ID NO: 8056443 - DNA, 22 bp, Homo sapiens
aaggaggacacccaggactggg

SEQ ID NO: 8056444 - DNA, 22 bp, Homo sapiens
aaggcagagattagcagaatga

SEQ ID NO: 8056445 - DNA, 22 bp, Homo sapiens
aaggcagagggctggatcagag

SEQ ID NO: 8056446 - DNA, 22 bp, Homo sapiens
aaggctgggaaacatgcaggcc

SEQ ID NO: 8056447 - DNA, 22 bp, Homo sapiens
acattgtttctgaccatgatga

SEQ ID NO: 8056448 - DNA, 22 bp, Homo sapiens
acattgttgtgcaattatagtt

SEQ ID NO: 8056449 - DNA, 22 bp, Homo sapiens
acattgttgtttgcagcacagg

SEQ ID NO: 8056450 - DNA, 22 bp, Homo sapiens
acattgttctacttctagttag

SEQ ID NO: 8056451 - DNA, 22 bp, Homo sapiens
acattgtttggaggagtgagag

SEQ ID NO: 8056452 - DNA, 21 bp, Homo sapiens
aaggcctgcttactgctagtt

SEQ ID NO: 8056453 - DNA, 22 bp, Homo sapiens
aaggcctgaacatgaggagatg

SEQ ID NO: 8056454 - DNA, 22 bp, Homo sapiens
aaggcctcttctctctggagat

SEQ ID NO: 8056455 - DNA, 20 bp, Homo sapiens
aaggcagagtgggttggagc

SEQ ID NO: 8056456 - DNA, 22 bp, Homo sapiens
aaggcctttgccccgatacagg

SEQ ID NO: 8056457 - DNA, 22 bp, Homo sapiens
accgggaagtcctgcactgggc

SEQ ID NO: 8056458 - DNA, 22 bp, Homo sapiens
aagggctgtagacaagattgct

SEQ ID NO: 8056459 - DNA, 22 bp, Homo sapiens
aagggctgtagtttgttgatca

SEQ ID NO: 8056460 - DNA, 22 bp, Homo sapiens
aagggctgttatgtttttatac

SEQ ID NO: 8056461 - DNA, 22 bp, Homo sapiens
aagggctgtaagccaagtaaag

SEQ ID NO: 8056462 - DNA, 22 bp, Homo sapiens
aagggctgggtctggttaaccc

SEQ ID NO: 8056463 - DNA, 22 bp, Homo sapiens
aagggctggtctagaaagggag

SEQ ID NO: 8056464 - DNA, 22 bp, Homo sapiens
accaggcccaccgcatgctcct

SEQ ID NO: 8056465 - DNA, 22 bp, Homo sapiens
acattttgagaaatgacaagct

SEQ ID NO: 8056466 - DNA, 22 bp, Homo sapiens
aagtctcatccgtgtagctcca

SEQ ID NO: 8056467 - DNA, 22 bp, Homo sapiens
aagtctctgatgtgtgttaggt

SEQ ID NO: 8056468 - DNA, 22 bp, Homo sapiens
acggggctagagaaggtttctt

SEQ ID NO: 8056469 - DNA, 22 bp, Homo sapiens
accgggaagtcctgcactgggc

SEQ ID NO: 8056470 - DNA, 22 bp, Homo sapiens
actcagacagaccaaagttctg

SEQ ID NO: 8056471 - DNA, 22 bp, Homo sapiens
actagtttttcctctgtcctgt

SEQ ID NO: 8056472 - DNA, 22 bp, Homo sapiens
actatacaccaaaatattaagg

SEQ ID NO: 8056473 - DNA, 22 bp, Homo sapiens
actagttttccataatatagga

SEQ ID NO: 8056474 - DNA, 22 bp, Homo sapiens
actagttttcaggcatgtctgg

SEQ ID NO: 8056475 - DNA, 22 bp, Homo sapiens
actagtttgaaaatatctgatt

SEQ ID NO: 8056476 - DNA, 22 bp, Homo sapiens
actagtttgagtaattgtaatg

SEQ ID NO: 8056477 - DNA, 22 bp, Homo sapiens
actgcactccaacctgggtgac

SEQ ID NO: 8056478 - DNA, 22 bp, Homo sapiens
actgcactccagcctgggtaac

SEQ ID NO: 8056479 - DNA, 22 bp, Homo sapiens
actgcactccagcctgggtgac

SEQ ID NO: 8056480 - DNA, 22 bp, Homo sapiens
actctggcgggcgggcgagcca

SEQ ID NO: 8056481 - DNA, 22 bp, Homo sapiens
actctcccttggagcctcaggc

SEQ ID NO: 8056482 - DNA, 22 bp, Homo sapiens
actctgcttgggccatatctgg

SEQ ID NO: 8056483 - DNA, 22 bp, Homo sapiens
aatacagaggaaacatttaata

SEQ ID NO: 8056484 - DNA, 22 bp, Homo sapiens
actggccaggcacagctgtggg

SEQ ID NO: 8056485 - DNA, 22 bp, Homo sapiens
actggccaggcagcagtagctt

SEQ ID NO: 8056486 - DNA, 22 bp, Homo sapiens
actggccaggcagcagtagctt

SEQ ID NO: 8056487 - DNA, 22 bp, Homo sapiens
actggccatgggatttatattt

SEQ ID NO: 8056488 - DNA, 22 bp, Homo sapiens
actggaggcccctcccagtgaa

SEQ ID NO: 8056489 - DNA, 22 bp, Homo sapiens
actggaggggaaaatggtagta

SEQ ID NO: 8056490 - DNA, 22 bp, Homo sapiens
actggccagaactaagtcacat

SEQ ID NO: 8056491 - DNA, 23 bp, Homo sapiens
actggacagagtggacgaggctg

SEQ ID NO: 8056492 - DNA, 22 bp, Homo sapiens
actggacagaggaaatatggag

SEQ ID NO: 8056493 - DNA, 22 bp, Homo sapiens
aatgatgtattagtacaacaca

SEQ ID NO: 8056494 - DNA, 23 bp, Homo sapiens
aatgatgtcagaagatgaagtct

SEQ ID NO: 8056495 - DNA, 22 bp, Homo sapiens
aatgatgtttttaaagaacata

SEQ ID NO: 8056496 - DNA, 22 bp, Homo sapiens
aatgatgtggtgggaaggacat

SEQ ID NO: 8056497 - DNA, 22 bp, Homo sapiens
aatgatgtcgaaaagtaagctc

SEQ ID NO: 8056498 - DNA, 22 bp, Homo sapiens
agaagcagaaggaagcagggcc

SEQ ID NO: 8056499 - DNA, 22 bp, Homo sapiens
aatgcaaacagcccagaatcca

SEQ ID NO: 8056500 - DNA, 22 bp, Homo sapiens
aatgatttcccctacacagaag

SEQ ID NO: 8056501 - DNA, 22 bp, Homo sapiens
agaacaatgaggtatggatgga

SEQ ID NO: 8056502 - DNA, 22 bp, Homo sapiens
agaaattctaagcatcaatagc

SEQ ID NO: 8056503 - DNA, 22 bp, Homo sapiens
agaaattctaagcatcaatagc

SEQ ID NO: 8056504 - DNA, 22 bp, Homo sapiens
agaaattcaattctaattagct

SEQ ID NO: 8056505 - DNA, 22 bp, Homo sapiens
agaaattcctaaggtacacaag

SEQ ID NO: 8056506 - DNA, 22 bp, Homo sapiens
agaaatgacacacatgagacat

SEQ ID NO: 8056507 - DNA, 23 bp, Homo sapiens
aatcagtgcagttttatgccaag

SEQ ID NO: 8056508 - DNA, 17 bp, Homo sapiens
aatcagatttctgagga

SEQ ID NO: 8056509 - DNA, 22 bp, Homo sapiens
aatatactatactactttctgg

SEQ ID NO: 8056510 - DNA, 22 bp, Homo sapiens
aatatagaatcactttccttca

SEQ ID NO: 8056511 - DNA, 22 bp, Homo sapiens
actgggcttcacttggcacatc

SEQ ID NO: 8056512 - DNA, 22 bp, Homo sapiens
actttcttaggctgtataaatg

SEQ ID NO: 8056513 - DNA, 22 bp, Homo sapiens
actttgaaactaaaattcatta

SEQ ID NO: 8056514 - DNA, 22 bp, Homo sapiens
actttatgacaccctttagtga

SEQ ID NO: 8056515 - DNA, 23 bp, Homo sapiens
actttattgaccccaggtcagtt

SEQ ID NO: 8056516 - DNA, 22 bp, Homo sapiens
actttatgtttgatatctatgg

SEQ ID NO: 8056517 - DNA, 22 bp, Homo sapiens
actttatgtgcttgctctttcc

SEQ ID NO: 8056518 - DNA, 22 bp, Homo sapiens
actttatgatacagggaagggt

SEQ ID NO: 8056519 - DNA, 22 bp, Homo sapiens
actttatgctaaactttactct

SEQ ID NO: 8056520 - DNA, 20 bp, Homo sapiens
actttatgagttcaattttg

SEQ ID NO: 8056521 - DNA, 21 bp, Homo sapiens
actttatgacctacccttttt

SEQ ID NO: 8056522 - DNA, 23 bp, Homo sapiens
actttattgaccccaggtcagtt

SEQ ID NO: 8056523 - DNA, 22 bp, Homo sapiens
actttatttcctattgcatcca

SEQ ID NO: 8056524 - DNA, 23 bp, Homo sapiens
actttattgaccccaggtcagtt

SEQ ID NO: 8056525 - DNA, 22 bp, Homo sapiens
gtggcatcgtctgaggtggggt

SEQ ID NO: 8056526 - DNA, 22 bp, Homo sapiens
gtggcaggggtattccagctga

SEQ ID NO: 8056527 - DNA, 22 bp, Homo sapiens
gtggcaggggcgggctgttccg

SEQ ID NO: 8056528 - DNA, 22 bp, Homo sapiens
gtggcagggtgctcatcatgca

SEQ ID NO: 8056529 - DNA, 22 bp, Homo sapiens
gtggcagggtgctcatcatgca

SEQ ID NO: 8056530 - DNA, 22 bp, Homo sapiens
gtggcaggatcacggctcactg

SEQ ID NO: 8056531 - DNA, 22 bp, Homo sapiens
gtggcaggagtgggccttgaag

SEQ ID NO: 8056532 - DNA, 22 bp, Homo sapiens
gtggcaggagagacacagccat

SEQ ID NO: 8056533 - DNA, 22 bp, Homo sapiens
gtggcaggagagacacagccat

SEQ ID NO: 8056534 - DNA, 22 bp, Homo sapiens
gtggcagctgtgggacactggt

SEQ ID NO: 8056535 - DNA, 22 bp, Homo sapiens
gtggcagctggtatgcagacag

SEQ ID NO: 8056536 - DNA, 22 bp, Homo sapiens
gtggcagctgtgttgcagtttt

SEQ ID NO: 8056537 - DNA, 20 bp, Homo sapiens
gtggcaggcagtgaaggagc

SEQ ID NO: 8056538 - DNA, 20 bp, Homo sapiens
gtggcaggcagtgaaggagc

SEQ ID NO: 8056539 - DNA, 22 bp, Homo sapiens
gtggcaggatcacggctcactg

SEQ ID NO: 8056540 - DNA, 22 bp, Homo sapiens
gtggcagggagaagccattggg

SEQ ID NO: 8056541 - DNA, 22 bp, Homo sapiens
gtggcagggagaagccattggg

SEQ ID NO: 8056542 - DNA, 22 bp, Homo sapiens
gtggcagggctttgctgttctt

SEQ ID NO: 8056543 - DNA, 22 bp, Homo sapiens
gtggccaggccgactgccaggc

SEQ ID NO: 8056544 - DNA, 22 bp, Homo sapiens
gtggccaggagaccttgggcat

SEQ ID NO: 8056545 - DNA, 22 bp, Homo sapiens
gtggccagccccatggacagtt

SEQ ID NO: 8056546 - DNA, 22 bp, Homo sapiens
gtggccagccagggtgctgatg

SEQ ID NO: 8056547 - DNA, 22 bp, Homo sapiens
gtggccagaatcttgaggcctt

SEQ ID NO: 8056548 - DNA, 22 bp, Homo sapiens
gtgggagaagatttggtcatct

SEQ ID NO: 8056549 - DNA, 22 bp, Homo sapiens
gtgggagccatttccagtatgc

SEQ ID NO: 8056550 - DNA, 22 bp, Homo sapiens
gtgggagcatggtcccagtgcc

SEQ ID NO: 8056551 - DNA, 22 bp, Homo sapiens
gtgggagctgcggaggcctggg

SEQ ID NO: 8056552 - DNA, 22 bp, Homo sapiens
gtgggagcttcatcaagcagtt

SEQ ID NO: 8056553 - DNA, 22 bp, Homo sapiens
gtgggagctttggcatcaggct

SEQ ID NO: 8056554 - DNA, 22 bp, Homo sapiens
gtggctgcagcccagcggcacg

SEQ ID NO: 8056555 - DNA, 22 bp, Homo sapiens
gtggctgctggtactctgggaa

SEQ ID NO: 8056556 - DNA, 22 bp, Homo sapiens
gtggctgctgtcctctctggtt

SEQ ID NO: 8056557 - DNA, 22 bp, Homo sapiens
gtggctgctaagtctccttcct

SEQ ID NO: 8056558 - DNA, 19 bp, Homo sapiens
gtggctgccgatcgcggct

SEQ ID NO: 8056559 - DNA, 22 bp, Homo sapiens
gtggctgctcgggctccggccc

SEQ ID NO: 8056560 - DNA, 22 bp, Homo sapiens
gtggctgggctccgagcggctt

SEQ ID NO: 8056561 - DNA, 21 bp, Homo sapiens
gtggccctggtgtggctgcac

SEQ ID NO: 8056562 - DNA, 22 bp, Homo sapiens
gtggcctggaaaggctggtctg

SEQ ID NO: 8056563 - DNA, 19 bp, Homo sapiens
gtggcctgcgctgggtgcg

SEQ ID NO: 8056564 - DNA, 19 bp, Homo sapiens
gtggcctgcgctgggtgcg

SEQ ID NO: 8056565 - DNA, 21 bp, Homo sapiens
gtggcctgattatgaatgggt

SEQ ID NO: 8056566 - DNA, 22 bp, Homo sapiens
gtggcctgcaggcaccttgggg

SEQ ID NO: 8056567 - DNA, 22 bp, Homo sapiens
gtggcctgccagcagatggcgc

SEQ ID NO: 8056568 - DNA, 17 bp, Homo sapiens
gtggctgcacacacatg

SEQ ID NO: 8056569 - DNA, 22 bp, Homo sapiens
gtggctgcagagccagcaagct

SEQ ID NO: 8056570 - DNA, 22 bp, Homo sapiens
gtggctgcagagggcacagcat

SEQ ID NO: 8056571 - DNA, 22 bp, Homo sapiens
gtggcctggcgagctggcgcgg

SEQ ID NO: 8056572 - DNA, 22 bp, Homo sapiens
gtggcctggggtttgttctgag

SEQ ID NO: 8056573 - DNA, 22 bp, Homo sapiens
gtggctccttttcaggaggctg

SEQ ID NO: 8056574 - DNA, 22 bp, Homo sapiens
gtggctctaggtgagcatggag

SEQ ID NO: 8056575 - DNA, 18 bp, Homo sapiens
gtggatgcattgggaggg

SEQ ID NO: 8056576 - DNA, 22 bp, Homo sapiens
gtggatgcttaggcagcctggg

SEQ ID NO: 8056577 - DNA, 22 bp, Homo sapiens
gtggagggtttgcaatgtgcag

SEQ ID NO: 8056578 - DNA, 18 bp, Homo sapiens
gtggagggttctcagaat

SEQ ID NO: 8056579 - DNA, 22 bp, Homo sapiens
gtggagggtgattgccggctgt

SEQ ID NO: 8056580 - DNA, 22 bp, Homo sapiens
gtggacagcttctaggtgccag

SEQ ID NO: 8056581 - DNA, 22 bp, Homo sapiens
gtggcagcggtgtgcaaggagg

SEQ ID NO: 8056582 - DNA, 22 bp, Homo sapiens
gtggcagcggtgtgcaaggagg

SEQ ID NO: 8056583 - DNA, 22 bp, Homo sapiens
gtggcagccgcaggccctgtgt

SEQ ID NO: 8056584 - DNA, 22 bp, Homo sapiens
gtggcagccgcaggccctgtgt

SEQ ID NO: 8056585 - DNA, 22 bp, Homo sapiens
gtggcagcggcccaggccgtct

SEQ ID NO: 8056586 - DNA, 22 bp, Homo sapiens
gtggcagcagaggggtggtatg

SEQ ID NO: 8056587 - DNA, 22 bp, Homo sapiens
gtggcagcaaatgcctggacta

SEQ ID NO: 8056588 - DNA, 22 bp, Homo sapiens
gtggcagcaaaatcctgcattc

SEQ ID NO: 8056589 - DNA, 22 bp, Homo sapiens
gtggcagcaaaatcctgcattc

SEQ ID NO: 8056590 - DNA, 22 bp, Homo sapiens
gtggcagattgctcaccatggt

SEQ ID NO: 8056591 - DNA, 22 bp, Homo sapiens
gtggcagagttgctgactagaa

SEQ ID NO: 8056592 - DNA, 22 bp, Homo sapiens
gtggcagaggctctgggaccag

SEQ ID NO: 8056593 - DNA, 22 bp, Homo sapiens
gtggcagagggtgagctggact

SEQ ID NO: 8056594 - DNA, 22 bp, Homo sapiens
gtggcacagagatggggcatga

SEQ ID NO: 8056595 - DNA, 22 bp, Homo sapiens
gtggcacaaggcttacacagca

SEQ ID NO: 8056596 - DNA, 22 bp, Homo sapiens
gtggcacacaggagagagctca

SEQ ID NO: 8056597 - DNA, 22 bp, Homo sapiens
gtggcacagtgggagagcccca

SEQ ID NO: 8056598 - DNA, 22 bp, Homo sapiens
gtggaagcaaccctggcaggag

SEQ ID NO: 8056599 - DNA, 22 bp, Homo sapiens
gtgcctggcagggtcagctgct

SEQ ID NO: 8056600 - DNA, 22 bp, Homo sapiens
gtgcctggcatgcgccggtgct

SEQ ID NO: 8056601 - DNA, 22 bp, Homo sapiens
gtgcctggcacacagaaggcaa

SEQ ID NO: 8056602 - DNA, 20 bp, Homo sapiens
gtgcctggagaagaggctgt

SEQ ID NO: 8056603 - DNA, 22 bp, Homo sapiens
gtgccttccccggtggtctgtt

SEQ ID NO: 8056604 - DNA, 22 bp, Homo sapiens
gtgcctgctgcagctgagcagt

SEQ ID NO: 8056605 - DNA, 22 bp, Homo sapiens
gtgcctgctgcagagtcgctgt

SEQ ID NO: 8056606 - DNA, 22 bp, Homo sapiens
gtgcctgagccagctgcagctc

SEQ ID NO: 8056607 - DNA, 22 bp, Homo sapiens
gtgcctggaatgcgcctcggcg

SEQ ID NO: 8056608 - DNA, 22 bp, Homo sapiens
gtgcctggaactgggtaggctg

SEQ ID NO: 8056609 - DNA, 22 bp, Homo sapiens
gtgcctggaactgggtaggctg

SEQ ID NO: 8056610 - DNA, 22 bp, Homo sapiens
gtctggggtactttcatctgat

SEQ ID NO: 8056611 - DNA, 22 bp, Homo sapiens
gtgacaggccactgcggctctg

SEQ ID NO: 8056612 - DNA, 22 bp, Homo sapiens
gtgacagggggcttggtttcta

SEQ ID NO: 8056613 - DNA, 22 bp, Homo sapiens
gtatgtctatttcaaatagctg

SEQ ID NO: 8056614 - DNA, 22 bp, Homo sapiens
gtatgtgaggttggtttccagg

SEQ ID NO: 8056615 - DNA, 22 bp, Homo sapiens
gtcagctgcagtgggcacagcc

SEQ ID NO: 8056616 - DNA, 21 bp, Homo sapiens
gtcaggcccatagcagtgcct

SEQ ID NO: 8056617 - DNA, 22 bp, Homo sapiens
gtcccaggtgggctccacctct

SEQ ID NO: 8056618 - DNA, 22 bp, Homo sapiens
gtcccagggatgcagacatgag

SEQ ID NO: 8056619 - DNA, 22 bp, Homo sapiens
gtctgaaaatgccctacgattg

SEQ ID NO: 8056620 - DNA, 22 bp, Homo sapiens
gtctgaaaatatgattttgcct

SEQ ID NO: 8056621 - DNA, 22 bp, Homo sapiens
gtctgaaacgcattgttatcga

SEQ ID NO: 8056622 - DNA, 22 bp, Homo sapiens
gtctgaaagtagggctgatcta

SEQ ID NO: 8056623 - DNA, 22 bp, Homo sapiens
gtctgaaatggaggtgggaact

SEQ ID NO: 8056624 - DNA, 22 bp, Homo sapiens
gtctggggcagcaaggcgcgcg

SEQ ID NO: 8056625 - DNA, 22 bp, Homo sapiens
gtctgggggtccgggtgcctgc

SEQ ID NO: 8056626 - DNA, 22 bp, Homo sapiens
gtctggggaagtcagggcatca

SEQ ID NO: 8056627 - DNA, 22 bp, Homo sapiens
gtctgggcatcagactgcgggc

SEQ ID NO: 8056628 - DNA, 22 bp, Homo sapiens
ggtggcagttacaggggcaaat

SEQ ID NO: 8056629 - DNA, 22 bp, Homo sapiens
ggtggccaggccagctctggcc

SEQ ID NO: 8056630 - DNA, 22 bp, Homo sapiens
ggtggccaggccagctctggcc

SEQ ID NO: 8056631 - DNA, 23 bp, Homo sapiens
ggtggcaggagtggatgctgagc

SEQ ID NO: 8056632 - DNA, 23 bp, Homo sapiens
ggtggcaggagtggatgctgagc

SEQ ID NO: 8056633 - DNA, 22 bp, Homo sapiens
ggtggcaggctggcattggcaa

SEQ ID NO: 8056634 - DNA, 22 bp, Homo sapiens
ggtggcaggctggcattggcaa

SEQ ID NO: 8056635 - DNA, 22 bp, Homo sapiens
ggtggcaggccctgagcatccc

SEQ ID NO: 8056636 - DNA, 22 bp, Homo sapiens
ggtggcaggccctgagcatccc

SEQ ID NO: 8056637 - DNA, 22 bp, Homo sapiens
ggtgtagctctgtgtcccactg

SEQ ID NO: 8056638 - DNA, 20 bp, Homo sapiens
ggtgtcagggccatgcctgg

SEQ ID NO: 8056639 - DNA, 19 bp, Homo sapiens
ggtgtcaggcctctctcct

SEQ ID NO: 8056640 - DNA, 22 bp, Homo sapiens
ggtgtcctacagggccgcaggc

SEQ ID NO: 8056641 - DNA, 22 bp, Homo sapiens
ggtgtcctactgcttggttgct

SEQ ID NO: 8056642 - DNA, 19 bp, Homo sapiens
ggtgtcctagagataagag

SEQ ID NO: 8056643 - DNA, 22 bp, Homo sapiens
ggtggcagagaggaggtagttt

SEQ ID NO: 8056644 - DNA, 22 bp, Homo sapiens
ggtggcagaggtgcatcagccc

SEQ ID NO: 8056645 - DNA, 22 bp, Homo sapiens
ggtgcaggagcggggtgctcgg

SEQ ID NO: 8056646 - DNA, 22 bp, Homo sapiens
ggtgcaggagcggggtgctcgg

SEQ ID NO: 8056647 - DNA, 22 bp, Homo sapiens
ggtgcaggcggtggggcaagta

SEQ ID NO: 8056648 - DNA, 22 bp, Homo sapiens
ggtgcaaaaatctatcaccagc

SEQ ID NO: 8056649 - DNA, 22 bp, Homo sapiens
ggtgcaggagcggggtgctcgg

SEQ ID NO: 8056650 - DNA, 22 bp, Homo sapiens
ggtgaggggctcctctgcccgg

SEQ ID NO: 8056651 - DNA, 22 bp, Homo sapiens
ggtgaggggcgcctctgcccag

SEQ ID NO: 8056652 - DNA, 22 bp, Homo sapiens
ggtgaggggcgcctctgcccgg

SEQ ID NO: 8056653 - DNA, 22 bp, Homo sapiens
ggtgaggggagagtgaaagaaa

SEQ ID NO: 8056654 - DNA, 22 bp, Homo sapiens
ggtgaggggcacctctgcccgg

SEQ ID NO: 8056655 - DNA, 22 bp, Homo sapiens
gggtggggcccaggaaatctat

SEQ ID NO: 8056656 - DNA, 22 bp, Homo sapiens
gggtggggccaggcaatttgca

SEQ ID NO: 8056657 - DNA, 22 bp, Homo sapiens
gggtggggcccaggaaatctat

SEQ ID NO: 8056658 - DNA, 22 bp, Homo sapiens
gggtggggtgtatcggatccta

SEQ ID NO: 8056659 - DNA, 22 bp, Homo sapiens
gggtggggttcaggaatcttca

SEQ ID NO: 8056660 - DNA, 21 bp, Homo sapiens
gggtggggttccagccttttc

SEQ ID NO: 8056661 - DNA, 21 bp, Homo sapiens
gtatggcattgattagttact

SEQ ID NO: 8056662 - DNA, 22 bp, Homo sapiens
gtatggcactatcctctctgat

SEQ ID NO: 8056663 - DNA, 21 bp, Homo sapiens
gtatatcagcagtgaattcaa

SEQ ID NO: 8056664 - DNA, 22 bp, Homo sapiens
gtatagaaacccagaaagatag

SEQ ID NO: 8056665 - DNA, 22 bp, Homo sapiens
gtacataagaaattactacaga

SEQ ID NO: 8056666 - DNA, 22 bp, Homo sapiens
gtacagtacttcagaaccagcc

SEQ ID NO: 8056667 - DNA, 22 bp, Homo sapiens
ggtgtcctcatgattttctaga

SEQ ID NO: 8056668 - DNA, 22 bp, Homo sapiens
ggtgtcctcactatagcaagtc

SEQ ID NO: 8056669 - DNA, 21 bp, Homo sapiens
ggtgtcctgagggataggtag

SEQ ID NO: 8056670 - DNA, 22 bp, Homo sapiens
ggtgtcctcggattcagggcag

SEQ ID NO: 8056671 - DNA, 22 bp, Homo sapiens
ggtgtcctgtcagctagagtga

SEQ ID NO: 8056672 - DNA, 22 bp, Homo sapiens
ggtgtcctgggcaggcagctga

SEQ ID NO: 8056673 - DNA, 22 bp, Homo sapiens
gtacagattaataatatactga

SEQ ID NO: 8056674 - DNA, 22 bp, Homo sapiens
gtacacacaatctctggtcagt

SEQ ID NO: 8056675 - DNA, 21 bp, Homo sapiens
gtacacacaggtggatgggct

SEQ ID NO: 8056676 - DNA, 22 bp, Homo sapiens
gttctgagtcctcctttgaagg

SEQ ID NO: 8056677 - DNA, 22 bp, Homo sapiens
gttgttttaaaatactccagaa

SEQ ID NO: 8056678 - DNA, 22 bp, Homo sapiens
gttgttttattgtgagtcccat

SEQ ID NO: 8056679 - DNA, 22 bp, Homo sapiens
gttgttttataggctcatgcct

SEQ ID NO: 8056680 - DNA, 22 bp, Homo sapiens
gttgttttcacaaacccatgat

SEQ ID NO: 8056681 - DNA, 22 bp, Homo sapiens
gttgttttataattgattgcaa

SEQ ID NO: 8056682 - DNA, 22 bp, Homo sapiens
gttgtgtttttctgctggaagc

SEQ ID NO: 8056683 - DNA, 22 bp, Homo sapiens
gtgtgtccaaggcacggatgac

SEQ ID NO: 8056684 - DNA, 22 bp, Homo sapiens
gtgtgtccaaggccacaatagc

SEQ ID NO: 8056685 - DNA, 22 bp, Homo sapiens
gtgtgtccacacatacatacat

SEQ ID NO: 8056686 - DNA, 23 bp, Homo sapiens
gtgtgtccattcgcactcttagg

SEQ ID NO: 8056687 - DNA, 22 bp, Homo sapiens
gtgtgtccaggcgggagtcaag

SEQ ID NO: 8056688 - DNA, 22 bp, Homo sapiens
gtgtgtccctacaacagcttca

SEQ ID NO: 8056689 - DNA, 22 bp, Homo sapiens
gtgtgtccctcctctcctgagt

SEQ ID NO: 8056690 - DNA, 22 bp, Homo sapiens
gtgtgtcccttggaacctcagc

SEQ ID NO: 8056691 - DNA, 22 bp, Homo sapiens
gtgtgtcctcagtagtggcatg

SEQ ID NO: 8056692 - DNA, 21 bp, Homo sapiens
gttattttaagtgagctttgc

SEQ ID NO: 8056693 - DNA, 22 bp, Homo sapiens
gttcaagaccagcctggccaac

SEQ ID NO: 8056694 - DNA, 22 bp, Homo sapiens
gtgtcctcttattgctcttggc

SEQ ID NO: 8056695 - DNA, 22 bp, Homo sapiens
gtgtccttatgcataccagagt

SEQ ID NO: 8056696 - DNA, 22 bp, Homo sapiens
gtgtgggctgcagaggcacagc

SEQ ID NO: 8056697 - DNA, 22 bp, Homo sapiens
gtgtgggctatgtgcgtgggca

SEQ ID NO: 8056698 - DNA, 22 bp, Homo sapiens
gtgtgcagggatgagtgcaggt

SEQ ID NO: 8056699 - DNA, 22 bp, Homo sapiens
gtgtgcaggtgtcagtgcagct

SEQ ID NO: 8056700 - DNA, 22 bp, Homo sapiens
gtgtgcagggggccagcgcagc

SEQ ID NO: 8056701 - DNA, 22 bp, Homo sapiens
gtgtgcagaacagggagtgggt

SEQ ID NO: 8056702 - DNA, 22 bp, Homo sapiens
gtggtgcaggaagcatctggct

SEQ ID NO: 8056703 - DNA, 22 bp, Homo sapiens
gtgggtggacggtgcttttgtt

SEQ ID NO: 8056704 - DNA, 22 bp, Homo sapiens
gtgggtgcggggagccgaggcg

SEQ ID NO: 8056705 - DNA, 22 bp, Homo sapiens
gtggtatctgtctcccccactg

SEQ ID NO: 8056706 - DNA, 22 bp, Homo sapiens
gtggtcaaagcatcagagacct

SEQ ID NO: 8056707 - DNA, 22 bp, Homo sapiens
gtggtcagaatggagcccagga

SEQ ID NO: 8056708 - DNA, 22 bp, Homo sapiens
gtggtcaggttatcagatcata

SEQ ID NO: 8056709 - DNA, 22 bp, Homo sapiens
gtggggtgtccagcagcgagct

SEQ ID NO: 8056710 - DNA, 22 bp, Homo sapiens
gtggggtgtccagcagcgagct

SEQ ID NO: 8056711 - DNA, 22 bp, Homo sapiens
gtggggtagatctttctcagga

SEQ ID NO: 8056712 - DNA, 22 bp, Homo sapiens
gtgggctggatttgcttgcaga

SEQ ID NO: 8056713 - DNA, 22 bp, Homo sapiens
gtgggctgcccttgaggtcagc

SEQ ID NO: 8056714 - DNA, 22 bp, Homo sapiens
gtgggccttgcagggtgcaggg

SEQ ID NO: 8056715 - DNA, 22 bp, Homo sapiens
gtgggcctgatgctgccatgag

SEQ ID NO: 8056716 - DNA, 22 bp, Homo sapiens
gtgggccagttcctcacaggta

SEQ ID NO: 8056717 - DNA, 22 bp, Homo sapiens
gtgggctcccctggcatgtcca

SEQ ID NO: 8056718 - DNA, 22 bp, Homo sapiens
gtggggaggcctaagcaagttg

SEQ ID NO: 8056719 - DNA, 22 bp, Homo sapiens
gtgggggcaggcagtgctagga

SEQ ID NO: 8056720 - DNA, 22 bp, Homo sapiens
gtgggccaggccggagtgcaga

SEQ ID NO: 8056721 - DNA, 19 bp, Homo sapiens
gtgggccaggcagaaggct

SEQ ID NO: 8056722 - DNA, 22 bp, Homo sapiens
gtgggccaggcgtctaggccct

SEQ ID NO: 8056723 - DNA, 22 bp, Homo sapiens
gtgggccaggacccgctgtccg

SEQ ID NO: 8056724 - DNA, 22 bp, Homo sapiens
gtgggccagcattttgaagagt

SEQ ID NO: 8056725 - DNA, 22 bp, Homo sapiens
gtgggccagcttttctcctggg

SEQ ID NO: 8056726 - DNA, 22 bp, Homo sapiens
gtgggcatctccttggaagcca

SEQ ID NO: 8056727 - DNA, 22 bp, Homo sapiens
gtgggccactgggaggcaaggg

SEQ ID NO: 8056728 - DNA, 22 bp, Homo sapiens
gtgggccacatcccagggctct

SEQ ID NO: 8056729 - DNA, 22 bp, Homo sapiens
gtgggcagtggtttgcgcggtc

SEQ ID NO: 8056730 - DNA, 22 bp, Homo sapiens
gtgggcagttcaattctgggag

SEQ ID NO: 8056731 - DNA, 22 bp, Homo sapiens
gtgggcagttcaattctgggag

SEQ ID NO: 8056732 - DNA, 22 bp, Homo sapiens
gtgggcaggaggccctgccctg

SEQ ID NO: 8056733 - DNA, 22 bp, Homo sapiens
gtgggcaggaggccctgccctg

SEQ ID NO: 8056734 - DNA, 22 bp, Homo sapiens
gtgggcagccccttcaaggcca

SEQ ID NO: 8056735 - DNA, 20 bp, Homo sapiens
gtgggcagcaggcatactgg

SEQ ID NO: 8056736 - DNA, 22 bp, Homo sapiens
gtgggcagccccttcaaggcca

SEQ ID NO: 8056737 - DNA, 20 bp, Homo sapiens
gtgggcagcaggcatactgg

SEQ ID NO: 8056738 - DNA, 22 bp, Homo sapiens
gtgggcagacagtgctttgcag

SEQ ID NO: 8056739 - DNA, 22 bp, Homo sapiens
gtgggcagaacatttgtaggct

SEQ ID NO: 8056740 - DNA, 22 bp, Homo sapiens
gtgggcagaacatttgtaggct

SEQ ID NO: 8056741 - DNA, 22 bp, Homo sapiens
gtgggcagagcaagggaactca

SEQ ID NO: 8056742 - DNA, 22 bp, Homo sapiens
taaagcaggccacatatgtgat

SEQ ID NO: 8056743 - DNA, 22 bp, Homo sapiens
taaaggaggagttaatgagact

SEQ ID NO: 8056744 - DNA, 22 bp, Homo sapiens
taaaggagtgtgatgaaaggga

SEQ ID NO: 8056745 - DNA, 22 bp, Homo sapiens
gttgttttgctgtctgtcttag

SEQ ID NO: 8056746 - DNA, 22 bp, Homo sapiens
gttgtttttgaacggtggtggc

SEQ ID NO: 8056747 - DNA, 22 bp, Homo sapiens
gttgttttgcaggatccttaca

SEQ ID NO: 8056748 - DNA, 22 bp, Homo sapiens
gttgttttcagcagtttatgac

SEQ ID NO: 8056749 - DNA, 19 bp, Homo sapiens
gttgtttttcttattatgg

SEQ ID NO: 8056750 - DNA, 22 bp, Homo sapiens
gttgtttttgttctctatagct

SEQ ID NO: 8056751 - DNA, 22 bp, Homo sapiens
gtttttctaagtagcgatattt

SEQ ID NO: 8056752 - DNA, 22 bp, Homo sapiens
gtttttctagaaatctcctcct

SEQ ID NO: 8056753 - DNA, 22 bp, Homo sapiens
ggagaaggaatattggagtagg

SEQ ID NO: 8056754 - DNA, 19 bp, Homo sapiens
ggagaagcccaggaatcct

SEQ ID NO: 8056755 - DNA, 22 bp, Homo sapiens
ggagagggggctccctgcttgg

SEQ ID NO: 8056756 - DNA, 22 bp, Homo sapiens
ggagagggtaggggtcctgccc

SEQ ID NO: 8056757 - DNA, 22 bp, Homo sapiens
ggagagggtaggggtcctgccc

SEQ ID NO: 8056758 - DNA, 22 bp, Homo sapiens
ggagagggtgtggaaagttatc

SEQ ID NO: 8056759 - DNA, 22 bp, Homo sapiens
ggagcctgtgcccaagcccaga

SEQ ID NO: 8056760 - DNA, 22 bp, Homo sapiens
ggagcctggttactagagcctg

SEQ ID NO: 8056761 - DNA, 22 bp, Homo sapiens
ggagcctgtggccgtcacgact

SEQ ID NO: 8056762 - DNA, 22 bp, Homo sapiens
ggagcctgttagttgagtgctc

SEQ ID NO: 8056763 - DNA, 22 bp, Homo sapiens
ggagcctgtgggatgagatgtg

SEQ ID NO: 8056764 - DNA, 22 bp, Homo sapiens
ggagcctgtgggatgagatgtg

SEQ ID NO: 8056765 - DNA, 22 bp, Homo sapiens
ggagcgtgcactccaggccctt

SEQ ID NO: 8056766 - DNA, 22 bp, Homo sapiens
ggaggacactggctctgccttc

SEQ ID NO: 8056767 - DNA, 22 bp, Homo sapiens
ggaggacactggctctgccttc

SEQ ID NO: 8056768 - DNA, 22 bp, Homo sapiens
ggaggagcatgagagggtagtg

SEQ ID NO: 8056769 - DNA, 22 bp, Homo sapiens
ggaggagcatgagagggtagtg

SEQ ID NO: 8056770 - DNA, 22 bp, Homo sapiens
ggagctgagacccagtggctga

SEQ ID NO: 8056771 - DNA, 22 bp, Homo sapiens
ggagctgaggctgaggcctcac

SEQ ID NO: 8056772 - DNA, 22 bp, Homo sapiens
ggaggccatctggctggaggct

SEQ ID NO: 8056773 - DNA, 22 bp, Homo sapiens
ggaggccagtcctggccgggct

SEQ ID NO: 8056774 - DNA, 22 bp, Homo sapiens
ggaggccaccatggagtcactt

SEQ ID NO: 8056775 - DNA, 22 bp, Homo sapiens
ggaggaggcggcagaagttcct

SEQ ID NO: 8056776 - DNA, 22 bp, Homo sapiens
ggaggagctgctgtgggggccc

SEQ ID NO: 8056777 - DNA, 22 bp, Homo sapiens
ggaaagatgtaatattatctaa

SEQ ID NO: 8056778 - DNA, 22 bp, Homo sapiens
ggaaaacaagagaatgatgttt

SEQ ID NO: 8056779 - DNA, 22 bp, Homo sapiens
ggaaaccattcccgactctcct

SEQ ID NO: 8056780 - DNA, 19 bp, Homo sapiens
ggaaacaggggccagagga

SEQ ID NO: 8056781 - DNA, 22 bp, Homo sapiens
ggaaggggtgggtgagcctcag

SEQ ID NO: 8056782 - DNA, 22 bp, Homo sapiens
ggaaggggtgtcgcccatggat

SEQ ID NO: 8056783 - DNA, 22 bp, Homo sapiens
gctgggctccaggccagggtga

SEQ ID NO: 8056784 - DNA, 22 bp, Homo sapiens
gctgggctccaccctcaactgt

SEQ ID NO: 8056785 - DNA, 22 bp, Homo sapiens
gctgggccagagcagcagcact

SEQ ID NO: 8056786 - DNA, 21 bp, Homo sapiens
gctgggctccagtctgccgct

SEQ ID NO: 8056787 - DNA, 22 bp, Homo sapiens
gctgggctcgttcccacacgcg

SEQ ID NO: 8056788 - DNA, 22 bp, Homo sapiens
gctgggctctgtcatgccttcc

SEQ ID NO: 8056789 - DNA, 22 bp, Homo sapiens
gctgggctgcccaacctctgac

SEQ ID NO: 8056790 - DNA, 22 bp, Homo sapiens
gctgggctggaaggccaaggca

SEQ ID NO: 8056791 - DNA, 23 bp, Homo sapiens
gcttctgccatttgctagctgtg

SEQ ID NO: 8056792 - DNA, 22 bp, Homo sapiens
gcttcctgtatcctcctgtacc

SEQ ID NO: 8056793 - DNA, 22 bp, Homo sapiens
gcttcagacctgaaaggaaaaa

SEQ ID NO: 8056794 - DNA, 22 bp, Homo sapiens
gcttcattaatagaattagtat

SEQ ID NO: 8056795 - DNA, 22 bp, Homo sapiens
gcttcctgggacaggctatgtg

SEQ ID NO: 8056796 - DNA, 22 bp, Homo sapiens
gcttcatttctctctgtagacc

SEQ ID NO: 8056797 - DNA, 22 bp, Homo sapiens
gcttcatttgagaacctctgtg

SEQ ID NO: 8056798 - DNA, 22 bp, Homo sapiens
gcttcattactgacagtctgtg

SEQ ID NO: 8056799 - DNA, 22 bp, Homo sapiens
ggagggcagagtcccctgctga

SEQ ID NO: 8056800 - DNA, 22 bp, Homo sapiens
ggagggcccctccagtgggcag

SEQ ID NO: 8056801 - DNA, 22 bp, Homo sapiens
ggagggccctgggtgcagctct

SEQ ID NO: 8056802 - DNA, 22 bp, Homo sapiens
ggagggctgagactggggtctg

SEQ ID NO: 8056803 - DNA, 22 bp, Homo sapiens
ggagggctcgtcatccaccact

SEQ ID NO: 8056804 - DNA, 22 bp, Homo sapiens
ggagggctgagactggggtctg

SEQ ID NO: 8056805 - DNA, 22 bp, Homo sapiens
ggagggctcaattgactcctga

SEQ ID NO: 8056806 - DNA, 22 bp, Homo sapiens
ggagggccctgggtgcagctct

SEQ ID NO: 8056807 - DNA, 22 bp, Homo sapiens
ggagggctccctgggagtggat

SEQ ID NO: 8056808 - DNA, 22 bp, Homo sapiens
ggagggctccctgggagtggat

SEQ ID NO: 8056809 - DNA, 22 bp, Homo sapiens
ggagggctccctgggagtggat

SEQ ID NO: 8056810 - DNA, 22 bp, Homo sapiens
ggagggctgccaggtggagcgg

SEQ ID NO: 8056811 - DNA, 22 bp, Homo sapiens
ggagggctgccaggtggagcgg

SEQ ID NO: 8056812 - DNA, 22 bp, Homo sapiens
ggagggctgtagaggagacctg

SEQ ID NO: 8056813 - DNA, 22 bp, Homo sapiens
ggagggctgtagaggagacctg

SEQ ID NO: 8056814 - DNA, 22 bp, Homo sapiens
ggaggggaactaatcccgtgac

SEQ ID NO: 8056815 - DNA, 22 bp, Homo sapiens
ggaggggaactaatcccgtgac

SEQ ID NO: 8056816 - DNA, 18 bp, Homo sapiens
ggagggctttggggactg

SEQ ID NO: 8056817 - DNA, 18 bp, Homo sapiens
ggagggctttggggactg

SEQ ID NO: 8056818 - DNA, 19 bp, Homo sapiens
ggaggcttcttggggtcgg

SEQ ID NO: 8056819 - DNA, 22 bp, Homo sapiens
ggaggctgctgcctcacgtggg

SEQ ID NO: 8056820 - DNA, 22 bp, Homo sapiens
ggaggctgctgcctcacgtggg

SEQ ID NO: 8056821 - DNA, 22 bp, Homo sapiens
ggaggctgaggcccctcacagg

SEQ ID NO: 8056822 - DNA, 22 bp, Homo sapiens
ggaggctgaggcaggcggatca

SEQ ID NO: 8056823 - DNA, 22 bp, Homo sapiens
ggaggcggaggttgcagtgagt

SEQ ID NO: 8056824 - DNA, 22 bp, Homo sapiens
ggaggcggaggttgcagtgagt

SEQ ID NO: 8056825 - DNA, 22 bp, Homo sapiens
ggaggcggaggttgcagtgagc

SEQ ID NO: 8056826 - DNA, 22 bp, Homo sapiens
ggaggcggaggttgcagtgagc

SEQ ID NO: 8056827 - DNA, 22 bp, Homo sapiens
ggaggccttgaggccaggagct

SEQ ID NO: 8056828 - DNA, 22 bp, Homo sapiens
ggaggccttgaggccaggagct

SEQ ID NO: 8056829 - DNA, 22 bp, Homo sapiens
ggaggcctcctgggggaggttc

SEQ ID NO: 8056830 - DNA, 22 bp, Homo sapiens
ggaggcctaaggtacagtttgc

SEQ ID NO: 8056831 - DNA, 22 bp, Homo sapiens
ggaggcctagccagctccagtt

SEQ ID NO: 8056832 - DNA, 22 bp, Homo sapiens
ggaggggtggtcacctggcagg

SEQ ID NO: 8056833 - DNA, 22 bp, Homo sapiens
ggaggggtgagaatggctgcct

SEQ ID NO: 8056834 - DNA, 22 bp, Homo sapiens
ggaggggtgctcagctgtcacg

SEQ ID NO: 8056835 - DNA, 22 bp, Homo sapiens
ggagggggactgacactgattt

SEQ ID NO: 8056836 - DNA, 22 bp, Homo sapiens
ggagggggactgacactgattt

SEQ ID NO: 8056837 - DNA, 22 bp, Homo sapiens
ggaggggagatgtttgggctca

SEQ ID NO: 8056838 - DNA, 22 bp, Homo sapiens
ggaggggagatgtttgggctca

SEQ ID NO: 8056839 - DNA, 22 bp, Homo sapiens
ggaggggaggattaatgacaaa

SEQ ID NO: 8056840 - DNA, 22 bp, Homo sapiens
ggaggggaggattaatgacaaa

SEQ ID NO: 8056841 - DNA, 22 bp, Homo sapiens
ggaggggagtctcccaaagccg

SEQ ID NO: 8056842 - DNA, 22 bp, Homo sapiens
ggaggggagtctcccaaagccg

SEQ ID NO: 8056843 - DNA, 22 bp, Homo sapiens
ggaggggaggtccagctgatct

SEQ ID NO: 8056844 - DNA, 22 bp, Homo sapiens
ggaggggaggtccagctgatct

SEQ ID NO: 8056845 - DNA, 22 bp, Homo sapiens
ggagggggaaactttggctgcc

SEQ ID NO: 8056846 - DNA, 22 bp, Homo sapiens
ggagggggaaactttggctgcc

SEQ ID NO: 8056847 - DNA, 22 bp, Homo sapiens
ggagggggaaactttggctgcc

SEQ ID NO: 8056848 - DNA, 22 bp, Homo sapiens
ggagggggaagaagctaaagac

SEQ ID NO: 8056849 - DNA, 22 bp, Homo sapiens
ggagggggaagaagctaaagac

SEQ ID NO: 8056850 - DNA, 22 bp, Homo sapiens
ggagggggaagaagctaaagac

SEQ ID NO: 8056851 - DNA, 22 bp, Homo sapiens
ggagggggaattcagccccagc

SEQ ID NO: 8056852 - DNA, 22 bp, Homo sapiens
ggagggggaattcagccccagc

SEQ ID NO: 8056853 - DNA, 22 bp, Homo sapiens
ggagggggaattcagccccagc

SEQ ID NO: 8056854 - DNA, 22 bp, Homo sapiens
ggaggtgggctaaggactctct

SEQ ID NO: 8056855 - DNA, 22 bp, Homo sapiens
ggaggtggaggttgcagtgagc

SEQ ID NO: 8056856 - DNA, 22 bp, Homo sapiens
ggagggttagcaaaggcacaga

SEQ ID NO: 8056857 - DNA, 22 bp, Homo sapiens
ggagggttagcaaaggcacaga

SEQ ID NO: 8056858 - DNA, 22 bp, Homo sapiens
ggagtggctgtttctgccccca

SEQ ID NO: 8056859 - DNA, 22 bp, Homo sapiens
ggagtggctatttgtgctggtt

SEQ ID NO: 8056860 - DNA, 22 bp, Homo sapiens
ggagtgggaacaatgacatggt

SEQ ID NO: 8056861 - DNA, 22 bp, Homo sapiens
ggagtgggaacaatgacatggt

SEQ ID NO: 8056862 - DNA, 22 bp, Homo sapiens
ggagtgggcagcactgccctgt

SEQ ID NO: 8056863 - DNA, 22 bp, Homo sapiens
ggagtggcaggccacagtgctg

SEQ ID NO: 8056864 - DNA, 22 bp, Homo sapiens
ggagtggcaggccacagtgctg

SEQ ID NO: 8056865 - DNA, 22 bp, Homo sapiens
ggagtggccacgactgggagat

SEQ ID NO: 8056866 - DNA, 22 bp, Homo sapiens
ggagtggcctctcctgtgcagg

SEQ ID NO: 8056867 - DNA, 22 bp, Homo sapiens
ggcacacagcttggcaggagat

SEQ ID NO: 8056868 - DNA, 22 bp, Homo sapiens
ggcaaggcctgcagctcagtgt

SEQ ID NO: 8056869 - DNA, 22 bp, Homo sapiens
ggcagagcttgttccttctgtt

SEQ ID NO: 8056870 - DNA, 22 bp, Homo sapiens
ggcagaggaagctggaagtggg

SEQ ID NO: 8056871 - DNA, 22 bp, Homo sapiens
ggcagagagttctccacctctc

SEQ ID NO: 8056872 - DNA, 23 bp, Homo sapiens
ggcagagagcatggctggggccc

SEQ ID NO: 8056873 - DNA, 20 bp, Homo sapiens
ggcagacctgctgagagccc

SEQ ID NO: 8056874 - DNA, 22 bp, Homo sapiens
ggcagacactcaaaagctggga

SEQ ID NO: 8056875 - DNA, 22 bp, Homo sapiens
ggcagacctctccagccccaca

SEQ ID NO: 8056876 - DNA, 22 bp, Homo sapiens
ggcacagagctccagccttggc

SEQ ID NO: 8056877 - DNA, 22 bp, Homo sapiens
ggcacagagctttgtcccagtt

SEQ ID NO: 8056878 - DNA, 22 bp, Homo sapiens
ggcacagagttggcagagctgc

SEQ ID NO: 8056879 - DNA, 23 bp, Homo sapiens
ggcacagatgctgagcatgtgca

SEQ ID NO: 8056880 - DNA, 22 bp, Homo sapiens
ggcacagcactgtaggcctggg

SEQ ID NO: 8056881 - DNA, 22 bp, Homo sapiens
ggcacagcactgtaggcctggg

SEQ ID NO: 8056882 - DNA, 22 bp, Homo sapiens
ggcacagcacagtggacccagg

SEQ ID NO: 8056883 - DNA, 22 bp, Homo sapiens
ggcacagcacagtggacccagg

SEQ ID NO: 8056884 - DNA, 22 bp, Homo sapiens
ggcacagcacagagcacatgta

SEQ ID NO: 8056885 - DNA, 22 bp, Homo sapiens
ggcacagcacagagcacatgta

SEQ ID NO: 8056886 - DNA, 19 bp, Homo sapiens
ggcagctggacgctgttca

SEQ ID NO: 8056887 - DNA, 22 bp, Homo sapiens
ggcagaggaagctggaagtggg

SEQ ID NO: 8056888 - DNA, 22 bp, Homo sapiens
ggcagaggaagctggaagtggg

SEQ ID NO: 8056889 - DNA, 22 bp, Homo sapiens
ggcagctgtgaagtgcctcaca

SEQ ID NO: 8056890 - DNA, 22 bp, Homo sapiens
ggcagctggggcagtgccctgt

SEQ ID NO: 8056891 - DNA, 20 bp, Homo sapiens
ggcaggtgctcgcttggtct

SEQ ID NO: 8056892 - DNA, 22 bp, Homo sapiens
ggcaggtgctctgtgggcctgg

SEQ ID NO: 8056893 - DNA, 22 bp, Homo sapiens
ggcaggtgctcaaaaatatttg

SEQ ID NO: 8056894 - DNA, 17 bp, Homo sapiens
ggcaggtgcggggccgc

SEQ ID NO: 8056895 - DNA, 17 bp, Homo sapiens
ggcaggtgcggggccgc

SEQ ID NO: 8056896 - DNA, 22 bp, Homo sapiens
ggcaggtgctaagagaggtaaa

SEQ ID NO: 8056897 - DNA, 22 bp, Homo sapiens
ggcaggtgaggcatgtgcctgg

SEQ ID NO: 8056898 - DNA, 22 bp, Homo sapiens
ggcaggtgaggcatgtgcctgg

SEQ ID NO: 8056899 - DNA, 22 bp, Homo sapiens
ggcaggtgagttcattatctgc

SEQ ID NO: 8056900 - DNA, 22 bp, Homo sapiens
ggcaggctgcttgggtcatgtc

SEQ ID NO: 8056901 - DNA, 22 bp, Homo sapiens
ggcaggctgcttgggtcatgtc

SEQ ID NO: 8056902 - DNA, 22 bp, Homo sapiens
ggcaggcctgagaggcagggct

SEQ ID NO: 8056903 - DNA, 22 bp, Homo sapiens
ggcaggcctgagaggcagggct

SEQ ID NO: 8056904 - DNA, 22 bp, Homo sapiens
ggcaggctcagcagccaaggag

SEQ ID NO: 8056905 - DNA, 22 bp, Homo sapiens
ggcaggcaggagcgtgcttggg

SEQ ID NO: 8056906 - DNA, 22 bp, Homo sapiens
ggctctccactatggatgagaa

SEQ ID NO: 8056907 - DNA, 19 bp, Homo sapiens
ggctcctggggctcagccc

SEQ ID NO: 8056908 - DNA, 22 bp, Homo sapiens
ggctcctggggaggtgagcttg

SEQ ID NO: 8056909 - DNA, 22 bp, Homo sapiens
ggctcctgttttaaaaggtgaa

SEQ ID NO: 8056910 - DNA, 22 bp, Homo sapiens
ggctcctgggatgggactgagc

SEQ ID NO: 8056911 - DNA, 22 bp, Homo sapiens
ggctgcagagctggtgccctgg

SEQ ID NO: 8056912 - DNA, 22 bp, Homo sapiens
ggctgcaggaacgacggagggg

SEQ ID NO: 8056913 - DNA, 22 bp, Homo sapiens
ggctgcagaggcgatctgaggt

SEQ ID NO: 8056914 - DNA, 22 bp, Homo sapiens
ggctgcaggcagaggctgtctg

SEQ ID NO: 8056915 - DNA, 22 bp, Homo sapiens
ggctgccttcagactccagctt

SEQ ID NO: 8056916 - DNA, 22 bp, Homo sapiens
ggctgccttcatagaccatggg

SEQ ID NO: 8056917 - DNA, 22 bp, Homo sapiens
ggctgcctggtttagtgctgac

SEQ ID NO: 8056918 - DNA, 22 bp, Homo sapiens
ggctggcctcagggtcctcgct

SEQ ID NO: 8056919 - DNA, 23 bp, Homo sapiens
ggctggcccggggctgctcctga

SEQ ID NO: 8056920 - DNA, 22 bp, Homo sapiens
ggctgctgaacaagggaaccct

SEQ ID NO: 8056921 - DNA, 22 bp, Homo sapiens
ggctggctacattggaggaagg

SEQ ID NO: 8056922 - DNA, 22 bp, Homo sapiens
ggctggcgggtgggtgaaagac

SEQ ID NO: 8056923 - DNA, 22 bp, Homo sapiens
ggctgctcggcagctcctgagc

SEQ ID NO: 8056924 - DNA, 19 bp, Homo sapiens
ggctgccttctgctcatct

SEQ ID NO: 8056925 - DNA, 22 bp, Homo sapiens
ggctgctctgccttccagctgg

SEQ ID NO: 8056926 - DNA, 22 bp, Homo sapiens
ggctgctctccatcccaggcct

SEQ ID NO: 8056927 - DNA, 22 bp, Homo sapiens
ggcttcagtgagctgagctcac

SEQ ID NO: 8056928 - DNA, 22 bp, Homo sapiens
ggctggctcttaccgacagcgt

SEQ ID NO: 8056929 - DNA, 22 bp, Homo sapiens
ggctgtggtggcatccctgagc

SEQ ID NO: 8056930 - DNA, 19 bp, Homo sapiens
ggctgtggtggtgccttgc

SEQ ID NO: 8056931 - DNA, 22 bp, Homo sapiens
ggctggcttgccaagctcaggg

SEQ ID NO: 8056932 - DNA, 22 bp, Homo sapiens
ggctggctggctggtagacaag

SEQ ID NO: 8056933 - DNA, 22 bp, Homo sapiens
ggctggctgtgccctgtactct

SEQ ID NO: 8056934 - DNA, 22 bp, Homo sapiens
gggaacagagtgccagactgac

SEQ ID NO: 8056935 - DNA, 22 bp, Homo sapiens
gggaacagcatatctgaagggt

SEQ ID NO: 8056936 - DNA, 22 bp, Homo sapiens
gggaacagcttgggctctgcca

SEQ ID NO: 8056937 - DNA, 22 bp, Homo sapiens
gggaccaggtcagggctctgac

SEQ ID NO: 8056938 - DNA, 22 bp, Homo sapiens
gggaagagaccgtaccctggcc

SEQ ID NO: 8056939 - DNA, 22 bp, Homo sapiens
ggctcaggcctgtaatcctagc

SEQ ID NO: 8056940 - DNA, 22 bp, Homo sapiens
ggctcaggtttccttcccagct

SEQ ID NO: 8056941 - DNA, 22 bp, Homo sapiens
ggctcatgtatgaaagggtgtg

SEQ ID NO: 8056942 - DNA, 22 bp, Homo sapiens
ggctcctgatttgagggggctg

SEQ ID NO: 8056943 - DNA, 22 bp, Homo sapiens
ggctcagcttatctgggcaggc

SEQ ID NO: 8056944 - DNA, 22 bp, Homo sapiens
ggctcagccccgtaacacagca

SEQ ID NO: 8056945 - DNA, 22 bp, Homo sapiens
ggccttgggatgtggctgcagc

SEQ ID NO: 8056946 - DNA, 18 bp, Homo sapiens
ggctcagcaggctctctc

SEQ ID NO: 8056947 - DNA, 22 bp, Homo sapiens
ggccttgggaggagggtcagaa

SEQ ID NO: 8056948 - DNA, 21 bp, Homo sapiens
ggccttggcgggggccgaatt

SEQ ID NO: 8056949 - DNA, 22 bp, Homo sapiens
ggctcaggactgcagcgtagag

SEQ ID NO: 8056950 - DNA, 22 bp, Homo sapiens
ggctcaggacctgggattgcca

SEQ ID NO: 8056951 - DNA, 22 bp, Homo sapiens
ggctcagcttggtgcgcagaaa

SEQ ID NO: 8056952 - DNA, 22 bp, Homo sapiens
ggctcaggccagaccacgactc

SEQ ID NO: 8056953 - DNA, 22 bp, Homo sapiens
ggctcaggccagaccacgactc

SEQ ID NO: 8056954 - DNA, 22 bp, Homo sapiens
ggctcaggatgagccttctcat

SEQ ID NO: 8056955 - DNA, 22 bp, Homo sapiens
ggccttggaaagatacccagct

SEQ ID NO: 8056956 - DNA, 20 bp, Homo sapiens
ggccttggaatagcacagct

SEQ ID NO: 8056957 - DNA, 22 bp, Homo sapiens
ggccttggagtcctccactgga

SEQ ID NO: 8056958 - DNA, 23 bp, Homo sapiens
ggcctgtgttttgtctgaagtac

SEQ ID NO: 8056959 - DNA, 22 bp, Homo sapiens
ggccctgcaaggtacccaggcc

SEQ ID NO: 8056960 - DNA, 22 bp, Homo sapiens
ggccctgcgattaggtggcagg

SEQ ID NO: 8056961 - DNA, 22 bp, Homo sapiens
ggccctccctgagccaggtggg

SEQ ID NO: 8056962 - DNA, 22 bp, Homo sapiens
ggcccagcctggcaacaatgac

SEQ ID NO: 8056963 - DNA, 22 bp, Homo sapiens
ggcccagcctcagacatgccct

SEQ ID NO: 8056964 - DNA, 22 bp, Homo sapiens
ggcccagcctcagacatgccct

SEQ ID NO: 8056965 - DNA, 22 bp, Homo sapiens
ggcccagcgaggccacctacag

SEQ ID NO: 8056966 - DNA, 22 bp, Homo sapiens
ggcccacactgacagctgagct

SEQ ID NO: 8056967 - DNA, 22 bp, Homo sapiens
ggcccaaggtgccaaggcctcc

SEQ ID NO: 8056968 - DNA, 22 bp, Homo sapiens
ggcccagccggcgagtctcgcg

SEQ ID NO: 8056969 - DNA, 22 bp, Homo sapiens
ggcccacatggaagcatcgagg

SEQ ID NO: 8056970 - DNA, 22 bp, Homo sapiens
ggcccagaagccagaagcctcc

SEQ ID NO: 8056971 - DNA, 22 bp, Homo sapiens
ggccatggtggtttgagcacct

SEQ ID NO: 8056972 - DNA, 20 bp, Homo sapiens
ggccatgggttgcctgaggt

SEQ ID NO: 8056973 - DNA, 17 bp, Homo sapiens
ggccagaggcggggctg

SEQ ID NO: 8056974 - DNA, 22 bp, Homo sapiens
ggccagagggagggcacaaatc

SEQ ID NO: 8056975 - DNA, 18 bp, Homo sapiens
ggccagagggagggtccc

SEQ ID NO: 8056976 - DNA, 18 bp, Homo sapiens
ggccagagggagggtccc

SEQ ID NO: 8056977 - DNA, 22 bp, Homo sapiens
ggccatgggaagaggtggagag

SEQ ID NO: 8056978 - DNA, 22 bp, Homo sapiens
ggccagaggtgtcctcagttct

SEQ ID NO: 8056979 - DNA, 22 bp, Homo sapiens
ggccagaggtggtacatagctt

SEQ ID NO: 8056980 - DNA, 22 bp, Homo sapiens
ggccagagagccgctgttagga

SEQ ID NO: 8056981 - DNA, 22 bp, Homo sapiens
ggccagagctcaaacagtcgca

SEQ ID NO: 8056982 - DNA, 22 bp, Homo sapiens
ggccagagagcagccaggattc

SEQ ID NO: 8056983 - DNA, 22 bp, Homo sapiens
ggccagaggccacagctgtgtc

SEQ ID NO: 8056984 - DNA, 22 bp, Homo sapiens
ggccagaggccacagctgtgtc

SEQ ID NO: 8056985 - DNA, 22 bp, Homo sapiens
ggccagaggccatcctcctgct

SEQ ID NO: 8056986 - DNA, 22 bp, Homo sapiens
ggccacctggctgtgggggcag

SEQ ID NO: 8056987 - DNA, 22 bp, Homo sapiens
ggccacctgggttcgactgggc

SEQ ID NO: 8056988 - DNA, 22 bp, Homo sapiens
ggccagagaatatgccttacgt

SEQ ID NO: 8056989 - DNA, 22 bp, Homo sapiens
ggccagagaagtcagacccttg

SEQ ID NO: 8056990 - DNA, 22 bp, Homo sapiens
ggcaggtggaaggtctccattc

SEQ ID NO: 8056991 - DNA, 22 bp, Homo sapiens
ggcaggtggaagttggcagagc

SEQ ID NO: 8056992 - DNA, 22 bp, Homo sapiens
ggcaggtggaagttggcagagc

SEQ ID NO: 8056993 - DNA, 22 bp, Homo sapiens
ggcaggtgcttgtcgaaggcct

SEQ ID NO: 8056994 - DNA, 22 bp, Homo sapiens
ggcaggtgcttgtcgaaggcct

SEQ ID NO: 8056995 - DNA, 22 bp, Homo sapiens
ggcaggtgctgggagcatctca

SEQ ID NO: 8056996 - DNA, 20 bp, Homo sapiens
ggcaggtgctgtcccctcct

SEQ ID NO: 8056997 - DNA, 22 bp, Homo sapiens
gggctctggtacttcctggctc

SEQ ID NO: 8056998 - DNA, 22 bp, Homo sapiens
gggctctggtacttcctggctc

SEQ ID NO: 8056999 - DNA, 22 bp, Homo sapiens
gggctagcctcttccctgctcc

SEQ ID NO: 8057000 - DNA, 20 bp, Homo sapiens
gggctagaccagggcagagg

SEQ ID NO: 8057001 - DNA, 22 bp, Homo sapiens
gggctaggcttggccagcactg

SEQ ID NO: 8057002 - DNA, 22 bp, Homo sapiens
gggctctgtggcttccttctta

SEQ ID NO: 8057003 - DNA, 22 bp, Homo sapiens
gggctctgtggcttccttctta

SEQ ID NO: 8057004 - DNA, 22 bp, Homo sapiens
gggctctgtggatgtgagagct

SEQ ID NO: 8057005 - DNA, 22 bp, Homo sapiens
gggctctgtggatgtgagagct

SEQ ID NO: 8057006 - DNA, 22 bp, Homo sapiens
gggctctgtgcaccccagcacc

SEQ ID NO: 8057007 - DNA, 22 bp, Homo sapiens
gggctctgtccattccttcata

SEQ ID NO: 8057008 - DNA, 22 bp, Homo sapiens
gggctctggtcctgaactgaag

SEQ ID NO: 8057009 - DNA, 22 bp, Homo sapiens
gggctctggtcctgaactgaag

SEQ ID NO: 8057010 - DNA, 22 bp, Homo sapiens
gggctctgtccattccttcata

SEQ ID NO: 8057011 - DNA, 20 bp, Homo sapiens
gggctctgtaaggttgaaag

SEQ ID NO: 8057012 - DNA, 22 bp, Homo sapiens
gggctgcttcctggggaatgct

SEQ ID NO: 8057013 - DNA, 22 bp, Homo sapiens
gggctgcttgctggagacagac

SEQ ID NO: 8057014 - DNA, 22 bp, Homo sapiens
gggctgcttggaggaggcgctc

SEQ ID NO: 8057015 - DNA, 22 bp, Homo sapiens
gggctgcttttaagggtctcag

SEQ ID NO: 8057016 - DNA, 22 bp, Homo sapiens
gggctgcttttttcttagcaga

SEQ ID NO: 8057017 - DNA, 23 bp, Homo sapiens
ggggacagttcccactggggtct

SEQ ID NO: 8057018 - DNA, 23 bp, Homo sapiens
ggggacagttcccactggggtct

SEQ ID NO: 8057019 - DNA, 22 bp, Homo sapiens
ggggacagtcgatctagtgatt

SEQ ID NO: 8057020 - DNA, 22 bp, Homo sapiens
ggggacagtcgatctagtgatt

SEQ ID NO: 8057021 - DNA, 23 bp, Homo sapiens
ggggacagagggcagcccgcatc

SEQ ID NO: 8057022 - DNA, 22 bp, Homo sapiens
ggggaaggattgagttgaccca

SEQ ID NO: 8057023 - DNA, 22 bp, Homo sapiens
ggggaagggagtccaagtgtta

SEQ ID NO: 8057024 - DNA, 22 bp, Homo sapiens
gggctggagccagctgtggctg

SEQ ID NO: 8057025 - DNA, 22 bp, Homo sapiens
gggctggagccagctgtggctg

SEQ ID NO: 8057026 - DNA, 22 bp, Homo sapiens
gggctggatgggagccttggcc

SEQ ID NO: 8057027 - DNA, 22 bp, Homo sapiens
gggctggcaggacctgggctga

SEQ ID NO: 8057028 - DNA, 22 bp, Homo sapiens
gggctggcaggacctgggctga

SEQ ID NO: 8057029 - DNA, 17 bp, Homo sapiens
gggtgggcactgctggc

SEQ ID NO: 8057030 - DNA, 22 bp, Homo sapiens
gggtgggccactgagcagcgtg

SEQ ID NO: 8057031 - DNA, 22 bp, Homo sapiens
gggtgaggagctgccagtcatg

SEQ ID NO: 8057032 - DNA, 22 bp, Homo sapiens
gggggctgtcctgtgcattgta

SEQ ID NO: 8057033 - DNA, 22 bp, Homo sapiens
gggggctggactttcccacaca

SEQ ID NO: 8057034 - DNA, 22 bp, Homo sapiens
gggggctgatcatttactgggc

SEQ ID NO: 8057035 - DNA, 22 bp, Homo sapiens
gggggctggaatatccatcaac

SEQ ID NO: 8057036 - DNA, 22 bp, Homo sapiens
gggggctccaggcgagaatgtg

SEQ ID NO: 8057037 - DNA, 22 bp, Homo sapiens
gggggctgaggctgttctgagg

SEQ ID NO: 8057038 - DNA, 22 bp, Homo sapiens
ggggtaggcaggtgatctgatc

SEQ ID NO: 8057039 - DNA, 22 bp, Homo sapiens
gggggtgagcctgccaggccca

SEQ ID NO: 8057040 - DNA, 22 bp, Homo sapiens
gggggtttctgggctgagcaga

SEQ ID NO: 8057041 - DNA, 20 bp, Homo sapiens
ggggggcttcagggcctgtg

SEQ ID NO: 8057042 - DNA, 22 bp, Homo sapiens
ggggggctgttctggacaggaa

SEQ ID NO: 8057043 - DNA, 22 bp, Homo sapiens
ggggggctgttctggacaggaa

SEQ ID NO: 8057044 - DNA, 22 bp, Homo sapiens
gggggtgacgatggcagctggt

SEQ ID NO: 8057045 - DNA, 22 bp, Homo sapiens
ggggggtgctgatcagtggagc

SEQ ID NO: 8057046 - DNA, 22 bp, Homo sapiens
gggatgaggatcaatcagggag

SEQ ID NO: 8057047 - DNA, 22 bp, Homo sapiens
gggagggaaagcttgatctgtc

SEQ ID NO: 8057048 - DNA, 22 bp, Homo sapiens
gggaggcttgagccatactgcc

SEQ ID NO: 8057049 - DNA, 22 bp, Homo sapiens
gggaggctggctctggccacag

SEQ ID NO: 8057050 - DNA, 22 bp, Homo sapiens
gggagggaaggtacctgtgtga

SEQ ID NO: 8057051 - DNA, 22 bp, Homo sapiens
gggatggactgacggtagcgcg

SEQ ID NO: 8057052 - DNA, 22 bp, Homo sapiens
gggatggagggtagagcaagtg

SEQ ID NO: 8057053 - DNA, 22 bp, Homo sapiens
gggatggacttggggactccag

SEQ ID NO: 8057054 - DNA, 22 bp, Homo sapiens
gggatggagggtagagcaagtg

SEQ ID NO: 8057055 - DNA, 22 bp, Homo sapiens
gggatggatcttggctgaggct

SEQ ID NO: 8057056 - DNA, 22 bp, Homo sapiens
gggatggatcttggctgaggct

SEQ ID NO: 8057057 - DNA, 22 bp, Homo sapiens
gggatggctgcctgcatcagga

SEQ ID NO: 8057058 - DNA, 19 bp, Homo sapiens
gggatgggccctcaccctc

SEQ ID NO: 8057059 - DNA, 22 bp, Homo sapiens
gggatgggagagcatttagaga

SEQ ID NO: 8057060 - DNA, 22 bp, Homo sapiens
gggatggggagctggaaagggg

SEQ ID NO: 8057061 - DNA, 22 bp, Homo sapiens
gggatggggagctggaaagggg

SEQ ID NO: 8057062 - DNA, 22 bp, Homo sapiens
gggcagaggggcgcttccctct

SEQ ID NO: 8057063 - DNA, 22 bp, Homo sapiens
gggagaaggaggactgtgctgt

SEQ ID NO: 8057064 - DNA, 22 bp, Homo sapiens
gggaggctcagtggtgtcctct

SEQ ID NO: 8057065 - DNA, 22 bp, Homo sapiens
gggaggctctgctcagcccccg

SEQ ID NO: 8057066 - DNA, 22 bp, Homo sapiens
gggaggctctgctcagcccccg

SEQ ID NO: 8057067 - DNA, 22 bp, Homo sapiens
gggaggctgccatccttcagga

SEQ ID NO: 8057068 - DNA, 20 bp, Homo sapiens
gggaggcgagggctgagcag

SEQ ID NO: 8057069 - DNA, 22 bp, Homo sapiens
gggaggcgccgagggtagctaa

SEQ ID NO: 8057070 - DNA, 22 bp, Homo sapiens
gggacctggtctagcactgagc

SEQ ID NO: 8057071 - DNA, 22 bp, Homo sapiens
gggacgggcagtccaaggggtc

SEQ ID NO: 8057072 - DNA, 22 bp, Homo sapiens
gggccagtgggacctgggtctc

SEQ ID NO: 8057073 - DNA, 22 bp, Homo sapiens
gggcccagcactggctgggatc

SEQ ID NO: 8057074 - DNA, 22 bp, Homo sapiens
gggcccagcactggctgggatc

SEQ ID NO: 8057075 - DNA, 23 bp, Homo sapiens
gggcccagcacaggacctggcag

SEQ ID NO: 8057076 - DNA, 22 bp, Homo sapiens
gggcccagccctctgctcactg

SEQ ID NO: 8057077 - DNA, 22 bp, Homo sapiens
gggcccagccctctgctcactg

SEQ ID NO: 8057078 - DNA, 19 bp, Homo sapiens
gggcccagcatggagggtt

SEQ ID NO: 8057079 - DNA, 22 bp, Homo sapiens
gggctagaagttagctagagaa

SEQ ID NO: 8057080 - DNA, 22 bp, Homo sapiens
gggctagaaattctgcagtgga

SEQ ID NO: 8057081 - DNA, 22 bp, Homo sapiens
gggcgtggatggtcagtgcagg

SEQ ID NO: 8057082 - DNA, 22 bp, Homo sapiens
gggcgtggatggtcagtgcagg

SEQ ID NO: 8057083 - DNA, 22 bp, Homo sapiens
gggccacaggagaggctgtcag

SEQ ID NO: 8057084 - DNA, 22 bp, Homo sapiens
gggccacaggccttgcccgcag

SEQ ID NO: 8057085 - DNA, 22 bp, Homo sapiens
gggccacaggccttgcccgcag

SEQ ID NO: 8057086 - DNA, 22 bp, Homo sapiens
gggccaggagtggagatatggg

SEQ ID NO: 8057087 - DNA, 22 bp, Homo sapiens
gggccaggtggaccccagcctc

SEQ ID NO: 8057088 - DNA, 22 bp, Homo sapiens
gggccaggtcggtgaatggtca

SEQ ID NO: 8057089 - DNA, 22 bp, Homo sapiens
gggccaggtggaccccagcctc

SEQ ID NO: 8057090 - DNA, 20 bp, Homo sapiens
gggcagcctcgggagtgggt

SEQ ID NO: 8057091 - DNA, 22 bp, Homo sapiens
gggcagcagagccctgccgagt

SEQ ID NO: 8057092 - DNA, 22 bp, Homo sapiens
gggcagcacgtttcaggaggat

SEQ ID NO: 8057093 - DNA, 22 bp, Homo sapiens
gggcagcacgtttcaggaggat

SEQ ID NO: 8057094 - DNA, 21 bp, Homo sapiens
gggcagcacgtcattcctgtg

SEQ ID NO: 8057095 - DNA, 22 bp, Homo sapiens
gggcagcaaatctgagtctggt

SEQ ID NO: 8057096 - DNA, 18 bp, Homo sapiens
gggcagcacagcagcctc

SEQ ID NO: 8057097 - DNA, 22 bp, Homo sapiens
gactgtggtctgttctccaggt

SEQ ID NO: 8057098 - DNA, 22 bp, Homo sapiens
gactgtggggaagcagatgcca

SEQ ID NO: 8057099 - DNA, 22 bp, Homo sapiens
gactgtggggggcggacacaag

SEQ ID NO: 8057100 - DNA, 22 bp, Homo sapiens
gactgtgggaagactgtaggtt

SEQ ID NO: 8057101 - DNA, 22 bp, Homo sapiens
gactgtgggctccttgagggca

SEQ ID NO: 8057102 - DNA, 22 bp, Homo sapiens
gactgtgggctctgtttgtctt

SEQ ID NO: 8057103 - DNA, 22 bp, Homo sapiens
gactgtggcgtagatgctggga

SEQ ID NO: 8057104 - DNA, 22 bp, Homo sapiens
gactgtggctgcgtgtaaggaa

SEQ ID NO: 8057105 - DNA, 22 bp, Homo sapiens
gactgtggctaatggtgttagg

SEQ ID NO: 8057106 - DNA, 22 bp, Homo sapiens
gactgtggccttggaccatggg

SEQ ID NO: 8057107 - DNA, 22 bp, Homo sapiens
gactgtggcaggctcagcactg

SEQ ID NO: 8057108 - DNA, 22 bp, Homo sapiens
gactgtggatagaacactgcag

SEQ ID NO: 8057109 - DNA, 22 bp, Homo sapiens
gactgtggcagaaatgttgttg

SEQ ID NO: 8057110 - DNA, 22 bp, Homo sapiens
gactgtctcctgtcatgaggga

SEQ ID NO: 8057111 - DNA, 22 bp, Homo sapiens
gactgtgccagtcagtgggcgg

SEQ ID NO: 8057112 - DNA, 22 bp, Homo sapiens
gactgtggactctcatgataga

SEQ ID NO: 8057113 - DNA, 22 bp, Homo sapiens
gacccagggtttctgcacaggg

SEQ ID NO: 8057114 - DNA, 22 bp, Homo sapiens
gactttaaaatgctagaacagg

SEQ ID NO: 8057115 - DNA, 22 bp, Homo sapiens
gacccagggtatccagagctgc

SEQ ID NO: 8057116 - DNA, 22 bp, Homo sapiens
gacccaggagtgcagagagtgg

SEQ ID NO: 8057117 - DNA, 22 bp, Homo sapiens
gacccaggcccaaggctgccag

SEQ ID NO: 8057118 - DNA, 18 bp, Homo sapiens
gacccagcagatgggctt

SEQ ID NO: 8057119 - DNA, 18 bp, Homo sapiens
gacccaggaaagagtcct

SEQ ID NO: 8057120 - DNA, 22 bp, Homo sapiens
gacccagctaaccaggtgggga

SEQ ID NO: 8057121 - DNA, 22 bp, Homo sapiens
gacccagcctggtttttatagg

SEQ ID NO: 8057122 - DNA, 22 bp, Homo sapiens
gacccagcttaagtcacatgtt

SEQ ID NO: 8057123 - DNA, 22 bp, Homo sapiens
gacaggcacgaaattgggctgg

SEQ ID NO: 8057124 - DNA, 22 bp, Homo sapiens
gacaggaggcagagctcaggtg

SEQ ID NO: 8057125 - DNA, 22 bp, Homo sapiens
gacaggcatgctttcaggacta

SEQ ID NO: 8057126 - DNA, 22 bp, Homo sapiens
gacaggccagacaggagactga

SEQ ID NO: 8057127 - DNA, 22 bp, Homo sapiens
gacaggcaggccagggctgtgg

SEQ ID NO: 8057128 - DNA, 22 bp, Homo sapiens
gacaggcaggccagggctgtgg

SEQ ID NO: 8057129 - DNA, 22 bp, Homo sapiens
gagaaaatgtcagacttggtcg

SEQ ID NO: 8057130 - DNA, 22 bp, Homo sapiens
gagaaaatcttgggtcaagaat

SEQ ID NO: 8057131 - DNA, 22 bp, Homo sapiens
gagaaaatagcatgtgtagtat

SEQ ID NO: 8057132 - DNA, 22 bp, Homo sapiens
gactttatcctgcctgaccacg

SEQ ID NO: 8057133 - DNA, 22 bp, Homo sapiens
gactttataaatgagaggcgga

SEQ ID NO: 8057134 - DNA, 22 bp, Homo sapiens
gactttatcttgtccttcctgc

SEQ ID NO: 8057135 - DNA, 22 bp, Homo sapiens
gactttatgaagagatgaccaa

SEQ ID NO: 8057136 - DNA, 22 bp, Homo sapiens
gactttattactaaccctgtga

SEQ ID NO: 8057137 - DNA, 22 bp, Homo sapiens
gactttattcgttaactgttaa

SEQ ID NO: 8057138 - DNA, 22 bp, Homo sapiens
gactttattatagtggcaatag

SEQ ID NO: 8057139 - DNA, 22 bp, Homo sapiens
gactttattttaacggagattc

SEQ ID NO: 8057140 - DNA, 22 bp, Homo sapiens
gactttatttccttatttgtga

SEQ ID NO: 8057141 - DNA, 22 bp, Homo sapiens
gagagctggattctggataggt

SEQ ID NO: 8057142 - DNA, 22 bp, Homo sapiens
gagagctgggctttgggtgaag

SEQ ID NO: 8057143 - DNA, 20 bp, Homo sapiens
gagagctggggatgaggctg

SEQ ID NO: 8057144 - DNA, 22 bp, Homo sapiens
gagagcctttgaagggaagtga

SEQ ID NO: 8057145 - DNA, 22 bp, Homo sapiens
gaagtacaaaggacatggaaac

SEQ ID NO: 8057146 - DNA, 22 bp, Homo sapiens
gaagtgatgctggttgagatct

SEQ ID NO: 8057147 - DNA, 22 bp, Homo sapiens
gaagtgacaagatgctaggatc

SEQ ID NO: 8057148 - DNA, 22 bp, Homo sapiens
gaaggctgcgaggggagtgccg

SEQ ID NO: 8057149 - DNA, 22 bp, Homo sapiens
gaactgtggggtggtagcagga

SEQ ID NO: 8057150 - DNA, 22 bp, Homo sapiens
gaactgtgtttgtttctaggtc

SEQ ID NO: 8057151 - DNA, 22 bp, Homo sapiens
gaactgtcattggggacatcag

SEQ ID NO: 8057152 - DNA, 22 bp, Homo sapiens
gaactgtgggtaatatattaga

SEQ ID NO: 8057153 - DNA, 22 bp, Homo sapiens
gaactgtgtacattgtagataa

SEQ ID NO: 8057154 - DNA, 19 bp, Homo sapiens
gaaggagagctgagttagg

SEQ ID NO: 8057155 - DNA, 22 bp, Homo sapiens
gaaggagagagacatcgtccct

SEQ ID NO: 8057156 - DNA, 21 bp, Homo sapiens
gaaggagaaagcaagtgctgc

SEQ ID NO: 8057157 - DNA, 22 bp, Homo sapiens
gaaggagaccctgaagatgctg

SEQ ID NO: 8057158 - DNA, 22 bp, Homo sapiens
gaaggagagaaaggcaattctg

SEQ ID NO: 8057159 - DNA, 22 bp, Homo sapiens
gaaggagaggattgtgaggctg

SEQ ID NO: 8057160 - DNA, 22 bp, Homo sapiens
gaaggagagggtcaaggataat

SEQ ID NO: 8057161 - DNA, 22 bp, Homo sapiens
gaattcacttgtcttccatttt

SEQ ID NO: 8057162 - DNA, 22 bp, Homo sapiens
gacacagatatctctgagatta

SEQ ID NO: 8057163 - DNA, 22 bp, Homo sapiens
gacacagagggcaccagatatg

SEQ ID NO: 8057164 - DNA, 22 bp, Homo sapiens
gacacagagctcacagtctcct

SEQ ID NO: 8057165 - DNA, 19 bp, Homo sapiens
gacaggacgaagggaagtt

SEQ ID NO: 8057166 - DNA, 19 bp, Homo sapiens
gacaggacgaagggaagtt

SEQ ID NO: 8057167 - DNA, 22 bp, Homo sapiens
cttggctgcttttgtgcacatt

SEQ ID NO: 8057168 - DNA, 22 bp, Homo sapiens
cttgaagaaatggagacaggat

SEQ ID NO: 8057169 - DNA, 22 bp, Homo sapiens
cttgaagagtaaattggtacac

SEQ ID NO: 8057170 - DNA, 17 bp, Homo sapiens
cttggcacctctgccat

SEQ ID NO: 8057171 - DNA, 22 bp, Homo sapiens
cttgggctcagacttgaggaca

SEQ ID NO: 8057172 - DNA, 22 bp, Homo sapiens
cttgggggccattaaggggcct

SEQ ID NO: 8057173 - DNA, 22 bp, Homo sapiens
cttggggctttgtgtgtaggat

SEQ ID NO: 8057174 - DNA, 22 bp, Homo sapiens
cttggggctgtcactctggcat

SEQ ID NO: 8057175 - DNA, 22 bp, Homo sapiens
ctttatgaacctgttcagcttg

SEQ ID NO: 8057176 - DNA, 22 bp, Homo sapiens
cttctcttcccagggacacagg

SEQ ID NO: 8057177 - DNA, 22 bp, Homo sapiens
cttcttttgaagggcgttgtgt

SEQ ID NO: 8057178 - DNA, 22 bp, Homo sapiens
cttcttttcatggcttgggaag

SEQ ID NO: 8057179 - DNA, 18 bp, Homo sapiens
cttgaagaattttgcagt

SEQ ID NO: 8057180 - DNA, 19 bp, Homo sapiens
cttgaaatgagactgaagg

SEQ ID NO: 8057181 - DNA, 22 bp, Homo sapiens
cttcttttacaggtcttgggtt

SEQ ID NO: 8057182 - DNA, 22 bp, Homo sapiens
ctggctgggttccaggattcca

SEQ ID NO: 8057183 - DNA, 22 bp, Homo sapiens
ctggctggtcatgtcatgagcc

SEQ ID NO: 8057184 - DNA, 22 bp, Homo sapiens
ctggctggtcatgtcatgagcc

SEQ ID NO: 8057185 - DNA, 22 bp, Homo sapiens
ctggctggtcctcggggacagc

SEQ ID NO: 8057186 - DNA, 22 bp, Homo sapiens
ctggctggtcctcggggacagc

SEQ ID NO: 8057187 - DNA, 22 bp, Homo sapiens
ctggctggagtgcaggtgagtg

SEQ ID NO: 8057188 - DNA, 22 bp, Homo sapiens
gaacacagtttagaaaatgctg

SEQ ID NO: 8057189 - DNA, 22 bp, Homo sapiens
gaacacagaagaatttctaaga

SEQ ID NO: 8057190 - DNA, 22 bp, Homo sapiens
gaaataattctgtgtctgaaca

SEQ ID NO: 8057191 - DNA, 22 bp, Homo sapiens
gaaataattctgtgtctgaaca

SEQ ID NO: 8057192 - DNA, 22 bp, Homo sapiens
gaaataatttagaaggtattcc

SEQ ID NO: 8057193 - DNA, 22 bp, Homo sapiens
gaacgggtgcagccatgggccc

SEQ ID NO: 8057194 - DNA, 22 bp, Homo sapiens
ctttgttttactcagaggcatg

SEQ ID NO: 8057195 - DNA, 22 bp, Homo sapiens
gaaagttcacacatccacatgg

SEQ ID NO: 8057196 - DNA, 22 bp, Homo sapiens
gaggacagagccgcctggcaag

SEQ ID NO: 8057197 - DNA, 22 bp, Homo sapiens
gaggacagagccgcctggcaag

SEQ ID NO: 8057198 - DNA, 22 bp, Homo sapiens
gaggacagcttagggcttcctg

SEQ ID NO: 8057199 - DNA, 22 bp, Homo sapiens
gaggacagctctaactaaagtc

SEQ ID NO: 8057200 - DNA, 18 bp, Homo sapiens
gagctgggagaaggaagg

SEQ ID NO: 8057201 - DNA, 22 bp, Homo sapiens
gagctgggacttggaatccaca

SEQ ID NO: 8057202 - DNA, 22 bp, Homo sapiens
gagctgggagctgggatttgga

SEQ ID NO: 8057203 - DNA, 22 bp, Homo sapiens
gagctgggaggactgggaactt

SEQ ID NO: 8057204 - DNA, 22 bp, Homo sapiens
gagctgggagttatagcatgtt

SEQ ID NO: 8057205 - DNA, 22 bp, Homo sapiens
gaggaagggctgcctgccgggc

SEQ ID NO: 8057206 - DNA, 23 bp, Homo sapiens
gagctgggatacaggcttactgc

SEQ ID NO: 8057207 - DNA, 22 bp, Homo sapiens
gagctgggattcatctatgtct

SEQ ID NO: 8057208 - DNA, 22 bp, Homo sapiens
gagctggcctcaggcacaggag

SEQ ID NO: 8057209 - DNA, 22 bp, Homo sapiens
gagctggcctcaggcacaggag

SEQ ID NO: 8057210 - DNA, 22 bp, Homo sapiens
gagctggctccgccatgctgct

SEQ ID NO: 8057211 - DNA, 22 bp, Homo sapiens
gagctggctccgccatgctgct

SEQ ID NO: 8057212 - DNA, 22 bp, Homo sapiens
gagctgggacatgggtcctctc

SEQ ID NO: 8057213 - DNA, 22 bp, Homo sapiens
gagctgggaagatagcttgagc

SEQ ID NO: 8057214 - DNA, 22 bp, Homo sapiens
gagctgcttgcccagaagcaga

SEQ ID NO: 8057215 - DNA, 22 bp, Homo sapiens
gaggaggcttccgggaggcacg

SEQ ID NO: 8057216 - DNA, 22 bp, Homo sapiens
gaggaggcttccgggaggcacg

SEQ ID NO: 8057217 - DNA, 22 bp, Homo sapiens
gaggaggctgtttctctgcatt

SEQ ID NO: 8057218 - DNA, 22 bp, Homo sapiens
gaggcagcaataaaaagaattt

SEQ ID NO: 8057219 - DNA, 22 bp, Homo sapiens
gaggcagcagaacatggaagag

SEQ ID NO: 8057220 - DNA, 22 bp, Homo sapiens
gaggccctcttgccacaatgaa

SEQ ID NO: 8057221 - DNA, 22 bp, Homo sapiens
gaggccctgaagacagctgggg

SEQ ID NO: 8057222 - DNA, 21 bp, Homo sapiens
gaggcctcagcctcagctcct

SEQ ID NO: 8057223 - DNA, 22 bp, Homo sapiens
gaggcctgaggctgcctggagc

SEQ ID NO: 8057224 - DNA, 22 bp, Homo sapiens
gaggcctcttctttgttaacct

SEQ ID NO: 8057225 - DNA, 22 bp, Homo sapiens
gaggcctgaaaggggacctatg

SEQ ID NO: 8057226 - DNA, 18 bp, Homo sapiens
gaggcctgagaaccaggt

SEQ ID NO: 8057227 - DNA, 22 bp, Homo sapiens
gaggcctcctctgagacatctg

SEQ ID NO: 8057228 - DNA, 23 bp, Homo sapiens
gaggcagctcctgcagtgccctg

SEQ ID NO: 8057229 - DNA, 22 bp, Homo sapiens
gaggcagctgaaggagtgacag

SEQ ID NO: 8057230 - DNA, 22 bp, Homo sapiens
gaggcagcaggctgaggaggat

SEQ ID NO: 8057231 - DNA, 18 bp, Homo sapiens
gaggcagctagcaatttt

SEQ ID NO: 8057232 - DNA, 22 bp, Homo sapiens
gaggcccagtcctgcaagcacg

SEQ ID NO: 8057233 - DNA, 22 bp, Homo sapiens
gaggcccaggtcaagcagccac

SEQ ID NO: 8057234 - DNA, 22 bp, Homo sapiens
gaggcagctgggatacaaggga

SEQ ID NO: 8057235 - DNA, 22 bp, Homo sapiens
gaggggcgtcctgagtgggcct

SEQ ID NO: 8057236 - DNA, 22 bp, Homo sapiens
gaggggcctggcactgagctgg

SEQ ID NO: 8057237 - DNA, 22 bp, Homo sapiens
gaggggcctggcgaggacatgt

SEQ ID NO: 8057238 - DNA, 22 bp, Homo sapiens
gaggggcctggcgaggacatgt

SEQ ID NO: 8057239 - DNA, 22 bp, Homo sapiens
gaggtcaggcttgcagcagggt

SEQ ID NO: 8057240 - DNA, 22 bp, Homo sapiens
gagtccagttgttcacagaggc

SEQ ID NO: 8057241 - DNA, 22 bp, Homo sapiens
gaggtgtctggcctttgtagga

SEQ ID NO: 8057242 - DNA, 22 bp, Homo sapiens
gaggtgtcctcagccaactctg

SEQ ID NO: 8057243 - DNA, 22 bp, Homo sapiens
gaggtgtcgtagattattctca

SEQ ID NO: 8057244 - DNA, 22 bp, Homo sapiens
gaggtgtctgctgtgttcaaag

SEQ ID NO: 8057245 - DNA, 22 bp, Homo sapiens
gaggtgtctagatctaccagta

SEQ ID NO: 8057246 - DNA, 22 bp, Homo sapiens
gaggtgtctgagtggggacctg

SEQ ID NO: 8057247 - DNA, 22 bp, Homo sapiens
gaggtgtcatttagttaatcag

SEQ ID NO: 8057248 - DNA, 22 bp, Homo sapiens
gaggtgtcatcaggcagctctg

SEQ ID NO: 8057249 - DNA, 22 bp, Homo sapiens
gaggtgtcatgagggcctgctc

SEQ ID NO: 8057250 - DNA, 22 bp, Homo sapiens
gaggtgtcccgcagtccccaag

SEQ ID NO: 8057251 - DNA, 22 bp, Homo sapiens
gaggtgtccctgaccctttgca

SEQ ID NO: 8057252 - DNA, 22 bp, Homo sapiens
gaggtgtcctagaagtattcag

SEQ ID NO: 8057253 - DNA, 22 bp, Homo sapiens
gaggtgtcactattttgcttat

SEQ ID NO: 8057254 - DNA, 22 bp, Homo sapiens
gaggtgtcagggtagtcatgat

SEQ ID NO: 8057255 - DNA, 22 bp, Homo sapiens
gaggtggttcaggtagagccca

SEQ ID NO: 8057256 - DNA, 22 bp, Homo sapiens
gaggtggtttgtggtgactcat

SEQ ID NO: 8057257 - DNA, 22 bp, Homo sapiens
gaggtggtggtggaggcatagc

SEQ ID NO: 8057258 - DNA, 22 bp, Homo sapiens
gaggtggtcgaggaggggtacc

SEQ ID NO: 8057259 - DNA, 20 bp, Homo sapiens
gagggcaggcacccatttca

SEQ ID NO: 8057260 - DNA, 22 bp, Homo sapiens
gagggcaggggtcttgcacggt

SEQ ID NO: 8057261 - DNA, 22 bp, Homo sapiens
gagggcaggggtcttgcacggt

SEQ ID NO: 8057262 - DNA, 22 bp, Homo sapiens
gagggcagtagcctcgtaccct

SEQ ID NO: 8057263 - DNA, 22 bp, Homo sapiens
gagggcagtagcctcgtaccct

SEQ ID NO: 8057264 - DNA, 22 bp, Homo sapiens
gagggcagtgaattttgaagct

SEQ ID NO: 8057265 - DNA, 22 bp, Homo sapiens
gagggccaaagagcaagagcct

SEQ ID NO: 8057266 - DNA, 22 bp, Homo sapiens
gaggggccggcatgtgcctctc

SEQ ID NO: 8057267 - DNA, 22 bp, Homo sapiens
gaggggcacagtaaagggtccc

SEQ ID NO: 8057268 - DNA, 22 bp, Homo sapiens
gaggggattggaaggaacaccc

SEQ ID NO: 8057269 - DNA, 22 bp, Homo sapiens
gaggggcaatgagggaaagagt

SEQ ID NO: 8057270 - DNA, 22 bp, Homo sapiens
gaggggagtgtcctccgggccc

SEQ ID NO: 8057271 - DNA, 22 bp, Homo sapiens
gaggggagtgtcctccgggccc

SEQ ID NO: 8057272 - DNA, 22 bp, Homo sapiens
gaggggagtaaagtcatgttac

SEQ ID NO: 8057273 - DNA, 22 bp, Homo sapiens
gaggggatgcagagaggcttat

SEQ ID NO: 8057274 - DNA, 22 bp, Homo sapiens
gaggctgccccttcctcagctg

SEQ ID NO: 8057275 - DNA, 22 bp, Homo sapiens
gaggcctgctttggcactctgg

SEQ ID NO: 8057276 - DNA, 22 bp, Homo sapiens
gaggcctgaggctgcctggagc

SEQ ID NO: 8057277 - DNA, 22 bp, Homo sapiens
gaggcctgaggctgcctggagc

SEQ ID NO: 8057278 - DNA, 22 bp, Homo sapiens
gaggcctgcagcgtggtccctg

SEQ ID NO: 8057279 - DNA, 22 bp, Homo sapiens
gaggctgggggctgccttcctc

SEQ ID NO: 8057280 - DNA, 22 bp, Homo sapiens
gagggcagagtctaatgatgca

SEQ ID NO: 8057281 - DNA, 16 bp, Homo sapiens
gagggcagaggcggaa

SEQ ID NO: 8057282 - DNA, 22 bp, Homo sapiens
gagggatgcagaaacagaggcc

SEQ ID NO: 8057283 - DNA, 22 bp, Homo sapiens
gagggatggtagttgacactga

SEQ ID NO: 8057284 - DNA, 22 bp, Homo sapiens
gatgcaaactgtgacatagagt

SEQ ID NO: 8057285 - DNA, 22 bp, Homo sapiens
gatgcaaagataaaacagacgc

SEQ ID NO: 8057286 - DNA, 22 bp, Homo sapiens
gataccagacagggagggagaa

SEQ ID NO: 8057287 - DNA, 21 bp, Homo sapiens
gatacagagggccactgattg

SEQ ID NO: 8057288 - DNA, 20 bp, Homo sapiens
gatacacagcacagagggcc

SEQ ID NO: 8057289 - DNA, 22 bp, Homo sapiens
gatatacagagcattctttgat

SEQ ID NO: 8057290 - DNA, 22 bp, Homo sapiens
gatatacaatccacagttgatt

SEQ ID NO: 8057291 - DNA, 22 bp, Homo sapiens
gatagataaaactatattttca

SEQ ID NO: 8057292 - DNA, 22 bp, Homo sapiens
gatagaaagaatatagattcca

SEQ ID NO: 8057293 - DNA, 22 bp, Homo sapiens
gatcatcatctttcaggcaagt

SEQ ID NO: 8057294 - DNA, 22 bp, Homo sapiens
gatcatcaagcaagaacctgat

SEQ ID NO: 8057295 - DNA, 22 bp, Homo sapiens
gatatatgtaaaagtagacaga

SEQ ID NO: 8057296 - DNA, 22 bp, Homo sapiens
gatatacataggtttctatgca

SEQ ID NO: 8057297 - DNA, 22 bp, Homo sapiens
gataaagtagatttgttctaga

SEQ ID NO: 8057298 - DNA, 22 bp, Homo sapiens
gagtggggtctgggcatcagtc

SEQ ID NO: 8057299 - DNA, 22 bp, Homo sapiens
gagtggcaggcactgtgacgga

SEQ ID NO: 8057300 - DNA, 22 bp, Homo sapiens
gagtggcatatgtgcctgtgaa

SEQ ID NO: 8057301 - DNA, 22 bp, Homo sapiens
gagtggagatcgtgccactgca

SEQ ID NO: 8057302 - DNA, 22 bp, Homo sapiens
gagtggctttggagaagtaggg

SEQ ID NO: 8057303 - DNA, 15 bp, Homo sapiens
gagtggctttcagaa

SEQ ID NO: 8057304 - DNA, 22 bp, Homo sapiens
gagtggctgtgtacatgcccag

SEQ ID NO: 8057305 - DNA, 15 bp, Homo sapiens
gagtggctggtgaaa

SEQ ID NO: 8057306 - DNA, 22 bp, Homo sapiens
gagtggctgggtgtttgaatcc

SEQ ID NO: 8057307 - DNA, 22 bp, Homo sapiens
gagtggctgagtaagaggggag

SEQ ID NO: 8057308 - DNA, 22 bp, Homo sapiens
gagtggctccttacaagttcca

SEQ ID NO: 8057309 - DNA, 22 bp, Homo sapiens
gagtggctccctgggtttggca

SEQ ID NO: 8057310 - DNA, 22 bp, Homo sapiens
gagtggctccaatttggtccta

SEQ ID NO: 8057311 - DNA, 22 bp, Homo sapiens
gagtggctattgatccgtgatg

SEQ ID NO: 8057312 - DNA, 22 bp, Homo sapiens
gagtggctacaggcagcttaca

SEQ ID NO: 8057313 - DNA, 22 bp, Homo sapiens
gagtggctaaagtatgtcatgg

SEQ ID NO: 8057314 - DNA, 21 bp, Homo sapiens
gagtgggacatgggagtggtt

SEQ ID NO: 8057315 - DNA, 22 bp, Homo sapiens
gagtggcttttttatggtaatg

SEQ ID NO: 8057316 - DNA, 21 bp, Homo sapiens
gagtgggacatgggagtggtt

SEQ ID NO: 8057317 - DNA, 22 bp, Homo sapiens
gagtggggctttaaaggctcag

SEQ ID NO: 8057318 - DNA, 22 bp, Homo sapiens
gagtgctggggtgcagagaggt

SEQ ID NO: 8057319 - DNA, 23 bp, Homo sapiens
gagtgcagaatagacatgcagtg

SEQ ID NO: 8057320 - DNA, 22 bp, Homo sapiens
gagtcgagcagaaagccgtcgg

SEQ ID NO: 8057321 - DNA, 22 bp, Homo sapiens
gcacaaaaggtacttcatgtag

SEQ ID NO: 8057322 - DNA, 22 bp, Homo sapiens
gattttcttgggaaacaatgag

SEQ ID NO: 8057323 - DNA, 22 bp, Homo sapiens
gattttctgagccttcaaattt

SEQ ID NO: 8057324 - DNA, 22 bp, Homo sapiens
gatttttcagtataaaatatat

SEQ ID NO: 8057325 - DNA, 22 bp, Homo sapiens
gcaaacagaaatgcaggacgct

SEQ ID NO: 8057326 - DNA, 22 bp, Homo sapiens
gatttcaagcccccagagattc

SEQ ID NO: 8057327 - DNA, 22 bp, Homo sapiens
gatttctgtggcttgtacatat

SEQ ID NO: 8057328 - DNA, 22 bp, Homo sapiens
gcagagccaggagagacccttg

SEQ ID NO: 8057329 - DNA, 22 bp, Homo sapiens
gcagagccaggagcccaggatc

SEQ ID NO: 8057330 - DNA, 22 bp, Homo sapiens
gcagagccaggagcccaggatc

SEQ ID NO: 8057331 - DNA, 22 bp, Homo sapiens
gcagagccaggctggggcaggt

SEQ ID NO: 8057332 - DNA, 22 bp, Homo sapiens
gcagagcccctcaagccagcct

SEQ ID NO: 8057333 - DNA, 22 bp, Homo sapiens
gcagagccaggctggggcaggt

SEQ ID NO: 8057334 - DNA, 22 bp, Homo sapiens
gcagagccaggctggggcaggt

SEQ ID NO: 8057335 - DNA, 22 bp, Homo sapiens
gcagagccccattgctggcggg

SEQ ID NO: 8057336 - DNA, 22 bp, Homo sapiens
gcagaaggatccgcaggtgcaa

SEQ ID NO: 8057337 - DNA, 22 bp, Homo sapiens
gcagagccagaatggccaggac

SEQ ID NO: 8057338 - DNA, 22 bp, Homo sapiens
gcagagccagaatggccaggac

SEQ ID NO: 8057339 - DNA, 22 bp, Homo sapiens
gcacccagtgggatgcttagca

SEQ ID NO: 8057340 - DNA, 22 bp, Homo sapiens
gcacccagggcaggaagtgagg

SEQ ID NO: 8057341 - DNA, 22 bp, Homo sapiens
gcacccagtttgtctcagggtt

SEQ ID NO: 8057342 - DNA, 22 bp, Homo sapiens
gcacccagggacttggctggcc

SEQ ID NO: 8057343 - DNA, 22 bp, Homo sapiens
gcacccaggcttgggcagcaac

SEQ ID NO: 8057344 - DNA, 22 bp, Homo sapiens
gcacccaggcttgggcagcaac

SEQ ID NO: 8057345 - DNA, 16 bp, Homo sapiens
gcacacacatcaatga

SEQ ID NO: 8057346 - DNA, 22 bp, Homo sapiens
gcacacacatgtgagtacatgc

SEQ ID NO: 8057347 - DNA, 22 bp, Homo sapiens
gcacccaggcactttcctttct

SEQ ID NO: 8057348 - DNA, 22 bp, Homo sapiens
gcacccaggccggcgactgcag

SEQ ID NO: 8057349 - DNA, 22 bp, Homo sapiens
gcacctccaggggccgcccacc

SEQ ID NO: 8057350 - DNA, 22 bp, Homo sapiens
gcacctggacagtgaccctagc

SEQ ID NO: 8057351 - DNA, 22 bp, Homo sapiens
gcaccctgtcaaaatggaccaa

SEQ ID NO: 8057352 - DNA, 19 bp, Homo sapiens
gcaccctgaggtcatggcc

SEQ ID NO: 8057353 - DNA, 22 bp, Homo sapiens
gattcactcatattttacgttt

SEQ ID NO: 8057354 - DNA, 22 bp, Homo sapiens
gattctttactcagattttgtt

SEQ ID NO: 8057355 - DNA, 22 bp, Homo sapiens
gattagctaaactctcaggttc

SEQ ID NO: 8057356 - DNA, 22 bp, Homo sapiens
gattaagattacatatttaagt

SEQ ID NO: 8057357 - DNA, 22 bp, Homo sapiens
gatttacttgtgctgtttctgg

SEQ ID NO: 8057358 - DNA, 22 bp, Homo sapiens
gatttatttttaatcagcaggg

SEQ ID NO: 8057359 - DNA, 22 bp, Homo sapiens
gatttattgtccctgtcctgct

SEQ ID NO: 8057360 - DNA, 22 bp, Homo sapiens
gatttattggtctttcattggt

SEQ ID NO: 8057361 - DNA, 19 bp, Homo sapiens
gatttaaacgtggctctat

SEQ ID NO: 8057362 - DNA, 22 bp, Homo sapiens
gatgggctgtctgagcgctgtg

SEQ ID NO: 8057363 - DNA, 22 bp, Homo sapiens
gatgggcagcacagctggccaa

SEQ ID NO: 8057364 - DNA, 22 bp, Homo sapiens
gatgggaggaacctgggtccct

SEQ ID NO: 8057365 - DNA, 22 bp, Homo sapiens
gatgcattacaaaagtgattat

SEQ ID NO: 8057366 - DNA, 22 bp, Homo sapiens
gatggtgcaggtgaagtgctgg

SEQ ID NO: 8057367 - DNA, 22 bp, Homo sapiens
gatggggctggctttgagggtt

SEQ ID NO: 8057368 - DNA, 22 bp, Homo sapiens
gatgtgtccccagaggattgaa

SEQ ID NO: 8057369 - DNA, 22 bp, Homo sapiens
gatgtgtccctttcaactcaga

SEQ ID NO: 8057370 - DNA, 22 bp, Homo sapiens
gatgtgtcctagtacgggtggg

SEQ ID NO: 8057371 - DNA, 22 bp, Homo sapiens
gatgtgtctggctcccctgcaa

SEQ ID NO: 8057372 - DNA, 22 bp, Homo sapiens
gatgtgtctccgtttcaaggca

SEQ ID NO: 8057373 - DNA, 22 bp, Homo sapiens
gatgtgtctattcaacatgaaa

SEQ ID NO: 8057374 - DNA, 22 bp, Homo sapiens
gatgtgtctccatacaccaccc

SEQ ID NO: 8057375 - DNA, 22 bp, Homo sapiens
gatgtgtccttttctccatcca

SEQ ID NO: 8057376 - DNA, 20 bp, Homo sapiens
gatgtgtcctcagcagtggt

SEQ ID NO: 8057377 - DNA, 22 bp, Homo sapiens
gcagtggggaatgctggggaga

SEQ ID NO: 8057378 - DNA, 22 bp, Homo sapiens
gcagtgtcagtgcctgggtggt

SEQ ID NO: 8057379 - DNA, 22 bp, Homo sapiens
gcaggtgtcttcagcaggatga

SEQ ID NO: 8057380 - DNA, 22 bp, Homo sapiens
gcaggtgtctgactgccttctt

SEQ ID NO: 8057381 - DNA, 22 bp, Homo sapiens
gcaggtgtcagtccccaaggtg

SEQ ID NO: 8057382 - DNA, 22 bp, Homo sapiens
gcaggtgtcctgggctggcagt

SEQ ID NO: 8057383 - DNA, 22 bp, Homo sapiens
gcaggtgtgctgaattacgtga

SEQ ID NO: 8057384 - DNA, 22 bp, Homo sapiens
gcaggtgtgaatgtgaattaag

SEQ ID NO: 8057385 - DNA, 19 bp, Homo sapiens
gcaggtgtgaatccgtaga

SEQ ID NO: 8057386 - DNA, 22 bp, Homo sapiens
gcaggtgtcttcatggaactct

SEQ ID NO: 8057387 - DNA, 22 bp, Homo sapiens
gcagtgggcaacaagagctgga

SEQ ID NO: 8057388 - DNA, 22 bp, Homo sapiens
gcagggtggatggcagggccag

SEQ ID NO: 8057389 - DNA, 22 bp, Homo sapiens
gcaggtgggagccgctgcctga

SEQ ID NO: 8057390 - DNA, 22 bp, Homo sapiens
gcaggtgggagccgctgcctga

SEQ ID NO: 8057391 - DNA, 22 bp, Homo sapiens
gcaggtggcagaggtgggatct

SEQ ID NO: 8057392 - DNA, 19 bp, Homo sapiens
gcaggtggatgtggtcagc

SEQ ID NO: 8057393 - DNA, 22 bp, Homo sapiens
gcaggtggagcagtagtctggt

SEQ ID NO: 8057394 - DNA, 22 bp, Homo sapiens
gcaggtggattatcagaagtgc

SEQ ID NO: 8057395 - DNA, 16 bp, Homo sapiens
gcaggtggggcgcgca

SEQ ID NO: 8057396 - DNA, 22 bp, Homo sapiens
gcaggtggggctgctaccagaa

SEQ ID NO: 8057397 - DNA, 22 bp, Homo sapiens
gcaggtgggggagaagttgtga

SEQ ID NO: 8057398 - DNA, 22 bp, Homo sapiens
gcaggtggggctgctaccagaa

SEQ ID NO: 8057399 - DNA, 22 bp, Homo sapiens
gcaggtggtcactcatccccag

SEQ ID NO: 8057400 - DNA, 22 bp, Homo sapiens
gcaggtgggggtcggtgcatct

SEQ ID NO: 8057401 - DNA, 22 bp, Homo sapiens
gcaggtgggggtcggtgcatct

SEQ ID NO: 8057402 - DNA, 22 bp, Homo sapiens
gcaggtgggggtcggtgcatct

SEQ ID NO: 8057403 - DNA, 22 bp, Homo sapiens
gcaggtggttaaggtcccatgt

SEQ ID NO: 8057404 - DNA, 22 bp, Homo sapiens
gcaggtggttaaggtcccatgt

SEQ ID NO: 8057405 - DNA, 22 bp, Homo sapiens
gcaggtggtgggggagccgttc

SEQ ID NO: 8057406 - DNA, 22 bp, Homo sapiens
gcaggtggttaaggtcccatgt

SEQ ID NO: 8057407 - DNA, 23 bp, Homo sapiens
gcaggtggttcgaacagaagttt

SEQ ID NO: 8057408 - DNA, 22 bp, Homo sapiens
gcaggtggtgggggagccgttc

SEQ ID NO: 8057409 - DNA, 22 bp, Homo sapiens
gcaggtggtggggctatgatct

SEQ ID NO: 8057410 - DNA, 22 bp, Homo sapiens
gcaggtggtggcgcgcgccctg

SEQ ID NO: 8057411 - DNA, 22 bp, Homo sapiens
gcaggtggtggcgcgcgccctg

SEQ ID NO: 8057412 - DNA, 22 bp, Homo sapiens
gcaggtggtccccgtggagtgg

SEQ ID NO: 8057413 - DNA, 22 bp, Homo sapiens
gcatgtgtctttatagcagcat

SEQ ID NO: 8057414 - DNA, 22 bp, Homo sapiens
gcatgtgtgagaccttttagca

SEQ ID NO: 8057415 - DNA, 22 bp, Homo sapiens
gcatgtgtccctcagtctgtgc

SEQ ID NO: 8057416 - DNA, 22 bp, Homo sapiens
gcatgtgtctccccagtggagg

SEQ ID NO: 8057417 - DNA, 22 bp, Homo sapiens
gcatgtgtggaggagatgtgct

SEQ ID NO: 8057418 - DNA, 21 bp, Homo sapiens
gcatgtgtgggactggatcct

SEQ ID NO: 8057419 - DNA, 21 bp, Homo sapiens
gcatgtgtggtgtgctccaca

SEQ ID NO: 8057420 - DNA, 22 bp, Homo sapiens
gcatgtgtgtcactttcctgcc

SEQ ID NO: 8057421 - DNA, 22 bp, Homo sapiens
gcatgtgtcatctgcctttcgt

SEQ ID NO: 8057422 - DNA, 20 bp, Homo sapiens
gcatgtgtatggaaggggga

SEQ ID NO: 8057423 - DNA, 22 bp, Homo sapiens
gcatgtgtatggtaggaatatt

SEQ ID NO: 8057424 - DNA, 15 bp, Homo sapiens
gcatgtgtaataggc

SEQ ID NO: 8057425 - DNA, 22 bp, Homo sapiens
gcatgtggtgctgaggctgtcg

SEQ ID NO: 8057426 - DNA, 22 bp, Homo sapiens
gcatgtggccttcaggctggaa

SEQ ID NO: 8057427 - DNA, 22 bp, Homo sapiens
gcatgggctttctcagagttct

SEQ ID NO: 8057428 - DNA, 22 bp, Homo sapiens
gcatgggcaagaggactggggg

SEQ ID NO: 8057429 - DNA, 22 bp, Homo sapiens
gcatggcttctgccaggcacct

SEQ ID NO: 8057430 - DNA, 22 bp, Homo sapiens
gcatgtgttattttatgtatga

SEQ ID NO: 8057431 - DNA, 22 bp, Homo sapiens
gcatgtgttatttctctgtggg

SEQ ID NO: 8057432 - DNA, 22 bp, Homo sapiens
gcatgtgttagagtgtgcatgc

SEQ ID NO: 8057433 - DNA, 22 bp, Homo sapiens
gcatgtgttcttgaaaggccac

SEQ ID NO: 8057434 - DNA, 22 bp, Homo sapiens
gcatgtgttggtttatgcatgt

SEQ ID NO: 8057435 - DNA, 22 bp, Homo sapiens
gccacagcagggccctctcagg

SEQ ID NO: 8057436 - DNA, 22 bp, Homo sapiens
gccacagcaacaataatgcagc

SEQ ID NO: 8057437 - DNA, 22 bp, Homo sapiens
gccacactgcttctttgagcct

SEQ ID NO: 8057438 - DNA, 22 bp, Homo sapiens
gccacagcccgagcaccatgag

SEQ ID NO: 8057439 - DNA, 22 bp, Homo sapiens
gccagcagcccagaaggacttt

SEQ ID NO: 8057440 - DNA, 22 bp, Homo sapiens
gccagcagctgtggggtggcca

SEQ ID NO: 8057441 - DNA, 22 bp, Homo sapiens
gccagcagctcttgggcgggca

SEQ ID NO: 8057442 - DNA, 22 bp, Homo sapiens
gccagcagggaagccttgggct

SEQ ID NO: 8057443 - DNA, 19 bp, Homo sapiens
gccagcacccagctgtgtc

SEQ ID NO: 8057444 - DNA, 22 bp, Homo sapiens
gccagcaaagcaagttgtcagc

SEQ ID NO: 8057445 - DNA, 19 bp, Homo sapiens
gccagcagaatgatgaggc

SEQ ID NO: 8057446 - DNA, 22 bp, Homo sapiens
gccagcagccacagaagtcact

SEQ ID NO: 8057447 - DNA, 22 bp, Homo sapiens
gccagcagccacagaagtcact

SEQ ID NO: 8057448 - DNA, 22 bp, Homo sapiens
gccacaggctccagcatcagta

SEQ ID NO: 8057449 - DNA, 22 bp, Homo sapiens
gccacaggctccagcatcagta

SEQ ID NO: 8057450 - DNA, 20 bp, Homo sapiens
gccagaggccggcaggggct

SEQ ID NO: 8057451 - DNA, 22 bp, Homo sapiens
gccagatgccgtaaagatgggc

SEQ ID NO: 8057452 - DNA, 22 bp, Homo sapiens
gccagatgtagatagcaaggta

SEQ ID NO: 8057453 - DNA, 22 bp, Homo sapiens
gccacaggcacttaagggctgg

SEQ ID NO: 8057454 - DNA, 22 bp, Homo sapiens
gccacagcttagatcacagcct

SEQ ID NO: 8057455 - DNA, 22 bp, Homo sapiens
gccacagcggggccgctagagc

SEQ ID NO: 8057456 - DNA, 22 bp, Homo sapiens
gcaggcagagaaggaacattta

SEQ ID NO: 8057457 - DNA, 22 bp, Homo sapiens
gcaggcactcctaggaccatca

SEQ ID NO: 8057458 - DNA, 21 bp, Homo sapiens
gcaggcactctagaggagctg

SEQ ID NO: 8057459 - DNA, 21 bp, Homo sapiens
gcaggcactctagaggagctg

SEQ ID NO: 8057460 - DNA, 21 bp, Homo sapiens
gcaggcactctagaggagctg

SEQ ID NO: 8057461 - DNA, 17 bp, Homo sapiens
gcaggcactgctgcctg

SEQ ID NO: 8057462 - DNA, 17 bp, Homo sapiens
gcaggcactgctgcctg

SEQ ID NO: 8057463 - DNA, 22 bp, Homo sapiens
gcaggctggaggctgttctggg

SEQ ID NO: 8057464 - DNA, 22 bp, Homo sapiens
gcaggcagaggtggaggagaca

SEQ ID NO: 8057465 - DNA, 22 bp, Homo sapiens
gcaggctgccctcttgtgttga

SEQ ID NO: 8057466 - DNA, 22 bp, Homo sapiens
gcaggctgccctcttgtgttga

SEQ ID NO: 8057467 - DNA, 22 bp, Homo sapiens
gcaggcagaggtggaggagaca

SEQ ID NO: 8057468 - DNA, 22 bp, Homo sapiens
gcaggcttcaagcacagctttt

SEQ ID NO: 8057469 - DNA, 22 bp, Homo sapiens
gcaggctggtctgaccatccct

SEQ ID NO: 8057470 - DNA, 22 bp, Homo sapiens
gcagggcacagacagtgccaag

SEQ ID NO: 8057471 - DNA, 22 bp, Homo sapiens
gcagggcagaaggtgctgagga

SEQ ID NO: 8057472 - DNA, 22 bp, Homo sapiens
gcagggcagaaggtgctgagga

SEQ ID NO: 8057473 - DNA, 22 bp, Homo sapiens
gcagggcagagggagaatctct

SEQ ID NO: 8057474 - DNA, 22 bp, Homo sapiens
gcagggcagacctccagcctat

SEQ ID NO: 8057475 - DNA, 22 bp, Homo sapiens
gcagggcagacctccagcctat

SEQ ID NO: 8057476 - DNA, 22 bp, Homo sapiens
gcagggcacacaagaatgataa

SEQ ID NO: 8057477 - DNA, 22 bp, Homo sapiens
gcagggcaatgatcccgagagg

SEQ ID NO: 8057478 - DNA, 22 bp, Homo sapiens
gcagggcacaaggacgcacagg

SEQ ID NO: 8057479 - DNA, 20 bp, Homo sapiens
gcagggcaagggatatgaaa

SEQ ID NO: 8057480 - DNA, 22 bp, Homo sapiens
gcagggcaaatgtggaaaggag

SEQ ID NO: 8057481 - DNA, 22 bp, Homo sapiens
gcagggcaaatgtggaaaggag

SEQ ID NO: 8057482 - DNA, 22 bp, Homo sapiens
gcagggcaaatgtggaaaggag

SEQ ID NO: 8057483 - DNA, 22 bp, Homo sapiens
gcaggggctgctgggaactcgg

SEQ ID NO: 8057484 - DNA, 22 bp, Homo sapiens
gcaggggctgagcaccagcggg

SEQ ID NO: 8057485 - DNA, 22 bp, Homo sapiens
gcagggtgacgttgcccacctc

SEQ ID NO: 8057486 - DNA, 22 bp, Homo sapiens
gcagggggtcattcacgctggc

SEQ ID NO: 8057487 - DNA, 22 bp, Homo sapiens
gcagggggatggagttgaaatg

SEQ ID NO: 8057488 - DNA, 22 bp, Homo sapiens
gcaggggctactctgagcttcc

SEQ ID NO: 8057489 - DNA, 22 bp, Homo sapiens
gcaggggcaggagatctcaggc

SEQ ID NO: 8057490 - DNA, 22 bp, Homo sapiens
gcagggcagccacaggccccct

SEQ ID NO: 8057491 - DNA, 22 bp, Homo sapiens
gcagggcagccacaggccccct

SEQ ID NO: 8057492 - DNA, 21 bp, Homo sapiens
gcaggggatagaaatggtctg

SEQ ID NO: 8057493 - DNA, 22 bp, Homo sapiens
gcaggagactggctgtggtagt

SEQ ID NO: 8057494 - DNA, 22 bp, Homo sapiens
gcaggagaacaaagcaagctgc

SEQ ID NO: 8057495 - DNA, 22 bp, Homo sapiens
gcaggacaggcgttggtccagt

SEQ ID NO: 8057496 - DNA, 22 bp, Homo sapiens
gcaggacctggcagatggggca

SEQ ID NO: 8057497 - DNA, 22 bp, Homo sapiens
gcaggacctctggatgcaatgc

SEQ ID NO: 8057498 - DNA, 22 bp, Homo sapiens
gcaggacttgaatccaggcagt

SEQ ID NO: 8057499 - DNA, 22 bp, Homo sapiens
gcaggaccaggcacgagggcca

SEQ ID NO: 8057500 - DNA, 22 bp, Homo sapiens
gcaggagctcgtttccaggctg

SEQ ID NO: 8057501 - DNA, 22 bp, Homo sapiens
gcaggagctcgtttccaggctg

SEQ ID NO: 8057502 - DNA, 22 bp, Homo sapiens
gcaggagctgctctcctgacga

SEQ ID NO: 8057503 - DNA, 22 bp, Homo sapiens
gcaggagctgctctcctgacga

SEQ ID NO: 8057504 - DNA, 22 bp, Homo sapiens
gcaggagccagggattccagga

SEQ ID NO: 8057505 - DNA, 22 bp, Homo sapiens
gcaggagccaggccgagctggt

SEQ ID NO: 8057506 - DNA, 22 bp, Homo sapiens
gcaggcaccgcggcggcaggtt

SEQ ID NO: 8057507 - DNA, 22 bp, Homo sapiens
gcaggcacatgggcgggtctgg

SEQ ID NO: 8057508 - DNA, 19 bp, Homo sapiens
gcaggcacagccctgggtg

SEQ ID NO: 8057509 - DNA, 22 bp, Homo sapiens
gcagctcctggcacagtttttt

SEQ ID NO: 8057510 - DNA, 22 bp, Homo sapiens
gcagagcctgtgtctgagcaaa

SEQ ID NO: 8057511 - DNA, 22 bp, Homo sapiens
gcagagcctgtgtctgagcaaa

SEQ ID NO: 8057512 - DNA, 22 bp, Homo sapiens
gcagagcctgggggtctgcgga

SEQ ID NO: 8057513 - DNA, 22 bp, Homo sapiens
gcagagcctgggggtctgcgga

SEQ ID NO: 8057514 - DNA, 21 bp, Homo sapiens
gcagagccggggcgagaaggc

SEQ ID NO: 8057515 - DNA, 21 bp, Homo sapiens
gcagagccggggcgagaaggc

SEQ ID NO: 8057516 - DNA, 20 bp, Homo sapiens
gcagagcctcactgcaaggg

SEQ ID NO: 8057517 - DNA, 20 bp, Homo sapiens
gcagagcctcactgcaaggg

SEQ ID NO: 8057518 - DNA, 22 bp, Homo sapiens
gcagcgtggggctgagtcagct

SEQ ID NO: 8057519 - DNA, 19 bp, Homo sapiens
gccgggcccgggttggccg

SEQ ID NO: 8057520 - DNA, 22 bp, Homo sapiens
gccggggctggggagagacatg

SEQ ID NO: 8057521 - DNA, 22 bp, Homo sapiens
gccggggctggggagagacatg

SEQ ID NO: 8057522 - DNA, 22 bp, Homo sapiens
gcctctgcaccagtactgtgcc

SEQ ID NO: 8057523 - DNA, 22 bp, Homo sapiens
gcctctgcactgtggcacacca

SEQ ID NO: 8057524 - DNA, 22 bp, Homo sapiens
gcctctgcccatccaccatcag

SEQ ID NO: 8057525 - DNA, 19 bp, Homo sapiens
gcctctgctggggacaggc

SEQ ID NO: 8057526 - DNA, 22 bp, Homo sapiens
gccctctggcacagagatgcag

SEQ ID NO: 8057527 - DNA, 22 bp, Homo sapiens
gccctctgcacagctctgagca

SEQ ID NO: 8057528 - DNA, 22 bp, Homo sapiens
gcccttccaacccagagggcaa

SEQ ID NO: 8057529 - DNA, 22 bp, Homo sapiens
gcccttccttagacagcaggat

SEQ ID NO: 8057530 - DNA, 22 bp, Homo sapiens
gcccttggaaagccaaggcagc

SEQ ID NO: 8057531 - DNA, 22 bp, Homo sapiens
gccctcgcttcttcctaggggt

SEQ ID NO: 8057532 - DNA, 22 bp, Homo sapiens
gccaggctgtttttattactgt

SEQ ID NO: 8057533 - DNA, 22 bp, Homo sapiens
gccagggaaactgcagaccagc

SEQ ID NO: 8057534 - DNA, 22 bp, Homo sapiens
gccaggctggtgtcacaactct

SEQ ID NO: 8057535 - DNA, 22 bp, Homo sapiens
gccaggctgctccagggaggcc

SEQ ID NO: 8057536 - DNA, 22 bp, Homo sapiens
gccaggctgctggctgctgtcc

SEQ ID NO: 8057537 - DNA, 22 bp, Homo sapiens
gccaggctgctggctgctgtcc

SEQ ID NO: 8057538 - DNA, 20 bp, Homo sapiens
gcccaggatctctgaggcat

SEQ ID NO: 8057539 - DNA, 20 bp, Homo sapiens
gcccaggatctctgaggcat

SEQ ID NO: 8057540 - DNA, 22 bp, Homo sapiens
gcccaggatggagaatagtggt

SEQ ID NO: 8057541 - DNA, 22 bp, Homo sapiens
gcccaggctagcgtagagtgca

SEQ ID NO: 8057542 - DNA, 22 bp, Homo sapiens
gcccaggctggagtgcagtggc

SEQ ID NO: 8057543 - DNA, 22 bp, Homo sapiens
gccatcatatcccctgtgacct

SEQ ID NO: 8057544 - DNA, 22 bp, Homo sapiens
gccatgggcaaatgcagagctg

SEQ ID NO: 8057545 - DNA, 23 bp, Homo sapiens
gccatggctgccccacaggcctc

SEQ ID NO: 8057546 - DNA, 19 bp, Homo sapiens
gccatgggctggcagcaga

SEQ ID NO: 8057547 - DNA, 22 bp, Homo sapiens
gccatggggctcagctgcacta

SEQ ID NO: 8057548 - DNA, 22 bp, Homo sapiens
gccatggggagggcagcgcctg

SEQ ID NO: 8057549 - DNA, 22 bp, Homo sapiens
gccatgggtctgctggctcagc

SEQ ID NO: 8057550 - DNA, 22 bp, Homo sapiens
gcccaggaggtcaagtagctat

SEQ ID NO: 8057551 - DNA, 22 bp, Homo sapiens
gcccaggagttggaggctgcag

SEQ ID NO: 8057552 - DNA, 21 bp, Homo sapiens
gccatttcacacagacatttg

SEQ ID NO: 8057553 - DNA, 22 bp, Homo sapiens
gcctggcaggggcctgggagtg

SEQ ID NO: 8057554 - DNA, 21 bp, Homo sapiens
gcctggcaggtggaagggctc

SEQ ID NO: 8057555 - DNA, 22 bp, Homo sapiens
gcctggcagtggggccctggga

SEQ ID NO: 8057556 - DNA, 22 bp, Homo sapiens
gcctggcagtgatgtcttttgg

SEQ ID NO: 8057557 - DNA, 22 bp, Homo sapiens
gcctggcattacagcactcctg

SEQ ID NO: 8057558 - DNA, 22 bp, Homo sapiens
gcctggcatatagtagttgtgc

SEQ ID NO: 8057559 - DNA, 22 bp, Homo sapiens
gcctggcattggagccggggca

SEQ ID NO: 8057560 - DNA, 22 bp, Homo sapiens
gcctggcagtgtaattcctgtc

SEQ ID NO: 8057561 - DNA, 22 bp, Homo sapiens
gcctggcagttgacagtttgct

SEQ ID NO: 8057562 - DNA, 19 bp, Homo sapiens
gcctggcagtgtacaaggc

SEQ ID NO: 8057563 - DNA, 22 bp, Homo sapiens
gcctggcaggcctgttggggct

SEQ ID NO: 8057564 - DNA, 22 bp, Homo sapiens
gcctggcaggcctgttggggct

SEQ ID NO: 8057565 - DNA, 22 bp, Homo sapiens
gcctggcagggagattgtaaga

SEQ ID NO: 8057566 - DNA, 22 bp, Homo sapiens
gcctggcagggcccggacggca

SEQ ID NO: 8057567 - DNA, 22 bp, Homo sapiens
gcctggcaggcctgggccagca

SEQ ID NO: 8057568 - DNA, 22 bp, Homo sapiens
gcctggcaggcctgggccagca

SEQ ID NO: 8057569 - DNA, 22 bp, Homo sapiens
gcctggagtagcatggcaagcc

SEQ ID NO: 8057570 - DNA, 22 bp, Homo sapiens
gcctggagtagcatggcaagcc

SEQ ID NO: 8057571 - DNA, 22 bp, Homo sapiens
gcctggagtactccttgaagtg

SEQ ID NO: 8057572 - DNA, 22 bp, Homo sapiens
gcctggagggttgaggttttgt

SEQ ID NO: 8057573 - DNA, 22 bp, Homo sapiens
gcctggagtactccttgaagtg

SEQ ID NO: 8057574 - DNA, 22 bp, Homo sapiens
gcctggccgctccgagctccgc

SEQ ID NO: 8057575 - DNA, 21 bp, Homo sapiens
gcctgggaaatctgggaagcc

SEQ ID NO: 8057576 - DNA, 22 bp, Homo sapiens
gcctgggaaagagtagggaaat

SEQ ID NO: 8057577 - DNA, 22 bp, Homo sapiens
gcctgggaactctgatctcctg

SEQ ID NO: 8057578 - DNA, 22 bp, Homo sapiens
gcctggctaagcagaaggaccc

SEQ ID NO: 8057579 - DNA, 22 bp, Homo sapiens
gcctggcctgaactaggaggtg

SEQ ID NO: 8057580 - DNA, 22 bp, Homo sapiens
gcctgggagaatgacctccaac

SEQ ID NO: 8057581 - DNA, 22 bp, Homo sapiens
gcctgggatagaggcaatgcat

SEQ ID NO: 8057582 - DNA, 19 bp, Homo sapiens
gcctgggatgggcagaact

SEQ ID NO: 8057583 - DNA, 21 bp, Homo sapiens
gcctgggatagtggcctccgg

SEQ ID NO: 8057584 - DNA, 23 bp, Homo sapiens
gcctgggactcaggaggagctca

SEQ ID NO: 8057585 - DNA, 21 bp, Homo sapiens
gcctgtggagcccaagggccc

SEQ ID NO: 8057586 - DNA, 22 bp, Homo sapiens
gcctggtgtctccccaaggaag

SEQ ID NO: 8057587 - DNA, 22 bp, Homo sapiens
gcctgcctgttggctgaggtgc

SEQ ID NO: 8057588 - DNA, 20 bp, Homo sapiens
gcctgcctcagctagctgag

SEQ ID NO: 8057589 - DNA, 22 bp, Homo sapiens
gcctgccagccacagtggcagc

SEQ ID NO: 8057590 - DNA, 23 bp, Homo sapiens
gcctgccatatacctggaaacag

SEQ ID NO: 8057591 - DNA, 22 bp, Homo sapiens
gcctgccacgcatgcagagtca

SEQ ID NO: 8057592 - DNA, 22 bp, Homo sapiens
gcctggaaattgaggcacagtt

SEQ ID NO: 8057593 - DNA, 22 bp, Homo sapiens
gcctggaaattgaggcacagtt

SEQ ID NO: 8057594 - DNA, 22 bp, Homo sapiens
gcctggaagtccagagtacatt

SEQ ID NO: 8057595 - DNA, 22 bp, Homo sapiens
gcctggaatgcaatgtgacgaa

SEQ ID NO: 8057596 - DNA, 22 bp, Homo sapiens
gcctggaatcatgcaggggtta

SEQ ID NO: 8057597 - DNA, 22 bp, Homo sapiens
gcctggaagtgtgtcgtgggaa

SEQ ID NO: 8057598 - DNA, 22 bp, Homo sapiens
gcctggaaacagtgagcgaagg

SEQ ID NO: 8057599 - DNA, 22 bp, Homo sapiens
gcctggagggctctagagaggc

SEQ ID NO: 8057600 - DNA, 22 bp, Homo sapiens
gcctggaggggacagtctctgg

SEQ ID NO: 8057601 - DNA, 22 bp, Homo sapiens
gcctggaggggccagggtggta

SEQ ID NO: 8057602 - DNA, 22 bp, Homo sapiens
gcctggaggggacagtctctgg

SEQ ID NO: 8057603 - DNA, 22 bp, Homo sapiens
gcctggagggtccctctctgga

SEQ ID NO: 8057604 - DNA, 22 bp, Homo sapiens
gcctggagggtccctctctgga

SEQ ID NO: 8057605 - DNA, 22 bp, Homo sapiens
gcctggaggggccagggtggta

SEQ ID NO: 8057606 - DNA, 22 bp, Homo sapiens
gcctggaggcgagaacccaatg

SEQ ID NO: 8057607 - DNA, 22 bp, Homo sapiens
gcctggagggctctagagaggc

SEQ ID NO: 8057608 - DNA, 22 bp, Homo sapiens
gcctggagggatagaatgcaag

SEQ ID NO: 8057609 - DNA, 20 bp, Homo sapiens
gcctggaggcagagataaag

SEQ ID NO: 8057610 - DNA, 22 bp, Homo sapiens
gcctggaggcgagaacccaatg

SEQ ID NO: 8057611 - DNA, 20 bp, Homo sapiens
gcctggaggcagagataaag

SEQ ID NO: 8057612 - DNA, 20 bp, Homo sapiens
gcctggaggcaatgggaaga

SEQ ID NO: 8057613 - DNA, 22 bp, Homo sapiens
gcctggagcctcagcaaggagg

SEQ ID NO: 8057614 - DNA, 22 bp, Homo sapiens
gcctggacaccgcccttgcaga

SEQ ID NO: 8057615 - DNA, 22 bp, Homo sapiens
gcctggagcctcagcaaggagg

SEQ ID NO: 8057616 - DNA, 22 bp, Homo sapiens
gctgctgcatgaacagcggtca

SEQ ID NO: 8057617 - DNA, 22 bp, Homo sapiens
gctgctgccgcggccgctggga

SEQ ID NO: 8057618 - DNA, 22 bp, Homo sapiens
gctgctcttttcagagatgaga

SEQ ID NO: 8057619 - DNA, 22 bp, Homo sapiens
gctgctctgggtctgcccagct

SEQ ID NO: 8057620 - DNA, 22 bp, Homo sapiens
gctgctctgtgacagcctccgg

SEQ ID NO: 8057621 - DNA, 22 bp, Homo sapiens
gctgctctgttaattgctgtaa

SEQ ID NO: 8057622 - DNA, 22 bp, Homo sapiens
gctgctcttgaggggctcactg

SEQ ID NO: 8057623 - DNA, 22 bp, Homo sapiens
gctgctctccaagcctccttga

SEQ ID NO: 8057624 - DNA, 22 bp, Homo sapiens
gctgctctcatagatggcttca

SEQ ID NO: 8057625 - DNA, 22 bp, Homo sapiens
gctgctctggctctgcagtgtc

SEQ ID NO: 8057626 - DNA, 22 bp, Homo sapiens
gctgctctgctgtgtaagcagg

SEQ ID NO: 8057627 - DNA, 19 bp, Homo sapiens
gctgctctgggtctcatct

SEQ ID NO: 8057628 - DNA, 22 bp, Homo sapiens
gctgctctcagagctcatgctg

SEQ ID NO: 8057629 - DNA, 22 bp, Homo sapiens
gctgcctgatgtccagcaggac

SEQ ID NO: 8057630 - DNA, 22 bp, Homo sapiens
gctgcctgctcggctcctggga

SEQ ID NO: 8057631 - DNA, 22 bp, Homo sapiens
gctgcctggaataacggctggc

SEQ ID NO: 8057632 - DNA, 22 bp, Homo sapiens
gctgcctggctttagtccactt

SEQ ID NO: 8057633 - DNA, 22 bp, Homo sapiens
gctgcctggagctcagcctgcc

SEQ ID NO: 8057634 - DNA, 22 bp, Homo sapiens
gctgcctggagaggcagggatg

SEQ ID NO: 8057635 - DNA, 22 bp, Homo sapiens
gctgagccacaggcagtgcact

SEQ ID NO: 8057636 - DNA, 22 bp, Homo sapiens
gctgagcccccctgcgtgggtc

SEQ ID NO: 8057637 - DNA, 22 bp, Homo sapiens
gctgagccctcatccctagttt

SEQ ID NO: 8057638 - DNA, 22 bp, Homo sapiens
gctgggcagcctggccgctgcc

SEQ ID NO: 8057639 - DNA, 22 bp, Homo sapiens
gctgggcagcccctacagagag

SEQ ID NO: 8057640 - DNA, 22 bp, Homo sapiens
gctgggcagctgaggcctctca

SEQ ID NO: 8057641 - DNA, 22 bp, Homo sapiens
gctgggcagctgaggcctctca

SEQ ID NO: 8057642 - DNA, 22 bp, Homo sapiens
gctgggcagtgagtgagtcctt

SEQ ID NO: 8057643 - DNA, 22 bp, Homo sapiens
gctgggcaggcctcgtgagggc

SEQ ID NO: 8057644 - DNA, 22 bp, Homo sapiens
gctgggcaatgccagagaggag

SEQ ID NO: 8057645 - DNA, 22 bp, Homo sapiens
gctgggcaagtgccttgggttt

SEQ ID NO: 8057646 - DNA, 22 bp, Homo sapiens
gctgggcactgtcccataggct

SEQ ID NO: 8057647 - DNA, 22 bp, Homo sapiens
gctgggagtgggcaagatgaga

SEQ ID NO: 8057648 - DNA, 22 bp, Homo sapiens
gctggcggcagtggtgtctctg

SEQ ID NO: 8057649 - DNA, 22 bp, Homo sapiens
gctgggagtttgatttgactgg

SEQ ID NO: 8057650 - DNA, 22 bp, Homo sapiens
gctggcctgacctgaggctggg

SEQ ID NO: 8057651 - DNA, 22 bp, Homo sapiens
gctggagctgcagcctgggcct

SEQ ID NO: 8057652 - DNA, 22 bp, Homo sapiens
gctggagccattggcttggcct

SEQ ID NO: 8057653 - DNA, 22 bp, Homo sapiens
gctggagccttctgctctgttg

SEQ ID NO: 8057654 - DNA, 22 bp, Homo sapiens
gctggagccaagctgctcttgg

SEQ ID NO: 8057655 - DNA, 22 bp, Homo sapiens
gctggagcgggttcgggccgct

SEQ ID NO: 8057656 - DNA, 22 bp, Homo sapiens
gctggagctgcagcctgggcct

SEQ ID NO: 8057657 - DNA, 22 bp, Homo sapiens
gctggagctgagttccctgggc

SEQ ID NO: 8057658 - DNA, 22 bp, Homo sapiens
gctggagagtgaggggagcaag

SEQ ID NO: 8057659 - DNA, 22 bp, Homo sapiens
gctggagatagtaggatccata

SEQ ID NO: 8057660 - DNA, 22 bp, Homo sapiens
gctcagagcatcccagtgaatg

SEQ ID NO: 8057661 - DNA, 22 bp, Homo sapiens
gctcatgggcccagagcagccc

SEQ ID NO: 8057662 - DNA, 22 bp, Homo sapiens
gctcagagcactcagactcagc

SEQ ID NO: 8057663 - DNA, 22 bp, Homo sapiens
gctcagagatgttcagtagctt

SEQ ID NO: 8057664 - DNA, 22 bp, Homo sapiens
gctcagaaaagtgaggctcagt

SEQ ID NO: 8057665 - DNA, 22 bp, Homo sapiens
gctcagactctggcctgatgat

SEQ ID NO: 8057666 - DNA, 19 bp, Homo sapiens
gctcagacattaagcagct

SEQ ID NO: 8057667 - DNA, 22 bp, Homo sapiens
gctcagaccccaccctggcaga

SEQ ID NO: 8057668 - DNA, 22 bp, Homo sapiens
gctccaggagctcacagctcgc

SEQ ID NO: 8057669 - DNA, 22 bp, Homo sapiens
gctcctggctctctgagggctg

SEQ ID NO: 8057670 - DNA, 22 bp, Homo sapiens
gctcctggccagcacagggccc

SEQ ID NO: 8057671 - DNA, 22 bp, Homo sapiens
gctccagcacctagagcaggtc

SEQ ID NO: 8057672 - DNA, 22 bp, Homo sapiens
gctccaaggtatccaccagggt

SEQ ID NO: 8057673 - DNA, 22 bp, Homo sapiens
gctcctgggccctgggctaact

SEQ ID NO: 8057674 - DNA, 22 bp, Homo sapiens
gctctctttccatgtggaggat

SEQ ID NO: 8057675 - DNA, 22 bp, Homo sapiens
gctctgagcccccagaagcaga

SEQ ID NO: 8057676 - DNA, 23 bp, Homo sapiens
gctctgccacttaatagctgtgt

SEQ ID NO: 8057677 - DNA, 21 bp, Homo sapiens
gctctgccacttaccagattt

SEQ ID NO: 8057678 - DNA, 22 bp, Homo sapiens
gctctgaggctgggagcactct

SEQ ID NO: 8057679 - DNA, 22 bp, Homo sapiens
gctcttggaagacaggatgtgt

SEQ ID NO: 8057680 - DNA, 22 bp, Homo sapiens
gctctgtgttccctccaggctc

SEQ ID NO: 8057681 - DNA, 20 bp, Homo sapiens
gctctgccacttagaagctg

SEQ ID NO: 8057682 - DNA, 17 bp, Homo sapiens
gctctgccaggaaagag

SEQ ID NO: 8057683 - DNA, 22 bp, Homo sapiens
gctctgtttatccctgacaatt

SEQ ID NO: 8057684 - DNA, 22 bp, Homo sapiens
gctctgttgtctctgaattgca

SEQ ID NO: 8057685 - DNA, 22 bp, Homo sapiens
gctctgtgttgtcagaggcacc

SEQ ID NO: 8057686 - DNA, 22 bp, Homo sapiens
gctcttatattgacatcatgct

SEQ ID NO: 8057687 - DNA, 22 bp, Homo sapiens
gctcttatagtcccagcatgtt

SEQ ID NO: 8057688 - DNA, 22 bp, Homo sapiens
ctcatattcagtcactgatgca

SEQ ID NO: 8057689 - DNA, 22 bp, Homo sapiens
ctcatattgctggtggtctaag

SEQ ID NO: 8057690 - DNA, 22 bp, Homo sapiens
ctcatcaccacatataacaaag

SEQ ID NO: 8057691 - DNA, 22 bp, Homo sapiens
ctcatctcccacctgcgtgcag

SEQ ID NO: 8057692 - DNA, 22 bp, Homo sapiens
ttgggcagggaaaggacaggca

SEQ ID NO: 8057693 - DNA, 22 bp, Homo sapiens
ctcagtgctttggatcctggat

SEQ ID NO: 8057694 - DNA, 22 bp, Homo sapiens
ttgcttttaatctttgtacatc

SEQ ID NO: 8057695 - DNA, 22 bp, Homo sapiens
ttgcttttaatctttgtacatc

SEQ ID NO: 8057696 - DNA, 17 bp, Homo sapiens
ttgcttttgaaattgtc

SEQ ID NO: 8057697 - DNA, 22 bp, Homo sapiens
ttgtatttgattgtcatatcgt

SEQ ID NO: 8057698 - DNA, 22 bp, Homo sapiens
ctccaggtagctaagtcctggg

SEQ ID NO: 8057699 - DNA, 22 bp, Homo sapiens
ttgttaaatggatgcagaataa

SEQ ID NO: 8057700 - DNA, 22 bp, Homo sapiens
ttgtattttgttatgctactgc

SEQ ID NO: 8057701 - DNA, 22 bp, Homo sapiens
ctccagtctagtagagcctgct

SEQ ID NO: 8057702 - DNA, 22 bp, Homo sapiens
ctccaggttacttagcctagct

SEQ ID NO: 8057703 - DNA, 19 bp, Homo sapiens
ctctccagctccagtagct

SEQ ID NO: 8057704 - DNA, 22 bp, Homo sapiens
ctctccagcagatgtagtctgt

SEQ ID NO: 8057705 - DNA, 22 bp, Homo sapiens
ctctccagatctgctgagccag

SEQ ID NO: 8057706 - DNA, 22 bp, Homo sapiens
ctctcctccaacagccctgccg

SEQ ID NO: 8057707 - DNA, 22 bp, Homo sapiens
ctctccctggccagctgtgcag

SEQ ID NO: 8057708 - DNA, 22 bp, Homo sapiens
ctctccctatgcctcccaggag

SEQ ID NO: 8057709 - DNA, 22 bp, Homo sapiens
ctctccctatgcctcccaggag

SEQ ID NO: 8057710 - DNA, 22 bp, Homo sapiens
ctctccctaggttagcggtcag

SEQ ID NO: 8057711 - DNA, 22 bp, Homo sapiens
ctcctctgtctaccacgagggt

SEQ ID NO: 8057712 - DNA, 22 bp, Homo sapiens
ctcctctgtattgattgggact

SEQ ID NO: 8057713 - DNA, 22 bp, Homo sapiens
ctcctctgggtcctggtggcca

SEQ ID NO: 8057714 - DNA, 22 bp, Homo sapiens
ctcctctgtctggccctgagcc

SEQ ID NO: 8057715 - DNA, 22 bp, Homo sapiens
ctcctctgtctaccacgagggt

SEQ ID NO: 8057716 - DNA, 22 bp, Homo sapiens
ctcctctttagccccagctgga

SEQ ID NO: 8057717 - DNA, 22 bp, Homo sapiens
ctcctgagaggatctctgttgt

SEQ ID NO: 8057718 - DNA, 16 bp, Homo sapiens
ctcctctccttcagga

SEQ ID NO: 8057719 - DNA, 22 bp, Homo sapiens
ctcctctggcttcctggaggca

SEQ ID NO: 8057720 - DNA, 22 bp, Homo sapiens
ctcctctggcttcctggaggca

SEQ ID NO: 8057721 - DNA, 22 bp, Homo sapiens
tttagacatagctgaaatcatt

SEQ ID NO: 8057722 - DNA, 22 bp, Homo sapiens
tttacagttaagaaatgttacc

SEQ ID NO: 8057723 - DNA, 22 bp, Homo sapiens
tttacacatacctctttaaagt

SEQ ID NO: 8057724 - DNA, 22 bp, Homo sapiens
tttaacagatgctatgtctacc

SEQ ID NO: 8057725 - DNA, 22 bp, Homo sapiens
tttacatgtaatgttatacaaa

SEQ ID NO: 8057726 - DNA, 22 bp, Homo sapiens
tttaaaaggcagcttcttttgt

SEQ ID NO: 8057727 - DNA, 22 bp, Homo sapiens
tttaacagatgaggaggtgagg

SEQ ID NO: 8057728 - DNA, 22 bp, Homo sapiens
tttaaatttagaagaaacactg

SEQ ID NO: 8057729 - DNA, 22 bp, Homo sapiens
ttcctttctctggactgcagcc

SEQ ID NO: 8057730 - DNA, 22 bp, Homo sapiens
ctagcccaggaatgccgtggcc

SEQ ID NO: 8057731 - DNA, 20 bp, Homo sapiens
ctaggcagcgagtgactgag

SEQ ID NO: 8057732 - DNA, 20 bp, Homo sapiens
ttccttttcgcctctctccc

SEQ ID NO: 8057733 - DNA, 22 bp, Homo sapiens
ctagggagcactagctgccttg

SEQ ID NO: 8057734 - DNA, 22 bp, Homo sapiens
ctaggccttcataggcatggaa

SEQ ID NO: 8057735 - DNA, 23 bp, Homo sapiens
ctaggcaggattgtaggcgggta

SEQ ID NO: 8057736 - DNA, 22 bp, Homo sapiens
ctaggcagctttgggtgtgaag

SEQ ID NO: 8057737 - DNA, 22 bp, Homo sapiens
ttctgtatattgtaaagactca

SEQ ID NO: 8057738 - DNA, 22 bp, Homo sapiens
ttctgtatacgttacaattgag

SEQ ID NO: 8057739 - DNA, 22 bp, Homo sapiens
ttctgtatctttcttcaagatt

SEQ ID NO: 8057740 - DNA, 22 bp, Homo sapiens
ttctgtatttagtttgaggaca

SEQ ID NO: 8057741 - DNA, 22 bp, Homo sapiens
ttcttcctcacactctcaccca

SEQ ID NO: 8057742 - DNA, 22 bp, Homo sapiens
ttctgtcacttgcaatcaagag

SEQ ID NO: 8057743 - DNA, 22 bp, Homo sapiens
ttctgtcacagtgctggtatca

SEQ ID NO: 8057744 - DNA, 22 bp, Homo sapiens
ctatttttctgtaccctaattt

SEQ ID NO: 8057745 - DNA, 22 bp, Homo sapiens
ctcagcaccccgacaggacatt

SEQ ID NO: 8057746 - DNA, 22 bp, Homo sapiens
ctcagcaggcactgtgccttac

SEQ ID NO: 8057747 - DNA, 17 bp, Homo sapiens
ctcagcagggctcactt

SEQ ID NO: 8057748 - DNA, 22 bp, Homo sapiens
ctcagcaggtaccacatgatct

SEQ ID NO: 8057749 - DNA, 22 bp, Homo sapiens
ctcagcagctgctgctggtggg

SEQ ID NO: 8057750 - DNA, 20 bp, Homo sapiens
ctcagcagattcttctagaa

SEQ ID NO: 8057751 - DNA, 22 bp, Homo sapiens
ttcttgtttattaagatataaa

SEQ ID NO: 8057752 - DNA, 22 bp, Homo sapiens
ttcttgttttgcccaagttgta

SEQ ID NO: 8057753 - DNA, 22 bp, Homo sapiens
ttcttgtctttgttatgtagga

SEQ ID NO: 8057754 - DNA, 22 bp, Homo sapiens
ttcttgttctcctcatttagag

SEQ ID NO: 8057755 - DNA, 22 bp, Homo sapiens
ttcttgttctggttctgttagc

SEQ ID NO: 8057756 - DNA, 22 bp, Homo sapiens
ttgactttatgtcaacttgcct

SEQ ID NO: 8057757 - DNA, 22 bp, Homo sapiens
ttgactttatgtcaacttgcct

SEQ ID NO: 8057758 - DNA, 23 bp, Homo sapiens
cggctgctcggccgagtcctcgg

SEQ ID NO: 8057759 - DNA, 22 bp, Homo sapiens
cggctgcttctgagccccggcg

SEQ ID NO: 8057760 - DNA, 22 bp, Homo sapiens
cggctgctgcctgagtcgctgt

SEQ ID NO: 8057761 - DNA, 22 bp, Homo sapiens
cggctggggctgtccccatgac

SEQ ID NO: 8057762 - DNA, 22 bp, Homo sapiens
cggctgggtagaggtgccgggt

SEQ ID NO: 8057763 - DNA, 22 bp, Homo sapiens
ttcagaaaaaacttcaataagt

SEQ ID NO: 8057764 - DNA, 22 bp, Homo sapiens
ttcagaaaaagaccattgcaat

SEQ ID NO: 8057765 - DNA, 22 bp, Homo sapiens
cgctgggcgccgacctgctggc

SEQ ID NO: 8057766 - DNA, 22 bp, Homo sapiens
cgctgggggaacttcagccaat

SEQ ID NO: 8057767 - DNA, 22 bp, Homo sapiens
cgctgggcgcgctccgaacccg

SEQ ID NO: 8057768 - DNA, 22 bp, Homo sapiens
cgctggggctttttgcttgaga

SEQ ID NO: 8057769 - DNA, 22 bp, Homo sapiens
cgctgggggaacagcgagggtg

SEQ ID NO: 8057770 - DNA, 21 bp, Homo sapiens
cggctcagtgcctgctccttc

SEQ ID NO: 8057771 - DNA, 22 bp, Homo sapiens
ttcacagtgtttctcacggtta

SEQ ID NO: 8057772 - DNA, 22 bp, Homo sapiens
ttcacataaatagatcacatca

SEQ ID NO: 8057773 - DNA, 22 bp, Homo sapiens
ttcccacagagattacattgaa

SEQ ID NO: 8057774 - DNA, 22 bp, Homo sapiens
ttcccacattctttacattcat

SEQ ID NO: 8057775 - DNA, 22 bp, Homo sapiens
ttcccacagtgttgaatcctct

SEQ ID NO: 8057776 - DNA, 22 bp, Homo sapiens
ctaatgtatcatggctctcagc

SEQ ID NO: 8057777 - DNA, 22 bp, Homo sapiens
ctaattgtaagctccttgaggg

SEQ ID NO: 8057778 - DNA, 22 bp, Homo sapiens
ctacaaaagtaattgtggtttt

SEQ ID NO: 8057779 - DNA, 22 bp, Homo sapiens
ctaatgtaatgatatgttgaat

SEQ ID NO: 8057780 - DNA, 22 bp, Homo sapiens
ctaatgtaaagcatttgttcag

SEQ ID NO: 8057781 - DNA, 22 bp, Homo sapiens
ctaatgtaaaacagacttgcat

SEQ ID NO: 8057782 - DNA, 22 bp, Homo sapiens
ctaatgaagctgctttctatga

SEQ ID NO: 8057783 - DNA, 22 bp, Homo sapiens
ttccttccacttcaggattttg

SEQ ID NO: 8057784 - DNA, 22 bp, Homo sapiens
ttccttcctggggatttatcat

SEQ ID NO: 8057785 - DNA, 22 bp, Homo sapiens
ctgcctccaggctcaccttgac

SEQ ID NO: 8057786 - DNA, 22 bp, Homo sapiens
ctgcctcctcacgtccacagtg

SEQ ID NO: 8057787 - DNA, 22 bp, Homo sapiens
ctgccgttgtgaagctcttaga

SEQ ID NO: 8057788 - DNA, 22 bp, Homo sapiens
ctgccaggtgagctccaggcct

SEQ ID NO: 8057789 - DNA, 22 bp, Homo sapiens
ctgcagcaggaggctcctgcag

SEQ ID NO: 8057790 - DNA, 22 bp, Homo sapiens
ctgccagggaggctgggaagtt

SEQ ID NO: 8057791 - DNA, 22 bp, Homo sapiens
ctgccaggcgatggattggctg

SEQ ID NO: 8057792 - DNA, 22 bp, Homo sapiens
ctgccaggctgtcccaggtccg

SEQ ID NO: 8057793 - DNA, 22 bp, Homo sapiens
ctgccaggggcctcacaggcca

SEQ ID NO: 8057794 - DNA, 22 bp, Homo sapiens
ctgccaggtaaactgcaggaat

SEQ ID NO: 8057795 - DNA, 22 bp, Homo sapiens
ctgccagggcatcctgtggtgg

SEQ ID NO: 8057796 - DNA, 22 bp, Homo sapiens
ctgccaggcctggggtgctgtc

SEQ ID NO: 8057797 - DNA, 22 bp, Homo sapiens
ctgccaggcctccgctgtcccc

SEQ ID NO: 8057798 - DNA, 22 bp, Homo sapiens
ctgaggaggggcctgagtgaga

SEQ ID NO: 8057799 - DNA, 22 bp, Homo sapiens
ctgaggaccccacaggaggccc

SEQ ID NO: 8057800 - DNA, 22 bp, Homo sapiens
ctgaggcactggtaatgggcat

SEQ ID NO: 8057801 - DNA, 22 bp, Homo sapiens
ctgaggagtgggtgggcagtga

SEQ ID NO: 8057802 - DNA, 22 bp, Homo sapiens
ctgaggagtgggtgggcagtga

SEQ ID NO: 8057803 - DNA, 22 bp, Homo sapiens
ctgattttcaaaatgtgttaaa

SEQ ID NO: 8057804 - DNA, 22 bp, Homo sapiens
ctgcacttgacatgctctcaga

SEQ ID NO: 8057805 - DNA, 22 bp, Homo sapiens
tttgtgaataggttggcttcca

SEQ ID NO: 8057806 - DNA, 22 bp, Homo sapiens
ctctggctgcctctcaggcctg

SEQ ID NO: 8057807 - DNA, 22 bp, Homo sapiens
ctctggcttctaccttgcagtt

SEQ ID NO: 8057808 - DNA, 22 bp, Homo sapiens
ctctcctctgaagtggtgaccc

SEQ ID NO: 8057809 - DNA, 22 bp, Homo sapiens
ctctcctggggagcacacacac

SEQ ID NO: 8057810 - DNA, 22 bp, Homo sapiens
tttgtctttcccctcctcattg

SEQ ID NO: 8057811 - DNA, 22 bp, Homo sapiens
ctctgggcaccaaagagcagct

SEQ ID NO: 8057812 - DNA, 22 bp, Homo sapiens
ctctgggcaggaccagtggacc

SEQ ID NO: 8057813 - DNA, 22 bp, Homo sapiens
ttttattcaaatagttcacact

SEQ ID NO: 8057814 - DNA, 23 bp, Homo sapiens
ttttattgatatgtagctgttgt

SEQ ID NO: 8057815 - DNA, 22 bp, Homo sapiens
ttttagttgtactgtcaacagt

SEQ ID NO: 8057816 - DNA, 20 bp, Homo sapiens
ctgaagagactggaggggca

SEQ ID NO: 8057817 - DNA, 22 bp, Homo sapiens
ctgaaaggagagctgcaaggat

SEQ ID NO: 8057818 - DNA, 19 bp, Homo sapiens
tttttaatgggctggagca

SEQ ID NO: 8057819 - DNA, 20 bp, Homo sapiens
ctgagaactatgactgtctt

SEQ ID NO: 8057820 - DNA, 22 bp, Homo sapiens
ctcttttagagatgaaaattgg

SEQ ID NO: 8057821 - DNA, 22 bp, Homo sapiens
ctcttttatgtgacgtgtgtga

SEQ ID NO: 8057822 - DNA, 22 bp, Homo sapiens
ctcttttacaccaaaaggccta

SEQ ID NO: 8057823 - DNA, 19 bp, Homo sapiens
ctgaaaaacattctcagga

SEQ ID NO: 8057824 - DNA, 22 bp, Homo sapiens
ctcttttaattgtcataacaac

SEQ ID NO: 8057825 - DNA, 21 bp, Homo sapiens
ctctggtcctgtctggcaggc

SEQ ID NO: 8057826 - DNA, 22 bp, Homo sapiens
ctctgggttttgtcagctgagg

SEQ ID NO: 8057827 - DNA, 22 bp, Homo sapiens
ctctggtcatttggaagagcat

SEQ ID NO: 8057828 - DNA, 22 bp, Homo sapiens
ctctgggttcactgaggctctg

SEQ ID NO: 8057829 - DNA, 21 bp, Homo sapiens
ttttattgatgaatggccact

SEQ ID NO: 8057830 - DNA, 22 bp, Homo sapiens
ctggcagcattaacagagagca

SEQ ID NO: 8057831 - DNA, 22 bp, Homo sapiens
ctggcagcattaacagagagca

SEQ ID NO: 8057832 - DNA, 22 bp, Homo sapiens
ctggcagcatggagcctgtgct

SEQ ID NO: 8057833 - DNA, 22 bp, Homo sapiens
ctggcagcatggagcctgtgct

SEQ ID NO: 8057834 - DNA, 22 bp, Homo sapiens
ctggcagtcacggccatgtgct

SEQ ID NO: 8057835 - DNA, 22 bp, Homo sapiens
ctggcaggtccagctggactca

SEQ ID NO: 8057836 - DNA, 22 bp, Homo sapiens
ctggcaggtatctaaagttgtc

SEQ ID NO: 8057837 - DNA, 22 bp, Homo sapiens
ctggcagtgtgaccctggacag

SEQ ID NO: 8057838 - DNA, 22 bp, Homo sapiens
ctggcagtggggcctcagtgtt

SEQ ID NO: 8057839 - DNA, 22 bp, Homo sapiens
ctggcagtgcccagtcactgtt

SEQ ID NO: 8057840 - DNA, 19 bp, Homo sapiens
ctggccacacctgctggtt

SEQ ID NO: 8057841 - DNA, 22 bp, Homo sapiens
ctggcatgccttgggtgcctct

SEQ ID NO: 8057842 - DNA, 19 bp, Homo sapiens
ctggccacacctgctggtt

SEQ ID NO: 8057843 - DNA, 22 bp, Homo sapiens
ctggccaggctctcacgtggtc

SEQ ID NO: 8057844 - DNA, 22 bp, Homo sapiens
ctggcaagaaatatatatctta

SEQ ID NO: 8057845 - DNA, 22 bp, Homo sapiens
ctggcacatagtaggtgcacag

SEQ ID NO: 8057846 - DNA, 22 bp, Homo sapiens
ctggcacatagtcagcactcaa

SEQ ID NO: 8057847 - DNA, 22 bp, Homo sapiens
ctggcaagtactgggccagctc

SEQ ID NO: 8057848 - DNA, 22 bp, Homo sapiens
ctggcagatatttgcagacatg

SEQ ID NO: 8057849 - DNA, 22 bp, Homo sapiens
ctggcagatagccacgcctgtc

SEQ ID NO: 8057850 - DNA, 22 bp, Homo sapiens
ctggcagagtctgctgtctgca

SEQ ID NO: 8057851 - DNA, 22 bp, Homo sapiens
ctggcagaggatggggacccag

SEQ ID NO: 8057852 - DNA, 22 bp, Homo sapiens
ctggcagcaggtcacacgcaga

SEQ ID NO: 8057853 - DNA, 22 bp, Homo sapiens
ctggcagcagcttctggatcga

SEQ ID NO: 8057854 - DNA, 22 bp, Homo sapiens
ctggcagcagcttctggatcga

SEQ ID NO: 8057855 - DNA, 22 bp, Homo sapiens
ctggcctggcgcagtggctcac

SEQ ID NO: 8057856 - DNA, 22 bp, Homo sapiens
ctggcctgggagctgctagcgt

SEQ ID NO: 8057857 - DNA, 22 bp, Homo sapiens
ctggcctggtctggcctctcca

SEQ ID NO: 8057858 - DNA, 22 bp, Homo sapiens
ctggcctggggggacacatccc

SEQ ID NO: 8057859 - DNA, 22 bp, Homo sapiens
ctggcctggggcctcagctgct

SEQ ID NO: 8057860 - DNA, 22 bp, Homo sapiens
ctggctccaggtcatgcactca

SEQ ID NO: 8057861 - DNA, 22 bp, Homo sapiens
ctggcccttctcttgcttcctg

SEQ ID NO: 8057862 - DNA, 22 bp, Homo sapiens
ctggccctgtggcctaaggact

SEQ ID NO: 8057863 - DNA, 22 bp, Homo sapiens
ctggcctgagcacagcggctgc

SEQ ID NO: 8057864 - DNA, 22 bp, Homo sapiens
ctggcctgaggccgccttcaga

SEQ ID NO: 8057865 - DNA, 22 bp, Homo sapiens
ctggcctgcagatcccagggtc

SEQ ID NO: 8057866 - DNA, 22 bp, Homo sapiens
ctggcctggagcctctgggtgg

SEQ ID NO: 8057867 - DNA, 20 bp, Homo sapiens
ctggcccaggatgatggcgc

SEQ ID NO: 8057868 - DNA, 22 bp, Homo sapiens
ctggcccaggctcctggggcac

SEQ ID NO: 8057869 - DNA, 21 bp, Homo sapiens
ctggcccagggatctgcattt

SEQ ID NO: 8057870 - DNA, 22 bp, Homo sapiens
ctggccataggttctcagtgtg

SEQ ID NO: 8057871 - DNA, 22 bp, Homo sapiens
ctggccataggttctcagtgtg

SEQ ID NO: 8057872 - DNA, 22 bp, Homo sapiens
ctggccatgttgcctctgagac

SEQ ID NO: 8057873 - DNA, 22 bp, Homo sapiens
ctggcccagagagcagagctta

SEQ ID NO: 8057874 - DNA, 22 bp, Homo sapiens
ctggacagaaaaggccactgga

SEQ ID NO: 8057875 - DNA, 22 bp, Homo sapiens
ctggacaggctggggactgcaa

SEQ ID NO: 8057876 - DNA, 22 bp, Homo sapiens
ctggacagtgggcagaggagac

SEQ ID NO: 8057877 - DNA, 22 bp, Homo sapiens
ctggacaggctggggactgcaa

SEQ ID NO: 8057878 - DNA, 22 bp, Homo sapiens
ctggacagaaagggctgctgtg

SEQ ID NO: 8057879 - DNA, 22 bp, Homo sapiens
ctggacagaaaccagtcctggg

SEQ ID NO: 8057880 - DNA, 22 bp, Homo sapiens
ctggacagaagtggctgggcag

SEQ ID NO: 8057881 - DNA, 22 bp, Homo sapiens
ctgctttgcatagctgccagag

SEQ ID NO: 8057882 - DNA, 22 bp, Homo sapiens
ctgcctggcatggagaagagaa

SEQ ID NO: 8057883 - DNA, 22 bp, Homo sapiens
ctgcttctaagaacctgcagct

SEQ ID NO: 8057884 - DNA, 22 bp, Homo sapiens
ctgcctggggaatgtgaggatt

SEQ ID NO: 8057885 - DNA, 22 bp, Homo sapiens
ctgcctgggccatgcccagtcc

SEQ ID NO: 8057886 - DNA, 23 bp, Homo sapiens
ctgctttcccactccatgctctt

SEQ ID NO: 8057887 - DNA, 22 bp, Homo sapiens
ctggaggaccacagaagctggt

SEQ ID NO: 8057888 - DNA, 22 bp, Homo sapiens
ctggaggaatcacagaaggctt

SEQ ID NO: 8057889 - DNA, 22 bp, Homo sapiens
ctggaggccactgtacagattg

SEQ ID NO: 8057890 - DNA, 22 bp, Homo sapiens
ctggaggctggcttcccctggc

SEQ ID NO: 8057891 - DNA, 22 bp, Homo sapiens
ctggagggacaaggtatgcatt

SEQ ID NO: 8057892 - DNA, 21 bp, Homo sapiens
ctggaggcaggtggtgccagg

SEQ ID NO: 8057893 - DNA, 22 bp, Homo sapiens
ctggaggagaacttgaggaagg

SEQ ID NO: 8057894 - DNA, 22 bp, Homo sapiens
ctggaggagagtctgaatgaca

SEQ ID NO: 8057895 - DNA, 22 bp, Homo sapiens
ctggaggagagtctgaatgaca

SEQ ID NO: 8057896 - DNA, 22 bp, Homo sapiens
ctggaggacccctgcctggaag

SEQ ID NO: 8057897 - DNA, 22 bp, Homo sapiens
ctggaggcacccttagagaggc

SEQ ID NO: 8057898 - DNA, 22 bp, Homo sapiens
ctggaggcaaagcagaggcatg

SEQ ID NO: 8057899 - DNA, 21 bp, Homo sapiens
ctggagggtagagttgggctg

SEQ ID NO: 8057900 - DNA, 21 bp, Homo sapiens
ctggagggtagagttgggctg

SEQ ID NO: 8057901 - DNA, 22 bp, Homo sapiens
ctggagggggaaatgttcattg

SEQ ID NO: 8057902 - DNA, 22 bp, Homo sapiens
ctggagggtgagcctcatctct

SEQ ID NO: 8057903 - DNA, 22 bp, Homo sapiens
ctggagggtggagagaagtctc

SEQ ID NO: 8057904 - DNA, 22 bp, Homo sapiens
ctggaggggctggcatggtagc

SEQ ID NO: 8057905 - DNA, 22 bp, Homo sapiens
ctggaggggccatccacagtct

SEQ ID NO: 8057906 - DNA, 22 bp, Homo sapiens
ctggagggactttctcacggat

SEQ ID NO: 8057907 - DNA, 22 bp, Homo sapiens
ctggagggcttctgcaggttac

SEQ ID NO: 8057908 - DNA, 22 bp, Homo sapiens
ctggagggctggactaaggaaa

SEQ ID NO: 8057909 - DNA, 22 bp, Homo sapiens
ctggagtcagcaaggacgaggc

SEQ ID NO: 8057910 - DNA, 22 bp, Homo sapiens
ccctggctcaggcagctttgtt

SEQ ID NO: 8057911 - DNA, 22 bp, Homo sapiens
ccctggcaaaatccctggtaca

SEQ ID NO: 8057912 - DNA, 18 bp, Homo sapiens
tggagctgagggcaatgc

SEQ ID NO: 8057913 - DNA, 22 bp, Homo sapiens
tggcaagaaactgaggcctgct

SEQ ID NO: 8057914 - DNA, 22 bp, Homo sapiens
tggcaagaaactgaggcctgct

SEQ ID NO: 8057915 - DNA, 17 bp, Homo sapiens
tggcaagacagctcagg

SEQ ID NO: 8057916 - DNA, 22 bp, Homo sapiens
tggcaagagggatgcaaggttt

SEQ ID NO: 8057917 - DNA, 22 bp, Homo sapiens
tggcaagctgggttgggtagcc

SEQ ID NO: 8057918 - DNA, 22 bp, Homo sapiens
tggcaagcagagtctggtgggg

SEQ ID NO: 8057919 - DNA, 22 bp, Homo sapiens
tggcaagctcgtttgggtcaga

SEQ ID NO: 8057920 - DNA, 22 bp, Homo sapiens
ccctggagcatctctgctgtct

SEQ ID NO: 8057921 - DNA, 22 bp, Homo sapiens
ccctggagatcgggagaggaag

SEQ ID NO: 8057922 - DNA, 22 bp, Homo sapiens
ccctggagcatctctgctgtct

SEQ ID NO: 8057923 - DNA, 22 bp, Homo sapiens
ccctggagctagtctgagcaga

SEQ ID NO: 8057924 - DNA, 19 bp, Homo sapiens
ccctggagaataccctgga

SEQ ID NO: 8057925 - DNA, 20 bp, Homo sapiens
ccctggagagaagctccacg

SEQ ID NO: 8057926 - DNA, 22 bp, Homo sapiens
ccctggagaggactcacccctg

SEQ ID NO: 8057927 - DNA, 22 bp, Homo sapiens
tggagctgagaagtggagctct

SEQ ID NO: 8057928 - DNA, 22 bp, Homo sapiens
tggagctgagagccaggctggc

SEQ ID NO: 8057929 - DNA, 19 bp, Homo sapiens
ccctggagaataccctgga

SEQ ID NO: 8057930 - DNA, 22 bp, Homo sapiens
ccctggagaaggggacgcggag

SEQ ID NO: 8057931 - DNA, 22 bp, Homo sapiens
ccctccagccatggacccaggt

SEQ ID NO: 8057932 - DNA, 22 bp, Homo sapiens
ccctcatgtcagtccctgccca

SEQ ID NO: 8057933 - DNA, 22 bp, Homo sapiens
tggcacaggaatttagatgcag

SEQ ID NO: 8057934 - DNA, 22 bp, Homo sapiens
tggcacagtcctgggtgcctgc

SEQ ID NO: 8057935 - DNA, 22 bp, Homo sapiens
tggcacagggcttggtcgctca

SEQ ID NO: 8057936 - DNA, 22 bp, Homo sapiens
tggcacaggcggtaagggtgtg

SEQ ID NO: 8057937 - DNA, 22 bp, Homo sapiens
tggcacaggatctcagcggcca

SEQ ID NO: 8057938 - DNA, 22 bp, Homo sapiens
tggcacaggatctcagcggcca

SEQ ID NO: 8057939 - DNA, 22 bp, Homo sapiens
tggcagctggctctgcgcaggc

SEQ ID NO: 8057940 - DNA, 22 bp, Homo sapiens
tggcagcacggcatccactctc

SEQ ID NO: 8057941 - DNA, 22 bp, Homo sapiens
tggcagcaccagcagtgtcctt

SEQ ID NO: 8057942 - DNA, 22 bp, Homo sapiens
tggcagcacaaggtggcccatg

SEQ ID NO: 8057943 - DNA, 22 bp, Homo sapiens
tggcagcaagttcttgggaggt

SEQ ID NO: 8057944 - DNA, 22 bp, Homo sapiens
tggcagcaattagctagagctg

SEQ ID NO: 8057945 - DNA, 22 bp, Homo sapiens
cctaggccctcaaagagcataa

SEQ ID NO: 8057946 - DNA, 22 bp, Homo sapiens
tggccaggcattcagataagac

SEQ ID NO: 8057947 - DNA, 22 bp, Homo sapiens
tggccaggcattcagataagac

SEQ ID NO: 8057948 - DNA, 22 bp, Homo sapiens
tggccaggcaggtagaacggcc

SEQ ID NO: 8057949 - DNA, 23 bp, Homo sapiens
tggccaggcataaaggtgggtgg

SEQ ID NO: 8057950 - DNA, 22 bp, Homo sapiens
tggccaggcaggtagaacggcc

SEQ ID NO: 8057951 - DNA, 22 bp, Homo sapiens
tggccagctttttgtagtgctc

SEQ ID NO: 8057952 - DNA, 22 bp, Homo sapiens
tggccacacccacctagaggag

SEQ ID NO: 8057953 - DNA, 22 bp, Homo sapiens
tggcagctgtgtccaggtagaa

SEQ ID NO: 8057954 - DNA, 22 bp, Homo sapiens
cctctccagcggcctcagggcc

SEQ ID NO: 8057955 - DNA, 22 bp, Homo sapiens
tggctgccctcatgggcctgat

SEQ ID NO: 8057956 - DNA, 21 bp, Homo sapiens
tggctgcctacatgctgcagg

SEQ ID NO: 8057957 - DNA, 22 bp, Homo sapiens
tggctgcctagtccctcagcct

SEQ ID NO: 8057958 - DNA, 22 bp, Homo sapiens
tggctgcctgatcgagcaggtg

SEQ ID NO: 8057959 - DNA, 22 bp, Homo sapiens
tggctgcctagtgtctgagcag

SEQ ID NO: 8057960 - DNA, 21 bp, Homo sapiens
tggctgcctggctctgtggtt

SEQ ID NO: 8057961 - DNA, 22 bp, Homo sapiens
cctctctgtgtggcctctccat

SEQ ID NO: 8057962 - DNA, 22 bp, Homo sapiens
cctctctgtaagggtccctccc

SEQ ID NO: 8057963 - DNA, 20 bp, Homo sapiens
cctctctgaagaggtcatct

SEQ ID NO: 8057964 - DNA, 20 bp, Homo sapiens
cctctctgcatgctccctga

SEQ ID NO: 8057965 - DNA, 22 bp, Homo sapiens
cctctgtgcaggaaatacatgt

SEQ ID NO: 8057966 - DNA, 22 bp, Homo sapiens
cctctgtgatttctgagccaat

SEQ ID NO: 8057967 - DNA, 22 bp, Homo sapiens
cctccaagtttgactcaggaca

SEQ ID NO: 8057968 - DNA, 22 bp, Homo sapiens
cctcccttcagtagagcccaat

SEQ ID NO: 8057969 - DNA, 23 bp, Homo sapiens
cctcctcatatctttgactagtg

SEQ ID NO: 8057970 - DNA, 22 bp, Homo sapiens
tggcccagtgcttatgctctga

SEQ ID NO: 8057971 - DNA, 22 bp, Homo sapiens
tggcccagccctgctctagggc

SEQ ID NO: 8057972 - DNA, 20 bp, Homo sapiens
tggcccagtggggcagggtg

SEQ ID NO: 8057973 - DNA, 22 bp, Homo sapiens
tggcccctgaggagcgtcagcc

SEQ ID NO: 8057974 - DNA, 22 bp, Homo sapiens
tggccctgctatgatcctgcaa

SEQ ID NO: 8057975 - DNA, 22 bp, Homo sapiens
tggccctgctggacacgcctgc

SEQ ID NO: 8057976 - DNA, 22 bp, Homo sapiens
tggctcagtttagcagctcagt

SEQ ID NO: 8057977 - DNA, 22 bp, Homo sapiens
tggctcagctgtcacagcctgg

SEQ ID NO: 8057978 - DNA, 22 bp, Homo sapiens
tggccctgctgggtcagagctg

SEQ ID NO: 8057979 - DNA, 22 bp, Homo sapiens
tggccctgctgtatcatctgct

SEQ ID NO: 8057980 - DNA, 22 bp, Homo sapiens
tggccctgcttatgtctctctt

SEQ ID NO: 8057981 - DNA, 22 bp, Homo sapiens
tggctcagtttgggggattgaa

SEQ ID NO: 8057982 - DNA, 22 bp, Homo sapiens
tggctcagtttctgcccagctg

SEQ ID NO: 8057983 - DNA, 22 bp, Homo sapiens
tggctcagtttcagtcctggtt

SEQ ID NO: 8057984 - DNA, 22 bp, Homo sapiens
cccagcctgtgacagccgtcct

SEQ ID NO: 8057985 - DNA, 22 bp, Homo sapiens
cccagcctttgcttcctggttc

SEQ ID NO: 8057986 - DNA, 22 bp, Homo sapiens
cccagcctttgcttcctggttc

SEQ ID NO: 8057987 - DNA, 23 bp, Homo sapiens
cccagcgctgagccctgcaggca

SEQ ID NO: 8057988 - DNA, 22 bp, Homo sapiens
tgcagggaatgcttgcagcatg

SEQ ID NO: 8057989 - DNA, 22 bp, Homo sapiens
tgcagggaatgcttgcagcatg

SEQ ID NO: 8057990 - DNA, 22 bp, Homo sapiens
cccagctcttcaagtcaccccc

SEQ ID NO: 8057991 - DNA, 22 bp, Homo sapiens
cccagctgatttttgcagagat

SEQ ID NO: 8057992 - DNA, 23 bp, Homo sapiens
cccagctgagacttcctgaactc

SEQ ID NO: 8057993 - DNA, 20 bp, Homo sapiens
tgcattaagtggcattgagc

SEQ ID NO: 8057994 - DNA, 22 bp, Homo sapiens
tgcatcagaggatagctgcagt

SEQ ID NO: 8057995 - DNA, 22 bp, Homo sapiens
cccagcttctgagggggccttg

SEQ ID NO: 8057996 - DNA, 22 bp, Homo sapiens
cccagcttgcaaatgggttgct

SEQ ID NO: 8057997 - DNA, 22 bp, Homo sapiens
cccagcttgcgggcggcaggag

SEQ ID NO: 8057998 - DNA, 23 bp, Homo sapiens
cccagctttcccactgccgagag

SEQ ID NO: 8057999 - DNA, 22 bp, Homo sapiens
cccaggaggtggagttcacagt

SEQ ID NO: 8058000 - DNA, 22 bp, Homo sapiens
cccaggaggttgaggctgcagt

SEQ ID NO: 8058001 - DNA, 22 bp, Homo sapiens
cccaggaggttgaggctgcagt

SEQ ID NO: 8058002 - DNA, 22 bp, Homo sapiens
tgccaggcctcaggagtctcca

SEQ ID NO: 8058003 - DNA, 22 bp, Homo sapiens
tgccacagagcaattctgctga

SEQ ID NO: 8058004 - DNA, 22 bp, Homo sapiens
cccaggaggtggaggctgcagt

SEQ ID NO: 8058005 - DNA, 22 bp, Homo sapiens
cccaggaggtggaggctgcagt

SEQ ID NO: 8058006 - DNA, 22 bp, Homo sapiens
tgccacagacaggacagaacag

SEQ ID NO: 8058007 - DNA, 22 bp, Homo sapiens
tgccaggcgtggtggtgcgcac

SEQ ID NO: 8058008 - DNA, 22 bp, Homo sapiens
tgccaggcgattgctatcagca

SEQ ID NO: 8058009 - DNA, 22 bp, Homo sapiens
cccaggcacactgaagtgacat

SEQ ID NO: 8058010 - DNA, 22 bp, Homo sapiens
cccaggcagagagctggtgagc

SEQ ID NO: 8058011 - DNA, 22 bp, Homo sapiens
cccaggcagggacgtgctctgg

SEQ ID NO: 8058012 - DNA, 22 bp, Homo sapiens
cccaggcagtagaaagaagagg

SEQ ID NO: 8058013 - DNA, 22 bp, Homo sapiens
cccaggcagtgctgatccctca

SEQ ID NO: 8058014 - DNA, 22 bp, Homo sapiens
cccaggcagcggggtctccttg

SEQ ID NO: 8058015 - DNA, 20 bp, Homo sapiens
cccaggcagagctagcggca

SEQ ID NO: 8058016 - DNA, 22 bp, Homo sapiens
cccccaaagtttgcacggataa

SEQ ID NO: 8058017 - DNA, 22 bp, Homo sapiens
ccctcaggatgcagtggaagtg

SEQ ID NO: 8058018 - DNA, 23 bp, Homo sapiens
cccctctggtggctcagctcctg

SEQ ID NO: 8058019 - DNA, 22 bp, Homo sapiens
cccctctggtcaaccagtcaca

SEQ ID NO: 8058020 - DNA, 22 bp, Homo sapiens
ccccagccttccatgggaattg

SEQ ID NO: 8058021 - DNA, 22 bp, Homo sapiens
ccccacctgtgcgtctgccgca

SEQ ID NO: 8058022 - DNA, 22 bp, Homo sapiens
ccccagccagcaggacctctga

SEQ ID NO: 8058023 - DNA, 22 bp, Homo sapiens
tgctccaggtgtgcctctcatg

SEQ ID NO: 8058024 - DNA, 22 bp, Homo sapiens
cccaggctcctgactcattcta

SEQ ID NO: 8058025 - DNA, 22 bp, Homo sapiens
cccaggctcctagaggcccaga

SEQ ID NO: 8058026 - DNA, 22 bp, Homo sapiens
tgcctgggagtgaccaagactc

SEQ ID NO: 8058027 - DNA, 22 bp, Homo sapiens
tgcctgctcttaccactctccc

SEQ ID NO: 8058028 - DNA, 20 bp, Homo sapiens
tgcctgggaaggcgtggagg

SEQ ID NO: 8058029 - DNA, 22 bp, Homo sapiens
cccagggagagcgcggaggcgg

SEQ ID NO: 8058030 - DNA, 22 bp, Homo sapiens
cccagggaggcccaggctctgc

SEQ ID NO: 8058031 - DNA, 22 bp, Homo sapiens
tgctgaatgggatatgttgagc

SEQ ID NO: 8058032 - DNA, 22 bp, Homo sapiens
tgctgcacagcccgctggccca

SEQ ID NO: 8058033 - DNA, 22 bp, Homo sapiens
cctgcccactgcccggtcagcc

SEQ ID NO: 8058034 - DNA, 22 bp, Homo sapiens
tggtgctgataatggcaggatt

SEQ ID NO: 8058035 - DNA, 22 bp, Homo sapiens
cctgccagtgaagctgacgggc

SEQ ID NO: 8058036 - DNA, 19 bp, Homo sapiens
tggtcccatactgctggcc

SEQ ID NO: 8058037 - DNA, 21 bp, Homo sapiens
cctggagacaaagacagggtg

SEQ ID NO: 8058038 - DNA, 22 bp, Homo sapiens
tgtaaacataccagagccaagt

SEQ ID NO: 8058039 - DNA, 22 bp, Homo sapiens
tgtaaacagccccatggagagc

SEQ ID NO: 8058040 - DNA, 22 bp, Homo sapiens
cctggagagctcgggccaggca

SEQ ID NO: 8058041 - DNA, 22 bp, Homo sapiens
cctggagacgaggctggaccat

SEQ ID NO: 8058042 - DNA, 22 bp, Homo sapiens
cctggagacctgatggcagcgg

SEQ ID NO: 8058043 - DNA, 22 bp, Homo sapiens
cctggagacctgatggcagcgg

SEQ ID NO: 8058044 - DNA, 22 bp, Homo sapiens
tggtgctgcctcagatgcctta

SEQ ID NO: 8058045 - DNA, 22 bp, Homo sapiens
cctggcagactgtgagggcagg

SEQ ID NO: 8058046 - DNA, 22 bp, Homo sapiens
cctggcagacagcactgaagct

SEQ ID NO: 8058047 - DNA, 22 bp, Homo sapiens
cctggcagaatattaaagtgca

SEQ ID NO: 8058048 - DNA, 21 bp, Homo sapiens
cctggcagaagcctgatatgc

SEQ ID NO: 8058049 - DNA, 22 bp, Homo sapiens
cctggcagaaagagttacacct

SEQ ID NO: 8058050 - DNA, 22 bp, Homo sapiens
cctggagcaaaaatctaaggag

SEQ ID NO: 8058051 - DNA, 22 bp, Homo sapiens
cctggagcacatggcaggaggc

SEQ ID NO: 8058052 - DNA, 22 bp, Homo sapiens
cctggagcacagcccagtccca

SEQ ID NO: 8058053 - DNA, 22 bp, Homo sapiens
cctggagcacatggcaggaggc

SEQ ID NO: 8058054 - DNA, 22 bp, Homo sapiens
cctggagaggcgctgcagagga

SEQ ID NO: 8058055 - DNA, 22 bp, Homo sapiens
tgtaaagaaagacgcagagtta

SEQ ID NO: 8058056 - DNA, 23 bp, Homo sapiens
tgtaaacatcaccccctggagtt

SEQ ID NO: 8058057 - DNA, 22 bp, Homo sapiens
tgtaaacatatgtatgtatgta

SEQ ID NO: 8058058 - DNA, 23 bp, Homo sapiens
cctggcagcaaacgaggaggtta

SEQ ID NO: 8058059 - DNA, 22 bp, Homo sapiens
cctggcagcattggtagagatt

SEQ ID NO: 8058060 - DNA, 18 bp, Homo sapiens
cctggcagccatgcgcgc

SEQ ID NO: 8058061 - DNA, 22 bp, Homo sapiens
cctggcagcagcacatgccttc

SEQ ID NO: 8058062 - DNA, 22 bp, Homo sapiens
cctggcagcaggtgggcccgtg

SEQ ID NO: 8058063 - DNA, 22 bp, Homo sapiens
cctggcagcaggtgggcccgtg

SEQ ID NO: 8058064 - DNA, 20 bp, Homo sapiens
cctggcaggcgggttactta

SEQ ID NO: 8058065 - DNA, 22 bp, Homo sapiens
cctggcaggctggggacagtgc

SEQ ID NO: 8058066 - DNA, 22 bp, Homo sapiens
cctggcaggcaagaggaaggga

SEQ ID NO: 8058067 - DNA, 22 bp, Homo sapiens
cctggcaggactgttgtaagaa

SEQ ID NO: 8058068 - DNA, 22 bp, Homo sapiens
cctggcaggcccctcctggatt

SEQ ID NO: 8058069 - DNA, 22 bp, Homo sapiens
cctggcaggttacaaccagtta

SEQ ID NO: 8058070 - DNA, 22 bp, Homo sapiens
cctggcagtcaggggagtcctt

SEQ ID NO: 8058071 - DNA, 22 bp, Homo sapiens
cctggcagtcaggggagtcctt

SEQ ID NO: 8058072 - DNA, 22 bp, Homo sapiens
cctggcaggtagcattgaggag

SEQ ID NO: 8058073 - DNA, 22 bp, Homo sapiens
cctggcaggtggaggttgcagt

SEQ ID NO: 8058074 - DNA, 22 bp, Homo sapiens
cctggcagggctgcagtaatgg

SEQ ID NO: 8058075 - DNA, 22 bp, Homo sapiens
cctggcaggtagcattgaggag

SEQ ID NO: 8058076 - DNA, 22 bp, Homo sapiens
cctggcaggtggcgccctcggc

SEQ ID NO: 8058077 - DNA, 22 bp, Homo sapiens
cctggcagttcatcaaatggca

SEQ ID NO: 8058078 - DNA, 22 bp, Homo sapiens
cctggcagtggtgaagaagagg

SEQ ID NO: 8058079 - DNA, 22 bp, Homo sapiens
cctggcagttttgcccaggatt

SEQ ID NO: 8058080 - DNA, 22 bp, Homo sapiens
cctggcagttttgcccaggatt

SEQ ID NO: 8058081 - DNA, 22 bp, Homo sapiens
cctggccatagggcccaggaaa

SEQ ID NO: 8058082 - DNA, 22 bp, Homo sapiens
cctggccagtttccaggccctg

SEQ ID NO: 8058083 - DNA, 22 bp, Homo sapiens
tgtcctcatcctccagtctgtc

SEQ ID NO: 8058084 - DNA, 22 bp, Homo sapiens
tgtcctcatcttttccagaaat

SEQ ID NO: 8058085 - DNA, 22 bp, Homo sapiens
cctggcccacatggcttctccc

SEQ ID NO: 8058086 - DNA, 22 bp, Homo sapiens
cctggctctctgcagatcctgg

SEQ ID NO: 8058087 - DNA, 22 bp, Homo sapiens
cctggctcctgcctctgcaggg

SEQ ID NO: 8058088 - DNA, 22 bp, Homo sapiens
cctggccttaagggcagggagc

SEQ ID NO: 8058089 - DNA, 22 bp, Homo sapiens
cctggcctcagacagagggtgg

SEQ ID NO: 8058090 - DNA, 22 bp, Homo sapiens
cctggcccagggactttcgcct

SEQ ID NO: 8058091 - DNA, 22 bp, Homo sapiens
tgtctcagatacgccatcaagg

SEQ ID NO: 8058092 - DNA, 22 bp, Homo sapiens
tgtctcaggtacatgcgtcctg

SEQ ID NO: 8058093 - DNA, 18 bp, Homo sapiens
tgtctcagttctgctatg

SEQ ID NO: 8058094 - DNA, 22 bp, Homo sapiens
tgtctcagttcccttctctgga

SEQ ID NO: 8058095 - DNA, 22 bp, Homo sapiens
tgtctctgtgagatctgacgat

SEQ ID NO: 8058096 - DNA, 22 bp, Homo sapiens
tgtctctgggtgattcagtcct

SEQ ID NO: 8058097 - DNA, 22 bp, Homo sapiens
cctggctgaacaaagtccctcc

SEQ ID NO: 8058098 - DNA, 22 bp, Homo sapiens
cctggctgaggggccaaggacc

SEQ ID NO: 8058099 - DNA, 21 bp, Homo sapiens
cctggctgcacagttgctggt

SEQ ID NO: 8058100 - DNA, 22 bp, Homo sapiens
tgtctgtccactcactgtggag

SEQ ID NO: 8058101 - DNA, 22 bp, Homo sapiens
tgtctggtgggttgacaggcag

SEQ ID NO: 8058102 - DNA, 22 bp, Homo sapiens
tgtctttggaatatttagctga

SEQ ID NO: 8058103 - DNA, 22 bp, Homo sapiens
cctggctgccgagtgtgcagcg

SEQ ID NO: 8058104 - DNA, 22 bp, Homo sapiens
cctgggaagaccggcagtgggg

SEQ ID NO: 8058105 - DNA, 22 bp, Homo sapiens
cctggctgtttgagcggggaat

SEQ ID NO: 8058106 - DNA, 22 bp, Homo sapiens
cctgggagagccatctgtggcc

SEQ ID NO: 8058107 - DNA, 22 bp, Homo sapiens
cctgggagagctgcccgggtga

SEQ ID NO: 8058108 - DNA, 22 bp, Homo sapiens
tgtgcccatctcccagcttgac

SEQ ID NO: 8058109 - DNA, 23 bp, Homo sapiens
tgtgccattgaggctgaggctca

SEQ ID NO: 8058110 - DNA, 22 bp, Homo sapiens
tgtgttcaatgacttcatcttt

SEQ ID NO: 8058111 - DNA, 22 bp, Homo sapiens
tgtgttcatcatgatatcaggt

SEQ ID NO: 8058112 - DNA, 22 bp, Homo sapiens
tgtgttcatgtatgtatacata

SEQ ID NO: 8058113 - DNA, 22 bp, Homo sapiens
tgtgttcctgcctggctctggt

SEQ ID NO: 8058114 - DNA, 20 bp, Homo sapiens
tgtgttccctccgagacagc

SEQ ID NO: 8058115 - DNA, 22 bp, Homo sapiens
tgtgttcctctgcttcctcccc

SEQ ID NO: 8058116 - DNA, 22 bp, Homo sapiens
cctgggtgacagagtgagacct

SEQ ID NO: 8058117 - DNA, 22 bp, Homo sapiens
cctgggtcttcagtctgctggt

SEQ ID NO: 8058118 - DNA, 22 bp, Homo sapiens
cctgggctttggaacagtactt

SEQ ID NO: 8058119 - DNA, 22 bp, Homo sapiens
cctggggaaaagcaggcattta

SEQ ID NO: 8058120 - DNA, 22 bp, Homo sapiens
cctggggaatcttgcaggggaa

SEQ ID NO: 8058121 - DNA, 22 bp, Homo sapiens
cctggggaatcttgcaggggaa

SEQ ID NO: 8058122 - DNA, 22 bp, Homo sapiens
cctgggccttgacctcgtgggc

SEQ ID NO: 8058123 - DNA, 22 bp, Homo sapiens
cctgggctcaagtgatcctcct

SEQ ID NO: 8058124 - DNA, 22 bp, Homo sapiens
cctgggctttgctggcaaggcc

SEQ ID NO: 8058125 - DNA, 22 bp, Homo sapiens
cctgggcctggcgggtcggctc

SEQ ID NO: 8058126 - DNA, 22 bp, Homo sapiens
cctgggcctctcaaagtgctgg

SEQ ID NO: 8058127 - DNA, 22 bp, Homo sapiens
cctgggcctctcaaagtgctgg

SEQ ID NO: 8058128 - DNA, 19 bp, Homo sapiens
cctgggcctccatcacccc

SEQ ID NO: 8058129 - DNA, 19 bp, Homo sapiens
cctgggaggcggaggttgc

SEQ ID NO: 8058130 - DNA, 22 bp, Homo sapiens
cctgggaggcagaggttgcagt

SEQ ID NO: 8058131 - DNA, 22 bp, Homo sapiens
cctgggagctgtggaaaggctg

SEQ ID NO: 8058132 - DNA, 22 bp, Homo sapiens
cctgggagctgtggaaaggctg

SEQ ID NO: 8058133 - DNA, 22 bp, Homo sapiens
tgtggcaggatgcggaagatgc

SEQ ID NO: 8058134 - DNA, 22 bp, Homo sapiens
tgtggcagctggaggtggagaa

SEQ ID NO: 8058135 - DNA, 22 bp, Homo sapiens
tgtggcagctggaggtggagaa

SEQ ID NO: 8058136 - DNA, 20 bp, Homo sapiens
tgtggcaggatgagggcgga

SEQ ID NO: 8058137 - DNA, 20 bp, Homo sapiens
tgtggcaggatgagggcgga

SEQ ID NO: 8058138 - DNA, 22 bp, Homo sapiens
tgtgcttcttgcagctcctgta

SEQ ID NO: 8058139 - DNA, 21 bp, Homo sapiens
cctgggccaaattccctggac

SEQ ID NO: 8058140 - DNA, 22 bp, Homo sapiens
cctgggccctcaccgccggtgg

SEQ ID NO: 8058141 - DNA, 22 bp, Homo sapiens
cctgggccaggcttgggaatgc

SEQ ID NO: 8058142 - DNA, 22 bp, Homo sapiens
cctgggcaatatagtgaggccc

SEQ ID NO: 8058143 - DNA, 22 bp, Homo sapiens
cctgggaggcggaggttgcagt

SEQ ID NO: 8058144 - DNA, 22 bp, Homo sapiens
cctgggaggcggaggttgcagg

SEQ ID NO: 8058145 - DNA, 22 bp, Homo sapiens
tgtggggcagctagccggcctg

SEQ ID NO: 8058146 - DNA, 22 bp, Homo sapiens
cctgggcctatcctagaaccaa

SEQ ID NO: 8058147 - DNA, 22 bp, Homo sapiens
cctgggcctcacccagctcttg

SEQ ID NO: 8058148 - DNA, 22 bp, Homo sapiens
tgtggggctgtcaggcaactgg

SEQ ID NO: 8058149 - DNA, 22 bp, Homo sapiens
tgtggggctccctggcagcctg

SEQ ID NO: 8058150 - DNA, 22 bp, Homo sapiens
tgtggggctccctggcagcctg

SEQ ID NO: 8058151 - DNA, 22 bp, Homo sapiens
tgtggggcctcgtgctagctgg

SEQ ID NO: 8058152 - DNA, 22 bp, Homo sapiens
tgtggggcagctagccggcctg

SEQ ID NO: 8058153 - DNA, 22 bp, Homo sapiens
tgtggggccaaagcccagccac

SEQ ID NO: 8058154 - DNA, 22 bp, Homo sapiens
tgtggggcttacaaaggcagat

SEQ ID NO: 8058155 - DNA, 22 bp, Homo sapiens
tgtggggcttacaaaggcagat

SEQ ID NO: 8058156 - DNA, 22 bp, Homo sapiens
tgtggggctgtggtgttcttct

SEQ ID NO: 8058157 - DNA, 22 bp, Homo sapiens
caggaaagggatgggctgccac

SEQ ID NO: 8058158 - DNA, 22 bp, Homo sapiens
gttcccaggccctgggctctcc

SEQ ID NO: 8058159 - DNA, 22 bp, Homo sapiens
gttcacagtctacatagtaaag

SEQ ID NO: 8058160 - DNA, 22 bp, Homo sapiens
gttctgggagatcttgagcttc

SEQ ID NO: 8058161 - DNA, 22 bp, Homo sapiens
gtttattgggtattgtggagcc

SEQ ID NO: 8058162 - DNA, 22 bp, Homo sapiens
gtttattgataaaagctggaca

SEQ ID NO: 8058163 - DNA, 22 bp, Homo sapiens
caggaagaggacaggcttcccc

SEQ ID NO: 8058164 - DNA, 22 bp, Homo sapiens
caggaagaggtatcaccgagca

SEQ ID NO: 8058165 - DNA, 19 bp, Homo sapiens
caggaacatggagggaggg

SEQ ID NO: 8058166 - DNA, 22 bp, Homo sapiens
caggaacagcaccaggagctag

SEQ ID NO: 8058167 - DNA, 22 bp, Homo sapiens
caggaagcacagtgaggagacc

SEQ ID NO: 8058168 - DNA, 22 bp, Homo sapiens
gttacaaatgtaaattctgggg

SEQ ID NO: 8058169 - DNA, 22 bp, Homo sapiens
gtgttttctctccagcaggcag

SEQ ID NO: 8058170 - DNA, 22 bp, Homo sapiens
gtgttttatggagtcataacgt

SEQ ID NO: 8058171 - DNA, 22 bp, Homo sapiens
cagcttctaaagtgtgaagcca

SEQ ID NO: 8058172 - DNA, 22 bp, Homo sapiens
cagcttcccttggctgagcaga

SEQ ID NO: 8058173 - DNA, 20 bp, Homo sapiens
cagcttcaatgtcagcttga

SEQ ID NO: 8058174 - DNA, 22 bp, Homo sapiens
cagcttcagggacagcttcttt

SEQ ID NO: 8058175 - DNA, 22 bp, Homo sapiens
cagctgtgctgattgctcagta

SEQ ID NO: 8058176 - DNA, 22 bp, Homo sapiens
cagctgtgatatgcctgcctga

SEQ ID NO: 8058177 - DNA, 22 bp, Homo sapiens
cagctgtgattcctgctgtcca

SEQ ID NO: 8058178 - DNA, 22 bp, Homo sapiens
cagctgtgggcctgacgtggca

SEQ ID NO: 8058179 - DNA, 22 bp, Homo sapiens
cagctgtggggagcttgggcca

SEQ ID NO: 8058180 - DNA, 22 bp, Homo sapiens
cagctgtggctgccactgctcc

SEQ ID NO: 8058181 - DNA, 22 bp, Homo sapiens
cagctgtgtagatgcagggtca

SEQ ID NO: 8058182 - DNA, 22 bp, Homo sapiens
cagctgtgtaaacacatgtgta

SEQ ID NO: 8058183 - DNA, 22 bp, Homo sapiens
cagctttccagagacctgcccc

SEQ ID NO: 8058184 - DNA, 23 bp, Homo sapiens
cagctttcagggctttagggaag

SEQ ID NO: 8058185 - DNA, 22 bp, Homo sapiens
cagctttatttcacgtgtttgt

SEQ ID NO: 8058186 - DNA, 22 bp, Homo sapiens
cagctttattgaggtataattg

SEQ ID NO: 8058187 - DNA, 22 bp, Homo sapiens
cagctttctttccataaggttt

SEQ ID NO: 8058188 - DNA, 22 bp, Homo sapiens
cagctttcttccttctgtctgt

SEQ ID NO: 8058189 - DNA, 20 bp, Homo sapiens
cagctttagatctttgatta

SEQ ID NO: 8058190 - DNA, 22 bp, Homo sapiens
cagctttaggactcataataaa

SEQ ID NO: 8058191 - DNA, 22 bp, Homo sapiens
cagctttagtaacccactgctc

SEQ ID NO: 8058192 - DNA, 17 bp, Homo sapiens
cagctttatgctactgt

SEQ ID NO: 8058193 - DNA, 22 bp, Homo sapiens
cagctttattaatgattgtctt

SEQ ID NO: 8058194 - DNA, 16 bp, Homo sapiens
cagctttatgtcagtg

SEQ ID NO: 8058195 - DNA, 22 bp, Homo sapiens
cagcttgtattgaagctatacc

SEQ ID NO: 8058196 - DNA, 22 bp, Homo sapiens
cagcttgttttatttggggacc

SEQ ID NO: 8058197 - DNA, 22 bp, Homo sapiens
cagctttacctttaggagtaac

SEQ ID NO: 8058198 - DNA, 22 bp, Homo sapiens
cagctttaccaatatttggaaa

SEQ ID NO: 8058199 - DNA, 22 bp, Homo sapiens
cagctttagagaaaacatattt

SEQ ID NO: 8058200 - DNA, 19 bp, Homo sapiens
caggaaacacctactgcta

SEQ ID NO: 8058201 - DNA, 22 bp, Homo sapiens
cagcttctcagaaagctgaggt

SEQ ID NO: 8058202 - DNA, 22 bp, Homo sapiens
cagcttctccagatgaccctca

SEQ ID NO: 8058203 - DNA, 22 bp, Homo sapiens
cagcttctccagatgaccctca

SEQ ID NO: 8058204 - DNA, 22 bp, Homo sapiens
cagcttctagcatcggctttga

SEQ ID NO: 8058205 - DNA, 22 bp, Homo sapiens
cagcttctatttatctttgtgt

SEQ ID NO: 8058206 - DNA, 22 bp, Homo sapiens
cagcttctccggcctggtgcgg

SEQ ID NO: 8058207 - DNA, 22 bp, Homo sapiens
cagcttctccattcttctggct

SEQ ID NO: 8058208 - DNA, 22 bp, Homo sapiens
cagcttctcgggagcgcatgtg

SEQ ID NO: 8058209 - DNA, 22 bp, Homo sapiens
cagcttctgagcaagccagggg

SEQ ID NO: 8058210 - DNA, 22 bp, Homo sapiens
cagcttctgctatcgaacatct

SEQ ID NO: 8058211 - DNA, 21 bp, Homo sapiens
cagcttctgaaggtgtaggaa

SEQ ID NO: 8058212 - DNA, 22 bp, Homo sapiens
cagcttctaccatcaggaaatt

SEQ ID NO: 8058213 - DNA, 22 bp, Homo sapiens
gttattgaggtggagtctcact

SEQ ID NO: 8058214 - DNA, 22 bp, Homo sapiens
gttattgagacatagagttatg

SEQ ID NO: 8058215 - DNA, 22 bp, Homo sapiens
gttattgacatgtattaagcac

SEQ ID NO: 8058216 - DNA, 22 bp, Homo sapiens
gttattgactctcttgtggctt

SEQ ID NO: 8058217 - DNA, 21 bp, Homo sapiens
gttattgacctccaggctggc

SEQ ID NO: 8058218 - DNA, 19 bp, Homo sapiens
gtggccagggcaggggctg

SEQ ID NO: 8058219 - DNA, 22 bp, Homo sapiens
gtggccagtgggaatgggctca

SEQ ID NO: 8058220 - DNA, 22 bp, Homo sapiens
gtggccagtggtgggcgccctg

SEQ ID NO: 8058221 - DNA, 22 bp, Homo sapiens
gtggccagggcccacaggatga

SEQ ID NO: 8058222 - DNA, 20 bp, Homo sapiens
cagctctgggaaagaggcca

SEQ ID NO: 8058223 - DNA, 20 bp, Homo sapiens
cagctctgggaaagaggcca

SEQ ID NO: 8058224 - DNA, 22 bp, Homo sapiens
cagctctggctttggggagctt

SEQ ID NO: 8058225 - DNA, 22 bp, Homo sapiens
cagctctggctattgaggacca

SEQ ID NO: 8058226 - DNA, 22 bp, Homo sapiens
cagctctggctattgaggacca

SEQ ID NO: 8058227 - DNA, 22 bp, Homo sapiens
cagctctgtgcaggcctgggga

SEQ ID NO: 8058228 - DNA, 22 bp, Homo sapiens
cagctctggcagagcccaaccc

SEQ ID NO: 8058229 - DNA, 22 bp, Homo sapiens
cagctctggcgtcagggagcga

SEQ ID NO: 8058230 - DNA, 22 bp, Homo sapiens
cagctctgctggtggtgccagg

SEQ ID NO: 8058231 - DNA, 22 bp, Homo sapiens
cagctctgctggtggtgccagg

SEQ ID NO: 8058232 - DNA, 22 bp, Homo sapiens
cagctctgcttccttgtacagg

SEQ ID NO: 8058233 - DNA, 22 bp, Homo sapiens
gtggcagaagagtaggatgggc

SEQ ID NO: 8058234 - DNA, 22 bp, Homo sapiens
gtggcagaaatgggactttgag

SEQ ID NO: 8058235 - DNA, 22 bp, Homo sapiens
gtggcagagaacaaggagaggt

SEQ ID NO: 8058236 - DNA, 22 bp, Homo sapiens
gtggcaggtcccattggagcag

SEQ ID NO: 8058237 - DNA, 22 bp, Homo sapiens
gtggcagagccaaggctggagc

SEQ ID NO: 8058238 - DNA, 22 bp, Homo sapiens
gtggcaggttataagcatctca

SEQ ID NO: 8058239 - DNA, 22 bp, Homo sapiens
gtggcaggttataagcatctca

SEQ ID NO: 8058240 - DNA, 22 bp, Homo sapiens
cagcccaggccgacagttcctc

SEQ ID NO: 8058241 - DNA, 22 bp, Homo sapiens
gtggcagaaactggcagaggag

SEQ ID NO: 8058242 - DNA, 22 bp, Homo sapiens
gtggcagaaactggcagaggag

SEQ ID NO: 8058243 - DNA, 22 bp, Homo sapiens
cagcccaggccgacagttcctc

SEQ ID NO: 8058244 - DNA, 22 bp, Homo sapiens
cagcccaggactgcaggtgttt

SEQ ID NO: 8058245 - DNA, 22 bp, Homo sapiens
cagcccaggccgacagttcctc

SEQ ID NO: 8058246 - DNA, 22 bp, Homo sapiens
cagcccagcgcaaacaactggc

SEQ ID NO: 8058247 - DNA, 22 bp, Homo sapiens
cagcccagctgggatcacactc

SEQ ID NO: 8058248 - DNA, 21 bp, Homo sapiens
cagcccagcttcttccccagt

SEQ ID NO: 8058249 - DNA, 22 bp, Homo sapiens
cagcccagccttgtctctttat

SEQ ID NO: 8058250 - DNA, 22 bp, Homo sapiens
cagcccagcgcaaacaactggc

SEQ ID NO: 8058251 - DNA, 22 bp, Homo sapiens
cagcccagccgagggcctggct

SEQ ID NO: 8058252 - DNA, 22 bp, Homo sapiens
cagcccagccgagggcctggct

SEQ ID NO: 8058253 - DNA, 22 bp, Homo sapiens
cagctctgttcatagatggtgc

SEQ ID NO: 8058254 - DNA, 22 bp, Homo sapiens
cagctctgttgccaaagtgggc

SEQ ID NO: 8058255 - DNA, 22 bp, Homo sapiens
cagctctgttgccaaagtgggc

SEQ ID NO: 8058256 - DNA, 22 bp, Homo sapiens
cagctcttaacacagcttgtat

SEQ ID NO: 8058257 - DNA, 22 bp, Homo sapiens
cagctcttggagcctccagtaa

SEQ ID NO: 8058258 - DNA, 22 bp, Homo sapiens
cagctcttttttgcagcagctg

SEQ ID NO: 8058259 - DNA, 22 bp, Homo sapiens
gtgggaagtctctcggaggaag

SEQ ID NO: 8058260 - DNA, 22 bp, Homo sapiens
gtgggaagaacttcaagtggct

SEQ ID NO: 8058261 - DNA, 19 bp, Homo sapiens
gtgggacagacattacata

SEQ ID NO: 8058262 - DNA, 22 bp, Homo sapiens
gtggcttggaccagtcacagtg

SEQ ID NO: 8058263 - DNA, 22 bp, Homo sapiens
gtggggagggagatgctgaagt

SEQ ID NO: 8058264 - DNA, 22 bp, Homo sapiens
gtgggcaggtaggcaccagcta

SEQ ID NO: 8058265 - DNA, 22 bp, Homo sapiens
gtgggcaggccccaaagcaggg

SEQ ID NO: 8058266 - DNA, 22 bp, Homo sapiens
gtgtgcctttcacacactggga

SEQ ID NO: 8058267 - DNA, 22 bp, Homo sapiens
gtgtgctcaagggcaggaacct

SEQ ID NO: 8058268 - DNA, 22 bp, Homo sapiens
gtgtgctgcccaactcgcagat

SEQ ID NO: 8058269 - DNA, 22 bp, Homo sapiens
gtgtgctgcccaactcgcagat

SEQ ID NO: 8058270 - DNA, 22 bp, Homo sapiens
cagctgggagctccattagata

SEQ ID NO: 8058271 - DNA, 22 bp, Homo sapiens
gtgtggcctcaacgggatgcaa

SEQ ID NO: 8058272 - DNA, 22 bp, Homo sapiens
cagctggggcagccacgtgcgg

SEQ ID NO: 8058273 - DNA, 22 bp, Homo sapiens
cagctgggtgatcttgggcagg

SEQ ID NO: 8058274 - DNA, 22 bp, Homo sapiens
cagctggggagagacatggcag

SEQ ID NO: 8058275 - DNA, 22 bp, Homo sapiens
cagctggggagagacatggcag

SEQ ID NO: 8058276 - DNA, 22 bp, Homo sapiens
cagctgggcctcctgagccctg

SEQ ID NO: 8058277 - DNA, 22 bp, Homo sapiens
cagctgtgacagccagttgatg

SEQ ID NO: 8058278 - DNA, 22 bp, Homo sapiens
cagctgtgacagccagttgatg

SEQ ID NO: 8058279 - DNA, 17 bp, Homo sapiens
cagctgtgagagcctta

SEQ ID NO: 8058280 - DNA, 17 bp, Homo sapiens
cagctgtgagagcctta

SEQ ID NO: 8058281 - DNA, 22 bp, Homo sapiens
cagctgtgagagtgcattgaag

SEQ ID NO: 8058282 - DNA, 22 bp, Homo sapiens
cagctgtgagcagccagttgcc

SEQ ID NO: 8058283 - DNA, 22 bp, Homo sapiens
cagctgtgagcagccagttgcc

SEQ ID NO: 8058284 - DNA, 22 bp, Homo sapiens
gtgggtggggagctctctggag

SEQ ID NO: 8058285 - DNA, 22 bp, Homo sapiens
gtggtaccagtaggtcagccat

SEQ ID NO: 8058286 - DNA, 22 bp, Homo sapiens
gtgtctggaacgggtggtactc

SEQ ID NO: 8058287 - DNA, 22 bp, Homo sapiens
gtgtcaaatccactcctctttt

SEQ ID NO: 8058288 - DNA, 22 bp, Homo sapiens
cagctggctgcatgatgccaaa

SEQ ID NO: 8058289 - DNA, 22 bp, Homo sapiens
cagctggcgcctggggaccaga

SEQ ID NO: 8058290 - DNA, 22 bp, Homo sapiens
cagctggcgggcagagccgcca

SEQ ID NO: 8058291 - DNA, 22 bp, Homo sapiens
cagctggctccacctctgggct

SEQ ID NO: 8058292 - DNA, 22 bp, Homo sapiens
cagctggccctttggtagcctt

SEQ ID NO: 8058293 - DNA, 22 bp, Homo sapiens
cagctggcctgatccctgtggc

SEQ ID NO: 8058294 - DNA, 22 bp, Homo sapiens
cagctgctctggtggtctctcc

SEQ ID NO: 8058295 - DNA, 22 bp, Homo sapiens
cagctgcctgtctggaggcaat

SEQ ID NO: 8058296 - DNA, 22 bp, Homo sapiens
cagctggccaatcagggcgccc

SEQ ID NO: 8058297 - DNA, 20 bp, Homo sapiens
cagctgcctggctctgggat

SEQ ID NO: 8058298 - DNA, 22 bp, Homo sapiens
cagctgcctgcaacacaagctt

SEQ ID NO: 8058299 - DNA, 22 bp, Homo sapiens
cagctgcctgtattgtcctcat

SEQ ID NO: 8058300 - DNA, 22 bp, Homo sapiens
cagctgcctatgacctagcctc

SEQ ID NO: 8058301 - DNA, 22 bp, Homo sapiens
cagctgccacttgctctcggct

SEQ ID NO: 8058302 - DNA, 22 bp, Homo sapiens
gtggggctggaagatgggtact

SEQ ID NO: 8058303 - DNA, 22 bp, Homo sapiens
gtggggcagtggcctgggagca

SEQ ID NO: 8058304 - DNA, 22 bp, Homo sapiens
gtggggagtgttctgtgattgg

SEQ ID NO: 8058305 - DNA, 22 bp, Homo sapiens
gtggggctcccatctcctggct

SEQ ID NO: 8058306 - DNA, 22 bp, Homo sapiens
gtggggctaaaaactgtgcagt

SEQ ID NO: 8058307 - DNA, 22 bp, Homo sapiens
caggaagctgagctgcactgca

SEQ ID NO: 8058308 - DNA, 22 bp, Homo sapiens
caggacagtataggctttagga

SEQ ID NO: 8058309 - DNA, 22 bp, Homo sapiens
caggacaggtgttctagatcag

SEQ ID NO: 8058310 - DNA, 22 bp, Homo sapiens
caggacagtgcaggtccatcct

SEQ ID NO: 8058311 - DNA, 22 bp, Homo sapiens
caggacagtgcaggtccatcct

SEQ ID NO: 8058312 - DNA, 22 bp, Homo sapiens
caggacagctgggccaccacca

SEQ ID NO: 8058313 - DNA, 22 bp, Homo sapiens
caggacagctcaacacctcctc

SEQ ID NO: 8058314 - DNA, 22 bp, Homo sapiens
caggacaggccctgtggggtct

SEQ ID NO: 8058315 - DNA, 22 bp, Homo sapiens
caggacaggccctgtggggtct

SEQ ID NO: 8058316 - DNA, 22 bp, Homo sapiens
caggacaggagtggggtcaaag

SEQ ID NO: 8058317 - DNA, 22 bp, Homo sapiens
caggacaggagtggggtcaaag

SEQ ID NO: 8058318 - DNA, 22 bp, Homo sapiens
gttttcttcctgcaattggcat

SEQ ID NO: 8058319 - DNA, 22 bp, Homo sapiens
caggaccaggcgttctgggctg

SEQ ID NO: 8058320 - DNA, 22 bp, Homo sapiens
caggacccatcagccaggcact

SEQ ID NO: 8058321 - DNA, 22 bp, Homo sapiens
caggacagtttgctttgccctg

SEQ ID NO: 8058322 - DNA, 19 bp, Homo sapiens
caggacagtttgccaagaa

SEQ ID NO: 8058323 - DNA, 22 bp, Homo sapiens
caggacagttggcatctgctgc

SEQ ID NO: 8058324 - DNA, 19 bp, Homo sapiens
caggacagtttgccaagaa

SEQ ID NO: 8058325 - DNA, 22 bp, Homo sapiens
caggagaagtctctagggggtg

SEQ ID NO: 8058326 - DNA, 22 bp, Homo sapiens
caggagaaggtttggagtgcag

SEQ ID NO: 8058327 - DNA, 22 bp, Homo sapiens
caggagacaatggctgtggggc

SEQ ID NO: 8058328 - DNA, 22 bp, Homo sapiens
caggacagttggcatctgctgc

SEQ ID NO: 8058329 - DNA, 22 bp, Homo sapiens
caggacagtgcaggtccatcct

SEQ ID NO: 8058330 - DNA, 22 bp, Homo sapiens
caggagtgtcgggtcactaggt

SEQ ID NO: 8058331 - DNA, 22 bp, Homo sapiens
caggagtgtctccacacagcaa

SEQ ID NO: 8058332 - DNA, 22 bp, Homo sapiens
caggagtgtcgggtcactaggt

SEQ ID NO: 8058333 - DNA, 22 bp, Homo sapiens
caggagtggtgtgagggactcc

SEQ ID NO: 8058334 - DNA, 22 bp, Homo sapiens
caggagtgttgattgctcagga

SEQ ID NO: 8058335 - DNA, 22 bp, Homo sapiens
caggaggcagaggttgcagcga

SEQ ID NO: 8058336 - DNA, 22 bp, Homo sapiens
caggaggcagaggatgcccagt

SEQ ID NO: 8058337 - DNA, 20 bp, Homo sapiens
caggaggcaaggtcaaggtc

SEQ ID NO: 8058338 - DNA, 22 bp, Homo sapiens
taaatcaagaatatcagcttgt

SEQ ID NO: 8058339 - DNA, 22 bp, Homo sapiens
taaagtgcatgcggggccagat

SEQ ID NO: 8058340 - DNA, 22 bp, Homo sapiens
caggagagatatgagtccccac

SEQ ID NO: 8058341 - DNA, 22 bp, Homo sapiens
caggagagatatgagtccccac

SEQ ID NO: 8058342 - DNA, 22 bp, Homo sapiens
caggagagcccgggtccgggct

SEQ ID NO: 8058343 - DNA, 22 bp, Homo sapiens
taacagaaaggggacagaaata

SEQ ID NO: 8058344 - DNA, 22 bp, Homo sapiens
caggatggtctcgatctcctga

SEQ ID NO: 8058345 - DNA, 22 bp, Homo sapiens
caggatgctgaaaacacgagga

SEQ ID NO: 8058346 - DNA, 22 bp, Homo sapiens
caggatggtcttcatttggctc

SEQ ID NO: 8058347 - DNA, 22 bp, Homo sapiens
caggatggtggcatgatcagaa

SEQ ID NO: 8058348 - DNA, 22 bp, Homo sapiens
caggatgaggtagaggcagata

SEQ ID NO: 8058349 - DNA, 22 bp, Homo sapiens
caggatctgccaatattcaacc

SEQ ID NO: 8058350 - DNA, 22 bp, Homo sapiens
caggatgaagggcaaaggcaag

SEQ ID NO: 8058351 - DNA, 22 bp, Homo sapiens
taagaaacccaggaatttctta

SEQ ID NO: 8058352 - DNA, 22 bp, Homo sapiens
taactttaggaataggtaatct

SEQ ID NO: 8058353 - DNA, 22 bp, Homo sapiens
taactttagtgtatgaggtaag

SEQ ID NO: 8058354 - DNA, 22 bp, Homo sapiens
taactttgatcacttgataagg

SEQ ID NO: 8058355 - DNA, 21 bp, Homo sapiens
taacttttgtgcctatcttgt

SEQ ID NO: 8058356 - DNA, 22 bp, Homo sapiens
taagaaacatgatacttttcct

SEQ ID NO: 8058357 - DNA, 22 bp, Homo sapiens
caggcaagatccagaggctgct

SEQ ID NO: 8058358 - DNA, 22 bp, Homo sapiens
caggatggtgtgagtgtgagga

SEQ ID NO: 8058359 - DNA, 22 bp, Homo sapiens
caggatggtgtgagtgtgagga

SEQ ID NO: 8058360 - DNA, 22 bp, Homo sapiens
caggcaagattagagatgagca

SEQ ID NO: 8058361 - DNA, 22 bp, Homo sapiens
caggcaagcaaggggtcttgaa

SEQ ID NO: 8058362 - DNA, 22 bp, Homo sapiens
caggcaaggaggcactgaggga

SEQ ID NO: 8058363 - DNA, 22 bp, Homo sapiens
caggcaaggagctggctcaagt

SEQ ID NO: 8058364 - DNA, 22 bp, Homo sapiens
caggcaaggaggcactgaggga

SEQ ID NO: 8058365 - DNA, 22 bp, Homo sapiens
caggcacaaatttctagataag

SEQ ID NO: 8058366 - DNA, 22 bp, Homo sapiens
caggcacagctaagactggcca

SEQ ID NO: 8058367 - DNA, 22 bp, Homo sapiens
caggcacagctgggcaattgcg

SEQ ID NO: 8058368 - DNA, 22 bp, Homo sapiens
caggcacaggggaatgtctttt

SEQ ID NO: 8058369 - DNA, 22 bp, Homo sapiens
caggcacagtggggtcctctct

SEQ ID NO: 8058370 - DNA, 22 bp, Homo sapiens
caggcacagtgttgctgttcaa

SEQ ID NO: 8058371 - DNA, 22 bp, Homo sapiens
caggcacagttccaagcatttt

SEQ ID NO: 8058372 - DNA, 17 bp, Homo sapiens
caggcacatgaagccag

SEQ ID NO: 8058373 - DNA, 22 bp, Homo sapiens
caggcacatgggagctcatcat

SEQ ID NO: 8058374 - DNA, 19 bp, Homo sapiens
taagacacaaatgcaagcc

SEQ ID NO: 8058375 - DNA, 22 bp, Homo sapiens
taagacacaaatatcttttaca

SEQ ID NO: 8058376 - DNA, 22 bp, Homo sapiens
caggcagaaattttgtttcatt

SEQ ID NO: 8058377 - DNA, 22 bp, Homo sapiens
caggcactttgctgggggcgca

SEQ ID NO: 8058378 - DNA, 22 bp, Homo sapiens
taagcaacaaggtgtttaaatt

SEQ ID NO: 8058379 - DNA, 22 bp, Homo sapiens
taagcaacaaatggtttctgat

SEQ ID NO: 8058380 - DNA, 22 bp, Homo sapiens
taagacacagtccgcactctct

SEQ ID NO: 8058381 - DNA, 22 bp, Homo sapiens
taagacacattcatatctgtct

SEQ ID NO: 8058382 - DNA, 22 bp, Homo sapiens
taagacacatgcgtacaagata

SEQ ID NO: 8058383 - DNA, 22 bp, Homo sapiens
taagacacattgagaaacacaa

SEQ ID NO: 8058384 - DNA, 22 bp, Homo sapiens
taagacacattggagtagatga

SEQ ID NO: 8058385 - DNA, 23 bp, Homo sapiens
taagacacccgactccagagatg

SEQ ID NO: 8058386 - DNA, 22 bp, Homo sapiens
taagacacctctctgcccttca

SEQ ID NO: 8058387 - DNA, 22 bp, Homo sapiens
taagacacgggctgatctaaag

SEQ ID NO: 8058388 - DNA, 22 bp, Homo sapiens
taattgtaaagtagtagtacag

SEQ ID NO: 8058389 - DNA, 22 bp, Homo sapiens
caggcagagccaatcgtggggt

SEQ ID NO: 8058390 - DNA, 22 bp, Homo sapiens
caggcagagcaactggtccaga

SEQ ID NO: 8058391 - DNA, 22 bp, Homo sapiens
caggcagctgggtcaccgtccc

SEQ ID NO: 8058392 - DNA, 22 bp, Homo sapiens
caggcagctgaggactttgcta

SEQ ID NO: 8058393 - DNA, 22 bp, Homo sapiens
caggcaggagaggaggatttct

SEQ ID NO: 8058394 - DNA, 23 bp, Homo sapiens
caggcaggatgaggactacactc

SEQ ID NO: 8058395 - DNA, 22 bp, Homo sapiens
caggcaggagccagggattcca

SEQ ID NO: 8058396 - DNA, 22 bp, Homo sapiens
caggcagctctaatggaaagtg

SEQ ID NO: 8058397 - DNA, 22 bp, Homo sapiens
caggcagctctaatggaaagtg

SEQ ID NO: 8058398 - DNA, 22 bp, Homo sapiens
caggcagcctgagggatctggg

SEQ ID NO: 8058399 - DNA, 22 bp, Homo sapiens
caggcagctgactgtcagatat

SEQ ID NO: 8058400 - DNA, 22 bp, Homo sapiens
caggcagctgactgtcagatat

SEQ ID NO: 8058401 - DNA, 22 bp, Homo sapiens
caggcagctctaatggaaagtg

SEQ ID NO: 8058402 - DNA, 22 bp, Homo sapiens
caggcagcatttactctgatga

SEQ ID NO: 8058403 - DNA, 22 bp, Homo sapiens
caggcagccaggggacctgtcc

SEQ ID NO: 8058404 - DNA, 22 bp, Homo sapiens
caggcagccaggggacctgtcc

SEQ ID NO: 8058405 - DNA, 22 bp, Homo sapiens
caggcagcatcagtctgctgta

SEQ ID NO: 8058406 - DNA, 22 bp, Homo sapiens
caggcagcatcagtctgctgta

SEQ ID NO: 8058407 - DNA, 22 bp, Homo sapiens
caggcagcatttactctgatga

SEQ ID NO: 8058408 - DNA, 22 bp, Homo sapiens
caggcagcagccactctggtat

SEQ ID NO: 8058409 - DNA, 22 bp, Homo sapiens
caggcagcagccactctggtat

SEQ ID NO: 8058410 - DNA, 22 bp, Homo sapiens
caggcagcaggagccctgctcg

SEQ ID NO: 8058411 - DNA, 22 bp, Homo sapiens
caggcagcaggagccctgctcg

SEQ ID NO: 8058412 - DNA, 22 bp, Homo sapiens
caggcagcaggagccctgctcg

SEQ ID NO: 8058413 - DNA, 22 bp, Homo sapiens
caggccctgggcaggcacagag

SEQ ID NO: 8058414 - DNA, 22 bp, Homo sapiens
caggccctgggcaggatcagcc

SEQ ID NO: 8058415 - DNA, 22 bp, Homo sapiens
caggccctggcagggctgagtc

SEQ ID NO: 8058416 - DNA, 18 bp, Homo sapiens
caggccctgtctggcctc

SEQ ID NO: 8058417 - DNA, 22 bp, Homo sapiens
caggccctttcctgggcatagg

SEQ ID NO: 8058418 - DNA, 22 bp, Homo sapiens
tacaggtgctctacagacagga

SEQ ID NO: 8058419 - DNA, 22 bp, Homo sapiens
tacaggtggatcactagtatag

SEQ ID NO: 8058420 - DNA, 22 bp, Homo sapiens
tacaggtggtaaaaatattgtt

SEQ ID NO: 8058421 - DNA, 22 bp, Homo sapiens
tacatgtggagataactgaagc

SEQ ID NO: 8058422 - DNA, 22 bp, Homo sapiens
tacatgtgctatttgttttgta

SEQ ID NO: 8058423 - DNA, 22 bp, Homo sapiens
tacatgtgctgggttcttggcc

SEQ ID NO: 8058424 - DNA, 22 bp, Homo sapiens
tacatgtggagttttctagtca

SEQ ID NO: 8058425 - DNA, 22 bp, Homo sapiens
tacatgtggccagaaatttgag

SEQ ID NO: 8058426 - DNA, 22 bp, Homo sapiens
tacatgtgatcagaaagtgaaa

SEQ ID NO: 8058427 - DNA, 22 bp, Homo sapiens
tacatgtgcacgtgtgactttg

SEQ ID NO: 8058428 - DNA, 21 bp, Homo sapiens
tacatcagttttcttggctca

SEQ ID NO: 8058429 - DNA, 22 bp, Homo sapiens
tacatattcaacgttcagtatt

SEQ ID NO: 8058430 - DNA, 22 bp, Homo sapiens
caggcagggagctggaaaggat

SEQ ID NO: 8058431 - DNA, 22 bp, Homo sapiens
tacaaatgaccatagccactta

SEQ ID NO: 8058432 - DNA, 22 bp, Homo sapiens
tacaggggtaacagtggggaat

SEQ ID NO: 8058433 - DNA, 22 bp, Homo sapiens
ccagaggagcaggctggctcca

SEQ ID NO: 8058434 - DNA, 22 bp, Homo sapiens
ccagaggagggctctgatgagg

SEQ ID NO: 8058435 - DNA, 22 bp, Homo sapiens
tctcctgggaggacaaggaagg

SEQ ID NO: 8058436 - DNA, 22 bp, Homo sapiens
tctccataggcagttcataaca

SEQ ID NO: 8058437 - DNA, 22 bp, Homo sapiens
ccagaatttgaactcaggcaat

SEQ ID NO: 8058438 - DNA, 22 bp, Homo sapiens
ccagaatttggatcatgatttt

SEQ ID NO: 8058439 - DNA, 22 bp, Homo sapiens
ccagaattcagaaagggcataa

SEQ ID NO: 8058440 - DNA, 20 bp, Homo sapiens
ccagacagcacctgcctggt

SEQ ID NO: 8058441 - DNA, 22 bp, Homo sapiens
ccagacagcagttaaaggacat

SEQ ID NO: 8058442 - DNA, 22 bp, Homo sapiens
ccagacagcagttaaaggacat

SEQ ID NO: 8058443 - DNA, 22 bp, Homo sapiens
ccagacaggaacacacatctcc

SEQ ID NO: 8058444 - DNA, 22 bp, Homo sapiens
ccagagcctgctgagccccatt

SEQ ID NO: 8058445 - DNA, 22 bp, Homo sapiens
ccagacaggggctgttcctgct

SEQ ID NO: 8058446 - DNA, 21 bp, Homo sapiens
ccagagcctgctgagccccct

SEQ ID NO: 8058447 - DNA, 22 bp, Homo sapiens
ccagagctgcatccagcaggtt

SEQ ID NO: 8058448 - DNA, 22 bp, Homo sapiens
ccactgcctgacttagatgaca

SEQ ID NO: 8058449 - DNA, 22 bp, Homo sapiens
ccactgccgtgggccttgggga

SEQ ID NO: 8058450 - DNA, 22 bp, Homo sapiens
ccactgcccaccccgacgtcta

SEQ ID NO: 8058451 - DNA, 22 bp, Homo sapiens
ccactgccatgggctaggcatg

SEQ ID NO: 8058452 - DNA, 22 bp, Homo sapiens
ccactgagtacccgatggctgc

SEQ ID NO: 8058453 - DNA, 22 bp, Homo sapiens
ccactgcacttcagcctgggtg

SEQ ID NO: 8058454 - DNA, 22 bp, Homo sapiens
ccactgcactccagccttggca

SEQ ID NO: 8058455 - DNA, 22 bp, Homo sapiens
ccactgccagccgcccggaggc

SEQ ID NO: 8058456 - DNA, 16 bp, Homo sapiens
ccacctgcagctctca

SEQ ID NO: 8058457 - DNA, 22 bp, Homo sapiens
ccactgacacagacaaggcctg

SEQ ID NO: 8058458 - DNA, 23 bp, Homo sapiens
ccactgaagaatccagggagttt

SEQ ID NO: 8058459 - DNA, 18 bp, Homo sapiens
tcctggtggagaagtggt

SEQ ID NO: 8058460 - DNA, 19 bp, Homo sapiens
tcctggtgcttgacactga

SEQ ID NO: 8058461 - DNA, 22 bp, Homo sapiens
tcctggtgcttgtatttgaagt

SEQ ID NO: 8058462 - DNA, 20 bp, Homo sapiens
tcctggtggatactgcttaa

SEQ ID NO: 8058463 - DNA, 22 bp, Homo sapiens
tcctggtggatagaagccaagg

SEQ ID NO: 8058464 - DNA, 23 bp, Homo sapiens
tcctggtgacatgcctgagcatc

SEQ ID NO: 8058465 - DNA, 19 bp, Homo sapiens
tcctggtgaccctgaaatt

SEQ ID NO: 8058466 - DNA, 22 bp, Homo sapiens
tcctggtgaggactccaagata

SEQ ID NO: 8058467 - DNA, 22 bp, Homo sapiens
tcctggtgaggctagaagtgtc

SEQ ID NO: 8058468 - DNA, 22 bp, Homo sapiens
tcctggtgatcaaaattcattt

SEQ ID NO: 8058469 - DNA, 22 bp, Homo sapiens
tcctggtgcctggagctctcca

SEQ ID NO: 8058470 - DNA, 22 bp, Homo sapiens
tcctggtgctgacacccatagc

SEQ ID NO: 8058471 - DNA, 22 bp, Homo sapiens
tcctggtgaatgactttttatt

SEQ ID NO: 8058472 - DNA, 22 bp, Homo sapiens
catttatataaaatgtccagaa

SEQ ID NO: 8058473 - DNA, 22 bp, Homo sapiens
tcccagggtcagtggtgaggcc

SEQ ID NO: 8058474 - DNA, 21 bp, Homo sapiens
tcccagggccaggtgccatca

SEQ ID NO: 8058475 - DNA, 22 bp, Homo sapiens
tccctgcctgacagcacccacc

SEQ ID NO: 8058476 - DNA, 22 bp, Homo sapiens
catttgctgtaatgacaataag

SEQ ID NO: 8058477 - DNA, 23 bp, Homo sapiens
catttgatcctcacaataaatgg

SEQ ID NO: 8058478 - DNA, 22 bp, Homo sapiens
catttgaagacttagaagagga

SEQ ID NO: 8058479 - DNA, 22 bp, Homo sapiens
tccctgctgcactcacacctac

SEQ ID NO: 8058480 - DNA, 22 bp, Homo sapiens
tccctgctgagagtgctctccc

SEQ ID NO: 8058481 - DNA, 22 bp, Homo sapiens
tccctgcttggaatgaccctta

SEQ ID NO: 8058482 - DNA, 21 bp, Homo sapiens
tccctgctttctggcccagtc

SEQ ID NO: 8058483 - DNA, 22 bp, Homo sapiens
ccacaaggcctgtggggctgct

SEQ ID NO: 8058484 - DNA, 22 bp, Homo sapiens
ccacacagataagtgttttcta

SEQ ID NO: 8058485 - DNA, 22 bp, Homo sapiens
tcctgcagtgtgtctcctgcac

SEQ ID NO: 8058486 - DNA, 22 bp, Homo sapiens
tcctgcagttacatcccagcca

SEQ ID NO: 8058487 - DNA, 22 bp, Homo sapiens
ccacagaggacaactgcctggc

SEQ ID NO: 8058488 - DNA, 19 bp, Homo sapiens
tcctgcccaccagccaggg

SEQ ID NO: 8058489 - DNA, 22 bp, Homo sapiens
ccacagagtcttccttctcttc

SEQ ID NO: 8058490 - DNA, 20 bp, Homo sapiens
tcctgcagttcctaggaggg

SEQ ID NO: 8058491 - DNA, 22 bp, Homo sapiens
ccacagccattccagggaggct

SEQ ID NO: 8058492 - DNA, 19 bp, Homo sapiens
ccacagcctgctgtcttcc

SEQ ID NO: 8058493 - DNA, 17 bp, Homo sapiens
ccacagcctggcacttg

SEQ ID NO: 8058494 - DNA, 22 bp, Homo sapiens
ccacagcatgcaggcctgacac

SEQ ID NO: 8058495 - DNA, 22 bp, Homo sapiens
ccacagagttgatgcaataaga

SEQ ID NO: 8058496 - DNA, 22 bp, Homo sapiens
tctgcctgaaattcacatgtaa

SEQ ID NO: 8058497 - DNA, 22 bp, Homo sapiens
tctgccttgccgaattccaggc

SEQ ID NO: 8058498 - DNA, 22 bp, Homo sapiens
tctgcctgaaccactcttggag

SEQ ID NO: 8058499 - DNA, 22 bp, Homo sapiens
tctgcctttcccaggctactgt

SEQ ID NO: 8058500 - DNA, 22 bp, Homo sapiens
ccagctggtaagtgatggagcc

SEQ ID NO: 8058501 - DNA, 22 bp, Homo sapiens
ccagctggtaagtgatggagcc

SEQ ID NO: 8058502 - DNA, 22 bp, Homo sapiens
ccagctgggtccctgctggggc

SEQ ID NO: 8058503 - DNA, 22 bp, Homo sapiens
ccagctgggattaagggaaaat

SEQ ID NO: 8058504 - DNA, 22 bp, Homo sapiens
ccagctggttaaaatagagaaa

SEQ ID NO: 8058505 - DNA, 22 bp, Homo sapiens
ccagctggtgttccttaggacc

SEQ ID NO: 8058506 - DNA, 22 bp, Homo sapiens
ccagctggtctgtgctcatgtt

SEQ ID NO: 8058507 - DNA, 22 bp, Homo sapiens
ccagctgtttctgatgctaggc

SEQ ID NO: 8058508 - DNA, 22 bp, Homo sapiens
tctggaggcaggctgccaggat

SEQ ID NO: 8058509 - DNA, 22 bp, Homo sapiens
tctggagcttgtttcagatggt

SEQ ID NO: 8058510 - DNA, 22 bp, Homo sapiens
tctgtggcaaacacagtgacca

SEQ ID NO: 8058511 - DNA, 22 bp, Homo sapiens
ccagcttcggcaagcagacttt

SEQ ID NO: 8058512 - DNA, 22 bp, Homo sapiens
ccagcttctccttatgtcctca

SEQ ID NO: 8058513 - DNA, 22 bp, Homo sapiens
ccaggagcgcgtgaacaggctg

SEQ ID NO: 8058514 - DNA, 22 bp, Homo sapiens
ccagcccatgcccttatagcat

SEQ ID NO: 8058515 - DNA, 19 bp, Homo sapiens
ccagcccatagtccatcac

SEQ ID NO: 8058516 - DNA, 21 bp, Homo sapiens
ccagcccagcctccttctctt

SEQ ID NO: 8058517 - DNA, 21 bp, Homo sapiens
ccagcccagcctccttctctt

SEQ ID NO: 8058518 - DNA, 19 bp, Homo sapiens
ccagcccacagtgactttc

SEQ ID NO: 8058519 - DNA, 19 bp, Homo sapiens
ccagcccacagtgactttc

SEQ ID NO: 8058520 - DNA, 21 bp, Homo sapiens
ccagcccagctgtgtcccagc

SEQ ID NO: 8058521 - DNA, 21 bp, Homo sapiens
ccagcccagctgtgtcccagc

SEQ ID NO: 8058522 - DNA, 19 bp, Homo sapiens
ccagcccatagtccatcac

SEQ ID NO: 8058523 - DNA, 22 bp, Homo sapiens
ccagcccaaacaagccgccttc

SEQ ID NO: 8058524 - DNA, 22 bp, Homo sapiens
ccagcccaaacaagccgccttc

SEQ ID NO: 8058525 - DNA, 22 bp, Homo sapiens
ccagcccaaagtcaccccggga

SEQ ID NO: 8058526 - DNA, 22 bp, Homo sapiens
ccagccctcactgaggcctctc

SEQ ID NO: 8058527 - DNA, 22 bp, Homo sapiens
tctgaaatatattttgagtgtt

SEQ ID NO: 8058528 - DNA, 22 bp, Homo sapiens
ccagccactgggccactgccag

SEQ ID NO: 8058529 - DNA, 22 bp, Homo sapiens
ccagccagtcccgcatgaccgc

SEQ ID NO: 8058530 - DNA, 22 bp, Homo sapiens
ccagccagtccagcattggtgt

SEQ ID NO: 8058531 - DNA, 22 bp, Homo sapiens
tctcttggaggttcttcctgtt

SEQ ID NO: 8058532 - DNA, 22 bp, Homo sapiens
tctctctgtgacagctttgctg

SEQ ID NO: 8058533 - DNA, 22 bp, Homo sapiens
ccagcctggagggcagtggtgg

SEQ ID NO: 8058534 - DNA, 22 bp, Homo sapiens
ccagcctggagggcagtggtgg

SEQ ID NO: 8058535 - DNA, 23 bp, Homo sapiens
ccagctcatccattacctctctt

SEQ ID NO: 8058536 - DNA, 22 bp, Homo sapiens
ccagctccagcatagccaccat

SEQ ID NO: 8058537 - DNA, 22 bp, Homo sapiens
ccagctccactgtcagatgaga

SEQ ID NO: 8058538 - DNA, 22 bp, Homo sapiens
ccagctccactgtcagatgaga

SEQ ID NO: 8058539 - DNA, 22 bp, Homo sapiens
ccagccttgcaccgagccagcc

SEQ ID NO: 8058540 - DNA, 23 bp, Homo sapiens
ccagcgctcactcagagcatgtt

SEQ ID NO: 8058541 - DNA, 22 bp, Homo sapiens
ccagcctgggtgttagaagaca

SEQ ID NO: 8058542 - DNA, 22 bp, Homo sapiens
ccagctccaggactgggagctg

SEQ ID NO: 8058543 - DNA, 22 bp, Homo sapiens
ccagctcctcttcccagtgtca

SEQ ID NO: 8058544 - DNA, 22 bp, Homo sapiens
ccagctctaaacggctctgtgg

SEQ ID NO: 8058545 - DNA, 22 bp, Homo sapiens
ccagctctagccccatgtggct

SEQ ID NO: 8058546 - DNA, 22 bp, Homo sapiens
ccagctctcagcgggagactca

SEQ ID NO: 8058547 - DNA, 22 bp, Homo sapiens
tctgccaccacctacactagta

SEQ ID NO: 8058548 - DNA, 22 bp, Homo sapiens
tctgccacttttgcttactggg

SEQ ID NO: 8058549 - DNA, 22 bp, Homo sapiens
tctgccagacctgactcagtag

SEQ ID NO: 8058550 - DNA, 22 bp, Homo sapiens
tctgccaggaagaaagcacaat

SEQ ID NO: 8058551 - DNA, 22 bp, Homo sapiens
tatggctactacgaataatgct

SEQ ID NO: 8058552 - DNA, 22 bp, Homo sapiens
tatggctaattctttactgacc

SEQ ID NO: 8058553 - DNA, 22 bp, Homo sapiens
caggtctgtattaacagagggt

SEQ ID NO: 8058554 - DNA, 22 bp, Homo sapiens
tatggcaattgtctaagtttta

SEQ ID NO: 8058555 - DNA, 22 bp, Homo sapiens
tatggcaatatgtatcaagatc

SEQ ID NO: 8058556 - DNA, 22 bp, Homo sapiens
tatggcaaaactctttatccaa

SEQ ID NO: 8058557 - DNA, 22 bp, Homo sapiens
tatggcaagagaatcaactgaa

SEQ ID NO: 8058558 - DNA, 22 bp, Homo sapiens
tatggcaagatgacatgttctc

SEQ ID NO: 8058559 - DNA, 22 bp, Homo sapiens
tatgttttaggaattaattgtt

SEQ ID NO: 8058560 - DNA, 22 bp, Homo sapiens
tatgtgtcaaaccattcatctg

SEQ ID NO: 8058561 - DNA, 22 bp, Homo sapiens
tatgtgtccctgctactcaaca

SEQ ID NO: 8058562 - DNA, 22 bp, Homo sapiens
tatgtgtcccttggtgtagcaa

SEQ ID NO: 8058563 - DNA, 22 bp, Homo sapiens
tatgtgtcctaagcaatcatcc

SEQ ID NO: 8058564 - DNA, 22 bp, Homo sapiens
tataatgttttccatggactga

SEQ ID NO: 8058565 - DNA, 22 bp, Homo sapiens
tacatgtgggttaaaaacactc

SEQ ID NO: 8058566 - DNA, 22 bp, Homo sapiens
tacatgtggtagggagggcagt

SEQ ID NO: 8058567 - DNA, 17 bp, Homo sapiens
tacatgtgtatctgatt

SEQ ID NO: 8058568 - DNA, 22 bp, Homo sapiens
tacatgtgttctgtttcaagtt

SEQ ID NO: 8058569 - DNA, 22 bp, Homo sapiens
caggggccggctgtccgtgccc

SEQ ID NO: 8058570 - DNA, 22 bp, Homo sapiens
caggggcctggctgtctaggaa

SEQ ID NO: 8058571 - DNA, 22 bp, Homo sapiens
caggggccaggctgtctgctgt

SEQ ID NO: 8058572 - DNA, 22 bp, Homo sapiens
caggggccaggctgtctgctgt

SEQ ID NO: 8058573 - DNA, 22 bp, Homo sapiens
caggggccaagggtccagacct

SEQ ID NO: 8058574 - DNA, 22 bp, Homo sapiens
cagggtcttggcgccatcaccc

SEQ ID NO: 8058575 - DNA, 22 bp, Homo sapiens
cagggtggaacaggcaatactt

SEQ ID NO: 8058576 - DNA, 22 bp, Homo sapiens
tatacagtcttttgctatattc

SEQ ID NO: 8058577 - DNA, 22 bp, Homo sapiens
cagggtggcactcagcgcatct

SEQ ID NO: 8058578 - DNA, 22 bp, Homo sapiens
cagggtggcacatcacagcatt

SEQ ID NO: 8058579 - DNA, 22 bp, Homo sapiens
caggtctggcatcagctgtgtg

SEQ ID NO: 8058580 - DNA, 22 bp, Homo sapiens
tcactcagcattcactgggcct

SEQ ID NO: 8058581 - DNA, 22 bp, Homo sapiens
tcacccagattacatcctgtca

SEQ ID NO: 8058582 - DNA, 22 bp, Homo sapiens
tcacccagaaaagacagcagat

SEQ ID NO: 8058583 - DNA, 22 bp, Homo sapiens
tcagaaatacaaaacacttact

SEQ ID NO: 8058584 - DNA, 22 bp, Homo sapiens
tcagaaatagtctttaaaatga

SEQ ID NO: 8058585 - DNA, 22 bp, Homo sapiens
tcagaaatgatcgttattcatt

SEQ ID NO: 8058586 - DNA, 22 bp, Homo sapiens
tcagaaatttaggctggacttg

SEQ ID NO: 8058587 - DNA, 23 bp, Homo sapiens
cagtgctggttctgcctgtgggg

SEQ ID NO: 8058588 - DNA, 22 bp, Homo sapiens
cagtgctgtgctggaagctgtt

SEQ ID NO: 8058589 - DNA, 22 bp, Homo sapiens
cagtgctgtgtttgctgcctgg

SEQ ID NO: 8058590 - DNA, 22 bp, Homo sapiens
tcaccattggcaattataaaac

SEQ ID NO: 8058591 - DNA, 22 bp, Homo sapiens
cagtgctgagagcctggccagg

SEQ ID NO: 8058592 - DNA, 22 bp, Homo sapiens
cagtgctgagagcctggccagg

SEQ ID NO: 8058593 - DNA, 22 bp, Homo sapiens
cagtgctgcaggcgcctgcggt

SEQ ID NO: 8058594 - DNA, 22 bp, Homo sapiens
cagtgctggaggggtgcttgca

SEQ ID NO: 8058595 - DNA, 22 bp, Homo sapiens
cagtgctggaggggtgcttgca

SEQ ID NO: 8058596 - DNA, 22 bp, Homo sapiens
cagtgctggtgtaggctgacca

SEQ ID NO: 8058597 - DNA, 22 bp, Homo sapiens
cagtgcaacgttgtgcattcaa

SEQ ID NO: 8058598 - DNA, 22 bp, Homo sapiens
cagtgatcgcactcaacagttt

SEQ ID NO: 8058599 - DNA, 22 bp, Homo sapiens
cagtgcaatgttaaataggaaa

SEQ ID NO: 8058600 - DNA, 17 bp, Homo sapiens
cagtgcagagccctttc

SEQ ID NO: 8058601 - DNA, 22 bp, Homo sapiens
cagtctctaaatcaatctgaat

SEQ ID NO: 8058602 - DNA, 22 bp, Homo sapiens
cagtctcaccctggaggcccca

SEQ ID NO: 8058603 - DNA, 22 bp, Homo sapiens
cagtcctgggtgcagcaggaaa

SEQ ID NO: 8058604 - DNA, 22 bp, Homo sapiens
cagtcctctcactcaggccttt

SEQ ID NO: 8058605 - DNA, 22 bp, Homo sapiens
tatttagtgatagaagcaagga

SEQ ID NO: 8058606 - DNA, 21 bp, Homo sapiens
tatttagttttacaaatgtgg

SEQ ID NO: 8058607 - DNA, 22 bp, Homo sapiens
tcaggtgggacctgctaggaca

SEQ ID NO: 8058608 - DNA, 22 bp, Homo sapiens
tcaggtggcttcggggagtggc

SEQ ID NO: 8058609 - DNA, 22 bp, Homo sapiens
tcaggtggcttcggggagtggc

SEQ ID NO: 8058610 - DNA, 22 bp, Homo sapiens
tcaggtggcttggagggggacg

SEQ ID NO: 8058611 - DNA, 22 bp, Homo sapiens
tcaggtggctggttgctggcta

SEQ ID NO: 8058612 - DNA, 22 bp, Homo sapiens
tcaggtggctggttgctggcta

SEQ ID NO: 8058613 - DNA, 22 bp, Homo sapiens
catccctgctggtggaaggggt

SEQ ID NO: 8058614 - DNA, 22 bp, Homo sapiens
tcaggtggtcctaagtgccatc

SEQ ID NO: 8058615 - DNA, 22 bp, Homo sapiens
tcaggtggtcctaagtgccatc

SEQ ID NO: 8058616 - DNA, 22 bp, Homo sapiens
tcaggtgggtctacaattagtt

SEQ ID NO: 8058617 - DNA, 22 bp, Homo sapiens
tcaggtgtaggttgttcagttt

SEQ ID NO: 8058618 - DNA, 22 bp, Homo sapiens
tcaggtgggcgttccggtgcgg

SEQ ID NO: 8058619 - DNA, 22 bp, Homo sapiens
tcaggtgggcagtgggttgagc

SEQ ID NO: 8058620 - DNA, 22 bp, Homo sapiens
tcaggtgggagtagaatgctag

SEQ ID NO: 8058621 - DNA, 22 bp, Homo sapiens
tcatggggtagaagcatgttta

SEQ ID NO: 8058622 - DNA, 22 bp, Homo sapiens
tcatggggtgacagaagggagg

SEQ ID NO: 8058623 - DNA, 22 bp, Homo sapiens
catgatcaccacttgacagccc

SEQ ID NO: 8058624 - DNA, 22 bp, Homo sapiens
catgatcagaaagagaagctag

SEQ ID NO: 8058625 - DNA, 22 bp, Homo sapiens
catgatacttgaatttggaagg

SEQ ID NO: 8058626 - DNA, 22 bp, Homo sapiens
tcattttcacacataaatagca

SEQ ID NO: 8058627 - DNA, 22 bp, Homo sapiens
catgcaatttttggttctctat

SEQ ID NO: 8058628 - DNA, 22 bp, Homo sapiens
catggctgaggcagaggactga

SEQ ID NO: 8058629 - DNA, 22 bp, Homo sapiens
catggctggtgcacctctggga

SEQ ID NO: 8058630 - DNA, 22 bp, Homo sapiens
catggctgggagacggctgagg

SEQ ID NO: 8058631 - DNA, 22 bp, Homo sapiens
catggctggccagtgggagtgg

SEQ ID NO: 8058632 - DNA, 19 bp, Homo sapiens
catggctgctgcttgggag

SEQ ID NO: 8058633 - DNA, 19 bp, Homo sapiens
catgtgcacatgtgaatgc

SEQ ID NO: 8058634 - DNA, 22 bp, Homo sapiens
tccagcccacacctgaagctgg

SEQ ID NO: 8058635 - DNA, 20 bp, Homo sapiens
tccagcccagcagcctgaca

SEQ ID NO: 8058636 - DNA, 22 bp, Homo sapiens
tccagcccagctcctctcagaa

SEQ ID NO: 8058637 - DNA, 22 bp, Homo sapiens
catatactgcatacatatgtgt

SEQ ID NO: 8058638 - DNA, 22 bp, Homo sapiens
catatacttttctatagctttc

SEQ ID NO: 8058639 - DNA, 22 bp, Homo sapiens
catatcttctgacatgatcagg

SEQ ID NO: 8058640 - DNA, 22 bp, Homo sapiens
catataatgtttgaagatgtgg

SEQ ID NO: 8058641 - DNA, 22 bp, Homo sapiens
catatacacttccacctctgtg

SEQ ID NO: 8058642 - DNA, 22 bp, Homo sapiens
catcacaggtcctgatgacatt

SEQ ID NO: 8058643 - DNA, 22 bp, Homo sapiens
catcacagaaataaacatacct

SEQ ID NO: 8058644 - DNA, 22 bp, Homo sapiens
tcagggcattcaagaggcctgg

SEQ ID NO: 8058645 - DNA, 22 bp, Homo sapiens
tcagggcatgtatgtttcttta

SEQ ID NO: 8058646 - DNA, 20 bp, Homo sapiens
tcagggcatgggacagcccc

SEQ ID NO: 8058647 - DNA, 22 bp, Homo sapiens
cagtttatatgtcagagctgta

SEQ ID NO: 8058648 - DNA, 22 bp, Homo sapiens
cagtttctgaggttccaggttt

SEQ ID NO: 8058649 - DNA, 22 bp, Homo sapiens
cagtttctctcatacatatttg

SEQ ID NO: 8058650 - DNA, 22 bp, Homo sapiens
tcagaagtagctccccttcatt

SEQ ID NO: 8058651 - DNA, 22 bp, Homo sapiens
tcagaagtattatgctaaagga

SEQ ID NO: 8058652 - DNA, 22 bp, Homo sapiens
tcagaagtcccttgcatcttag

SEQ ID NO: 8058653 - DNA, 22 bp, Homo sapiens
cagtttcttatcttcaaaattg

SEQ ID NO: 8058654 - DNA, 22 bp, Homo sapiens
cagtttcttaagactgagatct

SEQ ID NO: 8058655 - DNA, 22 bp, Homo sapiens
cagtttcttcatcagttaagca

SEQ ID NO: 8058656 - DNA, 22 bp, Homo sapiens
cagtttcttcaattcagacact

SEQ ID NO: 8058657 - DNA, 22 bp, Homo sapiens
cagtttcttcatctgcagaatc

SEQ ID NO: 8058658 - DNA, 22 bp, Homo sapiens
tcagcccaggaggttgagacta

SEQ ID NO: 8058659 - DNA, 22 bp, Homo sapiens
tcagcccaggaatgagccttct

SEQ ID NO: 8058660 - DNA, 20 bp, Homo sapiens
tcagcccagggtgagcatct

SEQ ID NO: 8058661 - DNA, 22 bp, Homo sapiens
tcagcccagggacagaggcccc

SEQ ID NO: 8058662 - DNA, 19 bp, Homo sapiens
tcagcccaggctgggaagc

SEQ ID NO: 8058663 - DNA, 19 bp, Homo sapiens
tcagcccaggctgggaagc

SEQ ID NO: 8058664 - DNA, 22 bp, Homo sapiens
tcagcccttcctggagctttta

SEQ ID NO: 8058665 - DNA, 22 bp, Homo sapiens
tcagccctgaggacagaggcag

SEQ ID NO: 8058666 - DNA, 22 bp, Homo sapiens
tcagccctgaggacagaggcag

SEQ ID NO: 8058667 - DNA, 20 bp, Homo sapiens
tcagccctgagtccaggctg

SEQ ID NO: 8058668 - DNA, 22 bp, Homo sapiens
tcagccctagcctcagtccagg

SEQ ID NO: 8058669 - DNA, 22 bp, Homo sapiens
tcagccctggcactgtctccca

SEQ ID NO: 8058670 - DNA, 22 bp, Homo sapiens
tcagccctgggacccagggatg

SEQ ID NO: 8058671 - DNA, 22 bp, Homo sapiens
tcagcccagttttatcatctgt

SEQ ID NO: 8058672 - DNA, 22 bp, Homo sapiens
tcagcccaggtcacgtaatcaa

SEQ ID NO: 8058673 - DNA, 21 bp, Homo sapiens
tcagcccaggtgtctttgccc

SEQ ID NO: 8058674 - DNA, 22 bp, Homo sapiens
tcagcccagttaagaacctgtt

SEQ ID NO: 8058675 - DNA, 22 bp, Homo sapiens
tcagcccatcactcacgtatta

SEQ ID NO: 8058676 - DNA, 19 bp, Homo sapiens
tcagcccatcagactcaca

SEQ ID NO: 8058677 - DNA, 22 bp, Homo sapiens
catactttttagatctgccttc

SEQ ID NO: 8058678 - DNA, 22 bp, Homo sapiens
catacatttatacacatctatg

SEQ ID NO: 8058679 - DNA, 22 bp, Homo sapiens
tgtaaaggtaggtgcaaaatga

SEQ ID NO: 8058680 - DNA, 23 bp, Homo sapiens
tggttctaggcctataattatat

SEQ ID NO: 8058681 - DNA, 22 bp, Homo sapiens
tggttctaaaggactatacaga

SEQ ID NO: 8058682 - DNA, 22 bp, Homo sapiens
tggtgtgggcgtggcaggcaag

SEQ ID NO: 8058683 - DNA, 22 bp, Homo sapiens
tggtgttgaacctcagcagggg

SEQ ID NO: 8058684 - DNA, 23 bp, Homo sapiens
tggtggggtcttggagacagcac

SEQ ID NO: 8058685 - DNA, 22 bp, Homo sapiens
tggtgtcactcaagcccggccg

SEQ ID NO: 8058686 - DNA, 22 bp, Homo sapiens
tgtacaaagttaaacctatata

SEQ ID NO: 8058687 - DNA, 22 bp, Homo sapiens
tgtaagaacaactgtcaaatgt

SEQ ID NO: 8058688 - DNA, 22 bp, Homo sapiens
tgtaagaaaacctgtacaaaga

SEQ ID NO: 8058689 - DNA, 22 bp, Homo sapiens
tgtacagaggtgtacatatgat

SEQ ID NO: 8058690 - DNA, 22 bp, Homo sapiens
tggtcctggaaggtcctgaggg

SEQ ID NO: 8058691 - DNA, 22 bp, Homo sapiens
tggtcctgccccgtgcacagag

SEQ ID NO: 8058692 - DNA, 22 bp, Homo sapiens
tggtgcagatagtggtgtagta

SEQ ID NO: 8058693 - DNA, 22 bp, Homo sapiens
tggtgcaagtctctgaggaggg

SEQ ID NO: 8058694 - DNA, 22 bp, Homo sapiens
tggtggcaacattgctggagtg

SEQ ID NO: 8058695 - DNA, 22 bp, Homo sapiens
tggtggcaaatcaggacacttc

SEQ ID NO: 8058696 - DNA, 22 bp, Homo sapiens
tggtggcaaaagaggcaaagtg

SEQ ID NO: 8058697 - DNA, 21 bp, Homo sapiens
tggtgccttcagctgtctttt

SEQ ID NO: 8058698 - DNA, 22 bp, Homo sapiens
tggtgcagtagagctgtctggg

SEQ ID NO: 8058699 - DNA, 22 bp, Homo sapiens
tggtgcagtcattggcccaggg

SEQ ID NO: 8058700 - DNA, 22 bp, Homo sapiens
tggtgcagtcattggcccaggg

SEQ ID NO: 8058701 - DNA, 22 bp, Homo sapiens
tggtgcaggtgttgatgcagga

SEQ ID NO: 8058702 - DNA, 22 bp, Homo sapiens
tggtgcaggagttggcagggac

SEQ ID NO: 8058703 - DNA, 22 bp, Homo sapiens
tggtgcagatagtggtgtagta

SEQ ID NO: 8058704 - DNA, 22 bp, Homo sapiens
tggtgcaggccaagctgcgagc

SEQ ID NO: 8058705 - DNA, 22 bp, Homo sapiens
tggtgcagttcccagggccggg

SEQ ID NO: 8058706 - DNA, 22 bp, Homo sapiens
tggtgcagttcccagggccggg

SEQ ID NO: 8058707 - DNA, 22 bp, Homo sapiens
tggtgcagtccaaagggagcag

SEQ ID NO: 8058708 - DNA, 22 bp, Homo sapiens
tggtgcagtccaaagggagcag

SEQ ID NO: 8058709 - DNA, 22 bp, Homo sapiens
tggtggcaattcaaagacagca

SEQ ID NO: 8058710 - DNA, 22 bp, Homo sapiens
tggtggcacaagggagagaatc

SEQ ID NO: 8058711 - DNA, 19 bp, Homo sapiens
tggtggcaatgtcagctaa

SEQ ID NO: 8058712 - DNA, 19 bp, Homo sapiens
tggtggcaatgtcagctaa

SEQ ID NO: 8058713 - DNA, 22 bp, Homo sapiens
tggtggcaatgtcctggagaag

SEQ ID NO: 8058714 - DNA, 23 bp, Homo sapiens
tggtggcagaagtagcagatgac

SEQ ID NO: 8058715 - DNA, 23 bp, Homo sapiens
tggtggcagaagtagcagatgac

SEQ ID NO: 8058716 - DNA, 22 bp, Homo sapiens
tggtggcactgacatcagacac

SEQ ID NO: 8058717 - DNA, 22 bp, Homo sapiens
tggtggcagagcaagagctgga

SEQ ID NO: 8058718 - DNA, 22 bp, Homo sapiens
tggtggcatcaattgacttctc

SEQ ID NO: 8058719 - DNA, 20 bp, Homo sapiens
tggtggccagtgctgcaggc

SEQ ID NO: 8058720 - DNA, 22 bp, Homo sapiens
tggtggcagctgggacagaggt

SEQ ID NO: 8058721 - DNA, 22 bp, Homo sapiens
tggtggcagctgagtgtcaggt

SEQ ID NO: 8058722 - DNA, 22 bp, Homo sapiens
tggtggcagcaggagggcccct

SEQ ID NO: 8058723 - DNA, 22 bp, Homo sapiens
tggtggcagctgagtgtcaggt

SEQ ID NO: 8058724 - DNA, 22 bp, Homo sapiens
tggtggcagtgagaaggagagg

SEQ ID NO: 8058725 - DNA, 16 bp, Homo sapiens
tggtggggaggacagc

SEQ ID NO: 8058726 - DNA, 22 bp, Homo sapiens
tggtgggctgagtctcatcgga

SEQ ID NO: 8058727 - DNA, 22 bp, Homo sapiens
tggtggggattccctccctggc

SEQ ID NO: 8058728 - DNA, 22 bp, Homo sapiens
tggtggggctttccttctgctt

SEQ ID NO: 8058729 - DNA, 22 bp, Homo sapiens
tggtggggccagacttcagctc

SEQ ID NO: 8058730 - DNA, 22 bp, Homo sapiens
tggtggggattccctccctggc

SEQ ID NO: 8058731 - DNA, 22 bp, Homo sapiens
tggtggggtcatcgtcagatgc

SEQ ID NO: 8058732 - DNA, 22 bp, Homo sapiens
tggtgggggaggctgtctagca

SEQ ID NO: 8058733 - DNA, 22 bp, Homo sapiens
tggtgggggaggctgtctagca

SEQ ID NO: 8058734 - DNA, 22 bp, Homo sapiens
tgtcacttcagttttgaaacaa

SEQ ID NO: 8058735 - DNA, 22 bp, Homo sapiens
tgtcattttctggttagttaat

SEQ ID NO: 8058736 - DNA, 22 bp, Homo sapiens
tgtcattttctaatctgttgtc

SEQ ID NO: 8058737 - DNA, 22 bp, Homo sapiens
tgtcatttggactttggtatta

SEQ ID NO: 8058738 - DNA, 22 bp, Homo sapiens
tgtccctgatccactggacccc

SEQ ID NO: 8058739 - DNA, 22 bp, Homo sapiens
tgtcccctgcccagggatggga

SEQ ID NO: 8058740 - DNA, 22 bp, Homo sapiens
tgtcccagtcaaggctgtcatc

SEQ ID NO: 8058741 - DNA, 22 bp, Homo sapiens
tgtcctcaggacctggcacagt

SEQ ID NO: 8058742 - DNA, 22 bp, Homo sapiens
tgtcctcacatggtggggagag

SEQ ID NO: 8058743 - DNA, 22 bp, Homo sapiens
tgtcctcagatatgtctactct

SEQ ID NO: 8058744 - DNA, 22 bp, Homo sapiens
tgtcctcaaggagcttcagtct

SEQ ID NO: 8058745 - DNA, 22 bp, Homo sapiens
tgtcctcacacgtagggagtaa

SEQ ID NO: 8058746 - DNA, 19 bp, Homo sapiens
tgtcctcacagagcataac

SEQ ID NO: 8058747 - DNA, 22 bp, Homo sapiens
tgtcctcacaggaatgaacttt

SEQ ID NO: 8058748 - DNA, 22 bp, Homo sapiens
tgtcacagatcgtttttgagct

SEQ ID NO: 8058749 - DNA, 22 bp, Homo sapiens
tgtcacagtttgtactttatag

SEQ ID NO: 8058750 - DNA, 22 bp, Homo sapiens
tgtatttgggtcacaagatggg

SEQ ID NO: 8058751 - DNA, 22 bp, Homo sapiens
tgtagaaagctcttctgaaatc

SEQ ID NO: 8058752 - DNA, 18 bp, Homo sapiens
tgtagagccaggtttgcc

SEQ ID NO: 8058753 - DNA, 22 bp, Homo sapiens
tgtagatattaattattccttt

SEQ ID NO: 8058754 - DNA, 22 bp, Homo sapiens
tgtagatagtgatttatgacca

SEQ ID NO: 8058755 - DNA, 20 bp, Homo sapiens
tgtatattttctggtgtaaa

SEQ ID NO: 8058756 - DNA, 22 bp, Homo sapiens
tggtataagctgtgtcagagcc

SEQ ID NO: 8058757 - DNA, 23 bp, Homo sapiens
tggtataaaaacagtacctacct

SEQ ID NO: 8058758 - DNA, 22 bp, Homo sapiens
tggtcaagattacacactggtg

SEQ ID NO: 8058759 - DNA, 22 bp, Homo sapiens
tggtaagggtattatttcatcc

SEQ ID NO: 8058760 - DNA, 22 bp, Homo sapiens
tgggttaggaaggggtatcacc

SEQ ID NO: 8058761 - DNA, 22 bp, Homo sapiens
tgggtggtccaggctcagcaga

SEQ ID NO: 8058762 - DNA, 19 bp, Homo sapiens
tgggtgtgaccatctctgc

SEQ ID NO: 8058763 - DNA, 22 bp, Homo sapiens
tgggtggttatagagatcaact

SEQ ID NO: 8058764 - DNA, 22 bp, Homo sapiens
tgggtgtgagcccgggagccgc

SEQ ID NO: 8058765 - DNA, 22 bp, Homo sapiens
tgggtcctgtctccttgttctg

SEQ ID NO: 8058766 - DNA, 20 bp, Homo sapiens
tgggtcctgcacattctcca

SEQ ID NO: 8058767 - DNA, 22 bp, Homo sapiens
tgggtccttgctgattgctgag

SEQ ID NO: 8058768 - DNA, 22 bp, Homo sapiens
tgggtccttcaaagctgggtct

SEQ ID NO: 8058769 - DNA, 22 bp, Homo sapiens
tgggtaggggacgtggaagaaa

SEQ ID NO: 8058770 - DNA, 22 bp, Homo sapiens
tgggtaggccaggaagcagtgt

SEQ ID NO: 8058771 - DNA, 22 bp, Homo sapiens
tgggtagggacttagctggctg

SEQ ID NO: 8058772 - DNA, 22 bp, Homo sapiens
tggggtggggttactcattctg

SEQ ID NO: 8058773 - DNA, 22 bp, Homo sapiens
tggggtgctttcttgcctgtac

SEQ ID NO: 8058774 - DNA, 22 bp, Homo sapiens
tgggggtggttcttgcctccag

SEQ ID NO: 8058775 - DNA, 23 bp, Homo sapiens
tgggggtgcacgggccacatctt

SEQ ID NO: 8058776 - DNA, 22 bp, Homo sapiens
tgggggtgactatctcgggaat

SEQ ID NO: 8058777 - DNA, 22 bp, Homo sapiens
tgggcttggtttctaggtaggt

SEQ ID NO: 8058778 - DNA, 22 bp, Homo sapiens
tggggaagggcaccctggagac

SEQ ID NO: 8058779 - DNA, 17 bp, Homo sapiens
tggggatggttcatgag

SEQ ID NO: 8058780 - DNA, 22 bp, Homo sapiens
tggggatgtagaaatgaacaac

SEQ ID NO: 8058781 - DNA, 19 bp, Homo sapiens
tggggatgctgatgaccaa

SEQ ID NO: 8058782 - DNA, 22 bp, Homo sapiens
tggggatgaaacccaggcatct

SEQ ID NO: 8058783 - DNA, 22 bp, Homo sapiens
tggggaggtaacaatttcaggc

SEQ ID NO: 8058784 - DNA, 22 bp, Homo sapiens
tggggaggttcgggaatcttgt

SEQ ID NO: 8058785 - DNA, 22 bp, Homo sapiens
tggggaggacgggcgccttcct

SEQ ID NO: 8058786 - DNA, 22 bp, Homo sapiens
tggggaggatatgtgagttatt

SEQ ID NO: 8058787 - DNA, 21 bp, Homo sapiens
tggggaggggacctgattatg

SEQ ID NO: 8058788 - DNA, 21 bp, Homo sapiens
tggggaggggacctgattatg

SEQ ID NO: 8058789 - DNA, 23 bp, Homo sapiens
tggggagggaagtcatttctgta

SEQ ID NO: 8058790 - DNA, 22 bp, Homo sapiens
tggggccaggtggctgcaggtc

SEQ ID NO: 8058791 - DNA, 22 bp, Homo sapiens
tggggccaggtggctgcaggtc

SEQ ID NO: 8058792 - DNA, 22 bp, Homo sapiens
tggggccagggaggaccagaca

SEQ ID NO: 8058793 - DNA, 22 bp, Homo sapiens
tggggccagcggggaggactca

SEQ ID NO: 8058794 - DNA, 22 bp, Homo sapiens
tggggccagcggggaggactca

SEQ ID NO: 8058795 - DNA, 22 bp, Homo sapiens
tggggccagcggggaggactca

SEQ ID NO: 8058796 - DNA, 22 bp, Homo sapiens
tggggcctgaaaggttctcgcc

SEQ ID NO: 8058797 - DNA, 22 bp, Homo sapiens
tggggcctgaggtggagctgca

SEQ ID NO: 8058798 - DNA, 22 bp, Homo sapiens
tggggccaggtggctgcaggtc

SEQ ID NO: 8058799 - DNA, 22 bp, Homo sapiens
tggggcagcagacctttcttgg

SEQ ID NO: 8058800 - DNA, 22 bp, Homo sapiens
tggggccagagctgcagggagc

SEQ ID NO: 8058801 - DNA, 22 bp, Homo sapiens
tggggccagagctgcagggagc

SEQ ID NO: 8058802 - DNA, 22 bp, Homo sapiens
tggggccagagctgcagggagc

SEQ ID NO: 8058803 - DNA, 22 bp, Homo sapiens
tggggccagagatggggcgcag

SEQ ID NO: 8058804 - DNA, 22 bp, Homo sapiens
tggggcagagtaggattttggc

SEQ ID NO: 8058805 - DNA, 22 bp, Homo sapiens
tggggcagagtaggattttggc

SEQ ID NO: 8058806 - DNA, 22 bp, Homo sapiens
tggggctctccacagtgtctca

SEQ ID NO: 8058807 - DNA, 22 bp, Homo sapiens
tggggctgaggagcctcactct

SEQ ID NO: 8058808 - DNA, 20 bp, Homo sapiens
tggggcctgtttctgtggtt

SEQ ID NO: 8058809 - DNA, 22 bp, Homo sapiens
tggggcgcgaggtcctggctcc

SEQ ID NO: 8058810 - DNA, 22 bp, Homo sapiens
tgggggagagtgcaagcatgaa

SEQ ID NO: 8058811 - DNA, 22 bp, Homo sapiens
tggggctggggatcttgagcct

SEQ ID NO: 8058812 - DNA, 22 bp, Homo sapiens
tggggctgtcccggtttggcga

SEQ ID NO: 8058813 - DNA, 22 bp, Homo sapiens
tggggctggctattgtctccct

SEQ ID NO: 8058814 - DNA, 22 bp, Homo sapiens
tgggggcacttcgaggtcgcct

SEQ ID NO: 8058815 - DNA, 22 bp, Homo sapiens
tgggggcagccaggctgtcaag

SEQ ID NO: 8058816 - DNA, 22 bp, Homo sapiens
tgggggcagaggattcaggaat

SEQ ID NO: 8058817 - DNA, 22 bp, Homo sapiens
tgggggcatggaccagcctggc

SEQ ID NO: 8058818 - DNA, 22 bp, Homo sapiens
tgggcctgaaggagctgcgccc

SEQ ID NO: 8058819 - DNA, 22 bp, Homo sapiens
tgggcctgaaggagctgcgccc

SEQ ID NO: 8058820 - DNA, 22 bp, Homo sapiens
tgggcctgaaggagctgcgccc

SEQ ID NO: 8058821 - DNA, 21 bp, Homo sapiens
tgggcctgattcccagggtca

SEQ ID NO: 8058822 - DNA, 22 bp, Homo sapiens
tgggcctgagctcaccaggggc

SEQ ID NO: 8058823 - DNA, 20 bp, Homo sapiens
tgggcctgagcctgtgggct

SEQ ID NO: 8058824 - DNA, 22 bp, Homo sapiens
tgggcctgacacttactaggga

SEQ ID NO: 8058825 - DNA, 22 bp, Homo sapiens
tgggcctgggctggacagcctg

SEQ ID NO: 8058826 - DNA, 22 bp, Homo sapiens
tgggcctgggctcctgtcctct

SEQ ID NO: 8058827 - DNA, 19 bp, Homo sapiens
tgggcctgcatctgggtct

SEQ ID NO: 8058828 - DNA, 22 bp, Homo sapiens
tgggcctgccccaggcttcagc

SEQ ID NO: 8058829 - DNA, 22 bp, Homo sapiens
tgggcctgccccaggcttcagc

SEQ ID NO: 8058830 - DNA, 18 bp, Homo sapiens
tgggcctgcatcctagtc

SEQ ID NO: 8058831 - DNA, 22 bp, Homo sapiens
tgggcctcctttccattcagag

SEQ ID NO: 8058832 - DNA, 22 bp, Homo sapiens
tgggcctcctggaagaatgtgg

SEQ ID NO: 8058833 - DNA, 23 bp, Homo sapiens
tgggccagttctgttgaaagcca

SEQ ID NO: 8058834 - DNA, 22 bp, Homo sapiens
tgggccagttatttcacctctg

SEQ ID NO: 8058835 - DNA, 22 bp, Homo sapiens
tgggccagtcctgcctaaggtg

SEQ ID NO: 8058836 - DNA, 22 bp, Homo sapiens
tgggccagttggtgactacaaa

SEQ ID NO: 8058837 - DNA, 22 bp, Homo sapiens
tgggccaggtctgcggtcattt

SEQ ID NO: 8058838 - DNA, 22 bp, Homo sapiens
tgggccaggtctgtgtcagctg

SEQ ID NO: 8058839 - DNA, 22 bp, Homo sapiens
tgggccaggtctgtgtcagctg

SEQ ID NO: 8058840 - DNA, 22 bp, Homo sapiens
tgggccaggggcctcttctgat

SEQ ID NO: 8058841 - DNA, 22 bp, Homo sapiens
tgggccagggcacccagtccag

SEQ ID NO: 8058842 - DNA, 22 bp, Homo sapiens
tgggccaggcatgtgatcagca

SEQ ID NO: 8058843 - DNA, 22 bp, Homo sapiens
tgggccaggcatgtgatcagca

SEQ ID NO: 8058844 - DNA, 22 bp, Homo sapiens
tgggccagtccagccccaggga

SEQ ID NO: 8058845 - DNA, 22 bp, Homo sapiens
tgggccagtagctactcgcaag

SEQ ID NO: 8058846 - DNA, 22 bp, Homo sapiens
tgggccagtccagccccaggga

SEQ ID NO: 8058847 - DNA, 17 bp, Homo sapiens
tgggccagtagaaggga

SEQ ID NO: 8058848 - DNA, 22 bp, Homo sapiens
tgggctctgctgcgtaccagtt

SEQ ID NO: 8058849 - DNA, 22 bp, Homo sapiens
tgggctctggtttcctggctgg

SEQ ID NO: 8058850 - DNA, 22 bp, Homo sapiens
tgggctctcacacatgttctga

SEQ ID NO: 8058851 - DNA, 22 bp, Homo sapiens
tgggctcagtctgcttggtcct

SEQ ID NO: 8058852 - DNA, 22 bp, Homo sapiens
tgggctctgaagtcagtctgct

SEQ ID NO: 8058853 - DNA, 22 bp, Homo sapiens
tgggctctctttacctcataac

SEQ ID NO: 8058854 - DNA, 22 bp, Homo sapiens
tgggctctggtttcctggctgg

SEQ ID NO: 8058855 - DNA, 21 bp, Homo sapiens
tgggctctttaacccaggcac

SEQ ID NO: 8058856 - DNA, 22 bp, Homo sapiens
tgggctcagggtcgaggacttt

SEQ ID NO: 8058857 - DNA, 22 bp, Homo sapiens
tgggctcagggaagcttggcct

SEQ ID NO: 8058858 - DNA, 22 bp, Homo sapiens
tgggctcagtctgcacctgcgg

SEQ ID NO: 8058859 - DNA, 22 bp, Homo sapiens
tgggctcaggaccccagaggcc

SEQ ID NO: 8058860 - DNA, 22 bp, Homo sapiens
tgggctcaggaccccagaggcc

SEQ ID NO: 8058861 - DNA, 22 bp, Homo sapiens
tgggctcagctcccaagggaag

SEQ ID NO: 8058862 - DNA, 23 bp, Homo sapiens
tgggctcagcttccagtggggag

SEQ ID NO: 8058863 - DNA, 23 bp, Homo sapiens
tgggctcagcttccagtggggag

SEQ ID NO: 8058864 - DNA, 22 bp, Homo sapiens
tgggctcactggggcagggacc

SEQ ID NO: 8058865 - DNA, 22 bp, Homo sapiens
tgggctcagccatgacctccac

SEQ ID NO: 8058866 - DNA, 21 bp, Homo sapiens
tgggctcagccccagccctgc

SEQ ID NO: 8058867 - DNA, 22 bp, Homo sapiens
tgggctcagccttcatgtggcc

SEQ ID NO: 8058868 - DNA, 22 bp, Homo sapiens
tgggctcagcctcagtctgtgg

SEQ ID NO: 8058869 - DNA, 21 bp, Homo sapiens
tgggctcagccccagccctgc

SEQ ID NO: 8058870 - DNA, 23 bp, Homo sapiens
tgggcggggcttttcactctgcc

SEQ ID NO: 8058871 - DNA, 22 bp, Homo sapiens
tgggcgggcaggagcgcacctg

SEQ ID NO: 8058872 - DNA, 22 bp, Homo sapiens
tgggcgaggcccagggctgcgt

SEQ ID NO: 8058873 - DNA, 22 bp, Homo sapiens
tgggcgaggcccagggctgcgt

SEQ ID NO: 8058874 - DNA, 22 bp, Homo sapiens
tgggctcaaactggaggttgtt

SEQ ID NO: 8058875 - DNA, 22 bp, Homo sapiens
tgggctcaagtgatgctcctgt

SEQ ID NO: 8058876 - DNA, 22 bp, Homo sapiens
tgggctcaatctgcttctgttt

SEQ ID NO: 8058877 - DNA, 22 bp, Homo sapiens
tgggcctgttgcctgagtccat

SEQ ID NO: 8058878 - DNA, 23 bp, Homo sapiens
tgggcgaggcaggagtggagcac

SEQ ID NO: 8058879 - DNA, 23 bp, Homo sapiens
tgggcgaggcaggagtggagcac

SEQ ID NO: 8058880 - DNA, 20 bp, Homo sapiens
tgggcctgtggcagaagtct

SEQ ID NO: 8058881 - DNA, 22 bp, Homo sapiens
tgggcctgtggcttggctctag

SEQ ID NO: 8058882 - DNA, 22 bp, Homo sapiens
tgggcctgggttcctcctgggc

SEQ ID NO: 8058883 - DNA, 22 bp, Homo sapiens
tgggcctgtgatgctgggctat

SEQ ID NO: 8058884 - DNA, 18 bp, Homo sapiens
tgggagtgggagtggata

SEQ ID NO: 8058885 - DNA, 22 bp, Homo sapiens
tgggagtgcacctgggacacga

SEQ ID NO: 8058886 - DNA, 22 bp, Homo sapiens
tgggagtgatacagtatggaat

SEQ ID NO: 8058887 - DNA, 23 bp, Homo sapiens
tgggatggattcaccagtgtgct

SEQ ID NO: 8058888 - DNA, 22 bp, Homo sapiens
tgggaggccaaggcaggcggat

SEQ ID NO: 8058889 - DNA, 22 bp, Homo sapiens
tgggaggcccaggcctggcagg

SEQ ID NO: 8058890 - DNA, 22 bp, Homo sapiens
tgggaggccgaggcaggtggat

SEQ ID NO: 8058891 - DNA, 22 bp, Homo sapiens
tgggaggccgaggcaggtggat

SEQ ID NO: 8058892 - DNA, 22 bp, Homo sapiens
tgggaggcttccagaccttgct

SEQ ID NO: 8058893 - DNA, 22 bp, Homo sapiens
tgggcaaggctggagcctgcag

SEQ ID NO: 8058894 - DNA, 22 bp, Homo sapiens
tgggcaagggacaggcctggct

SEQ ID NO: 8058895 - DNA, 22 bp, Homo sapiens
tgggcaagtatcggactctgag

SEQ ID NO: 8058896 - DNA, 21 bp, Homo sapiens
tgggcaagtttgggggtcctc

SEQ ID NO: 8058897 - DNA, 22 bp, Homo sapiens
tgggcacagagtcccatctgcc

SEQ ID NO: 8058898 - DNA, 22 bp, Homo sapiens
tgggcacaaacatctgcctgtt

SEQ ID NO: 8058899 - DNA, 22 bp, Homo sapiens
tgggcacagaatagatggccca

SEQ ID NO: 8058900 - DNA, 22 bp, Homo sapiens
tgggcaagctctgggtggacac

SEQ ID NO: 8058901 - DNA, 22 bp, Homo sapiens
tgggcaagcaggagggcctcag

SEQ ID NO: 8058902 - DNA, 21 bp, Homo sapiens
tgggatgggtctgggaccagc

SEQ ID NO: 8058903 - DNA, 22 bp, Homo sapiens
tgggcagagtcatacaggagac

SEQ ID NO: 8058904 - DNA, 22 bp, Homo sapiens
tgggcagactgagccctgtccc

SEQ ID NO: 8058905 - DNA, 22 bp, Homo sapiens
tgggcacaggggaatggatgaa

SEQ ID NO: 8058906 - DNA, 20 bp, Homo sapiens
tgggcacagctttggagggc

SEQ ID NO: 8058907 - DNA, 22 bp, Homo sapiens
tgggcagatctttggtggctag

SEQ ID NO: 8058908 - DNA, 21 bp, Homo sapiens
tgggcagatggcagtgtggct

SEQ ID NO: 8058909 - DNA, 22 bp, Homo sapiens
tgggcagattaatgcagtggct

SEQ ID NO: 8058910 - DNA, 22 bp, Homo sapiens
tgggcagcaaagactgtgtgct

SEQ ID NO: 8058911 - DNA, 22 bp, Homo sapiens
tgggcagcagaaccaggccgac

SEQ ID NO: 8058912 - DNA, 22 bp, Homo sapiens
tgggcagcatcctccacagtca

SEQ ID NO: 8058913 - DNA, 22 bp, Homo sapiens
tgggcagcagcaaagccagact

SEQ ID NO: 8058914 - DNA, 22 bp, Homo sapiens
tgggcaggagagaagctaaaga

SEQ ID NO: 8058915 - DNA, 22 bp, Homo sapiens
tgggcagggagctggaaccaca

SEQ ID NO: 8058916 - DNA, 22 bp, Homo sapiens
tgggcagccatcccagcctctc

SEQ ID NO: 8058917 - DNA, 22 bp, Homo sapiens
tgggcagggatctcttttgcaa

SEQ ID NO: 8058918 - DNA, 22 bp, Homo sapiens
tgggcaggggccctgcttccgt

SEQ ID NO: 8058919 - DNA, 22 bp, Homo sapiens
tgggcaggggccctgcttccgt

SEQ ID NO: 8058920 - DNA, 22 bp, Homo sapiens
tgggcatggactgtggagccgc

SEQ ID NO: 8058921 - DNA, 22 bp, Homo sapiens
tgggccaacaggaggtctagga

SEQ ID NO: 8058922 - DNA, 22 bp, Homo sapiens
tgggcagtcatcagcacaccgg

SEQ ID NO: 8058923 - DNA, 22 bp, Homo sapiens
tgggcagtgagaaaggtcaggt

SEQ ID NO: 8058924 - DNA, 22 bp, Homo sapiens
tgggcagtggctgggcctctct

SEQ ID NO: 8058925 - DNA, 22 bp, Homo sapiens
tgggcaggttgttatttgacat

SEQ ID NO: 8058926 - DNA, 19 bp, Homo sapiens
tgggcaggttcagtaatgg

SEQ ID NO: 8058927 - DNA, 22 bp, Homo sapiens
tgggcagggtctctgttatcag

SEQ ID NO: 8058928 - DNA, 22 bp, Homo sapiens
tgggcaggtgctattttccatg

SEQ ID NO: 8058929 - DNA, 22 bp, Homo sapiens
tgggccacgtcatctcccacaa

SEQ ID NO: 8058930 - DNA, 22 bp, Homo sapiens
tgggccacgggggtggagagct

SEQ ID NO: 8058931 - DNA, 22 bp, Homo sapiens
tgggccagcactgggtgctcat

SEQ ID NO: 8058932 - DNA, 22 bp, Homo sapiens
tgggccagcactgggtgctcat

SEQ ID NO: 8058933 - DNA, 22 bp, Homo sapiens
tgggccacagctcacacatcca

SEQ ID NO: 8058934 - DNA, 22 bp, Homo sapiens
tgggccacagttcaccaatccc

SEQ ID NO: 8058935 - DNA, 22 bp, Homo sapiens
tgggccacattccaaaccagct

SEQ ID NO: 8058936 - DNA, 22 bp, Homo sapiens
tgggccaagttaaatgccaggg

SEQ ID NO: 8058937 - DNA, 22 bp, Homo sapiens
tgggccacaagccatgggacca

SEQ ID NO: 8058938 - DNA, 22 bp, Homo sapiens
tgggccacacacagaagaatca

SEQ ID NO: 8058939 - DNA, 22 bp, Homo sapiens
tgggccacagagtgagaaatgt

SEQ ID NO: 8058940 - DNA, 22 bp, Homo sapiens
tgggccagctccctgcccctgg

SEQ ID NO: 8058941 - DNA, 22 bp, Homo sapiens
tgggccagcactgggtgctcat

SEQ ID NO: 8058942 - DNA, 22 bp, Homo sapiens
tgggccaggatttcaagaccct

SEQ ID NO: 8058943 - DNA, 22 bp, Homo sapiens
tgggccagctgaagtgccgccc

SEQ ID NO: 8058944 - DNA, 22 bp, Homo sapiens
tgtgcaaattaagtagattttc

SEQ ID NO: 8058945 - DNA, 22 bp, Homo sapiens
tgtgcaggtgcaggaagggggc

SEQ ID NO: 8058946 - DNA, 22 bp, Homo sapiens
tgtgcagggaagggcatgctat

SEQ ID NO: 8058947 - DNA, 20 bp, Homo sapiens
tgtgcaggagagtgaggctg

SEQ ID NO: 8058948 - DNA, 19 bp, Homo sapiens
tgtgccccctccagcctgc

SEQ ID NO: 8058949 - DNA, 22 bp, Homo sapiens
tgtgcctggcattctgggcttc

SEQ ID NO: 8058950 - DNA, 22 bp, Homo sapiens
tgtgcctggatctctgtgacaa

SEQ ID NO: 8058951 - DNA, 22 bp, Homo sapiens
tgtgcctggcccagtggtgtca

SEQ ID NO: 8058952 - DNA, 22 bp, Homo sapiens
tgtgcctgagttggctgagtac

SEQ ID NO: 8058953 - DNA, 22 bp, Homo sapiens
tgtgcctgagttggctgagtac

SEQ ID NO: 8058954 - DNA, 22 bp, Homo sapiens
tgtgcctgatggtcacgtggcc

SEQ ID NO: 8058955 - DNA, 22 bp, Homo sapiens
tgtgcctgtcaccctcagagag

SEQ ID NO: 8058956 - DNA, 22 bp, Homo sapiens
tgtgcctgttggtgtagacata

SEQ ID NO: 8058957 - DNA, 22 bp, Homo sapiens
tgtgctcatggtccagcatggt

SEQ ID NO: 8058958 - DNA, 23 bp, Homo sapiens
tgtgctcccaaatgtaggtctat

SEQ ID NO: 8058959 - DNA, 22 bp, Homo sapiens
tgtggaaaattggaacgttcct

SEQ ID NO: 8058960 - DNA, 22 bp, Homo sapiens
tgtgctgctctcagtgacagcc

SEQ ID NO: 8058961 - DNA, 23 bp, Homo sapiens
tgtctggagcctgagcaggtgct

SEQ ID NO: 8058962 - DNA, 22 bp, Homo sapiens
tgtctggggaactgtgcatcca

SEQ ID NO: 8058963 - DNA, 22 bp, Homo sapiens
tgtctgggatgtaattcctgcc

SEQ ID NO: 8058964 - DNA, 22 bp, Homo sapiens
tgtctgggagactgatcacccg

SEQ ID NO: 8058965 - DNA, 22 bp, Homo sapiens
tgtctgggagggacagggctac

SEQ ID NO: 8058966 - DNA, 22 bp, Homo sapiens
tgtcttttacctaatgagctgg

SEQ ID NO: 8058967 - DNA, 22 bp, Homo sapiens
tgtctcctgggtcccttccacc

SEQ ID NO: 8058968 - DNA, 21 bp, Homo sapiens
tgtctcctgttggcacatggc

SEQ ID NO: 8058969 - DNA, 22 bp, Homo sapiens
tgtctcctctgtcctgtcagga

SEQ ID NO: 8058970 - DNA, 22 bp, Homo sapiens
tgtctcctgagagctggacaga

SEQ ID NO: 8058971 - DNA, 22 bp, Homo sapiens
tgtctcctgcaggggtgtgggc

SEQ ID NO: 8058972 - DNA, 22 bp, Homo sapiens
tgtctcctgggccctggccctg

SEQ ID NO: 8058973 - DNA, 22 bp, Homo sapiens
tgtctccttgcttttccctgta

SEQ ID NO: 8058974 - DNA, 22 bp, Homo sapiens
tgtctcctcatactgtcatatt

SEQ ID NO: 8058975 - DNA, 22 bp, Homo sapiens
tgtctcctcatactgtcatatt

SEQ ID NO: 8058976 - DNA, 19 bp, Homo sapiens
tgtctcctcatgcaagtgt

SEQ ID NO: 8058977 - DNA, 19 bp, Homo sapiens
tgtctcctccccgccgtct

SEQ ID NO: 8058978 - DNA, 22 bp, Homo sapiens
tgtctcctcggctgtccagcca

SEQ ID NO: 8058979 - DNA, 22 bp, Homo sapiens
tgtctcctatttcctgctaagg

SEQ ID NO: 8058980 - DNA, 22 bp, Homo sapiens
tgtctcctatttcctgctaagg

SEQ ID NO: 8058981 - DNA, 22 bp, Homo sapiens
tgtctcctcaactcatgctcga

SEQ ID NO: 8058982 - DNA, 22 bp, Homo sapiens
tgtctcctcaactcatgctcga

SEQ ID NO: 8058983 - DNA, 22 bp, Homo sapiens
tgtctcctactgcctgtggatc

SEQ ID NO: 8058984 - DNA, 22 bp, Homo sapiens
tgtctcctaatgtctgtttcct

SEQ ID NO: 8058985 - DNA, 22 bp, Homo sapiens
tgtctctgctttccttgcaggg

SEQ ID NO: 8058986 - DNA, 22 bp, Homo sapiens
tgtctctgctgcaccttctggg

SEQ ID NO: 8058987 - DNA, 22 bp, Homo sapiens
tgtctgcaaagtccagcacagg

SEQ ID NO: 8058988 - DNA, 22 bp, Homo sapiens
tgtttcaaaacagtgataattt

SEQ ID NO: 8058989 - DNA, 22 bp, Homo sapiens
tgtttcaactgttaagatatgc

SEQ ID NO: 8058990 - DNA, 22 bp, Homo sapiens
ttaaaacgtaaatgtccccagc

SEQ ID NO: 8058991 - DNA, 22 bp, Homo sapiens
tgttgtcaggtacaaaatatat

SEQ ID NO: 8058992 - DNA, 22 bp, Homo sapiens
tgtttaaatagaacatactgca

SEQ ID NO: 8058993 - DNA, 22 bp, Homo sapiens
tgttacttcttggtaaaggaga

SEQ ID NO: 8058994 - DNA, 22 bp, Homo sapiens
tgtggggacccatgccatgggc

SEQ ID NO: 8058995 - DNA, 22 bp, Homo sapiens
tgtggggactgagtggaggctt

SEQ ID NO: 8058996 - DNA, 20 bp, Homo sapiens
tgtgggcccttggctggcaa

SEQ ID NO: 8058997 - DNA, 22 bp, Homo sapiens
tgtgggcactaatgacatgcag

SEQ ID NO: 8058998 - DNA, 19 bp, Homo sapiens
tgtgggcaagggatggcag

SEQ ID NO: 8058999 - DNA, 22 bp, Homo sapiens
tgtgggaggtctggaaggctcc

SEQ ID NO: 8059000 - DNA, 22 bp, Homo sapiens
tgtgggaggtctggaaggctcc

SEQ ID NO: 8059001 - DNA, 22 bp, Homo sapiens
tgtgggaggattcagaattggg

SEQ ID NO: 8059002 - DNA, 22 bp, Homo sapiens
tgtgggaggaattagaatggga

SEQ ID NO: 8059003 - DNA, 22 bp, Homo sapiens
tgtgggaggaacacagccagaa

SEQ ID NO: 8059004 - DNA, 22 bp, Homo sapiens
tgtgggagaaggaagcaagctg

SEQ ID NO: 8059005 - DNA, 22 bp, Homo sapiens
tgtgggaggaacacagccagaa

SEQ ID NO: 8059006 - DNA, 22 bp, Homo sapiens
tgtgggagaaggaagcaagctg

SEQ ID NO: 8059007 - DNA, 22 bp, Homo sapiens
tgtggcctttcaaggatggaat

SEQ ID NO: 8059008 - DNA, 22 bp, Homo sapiens
tgtggccttgcagcctggaggt

SEQ ID NO: 8059009 - DNA, 19 bp, Homo sapiens
tgtggctgagcactcctta

SEQ ID NO: 8059010 - DNA, 22 bp, Homo sapiens
tgtggctcggccagctgctgaa

SEQ ID NO: 8059011 - DNA, 21 bp, Homo sapiens
tgtggctgacaccctttggga

SEQ ID NO: 8059012 - DNA, 22 bp, Homo sapiens
tgtggctctcctcctgctgccc

SEQ ID NO: 8059013 - DNA, 22 bp, Homo sapiens
tgttaaaaattcagctctagat

SEQ ID NO: 8059014 - DNA, 22 bp, Homo sapiens
tgtgttaagtatttgatacact

SEQ ID NO: 8059015 - DNA, 22 bp, Homo sapiens
tgtgtgttatcttagttcatct

SEQ ID NO: 8059016 - DNA, 22 bp, Homo sapiens
tgtgtgttctcaattattgatg

SEQ ID NO: 8059017 - DNA, 22 bp, Homo sapiens
tgtgtgttcagagatagatata

SEQ ID NO: 8059018 - DNA, 22 bp, Homo sapiens
tgtgtgccagggcatgcacagg

SEQ ID NO: 8059019 - DNA, 22 bp, Homo sapiens
tgtgtgccccagatgagtagct

SEQ ID NO: 8059020 - DNA, 22 bp, Homo sapiens
tgtgtgcctgagccgtgcctgg

SEQ ID NO: 8059021 - DNA, 22 bp, Homo sapiens
tgtgtggattcatctcaaagag

SEQ ID NO: 8059022 - DNA, 22 bp, Homo sapiens
ttcactagcaacattacaagaa

SEQ ID NO: 8059023 - DNA, 22 bp, Homo sapiens
ttcactgctacatccaggtgcc

SEQ ID NO: 8059024 - DNA, 22 bp, Homo sapiens
ttcagctcagtctgtgcagcag

SEQ ID NO: 8059025 - DNA, 22 bp, Homo sapiens
ttcagctcagcactgacaagat

SEQ ID NO: 8059026 - DNA, 21 bp, Homo sapiens
ttcagctcggtctggcatgat

SEQ ID NO: 8059027 - DNA, 22 bp, Homo sapiens
ttcagctctagtaagcagacac

SEQ ID NO: 8059028 - DNA, 21 bp, Homo sapiens
ttcagctctgcttcagggaat

SEQ ID NO: 8059029 - DNA, 22 bp, Homo sapiens
ttatttgtgaatcatttatcta

SEQ ID NO: 8059030 - DNA, 22 bp, Homo sapiens
ttatttgaaaagaaggttacgt

SEQ ID NO: 8059031 - DNA, 22 bp, Homo sapiens
ttccagcttgacttctacttaa

SEQ ID NO: 8059032 - DNA, 22 bp, Homo sapiens
ttccagctcttgaaggtgggat

SEQ ID NO: 8059033 - DNA, 22 bp, Homo sapiens
ttccagccatggtttccctatg

SEQ ID NO: 8059034 - DNA, 22 bp, Homo sapiens
ttccagcccgcgacttgttcag

SEQ ID NO: 8059035 - DNA, 22 bp, Homo sapiens
ttccagctaactcacatccctt

SEQ ID NO: 8059036 - DNA, 22 bp, Homo sapiens
ttaatgtatggggttgagatga

SEQ ID NO: 8059037 - DNA, 22 bp, Homo sapiens
ttaatggaacagcatgcataga

SEQ ID NO: 8059038 - DNA, 22 bp, Homo sapiens
ttaatacatttcagactgttat

SEQ ID NO: 8059039 - DNA, 22 bp, Homo sapiens
ttaatacaagcatatgcacaca

SEQ ID NO: 8059040 - DNA, 22 bp, Homo sapiens
ttacatgaggttaattaagcat

SEQ ID NO: 8059041 - DNA, 22 bp, Homo sapiens
ttagatgtggacttatgttatt

SEQ ID NO: 8059042 - DNA, 22 bp, Homo sapiens
ttagatgtgtatatacatgtca

SEQ ID NO: 8059043 - DNA, 22 bp, Homo sapiens
ttagcagatttcatgtacattt

SEQ ID NO: 8059044 - DNA, 22 bp, Homo sapiens
ttagcagcttttaaatggttct

SEQ ID NO: 8059045 - DNA, 22 bp, Homo sapiens
ttagaaatgtcacagatctgat

SEQ ID NO: 8059046 - DNA, 22 bp, Homo sapiens
ttagaaatcacctctgaagatc

SEQ ID NO: 8059047 - DNA, 22 bp, Homo sapiens
ttagaaatacaagtgaggttga

SEQ ID NO: 8059048 - DNA, 22 bp, Homo sapiens
ttagaaaggttttgctctgaaa

SEQ ID NO: 8059049 - DNA, 22 bp, Homo sapiens
ttagatcattttgaactaattt

SEQ ID NO: 8059050 - DNA, 22 bp, Homo sapiens
ttagatatgtttttgctaatgc

SEQ ID NO: 8059051 - DNA, 22 bp, Homo sapiens
ttagataatgttattgtaattt

SEQ ID NO: 8059052 - DNA, 22 bp, Homo sapiens
ttagaagcactaattactcaca

SEQ ID NO: 8059053 - DNA, 22 bp, Homo sapiens
ttagaagcaggctgtgtcccca

SEQ ID NO: 8059054 - DNA, 22 bp, Homo sapiens
ttagataatgtagagatatgag

SEQ ID NO: 8059055 - DNA, 22 bp, Homo sapiens
ttagataacagtagaatatcaa

SEQ ID NO: 8059056 - DNA, 22 bp, Homo sapiens
ttagaacatagcaacagaatta

SEQ ID NO: 8059057 - DNA, 22 bp, Homo sapiens
ttattctgtctttggtctcaat

SEQ ID NO: 8059058 - DNA, 22 bp, Homo sapiens
ttattcttggatctgagtctct

SEQ ID NO: 8059059 - DNA, 22 bp, Homo sapiens
ttatttatggccctcacctgat

SEQ ID NO: 8059060 - DNA, 22 bp, Homo sapiens
ttatatgtttctgtttggaggc

SEQ ID NO: 8059061 - DNA, 22 bp, Homo sapiens
ttagtgatgaagaattactagg

SEQ ID NO: 8059062 - DNA, 22 bp, Homo sapiens
ttagtgattacagatatataaa

SEQ ID NO: 8059063 - DNA, 22 bp, Homo sapiens
ttatgaaaacaatcagtaggca

SEQ ID NO: 8059064 - DNA, 22 bp, Homo sapiens
ttatgagatatttatactgctg

SEQ ID NO: 8059065 - DNA, 22 bp, Homo sapiens
ttatgagactgttttacacact

SEQ ID NO: 8059066 - DNA, 23 bp, Homo sapiens
tggaaatctgggtgaggacagaa

SEQ ID NO: 8059067 - DNA, 22 bp, Homo sapiens
tggaaatatttgctcattatct

SEQ ID NO: 8059068 - DNA, 22 bp, Homo sapiens
tggaaatatacaatgtgtctct

SEQ ID NO: 8059069 - DNA, 18 bp, Homo sapiens
tggaaattgaaacagaaa

SEQ ID NO: 8059070 - DNA, 22 bp, Homo sapiens
tggaaattaacttggtacatat

SEQ ID NO: 8059071 - DNA, 22 bp, Homo sapiens
tggaaagatgaagatgtttaag

SEQ ID NO: 8059072 - DNA, 22 bp, Homo sapiens
tggaaaatgtgactattctaaa

SEQ ID NO: 8059073 - DNA, 22 bp, Homo sapiens
tgcttttagctagtaactagta

SEQ ID NO: 8059074 - DNA, 22 bp, Homo sapiens
tgcttttatttaatatcttgca

SEQ ID NO: 8059075 - DNA, 22 bp, Homo sapiens
tgctttatagacaaggaagtag

SEQ ID NO: 8059076 - DNA, 22 bp, Homo sapiens
tgctttataacttagtttatgg

SEQ ID NO: 8059077 - DNA, 22 bp, Homo sapiens
tgctttatatctctcttcttag

SEQ ID NO: 8059078 - DNA, 22 bp, Homo sapiens
tgctttataggggattgcaggc

SEQ ID NO: 8059079 - DNA, 22 bp, Homo sapiens
tgctttatcaaagctatagtga

SEQ ID NO: 8059080 - DNA, 22 bp, Homo sapiens
tgctttatctgacttggcgctg

SEQ ID NO: 8059081 - DNA, 22 bp, Homo sapiens
tgctttatctgtgagaacctga

SEQ ID NO: 8059082 - DNA, 22 bp, Homo sapiens
tgctttatggagcccatctcat

SEQ ID NO: 8059083 - DNA, 22 bp, Homo sapiens
tgctttatggatttgtgtcctg

SEQ ID NO: 8059084 - DNA, 20 bp, Homo sapiens
tgctttatgctatactttgt

SEQ ID NO: 8059085 - DNA, 18 bp, Homo sapiens
tgctttatgcttatataa

SEQ ID NO: 8059086 - DNA, 22 bp, Homo sapiens
tgctttatgtggctgatactca

SEQ ID NO: 8059087 - DNA, 22 bp, Homo sapiens
tgctttatgttatcagaagggt

SEQ ID NO: 8059088 - DNA, 21 bp, Homo sapiens
tgctttatgggaaaaatgtca

SEQ ID NO: 8059089 - DNA, 22 bp, Homo sapiens
tgctttattgcatcagtgtggg

SEQ ID NO: 8059090 - DNA, 22 bp, Homo sapiens
tgctttattcgacatctggtag

SEQ ID NO: 8059091 - DNA, 22 bp, Homo sapiens
tgctttatgttatcagaagggt

SEQ ID NO: 8059092 - DNA, 22 bp, Homo sapiens
tgctttattaagagagaaattt

SEQ ID NO: 8059093 - DNA, 22 bp, Homo sapiens
tgctttattcagtctctgccat

SEQ ID NO: 8059094 - DNA, 22 bp, Homo sapiens
tgctttattcccttctgatgtg

SEQ ID NO: 8059095 - DNA, 22 bp, Homo sapiens
tgctttattcagggtttacccc

SEQ ID NO: 8059096 - DNA, 22 bp, Homo sapiens
tgcttcttactcatatgctgat

SEQ ID NO: 8059097 - DNA, 22 bp, Homo sapiens
tgcttgcaagagatgcaatgac

SEQ ID NO: 8059098 - DNA, 22 bp, Homo sapiens
tgctttataaccatttctgtgg

SEQ ID NO: 8059099 - DNA, 22 bp, Homo sapiens
tggaatgcagtgggagcttacc

SEQ ID NO: 8059100 - DNA, 22 bp, Homo sapiens
tggacagcaaacatggagagaa

SEQ ID NO: 8059101 - DNA, 22 bp, Homo sapiens
tggacagagaggaaggccattt

SEQ ID NO: 8059102 - DNA, 18 bp, Homo sapiens
tggacacatggcctgggt

SEQ ID NO: 8059103 - DNA, 22 bp, Homo sapiens
tggacagcttgcagagccaccc

SEQ ID NO: 8059104 - DNA, 22 bp, Homo sapiens
tggacagcgaaagtgcctggga

SEQ ID NO: 8059105 - DNA, 22 bp, Homo sapiens
tggacagcgaaagtgcctggga

SEQ ID NO: 8059106 - DNA, 22 bp, Homo sapiens
tggacagccatgcaaatgagct

SEQ ID NO: 8059107 - DNA, 23 bp, Homo sapiens
tggacagcagcagcagtgtcacc

SEQ ID NO: 8059108 - DNA, 22 bp, Homo sapiens
tggacaggatagtgcagtacgc

SEQ ID NO: 8059109 - DNA, 22 bp, Homo sapiens
tggacaggatctgagactgaga

SEQ ID NO: 8059110 - DNA, 18 bp, Homo sapiens
tggacagggtggagaaaa

SEQ ID NO: 8059111 - DNA, 21 bp, Homo sapiens
tggaccaggaaggtggtggtg

SEQ ID NO: 8059112 - DNA, 22 bp, Homo sapiens
tggacaggtgcacacagcagcc

SEQ ID NO: 8059113 - DNA, 22 bp, Homo sapiens
tggaaggggagctggaaagggg

SEQ ID NO: 8059114 - DNA, 22 bp, Homo sapiens
tggaaggggccaggcgcggagt

SEQ ID NO: 8059115 - DNA, 22 bp, Homo sapiens
tggaagggggaagacagctctg

SEQ ID NO: 8059116 - DNA, 17 bp, Homo sapiens
tggaagtgaggacactg

SEQ ID NO: 8059117 - DNA, 22 bp, Homo sapiens
tggaaggaagccaaggaaggtt

SEQ ID NO: 8059118 - DNA, 22 bp, Homo sapiens
tggaaggaagccaaggaaggtt

SEQ ID NO: 8059119 - DNA, 22 bp, Homo sapiens
tggaaggaaaggtagcagagaa

SEQ ID NO: 8059120 - DNA, 22 bp, Homo sapiens
tggaagcccagaaggaagcaga

SEQ ID NO: 8059121 - DNA, 22 bp, Homo sapiens
tggagcctccagtctttctaga

SEQ ID NO: 8059122 - DNA, 22 bp, Homo sapiens
tggagccagtgttgcccaacac

SEQ ID NO: 8059123 - DNA, 22 bp, Homo sapiens
tggagctgaactttgaggccag

SEQ ID NO: 8059124 - DNA, 18 bp, Homo sapiens
tggagctgagtgctgtgc

SEQ ID NO: 8059125 - DNA, 22 bp, Homo sapiens
tggagctgatacagctggcttt

SEQ ID NO: 8059126 - DNA, 22 bp, Homo sapiens
tggagctgatacagctggcttt

SEQ ID NO: 8059127 - DNA, 22 bp, Homo sapiens
tggagctgggagtcctgggctg

SEQ ID NO: 8059128 - DNA, 22 bp, Homo sapiens
tggagctggaatttctgggcct

SEQ ID NO: 8059129 - DNA, 22 bp, Homo sapiens
tggagcaggaagtctatggctg

SEQ ID NO: 8059130 - DNA, 18 bp, Homo sapiens
tggagcaggaagcctggc

SEQ ID NO: 8059131 - DNA, 22 bp, Homo sapiens
tggagcaggaaacatctagagg

SEQ ID NO: 8059132 - DNA, 22 bp, Homo sapiens
tggagcagctctagcgggcgcc

SEQ ID NO: 8059133 - DNA, 22 bp, Homo sapiens
tggagcagctctagcgggcgcc

SEQ ID NO: 8059134 - DNA, 22 bp, Homo sapiens
tggagcaggtgctcagggtaat

SEQ ID NO: 8059135 - DNA, 22 bp, Homo sapiens
tggagcaggtgccaggtgtgtg

SEQ ID NO: 8059136 - DNA, 22 bp, Homo sapiens
tggagcaggtgccaggtgtgtg

SEQ ID NO: 8059137 - DNA, 22 bp, Homo sapiens
tggagcaggacggggagtggta

SEQ ID NO: 8059138 - DNA, 22 bp, Homo sapiens
tggagcagtggtcctggagatg

SEQ ID NO: 8059139 - DNA, 22 bp, Homo sapiens
tggagccaggagcctgggagtc

SEQ ID NO: 8059140 - DNA, 22 bp, Homo sapiens
tggagccagcggcctgctgagg

SEQ ID NO: 8059141 - DNA, 22 bp, Homo sapiens
tggagccagcgagccgaggcgg

SEQ ID NO: 8059142 - DNA, 22 bp, Homo sapiens
tggagccagagcgcagcctggg

SEQ ID NO: 8059143 - DNA, 22 bp, Homo sapiens
tggagagcgcgacgggaggaag

SEQ ID NO: 8059144 - DNA, 19 bp, Homo sapiens
tggagaggaaatgctgctc

SEQ ID NO: 8059145 - DNA, 22 bp, Homo sapiens
tggagaggaaagtgcagttttg

SEQ ID NO: 8059146 - DNA, 19 bp, Homo sapiens
tggagaggaaatgctgctc

SEQ ID NO: 8059147 - DNA, 22 bp, Homo sapiens
tggagcagagatgggagcccaa

SEQ ID NO: 8059148 - DNA, 22 bp, Homo sapiens
tggagcagagatgggagcccaa

SEQ ID NO: 8059149 - DNA, 22 bp, Homo sapiens
tggagcagaaatttgaagccat

SEQ ID NO: 8059150 - DNA, 22 bp, Homo sapiens
tggagaggagcaccatggccat

SEQ ID NO: 8059151 - DNA, 19 bp, Homo sapiens
tggagaggaaatgctgctc

SEQ ID NO: 8059152 - DNA, 22 bp, Homo sapiens
tggagaggttgaataacttgtc

SEQ ID NO: 8059153 - DNA, 22 bp, Homo sapiens
tggagcagagttcagcggggag

SEQ ID NO: 8059154 - DNA, 22 bp, Homo sapiens
tggagcagagttcagcggggag

SEQ ID NO: 8059155 - DNA, 22 bp, Homo sapiens
tggagcagcacaagaaagggga

SEQ ID NO: 8059156 - DNA, 22 bp, Homo sapiens
tggagcagagatggtggccttc

SEQ ID NO: 8059157 - DNA, 22 bp, Homo sapiens
tggagcagccatgatgacagag

SEQ ID NO: 8059158 - DNA, 22 bp, Homo sapiens
tggagcagcattcatccagcag

SEQ ID NO: 8059159 - DNA, 22 bp, Homo sapiens
tggaggctggtttctgctgagg

SEQ ID NO: 8059160 - DNA, 22 bp, Homo sapiens
tggaggctgtgtgcatgagacc

SEQ ID NO: 8059161 - DNA, 23 bp, Homo sapiens
tggagggcagaataacagactac

SEQ ID NO: 8059162 - DNA, 22 bp, Homo sapiens
tggagggcatctgtggtcaggc

SEQ ID NO: 8059163 - DNA, 22 bp, Homo sapiens
tggagggcatctgtggtcaggc

SEQ ID NO: 8059164 - DNA, 22 bp, Homo sapiens
tggagggcgcttagatggaggg

SEQ ID NO: 8059165 - DNA, 18 bp, Homo sapiens
tggagggcttgctgcagc

SEQ ID NO: 8059166 - DNA, 22 bp, Homo sapiens
tggagggctctttcacctggta

SEQ ID NO: 8059167 - DNA, 22 bp, Homo sapiens
tggaggtggggctcaggaatct

SEQ ID NO: 8059168 - DNA, 22 bp, Homo sapiens
tggaggtggcatctgacagctg

SEQ ID NO: 8059169 - DNA, 22 bp, Homo sapiens
tggatgggttgaaatgtgagcc

SEQ ID NO: 8059170 - DNA, 22 bp, Homo sapiens
tggatggattgacgaaggcagc

SEQ ID NO: 8059171 - DNA, 20 bp, Homo sapiens
tggagtgctgtgttgagaag

SEQ ID NO: 8059172 - DNA, 22 bp, Homo sapiens
tggaggctggagtgcagtggcg

SEQ ID NO: 8059173 - DNA, 22 bp, Homo sapiens
tggaggcaggttagccagacga

SEQ ID NO: 8059174 - DNA, 22 bp, Homo sapiens
tggaggcaccactggctgcccg

SEQ ID NO: 8059175 - DNA, 19 bp, Homo sapiens
tggaggcaagacatggagg

SEQ ID NO: 8059176 - DNA, 20 bp, Homo sapiens
tggaggcacctgtggagatc

SEQ ID NO: 8059177 - DNA, 20 bp, Homo sapiens
tggaggcagagccagaggga

SEQ ID NO: 8059178 - DNA, 20 bp, Homo sapiens
tggaggcagagccagaggga

SEQ ID NO: 8059179 - DNA, 22 bp, Homo sapiens
tggaggcactaaatggccacaa

SEQ ID NO: 8059180 - DNA, 22 bp, Homo sapiens
tggaggcaggagacagggcaaa

SEQ ID NO: 8059181 - DNA, 22 bp, Homo sapiens
tggaggagaatttatggtcgaa

SEQ ID NO: 8059182 - DNA, 22 bp, Homo sapiens
tggagctggtaaacagtgacat

SEQ ID NO: 8059183 - DNA, 23 bp, Homo sapiens
tggagctgggctcagaccctggg

SEQ ID NO: 8059184 - DNA, 22 bp, Homo sapiens
tggagctgggagtcctgggctg

SEQ ID NO: 8059185 - DNA, 22 bp, Homo sapiens
tggagctgtcactcagaaccaa

SEQ ID NO: 8059186 - DNA, 22 bp, Homo sapiens
tgctctggctggagcaatgact

SEQ ID NO: 8059187 - DNA, 22 bp, Homo sapiens
tgctctcctgctcctcagccca

SEQ ID NO: 8059188 - DNA, 23 bp, Homo sapiens
tgctctgggaggccctggagagc

SEQ ID NO: 8059189 - DNA, 22 bp, Homo sapiens
tgctctgggattcagcagcctg

SEQ ID NO: 8059190 - DNA, 22 bp, Homo sapiens
tgctctggctgggatgagtgca

SEQ ID NO: 8059191 - DNA, 22 bp, Homo sapiens
tgctctgggctcaatggcagct

SEQ ID NO: 8059192 - DNA, 22 bp, Homo sapiens
tgctctggggagctcctctgcg

SEQ ID NO: 8059193 - DNA, 22 bp, Homo sapiens
tgctctggggctccccaccaga

SEQ ID NO: 8059194 - DNA, 22 bp, Homo sapiens
tgctctgggggaagccagctgt

SEQ ID NO: 8059195 - DNA, 22 bp, Homo sapiens
tgctcgctgactcaacaagctt

SEQ ID NO: 8059196 - DNA, 22 bp, Homo sapiens
tgctcgccccacatgccctcat

SEQ ID NO: 8059197 - DNA, 22 bp, Homo sapiens
tgctcctgagtgtgcaggagat

SEQ ID NO: 8059198 - DNA, 22 bp, Homo sapiens
tgctccctgctcagagaggcca

SEQ ID NO: 8059199 - DNA, 22 bp, Homo sapiens
tgctcccttgccagaggggaag

SEQ ID NO: 8059200 - DNA, 21 bp, Homo sapiens
tgctccagggcagcttccagc

SEQ ID NO: 8059201 - DNA, 22 bp, Homo sapiens
tgctccagcatgaccctcaatg

SEQ ID NO: 8059202 - DNA, 22 bp, Homo sapiens
tgctgaggcagatgtctgtgac

SEQ ID NO: 8059203 - DNA, 20 bp, Homo sapiens
tgctctgggggtggagagac

SEQ ID NO: 8059204 - DNA, 18 bp, Homo sapiens
tgctctggtctcacttgg

SEQ ID NO: 8059205 - DNA, 22 bp, Homo sapiens
tgctctggtaactcacttccat

SEQ ID NO: 8059206 - DNA, 22 bp, Homo sapiens
tgctctgtattctatggcagtt

SEQ ID NO: 8059207 - DNA, 22 bp, Homo sapiens
tgctcttcacagtttcagcatc

SEQ ID NO: 8059208 - DNA, 23 bp, Homo sapiens
tgctcttctcagacctgtcagcc

SEQ ID NO: 8059209 - DNA, 22 bp, Homo sapiens
tgctcttcggggccactgcttg

SEQ ID NO: 8059210 - DNA, 22 bp, Homo sapiens
tgctgagcgcatccggcggccg

SEQ ID NO: 8059211 - DNA, 22 bp, Homo sapiens
tgctgaggaggtggctgtgctt

SEQ ID NO: 8059212 - DNA, 22 bp, Homo sapiens
tgctcattggcgatctgaggga

SEQ ID NO: 8059213 - DNA, 22 bp, Homo sapiens
tgctcacattaggcatccatgg

SEQ ID NO: 8059214 - DNA, 22 bp, Homo sapiens
tgctcacactcatgtccacgct

SEQ ID NO: 8059215 - DNA, 22 bp, Homo sapiens
tgctcacagcccagaacataat

SEQ ID NO: 8059216 - DNA, 22 bp, Homo sapiens
tgctcagacaagctgaacagta

SEQ ID NO: 8059217 - DNA, 21 bp, Homo sapiens
tgctcagattctccatctgga

SEQ ID NO: 8059218 - DNA, 22 bp, Homo sapiens
tgctcagccgtgagcagagccg

SEQ ID NO: 8059219 - DNA, 21 bp, Homo sapiens
tgctatcacactctttctgct

SEQ ID NO: 8059220 - DNA, 22 bp, Homo sapiens
tgcgcctgtaagtccagagtcc

SEQ ID NO: 8059221 - DNA, 22 bp, Homo sapiens
tgcgtttaggacataaggagaa

SEQ ID NO: 8059222 - DNA, 22 bp, Homo sapiens
tgccttggattgcagggaacct

SEQ ID NO: 8059223 - DNA, 22 bp, Homo sapiens
tgccttggaggaatgatgagag

SEQ ID NO: 8059224 - DNA, 22 bp, Homo sapiens
tgccttgggagccagcatgcca

SEQ ID NO: 8059225 - DNA, 20 bp, Homo sapiens
tgccttgggacagtgcctgt

SEQ ID NO: 8059226 - DNA, 22 bp, Homo sapiens
tgccttggttctctacttggag

SEQ ID NO: 8059227 - DNA, 22 bp, Homo sapiens
tgccttggtggcagtctgcggt

SEQ ID NO: 8059228 - DNA, 22 bp, Homo sapiens
tgccttgtccttcgtcagggct

SEQ ID NO: 8059229 - DNA, 22 bp, Homo sapiens
tgccttggtttccccatctgta

SEQ ID NO: 8059230 - DNA, 22 bp, Homo sapiens
tgcctgtgtgaccacgggcaag

SEQ ID NO: 8059231 - DNA, 20 bp, Homo sapiens
tgccttggagcagccaaggt

SEQ ID NO: 8059232 - DNA, 22 bp, Homo sapiens
tgcctggccagaccctatagag

SEQ ID NO: 8059233 - DNA, 22 bp, Homo sapiens
tgcctggctgggctgctcatgg

SEQ ID NO: 8059234 - DNA, 22 bp, Homo sapiens
tgcctggctctatcagtggtgg

SEQ ID NO: 8059235 - DNA, 22 bp, Homo sapiens
tgcctggggattgctctgggcc

SEQ ID NO: 8059236 - DNA, 22 bp, Homo sapiens
tgcctgggaaccaatcctggct

SEQ ID NO: 8059237 - DNA, 22 bp, Homo sapiens
tgcctggggttggcaaactgct

SEQ ID NO: 8059238 - DNA, 22 bp, Homo sapiens
tgcctgggtccaggccaagcct

SEQ ID NO: 8059239 - DNA, 22 bp, Homo sapiens
tgcctgggtgctggctggtcac

SEQ ID NO: 8059240 - DNA, 22 bp, Homo sapiens
tgcctgggtgccctctgctcct

SEQ ID NO: 8059241 - DNA, 22 bp, Homo sapiens
tgcctgggtgtaaagggccaac

SEQ ID NO: 8059242 - DNA, 22 bp, Homo sapiens
tgcctgggtgtaaagggccaac

SEQ ID NO: 8059243 - DNA, 22 bp, Homo sapiens
tgcctgggtgctggctggtcac

SEQ ID NO: 8059244 - DNA, 21 bp, Homo sapiens
tgctggcaagactcaggaata

SEQ ID NO: 8059245 - DNA, 22 bp, Homo sapiens
tgctggcacatagagactggct

SEQ ID NO: 8059246 - DNA, 22 bp, Homo sapiens
tgctggcaccagaatgactgca

SEQ ID NO: 8059247 - DNA, 22 bp, Homo sapiens
tgctggcatgcatgctgtagga

SEQ ID NO: 8059248 - DNA, 22 bp, Homo sapiens
tgctggaggccgagaagcagca

SEQ ID NO: 8059249 - DNA, 22 bp, Homo sapiens
tgctggctctaggctgagacag

SEQ ID NO: 8059250 - DNA, 22 bp, Homo sapiens
tgctggcattgcataggcagtt

SEQ ID NO: 8059251 - DNA, 22 bp, Homo sapiens
tgctggcatttcaggactcacc

SEQ ID NO: 8059252 - DNA, 22 bp, Homo sapiens
tgctggccaacaaggctccaag

SEQ ID NO: 8059253 - DNA, 22 bp, Homo sapiens
tgctggctccaacctggcatct

SEQ ID NO: 8059254 - DNA, 22 bp, Homo sapiens
tgctggctcagtttgcagactc

SEQ ID NO: 8059255 - DNA, 22 bp, Homo sapiens
tgctgctgcttctgtacagcct

SEQ ID NO: 8059256 - DNA, 22 bp, Homo sapiens
tgctgctgggtttgacagtcac

SEQ ID NO: 8059257 - DNA, 22 bp, Homo sapiens
tgctgctcctgcctggctccca

SEQ ID NO: 8059258 - DNA, 22 bp, Homo sapiens
tgctgccatggtcgctggtgtc

SEQ ID NO: 8059259 - DNA, 23 bp, Homo sapiens
tgctgcccactcttccagccctc

SEQ ID NO: 8059260 - DNA, 18 bp, Homo sapiens
tgctgcccaactctcccc

SEQ ID NO: 8059261 - DNA, 23 bp, Homo sapiens
tgctgccctgccttcagctctcc

SEQ ID NO: 8059262 - DNA, 23 bp, Homo sapiens
tgctgccctgccttcagctctcc

SEQ ID NO: 8059263 - DNA, 21 bp, Homo sapiens
tgctgccatcatgcagagatg

SEQ ID NO: 8059264 - DNA, 22 bp, Homo sapiens
tgctgccatctcaactgccctt

SEQ ID NO: 8059265 - DNA, 21 bp, Homo sapiens
tgctgccatagacctgaggga

SEQ ID NO: 8059266 - DNA, 22 bp, Homo sapiens
tgctgccagggctctgcccaca

SEQ ID NO: 8059267 - DNA, 22 bp, Homo sapiens
tgctgccagggctctgcccaca

SEQ ID NO: 8059268 - DNA, 22 bp, Homo sapiens
tgctgccaggtcttgctgtcca

SEQ ID NO: 8059269 - DNA, 22 bp, Homo sapiens
tgctgccagccaggccatggag

SEQ ID NO: 8059270 - DNA, 22 bp, Homo sapiens
tgctgccacctgtggtagtctg

SEQ ID NO: 8059271 - DNA, 22 bp, Homo sapiens
tgctgccactggtagtctcatt

SEQ ID NO: 8059272 - DNA, 22 bp, Homo sapiens
tgctgccaaatgcgagctctgt

SEQ ID NO: 8059273 - DNA, 22 bp, Homo sapiens
tgctgccaagcccgtgctcctg

SEQ ID NO: 8059274 - DNA, 17 bp, Homo sapiens
tgctgccaagtcccaac

SEQ ID NO: 8059275 - DNA, 22 bp, Homo sapiens
tgctgccaatttctggtcttga

SEQ ID NO: 8059276 - DNA, 22 bp, Homo sapiens
tgctgccacaaattcagctgcc

SEQ ID NO: 8059277 - DNA, 22 bp, Homo sapiens
tgctgccacctggtggctgaag

SEQ ID NO: 8059278 - DNA, 22 bp, Homo sapiens
tgctgccacccctcaccagagc

SEQ ID NO: 8059279 - DNA, 22 bp, Homo sapiens
tgctggtgaggtccttgctgga

SEQ ID NO: 8059280 - DNA, 21 bp, Homo sapiens
tgctggtgagctcatgtggct

SEQ ID NO: 8059281 - DNA, 22 bp, Homo sapiens
tgctgtcaaggttacatgcttt

SEQ ID NO: 8059282 - DNA, 16 bp, Homo sapiens
tgctggggcgccgtcc

SEQ ID NO: 8059283 - DNA, 22 bp, Homo sapiens
tgctggggcagaagagccaaga

SEQ ID NO: 8059284 - DNA, 22 bp, Homo sapiens
tgctggggagtgattgaccatc

SEQ ID NO: 8059285 - DNA, 22 bp, Homo sapiens
tgctggggatccgtaccaaccc

SEQ ID NO: 8059286 - DNA, 20 bp, Homo sapiens
tgctggggacatacagggtg

SEQ ID NO: 8059287 - DNA, 20 bp, Homo sapiens
tgctggggacatacagggtg

SEQ ID NO: 8059288 - DNA, 22 bp, Homo sapiens
tgctggggtcatggggcgcccg

SEQ ID NO: 8059289 - DNA, 22 bp, Homo sapiens
tgctggggtcatggggcgcccg

SEQ ID NO: 8059290 - DNA, 22 bp, Homo sapiens
tgctggggctctgaccactcca

SEQ ID NO: 8059291 - DNA, 22 bp, Homo sapiens
tgctggggtctctccggtgccc

SEQ ID NO: 8059292 - DNA, 22 bp, Homo sapiens
tgctggggtctctccggtgccc

SEQ ID NO: 8059293 - DNA, 22 bp, Homo sapiens
tgctgggctggagctgccaggg

SEQ ID NO: 8059294 - DNA, 21 bp, Homo sapiens
tgctgggctgcaggggatgca

SEQ ID NO: 8059295 - DNA, 22 bp, Homo sapiens
tgctgggcttcacccccacagt

SEQ ID NO: 8059296 - DNA, 22 bp, Homo sapiens
tgctgggctgttcctgtccatg

SEQ ID NO: 8059297 - DNA, 22 bp, Homo sapiens
tgctgggcttcaactgcctgag

SEQ ID NO: 8059298 - DNA, 22 bp, Homo sapiens
tgctgggctagggtggagctct

SEQ ID NO: 8059299 - DNA, 22 bp, Homo sapiens
tgctgggcctttacctccaggg

SEQ ID NO: 8059300 - DNA, 22 bp, Homo sapiens
tgctgggcggtgggctcatccc

SEQ ID NO: 8059301 - DNA, 22 bp, Homo sapiens
tgctgggctagaagctgaggcc

SEQ ID NO: 8059302 - DNA, 20 bp, Homo sapiens
tgctgggccatcttgcatgc

SEQ ID NO: 8059303 - DNA, 22 bp, Homo sapiens
tgctgggcctcttccctggata

SEQ ID NO: 8059304 - DNA, 22 bp, Homo sapiens
tgctgggcctgcccctgtcagc

SEQ ID NO: 8059305 - DNA, 22 bp, Homo sapiens
tgctgggcagtgtgccctcgag

SEQ ID NO: 8059306 - DNA, 23 bp, Homo sapiens
tgctgggcagagctggtgctgag

SEQ ID NO: 8059307 - DNA, 22 bp, Homo sapiens
tgctgggcatcgtaggaggtac

SEQ ID NO: 8059308 - DNA, 22 bp, Homo sapiens
tgctgggcatcgtaggaggtac

SEQ ID NO: 8059309 - DNA, 22 bp, Homo sapiens
tgctgggcactgtctctgggga

SEQ ID NO: 8059310 - DNA, 22 bp, Homo sapiens
tgcttaaacatccagacagtat

SEQ ID NO: 8059311 - DNA, 22 bp, Homo sapiens
tgcttagaatctggacttgttg

SEQ ID NO: 8059312 - DNA, 22 bp, Homo sapiens
tgcttacgagctattttcactt

SEQ ID NO: 8059313 - DNA, 18 bp, Homo sapiens
tgcttacaggagttcctg

SEQ ID NO: 8059314 - DNA, 22 bp, Homo sapiens
tgcttacaactttattgaggaa

SEQ ID NO: 8059315 - DNA, 22 bp, Homo sapiens
tgcttacattgcatctgtgcct

SEQ ID NO: 8059316 - DNA, 18 bp, Homo sapiens
tgctgtgcacagccctat

SEQ ID NO: 8059317 - DNA, 23 bp, Homo sapiens
tgctgtgcctttgtctgcctcca

SEQ ID NO: 8059318 - DNA, 23 bp, Homo sapiens
tgctgtgcctttgtctgcctcca

SEQ ID NO: 8059319 - DNA, 22 bp, Homo sapiens
tgcttccctgaaggcacaggag

SEQ ID NO: 8059320 - DNA, 19 bp, Homo sapiens
tgcttcagaaatagaaagc

SEQ ID NO: 8059321 - DNA, 23 bp, Homo sapiens
tggccaggtagaggaggtagtga

SEQ ID NO: 8059322 - DNA, 22 bp, Homo sapiens
tggccaggtgtgggttctcaga

SEQ ID NO: 8059323 - DNA, 19 bp, Homo sapiens
tggccaggtactgtctgct

SEQ ID NO: 8059324 - DNA, 23 bp, Homo sapiens
tggccagggtactacacccaccc

SEQ ID NO: 8059325 - DNA, 22 bp, Homo sapiens
tggccaggggagttcccctcca

SEQ ID NO: 8059326 - DNA, 22 bp, Homo sapiens
tggccaggctggtctggaacgc

SEQ ID NO: 8059327 - DNA, 22 bp, Homo sapiens
tggccaggcctcttggtgccca

SEQ ID NO: 8059328 - DNA, 22 bp, Homo sapiens
tggccaggggagttcccctcca

SEQ ID NO: 8059329 - DNA, 22 bp, Homo sapiens
tggccagccagaaagaagcctt

SEQ ID NO: 8059330 - DNA, 22 bp, Homo sapiens
tggccagcagagttcactctct

SEQ ID NO: 8059331 - DNA, 22 bp, Homo sapiens
tggccagcccttcagccatgcc

SEQ ID NO: 8059332 - DNA, 22 bp, Homo sapiens
tggccagcccttcagccatgcc

SEQ ID NO: 8059333 - DNA, 21 bp, Homo sapiens
tggccagctgctcgtctcctc

SEQ ID NO: 8059334 - DNA, 22 bp, Homo sapiens
tggccagccttgtcatcgcttt

SEQ ID NO: 8059335 - DNA, 22 bp, Homo sapiens
tggccagccttgtcatcgcttt

SEQ ID NO: 8059336 - DNA, 22 bp, Homo sapiens
tggccaggccggggacagaact

SEQ ID NO: 8059337 - DNA, 22 bp, Homo sapiens
tggccaggccggggacagaact

SEQ ID NO: 8059338 - DNA, 22 bp, Homo sapiens
tggccacatatgtgggacagct

SEQ ID NO: 8059339 - DNA, 22 bp, Homo sapiens
tggccacatgcgtctgtgaggc

SEQ ID NO: 8059340 - DNA, 22 bp, Homo sapiens
tggccacagtgtccagcagcag

SEQ ID NO: 8059341 - DNA, 19 bp, Homo sapiens
tggccacctctgctgttct

SEQ ID NO: 8059342 - DNA, 22 bp, Homo sapiens
tggccacactgcccccactggg

SEQ ID NO: 8059343 - DNA, 23 bp, Homo sapiens
tggccacagtccatgcatgccca

SEQ ID NO: 8059344 - DNA, 23 bp, Homo sapiens
tggccacagtccatgcatgccca

SEQ ID NO: 8059345 - DNA, 22 bp, Homo sapiens
tggccacagcctctgccagttc

SEQ ID NO: 8059346 - DNA, 22 bp, Homo sapiens
tggccacagcctctgccagttc

SEQ ID NO: 8059347 - DNA, 22 bp, Homo sapiens
tggcaggtcatgagtggccacc

SEQ ID NO: 8059348 - DNA, 22 bp, Homo sapiens
tggcagggtggcaacttttggt

SEQ ID NO: 8059349 - DNA, 22 bp, Homo sapiens
tggcagggtggcaacttttggt

SEQ ID NO: 8059350 - DNA, 22 bp, Homo sapiens
tggcagggtgccagttgcgagt

SEQ ID NO: 8059351 - DNA, 22 bp, Homo sapiens
tggcagggtgccagttgcgagt

SEQ ID NO: 8059352 - DNA, 22 bp, Homo sapiens
tggcagggtcttgctgtgttgc

SEQ ID NO: 8059353 - DNA, 22 bp, Homo sapiens
tggcagggtcttgctgtgttgc

SEQ ID NO: 8059354 - DNA, 22 bp, Homo sapiens
tggcagggtcttgctgtgttgc

SEQ ID NO: 8059355 - DNA, 22 bp, Homo sapiens
tggcaggtggcacagcctggga

SEQ ID NO: 8059356 - DNA, 22 bp, Homo sapiens
tggcaggtggagacagcagagc

SEQ ID NO: 8059357 - DNA, 20 bp, Homo sapiens
tggcaggtggcctcagttcc

SEQ ID NO: 8059358 - DNA, 22 bp, Homo sapiens
tggcaggtggctctggcattct

SEQ ID NO: 8059359 - DNA, 23 bp, Homo sapiens
tggcaggtggttagatgttttgt

SEQ ID NO: 8059360 - DNA, 22 bp, Homo sapiens
tggcaggttatgcgggccacat

SEQ ID NO: 8059361 - DNA, 22 bp, Homo sapiens
tggcaggttaacttacaactgt

SEQ ID NO: 8059362 - DNA, 22 bp, Homo sapiens
tggcaggtgcacttttggtttc

SEQ ID NO: 8059363 - DNA, 22 bp, Homo sapiens
tggcaggtgccatgggctcaga

SEQ ID NO: 8059364 - DNA, 22 bp, Homo sapiens
tggcaggtgcctgtaatctcag

SEQ ID NO: 8059365 - DNA, 18 bp, Homo sapiens
tggcaggtccagctgtgg

SEQ ID NO: 8059366 - DNA, 22 bp, Homo sapiens
tggcaggtccactcacagatct

SEQ ID NO: 8059367 - DNA, 22 bp, Homo sapiens
tggcaggtgaagttgttaggga

SEQ ID NO: 8059368 - DNA, 22 bp, Homo sapiens
tggcaggttggcctttggttca

SEQ ID NO: 8059369 - DNA, 21 bp, Homo sapiens
tggcaggttcaaaggcctatc

SEQ ID NO: 8059370 - DNA, 22 bp, Homo sapiens
tggcaggtttcgttaaaaatgg

SEQ ID NO: 8059371 - DNA, 22 bp, Homo sapiens
tggcaggtttcctcctcatagt

SEQ ID NO: 8059372 - DNA, 16 bp, Homo sapiens
tggcaggtttttatct

SEQ ID NO: 8059373 - DNA, 22 bp, Homo sapiens
tggcagtgatgcggcaggacat

SEQ ID NO: 8059374 - DNA, 22 bp, Homo sapiens
tggcatcattttcagctggcca

SEQ ID NO: 8059375 - DNA, 22 bp, Homo sapiens
tggcatgccttgtcagacagtg

SEQ ID NO: 8059376 - DNA, 19 bp, Homo sapiens
tggcatgatgatggatggg

SEQ ID NO: 8059377 - DNA, 22 bp, Homo sapiens
tggcatgggccagggagagctg

SEQ ID NO: 8059378 - DNA, 22 bp, Homo sapiens
tggcatgggtggagagagcaca

SEQ ID NO: 8059379 - DNA, 22 bp, Homo sapiens
tggcatggccagtgctgggagt

SEQ ID NO: 8059380 - DNA, 21 bp, Homo sapiens
tggcatggaggtagcagtgtg

SEQ ID NO: 8059381 - DNA, 22 bp, Homo sapiens
tggcatggactagtgctgaggt

SEQ ID NO: 8059382 - DNA, 22 bp, Homo sapiens
tggcctgccactgccacgccac

SEQ ID NO: 8059383 - DNA, 22 bp, Homo sapiens
tggcctgcccagagcagctctg

SEQ ID NO: 8059384 - DNA, 22 bp, Homo sapiens
tggcctgcctcccggcttcttt

SEQ ID NO: 8059385 - DNA, 22 bp, Homo sapiens
tggcctgaggctcggcatgggt

SEQ ID NO: 8059386 - DNA, 22 bp, Homo sapiens
tggcctgcaaagtcttcttgct

SEQ ID NO: 8059387 - DNA, 23 bp, Homo sapiens
tggcctgcagagtttctgctggg

SEQ ID NO: 8059388 - DNA, 22 bp, Homo sapiens
tggcctcttacgacatagcctt

SEQ ID NO: 8059389 - DNA, 20 bp, Homo sapiens
tggcctctgtagaggccaag

SEQ ID NO: 8059390 - DNA, 22 bp, Homo sapiens
tggcctctggctgaggactaac

SEQ ID NO: 8059391 - DNA, 18 bp, Homo sapiens
tggcctggagacaactct

SEQ ID NO: 8059392 - DNA, 22 bp, Homo sapiens
tggcctggaacctggcagggac

SEQ ID NO: 8059393 - DNA, 22 bp, Homo sapiens
tggcctggaagagaggtcgagg

SEQ ID NO: 8059394 - DNA, 22 bp, Homo sapiens
tggcctgccttcgctgagctga

SEQ ID NO: 8059395 - DNA, 22 bp, Homo sapiens
tggccctgtgtcctgctgccag

SEQ ID NO: 8059396 - DNA, 22 bp, Homo sapiens
tggccctgtgtgcaggctgcac

SEQ ID NO: 8059397 - DNA, 22 bp, Homo sapiens
tggccctgtggaggtcagtgag

SEQ ID NO: 8059398 - DNA, 20 bp, Homo sapiens
tggccctgttttctccaggc

SEQ ID NO: 8059399 - DNA, 22 bp, Homo sapiens
tggccctgggcagaggcaacat

SEQ ID NO: 8059400 - DNA, 22 bp, Homo sapiens
tggccctgccgcactatcctca

SEQ ID NO: 8059401 - DNA, 22 bp, Homo sapiens
tggccctgccgccacgacgtct

SEQ ID NO: 8059402 - DNA, 23 bp, Homo sapiens
tggccctgtgcatgctgcttccc

SEQ ID NO: 8059403 - DNA, 22 bp, Homo sapiens
tggccctgtgactgagttctag

SEQ ID NO: 8059404 - DNA, 22 bp, Homo sapiens
tggccctgtctgcacacaggat

SEQ ID NO: 8059405 - DNA, 22 bp, Homo sapiens
tggccctgtccctggagcctgg

SEQ ID NO: 8059406 - DNA, 22 bp, Homo sapiens
tggccctgtccctggagcctgg

SEQ ID NO: 8059407 - DNA, 22 bp, Homo sapiens
tggccctggtggcacagcctgc

SEQ ID NO: 8059408 - DNA, 22 bp, Homo sapiens
tggcccaggtctctctgagccc

SEQ ID NO: 8059409 - DNA, 22 bp, Homo sapiens
tggcccagggtctacagcctca

SEQ ID NO: 8059410 - DNA, 22 bp, Homo sapiens
tggcccagggcacagcagggag

SEQ ID NO: 8059411 - DNA, 22 bp, Homo sapiens
tggcccaggggctcttggtgtt

SEQ ID NO: 8059412 - DNA, 22 bp, Homo sapiens
tggcccaggggctcttggtgtt

SEQ ID NO: 8059413 - DNA, 22 bp, Homo sapiens
tggcccaggccaaagccctgga

SEQ ID NO: 8059414 - DNA, 22 bp, Homo sapiens
tggcccaggcgaggtgggcaga

SEQ ID NO: 8059415 - DNA, 22 bp, Homo sapiens
tggcccagggagttcatggtgt

SEQ ID NO: 8059416 - DNA, 22 bp, Homo sapiens
tggcccagctcagggtgggcgg

SEQ ID NO: 8059417 - DNA, 22 bp, Homo sapiens
tggcccagccctgctctagggc

SEQ ID NO: 8059418 - DNA, 22 bp, Homo sapiens
tggcccagagcactgctgggca

SEQ ID NO: 8059419 - DNA, 22 bp, Homo sapiens
tggccagtttgctcaggcagtc

SEQ ID NO: 8059420 - DNA, 22 bp, Homo sapiens
tggcccaggtgcacccagaggc

SEQ ID NO: 8059421 - DNA, 22 bp, Homo sapiens
tggccctgaatcaaggccagca

SEQ ID NO: 8059422 - DNA, 23 bp, Homo sapiens
tggccctgaatctgtcctggagg

SEQ ID NO: 8059423 - DNA, 22 bp, Homo sapiens
tggccctcagtcttgctcctgc

SEQ ID NO: 8059424 - DNA, 22 bp, Homo sapiens
tggccctcagtcttgctcctgc

SEQ ID NO: 8059425 - DNA, 22 bp, Homo sapiens
tggccctcgtccgacaggtggg

SEQ ID NO: 8059426 - DNA, 22 bp, Homo sapiens
tggccctcgtccgacaggtggg

SEQ ID NO: 8059427 - DNA, 22 bp, Homo sapiens
tggccctgaaggccttgagcat

SEQ ID NO: 8059428 - DNA, 22 bp, Homo sapiens
tggccctgacttggaggcctga

SEQ ID NO: 8059429 - DNA, 22 bp, Homo sapiens
tggccctgacttggaggcctga

SEQ ID NO: 8059430 - DNA, 22 bp, Homo sapiens
tggccctgaggacccagtgtgg

SEQ ID NO: 8059431 - DNA, 22 bp, Homo sapiens
tggccctgacaggtcctgggca

SEQ ID NO: 8059432 - DNA, 22 bp, Homo sapiens
tggccctgactgatgtggaggg

SEQ ID NO: 8059433 - DNA, 22 bp, Homo sapiens
tggccctgagggctcggagcca

SEQ ID NO: 8059434 - DNA, 22 bp, Homo sapiens
tggccctgagggctcggagcca

SEQ ID NO: 8059435 - DNA, 22 bp, Homo sapiens
tggccctgcacccagagcagtt

SEQ ID NO: 8059436 - DNA, 22 bp, Homo sapiens
tggccctgccactcactgctga

SEQ ID NO: 8059437 - DNA, 22 bp, Homo sapiens
tggccctgcagaactagcctgg

SEQ ID NO: 8059438 - DNA, 22 bp, Homo sapiens
tggcaggaaagtaacagagcac

SEQ ID NO: 8059439 - DNA, 22 bp, Homo sapiens
tggcaggaaataccctgcctag

SEQ ID NO: 8059440 - DNA, 22 bp, Homo sapiens
tggcaggaagacgtggggcacc

SEQ ID NO: 8059441 - DNA, 22 bp, Homo sapiens
tggcagctggagggcaatggcc

SEQ ID NO: 8059442 - DNA, 22 bp, Homo sapiens
tggcagctgattagatggtgcc

SEQ ID NO: 8059443 - DNA, 22 bp, Homo sapiens
tggcaggaagacgtggggcacc

SEQ ID NO: 8059444 - DNA, 20 bp, Homo sapiens
tggcaggactggctccaccc

SEQ ID NO: 8059445 - DNA, 20 bp, Homo sapiens
tggcaggaggcagcagtgga

SEQ ID NO: 8059446 - DNA, 22 bp, Homo sapiens
tggcagggagttcgttcacaac

SEQ ID NO: 8059447 - DNA, 22 bp, Homo sapiens
tggcagggagttcgttcacaac

SEQ ID NO: 8059448 - DNA, 19 bp, Homo sapiens
tggcagggagtgatattag

SEQ ID NO: 8059449 - DNA, 19 bp, Homo sapiens
tggcagggagtgatattag

SEQ ID NO: 8059450 - DNA, 18 bp, Homo sapiens
tggcagggaggaaatata

SEQ ID NO: 8059451 - DNA, 18 bp, Homo sapiens
tggcagggaggaaatata

SEQ ID NO: 8059452 - DNA, 22 bp, Homo sapiens
tggcaggcaggcagccttctga

SEQ ID NO: 8059453 - DNA, 22 bp, Homo sapiens
tggcaggcagtgtgggagctgg

SEQ ID NO: 8059454 - DNA, 22 bp, Homo sapiens
tggcaggcagctggcatcctaa

SEQ ID NO: 8059455 - DNA, 22 bp, Homo sapiens
tggcaggcagctggcatcctaa

SEQ ID NO: 8059456 - DNA, 22 bp, Homo sapiens
tggcaggatctttgagagtgaa

SEQ ID NO: 8059457 - DNA, 21 bp, Homo sapiens
tggcaggcagctggaagcttg

SEQ ID NO: 8059458 - DNA, 22 bp, Homo sapiens
tggcaggcagagagcggccttt

SEQ ID NO: 8059459 - DNA, 22 bp, Homo sapiens
tggcaggcaagttcagctccac

SEQ ID NO: 8059460 - DNA, 22 bp, Homo sapiens
tggcagggcctaccccaatatc

SEQ ID NO: 8059461 - DNA, 22 bp, Homo sapiens
tggcagggcctaccccaatatc

SEQ ID NO: 8059462 - DNA, 22 bp, Homo sapiens
tggcagggagttgcaggatttc

SEQ ID NO: 8059463 - DNA, 22 bp, Homo sapiens
tggcagggagttgcaggatttc

SEQ ID NO: 8059464 - DNA, 22 bp, Homo sapiens
tggcagggagttgcaggatttc

SEQ ID NO: 8059465 - DNA, 22 bp, Homo sapiens
tggcagggcctgctcatcatcc

SEQ ID NO: 8059466 - DNA, 22 bp, Homo sapiens
tggcagggcctgctcatcatcc

SEQ ID NO: 8059467 - DNA, 22 bp, Homo sapiens
tggcagggcctgaatcttatac

SEQ ID NO: 8059468 - DNA, 22 bp, Homo sapiens
tggcagggcctgaatcttatac

SEQ ID NO: 8059469 - DNA, 21 bp, Homo sapiens
tggcaggggtagtagtacagc

SEQ ID NO: 8059470 - DNA, 21 bp, Homo sapiens
tggcaggggtagtagtacagc

SEQ ID NO: 8059471 - DNA, 22 bp, Homo sapiens
tggcagggtacaccttaacacc

SEQ ID NO: 8059472 - DNA, 22 bp, Homo sapiens
tggcagggtacaccttaacacc

SEQ ID NO: 8059473 - DNA, 18 bp, Homo sapiens
tggcaggggcagtacgcc

SEQ ID NO: 8059474 - DNA, 18 bp, Homo sapiens
tggcaggggcagtacgcc

SEQ ID NO: 8059475 - DNA, 18 bp, Homo sapiens
tggcaggggcagtacgcc

SEQ ID NO: 8059476 - DNA, 22 bp, Homo sapiens
tggcaggggaggtgcttgctta

SEQ ID NO: 8059477 - DNA, 22 bp, Homo sapiens
tggcaggggaggtgcttgctta

SEQ ID NO: 8059478 - DNA, 22 bp, Homo sapiens
tggcagagttcgctgtgccttt

SEQ ID NO: 8059479 - DNA, 20 bp, Homo sapiens
tggcagagttgtcccaccca

SEQ ID NO: 8059480 - DNA, 22 bp, Homo sapiens
tggcagcagacaaaaggccatt

SEQ ID NO: 8059481 - DNA, 22 bp, Homo sapiens
tggcagagtctgggcttgggca

SEQ ID NO: 8059482 - DNA, 22 bp, Homo sapiens
tggcagagtctctcctttccag

SEQ ID NO: 8059483 - DNA, 22 bp, Homo sapiens
tggcagagtcatcacatctgga

SEQ ID NO: 8059484 - DNA, 22 bp, Homo sapiens
tggcagagtcatcacatctgga

SEQ ID NO: 8059485 - DNA, 22 bp, Homo sapiens
tggcagagtaggatggccctgt

SEQ ID NO: 8059486 - DNA, 22 bp, Homo sapiens
tggcagagtggaccatactcaa

SEQ ID NO: 8059487 - DNA, 22 bp, Homo sapiens
tggcagagtgcagaagaggcat

SEQ ID NO: 8059488 - DNA, 22 bp, Homo sapiens
tggcagccttctctgagaaggt

SEQ ID NO: 8059489 - DNA, 22 bp, Homo sapiens
tggcagccacatctcgtggatt

SEQ ID NO: 8059490 - DNA, 22 bp, Homo sapiens
tggcagccatcagagcaggggt

SEQ ID NO: 8059491 - DNA, 22 bp, Homo sapiens
tggcagccatcagagcaggggt

SEQ ID NO: 8059492 - DNA, 22 bp, Homo sapiens
tggcagcctgcgtgaaggagct

SEQ ID NO: 8059493 - DNA, 22 bp, Homo sapiens
tggcagccttctctgagaaggt

SEQ ID NO: 8059494 - DNA, 22 bp, Homo sapiens
tggcagcctcagacaaggacct

SEQ ID NO: 8059495 - DNA, 22 bp, Homo sapiens
tggcagcctcccagctgcattc

SEQ ID NO: 8059496 - DNA, 22 bp, Homo sapiens
tggcagccatctgagggtgggg

SEQ ID NO: 8059497 - DNA, 22 bp, Homo sapiens
tggcagcagacatctgaggtct

SEQ ID NO: 8059498 - DNA, 22 bp, Homo sapiens
tggcagcagcaaatggcatatc

SEQ ID NO: 8059499 - DNA, 18 bp, Homo sapiens
tggcagcaggaagccatt

SEQ ID NO: 8059500 - DNA, 22 bp, Homo sapiens
tggcagcagctaacttaggcag

SEQ ID NO: 8059501 - DNA, 22 bp, Homo sapiens
tggcagcagccatggaaggccc

SEQ ID NO: 8059502 - DNA, 22 bp, Homo sapiens
tggcagcagggcccctggagga

SEQ ID NO: 8059503 - DNA, 22 bp, Homo sapiens
tggcagcagggcccctggagga

SEQ ID NO: 8059504 - DNA, 22 bp, Homo sapiens
tggcagcagggaggccagtgtt

SEQ ID NO: 8059505 - DNA, 22 bp, Homo sapiens
tggcagcagggaggccagtgtt

SEQ ID NO: 8059506 - DNA, 22 bp, Homo sapiens
tggcagcatgtcccggcctcag

SEQ ID NO: 8059507 - DNA, 22 bp, Homo sapiens
tggcagcagtggaggtagaaag

SEQ ID NO: 8059508 - DNA, 22 bp, Homo sapiens
tggcaacaagaaaggcagaggg

SEQ ID NO: 8059509 - DNA, 22 bp, Homo sapiens
tggcaacatgtcgaagtgctgt

SEQ ID NO: 8059510 - DNA, 22 bp, Homo sapiens
tggcaacatggacaggtctgcc

SEQ ID NO: 8059511 - DNA, 22 bp, Homo sapiens
tggcaacacctggaagacatgg

SEQ ID NO: 8059512 - DNA, 23 bp, Homo sapiens
tggcaactagtggtgaagagcct

SEQ ID NO: 8059513 - DNA, 22 bp, Homo sapiens
tggatgggttgaaatgtgagcc

SEQ ID NO: 8059514 - DNA, 17 bp, Homo sapiens
tggatgtgggatctgga

SEQ ID NO: 8059515 - DNA, 22 bp, Homo sapiens
tggatgtgtcgccctggctctc

SEQ ID NO: 8059516 - DNA, 22 bp, Homo sapiens
tggatgtgagaaggatcaggct

SEQ ID NO: 8059517 - DNA, 22 bp, Homo sapiens
tggatgtgagagcatcatgttc

SEQ ID NO: 8059518 - DNA, 22 bp, Homo sapiens
tggcacagacagcacagcaatg

SEQ ID NO: 8059519 - DNA, 22 bp, Homo sapiens
tggcacagacagatcaggagtc

SEQ ID NO: 8059520 - DNA, 22 bp, Homo sapiens
tggcacagacagatcaggagtc

SEQ ID NO: 8059521 - DNA, 22 bp, Homo sapiens
tggcacagactgggccaaggaa

SEQ ID NO: 8059522 - DNA, 16 bp, Homo sapiens
tggcacagagcagata

SEQ ID NO: 8059523 - DNA, 22 bp, Homo sapiens
tggcacagagggacccagcagc

SEQ ID NO: 8059524 - DNA, 17 bp, Homo sapiens
tggcacagaggtgctat

SEQ ID NO: 8059525 - DNA, 21 bp, Homo sapiens
tggcacagcaagtgggctcat

SEQ ID NO: 8059526 - DNA, 22 bp, Homo sapiens
tggcacagcccagagctcttga

SEQ ID NO: 8059527 - DNA, 22 bp, Homo sapiens
tggcactgaaaaaggagaggtt

SEQ ID NO: 8059528 - DNA, 22 bp, Homo sapiens
tggcactgaagctggaaagcct

SEQ ID NO: 8059529 - DNA, 22 bp, Homo sapiens
tggcacgacaattggcaccaat

SEQ ID NO: 8059530 - DNA, 22 bp, Homo sapiens
tggcaccatgttggcaaatgtt

SEQ ID NO: 8059531 - DNA, 22 bp, Homo sapiens
tggcaccaggcggggtggctgt

SEQ ID NO: 8059532 - DNA, 20 bp, Homo sapiens
tggcaccaggtggtggcccc

SEQ ID NO: 8059533 - DNA, 20 bp, Homo sapiens
tggcaccaggtggtggcccc

SEQ ID NO: 8059534 - DNA, 22 bp, Homo sapiens
tggcaccatcaaggctgagaac

SEQ ID NO: 8059535 - DNA, 23 bp, Homo sapiens
tggcaccaggcattctaggggta

SEQ ID NO: 8059536 - DNA, 22 bp, Homo sapiens
tggcactggcgcaggatggcgg

SEQ ID NO: 8059537 - DNA, 22 bp, Homo sapiens
tggcactgtcaccaatgctgtc

SEQ ID NO: 8059538 - DNA, 22 bp, Homo sapiens
tggcactggaatcgtagccttg

SEQ ID NO: 8059539 - DNA, 22 bp, Homo sapiens
tggcactgaccccaggcctgtg

SEQ ID NO: 8059540 - DNA, 22 bp, Homo sapiens
tggcactgccaacctgctaggt

SEQ ID NO: 8059541 - DNA, 22 bp, Homo sapiens
tggcagagcaaaaagatagaat

SEQ ID NO: 8059542 - DNA, 22 bp, Homo sapiens
tggcagagatgaagagttgttt

SEQ ID NO: 8059543 - DNA, 22 bp, Homo sapiens
tggcagagagagtgcagtcgac

SEQ ID NO: 8059544 - DNA, 22 bp, Homo sapiens
tggcagagcccagaactgagca

SEQ ID NO: 8059545 - DNA, 22 bp, Homo sapiens
tggcagagcccagactccagtc

SEQ ID NO: 8059546 - DNA, 22 bp, Homo sapiens
tggcagaggaaaaagtcactgg

SEQ ID NO: 8059547 - DNA, 22 bp, Homo sapiens
tggcagagccttgccaaactcc

SEQ ID NO: 8059548 - DNA, 22 bp, Homo sapiens
tggcagagcccagactccagtc

SEQ ID NO: 8059549 - DNA, 22 bp, Homo sapiens
tggcagagctggctgcggatga

SEQ ID NO: 8059550 - DNA, 22 bp, Homo sapiens
tggcagagagactctccttgat

SEQ ID NO: 8059551 - DNA, 22 bp, Homo sapiens
tggcagagagagtgcagtcgac

SEQ ID NO: 8059552 - DNA, 22 bp, Homo sapiens
tggcagagactcctcctgggag

SEQ ID NO: 8059553 - DNA, 22 bp, Homo sapiens
tggcagagagactctccttgat

SEQ ID NO: 8059554 - DNA, 22 bp, Homo sapiens
tggcagagacaaggccgggcct

SEQ ID NO: 8059555 - DNA, 22 bp, Homo sapiens
tggcagagaacctgggctttgt

SEQ ID NO: 8059556 - DNA, 22 bp, Homo sapiens
tggcagagaacacggctgatct

SEQ ID NO: 8059557 - DNA, 22 bp, Homo sapiens
tggcagagaacacggctgatct

SEQ ID NO: 8059558 - DNA, 22 bp, Homo sapiens
tgggacagttgtcctccactct

SEQ ID NO: 8059559 - DNA, 22 bp, Homo sapiens
tgggacagtgtgccttgctcct

SEQ ID NO: 8059560 - DNA, 22 bp, Homo sapiens
tgggacacaaaccagaccagga

SEQ ID NO: 8059561 - DNA, 22 bp, Homo sapiens
tgggaaggttagcagtttgtca

SEQ ID NO: 8059562 - DNA, 22 bp, Homo sapiens
tgggacagtgaccccagaggtc

SEQ ID NO: 8059563 - DNA, 22 bp, Homo sapiens
tgggacacagaaaaggcaggtt

SEQ ID NO: 8059564 - DNA, 22 bp, Homo sapiens
tgggaagcattaatgatagggg

SEQ ID NO: 8059565 - DNA, 22 bp, Homo sapiens
tgggaagatggagtgacaggca

SEQ ID NO: 8059566 - DNA, 22 bp, Homo sapiens
tgggaagagttagagacagctg

SEQ ID NO: 8059567 - DNA, 22 bp, Homo sapiens
tgggaagggccgatggagcctc

SEQ ID NO: 8059568 - DNA, 22 bp, Homo sapiens
tgggaagggagtttcttggagt

SEQ ID NO: 8059569 - DNA, 22 bp, Homo sapiens
tgggaagggagagtgtcctgga

SEQ ID NO: 8059570 - DNA, 22 bp, Homo sapiens
tgggaaggcgtggaagtagaag

SEQ ID NO: 8059571 - DNA, 22 bp, Homo sapiens
tgggaagggtcaacagctggaa

SEQ ID NO: 8059572 - DNA, 22 bp, Homo sapiens
tgggaagggtctgaatctgaga

SEQ ID NO: 8059573 - DNA, 22 bp, Homo sapiens
tgggaagggtctgaatctgaga

SEQ ID NO: 8059574 - DNA, 22 bp, Homo sapiens
tgggaaggtacacgggaaagag

SEQ ID NO: 8059575 - DNA, 22 bp, Homo sapiens
tgggaaggggagctggaaagga

SEQ ID NO: 8059576 - DNA, 22 bp, Homo sapiens
tgggaagggtcaacagctggaa

SEQ ID NO: 8059577 - DNA, 22 bp, Homo sapiens
tgggagaacccagggtcaggct

SEQ ID NO: 8059578 - DNA, 22 bp, Homo sapiens
tgggagcaaatgactgggagat

SEQ ID NO: 8059579 - DNA, 22 bp, Homo sapiens
tgggagcaagctacttagggaa

SEQ ID NO: 8059580 - DNA, 21 bp, Homo sapiens
tgggagagggctcagctaccc

SEQ ID NO: 8059581 - DNA, 22 bp, Homo sapiens
tgggagctcctggagggcagga

SEQ ID NO: 8059582 - DNA, 22 bp, Homo sapiens
tgggagcaggaagcaggaagta

SEQ ID NO: 8059583 - DNA, 22 bp, Homo sapiens
tgggagcagctttgcgagggag

SEQ ID NO: 8059584 - DNA, 22 bp, Homo sapiens
tgggagcagcagggagatgcgg

SEQ ID NO: 8059585 - DNA, 22 bp, Homo sapiens
tgggagcagccaacatggcctt

SEQ ID NO: 8059586 - DNA, 22 bp, Homo sapiens
tgggagcaagctggtgctggag

SEQ ID NO: 8059587 - DNA, 22 bp, Homo sapiens
tgggagcaccctgaggagcttc

SEQ ID NO: 8059588 - DNA, 22 bp, Homo sapiens
tgggagcaccttgagggcagaa

SEQ ID NO: 8059589 - DNA, 22 bp, Homo sapiens
tgggagcaccttgagggcagaa

SEQ ID NO: 8059590 - DNA, 22 bp, Homo sapiens
tgggagcactctttgggaagca

SEQ ID NO: 8059591 - DNA, 22 bp, Homo sapiens
tgggagctctgagcctgctgtg

SEQ ID NO: 8059592 - DNA, 22 bp, Homo sapiens
tgggagctctgagcctgctatg

SEQ ID NO: 8059593 - DNA, 22 bp, Homo sapiens
tgggaggaatgtcactgagcca

SEQ ID NO: 8059594 - DNA, 22 bp, Homo sapiens
tgggaggatcgcttgagcccag

SEQ ID NO: 8059595 - DNA, 22 bp, Homo sapiens
tgggaggatctcttgaggccag

SEQ ID NO: 8059596 - DNA, 22 bp, Homo sapiens
tgggaggcaggtaggtgatgat

SEQ ID NO: 8059597 - DNA, 22 bp, Homo sapiens
tgggaggatctcttgaggccag

SEQ ID NO: 8059598 - DNA, 22 bp, Homo sapiens
tgggaggcagaagttgactgga

SEQ ID NO: 8059599 - DNA, 22 bp, Homo sapiens
tgggaaagactcaggacaggag

SEQ ID NO: 8059600 - DNA, 19 bp, Homo sapiens
tgggaaagtaacatacaaa

SEQ ID NO: 8059601 - DNA, 17 bp, Homo sapiens
tggcttccctgggccac

SEQ ID NO: 8059602 - DNA, 22 bp, Homo sapiens
tggctggcaaggctggagtcag

SEQ ID NO: 8059603 - DNA, 18 bp, Homo sapiens
tggctggcagtgggcagc

SEQ ID NO: 8059604 - DNA, 22 bp, Homo sapiens
tggctgggagctggaactgggc

SEQ ID NO: 8059605 - DNA, 22 bp, Homo sapiens
tggctgggcccccacctgcctc

SEQ ID NO: 8059606 - DNA, 22 bp, Homo sapiens
tggctgggcccccacctgcctc

SEQ ID NO: 8059607 - DNA, 22 bp, Homo sapiens
tggctgggccgggccttgtgcc

SEQ ID NO: 8059608 - DNA, 19 bp, Homo sapiens
tggctgggtgccaatggcc

SEQ ID NO: 8059609 - DNA, 22 bp, Homo sapiens
tggctgggggtgctatagctgc

SEQ ID NO: 8059610 - DNA, 22 bp, Homo sapiens
tggctgggtgctatccagtact

SEQ ID NO: 8059611 - DNA, 19 bp, Homo sapiens
tggctgggcgtgcctccgt

SEQ ID NO: 8059612 - DNA, 22 bp, Homo sapiens
tggctggggagccccgactccc

SEQ ID NO: 8059613 - DNA, 22 bp, Homo sapiens
tggctggggagccccgactccc

SEQ ID NO: 8059614 - DNA, 22 bp, Homo sapiens
tggctgggccgggccttgtgcc

SEQ ID NO: 8059615 - DNA, 19 bp, Homo sapiens
tggctgggcgtgcctccgt

SEQ ID NO: 8059616 - DNA, 22 bp, Homo sapiens
tggctggggccacagttttcct

SEQ ID NO: 8059617 - DNA, 22 bp, Homo sapiens
tggctggggccacagttttcct

SEQ ID NO: 8059618 - DNA, 22 bp, Homo sapiens
tggctggggcctgaatcctgca

SEQ ID NO: 8059619 - DNA, 22 bp, Homo sapiens
tggctccttccgcagcatgcct

SEQ ID NO: 8059620 - DNA, 22 bp, Homo sapiens
tggctccttcattctcctgcca

SEQ ID NO: 8059621 - DNA, 21 bp, Homo sapiens
tggctctgagcctcatggctg

SEQ ID NO: 8059622 - DNA, 23 bp, Homo sapiens
tggctctgagaggttcagatgct

SEQ ID NO: 8059623 - DNA, 23 bp, Homo sapiens
tggctctgagcttcctggtggcc

SEQ ID NO: 8059624 - DNA, 23 bp, Homo sapiens
tggctctgagcttcctggtggcc

SEQ ID NO: 8059625 - DNA, 17 bp, Homo sapiens
tggctctgaggctgaat

SEQ ID NO: 8059626 - DNA, 22 bp, Homo sapiens
tggctctgcgtctgttcgtggg

SEQ ID NO: 8059627 - DNA, 21 bp, Homo sapiens
tggctctgctcagagcagtcc

SEQ ID NO: 8059628 - DNA, 18 bp, Homo sapiens
tggctctggacttgctcc

SEQ ID NO: 8059629 - DNA, 22 bp, Homo sapiens
tggctctggagctggcggctga

SEQ ID NO: 8059630 - DNA, 18 bp, Homo sapiens
tggctctgccactcaccg

SEQ ID NO: 8059631 - DNA, 22 bp, Homo sapiens
tggctctgcacctcagtgtacc

SEQ ID NO: 8059632 - DNA, 18 bp, Homo sapiens
tggctctgcagccagatg

SEQ ID NO: 8059633 - DNA, 22 bp, Homo sapiens
tggctctgcagcagtgtgcgtg

SEQ ID NO: 8059634 - DNA, 22 bp, Homo sapiens
tggctctgttttatgagtacca

SEQ ID NO: 8059635 - DNA, 22 bp, Homo sapiens
tggctctgtttgttaactagac

SEQ ID NO: 8059636 - DNA, 22 bp, Homo sapiens
tggctctgttcgccatcaggag

SEQ ID NO: 8059637 - DNA, 22 bp, Homo sapiens
tggctctggccaccgggagggc

SEQ ID NO: 8059638 - DNA, 22 bp, Homo sapiens
tggctctggattaatctaggaa

SEQ ID NO: 8059639 - DNA, 22 bp, Homo sapiens
tggctctgggaatctgttgctt

SEQ ID NO: 8059640 - DNA, 23 bp, Homo sapiens
tggctctgtgtcacatacaggat

SEQ ID NO: 8059641 - DNA, 23 bp, Homo sapiens
tggctctgtggatccctcaggag

SEQ ID NO: 8059642 - DNA, 22 bp, Homo sapiens
tggctgaggctggagtgcagtg

SEQ ID NO: 8059643 - DNA, 22 bp, Homo sapiens
tggctgctgtgggtagagggat

SEQ ID NO: 8059644 - DNA, 21 bp, Homo sapiens
tggctgctggccctctctcca

SEQ ID NO: 8059645 - DNA, 22 bp, Homo sapiens
tggctgctgctcactcagcctc

SEQ ID NO: 8059646 - DNA, 22 bp, Homo sapiens
tggctgctgcttggtcttcttc

SEQ ID NO: 8059647 - DNA, 22 bp, Homo sapiens
tggctgcttaaaattgctgcaa

SEQ ID NO: 8059648 - DNA, 18 bp, Homo sapiens
tggctgcttccaggtaca

SEQ ID NO: 8059649 - DNA, 22 bp, Homo sapiens
tggctgctgagaaggcagctgt

SEQ ID NO: 8059650 - DNA, 22 bp, Homo sapiens
tggctgctctcttccccagggt

SEQ ID NO: 8059651 - DNA, 22 bp, Homo sapiens
tggctgccatgacgcctgggga

SEQ ID NO: 8059652 - DNA, 22 bp, Homo sapiens
tggctgcagttcacaggagcaa

SEQ ID NO: 8059653 - DNA, 22 bp, Homo sapiens
tggctgccaagcaggtcagaga

SEQ ID NO: 8059654 - DNA, 22 bp, Homo sapiens
tggctgcagttcacaggagcaa

SEQ ID NO: 8059655 - DNA, 22 bp, Homo sapiens
tggctgagttctccaggagtag

SEQ ID NO: 8059656 - DNA, 22 bp, Homo sapiens
tggctgcagatcaagggcaggc

SEQ ID NO: 8059657 - DNA, 22 bp, Homo sapiens
tggctaaaccctagtaaattaa

SEQ ID NO: 8059658 - DNA, 22 bp, Homo sapiens
tggctaaacttgggtcagatgt

SEQ ID NO: 8059659 - DNA, 21 bp, Homo sapiens
tggctaaaccctagtaaatta

SEQ ID NO: 8059660 - DNA, 22 bp, Homo sapiens
tggcgtctctcataagtatgtg

SEQ ID NO: 8059661 - DNA, 22 bp, Homo sapiens
tggcggagttccagctgggatc

SEQ ID NO: 8059662 - DNA, 20 bp, Homo sapiens
tggcggggatgagggagtta

SEQ ID NO: 8059663 - DNA, 22 bp, Homo sapiens
tggctcagaagaaaaggtaaac

SEQ ID NO: 8059664 - DNA, 22 bp, Homo sapiens
tggctcagaactacttctagtt

SEQ ID NO: 8059665 - DNA, 22 bp, Homo sapiens
tggctcagagttcatcttttag

SEQ ID NO: 8059666 - DNA, 22 bp, Homo sapiens
tggctcagatgctcttccagtg

SEQ ID NO: 8059667 - DNA, 22 bp, Homo sapiens
tggctcagataattcaaggggc

SEQ ID NO: 8059668 - DNA, 18 bp, Homo sapiens
tggctcagatggctttaa

SEQ ID NO: 8059669 - DNA, 22 bp, Homo sapiens
tggctcagatttttgtaggctt

SEQ ID NO: 8059670 - DNA, 22 bp, Homo sapiens
tggctcagagagggagtgtgga

SEQ ID NO: 8059671 - DNA, 22 bp, Homo sapiens
tggctcagaaggctgccttcac

SEQ ID NO: 8059672 - DNA, 22 bp, Homo sapiens
tggctcagaggggaagtggttt

SEQ ID NO: 8059673 - DNA, 22 bp, Homo sapiens
tggctcagagcagggactctgg

SEQ ID NO: 8059674 - DNA, 22 bp, Homo sapiens
tggctcagagccttgagagctg

SEQ ID NO: 8059675 - DNA, 22 bp, Homo sapiens
tggcctggtccttgtcaaggca

SEQ ID NO: 8059676 - DNA, 22 bp, Homo sapiens
tggcctgggtgctgctgacatc

SEQ ID NO: 8059677 - DNA, 22 bp, Homo sapiens
tggcctgggtcacaccagggtc

SEQ ID NO: 8059678 - DNA, 22 bp, Homo sapiens
tggcctggtgctcaggcagtag

SEQ ID NO: 8059679 - DNA, 22 bp, Homo sapiens
tggcctggtgtctgcgaggcct

SEQ ID NO: 8059680 - DNA, 18 bp, Homo sapiens
tggctcctgcctcctgca

SEQ ID NO: 8059681 - DNA, 19 bp, Homo sapiens
tggctcctgcctgccttct

SEQ ID NO: 8059682 - DNA, 22 bp, Homo sapiens
tggctccaggggacacgcagta

SEQ ID NO: 8059683 - DNA, 22 bp, Homo sapiens
tggctccatcatccatgcaaga

SEQ ID NO: 8059684 - DNA, 22 bp, Homo sapiens
tggctcctatcaaggagtgggt

SEQ ID NO: 8059685 - DNA, 22 bp, Homo sapiens
tggctccaccgccgcggagctc

SEQ ID NO: 8059686 - DNA, 21 bp, Homo sapiens
tggctcagttgctgggcacag

SEQ ID NO: 8059687 - DNA, 22 bp, Homo sapiens
tggctcagttaggtcagaaaca

SEQ ID NO: 8059688 - DNA, 22 bp, Homo sapiens
tggctcagttccatcatctgga

SEQ ID NO: 8059689 - DNA, 22 bp, Homo sapiens
tggctccagccctgagcaagct

SEQ ID NO: 8059690 - DNA, 23 bp, Homo sapiens
tggctccaggagaagccagaagc

SEQ ID NO: 8059691 - DNA, 22 bp, Homo sapiens
tggctccagatttcctgctgca

SEQ ID NO: 8059692 - DNA, 22 bp, Homo sapiens
tggctcagtgcattcacagtaa

SEQ ID NO: 8059693 - DNA, 22 bp, Homo sapiens
tggctcagtgacattcctccca

SEQ ID NO: 8059694 - DNA, 22 bp, Homo sapiens
tggctcagtggcagccgcagct

SEQ ID NO: 8059695 - DNA, 22 bp, Homo sapiens
tggctcagtgaagagataactt

SEQ ID NO: 8059696 - DNA, 22 bp, Homo sapiens
tggctcagtctgggttgactga

SEQ ID NO: 8059697 - DNA, 22 bp, Homo sapiens
tggctcagtcatggatgagtaa

SEQ ID NO: 8059698 - DNA, 22 bp, Homo sapiens
tggctcagtctgggttgactga

SEQ ID NO: 8059699 - DNA, 22 bp, Homo sapiens
tggctcagtagcagtgtggtca

SEQ ID NO: 8059700 - DNA, 22 bp, Homo sapiens
tggctcaggtgtgagctgaaga

SEQ ID NO: 8059701 - DNA, 22 bp, Homo sapiens
tggctcagtaatcgagtctcct

SEQ ID NO: 8059702 - DNA, 22 bp, Homo sapiens
tggctcaggggtctggctctgt

SEQ ID NO: 8059703 - DNA, 22 bp, Homo sapiens
tggctcagggtccccaaatggt

SEQ ID NO: 8059704 - DNA, 23 bp, Homo sapiens
tggctcagggtctcttatgaagt

SEQ ID NO: 8059705 - DNA, 22 bp, Homo sapiens
tggctcagctttccccatctgg

SEQ ID NO: 8059706 - DNA, 22 bp, Homo sapiens
tggctcagcttacttttgaggg

SEQ ID NO: 8059707 - DNA, 22 bp, Homo sapiens
tggctcagcaggttagaaacta

SEQ ID NO: 8059708 - DNA, 22 bp, Homo sapiens
tggctcagcaagacattgacct

SEQ ID NO: 8059709 - DNA, 22 bp, Homo sapiens
tggctcagccagccctaggaac

SEQ ID NO: 8059710 - DNA, 22 bp, Homo sapiens
tggctcagcattcactggtctt

SEQ ID NO: 8059711 - DNA, 22 bp, Homo sapiens
tggctcaggagggatctttgct

SEQ ID NO: 8059712 - DNA, 22 bp, Homo sapiens
tggctcaggataattttcccaa

SEQ ID NO: 8059713 - DNA, 22 bp, Homo sapiens
tggctcaggatctaagcagaat

SEQ ID NO: 8059714 - DNA, 22 bp, Homo sapiens
tggctcaggcctacgacgcctt

SEQ ID NO: 8059715 - DNA, 22 bp, Homo sapiens
tggctcaggcttgaaaatagat

SEQ ID NO: 8059716 - DNA, 22 bp, Homo sapiens
tggctcaggccacttcttttat

SEQ ID NO: 8059717 - DNA, 22 bp, Homo sapiens
tgacaggagggttgtggcaggg

SEQ ID NO: 8059718 - DNA, 23 bp, Homo sapiens
tgacaggccagaagagcagctgg

SEQ ID NO: 8059719 - DNA, 22 bp, Homo sapiens
tgacaggacagagaaatgacct

SEQ ID NO: 8059720 - DNA, 22 bp, Homo sapiens
tgacagggcaggcttactggtt

SEQ ID NO: 8059721 - DNA, 22 bp, Homo sapiens
tgacagggctgttctgttttag

SEQ ID NO: 8059722 - DNA, 22 bp, Homo sapiens
tgacagggcttccctttaatca

SEQ ID NO: 8059723 - DNA, 22 bp, Homo sapiens
tgacagggtgtttgtgagacta

SEQ ID NO: 8059724 - DNA, 21 bp, Homo sapiens
tgacaggtatttatctggaaa

SEQ ID NO: 8059725 - DNA, 22 bp, Homo sapiens
tgacaggtcatataagcttgca

SEQ ID NO: 8059726 - DNA, 22 bp, Homo sapiens
tgacaggtgaaatgtccttatt

SEQ ID NO: 8059727 - DNA, 22 bp, Homo sapiens
tgacaggtgattgtgaactaag

SEQ ID NO: 8059728 - DNA, 22 bp, Homo sapiens
tgacaggtgctgggggcagtgt

SEQ ID NO: 8059729 - DNA, 22 bp, Homo sapiens
tgacaggttcgttagtcatgtt

SEQ ID NO: 8059730 - DNA, 19 bp, Homo sapiens
tgacaggttttatgtgttt

SEQ ID NO: 8059731 - DNA, 22 bp, Homo sapiens
tgacaggttgtgtaggtggcca

SEQ ID NO: 8059732 - DNA, 21 bp, Homo sapiens
tgacaggtttaggattaaaat

SEQ ID NO: 8059733 - DNA, 22 bp, Homo sapiens
tgacatgtatgtatttgtttat

SEQ ID NO: 8059734 - DNA, 22 bp, Homo sapiens
tgacatgtatatcttacgctat

SEQ ID NO: 8059735 - DNA, 22 bp, Homo sapiens
tgacagtgacagccaaaggctt

SEQ ID NO: 8059736 - DNA, 22 bp, Homo sapiens
tgacagtgcatgtgacaaagga

SEQ ID NO: 8059737 - DNA, 22 bp, Homo sapiens
tgacatgtaagatggaaaagcg

SEQ ID NO: 8059738 - DNA, 22 bp, Homo sapiens
tgacagtgaatgacaaggttct

SEQ ID NO: 8059739 - DNA, 22 bp, Homo sapiens
tgacacagattagagacatacc

SEQ ID NO: 8059740 - DNA, 22 bp, Homo sapiens
tgacacagggcatgcagcagaa

SEQ ID NO: 8059741 - DNA, 22 bp, Homo sapiens
tgacacagtgggggatcctttt

SEQ ID NO: 8059742 - DNA, 22 bp, Homo sapiens
tgacacagtatcaaacatgatt

SEQ ID NO: 8059743 - DNA, 22 bp, Homo sapiens
tgacacagttgtcgactctaca

SEQ ID NO: 8059744 - DNA, 22 bp, Homo sapiens
tgacagcagcatagtgagcaat

SEQ ID NO: 8059745 - DNA, 23 bp, Homo sapiens
tgacagaccttcccagacagtca

SEQ ID NO: 8059746 - DNA, 22 bp, Homo sapiens
tgacagaccactgcaactctgt

SEQ ID NO: 8059747 - DNA, 17 bp, Homo sapiens
tgacagacatcatgagc

SEQ ID NO: 8059748 - DNA, 22 bp, Homo sapiens
tgacagacatggaagccagagt

SEQ ID NO: 8059749 - DNA, 22 bp, Homo sapiens
tgacagacacaccttaggaaag

SEQ ID NO: 8059750 - DNA, 22 bp, Homo sapiens
tgacagacagcttctcatttta

SEQ ID NO: 8059751 - DNA, 18 bp, Homo sapiens
tgacagaacctggagcct

SEQ ID NO: 8059752 - DNA, 22 bp, Homo sapiens
tgacatttgagagagatataca

SEQ ID NO: 8059753 - DNA, 22 bp, Homo sapiens
tgacatgtgtaatcagctccgt

SEQ ID NO: 8059754 - DNA, 22 bp, Homo sapiens
tgacatgtgtctccttccgtct

SEQ ID NO: 8059755 - DNA, 22 bp, Homo sapiens
tgacatgttagggaaatgtgat

SEQ ID NO: 8059756 - DNA, 22 bp, Homo sapiens
tgacattagagttattgtctca

SEQ ID NO: 8059757 - DNA, 22 bp, Homo sapiens
tgacatgtgctcatcttggcta

SEQ ID NO: 8059758 - DNA, 22 bp, Homo sapiens
tgacatgtggctttgacccagg

SEQ ID NO: 8059759 - DNA, 22 bp, Homo sapiens
tgacatgtatgttgttggcatg

SEQ ID NO: 8059760 - DNA, 22 bp, Homo sapiens
tgacatgtccaggtggtcctgt

SEQ ID NO: 8059761 - DNA, 22 bp, Homo sapiens
tgacatgtcctgagaagatggc

SEQ ID NO: 8059762 - DNA, 22 bp, Homo sapiens
tgactgtctctatggctctaaa

SEQ ID NO: 8059763 - DNA, 22 bp, Homo sapiens
tgactgtgccgtgcccctagga

SEQ ID NO: 8059764 - DNA, 21 bp, Homo sapiens
tgactgaggcttcttcacaca

SEQ ID NO: 8059765 - DNA, 22 bp, Homo sapiens
tgactttaaaataacaagttta

SEQ ID NO: 8059766 - DNA, 22 bp, Homo sapiens
tgaatgaatcctaacaaagaca

SEQ ID NO: 8059767 - DNA, 22 bp, Homo sapiens
tgaatgaatgaattaatagagt

SEQ ID NO: 8059768 - DNA, 21 bp, Homo sapiens
tgaatgcttcgtcatcctggc

SEQ ID NO: 8059769 - DNA, 22 bp, Homo sapiens
tgaatgcttggagtcataaaat

SEQ ID NO: 8059770 - DNA, 22 bp, Homo sapiens
tgaatgctttggagccttctaa

SEQ ID NO: 8059771 - DNA, 22 bp, Homo sapiens
tgaatgtaggtctaatatccca

SEQ ID NO: 8059772 - DNA, 22 bp, Homo sapiens
tgaatggtgattggtgcttctc

SEQ ID NO: 8059773 - DNA, 22 bp, Homo sapiens
tgaatagagcttggcactagaa

SEQ ID NO: 8059774 - DNA, 22 bp, Homo sapiens
tgaatagatggtgacagtatga

SEQ ID NO: 8059775 - DNA, 22 bp, Homo sapiens
tgaattgaattgaattgaattg

SEQ ID NO: 8059776 - DNA, 22 bp, Homo sapiens
tgaattgagataggatcagtct

SEQ ID NO: 8059777 - DNA, 22 bp, Homo sapiens
tgaattccttgcatttttacct

SEQ ID NO: 8059778 - DNA, 22 bp, Homo sapiens
tgaattctgggtcagcagcttg

SEQ ID NO: 8059779 - DNA, 22 bp, Homo sapiens
tgaaggagctgatgtaaggggt

SEQ ID NO: 8059780 - DNA, 21 bp, Homo sapiens
tgaataaagctgctgtcgata

SEQ ID NO: 8059781 - DNA, 22 bp, Homo sapiens
tcttttctagcaaatccaggag

SEQ ID NO: 8059782 - DNA, 22 bp, Homo sapiens
tcttttctgccacagcctgagc

SEQ ID NO: 8059783 - DNA, 22 bp, Homo sapiens
tcttttagagcatttctgattc

SEQ ID NO: 8059784 - DNA, 22 bp, Homo sapiens
tcttttagaaaagttgaatgta

SEQ ID NO: 8059785 - DNA, 22 bp, Homo sapiens
tctttgctgagtacatctccaa

SEQ ID NO: 8059786 - DNA, 22 bp, Homo sapiens
tctttgctcttacacagttagt

SEQ ID NO: 8059787 - DNA, 22 bp, Homo sapiens
tcttttgttgcctacttattaa

SEQ ID NO: 8059788 - DNA, 22 bp, Homo sapiens
tgaaaaaacaagttggcccatt

SEQ ID NO: 8059789 - DNA, 22 bp, Homo sapiens
tgaaaactccaagtttcatcag

SEQ ID NO: 8059790 - DNA, 22 bp, Homo sapiens
tgaaaattgttgtacttgataa

SEQ ID NO: 8059791 - DNA, 22 bp, Homo sapiens
tgaaaatttccatcagttatat

SEQ ID NO: 8059792 - DNA, 22 bp, Homo sapiens
tgaaaattaagcagatgaatga

SEQ ID NO: 8059793 - DNA, 22 bp, Homo sapiens
tgaaaattcatctcatagcaga

SEQ ID NO: 8059794 - DNA, 22 bp, Homo sapiens
tgaaaattctcaggctcacccc

SEQ ID NO: 8059795 - DNA, 22 bp, Homo sapiens
tgaaagaaacaggtatattggg

SEQ ID NO: 8059796 - DNA, 22 bp, Homo sapiens
tgaaagaagtgtcacattgcca

SEQ ID NO: 8059797 - DNA, 22 bp, Homo sapiens
tgaaagaactagcatcttcaag

SEQ ID NO: 8059798 - DNA, 22 bp, Homo sapiens
tgaaatatcattttcatctccc

SEQ ID NO: 8059799 - DNA, 22 bp, Homo sapiens
tgaaataatatctggatcaatc

SEQ ID NO: 8059800 - DNA, 23 bp, Homo sapiens
tgaaatattcttttgcatgagct

SEQ ID NO: 8059801 - DNA, 22 bp, Homo sapiens
tgaaagataagttattatgtac

SEQ ID NO: 8059802 - DNA, 22 bp, Homo sapiens
tgaaagttattactgatgatgt

SEQ ID NO: 8059803 - DNA, 22 bp, Homo sapiens
tgaaatcttcactaagtctctt

SEQ ID NO: 8059804 - DNA, 22 bp, Homo sapiens
tgaaatctgtcccactttagct

SEQ ID NO: 8059805 - DNA, 22 bp, Homo sapiens
tgaacatgctgttgatggcctg

SEQ ID NO: 8059806 - DNA, 22 bp, Homo sapiens
tgaactgcaggaatctcagtgg

SEQ ID NO: 8059807 - DNA, 22 bp, Homo sapiens
tgaacttagtgggaatatctct

SEQ ID NO: 8059808 - DNA, 22 bp, Homo sapiens
tgaagcaaatttttctcagagt

SEQ ID NO: 8059809 - DNA, 19 bp, Homo sapiens
tgaagcaataccatttttg

SEQ ID NO: 8059810 - DNA, 22 bp, Homo sapiens
tgaagcaatgatcttttggtgg

SEQ ID NO: 8059811 - DNA, 22 bp, Homo sapiens
tgaagcaatgatagcagaatga

SEQ ID NO: 8059812 - DNA, 22 bp, Homo sapiens
tgaagcaatagagacaagacca

SEQ ID NO: 8059813 - DNA, 22 bp, Homo sapiens
tgaagactcagaagctaagata

SEQ ID NO: 8059814 - DNA, 22 bp, Homo sapiens
tgaagaataagatagatggagc

SEQ ID NO: 8059815 - DNA, 22 bp, Homo sapiens
tgagggagcacacactgaagtg

SEQ ID NO: 8059816 - DNA, 22 bp, Homo sapiens
tgaggggagaagcagcagcctg

SEQ ID NO: 8059817 - DNA, 22 bp, Homo sapiens
tgaggggaaggcatgataaata

SEQ ID NO: 8059818 - DNA, 22 bp, Homo sapiens
tgaggggagacagagtggactc

SEQ ID NO: 8059819 - DNA, 22 bp, Homo sapiens
tgaggggagacagagtggactc

SEQ ID NO: 8059820 - DNA, 22 bp, Homo sapiens
tgaggggagctagcatgccttg

SEQ ID NO: 8059821 - DNA, 22 bp, Homo sapiens
tgaggggagcccgccctggacg

SEQ ID NO: 8059822 - DNA, 19 bp, Homo sapiens
tgaggggaggagaggcctg

SEQ ID NO: 8059823 - DNA, 22 bp, Homo sapiens
tgaggggatacggtacacattg

SEQ ID NO: 8059824 - DNA, 22 bp, Homo sapiens
tgaggggatacggtacacattg

SEQ ID NO: 8059825 - DNA, 22 bp, Homo sapiens
tgaggggaggttggggcacatc

SEQ ID NO: 8059826 - DNA, 22 bp, Homo sapiens
tgaggcctggagggaggagttt

SEQ ID NO: 8059827 - DNA, 22 bp, Homo sapiens
tgaggtggctagggaggcactc

SEQ ID NO: 8059828 - DNA, 22 bp, Homo sapiens
tgagtaattcacaaaacagatg

SEQ ID NO: 8059829 - DNA, 22 bp, Homo sapiens
tgagtagagaattcagctaagg

SEQ ID NO: 8059830 - DNA, 22 bp, Homo sapiens
tgagggtttccgggcagtggac

SEQ ID NO: 8059831 - DNA, 22 bp, Homo sapiens
tgagggtttttgagcagtgatt

SEQ ID NO: 8059832 - DNA, 22 bp, Homo sapiens
tgagggggttaattaggagagt

SEQ ID NO: 8059833 - DNA, 22 bp, Homo sapiens
tgaggggggtaatcactgggtt

SEQ ID NO: 8059834 - DNA, 19 bp, Homo sapiens
tgaggggctcacagtctca

SEQ ID NO: 8059835 - DNA, 22 bp, Homo sapiens
tgaggggccgcccaagcacttc

SEQ ID NO: 8059836 - DNA, 18 bp, Homo sapiens
tgaggcctctgctgggcc

SEQ ID NO: 8059837 - DNA, 22 bp, Homo sapiens
tgaggcctgaagcctggagcct

SEQ ID NO: 8059838 - DNA, 22 bp, Homo sapiens
tgaggccaatgaccctgggcag

SEQ ID NO: 8059839 - DNA, 22 bp, Homo sapiens
tgaggccacaggaaagggcccg

SEQ ID NO: 8059840 - DNA, 22 bp, Homo sapiens
tgaggccagactgaaaccaaca

SEQ ID NO: 8059841 - DNA, 22 bp, Homo sapiens
tgaggccacagtatcagaacag

SEQ ID NO: 8059842 - DNA, 22 bp, Homo sapiens
tgaggccacttccccacagccc

SEQ ID NO: 8059843 - DNA, 22 bp, Homo sapiens
tgaggccacttccccacagccc

SEQ ID NO: 8059844 - DNA, 22 bp, Homo sapiens
tgaggccacttccccacagccc

SEQ ID NO: 8059845 - DNA, 22 bp, Homo sapiens
tgaggccagccacagccaccct

SEQ ID NO: 8059846 - DNA, 18 bp, Homo sapiens
tgaggccagagtgggcat

SEQ ID NO: 8059847 - DNA, 22 bp, Homo sapiens
tgaggccagcttcagcagtgga

SEQ ID NO: 8059848 - DNA, 22 bp, Homo sapiens
tgaggccagcttcagcagtgga

SEQ ID NO: 8059849 - DNA, 22 bp, Homo sapiens
tgaggccaggacccccagcagg

SEQ ID NO: 8059850 - DNA, 22 bp, Homo sapiens
tgaggccaggacccccagcagg

SEQ ID NO: 8059851 - DNA, 22 bp, Homo sapiens
tgaggccaactagggagatgga

SEQ ID NO: 8059852 - DNA, 22 bp, Homo sapiens
tgaggccaagaaaagctgggtg

SEQ ID NO: 8059853 - DNA, 19 bp, Homo sapiens
tgaggccaaggtcacagat

SEQ ID NO: 8059854 - DNA, 19 bp, Homo sapiens
tgaggccaaggtcacagat

SEQ ID NO: 8059855 - DNA, 22 bp, Homo sapiens
tgagcagggactttgagtgtag

SEQ ID NO: 8059856 - DNA, 22 bp, Homo sapiens
tgagcaggcgcagcaggaggtc

SEQ ID NO: 8059857 - DNA, 22 bp, Homo sapiens
tgagcaggagataaacaggtag

SEQ ID NO: 8059858 - DNA, 22 bp, Homo sapiens
tgagcaagacccggcctctgcc

SEQ ID NO: 8059859 - DNA, 22 bp, Homo sapiens
tgagcaagagaaactgactgta

SEQ ID NO: 8059860 - DNA, 22 bp, Homo sapiens
tgagcacaagtttgcatgtgtg

SEQ ID NO: 8059861 - DNA, 22 bp, Homo sapiens
tgagcacactcctggtgagcga

SEQ ID NO: 8059862 - DNA, 22 bp, Homo sapiens
tgagcacatgccagcccttctc

SEQ ID NO: 8059863 - DNA, 22 bp, Homo sapiens
tgagccaggcactgctcctgga

SEQ ID NO: 8059864 - DNA, 22 bp, Homo sapiens
tgagcagggagctgggctgagc

SEQ ID NO: 8059865 - DNA, 22 bp, Homo sapiens
tgagcagggactttggagtctg

SEQ ID NO: 8059866 - DNA, 23 bp, Homo sapiens
tgagcccagttttccctcttgcc

SEQ ID NO: 8059867 - DNA, 22 bp, Homo sapiens
tgagccctcggctggggcagag

SEQ ID NO: 8059868 - DNA, 22 bp, Homo sapiens
tgagcctggagcccagatgttt

SEQ ID NO: 8059869 - DNA, 22 bp, Homo sapiens
tgagcctgctgtcgctggaccc

SEQ ID NO: 8059870 - DNA, 22 bp, Homo sapiens
tgagcctggagtcgtggagggg

SEQ ID NO: 8059871 - DNA, 22 bp, Homo sapiens
tgagcctggcctgcagagacca

SEQ ID NO: 8059872 - DNA, 22 bp, Homo sapiens
tgagcctggcggaagcagcgtg

SEQ ID NO: 8059873 - DNA, 22 bp, Homo sapiens
tgagcctgcctgcaggtgtgct

SEQ ID NO: 8059874 - DNA, 20 bp, Homo sapiens
tgagcctgctgtaggaggcc

SEQ ID NO: 8059875 - DNA, 23 bp, Homo sapiens
tgagcctgctgatagacacaatt

SEQ ID NO: 8059876 - DNA, 22 bp, Homo sapiens
tgagcctgagttcaaggctgca

SEQ ID NO: 8059877 - DNA, 22 bp, Homo sapiens
tgagcctgcaataagcacagcc

SEQ ID NO: 8059878 - DNA, 22 bp, Homo sapiens
tgagcctgggctttctctggag

SEQ ID NO: 8059879 - DNA, 22 bp, Homo sapiens
tgagcctggggcctgggcagcg

SEQ ID NO: 8059880 - DNA, 22 bp, Homo sapiens
tgagcctgggagatggaggctg

SEQ ID NO: 8059881 - DNA, 22 bp, Homo sapiens
tgagcctggttgcagtgtctgg

SEQ ID NO: 8059882 - DNA, 22 bp, Homo sapiens
tgagcctgtcattattcagaga

SEQ ID NO: 8059883 - DNA, 22 bp, Homo sapiens
tgagctggagtctgtggctcct

SEQ ID NO: 8059884 - DNA, 22 bp, Homo sapiens
tgagctggttcttgaggcatga

SEQ ID NO: 8059885 - DNA, 22 bp, Homo sapiens
tgagaacacattcgtgccctac

SEQ ID NO: 8059886 - DNA, 22 bp, Homo sapiens
tgagaaatggcagcattactgg

SEQ ID NO: 8059887 - DNA, 22 bp, Homo sapiens
tgagaaatgggtctgctgaaga

SEQ ID NO: 8059888 - DNA, 19 bp, Homo sapiens
tgagaaattccacaggatg

SEQ ID NO: 8059889 - DNA, 22 bp, Homo sapiens
tgagaaattacttcagtgatgg

SEQ ID NO: 8059890 - DNA, 21 bp, Homo sapiens
tgagagagtagcaggacatat

SEQ ID NO: 8059891 - DNA, 22 bp, Homo sapiens
tgagatatctgttaattttctt

SEQ ID NO: 8059892 - DNA, 22 bp, Homo sapiens
tgagatggaaggtgaggcagta

SEQ ID NO: 8059893 - DNA, 22 bp, Homo sapiens
tgagatgaataactcctgctaa

SEQ ID NO: 8059894 - DNA, 22 bp, Homo sapiens
tgagatgagggctgcactcaaa

SEQ ID NO: 8059895 - DNA, 22 bp, Homo sapiens
tgccagccaggttctgaggcta

SEQ ID NO: 8059896 - DNA, 22 bp, Homo sapiens
tgccagccagggaagctcaccc

SEQ ID NO: 8059897 - DNA, 22 bp, Homo sapiens
tgccagcccaccttggggcctc

SEQ ID NO: 8059898 - DNA, 22 bp, Homo sapiens
tgccagagatttcacactgcta

SEQ ID NO: 8059899 - DNA, 23 bp, Homo sapiens
tgccagaggcagtcacagtggtg

SEQ ID NO: 8059900 - DNA, 22 bp, Homo sapiens
tgccagcacttctggctgtctg

SEQ ID NO: 8059901 - DNA, 22 bp, Homo sapiens
tgccacagggtcctcaggccag

SEQ ID NO: 8059902 - DNA, 22 bp, Homo sapiens
tgccacaggcaatccctgcacg

SEQ ID NO: 8059903 - DNA, 22 bp, Homo sapiens
tgcattgattgacaggaaagta

SEQ ID NO: 8059904 - DNA, 22 bp, Homo sapiens
tgcattgagtcatttcagtatg

SEQ ID NO: 8059905 - DNA, 22 bp, Homo sapiens
tgcattgagaatttctcaggga

SEQ ID NO: 8059906 - DNA, 22 bp, Homo sapiens
tgcattgaggggctctcttcct

SEQ ID NO: 8059907 - DNA, 22 bp, Homo sapiens
tgcattgatagaaaaacatgga

SEQ ID NO: 8059908 - DNA, 22 bp, Homo sapiens
tgcattgagattttaaaattca

SEQ ID NO: 8059909 - DNA, 22 bp, Homo sapiens
tgcattgttgaatatttcatag

SEQ ID NO: 8059910 - DNA, 22 bp, Homo sapiens
tgcattttcttccaccaatatc

SEQ ID NO: 8059911 - DNA, 22 bp, Homo sapiens
tgcatttcagaagaaaattcgg

SEQ ID NO: 8059912 - DNA, 22 bp, Homo sapiens
tgcatgaacacatgtgcatgta

SEQ ID NO: 8059913 - DNA, 22 bp, Homo sapiens
tgcatgcttcctgtaagtacct

SEQ ID NO: 8059914 - DNA, 22 bp, Homo sapiens
tgcatagggttcaaaggctgta

SEQ ID NO: 8059915 - DNA, 22 bp, Homo sapiens
tgcagtgggccggaggccaggg

SEQ ID NO: 8059916 - DNA, 22 bp, Homo sapiens
tgcagtgggccggaggccaggg

SEQ ID NO: 8059917 - DNA, 22 bp, Homo sapiens
tgcagtggttgagagcccagac

SEQ ID NO: 8059918 - DNA, 22 bp, Homo sapiens
tgcagtggttgagagcccagac

SEQ ID NO: 8059919 - DNA, 22 bp, Homo sapiens
tgcaggtgtctctgtctagcgt

SEQ ID NO: 8059920 - DNA, 23 bp, Homo sapiens
tgcaggtgtgcagagggctcttg

SEQ ID NO: 8059921 - DNA, 22 bp, Homo sapiens
tgcaggtgtctgggggcaacag

SEQ ID NO: 8059922 - DNA, 22 bp, Homo sapiens
tgcaggtgtgggcaggggagca

SEQ ID NO: 8059923 - DNA, 22 bp, Homo sapiens
tgcaggtgtgggcaggggagca

SEQ ID NO: 8059924 - DNA, 20 bp, Homo sapiens
tgcaggtgtgtccaagcact

SEQ ID NO: 8059925 - DNA, 22 bp, Homo sapiens
tgcaggtgtggttcctcagcca

SEQ ID NO: 8059926 - DNA, 20 bp, Homo sapiens
tgcaggtgttggagaaggta

SEQ ID NO: 8059927 - DNA, 22 bp, Homo sapiens
tgcaggtgtgtgcaagggaggg

SEQ ID NO: 8059928 - DNA, 22 bp, Homo sapiens
tgcaggtgtaaattttcaagag

SEQ ID NO: 8059929 - DNA, 22 bp, Homo sapiens
tgcaggtgtagagttgggctcc

SEQ ID NO: 8059930 - DNA, 22 bp, Homo sapiens
tgcaggtgtagagttgggctcc

SEQ ID NO: 8059931 - DNA, 22 bp, Homo sapiens
tgcaggtgtctccagggcaggt

SEQ ID NO: 8059932 - DNA, 20 bp, Homo sapiens
tgcaggtgggcccttctggg

SEQ ID NO: 8059933 - DNA, 20 bp, Homo sapiens
tgcaggtgggcccttctggg

SEQ ID NO: 8059934 - DNA, 22 bp, Homo sapiens
tgcaggtggtacttctttttct

SEQ ID NO: 8059935 - DNA, 22 bp, Homo sapiens
tgcaggtggtccatttgggaac

SEQ ID NO: 8059936 - DNA, 22 bp, Homo sapiens
tgcaggtggtccttcctctgct

SEQ ID NO: 8059937 - DNA, 22 bp, Homo sapiens
tgcaggtggtccttcctctgct

SEQ ID NO: 8059938 - DNA, 22 bp, Homo sapiens
tgcaggtggtttggacactgct

SEQ ID NO: 8059939 - DNA, 22 bp, Homo sapiens
tgcaggtgacaccactcttcct

SEQ ID NO: 8059940 - DNA, 22 bp, Homo sapiens
tgcaggtgagtgcaggggctca

SEQ ID NO: 8059941 - DNA, 22 bp, Homo sapiens
tgcaggtctctgcaaggcctat

SEQ ID NO: 8059942 - DNA, 22 bp, Homo sapiens
tgcaggtgaaaattatgaggat

SEQ ID NO: 8059943 - DNA, 22 bp, Homo sapiens
tgcaggtacttgacaacttggg

SEQ ID NO: 8059944 - DNA, 22 bp, Homo sapiens
tgcaggtaggcctgacttccag

SEQ ID NO: 8059945 - DNA, 23 bp, Homo sapiens
tgcaggtagggcccagcagtctt

SEQ ID NO: 8059946 - DNA, 22 bp, Homo sapiens
tgcaggtggattcaatgtggga

SEQ ID NO: 8059947 - DNA, 22 bp, Homo sapiens
tgcaggtggcagcggggcacca

SEQ ID NO: 8059948 - DNA, 22 bp, Homo sapiens
tgcaggtggctccagggactgc

SEQ ID NO: 8059949 - DNA, 22 bp, Homo sapiens
tgcaggtggccatcttcgttct

SEQ ID NO: 8059950 - DNA, 22 bp, Homo sapiens
tgcaggtggatatctcatcaga

SEQ ID NO: 8059951 - DNA, 22 bp, Homo sapiens
tgcaggtgcagcgatactgtga

SEQ ID NO: 8059952 - DNA, 22 bp, Homo sapiens
tgcaggtgattctgatgcagtt

SEQ ID NO: 8059953 - DNA, 23 bp, Homo sapiens
tgcaggtgattaatccagtttca

SEQ ID NO: 8059954 - DNA, 22 bp, Homo sapiens
tgcagggtagatgcaggctgtg

SEQ ID NO: 8059955 - DNA, 22 bp, Homo sapiens
tgcagggtatccttgtctctgc

SEQ ID NO: 8059956 - DNA, 22 bp, Homo sapiens
tgcaggggcttgtctgggcctg

SEQ ID NO: 8059957 - DNA, 22 bp, Homo sapiens
tgcaggggcttgtctgggcctg

SEQ ID NO: 8059958 - DNA, 22 bp, Homo sapiens
tgcagggcttcctcttggagtt

SEQ ID NO: 8059959 - DNA, 22 bp, Homo sapiens
tgcagggcttcctcttggagtt

SEQ ID NO: 8059960 - DNA, 20 bp, Homo sapiens
tgcagggctgcctcccagct

SEQ ID NO: 8059961 - DNA, 20 bp, Homo sapiens
tgcagggctgcctcccagct

SEQ ID NO: 8059962 - DNA, 20 bp, Homo sapiens
tgcagggctctgcttctctc

SEQ ID NO: 8059963 - DNA, 20 bp, Homo sapiens
tgcagggctctgcttctctc

SEQ ID NO: 8059964 - DNA, 19 bp, Homo sapiens
tgcagggctgcgcctgggg

SEQ ID NO: 8059965 - DNA, 19 bp, Homo sapiens
tgcagggctgcgcctgggg

SEQ ID NO: 8059966 - DNA, 21 bp, Homo sapiens
tgcaggctgtgcgctcctgcc

SEQ ID NO: 8059967 - DNA, 22 bp, Homo sapiens
tgcagggaaaacccaggatgct

SEQ ID NO: 8059968 - DNA, 22 bp, Homo sapiens
tgcagggaacttggacagctag

SEQ ID NO: 8059969 - DNA, 22 bp, Homo sapiens
tgcagggcatctttgaagtgtg

SEQ ID NO: 8059970 - DNA, 22 bp, Homo sapiens
tgcagggccagactgggttgga

SEQ ID NO: 8059971 - DNA, 22 bp, Homo sapiens
tgcagggcatagggtccagttt

SEQ ID NO: 8059972 - DNA, 22 bp, Homo sapiens
tgcagggcatagggtccagttt

SEQ ID NO: 8059973 - DNA, 22 bp, Homo sapiens
tgcagggccatggtggcggctg

SEQ ID NO: 8059974 - DNA, 22 bp, Homo sapiens
tgcagggccatggtggcggctg

SEQ ID NO: 8059975 - DNA, 22 bp, Homo sapiens
tgcagggcccctctgcatgagt

SEQ ID NO: 8059976 - DNA, 22 bp, Homo sapiens
tgcagggcccctctgcatgagt

SEQ ID NO: 8059977 - DNA, 22 bp, Homo sapiens
tgcagggccgctggaggtcatg

SEQ ID NO: 8059978 - DNA, 22 bp, Homo sapiens
tgcagggctcctggctccaatc

SEQ ID NO: 8059979 - DNA, 22 bp, Homo sapiens
tgcagggctcctggctccaatc

SEQ ID NO: 8059980 - DNA, 22 bp, Homo sapiens
tgcagggctataactccattct

SEQ ID NO: 8059981 - DNA, 22 bp, Homo sapiens
tgcagggctataactccattct

SEQ ID NO: 8059982 - DNA, 22 bp, Homo sapiens
tgcagggccgctggaggtcatg

SEQ ID NO: 8059983 - DNA, 22 bp, Homo sapiens
tgcagggcccttggggttgaac

SEQ ID NO: 8059984 - DNA, 22 bp, Homo sapiens
tgcagggccctcattcctgtcc

SEQ ID NO: 8059985 - DNA, 22 bp, Homo sapiens
tgcagggccctcattcctgtcc

SEQ ID NO: 8059986 - DNA, 22 bp, Homo sapiens
tgcagggcagtggaggttgagt

SEQ ID NO: 8059987 - DNA, 22 bp, Homo sapiens
tgcagggcagtttgtttcggca

SEQ ID NO: 8059988 - DNA, 22 bp, Homo sapiens
tgcagggcagctagggagcttt

SEQ ID NO: 8059989 - DNA, 22 bp, Homo sapiens
tgcagggcacggtgcgcgtggg

SEQ ID NO: 8059990 - DNA, 22 bp, Homo sapiens
tgcagggcacggtgcgcgtggg

SEQ ID NO: 8059991 - DNA, 22 bp, Homo sapiens
tgcagggcagatatgactgtag

SEQ ID NO: 8059992 - DNA, 22 bp, Homo sapiens
tgcagggcagatatgactgtag

SEQ ID NO: 8059993 - DNA, 23 bp, Homo sapiens
tgcagggcaagttagagacccca

SEQ ID NO: 8059994 - DNA, 22 bp, Homo sapiens
tgcagggcacacgcacgggtgt

SEQ ID NO: 8059995 - DNA, 22 bp, Homo sapiens
tgcagggcacacgcacgggtgt

SEQ ID NO: 8059996 - DNA, 22 bp, Homo sapiens
tgcagggattgttggcatccat

SEQ ID NO: 8059997 - DNA, 22 bp, Homo sapiens
tgccgtggggctgaggctggag

SEQ ID NO: 8059998 - DNA, 22 bp, Homo sapiens
tgccctgggaacacagatgcca

SEQ ID NO: 8059999 - DNA, 22 bp, Homo sapiens
tgcccttgggtaacttgctgat

SEQ ID NO: 8060000 - DNA, 22 bp, Homo sapiens
tgccctggagtcagtggctatt

SEQ ID NO: 8060001 - DNA, 22 bp, Homo sapiens
tgccctggaggggcttacagtc

SEQ ID NO: 8060002 - DNA, 22 bp, Homo sapiens
tgccctgctgtggctctgccca

SEQ ID NO: 8060003 - DNA, 22 bp, Homo sapiens
tgccctggaaatgagaggtgtg

SEQ ID NO: 8060004 - DNA, 22 bp, Homo sapiens
tgccctggaaccatctacagtc

SEQ ID NO: 8060005 - DNA, 22 bp, Homo sapiens
tgccctggcacacacacagctg

SEQ ID NO: 8060006 - DNA, 22 bp, Homo sapiens
tgccctggatgctgcaggtgtg

SEQ ID NO: 8060007 - DNA, 22 bp, Homo sapiens
tgccctgcctgagagacagtaa

SEQ ID NO: 8060008 - DNA, 22 bp, Homo sapiens
tgccctgctgtgcctggagcca

SEQ ID NO: 8060009 - DNA, 22 bp, Homo sapiens
tgccctgccaagactcagtggt

SEQ ID NO: 8060010 - DNA, 22 bp, Homo sapiens
tgccctgccaagactgagtggt

SEQ ID NO: 8060011 - DNA, 22 bp, Homo sapiens
tgccctgcccatctaccctgtc

SEQ ID NO: 8060012 - DNA, 19 bp, Homo sapiens
tgccctgcccgcagccttg

SEQ ID NO: 8060013 - DNA, 22 bp, Homo sapiens
tgccctgcagaccctgcagtgt

SEQ ID NO: 8060014 - DNA, 22 bp, Homo sapiens
tgcccgctgctgctcagtctgt

SEQ ID NO: 8060015 - DNA, 22 bp, Homo sapiens
tgcctcagctgaggccgctcca

SEQ ID NO: 8060016 - DNA, 22 bp, Homo sapiens
tgcctcaggcacctggcaggtt

SEQ ID NO: 8060017 - DNA, 19 bp, Homo sapiens
tgcctcagggctttgagga

SEQ ID NO: 8060018 - DNA, 22 bp, Homo sapiens
tgcctcagtctaaagtctctca

SEQ ID NO: 8060019 - DNA, 22 bp, Homo sapiens
tgcctctgaggaagattgtgtt

SEQ ID NO: 8060020 - DNA, 22 bp, Homo sapiens
tgcctctgctgctgtggcatca

SEQ ID NO: 8060021 - DNA, 22 bp, Homo sapiens
tgcctccctggcaagtctctcc

SEQ ID NO: 8060022 - DNA, 22 bp, Homo sapiens
tgcctgagtgatgtggcagcca

SEQ ID NO: 8060023 - DNA, 22 bp, Homo sapiens
tgcctgaagaaaacttgcagca

SEQ ID NO: 8060024 - DNA, 22 bp, Homo sapiens
tgcctgaaataccatcatgagt

SEQ ID NO: 8060025 - DNA, 22 bp, Homo sapiens
tgcctctggttatctggtacct

SEQ ID NO: 8060026 - DNA, 22 bp, Homo sapiens
tgcctctgtgggccttcctggc

SEQ ID NO: 8060027 - DNA, 22 bp, Homo sapiens
tgcctctgtgggcagagctgcc

SEQ ID NO: 8060028 - DNA, 22 bp, Homo sapiens
tgcctctgtgggcagagctgcc

SEQ ID NO: 8060029 - DNA, 22 bp, Homo sapiens
tgcctctgtgggccttcctggc

SEQ ID NO: 8060030 - DNA, 20 bp, Homo sapiens
tgcctgcccaggtcctgcac

SEQ ID NO: 8060031 - DNA, 22 bp, Homo sapiens
tgcctggagaaggcaccatctg

SEQ ID NO: 8060032 - DNA, 23 bp, Homo sapiens
tgcctggagaagcatgaaatgta

SEQ ID NO: 8060033 - DNA, 23 bp, Homo sapiens
tgcctggagaagcatgaaatgta

SEQ ID NO: 8060034 - DNA, 22 bp, Homo sapiens
tgcctggaccccacctccggaa

SEQ ID NO: 8060035 - DNA, 22 bp, Homo sapiens
tgcctggaccccacctccggaa

SEQ ID NO: 8060036 - DNA, 19 bp, Homo sapiens
tgcctggacaaatgtgggg

SEQ ID NO: 8060037 - DNA, 22 bp, Homo sapiens
tgcctggaaggcccatgggaag

SEQ ID NO: 8060038 - DNA, 19 bp, Homo sapiens
tgcctggacaaatgtgggg

SEQ ID NO: 8060039 - DNA, 18 bp, Homo sapiens
tgcctggaaggaacagga

SEQ ID NO: 8060040 - DNA, 18 bp, Homo sapiens
tgcctggaaggaacagga

SEQ ID NO: 8060041 - DNA, 22 bp, Homo sapiens
tgcctggaaggcccatgggaag

SEQ ID NO: 8060042 - DNA, 22 bp, Homo sapiens
tgcctggcaccccagtctgcac

SEQ ID NO: 8060043 - DNA, 22 bp, Homo sapiens
tgcctggcatgttatagacaca

SEQ ID NO: 8060044 - DNA, 22 bp, Homo sapiens
tgcctggcatctagccctggga

SEQ ID NO: 8060045 - DNA, 22 bp, Homo sapiens
tgcctggattcggttgttgtca

SEQ ID NO: 8060046 - DNA, 22 bp, Homo sapiens
tgcctggattcaaagctcatgt

SEQ ID NO: 8060047 - DNA, 22 bp, Homo sapiens
tgcctggattcaaagctcatgt

SEQ ID NO: 8060048 - DNA, 22 bp, Homo sapiens
tgcctggattcggttgttgtca

SEQ ID NO: 8060049 - DNA, 22 bp, Homo sapiens
tgcctggatggctctgagcagg

SEQ ID NO: 8060050 - DNA, 22 bp, Homo sapiens
tgcctggatggctctgagcagg

SEQ ID NO: 8060051 - DNA, 22 bp, Homo sapiens
tgcctggatctgaggacccatt

SEQ ID NO: 8060052 - DNA, 22 bp, Homo sapiens
tgcctggattcaaagctcatgt

SEQ ID NO: 8060053 - DNA, 22 bp, Homo sapiens
tgcctggatgtgctggcctcac

SEQ ID NO: 8060054 - DNA, 22 bp, Homo sapiens
tgcctggatgtgctggcctcac

SEQ ID NO: 8060055 - DNA, 22 bp, Homo sapiens
tgcctggatctgaggacccatt

SEQ ID NO: 8060056 - DNA, 22 bp, Homo sapiens
tgcctggatactcattaatttc

SEQ ID NO: 8060057 - DNA, 22 bp, Homo sapiens
tgcctggagtccccaagtccat

SEQ ID NO: 8060058 - DNA, 22 bp, Homo sapiens
tgcctggagtgtgttcaggatt

SEQ ID NO: 8060059 - DNA, 22 bp, Homo sapiens
tgcctggagtccccaagtccat

SEQ ID NO: 8060060 - DNA, 19 bp, Homo sapiens
tgcctggagcataacaggc

SEQ ID NO: 8060061 - DNA, 19 bp, Homo sapiens
tgcctggagcataacaggc

SEQ ID NO: 8060062 - DNA, 22 bp, Homo sapiens
tgcctggagaaggcaccatctg

SEQ ID NO: 8060063 - DNA, 22 bp, Homo sapiens
tgcccaggtttgagtgcccaag

SEQ ID NO: 8060064 - DNA, 22 bp, Homo sapiens
tgccccaggtgctgaggttgga

SEQ ID NO: 8060065 - DNA, 22 bp, Homo sapiens
tgcccctcgacgcaatgaaggg

SEQ ID NO: 8060066 - DNA, 22 bp, Homo sapiens
tgcccctcagggaacgggtatc

SEQ ID NO: 8060067 - DNA, 22 bp, Homo sapiens
tgcccagggataagcctagaga

SEQ ID NO: 8060068 - DNA, 22 bp, Homo sapiens
tgcccagggataagcctagaga

SEQ ID NO: 8060069 - DNA, 22 bp, Homo sapiens
tgcccagggtggagtgcagcgg

SEQ ID NO: 8060070 - DNA, 22 bp, Homo sapiens
tgcccagggtggagtgcagcgg

SEQ ID NO: 8060071 - DNA, 22 bp, Homo sapiens
tgcccaggctggagtgcagagg

SEQ ID NO: 8060072 - DNA, 22 bp, Homo sapiens
tgcccaggcttcaccctcagag

SEQ ID NO: 8060073 - DNA, 22 bp, Homo sapiens
tgcccaggctcctcgcagcctt

SEQ ID NO: 8060074 - DNA, 22 bp, Homo sapiens
tgcccaggctcctcgcagcctt

SEQ ID NO: 8060075 - DNA, 22 bp, Homo sapiens
tgcccaggctggagtacagtgg

SEQ ID NO: 8060076 - DNA, 22 bp, Homo sapiens
tgcccaggctggaatgcagtgg

SEQ ID NO: 8060077 - DNA, 22 bp, Homo sapiens
tgcccaggattgtgaggtcagg

SEQ ID NO: 8060078 - DNA, 22 bp, Homo sapiens
tgcccagcagggagctacctgg

SEQ ID NO: 8060079 - DNA, 22 bp, Homo sapiens
tgcccagcactgtgccagtcac

SEQ ID NO: 8060080 - DNA, 22 bp, Homo sapiens
tgcccagcacccagcatgatgc

SEQ ID NO: 8060081 - DNA, 22 bp, Homo sapiens
tgcccagcaataaaccagaaga

SEQ ID NO: 8060082 - DNA, 22 bp, Homo sapiens
tgcccacatggtgccatggcca

SEQ ID NO: 8060083 - DNA, 20 bp, Homo sapiens
tgcccagcaagagtgcagtt

SEQ ID NO: 8060084 - DNA, 17 bp, Homo sapiens
tgccagcctgtcccagg

SEQ ID NO: 8060085 - DNA, 19 bp, Homo sapiens
tgccagctcacaggagctc

SEQ ID NO: 8060086 - DNA, 22 bp, Homo sapiens
tgccagcctggcctgagtcttt

SEQ ID NO: 8060087 - DNA, 18 bp, Homo sapiens
tgccagccgactggcctg

SEQ ID NO: 8060088 - DNA, 22 bp, Homo sapiens
tgccaggcaactgcccagccat

SEQ ID NO: 8060089 - DNA, 20 bp, Homo sapiens
tgccaggcacggagtgcatg

SEQ ID NO: 8060090 - DNA, 22 bp, Homo sapiens
tgccagctcccttttctcctcc

SEQ ID NO: 8060091 - DNA, 22 bp, Homo sapiens
tgccaggcacgtgagagtggcc

SEQ ID NO: 8060092 - DNA, 22 bp, Homo sapiens
tgccaggcaggaccctagaacc

SEQ ID NO: 8060093 - DNA, 22 bp, Homo sapiens
tgccaggcatgtagtagacttg

SEQ ID NO: 8060094 - DNA, 22 bp, Homo sapiens
tgccaggcatatggcctctttg

SEQ ID NO: 8060095 - DNA, 22 bp, Homo sapiens
tgccaggcagtgtcagattgag

SEQ ID NO: 8060096 - DNA, 22 bp, Homo sapiens
tgccaggccctcccacagatta

SEQ ID NO: 8060097 - DNA, 22 bp, Homo sapiens
tgccaggccctgcggggtccca

SEQ ID NO: 8060098 - DNA, 22 bp, Homo sapiens
tgccaggctcagcccctatctt

SEQ ID NO: 8060099 - DNA, 22 bp, Homo sapiens
tgccaggctcaggatgtccctg

SEQ ID NO: 8060100 - DNA, 22 bp, Homo sapiens
tgccaggcatttgacagacact

SEQ ID NO: 8060101 - DNA, 22 bp, Homo sapiens
tgccaggccaatgaaggcaggg

SEQ ID NO: 8060102 - DNA, 22 bp, Homo sapiens
tgccaggcccagcagggcggcc

SEQ ID NO: 8060103 - DNA, 22 bp, Homo sapiens
tgccaggccacgtagcttcaag

SEQ ID NO: 8060104 - DNA, 22 bp, Homo sapiens
tgccaggcccagcagggcggcc

SEQ ID NO: 8060105 - DNA, 22 bp, Homo sapiens
tgccaggcccagctccagagct

SEQ ID NO: 8060106 - DNA, 22 bp, Homo sapiens
tgccaggctgtcctgggcctgg

SEQ ID NO: 8060107 - DNA, 22 bp, Homo sapiens
tgccaggctgccctccagtctg

SEQ ID NO: 8060108 - DNA, 22 bp, Homo sapiens
tgccaggctgaacagggtctta

SEQ ID NO: 8060109 - DNA, 20 bp, Homo sapiens
tgccaggctgcacgcctgcc

SEQ ID NO: 8060110 - DNA, 22 bp, Homo sapiens
tgccaggctccggaacgacagt

SEQ ID NO: 8060111 - DNA, 22 bp, Homo sapiens
tgccaggctcaggatgtccctg

SEQ ID NO: 8060112 - DNA, 20 bp, Homo sapiens
tgccagggccagcagaggct

SEQ ID NO: 8060113 - DNA, 22 bp, Homo sapiens
tgccaggcttagagcaggggct

SEQ ID NO: 8060114 - DNA, 22 bp, Homo sapiens
tgccaggcttagagcaggggct

SEQ ID NO: 8060115 - DNA, 22 bp, Homo sapiens
tgccaggctttggtcaaaggct

SEQ ID NO: 8060116 - DNA, 22 bp, Homo sapiens
tgccagggagccctgctgacca

SEQ ID NO: 8060117 - DNA, 22 bp, Homo sapiens
tgccagggtcagctgcagctct

SEQ ID NO: 8060118 - DNA, 22 bp, Homo sapiens
tgccagggtgtcaggagagcta

SEQ ID NO: 8060119 - DNA, 22 bp, Homo sapiens
tgccagggccatagggagtcta

SEQ ID NO: 8060120 - DNA, 23 bp, Homo sapiens
tgccagggccctgtgtgcaatgc

SEQ ID NO: 8060121 - DNA, 22 bp, Homo sapiens
tgccaggtacacaagtagccag

SEQ ID NO: 8060122 - DNA, 22 bp, Homo sapiens
tgcagacctcccatggctgcct

SEQ ID NO: 8060123 - DNA, 22 bp, Homo sapiens
tgcagagaaaactcctgggtac

SEQ ID NO: 8060124 - DNA, 22 bp, Homo sapiens
tgcagagcagcaactgcgtgcg

SEQ ID NO: 8060125 - DNA, 22 bp, Homo sapiens
tgcagagcagcaactgcgtgcg

SEQ ID NO: 8060126 - DNA, 20 bp, Homo sapiens
tgcagagctggctggctcct

SEQ ID NO: 8060127 - DNA, 22 bp, Homo sapiens
tgcagcagaagtgttcttctct

SEQ ID NO: 8060128 - DNA, 22 bp, Homo sapiens
tgcagcagaatatggctgcagg

SEQ ID NO: 8060129 - DNA, 21 bp, Homo sapiens
tgcagcagaagtctctgtgtc

SEQ ID NO: 8060130 - DNA, 20 bp, Homo sapiens
tgcagcagaagcccatgctc

SEQ ID NO: 8060131 - DNA, 22 bp, Homo sapiens
tgcaggcaccattctgcctctc

SEQ ID NO: 8060132 - DNA, 21 bp, Homo sapiens
tgcaggattccaggtcagtat

SEQ ID NO: 8060133 - DNA, 22 bp, Homo sapiens
tgcaggcagctgaaaggtgcct

SEQ ID NO: 8060134 - DNA, 22 bp, Homo sapiens
tgcaggcctggactgatgtggt

SEQ ID NO: 8060135 - DNA, 21 bp, Homo sapiens
tgcaggctacttctgactcta

SEQ ID NO: 8060136 - DNA, 22 bp, Homo sapiens
tgcaggagctgctgtcctgctc

SEQ ID NO: 8060137 - DNA, 22 bp, Homo sapiens
tgcaggagcttggctctgtccc

SEQ ID NO: 8060138 - DNA, 21 bp, Homo sapiens
tgcaggaagtatggtgcctat

SEQ ID NO: 8060139 - DNA, 22 bp, Homo sapiens
tgcagctgtgaaagggaaccaa

SEQ ID NO: 8060140 - DNA, 22 bp, Homo sapiens
tgcagctgtaacagaggcctca

SEQ ID NO: 8060141 - DNA, 22 bp, Homo sapiens
tgcagctttgctctggtcccca

SEQ ID NO: 8060142 - DNA, 22 bp, Homo sapiens
tgcagctttaagctttcatcag

SEQ ID NO: 8060143 - DNA, 20 bp, Homo sapiens
tgcagcttctcatcttcaaa

SEQ ID NO: 8060144 - DNA, 22 bp, Homo sapiens
tgcagcttccacatccacactc

SEQ ID NO: 8060145 - DNA, 22 bp, Homo sapiens
tgcagcttaaatcagggtttct

SEQ ID NO: 8060146 - DNA, 20 bp, Homo sapiens
tgcagcttcacctgtgtcat

SEQ ID NO: 8060147 - DNA, 22 bp, Homo sapiens
tgcagcttcaaagaacctttcc

SEQ ID NO: 8060148 - DNA, 22 bp, Homo sapiens
tgcagctgggtctgccctggct

SEQ ID NO: 8060149 - DNA, 22 bp, Homo sapiens
tgcagctggtttagaactagat

SEQ ID NO: 8060150 - DNA, 22 bp, Homo sapiens
tgcagctgaggccagctatgcc

SEQ ID NO: 8060151 - DNA, 22 bp, Homo sapiens
tgcagctgaccagcaagtcctg

SEQ ID NO: 8060152 - DNA, 22 bp, Homo sapiens
tgcagctgaacctagagtctgt

SEQ ID NO: 8060153 - DNA, 22 bp, Homo sapiens
tgcagccattttctgccaatgc

SEQ ID NO: 8060154 - DNA, 22 bp, Homo sapiens
tgcagccatctttcttggagga

SEQ ID NO: 8060155 - DNA, 23 bp, Homo sapiens
tgcagcagggtggtctacttctc

SEQ ID NO: 8060156 - DNA, 22 bp, Homo sapiens
tgcagcaggtatggcaagctcc

SEQ ID NO: 8060157 - DNA, 22 bp, Homo sapiens
tgcagcagacataatgtggatt

SEQ ID NO: 8060158 - DNA, 22 bp, Homo sapiens
tgcagcagactgagtatgagaa

SEQ ID NO: 8060159 - DNA, 21 bp, Homo sapiens
tgcagcagagtaagcagggga

SEQ ID NO: 8060160 - DNA, 21 bp, Homo sapiens
tgcagcagatttgggggaaga

SEQ ID NO: 8060161 - DNA, 21 bp, Homo sapiens
tgcagcagatttgggggaaga

SEQ ID NO: 8060162 - DNA, 22 bp, Homo sapiens
tgcagcagcagggaggaggctc

SEQ ID NO: 8060163 - DNA, 22 bp, Homo sapiens
tgcagcagagtgggcctgggtg

SEQ ID NO: 8060164 - DNA, 22 bp, Homo sapiens
tgcagcagccaaggttctgtgc

SEQ ID NO: 8060165 - DNA, 22 bp, Homo sapiens
tgcagcagcctcatctggtttc

SEQ ID NO: 8060166 - DNA, 22 bp, Homo sapiens
tgcagcagctccaggttaccct

SEQ ID NO: 8060167 - DNA, 22 bp, Homo sapiens
tgcagcaggagccaggcctggt

SEQ ID NO: 8060168 - DNA, 22 bp, Homo sapiens
tgcagcaggcacaggacggaag

SEQ ID NO: 8060169 - DNA, 22 bp, Homo sapiens
tgcagcagggacctctatgtga

SEQ ID NO: 8060170 - DNA, 22 bp, Homo sapiens
tgcagcagggcccaggcacaga

SEQ ID NO: 8060171 - DNA, 22 bp, Homo sapiens
tgatatcagctggcagcagtgg

SEQ ID NO: 8060172 - DNA, 22 bp, Homo sapiens
tgatatttaagcaaaaatatgg

SEQ ID NO: 8060173 - DNA, 22 bp, Homo sapiens
tgagtggagaacagaggctctc

SEQ ID NO: 8060174 - DNA, 22 bp, Homo sapiens
tgagtggacacctgcttcttta

SEQ ID NO: 8060175 - DNA, 22 bp, Homo sapiens
tgatgaataaacttgagagtca

SEQ ID NO: 8060176 - DNA, 17 bp, Homo sapiens
tgatgcaaagtcagctg

SEQ ID NO: 8060177 - DNA, 18 bp, Homo sapiens
tgatgcaagagtgagcta

SEQ ID NO: 8060178 - DNA, 22 bp, Homo sapiens
tgatgcaatagagagatagata

SEQ ID NO: 8060179 - DNA, 22 bp, Homo sapiens
tgatgtcctcatgtcaagctcc

SEQ ID NO: 8060180 - DNA, 22 bp, Homo sapiens
tgattcatcagaataggagttt

SEQ ID NO: 8060181 - DNA, 22 bp, Homo sapiens
tgcaaattctttactctgtgat

SEQ ID NO: 8060182 - DNA, 22 bp, Homo sapiens
tgcaaacaggcatttcacaaac

SEQ ID NO: 8060183 - DNA, 22 bp, Homo sapiens
tgcaaacagaaagtttattgtg

SEQ ID NO: 8060184 - DNA, 22 bp, Homo sapiens
tgcaaactgggatactattcaa

SEQ ID NO: 8060185 - DNA, 22 bp, Homo sapiens
tgcaaactgggacactattcaa

SEQ ID NO: 8060186 - DNA, 22 bp, Homo sapiens
tgatttttggatctgagctgca

SEQ ID NO: 8060187 - DNA, 22 bp, Homo sapiens
tgatttttagctattctgaaga

SEQ ID NO: 8060188 - DNA, 22 bp, Homo sapiens
tgatttttaaaattctccttgc

SEQ ID NO: 8060189 - DNA, 22 bp, Homo sapiens
tgcaatgaatatggtacattaa

SEQ ID NO: 8060190 - DNA, 17 bp, Homo sapiens
tgcaagaagattaggaa

SEQ ID NO: 8060191 - DNA, 22 bp, Homo sapiens
tgcaagaaaggtggggccaggc

SEQ ID NO: 8060192 - DNA, 22 bp, Homo sapiens
tgcaacctgacccagccagccc

SEQ ID NO: 8060193 - DNA, 21 bp, Homo sapiens
tgcaagaatcaggaagctgcc

SEQ ID NO: 8060194 - DNA, 22 bp, Homo sapiens
tgcaagatattatctttgctgc

SEQ ID NO: 8060195 - DNA, 19 bp, Homo sapiens
tgcaagggtggtctcctgg

SEQ ID NO: 8060196 - DNA, 20 bp, Homo sapiens
tcctggcaagccgtacctcc

SEQ ID NO: 8060197 - DNA, 22 bp, Homo sapiens
tcctggcacaaccctttaccag

SEQ ID NO: 8060198 - DNA, 22 bp, Homo sapiens
tcctggagtttgtggtgatatg

SEQ ID NO: 8060199 - DNA, 22 bp, Homo sapiens
tcctggagtttgtaaggtgagc

SEQ ID NO: 8060200 - DNA, 22 bp, Homo sapiens
tcctggagttgtgcagtgcaca

SEQ ID NO: 8060201 - DNA, 20 bp, Homo sapiens
tcctggagtctggtttggct

SEQ ID NO: 8060202 - DNA, 22 bp, Homo sapiens
tcctggagtatttctgtggtgt

SEQ ID NO: 8060203 - DNA, 22 bp, Homo sapiens
tcctggagttgtctgtactcat

SEQ ID NO: 8060204 - DNA, 22 bp, Homo sapiens
tcctggagtggagtctgttgtt

SEQ ID NO: 8060205 - DNA, 22 bp, Homo sapiens
tcctggagtgtcttccccaagg

SEQ ID NO: 8060206 - DNA, 22 bp, Homo sapiens
tcctggcatttacaaacccacc

SEQ ID NO: 8060207 - DNA, 22 bp, Homo sapiens
tcctggagaagaggggcttgga

SEQ ID NO: 8060208 - DNA, 22 bp, Homo sapiens
tcctggagaactgattcgcggg

SEQ ID NO: 8060209 - DNA, 23 bp, Homo sapiens
tcctggagaaaagaaacatttct

SEQ ID NO: 8060210 - DNA, 22 bp, Homo sapiens
tcctggagaaactcagagatct

SEQ ID NO: 8060211 - DNA, 22 bp, Homo sapiens
tcctggagataattgcagtgaa

SEQ ID NO: 8060212 - DNA, 22 bp, Homo sapiens
tcctggagataattgcagtgaa

SEQ ID NO: 8060213 - DNA, 22 bp, Homo sapiens
tcctggagagtgggcgagcaca

SEQ ID NO: 8060214 - DNA, 22 bp, Homo sapiens
tcctggagagaggcctggaaga

SEQ ID NO: 8060215 - DNA, 22 bp, Homo sapiens
tcctggagagaggcctggaaga

SEQ ID NO: 8060216 - DNA, 22 bp, Homo sapiens
tcctggagaatggacaatgcac

SEQ ID NO: 8060217 - DNA, 22 bp, Homo sapiens
tcctggagaatcctgccacctg

SEQ ID NO: 8060218 - DNA, 20 bp, Homo sapiens
tcctggagtattccatgctt

SEQ ID NO: 8060219 - DNA, 20 bp, Homo sapiens
tcctggagtattccatgctt

SEQ ID NO: 8060220 - DNA, 22 bp, Homo sapiens
tcctggagtaggccttagccat

SEQ ID NO: 8060221 - DNA, 22 bp, Homo sapiens
tcctggagtaggccttagccat

SEQ ID NO: 8060222 - DNA, 22 bp, Homo sapiens
tcctggagggctcacaggcggc

SEQ ID NO: 8060223 - DNA, 22 bp, Homo sapiens
tcctggagggctcacaggcggc

SEQ ID NO: 8060224 - DNA, 22 bp, Homo sapiens
tcctggaggggacagcatgggc

SEQ ID NO: 8060225 - DNA, 22 bp, Homo sapiens
tcctggaggcaaatgagcacat

SEQ ID NO: 8060226 - DNA, 22 bp, Homo sapiens
tcctggaggcaaatgaagactc

SEQ ID NO: 8060227 - DNA, 22 bp, Homo sapiens
tcctggagccaatgtgctgctg

SEQ ID NO: 8060228 - DNA, 22 bp, Homo sapiens
tcctggaggcactcgctggggc

SEQ ID NO: 8060229 - DNA, 22 bp, Homo sapiens
tcctggagggaggcggtgctac

SEQ ID NO: 8060230 - DNA, 22 bp, Homo sapiens
tcctggagggaggcggtgctac

SEQ ID NO: 8060231 - DNA, 20 bp, Homo sapiens
tcctggaggcttcatccata

SEQ ID NO: 8060232 - DNA, 22 bp, Homo sapiens
taagaacagtagaacagtaggt

SEQ ID NO: 8060233 - DNA, 22 bp, Homo sapiens
tcctgggcacaagtgagtctcc

SEQ ID NO: 8060234 - DNA, 22 bp, Homo sapiens
tcctgggaactcggaaagctct

SEQ ID NO: 8060235 - DNA, 18 bp, Homo sapiens
tcctgtggcccagagttt

SEQ ID NO: 8060236 - DNA, 17 bp, Homo sapiens
tcctgtgggtgcagcag

SEQ ID NO: 8060237 - DNA, 21 bp, Homo sapiens
tcctgtaagcttgggtggctc

SEQ ID NO: 8060238 - DNA, 22 bp, Homo sapiens
tcctggtgtcctggtctgctag

SEQ ID NO: 8060239 - DNA, 22 bp, Homo sapiens
tcctggtgtcgcctggtcagtt

SEQ ID NO: 8060240 - DNA, 22 bp, Homo sapiens
tcctggtgtttatgtcacatag

SEQ ID NO: 8060241 - DNA, 22 bp, Homo sapiens
tcctggtgttactaaattgaaa

SEQ ID NO: 8060242 - DNA, 22 bp, Homo sapiens
tcctggtggtgccggtgcccgg

SEQ ID NO: 8060243 - DNA, 22 bp, Homo sapiens
tcctggtggtgccagctgcagg

SEQ ID NO: 8060244 - DNA, 22 bp, Homo sapiens
tcctggtggtttgaaaactgaa

SEQ ID NO: 8060245 - DNA, 22 bp, Homo sapiens
tcctggtgtaatggtaagcatg

SEQ ID NO: 8060246 - DNA, 22 bp, Homo sapiens
tcctggtggtctgtgcttcttc

SEQ ID NO: 8060247 - DNA, 22 bp, Homo sapiens
tcctggtgggacagaaaacctc

SEQ ID NO: 8060248 - DNA, 22 bp, Homo sapiens
tcctggtggctttccctgcctt

SEQ ID NO: 8060249 - DNA, 22 bp, Homo sapiens
tcctggggctgcaaggcctgtc

SEQ ID NO: 8060250 - DNA, 22 bp, Homo sapiens
tcctggggccagcactggtgga

SEQ ID NO: 8060251 - DNA, 22 bp, Homo sapiens
tcctggtggctctttgggaagg

SEQ ID NO: 8060252 - DNA, 22 bp, Homo sapiens
tcctggtggcagattttaggtc

SEQ ID NO: 8060253 - DNA, 22 bp, Homo sapiens
tcgcaccattgcactccagcca

SEQ ID NO: 8060254 - DNA, 22 bp, Homo sapiens
tccttggctagtactggccagc

SEQ ID NO: 8060255 - DNA, 22 bp, Homo sapiens
tctaaagacactttttacaggg

SEQ ID NO: 8060256 - DNA, 22 bp, Homo sapiens
tccttacatagtgctgaaatat

SEQ ID NO: 8060257 - DNA, 23 bp, Homo sapiens
tccttcaggctcttcccctggac

SEQ ID NO: 8060258 - DNA, 22 bp, Homo sapiens
tccttcagggggccgcctgcac

SEQ ID NO: 8060259 - DNA, 22 bp, Homo sapiens
tccttcagcttgttagagtgac

SEQ ID NO: 8060260 - DNA, 22 bp, Homo sapiens
tccttcagctgctaggaaatga

SEQ ID NO: 8060261 - DNA, 22 bp, Homo sapiens
tccttcagaggataaggaagaa

SEQ ID NO: 8060262 - DNA, 20 bp, Homo sapiens
tccttcagacgacaagcaag

SEQ ID NO: 8060263 - DNA, 23 bp, Homo sapiens
tccttcagagcctccctccaagc

SEQ ID NO: 8060264 - DNA, 22 bp, Homo sapiens
tccttctacactgcctctgaga

SEQ ID NO: 8060265 - DNA, 22 bp, Homo sapiens
tccttccttcctgaaattttag

SEQ ID NO: 8060266 - DNA, 19 bp, Homo sapiens
tccttcagtcagatctggg

SEQ ID NO: 8060267 - DNA, 22 bp, Homo sapiens
tccttcctggggtctctgctgc

SEQ ID NO: 8060268 - DNA, 21 bp, Homo sapiens
tccttgctattttcctcagct

SEQ ID NO: 8060269 - DNA, 22 bp, Homo sapiens
tctaccattgcttttcctccag

SEQ ID NO: 8060270 - DNA, 22 bp, Homo sapiens
tctactctactgtctgtgccta

SEQ ID NO: 8060271 - DNA, 22 bp, Homo sapiens
tctagaaacaggtttctagaaa

SEQ ID NO: 8060272 - DNA, 23 bp, Homo sapiens
tctagaaaatgaaagaatgcagt

SEQ ID NO: 8060273 - DNA, 22 bp, Homo sapiens
tctagctctgcttatcatggct

SEQ ID NO: 8060274 - DNA, 22 bp, Homo sapiens
tctaacttagggaatactttag

SEQ ID NO: 8060275 - DNA, 22 bp, Homo sapiens
tctacaaagaagaattaatgtc

SEQ ID NO: 8060276 - DNA, 22 bp, Homo sapiens
tctacatagaattaggtaattt

SEQ ID NO: 8060277 - DNA, 22 bp, Homo sapiens
tctatttttatagttgaagtgc

SEQ ID NO: 8060278 - DNA, 22 bp, Homo sapiens
tctatttaggagaccctggttc

SEQ ID NO: 8060279 - DNA, 22 bp, Homo sapiens
tctagttttctcaaatgacttg

SEQ ID NO: 8060280 - DNA, 23 bp, Homo sapiens
tctctgggtgggctgtgtctata

SEQ ID NO: 8060281 - DNA, 23 bp, Homo sapiens
tctctggcctttgatcaggttga

SEQ ID NO: 8060282 - DNA, 22 bp, Homo sapiens
tctctggctgatattcctctgc

SEQ ID NO: 8060283 - DNA, 22 bp, Homo sapiens
tctctggctggcaccccaggga

SEQ ID NO: 8060284 - DNA, 22 bp, Homo sapiens
tctctggccccatggctgagct

SEQ ID NO: 8060285 - DNA, 22 bp, Homo sapiens
tctctggcagactggctgggct

SEQ ID NO: 8060286 - DNA, 22 bp, Homo sapiens
tctctggcacataataaggtct

SEQ ID NO: 8060287 - DNA, 20 bp, Homo sapiens
tctctgctgtccacatttgc

SEQ ID NO: 8060288 - DNA, 18 bp, Homo sapiens
tctctctgataacatttt

SEQ ID NO: 8060289 - DNA, 22 bp, Homo sapiens
tctctctgagccctgctttttc

SEQ ID NO: 8060290 - DNA, 22 bp, Homo sapiens
tctctcctaatttcaggtgctt

SEQ ID NO: 8060291 - DNA, 22 bp, Homo sapiens
tctgaaaatgttgactttgttt

SEQ ID NO: 8060292 - DNA, 22 bp, Homo sapiens
tctgaaagccctagtttgtaat

SEQ ID NO: 8060293 - DNA, 22 bp, Homo sapiens
tctgaaataaatgcactgttag

SEQ ID NO: 8060294 - DNA, 22 bp, Homo sapiens
tctgaaataaatgcactgttag

SEQ ID NO: 8060295 - DNA, 22 bp, Homo sapiens
tctctttaaaaatagtgaaata

SEQ ID NO: 8060296 - DNA, 22 bp, Homo sapiens
tctctttagtgcttagacgtct

SEQ ID NO: 8060297 - DNA, 22 bp, Homo sapiens
tctctttaaagactcagagatt

SEQ ID NO: 8060298 - DNA, 22 bp, Homo sapiens
tctgaaggtgctagagaaagct

SEQ ID NO: 8060299 - DNA, 22 bp, Homo sapiens
tctgaaattttagttatagaaa

SEQ ID NO: 8060300 - DNA, 22 bp, Homo sapiens
tctgaaattttagttatagaaa

SEQ ID NO: 8060301 - DNA, 22 bp, Homo sapiens
tctgaaatgcaaatttgactga

SEQ ID NO: 8060302 - DNA, 22 bp, Homo sapiens
tctcttctatttgagactattt

SEQ ID NO: 8060303 - DNA, 22 bp, Homo sapiens
tctcttctgacctagccttgga

SEQ ID NO: 8060304 - DNA, 22 bp, Homo sapiens
tctcttccatgtttcagcccca

SEQ ID NO: 8060305 - DNA, 22 bp, Homo sapiens
tctcttagtcttatatgtaaaa

SEQ ID NO: 8060306 - DNA, 21 bp, Homo sapiens
tctctgtggtccaatcccagc

SEQ ID NO: 8060307 - DNA, 22 bp, Homo sapiens
tctctgtggtatgtcatagcaa

SEQ ID NO: 8060308 - DNA, 22 bp, Homo sapiens
tctctgtggtactgagagtcta

SEQ ID NO: 8060309 - DNA, 22 bp, Homo sapiens
tctctgtgggtttcaccagcgc

SEQ ID NO: 8060310 - DNA, 21 bp, Homo sapiens
tctctgtgtacagtctcaccc

SEQ ID NO: 8060311 - DNA, 22 bp, Homo sapiens
tctctgtggcaacaattcacta

SEQ ID NO: 8060312 - DNA, 22 bp, Homo sapiens
tctctgtggagcagtgtgttca

SEQ ID NO: 8060313 - DNA, 22 bp, Homo sapiens
tctctgtggcatccactcaact

SEQ ID NO: 8060314 - DNA, 22 bp, Homo sapiens
tctctgtgaatggcgtcacctg

SEQ ID NO: 8060315 - DNA, 22 bp, Homo sapiens
tctctgtgagatttgtattaag

SEQ ID NO: 8060316 - DNA, 22 bp, Homo sapiens
tctctgtgagccaggtcctagt

SEQ ID NO: 8060317 - DNA, 22 bp, Homo sapiens
tctctgtgagtggaaggcaccc

SEQ ID NO: 8060318 - DNA, 22 bp, Homo sapiens
tctcctcccaggctcttccagg

SEQ ID NO: 8060319 - DNA, 22 bp, Homo sapiens
tctcctctactgggtctgcaga

SEQ ID NO: 8060320 - DNA, 22 bp, Homo sapiens
tctcctctgcgcggcagtgccc

SEQ ID NO: 8060321 - DNA, 22 bp, Homo sapiens
tctcctggaagaataccacact

SEQ ID NO: 8060322 - DNA, 22 bp, Homo sapiens
tctcctggaagtgattcccctg

SEQ ID NO: 8060323 - DNA, 22 bp, Homo sapiens
tctcctgctcagaacagcctca

SEQ ID NO: 8060324 - DNA, 22 bp, Homo sapiens
tctcctggatggaccttctctt

SEQ ID NO: 8060325 - DNA, 22 bp, Homo sapiens
tctcctggcatttggttgagta

SEQ ID NO: 8060326 - DNA, 22 bp, Homo sapiens
tctcctggcatgtgggtcatct

SEQ ID NO: 8060327 - DNA, 22 bp, Homo sapiens
tctcctggatagatactatcca

SEQ ID NO: 8060328 - DNA, 22 bp, Homo sapiens
tctcctggagcccagatgctgg

SEQ ID NO: 8060329 - DNA, 22 bp, Homo sapiens
tctcctggagcaggaaggtggg

SEQ ID NO: 8060330 - DNA, 22 bp, Homo sapiens
tctcctggagcaggaaggtggg

SEQ ID NO: 8060331 - DNA, 22 bp, Homo sapiens
tctccttccaacaaaaggtcac

SEQ ID NO: 8060332 - DNA, 20 bp, Homo sapiens
tctcctggtctggtccgtgc

SEQ ID NO: 8060333 - DNA, 22 bp, Homo sapiens
tctcctggtcacctcagaagtc

SEQ ID NO: 8060334 - DNA, 20 bp, Homo sapiens
tctcctggtgacagtaccca

SEQ ID NO: 8060335 - DNA, 22 bp, Homo sapiens
tctcctggtttgttaaataatt

SEQ ID NO: 8060336 - DNA, 22 bp, Homo sapiens
tctcctgggtaaaagggttgat

SEQ ID NO: 8060337 - DNA, 22 bp, Homo sapiens
tctcctggccctgtcgccatct

SEQ ID NO: 8060338 - DNA, 22 bp, Homo sapiens
tctcctgggcttggttgaagtt

SEQ ID NO: 8060339 - DNA, 18 bp, Homo sapiens
tctcctgggtaggggcct

SEQ ID NO: 8060340 - DNA, 21 bp, Homo sapiens
tctcctgggtccaacccatgc

SEQ ID NO: 8060341 - DNA, 22 bp, Homo sapiens
tctcctggtacccttcctagca

SEQ ID NO: 8060342 - DNA, 22 bp, Homo sapiens
tctcctggtacccttcctagca

SEQ ID NO: 8060343 - DNA, 22 bp, Homo sapiens
tctcctgggtgctttatcagaa

SEQ ID NO: 8060344 - DNA, 22 bp, Homo sapiens
tctcctggtatgtatgcacctg

SEQ ID NO: 8060345 - DNA, 22 bp, Homo sapiens
tctccttcgaggcccagctccc

SEQ ID NO: 8060346 - DNA, 22 bp, Homo sapiens
tctccctcattcctgcttccat

SEQ ID NO: 8060347 - DNA, 22 bp, Homo sapiens
tctcccaggtgggtgcctggag

SEQ ID NO: 8060348 - DNA, 22 bp, Homo sapiens
tctccaggggctgctgtgccac

SEQ ID NO: 8060349 - DNA, 22 bp, Homo sapiens
tctccaggtgctaagtgtgcct

SEQ ID NO: 8060350 - DNA, 22 bp, Homo sapiens
tctccaggtgaaacttgcaggg

SEQ ID NO: 8060351 - DNA, 22 bp, Homo sapiens
tctcagggagagctgctggcat

SEQ ID NO: 8060352 - DNA, 22 bp, Homo sapiens
tctcacccaacgtgcaatgagt

SEQ ID NO: 8060353 - DNA, 22 bp, Homo sapiens
tctcaggtctcatgccaggcct

SEQ ID NO: 8060354 - DNA, 22 bp, Homo sapiens
tctcatctgcgagctctgccag

SEQ ID NO: 8060355 - DNA, 22 bp, Homo sapiens
tctccaggcacttggctgctac

SEQ ID NO: 8060356 - DNA, 22 bp, Homo sapiens
tctccaaactcagactaagtat

SEQ ID NO: 8060357 - DNA, 22 bp, Homo sapiens
tctgacagctccaggcagcaat

SEQ ID NO: 8060358 - DNA, 22 bp, Homo sapiens
tctgagccacagatgtcctgtt

SEQ ID NO: 8060359 - DNA, 22 bp, Homo sapiens
tctgagccacctgccagtgctg

SEQ ID NO: 8060360 - DNA, 22 bp, Homo sapiens
tctgagcccagtgagtctcgca

SEQ ID NO: 8060361 - DNA, 22 bp, Homo sapiens
tctgagcagagcatcatttcag

SEQ ID NO: 8060362 - DNA, 22 bp, Homo sapiens
tctgagctgggtcttgacagct

SEQ ID NO: 8060363 - DNA, 21 bp, Homo sapiens
tctgagctgagtcctctaggt

SEQ ID NO: 8060364 - DNA, 22 bp, Homo sapiens
tctgagctcaagtgacagttag

SEQ ID NO: 8060365 - DNA, 19 bp, Homo sapiens
tctgagggtccagatgcat

SEQ ID NO: 8060366 - DNA, 22 bp, Homo sapiens
tctgatattggggtcagagtag

SEQ ID NO: 8060367 - DNA, 22 bp, Homo sapiens
tctgatatttcattcaaaagta

SEQ ID NO: 8060368 - DNA, 22 bp, Homo sapiens
tctgcaagcgtcacatgattct

SEQ ID NO: 8060369 - DNA, 22 bp, Homo sapiens
tctgcccctgctgggcacagag

SEQ ID NO: 8060370 - DNA, 22 bp, Homo sapiens
tctgcccagggacccacaggga

SEQ ID NO: 8060371 - DNA, 22 bp, Homo sapiens
tctgcccaggaggtcccatggg

SEQ ID NO: 8060372 - DNA, 22 bp, Homo sapiens
tctgcccaggacacctgccact

SEQ ID NO: 8060373 - DNA, 22 bp, Homo sapiens
tctgcccagccagacccaaggt

SEQ ID NO: 8060374 - DNA, 22 bp, Homo sapiens
tctgcccactgctctgctgccc

SEQ ID NO: 8060375 - DNA, 22 bp, Homo sapiens
tctgctctagttgcttcctgcc

SEQ ID NO: 8060376 - DNA, 22 bp, Homo sapiens
tctgcaggagagtgccctagag

SEQ ID NO: 8060377 - DNA, 22 bp, Homo sapiens
tctgcaggatcagagccagagg

SEQ ID NO: 8060378 - DNA, 22 bp, Homo sapiens
tctgcaggaggctggctgcagg

SEQ ID NO: 8060379 - DNA, 22 bp, Homo sapiens
tctgcacaaaactgtcgcagaa

SEQ ID NO: 8060380 - DNA, 22 bp, Homo sapiens
tctgcaggcttggagtggcagc

SEQ ID NO: 8060381 - DNA, 22 bp, Homo sapiens
tctgcaggtcacgctccagcct

SEQ ID NO: 8060382 - DNA, 22 bp, Homo sapiens
tctgccaggcttggtgctagat

SEQ ID NO: 8060383 - DNA, 22 bp, Homo sapiens
tctgccaggccacacagggcac

SEQ ID NO: 8060384 - DNA, 23 bp, Homo sapiens
tctgccagtgtgtgccaggagcc

SEQ ID NO: 8060385 - DNA, 22 bp, Homo sapiens
tctgccagtattcacggcccgt

SEQ ID NO: 8060386 - DNA, 23 bp, Homo sapiens
tctgccagttccttgatcatgga

SEQ ID NO: 8060387 - DNA, 22 bp, Homo sapiens
tctgccagttagaaactggtta

SEQ ID NO: 8060388 - DNA, 22 bp, Homo sapiens
tctgccagtttatagacaagcc

SEQ ID NO: 8060389 - DNA, 22 bp, Homo sapiens
tctgcccacagcctcctgtcca

SEQ ID NO: 8060390 - DNA, 21 bp, Homo sapiens
tctgcccacactggccactgc

SEQ ID NO: 8060391 - DNA, 22 bp, Homo sapiens
tctggagaagcagtgagagtca

SEQ ID NO: 8060392 - DNA, 22 bp, Homo sapiens
tctgctctgagagggccatcag

SEQ ID NO: 8060393 - DNA, 22 bp, Homo sapiens
tctgctctccatacttccgcac

SEQ ID NO: 8060394 - DNA, 22 bp, Homo sapiens
tctgctctgtggcttcagctaa

SEQ ID NO: 8060395 - DNA, 22 bp, Homo sapiens
tctgctctgtactgcactggcc

SEQ ID NO: 8060396 - DNA, 22 bp, Homo sapiens
tctgctggaaaaccagggaatt

SEQ ID NO: 8060397 - DNA, 22 bp, Homo sapiens
tctgctggtcaaggctgggtcc

SEQ ID NO: 8060398 - DNA, 22 bp, Homo sapiens
tctggcagaggaaggaggcctg

SEQ ID NO: 8060399 - DNA, 22 bp, Homo sapiens
tctggcagagatatccatccca

SEQ ID NO: 8060400 - DNA, 22 bp, Homo sapiens
tctggcagagtcagtgcacaca

SEQ ID NO: 8060401 - DNA, 22 bp, Homo sapiens
tctggcagagtgataggataag

SEQ ID NO: 8060402 - DNA, 22 bp, Homo sapiens
tctggcagaaggcagaaattca

SEQ ID NO: 8060403 - DNA, 22 bp, Homo sapiens
tctggcagaagtgctgtcagta

SEQ ID NO: 8060404 - DNA, 22 bp, Homo sapiens
tctggcacatagcagggtctct

SEQ ID NO: 8060405 - DNA, 20 bp, Homo sapiens
tctggcaggtgaacgagctg

SEQ ID NO: 8060406 - DNA, 19 bp, Homo sapiens
tctggcaggtaattaggga

SEQ ID NO: 8060407 - DNA, 22 bp, Homo sapiens
tctggcaggtcaatcattcttt

SEQ ID NO: 8060408 - DNA, 22 bp, Homo sapiens
tctggcagatcttcccacgttt

SEQ ID NO: 8060409 - DNA, 22 bp, Homo sapiens
tctggcagcaagataacaatgg

SEQ ID NO: 8060410 - DNA, 22 bp, Homo sapiens
tctggcagggtgtgtatttaca

SEQ ID NO: 8060411 - DNA, 22 bp, Homo sapiens
tctggcagtgagcaacttgaca

SEQ ID NO: 8060412 - DNA, 22 bp, Homo sapiens
tctggcagtgaagtcatgaggt

SEQ ID NO: 8060413 - DNA, 22 bp, Homo sapiens
tctggcagtgaagtcatgaggt

SEQ ID NO: 8060414 - DNA, 22 bp, Homo sapiens
tctggcagtaataggggagaga

SEQ ID NO: 8060415 - DNA, 22 bp, Homo sapiens
tctggcaggttcccatgttatg

SEQ ID NO: 8060416 - DNA, 22 bp, Homo sapiens
tctggcagtggatgagggcagc

SEQ ID NO: 8060417 - DNA, 22 bp, Homo sapiens
tctggcagtgatttctgtgatc

SEQ ID NO: 8060418 - DNA, 22 bp, Homo sapiens
tctggcagtggatgagggcagc

SEQ ID NO: 8060419 - DNA, 21 bp, Homo sapiens
tctggcagtggtctttcaaat

SEQ ID NO: 8060420 - DNA, 22 bp, Homo sapiens
tctggcagtttgagaaaggcta

SEQ ID NO: 8060421 - DNA, 22 bp, Homo sapiens
tctggcagttccttgttgatat

SEQ ID NO: 8060422 - DNA, 22 bp, Homo sapiens
tctggcagttgccgcttcagtc

SEQ ID NO: 8060423 - DNA, 22 bp, Homo sapiens
tctggccatggcaagccgagtg

SEQ ID NO: 8060424 - DNA, 22 bp, Homo sapiens
tctggccaggatggcaagacca

SEQ ID NO: 8060425 - DNA, 22 bp, Homo sapiens
tctggccagtgaaatgcagaat

SEQ ID NO: 8060426 - DNA, 22 bp, Homo sapiens
tctggaggctctgagggtgagt

SEQ ID NO: 8060427 - DNA, 22 bp, Homo sapiens
tctggaggctctgagggtgagt

SEQ ID NO: 8060428 - DNA, 22 bp, Homo sapiens
tctggagggcccacatccacaa

SEQ ID NO: 8060429 - DNA, 22 bp, Homo sapiens
tctgggaggtaaccatgctgat

SEQ ID NO: 8060430 - DNA, 22 bp, Homo sapiens
tctgggaggtcacattggtctt

SEQ ID NO: 8060431 - DNA, 22 bp, Homo sapiens
tctgggaggtggcagggtgcat

SEQ ID NO: 8060432 - DNA, 22 bp, Homo sapiens
tctgggaggggctgccattgct

SEQ ID NO: 8060433 - DNA, 22 bp, Homo sapiens
tctgggaggtgttttgagaact

SEQ ID NO: 8060434 - DNA, 22 bp, Homo sapiens
tctgggagtaaggcctaggcat

SEQ ID NO: 8060435 - DNA, 22 bp, Homo sapiens
tctgggagtaaggcctaggcat

SEQ ID NO: 8060436 - DNA, 22 bp, Homo sapiens
tctgggagtgtgtctggccatc

SEQ ID NO: 8060437 - DNA, 22 bp, Homo sapiens
tctgggaatgaggcttgggcaa

SEQ ID NO: 8060438 - DNA, 22 bp, Homo sapiens
tctgggagagctgctgtcagag

SEQ ID NO: 8060439 - DNA, 22 bp, Homo sapiens
tctgggagagctgctgtcagag

SEQ ID NO: 8060440 - DNA, 22 bp, Homo sapiens
tctgggagagcacgtggctgac

SEQ ID NO: 8060441 - DNA, 22 bp, Homo sapiens
tctgggagacgtgtgttgtcag

SEQ ID NO: 8060442 - DNA, 22 bp, Homo sapiens
tctgggcagaagcagtgcaaag

SEQ ID NO: 8060443 - DNA, 19 bp, Homo sapiens
tctgggcagggccagcacc

SEQ ID NO: 8060444 - DNA, 22 bp, Homo sapiens
tctgggcacacaccatgcccac

SEQ ID NO: 8060445 - DNA, 22 bp, Homo sapiens
tctgggcaatggatgcactcac

SEQ ID NO: 8060446 - DNA, 18 bp, Homo sapiens
tctgggcaatctcagtat

SEQ ID NO: 8060447 - DNA, 22 bp, Homo sapiens
tctgggccagatctagggatct

SEQ ID NO: 8060448 - DNA, 22 bp, Homo sapiens
tctgggaacattttgagggcaa

SEQ ID NO: 8060449 - DNA, 22 bp, Homo sapiens
tctgggaaccaaagggtgctta

SEQ ID NO: 8060450 - DNA, 22 bp, Homo sapiens
tctggctctaactaggcatcag

SEQ ID NO: 8060451 - DNA, 22 bp, Homo sapiens
tctggcccctggcagtcctgga

SEQ ID NO: 8060452 - DNA, 22 bp, Homo sapiens
tctggcccctggtctctggtgt

SEQ ID NO: 8060453 - DNA, 22 bp, Homo sapiens
tctgtattttaagatgctgttt

SEQ ID NO: 8060454 - DNA, 22 bp, Homo sapiens
tctggggttgagtctgggtcag

SEQ ID NO: 8060455 - DNA, 22 bp, Homo sapiens
tctggggtcacctggggtgctt

SEQ ID NO: 8060456 - DNA, 22 bp, Homo sapiens
tctggggtgcagcctggacata

SEQ ID NO: 8060457 - DNA, 22 bp, Homo sapiens
tctggggtgcagcctaggcatc

SEQ ID NO: 8060458 - DNA, 22 bp, Homo sapiens
tctggggtgtgacctgagcatg

SEQ ID NO: 8060459 - DNA, 22 bp, Homo sapiens
tctgggcttggattggctctgc

SEQ ID NO: 8060460 - DNA, 22 bp, Homo sapiens
tctgggctggttgtgcttgctt

SEQ ID NO: 8060461 - DNA, 22 bp, Homo sapiens
tctgggggcgaccagggactgc

SEQ ID NO: 8060462 - DNA, 22 bp, Homo sapiens
tctgtgcctttaagaagctcat

SEQ ID NO: 8060463 - DNA, 22 bp, Homo sapiens
tctgtgctaatttatccttcct

SEQ ID NO: 8060464 - DNA, 22 bp, Homo sapiens
tctgtgggtttcagggggctgt

SEQ ID NO: 8060465 - DNA, 22 bp, Homo sapiens
tctgtgcttaactactcacccc

SEQ ID NO: 8060466 - DNA, 22 bp, Homo sapiens
tctgtgcttaactactcacccc

SEQ ID NO: 8060467 - DNA, 21 bp, Homo sapiens
tctgtgctgccgtcaacatcc

SEQ ID NO: 8060468 - DNA, 22 bp, Homo sapiens
tctgtgctgccatcctgtggcc

SEQ ID NO: 8060469 - DNA, 22 bp, Homo sapiens
tctgtgctgcaggagtctgcat

SEQ ID NO: 8060470 - DNA, 22 bp, Homo sapiens
tctgtgctgagctctgagatgt

SEQ ID NO: 8060471 - DNA, 22 bp, Homo sapiens
tctgtgctggactgatttcata

SEQ ID NO: 8060472 - DNA, 22 bp, Homo sapiens
tctgtgctggactgatttcata

SEQ ID NO: 8060473 - DNA, 22 bp, Homo sapiens
tctgtgctagaggagttggcca

SEQ ID NO: 8060474 - DNA, 22 bp, Homo sapiens
tctgtgctcatgcatgtgaatt

SEQ ID NO: 8060475 - DNA, 22 bp, Homo sapiens
tctgtgctcatgcatgtgaatt

SEQ ID NO: 8060476 - DNA, 22 bp, Homo sapiens
tctgttcttgtccccacttcag

SEQ ID NO: 8060477 - DNA, 20 bp, Homo sapiens
tcttattgtcttgaggagtt

SEQ ID NO: 8060478 - DNA, 22 bp, Homo sapiens
tcttcagatggccagttgtccc

SEQ ID NO: 8060479 - DNA, 22 bp, Homo sapiens
tcttccagaatctcagagggct

SEQ ID NO: 8060480 - DNA, 22 bp, Homo sapiens
tcttccagatgcagatgcttct

SEQ ID NO: 8060481 - DNA, 22 bp, Homo sapiens
tcttccagccaatagcgtcctt

SEQ ID NO: 8060482 - DNA, 19 bp, Homo sapiens
tcttccagcatctgggggc

SEQ ID NO: 8060483 - DNA, 18 bp, Homo sapiens
tcttccagcttctggagg

SEQ ID NO: 8060484 - DNA, 22 bp, Homo sapiens
tcttccagctgtaggacctagg

SEQ ID NO: 8060485 - DNA, 20 bp, Homo sapiens
tcttccagcttctggtagaa

SEQ ID NO: 8060486 - DNA, 22 bp, Homo sapiens
tcttccaggagggcatttcttt

SEQ ID NO: 8060487 - DNA, 22 bp, Homo sapiens
tcttccaggacctggggctcca

SEQ ID NO: 8060488 - DNA, 22 bp, Homo sapiens
tcttccagcttctggtggctgc

SEQ ID NO: 8060489 - DNA, 22 bp, Homo sapiens
tcttccaggagggtgggcaaac

SEQ ID NO: 8060490 - DNA, 20 bp, Homo sapiens
tcttccaggtacagtctgca

SEQ ID NO: 8060491 - DNA, 21 bp, Homo sapiens
tcttcctgacatatgcaaggc

SEQ ID NO: 8060492 - DNA, 23 bp, Homo sapiens
tcttcctgaactatcaggcacat

SEQ ID NO: 8060493 - DNA, 22 bp, Homo sapiens
tcttccttttgtaccttctgaa

SEQ ID NO: 8060494 - DNA, 22 bp, Homo sapiens
tcttcctgctttggtgaggctt

SEQ ID NO: 8060495 - DNA, 22 bp, Homo sapiens
tcttcctggtttctgggccatc

SEQ ID NO: 8060496 - DNA, 22 bp, Homo sapiens
tcttctgttttagattgcatac

SEQ ID NO: 8060497 - DNA, 22 bp, Homo sapiens
tcttctttttgtcccacagaat

SEQ ID NO: 8060498 - DNA, 22 bp, Homo sapiens
tcttcttcctcatttatacata

SEQ ID NO: 8060499 - DNA, 22 bp, Homo sapiens
tcttgaaagcattttcttcatc

SEQ ID NO: 8060500 - DNA, 22 bp, Homo sapiens
tcttgaaagcatgagatggaca

SEQ ID NO: 8060501 - DNA, 21 bp, Homo sapiens
tcttgaaaagttagattctct

SEQ ID NO: 8060502 - DNA, 19 bp, Homo sapiens
tctttcatttctagctctg

SEQ ID NO: 8060503 - DNA, 22 bp, Homo sapiens
tctttatttaagtctgttgtaa

SEQ ID NO: 8060504 - DNA, 22 bp, Homo sapiens
tctttattgctactggtttgtc

SEQ ID NO: 8060505 - DNA, 22 bp, Homo sapiens
tctttatgcctacctgggaaga

SEQ ID NO: 8060506 - DNA, 22 bp, Homo sapiens
tctttatgcacataaagaaact

SEQ ID NO: 8060507 - DNA, 22 bp, Homo sapiens
tctttatgtaagactgggcttg

SEQ ID NO: 8060508 - DNA, 22 bp, Homo sapiens
tctttatggaaaatgaatggca

SEQ ID NO: 8060509 - DNA, 22 bp, Homo sapiens
tctttattgctactggtttgtc

SEQ ID NO: 8060510 - DNA, 22 bp, Homo sapiens
tctttatgtttgaaagtacaat

SEQ ID NO: 8060511 - DNA, 22 bp, Homo sapiens
tctttatgtttactccagctga

SEQ ID NO: 8060512 - DNA, 22 bp, Homo sapiens
tctttatgttgatttcctcagg

SEQ ID NO: 8060513 - DNA, 21 bp, Homo sapiens
tctttatgacttgcccatttg

SEQ ID NO: 8060514 - DNA, 22 bp, Homo sapiens
tctttatgagaaaaagattgta

SEQ ID NO: 8060515 - DNA, 22 bp, Homo sapiens
tctttatacaaactgggaaaca

SEQ ID NO: 8060516 - DNA, 22 bp, Homo sapiens
tctttgaagtatcttaaatggt

SEQ ID NO: 8060517 - DNA, 21 bp, Homo sapiens
tcttggggaggagggctgcac

SEQ ID NO: 8060518 - DNA, 22 bp, Homo sapiens
tctttacatcacaattgtatgg

SEQ ID NO: 8060519 - DNA, 22 bp, Homo sapiens
tctttacacaagacaagaataa

SEQ ID NO: 8060520 - DNA, 20 bp, Homo sapiens
aagctctgcttcatgtggtc

SEQ ID NO: 8060521 - DNA, 22 bp, Homo sapiens
agaggctgtgcccaccaggcaa

SEQ ID NO: 8060522 - DNA, 22 bp, Homo sapiens
acactttatgtctagatctggg

SEQ ID NO: 8060523 - DNA, 22 bp, Homo sapiens
agctcctgcttgacagaagagg

SEQ ID NO: 8060524 - DNA, 22 bp, Homo sapiens
agctcctgcgcacggtgcacac

SEQ ID NO: 8060525 - DNA, 17 bp, Homo sapiens
agctcctgcccatggct

SEQ ID NO: 8060526 - DNA, 22 bp, Homo sapiens
agctcctgcccaggaaggctct

SEQ ID NO: 8060527 - DNA, 22 bp, Homo sapiens
agctcctgccaacactgatggg

SEQ ID NO: 8060528 - DNA, 22 bp, Homo sapiens
acactttagtatgaagaggtag

SEQ ID NO: 8060529 - DNA, 22 bp, Homo sapiens
acactttagaaaaaagaatggt

SEQ ID NO: 8060530 - DNA, 22 bp, Homo sapiens
aaactggattaccaggctggtg

SEQ ID NO: 8060531 - DNA, 22 bp, Homo sapiens
aagagggctgcaatcttattgc

SEQ ID NO: 8060532 - DNA, 22 bp, Homo sapiens
aactggaaggattgcagatgtc

SEQ ID NO: 8060533 - DNA, 22 bp, Homo sapiens
aactggaatagcacaggaaaag

SEQ ID NO: 8060534 - DNA, 22 bp, Homo sapiens
aactggaaagatcagtaggaag

SEQ ID NO: 8060535 - DNA, 22 bp, Homo sapiens
aagaaactgttgcgtgacagcg

SEQ ID NO: 8060536 - DNA, 22 bp, Homo sapiens
acagctcctggggctttaatgg

SEQ ID NO: 8060537 - DNA, 22 bp, Homo sapiens
acagctcctactgaagccatgt

SEQ ID NO: 8060538 - DNA, 22 bp, Homo sapiens
acagctcctaacaaaggctctc

SEQ ID NO: 8060539 - DNA, 22 bp, Homo sapiens
actgaaggaaacttttgtgttt

SEQ ID NO: 8060540 - DNA, 22 bp, Homo sapiens
actgaaggaagcgggcaggggt

SEQ ID NO: 8060541 - DNA, 22 bp, Homo sapiens
actgaaggctttcccaaggtca

SEQ ID NO: 8060542 - DNA, 22 bp, Homo sapiens
actgaagggtaatgtgggagcc

SEQ ID NO: 8060543 - DNA, 22 bp, Homo sapiens
actgaaggtctcagcaaggatg

SEQ ID NO: 8060544 - DNA, 22 bp, Homo sapiens
actccagggaggtgagtgtgcg

SEQ ID NO: 8060545 - DNA, 19 bp, Homo sapiens
actcagggaaaggagaatt

SEQ ID NO: 8060546 - DNA, 22 bp, Homo sapiens
agaatactaggcttcagaaagg

SEQ ID NO: 8060547 - DNA, 22 bp, Homo sapiens
agatgaagatatctgcaggggc

SEQ ID NO: 8060548 - DNA, 22 bp, Homo sapiens
agagggtggtgaggcctggttc

SEQ ID NO: 8060549 - DNA, 22 bp, Homo sapiens
cacagtcccattcgagagtaat

SEQ ID NO: 8060550 - DNA, 22 bp, Homo sapiens
cacagtccagactcctggagtt

SEQ ID NO: 8060551 - DNA, 23 bp, Homo sapiens
agctccagggaacaggcagtagg

SEQ ID NO: 8060552 - DNA, 22 bp, Homo sapiens
cagagagggagcagtagtctct

SEQ ID NO: 8060553 - DNA, 22 bp, Homo sapiens
cagagagggcggccctggcttc

SEQ ID NO: 8060554 - DNA, 22 bp, Homo sapiens
agctgcaggttcagcattccac

SEQ ID NO: 8060555 - DNA, 22 bp, Homo sapiens
aggagaggcatcaagaaaatcg

SEQ ID NO: 8060556 - DNA, 22 bp, Homo sapiens
aggcagttggtcattgctcttt

SEQ ID NO: 8060557 - DNA, 23 bp, Homo sapiens
aggcatcttctgagttaagagca

SEQ ID NO: 8060558 - DNA, 22 bp, Homo sapiens
atactttagagctagattgcct

SEQ ID NO: 8060559 - DNA, 22 bp, Homo sapiens
cctggaccaaacactggcctgg

SEQ ID NO: 8060560 - DNA, 22 bp, Homo sapiens
cctggacctgcagcatcagcat

SEQ ID NO: 8060561 - DNA, 22 bp, Homo sapiens
cggaggttgaggctgcagtgag

SEQ ID NO: 8060562 - DNA, 20 bp, Homo sapiens
ctcagctcttcagggcaagt

SEQ ID NO: 8060563 - DNA, 22 bp, Homo sapiens
ctcagctccctccacccagacc

SEQ ID NO: 8060564 - DNA, 22 bp, Homo sapiens
ctccagagagaaaggaggccgc

SEQ ID NO: 8060565 - DNA, 22 bp, Homo sapiens
gggactggaactactggtgcag

SEQ ID NO: 8060566 - DNA, 19 bp, Homo sapiens
gggactggaggatgtggag

SEQ ID NO: 8060567 - DNA, 22 bp, Homo sapiens
gggactggagtagaggccggtg

SEQ ID NO: 8060568 - DNA, 22 bp, Homo sapiens
gggactggatagatgtgggtga

SEQ ID NO: 8060569 - DNA, 22 bp, Homo sapiens
gggactggcacagggctgggag

SEQ ID NO: 8060570 - DNA, 22 bp, Homo sapiens
gggactgggagatcctcctggc

SEQ ID NO: 8060571 - DNA, 22 bp, Homo sapiens
gggactggccagggtttggaat

SEQ ID NO: 8060572 - DNA, 22 bp, Homo sapiens
gctgcagtgagccaagatcgtg

SEQ ID NO: 8060573 - DNA, 18 bp, Homo sapiens
gctcctggaccaggtcac

SEQ ID NO: 8060574 - DNA, 17 bp, Homo sapiens
gctcctgcaggtcagga

SEQ ID NO: 8060575 - DNA, 22 bp, Homo sapiens
gctcctgcaggacccaggagac

SEQ ID NO: 8060576 - DNA, 22 bp, Homo sapiens
gctcctggagagattgagaaag

SEQ ID NO: 8060577 - DNA, 19 bp, Homo sapiens
gctcctggatgacctgtgg

SEQ ID NO: 8060578 - DNA, 18 bp, Homo sapiens
gctcctggagtctgactc

SEQ ID NO: 8060579 - DNA, 22 bp, Homo sapiens
attcctaaggaaggctggcaag

SEQ ID NO: 8060580 - DNA, 22 bp, Homo sapiens
attcctaaagtaatacactaga

SEQ ID NO: 8060581 - DNA, 22 bp, Homo sapiens
tcactcagcattcactgggcct

SEQ ID NO: 8060582 - DNA, 22 bp, Homo sapiens
ccagctcctcttcccagtgtca

SEQ ID NO: 8060583 - DNA, 22 bp, Homo sapiens
ccagctccaggactgggagctg

SEQ ID NO: 8060584 - DNA, 22 bp, Homo sapiens
ccagctcctcttgtctctagca

SEQ ID NO: 8060585 - DNA, 22 bp, Homo sapiens
ccagctccactgtcagatgaga

SEQ ID NO: 8060586 - DNA, 21 bp, Homo sapiens
ccagctccaggaccttggatc

SEQ ID NO: 8060587 - DNA, 22 bp, Homo sapiens
ccagctccaagtttgggcatca

SEQ ID NO: 8060588 - DNA, 22 bp, Homo sapiens
gtgtggactctctggtgcacag

SEQ ID NO: 8060589 - DNA, 22 bp, Homo sapiens
gttcctaaccagcagagaaaca

SEQ ID NO: 8060590 - DNA, 22 bp, Homo sapiens
gttcctaaatttgaaggacttt

SEQ ID NO: 8060591 - DNA, 22 bp, Homo sapiens
gttcctaaatctggaggacctc

SEQ ID NO: 8060592 - DNA, 22 bp, Homo sapiens
ccctcaggagatgtcagctgga

SEQ ID NO: 8060593 - DNA, 22 bp, Homo sapiens
cctccactctggcctctcaggt

SEQ ID NO: 8060594 - DNA, 22 bp, Homo sapiens
ctggaggaggaagtctacaatg

SEQ ID NO: 8060595 - DNA, 22 bp, Homo sapiens
ctggaggagagtctgaatgaca

SEQ ID NO: 8060596 - DNA, 22 bp, Homo sapiens
ctggaggagcaatatggttagg

SEQ ID NO: 8060597 - DNA, 22 bp, Homo sapiens
ctgaagaggacgcagcagcaag

SEQ ID NO: 8060598 - DNA, 22 bp, Homo sapiens
ctgaagaggttgttgaggaata

SEQ ID NO: 8060599 - DNA, 22 bp, Homo sapiens
ctgatcctcctttaagtagctg

SEQ ID NO: 8060600 - DNA, 22 bp, Homo sapiens
ctccaggggccagaagcctggc

SEQ ID NO: 8060601 - DNA, 22 bp, Homo sapiens
ctccagggaggtctgcaggact

SEQ ID NO: 8060602 - DNA, 22 bp, Homo sapiens
ctccagggcagcatggcagtgg

SEQ ID NO: 8060603 - DNA, 22 bp, Homo sapiens
gctcctgggtgtggctgcccct

SEQ ID NO: 8060604 - DNA, 22 bp, Homo sapiens
gctcctggtctggagcttcaag

SEQ ID NO: 8060605 - DNA, 22 bp, Homo sapiens
gctcctgggccctgggctaact

SEQ ID NO: 8060606 - DNA, 22 bp, Homo sapiens
gctcctgggctctaccttgcta

SEQ ID NO: 8060607 - DNA, 19 bp, Homo sapiens
gctcctgggcctcactcat

SEQ ID NO: 8060608 - DNA, 16 bp, Homo sapiens
gctcctgggccctcga

SEQ ID NO: 8060609 - DNA, 22 bp, Homo sapiens
gctcctggcttcactgacatca

SEQ ID NO: 8060610 - DNA, 22 bp, Homo sapiens
gctcctggctctggccaaggga

SEQ ID NO: 8060611 - DNA, 22 bp, Homo sapiens
gctcctggccagcacagggccc

SEQ ID NO: 8060612 - DNA, 22 bp, Homo sapiens
gctcctggcatcctgcttttaa

SEQ ID NO: 8060613 - DNA, 22 bp, Homo sapiens
gctcctggctccaggcagccaa

SEQ ID NO: 8060614 - DNA, 22 bp, Homo sapiens
gctcctggctctctgagggctg

SEQ ID NO: 8060615 - DNA, 22 bp, Homo sapiens
gctcctggcaggcagtgtgtgt

SEQ ID NO: 8060616 - DNA, 22 bp, Homo sapiens
gcagctcctcctgggctggaga

SEQ ID NO: 8060617 - DNA, 22 bp, Homo sapiens
gcagctcccatcagggcacaga

SEQ ID NO: 8060618 - DNA, 22 bp, Homo sapiens
gccagaggctcaggttgccatg

SEQ ID NO: 8060619 - DNA, 22 bp, Homo sapiens
gcagtgttgctaggtgcggtga

SEQ ID NO: 8060620 - DNA, 22 bp, Homo sapiens
gcagtgttgagtggtggctgaa

SEQ ID NO: 8060621 - DNA, 22 bp, Homo sapiens
gcagtgttctaaattgggtgtg

SEQ ID NO: 8060622 - DNA, 22 bp, Homo sapiens
gcagtgttgactatggtatgag

SEQ ID NO: 8060623 - DNA, 22 bp, Homo sapiens
gcagtgttcttgttgcttttat

SEQ ID NO: 8060624 - DNA, 22 bp, Homo sapiens
gcagtgttgagccagctggggg

SEQ ID NO: 8060625 - DNA, 22 bp, Homo sapiens
gcagtgttccttctactggggc

SEQ ID NO: 8060626 - DNA, 22 bp, Homo sapiens
gcagtgttcagtgaagcaggag

SEQ ID NO: 8060627 - DNA, 22 bp, Homo sapiens
gcagtgttatgttttctataat

SEQ ID NO: 8060628 - DNA, 22 bp, Homo sapiens
gcagtgttaggaataaaaatga

SEQ ID NO: 8060629 - DNA, 22 bp, Homo sapiens
gatgcgggcccgctccactgcc

SEQ ID NO: 8060630 - DNA, 19 bp, Homo sapiens
gagatactgaagtgaggaa

SEQ ID NO: 8060631 - DNA, 20 bp, Homo sapiens
gggcagcctcgggagtgggt

SEQ ID NO: 8060632 - DNA, 22 bp, Homo sapiens
gggcagccgcgtgacctgccag

SEQ ID NO: 8060633 - DNA, 22 bp, Homo sapiens
gggcagcctcggtgcctgctgc

SEQ ID NO: 8060634 - DNA, 22 bp, Homo sapiens
gggacctgaggccctgctccac

SEQ ID NO: 8060635 - DNA, 19 bp, Homo sapiens
gggatgcactctgaccact

SEQ ID NO: 8060636 - DNA, 22 bp, Homo sapiens
gggatgcagtcagagcccctgt

SEQ ID NO: 8060637 - DNA, 22 bp, Homo sapiens
ggggaccctcaggactgcgtct

SEQ ID NO: 8060638 - DNA, 22 bp, Homo sapiens
gggctagcctcttccctgctcc

SEQ ID NO: 8060639 - DNA, 22 bp, Homo sapiens
ggagagggtgtggaaagttatc

SEQ ID NO: 8060640 - DNA, 22 bp, Homo sapiens
ggagagggtgtggaaagttatc

SEQ ID NO: 8060641 - DNA, 22 bp, Homo sapiens
ggagagggtaggggtcctgccc

SEQ ID NO: 8060642 - DNA, 23 bp, Homo sapiens
ggagaggggtgtgggcatcttta

SEQ ID NO: 8060643 - DNA, 23 bp, Homo sapiens
ggagaggggtgtgggcatcttta

SEQ ID NO: 8060644 - DNA, 22 bp, Homo sapiens
ggagagggggctccctgcttgg

SEQ ID NO: 8060645 - DNA, 22 bp, Homo sapiens
ggagaggggcaagtttatctag

SEQ ID NO: 8060646 - DNA, 22 bp, Homo sapiens
ggagaggggaacttgttgcttg

SEQ ID NO: 8060647 - DNA, 22 bp, Homo sapiens
gtggggtagatctttctcagga

SEQ ID NO: 8060648 - DNA, 22 bp, Homo sapiens
gtgaaggccagtagggtcctgg

SEQ ID NO: 8060649 - DNA, 22 bp, Homo sapiens
gtggcagcaaatgcctggacta

SEQ ID NO: 8060650 - DNA, 22 bp, Homo sapiens
tcttcaatgcattctcttgttt

SEQ ID NO: 8060651 - DNA, 22 bp, Homo sapiens
tcttcaattagatttaccaatt

SEQ ID NO: 8060652 - DNA, 22 bp, Homo sapiens
tctggcacttaaatgagaattt

SEQ ID NO: 8060653 - DNA, 22 bp, Homo sapiens
tctgaaggcctggagggtccca

SEQ ID NO: 8060654 - DNA, 22 bp, Homo sapiens
tctagctctgcttatcatggct

SEQ ID NO: 8060655 - DNA, 22 bp, Homo sapiens
tccttgactgtgaggaactagc

SEQ ID NO: 8060656 - DNA, 22 bp, Homo sapiens
tccttggctagtactggccagc

SEQ ID NO: 8060657 - DNA, 22 bp, Homo sapiens
tcctgggcagaatgggatggct

SEQ ID NO: 8060658 - DNA, 22 bp, Homo sapiens
tcctgggcaaagaggggcagtg

SEQ ID NO: 8060659 - DNA, 22 bp, Homo sapiens
tcctgggctgtggccccgggca

SEQ ID NO: 8060660 - DNA, 17 bp, Homo sapiens
tgatttagtaagctgcc

SEQ ID NO: 8060661 - DNA, 22 bp, Homo sapiens
tgcagtgtagaaaaagagtgag

SEQ ID NO: 8060662 - DNA, 21 bp, Homo sapiens
tgcagtgtccctaacagtggt

SEQ ID NO: 8060663 - DNA, 23 bp, Homo sapiens
tgcagtgtagcatctacgaagct

SEQ ID NO: 8060664 - DNA, 22 bp, Homo sapiens
tgcagtgtgaggtccacatctg

SEQ ID NO: 8060665 - DNA, 22 bp, Homo sapiens
tgcagtgtgacctgtagcgagc

SEQ ID NO: 8060666 - DNA, 22 bp, Homo sapiens
tgcagtgtgattttctggctga

SEQ ID NO: 8060667 - DNA, 22 bp, Homo sapiens
tgcagtgtgctagatttggact

SEQ ID NO: 8060668 - DNA, 22 bp, Homo sapiens
tgcagtgtcttgtggacttgag

SEQ ID NO: 8060669 - DNA, 23 bp, Homo sapiens
tgcagtgtcgctgcgagcccggc

SEQ ID NO: 8060670 - DNA, 20 bp, Homo sapiens
tgcagtgtcctcacttgtca

SEQ ID NO: 8060671 - DNA, 20 bp, Homo sapiens
tgcagtgtggaagactgaga

SEQ ID NO: 8060672 - DNA, 22 bp, Homo sapiens
tgcagtgtggccatgtcagcta

SEQ ID NO: 8060673 - DNA, 22 bp, Homo sapiens
tgcagtgttcagtgatctctcc

SEQ ID NO: 8060674 - DNA, 22 bp, Homo sapiens
tgcagtgttcctgtgggtttat

SEQ ID NO: 8060675 - DNA, 22 bp, Homo sapiens
tgcagtgttcctgtagcctgcc

SEQ ID NO: 8060676 - DNA, 22 bp, Homo sapiens
tgcagtgtttggatgctgagtc

SEQ ID NO: 8060677 - DNA, 22 bp, Homo sapiens
tgcagtgtttccagatattgtc

SEQ ID NO: 8060678 - DNA, 23 bp, Homo sapiens
tgcagtgtttaacaatgacttga

SEQ ID NO: 8060679 - DNA, 22 bp, Homo sapiens
tgcagtgtttttcagggcatat

SEQ ID NO: 8060680 - DNA, 21 bp, Homo sapiens
tgagagagtagcaggacatat

SEQ ID NO: 8060681 - DNA, 22 bp, Homo sapiens
tgagagagcgcctgggatcatt

SEQ ID NO: 8060682 - DNA, 22 bp, Homo sapiens
tgagagagcctgaatctcttac

SEQ ID NO: 8060683 - DNA, 22 bp, Homo sapiens
tgagagagtaattgagtggtaa

SEQ ID NO: 8060684 - DNA, 22 bp, Homo sapiens
tgagagaggggactgcctgctt

SEQ ID NO: 8060685 - DNA, 22 bp, Homo sapiens
tgagagagggatgcaccctcct

SEQ ID NO: 8060686 - DNA, 22 bp, Homo sapiens
tgagagaggatgccctcatatt

SEQ ID NO: 8060687 - DNA, 22 bp, Homo sapiens
tgagaggcagaatggtgcctgc

SEQ ID NO: 8060688 - DNA, 22 bp, Homo sapiens
tgaggcaggagttcaggctgcg

SEQ ID NO: 8060689 - DNA, 23 bp, Homo sapiens
tgaggcaggcggatcacgaggtc

SEQ ID NO: 8060690 - DNA, 22 bp, Homo sapiens
tgaaggcataaatcttgggaac

SEQ ID NO: 8060691 - DNA, 22 bp, Homo sapiens
tgaaggcattgatgaaggaatc

SEQ ID NO: 8060692 - DNA, 22 bp, Homo sapiens
tgaaggcatttgagttggtgag

SEQ ID NO: 8060693 - DNA, 22 bp, Homo sapiens
tgaaggcagtgattttgtttgg

SEQ ID NO: 8060694 - DNA, 22 bp, Homo sapiens
tgaaggcagtgagtttgtgttt

SEQ ID NO: 8060695 - DNA, 20 bp, Homo sapiens
tgaaggcaggtaagaaagat

SEQ ID NO: 8060696 - DNA, 22 bp, Homo sapiens
tgaaggcagcatgcacactagt

SEQ ID NO: 8060697 - DNA, 22 bp, Homo sapiens
tgaaggcaacctctgtggtcct

SEQ ID NO: 8060698 - DNA, 22 bp, Homo sapiens
tgaaggcaactgagaaaaagca

SEQ ID NO: 8060699 - DNA, 22 bp, Homo sapiens
tgaaggcaaaacatgttacacc

SEQ ID NO: 8060700 - DNA, 22 bp, Homo sapiens
tgaaggcacttgcctaggggca

SEQ ID NO: 8060701 - DNA, 22 bp, Homo sapiens
tgaaggcacagtttaaccagta

SEQ ID NO: 8060702 - DNA, 22 bp, Homo sapiens
tgaaggcacgtgggtggatact

SEQ ID NO: 8060703 - DNA, 22 bp, Homo sapiens
tgggactgtgacctccagggta

SEQ ID NO: 8060704 - DNA, 22 bp, Homo sapiens
tggcagcagcaaatggcatatc

SEQ ID NO: 8060705 - DNA, 22 bp, Homo sapiens
tgctcctgaggttggagatcca

SEQ ID NO: 8060706 - DNA, 22 bp, Homo sapiens
tgctcctgagtgtgcaggagat

SEQ ID NO: 8060707 - DNA, 22 bp, Homo sapiens
tgctcctgacagagtccatatg

SEQ ID NO: 8060708 - DNA, 22 bp, Homo sapiens
tgctcctggctccttccctaac

SEQ ID NO: 8060709 - DNA, 22 bp, Homo sapiens
tgctcctggcttcaggttgggc

SEQ ID NO: 8060710 - DNA, 22 bp, Homo sapiens
tgctcctggactggtgtgagat

SEQ ID NO: 8060711 - DNA, 22 bp, Homo sapiens
tggagaggaaagtgcagttttg

SEQ ID NO: 8060712 - DNA, 22 bp, Homo sapiens
tggagagaagaggcagtgtgct

SEQ ID NO: 8060713 - DNA, 22 bp, Homo sapiens
tggaccccctcaaggcagagct

SEQ ID NO: 8060714 - DNA, 22 bp, Homo sapiens
tggaccccagacaagccagggt

SEQ ID NO: 8060715 - DNA, 22 bp, Homo sapiens
tggactggaatgctgatcctct

SEQ ID NO: 8060716 - DNA, 22 bp, Homo sapiens
tggacagcttgcagagccaccc

SEQ ID NO: 8060717 - DNA, 22 bp, Homo sapiens
tgtggacaagatgccaattgat

SEQ ID NO: 8060718 - DNA, 22 bp, Homo sapiens
tgtggacaccactgggactgga

SEQ ID NO: 8060719 - DNA, 22 bp, Homo sapiens
tgtggacaccactgggaggtct

SEQ ID NO: 8060720 - DNA, 22 bp, Homo sapiens
aagatactgatgatgtaggcta

SEQ ID NO: 8060721 - DNA, 20 bp, Homo sapiens
aagatactccagaaattaaa

SEQ ID NO: 8060722 - DNA, 20 bp, Homo sapiens
aagagaggaagttatactag

SEQ ID NO: 8060723 - DNA, 22 bp, Homo sapiens
agagggtaacaagaggcctgga

SEQ ID NO: 8060724 - DNA, 19 bp, Homo sapiens
agaggcagtctccaacagg

SEQ ID NO: 8060725 - DNA, 22 bp, Homo sapiens
agagagagaaatgaaatgtgct

SEQ ID NO: 8060726 - DNA, 20 bp, Homo sapiens
agagagaggtaaattgagca

SEQ ID NO: 8060727 - DNA, 22 bp, Homo sapiens
agctcaggctctgcagggacta

SEQ ID NO: 8060728 - DNA, 22 bp, Homo sapiens
aatcttcaacagaatggtagga

SEQ ID NO: 8060729 - DNA, 22 bp, Homo sapiens
cagatgtggaatgcagcaggct

SEQ ID NO: 8060730 - DNA, 23 bp, Homo sapiens
agctccagaacatagcacaggaa

SEQ ID NO: 8060731 - DNA, 22 bp, Homo sapiens
agctccagaagcctgcaaggta

SEQ ID NO: 8060732 - DNA, 22 bp, Homo sapiens
agctccagccgctgatgggttt

SEQ ID NO: 8060733 - DNA, 22 bp, Homo sapiens
agctccagccctagtacagctg

SEQ ID NO: 8060734 - DNA, 22 bp, Homo sapiens
agctcctggaggtgcgcactcg

SEQ ID NO: 8060735 - DNA, 22 bp, Homo sapiens
agctcctggcaaggtcatggtg

SEQ ID NO: 8060736 - DNA, 22 bp, Homo sapiens
agctcctggacgaacagggagt

SEQ ID NO: 8060737 - DNA, 20 bp, Homo sapiens
agctcctggactagagagtg

SEQ ID NO: 8060738 - DNA, 22 bp, Homo sapiens
agctccagggaaagagtggatc

SEQ ID NO: 8060739 - DNA, 22 bp, Homo sapiens
agctccagcctcttctggaggt

SEQ ID NO: 8060740 - DNA, 22 bp, Homo sapiens
agctcctgtctcaagggagcct

SEQ ID NO: 8060741 - DNA, 22 bp, Homo sapiens
agctcctggtgcctcagccgaa

SEQ ID NO: 8060742 - DNA, 23 bp, Homo sapiens
agctcctgtaaggtggtcgtcac

SEQ ID NO: 8060743 - DNA, 18 bp, Homo sapiens
agctcctggtctcaggga

SEQ ID NO: 8060744 - DNA, 22 bp, Homo sapiens
agctcctggtctttgtccagag

SEQ ID NO: 8060745 - DNA, 20 bp, Homo sapiens
agctcctggtataggtgcct

SEQ ID NO: 8060746 - DNA, 22 bp, Homo sapiens
agctcctggctttcctctcacc

SEQ ID NO: 8060747 - DNA, 22 bp, Homo sapiens
agctcctgggagcaggtggtac

SEQ ID NO: 8060748 - DNA, 22 bp, Homo sapiens
agctcctgggccatcacaacca

SEQ ID NO: 8060749 - DNA, 22 bp, Homo sapiens
agctcctgggggttccaagcag

SEQ ID NO: 8060750 - DNA, 19 bp, Homo sapiens
agctcctgggctctgggcc

SEQ ID NO: 8060751 - DNA, 22 bp, Homo sapiens
agctcctgtggctgaaagagga

SEQ ID NO: 8060752 - DNA, 22 bp, Homo sapiens
agagagggcatagaaaaaggga

SEQ ID NO: 8060753 - DNA, 22 bp, Homo sapiens
agagaggttggctaggatgttt

SEQ ID NO: 8060754 - DNA, 22 bp, Homo sapiens
agactttagaatcagatagcct

SEQ ID NO: 8060755 - DNA, 22 bp, Homo sapiens
agacttaatagaagcatgacat

SEQ ID NO: 8060756 - DNA, 22 bp, Homo sapiens
atgaaggccaggcttcagtgtg

SEQ ID NO: 8060757 - DNA, 19 bp, Homo sapiens
atgaaggcactgagtggga

SEQ ID NO: 8060758 - DNA, 22 bp, Homo sapiens
agaggctgcacttgctcatgat

SEQ ID NO: 8060759 - DNA, 22 bp, Homo sapiens
agctgcagctacagtgttggtt

SEQ ID NO: 8060760 - DNA, 22 bp, Homo sapiens
agctgcagcctcatgattcggt

SEQ ID NO: 8060761 - DNA, 22 bp, Homo sapiens
agctgcagccgcagctgtggcc

SEQ ID NO: 8060762 - DNA, 22 bp, Homo sapiens
agggcctcgggctcagtgggtc

SEQ ID NO: 8060763 - DNA, 22 bp, Homo sapiens
agggcctcgaaggcagagggat

SEQ ID NO: 8060764 - DNA, 22 bp, Homo sapiens
agggcctctggaacactgaggg

SEQ ID NO: 8060765 - DNA, 20 bp, Homo sapiens
actttacagagaagactgac

SEQ ID NO: 8060766 - DNA, 21 bp, Homo sapiens
actttacaatttacatagtga

SEQ ID NO: 8060767 - DNA, 22 bp, Homo sapiens
actttacaagcttatagcctag

SEQ ID NO: 8060768 - DNA, 22 bp, Homo sapiens
actttacaaactcctcactgtt

SEQ ID NO: 8060769 - DNA, 22 bp, Homo sapiens
actcctggaaaagaacgcaggg

SEQ ID NO: 8060770 - DNA, 22 bp, Homo sapiens
actcctgggttccggagattct

SEQ ID NO: 8060771 - DNA, 22 bp, Homo sapiens
actccagggttttgcacctgga

SEQ ID NO: 8060772 - DNA, 22 bp, Homo sapiens
actgagagagctgggtatctcc

SEQ ID NO: 8060773 - DNA, 22 bp, Homo sapiens
ctagctccatataaagcaggat

SEQ ID NO: 8060774 - DNA, 22 bp, Homo sapiens
cttcaagaagacagcagagcat

SEQ ID NO: 8060775 - DNA, 20 bp, Homo sapiens
aggcagctggccaggcaggt

SEQ ID NO: 8060776 - DNA, 23 bp, Homo sapiens
ccagctccgtgagcctcgggctc

SEQ ID NO: 8060777 - DNA, 22 bp, Homo sapiens
ccccagagaaagtcagcagcat

SEQ ID NO: 8060778 - DNA, 22 bp, Homo sapiens
gcccactccagcttctcccaca

SEQ ID NO: 8060779 - DNA, 20 bp, Homo sapiens
gcccactctaatccactgtc

SEQ ID NO: 8060780 - DNA, 18 bp, Homo sapiens
gccagagggaagcaggtg

SEQ ID NO: 8060781 - DNA, 22 bp, Homo sapiens
gctcctggatgttcaagtcggc

SEQ ID NO: 8060782 - DNA, 22 bp, Homo sapiens
gctcagggtcccttggtgctgg

SEQ ID NO: 8060783 - DNA, 22 bp, Homo sapiens
gagggatggtgtgagaggctca

SEQ ID NO: 8060784 - DNA, 22 bp, Homo sapiens
gagaggtggaggttgcagtgag

SEQ ID NO: 8060785 - DNA, 22 bp, Homo sapiens
atcttcaatatttttgtgtaga

SEQ ID NO: 8060786 - DNA, 21 bp, Homo sapiens
atcttcaactgattggaggag

SEQ ID NO: 8060787 - DNA, 16 bp, Homo sapiens
cagagaggacagaggc

SEQ ID NO: 8060788 - DNA, 21 bp, Homo sapiens
cagctccactaaagcagctgt

SEQ ID NO: 8060789 - DNA, 22 bp, Homo sapiens
cagctccacttgagtggggcct

SEQ ID NO: 8060790 - DNA, 22 bp, Homo sapiens
cagctccagccaccggggggtg

SEQ ID NO: 8060791 - DNA, 22 bp, Homo sapiens
cagctccagcccaggcagctcc

SEQ ID NO: 8060792 - DNA, 23 bp, Homo sapiens
cagctccagtgcactcaggtagc

SEQ ID NO: 8060793 - DNA, 22 bp, Homo sapiens
cagctccatcttgcttatacca

SEQ ID NO: 8060794 - DNA, 22 bp, Homo sapiens
cagctccagccgactgtaagaa

SEQ ID NO: 8060795 - DNA, 22 bp, Homo sapiens
cagctccagcctgacaccaaga

SEQ ID NO: 8060796 - DNA, 22 bp, Homo sapiens
cagctccagctctgggcgcctc

SEQ ID NO: 8060797 - DNA, 22 bp, Homo sapiens
cagctcctagatcggcgaagtg

SEQ ID NO: 8060798 - DNA, 19 bp, Homo sapiens
cacagctctgctcagggaa

SEQ ID NO: 8060799 - DNA, 20 bp, Homo sapiens
caggctccgcaggactaggg

SEQ ID NO: 8060800 - DNA, 22 bp, Homo sapiens
caggctccttcccagggatggt

SEQ ID NO: 8060801 - DNA, 22 bp, Homo sapiens
caggctcccgctccactgggca

SEQ ID NO: 8060802 - DNA, 22 bp, Homo sapiens
tagacatttgtcaagaatgact

SEQ ID NO: 8060803 - DNA, 22 bp, Homo sapiens
ccaagaggcagaatgcagagaa

SEQ ID NO: 8060804 - DNA, 22 bp, Homo sapiens
ccaagaggttgaggctgcagtg

SEQ ID NO: 8060805 - DNA, 22 bp, Homo sapiens
tgcagagagatatggcaagagg

SEQ ID NO: 8060806 - DNA, 22 bp, Homo sapiens
cttccagagctgggctgacctt

SEQ ID NO: 8060807 - DNA, 22 bp, Homo sapiens
cttccagagatagggcctcaag

SEQ ID NO: 8060808 - DNA, 22 bp, Homo sapiens
ctgggctagaaggaccaggatg

SEQ ID NO: 8060809 - DNA, 22 bp, Homo sapiens
gaaggcagggaatgtggtgcta

SEQ ID NO: 8060810 - DNA, 22 bp, Homo sapiens
gagagggcaaggtagatgctac

SEQ ID NO: 8060811 - DNA, 22 bp, Homo sapiens
gagagggccgggggccagctcc

SEQ ID NO: 8060812 - DNA, 22 bp, Homo sapiens
gagagggccgggggccagctcc

SEQ ID NO: 8060813 - DNA, 22 bp, Homo sapiens
gagagggcaaacttgtagctaa

SEQ ID NO: 8060814 - DNA, 22 bp, Homo sapiens
ctcctggaggctccaagggaga

SEQ ID NO: 8060815 - DNA, 22 bp, Homo sapiens
ctcctggacatggagcggagga

SEQ ID NO: 8060816 - DNA, 22 bp, Homo sapiens
ctccctggtgtcccctccagga

SEQ ID NO: 8060817 - DNA, 22 bp, Homo sapiens
ctgctcctgtgggccagtggcc

SEQ ID NO: 8060818 - DNA, 22 bp, Homo sapiens
ctgctcctggtcatcctccact

SEQ ID NO: 8060819 - DNA, 22 bp, Homo sapiens
ctgagagatgatatagcttaat

SEQ ID NO: 8060820 - DNA, 22 bp, Homo sapiens
ctgagaggtgctggtggctgca

SEQ ID NO: 8060821 - DNA, 22 bp, Homo sapiens
ctgaaggcttgttgttttctta

SEQ ID NO: 8060822 - DNA, 22 bp, Homo sapiens
ctgaaggctgaggctgtgttgt

SEQ ID NO: 8060823 - DNA, 22 bp, Homo sapiens
ctgaaggcatttttgctgattt

SEQ ID NO: 8060824 - DNA, 22 bp, Homo sapiens
ctgaaggctaaaatggactgaa

SEQ ID NO: 8060825 - DNA, 22 bp, Homo sapiens
ctgaaggcaccaggggtgccag

SEQ ID NO: 8060826 - DNA, 18 bp, Homo sapiens
ctgaaggcaccagggcag

SEQ ID NO: 8060827 - DNA, 22 bp, Homo sapiens
ttcctaacaaacttcagtgaat

SEQ ID NO: 8060828 - DNA, 22 bp, Homo sapiens
ttcagggccctgagagggcagt

SEQ ID NO: 8060829 - DNA, 22 bp, Homo sapiens
ggatgcaggggcagcagagcct

SEQ ID NO: 8060830 - DNA, 22 bp, Homo sapiens
ggatgcaggaacacagcgacct

SEQ ID NO: 8060831 - DNA, 22 bp, Homo sapiens
gggcctcagctgccaacaggat

SEQ ID NO: 8060832 - DNA, 22 bp, Homo sapiens
gggcctcagctctgctctgcaa

SEQ ID NO: 8060833 - DNA, 22 bp, Homo sapiens
gggcctcaggccttgctctgtg

SEQ ID NO: 8060834 - DNA, 22 bp, Homo sapiens
gggcctcatgatggctcaggaa

SEQ ID NO: 8060835 - DNA, 22 bp, Homo sapiens
gccagaggcccaaggacagctg

SEQ ID NO: 8060836 - DNA, 22 bp, Homo sapiens
gcccactctggagcctgttccc

SEQ ID NO: 8060837 - DNA, 22 bp, Homo sapiens
ggacctgaacataaaacgaggc

SEQ ID NO: 8060838 - DNA, 22 bp, Homo sapiens
ggacactgttcatggggagggg

SEQ ID NO: 8060839 - DNA, 22 bp, Homo sapiens
ggagagaggagcccactgctgt

SEQ ID NO: 8060840 - DNA, 23 bp, Homo sapiens
gctgatggagacttgtggcctcc

SEQ ID NO: 8060841 - DNA, 22 bp, Homo sapiens
gctgaaggaggctctggtacta

SEQ ID NO: 8060842 - DNA, 19 bp, Homo sapiens
gctgaaggaggtgcctgca

SEQ ID NO: 8060843 - DNA, 22 bp, Homo sapiens
gctgaaggagcctggggtggga

SEQ ID NO: 8060844 - DNA, 22 bp, Homo sapiens
gctgaagggagtgctgagtctg

SEQ ID NO: 8060845 - DNA, 19 bp, Homo sapiens
gctgaaggcgctcagaagc

SEQ ID NO: 8060846 - DNA, 22 bp, Homo sapiens
gctgaaggcccggaggacaggg

SEQ ID NO: 8060847 - DNA, 21 bp, Homo sapiens
gctgaaggtgggttgtacagg

SEQ ID NO: 8060848 - DNA, 22 bp, Homo sapiens
gctgaaggtggttttcaagtat

SEQ ID NO: 8060849 - DNA, 22 bp, Homo sapiens
gctgaaggtgtgtggagagagg

SEQ ID NO: 8060850 - DNA, 22 bp, Homo sapiens
gctgaaggtatgagttttatct

SEQ ID NO: 8060851 - DNA, 22 bp, Homo sapiens
gctgaaggtctctggagaggtc

SEQ ID NO: 8060852 - DNA, 20 bp, Homo sapiens
gctgaaggggtgggtttgtt

SEQ ID NO: 8060853 - DNA, 22 bp, Homo sapiens
gctcagggaaagagctcctgtc

SEQ ID NO: 8060854 - DNA, 21 bp, Homo sapiens
gctcctggtgctgcgtggcgc

SEQ ID NO: 8060855 - DNA, 22 bp, Homo sapiens
gctcctggtgcaaagtttcttc

SEQ ID NO: 8060856 - DNA, 18 bp, Homo sapiens
gctcctggttggaaagaa

SEQ ID NO: 8060857 - DNA, 22 bp, Homo sapiens
gctcctggtgctgtagagattt

SEQ ID NO: 8060858 - DNA, 22 bp, Homo sapiens
gctcaagggatgggagtgggtg

SEQ ID NO: 8060859 - DNA, 22 bp, Homo sapiens
gtgttattagagcattaatttt

SEQ ID NO: 8060860 - DNA, 22 bp, Homo sapiens
taaatactgagttggagttggc

SEQ ID NO: 8060861 - DNA, 22 bp, Homo sapiens
tattcatattgtaaaagaagtg

SEQ ID NO: 8060862 - DNA, 23 bp, Homo sapiens
tcagagagctgttgagagctgcc

SEQ ID NO: 8060863 - DNA, 22 bp, Homo sapiens
tcctccagaaactgaggcagaa

SEQ ID NO: 8060864 - DNA, 22 bp, Homo sapiens
tccagggagcaagtcaggccgg

SEQ ID NO: 8060865 - DNA, 20 bp, Homo sapiens
ttcgctgggagtggccaggc

SEQ ID NO: 8060866 - DNA, 22 bp, Homo sapiens
ttgaccactgaatggttctgaa

SEQ ID NO: 8060867 - DNA, 19 bp, Homo sapiens
aacatggaactggagaggg

SEQ ID NO: 8060868 - DNA, 22 bp, Homo sapiens
aacggaattgtttcgtcaagca

SEQ ID NO: 8060869 - DNA, 22 bp, Homo sapiens
aagacagccagctccatgggat

SEQ ID NO: 8060870 - DNA, 22 bp, Homo sapiens
aagagagggatttggtttattg

SEQ ID NO: 8060871 - DNA, 22 bp, Homo sapiens
aagagagggacttattaaagtc

SEQ ID NO: 8060872 - DNA, 22 bp, Homo sapiens
aagagaggggttgcatggaaat

SEQ ID NO: 8060873 - DNA, 22 bp, Homo sapiens
aagagaggacatggtgaacctg

SEQ ID NO: 8060874 - DNA, 17 bp, Homo sapiens
aagagaggctgagctgg

SEQ ID NO: 8060875 - DNA, 22 bp, Homo sapiens
agctcctgtgtgcccacctgct

SEQ ID NO: 8060876 - DNA, 22 bp, Homo sapiens
agctcaagcgtgggctgggcgc

SEQ ID NO: 8060877 - DNA, 19 bp, Homo sapiens
agctcctgttcagcagctc

SEQ ID NO: 8060878 - DNA, 22 bp, Homo sapiens
agctcctgttctgagagcagga

SEQ ID NO: 8060879 - DNA, 20 bp, Homo sapiens
actccaggtggcatgaggac

SEQ ID NO: 8060880 - DNA, 22 bp, Homo sapiens
actccaggtgtgttggactcta

SEQ ID NO: 8060881 - DNA, 22 bp, Homo sapiens
actccaggttttttcactgaag

SEQ ID NO: 8060882 - DNA, 22 bp, Homo sapiens
actgcgctccagcctgggtgac

SEQ ID NO: 8060883 - DNA, 22 bp, Homo sapiens
agaggcagcagtcatactacag

SEQ ID NO: 8060884 - DNA, 17 bp, Homo sapiens
agaggcagatacttgga

SEQ ID NO: 8060885 - DNA, 22 bp, Homo sapiens
agagactgatggagctcactct

SEQ ID NO: 8060886 - DNA, 22 bp, Homo sapiens
agaccactggcctcctgcagac

SEQ ID NO: 8060887 - DNA, 22 bp, Homo sapiens
agaccactcaaaattagtgtct

SEQ ID NO: 8060888 - DNA, 22 bp, Homo sapiens
agacagctgggaaatggagtgt

SEQ ID NO: 8060889 - DNA, 22 bp, Homo sapiens
agacagctagggctgcagggac

SEQ ID NO: 8060890 - DNA, 22 bp, Homo sapiens
agacagctgctcgcagagctat

SEQ ID NO: 8060891 - DNA, 22 bp, Homo sapiens
cagctcaggctctccatgctcc

SEQ ID NO: 8060892 - DNA, 22 bp, Homo sapiens
agctcaggcaactctgggcccc

SEQ ID NO: 8060893 - DNA, 22 bp, Homo sapiens
agctcctgattctcagagatag

SEQ ID NO: 8060894 - DNA, 22 bp, Homo sapiens
agctcctgatacatgcaggaat

SEQ ID NO: 8060895 - DNA, 23 bp, Homo sapiens
agctcctgaggccagcctctcct

SEQ ID NO: 8060896 - DNA, 22 bp, Homo sapiens
agctcctgaaaatccagactgg

SEQ ID NO: 8060897 - DNA, 22 bp, Homo sapiens
cagctccaaagccccactgtcc

SEQ ID NO: 8060898 - DNA, 18 bp, Homo sapiens
agctcctgaactctgtgg

SEQ ID NO: 8060899 - DNA, 22 bp, Homo sapiens
agcagggtgtggtggccctgga

SEQ ID NO: 8060900 - DNA, 22 bp, Homo sapiens
actcctggtgctgatgaagaga

SEQ ID NO: 8060901 - DNA, 22 bp, Homo sapiens
actcctggttcccagttgagat

SEQ ID NO: 8060902 - DNA, 20 bp, Homo sapiens
agctgaagcccttggggaaa

SEQ ID NO: 8060903 - DNA, 22 bp, Homo sapiens
agctgaagtttagaattgtgaa

SEQ ID NO: 8060904 - DNA, 22 bp, Homo sapiens
agctgaagtcctcgcggtgcta

SEQ ID NO: 8060905 - DNA, 22 bp, Homo sapiens
cagggcctgcctggttcctgga

SEQ ID NO: 8060906 - DNA, 22 bp, Homo sapiens
agctgcagtgaactgttttgtc

SEQ ID NO: 8060907 - DNA, 22 bp, Homo sapiens
agctgcagataggatgttattt

SEQ ID NO: 8060908 - DNA, 22 bp, Homo sapiens
agggctgagtggtgcagtcaaa

SEQ ID NO: 8060909 - DNA, 23 bp, Homo sapiens
agggctgatgccattgcagctct

SEQ ID NO: 8060910 - DNA, 22 bp, Homo sapiens
ccagagagtaggaggcattatt

SEQ ID NO: 8060911 - DNA, 22 bp, Homo sapiens
agtggcagctgtcatgccctag

SEQ ID NO: 8060912 - DNA, 22 bp, Homo sapiens
ctccagggagctgcgggagcca

SEQ ID NO: 8060913 - DNA, 19 bp, Homo sapiens
aggtgtgggggctgcagac

SEQ ID NO: 8060914 - DNA, 22 bp, Homo sapiens
aggtctggaggcggagtcagga

SEQ ID NO: 8060915 - DNA, 22 bp, Homo sapiens
caaagaggtgagaggagccttt

SEQ ID NO: 8060916 - DNA, 22 bp, Homo sapiens
atgagaggtttcgtcagaggaa

SEQ ID NO: 8060917 - DNA, 21 bp, Homo sapiens
gagacagcccagtgccagggc

SEQ ID NO: 8060918 - DNA, 22 bp, Homo sapiens
gagacagcacaggccactggga

SEQ ID NO: 8060919 - DNA, 22 bp, Homo sapiens
cagagaggaggctatatgcaaa

SEQ ID NO: 8060920 - DNA, 22 bp, Homo sapiens
cagagaggatggattccatagc

SEQ ID NO: 8060921 - DNA, 22 bp, Homo sapiens
ggggccttggatctgtgccccg

SEQ ID NO: 8060922 - DNA, 22 bp, Homo sapiens
ggggccttttctgaatgtggaa

SEQ ID NO: 8060923 - DNA, 22 bp, Homo sapiens
gtaggccatggtggttgtctct

SEQ ID NO: 8060924 - DNA, 22 bp, Homo sapiens
caagctccttacatccacaggg

SEQ ID NO: 8060925 - DNA, 22 bp, Homo sapiens
ggagagaggctggccgtgatga

SEQ ID NO: 8060926 - DNA, 20 bp, Homo sapiens
ggaccagctgtctgaggggc

SEQ ID NO: 8060927 - DNA, 22 bp, Homo sapiens
cacagtcctgccagagggcctt

SEQ ID NO: 8060928 - DNA, 22 bp, Homo sapiens
cactcaggctgtgtcaggagga

SEQ ID NO: 8060929 - DNA, 21 bp, Homo sapiens
cactcagggtatgtgccaggc

SEQ ID NO: 8060930 - DNA, 22 bp, Homo sapiens
cactcagggatcaggtaaattc

SEQ ID NO: 8060931 - DNA, 22 bp, Homo sapiens
cactcagggtacaatggagggc

SEQ ID NO: 8060932 - DNA, 22 bp, Homo sapiens
cagggtgggcacccagcctcca

SEQ ID NO: 8060933 - DNA, 22 bp, Homo sapiens
ccagagaggccttggcaagaca

SEQ ID NO: 8060934 - DNA, 21 bp, Homo sapiens
ccagagagagggaagtgggtt

SEQ ID NO: 8060935 - DNA, 22 bp, Homo sapiens
ccagagagctacaaggcataaa

SEQ ID NO: 8060936 - DNA, 18 bp, Homo sapiens
cctggaggtcttcggggt

SEQ ID NO: 8060937 - DNA, 19 bp, Homo sapiens
cctggaggtgaaggttctc

SEQ ID NO: 8060938 - DNA, 22 bp, Homo sapiens
tggggtacttgtatcaaagcac

SEQ ID NO: 8060939 - DNA, 23 bp, Homo sapiens
cctgaagggtcagggtcctcagc

SEQ ID NO: 8060940 - DNA, 22 bp, Homo sapiens
cggagaggtgggggcagcatct

SEQ ID NO: 8060941 - DNA, 22 bp, Homo sapiens
ctccagaggatgcaggtgaggg

SEQ ID NO: 8060942 - DNA, 21 bp, Homo sapiens
ctcaggggattttgagattag

SEQ ID NO: 8060943 - DNA, 22 bp, Homo sapiens
ctcaggggacctggctccgagt

SEQ ID NO: 8060944 - DNA, 17 bp, Homo sapiens
ctagagagaaagagcta

SEQ ID NO: 8060945 - DNA, 22 bp, Homo sapiens
ctagagagccgctgtggaaaat

SEQ ID NO: 8060946 - DNA, 22 bp, Homo sapiens
ctagagaggtggtgttgggtgg

SEQ ID NO: 8060947 - DNA, 22 bp, Homo sapiens
ctcagagaaaaggagcaagggt

SEQ ID NO: 8060948 - DNA, 22 bp, Homo sapiens
ctcagagaagatggatgaggta

SEQ ID NO: 8060949 - DNA, 22 bp, Homo sapiens
ctcagagaacctaagcggagga

SEQ ID NO: 8060950 - DNA, 22 bp, Homo sapiens
ctcagagccccaggagggtgtg

SEQ ID NO: 8060951 - DNA, 17 bp, Homo sapiens
ctcagagagggtaagta

SEQ ID NO: 8060952 - DNA, 22 bp, Homo sapiens
ctggagaggccccaagatattt

SEQ ID NO: 8060953 - DNA, 22 bp, Homo sapiens
gaaactggatgcagggatgcag

SEQ ID NO: 8060954 - DNA, 22 bp, Homo sapiens
gaggagtctttccctaagtcct

SEQ ID NO: 8060955 - DNA, 22 bp, Homo sapiens
gagggcctctgctgctccacat

SEQ ID NO: 8060956 - DNA, 22 bp, Homo sapiens
gacagctccttttggtgcatat

SEQ ID NO: 8060957 - DNA, 22 bp, Homo sapiens
gacagctcctttctgaggatga

SEQ ID NO: 8060958 - DNA, 22 bp, Homo sapiens
gacagctccagctcctccaggc

SEQ ID NO: 8060959 - DNA, 22 bp, Homo sapiens
tagagaggtttgaattggctgc

SEQ ID NO: 8060960 - DNA, 16 bp, Homo sapiens
tagagagggcagggag

SEQ ID NO: 8060961 - DNA, 22 bp, Homo sapiens
tagagaggccgcgggtcccctc

SEQ ID NO: 8060962 - DNA, 22 bp, Homo sapiens
tagatactgcccattgagcaat

SEQ ID NO: 8060963 - DNA, 21 bp, Homo sapiens
tatggtaaccagacaagaatg

SEQ ID NO: 8060964 - DNA, 22 bp, Homo sapiens
tcctcaggtcaaagcaggagaa

SEQ ID NO: 8060965 - DNA, 22 bp, Homo sapiens
tcctaacgctggttctatcaac

SEQ ID NO: 8060966 - DNA, 20 bp, Homo sapiens
tcctaacgaggcccattgca

SEQ ID NO: 8060967 - DNA, 22 bp, Homo sapiens
tccagggacagcgctggagcta

SEQ ID NO: 8060968 - DNA, 21 bp, Homo sapiens
tccagggaacttctcaggaat

SEQ ID NO: 8060969 - DNA, 22 bp, Homo sapiens
gcagtgttggtttgctctgcag

SEQ ID NO: 8060970 - DNA, 22 bp, Homo sapiens
gcagtgttggcaggatggggct

SEQ ID NO: 8060971 - DNA, 22 bp, Homo sapiens
gcagtgtttcaaatcaaaggca

SEQ ID NO: 8060972 - DNA, 22 bp, Homo sapiens
gcagtgtttacatattagaaac

SEQ ID NO: 8060973 - DNA, 22 bp, Homo sapiens
gcagtgttgtgatccaggtctt

SEQ ID NO: 8060974 - DNA, 22 bp, Homo sapiens
gcagtgttgttaaaagattaga

SEQ ID NO: 8060975 - DNA, 22 bp, Homo sapiens
gcagtgtttcccagagatggaa

SEQ ID NO: 8060976 - DNA, 22 bp, Homo sapiens
gcagtgtttcagtgctttttct

SEQ ID NO: 8060977 - DNA, 23 bp, Homo sapiens
gcagtgtttgcttcatcttatcc

SEQ ID NO: 8060978 - DNA, 22 bp, Homo sapiens
gcagtgtttggatccatagcga

SEQ ID NO: 8060979 - DNA, 22 bp, Homo sapiens
gcagtgtttgtgttctcacatg

SEQ ID NO: 8060980 - DNA, 22 bp, Homo sapiens
gcagtgttttacagaccagcat

SEQ ID NO: 8060981 - DNA, 22 bp, Homo sapiens
gcagtgtttttcaatgcttcca

SEQ ID NO: 8060982 - DNA, 22 bp, Homo sapiens
ggactgcaacaggcttattcaa

SEQ ID NO: 8060983 - DNA, 20 bp, Homo sapiens
gctcagggcctgggtctgga

SEQ ID NO: 8060984 - DNA, 22 bp, Homo sapiens
gctgatagactgaatgttggga

SEQ ID NO: 8060985 - DNA, 22 bp, Homo sapiens
gtagttctgcagtgtcacctga

SEQ ID NO: 8060986 - DNA, 22 bp, Homo sapiens
gtagggctcagtaaatactttg

SEQ ID NO: 8060987 - DNA, 22 bp, Homo sapiens
ggaggcagaacttcccgtcagt

SEQ ID NO: 8060988 - DNA, 22 bp, Homo sapiens
aagaaggcggaccagaagggag

SEQ ID NO: 8060989 - DNA, 22 bp, Homo sapiens
agccagagattgagatgcaggc

SEQ ID NO: 8060990 - DNA, 22 bp, Homo sapiens
aatttcggttcaaggcccagtt

SEQ ID NO: 8060991 - DNA, 22 bp, Homo sapiens
agagaagggggaaagatctcac

SEQ ID NO: 8060992 - DNA, 22 bp, Homo sapiens
actgggaggcaaagagcaagga

SEQ ID NO: 8060993 - DNA, 22 bp, Homo sapiens
actgggagggtcttgaagaggg

SEQ ID NO: 8060994 - DNA, 22 bp, Homo sapiens
actgggagtcatgaggaaggag

SEQ ID NO: 8060995 - DNA, 22 bp, Homo sapiens
actgcagtcatcatctccctgg

SEQ ID NO: 8060996 - DNA, 22 bp, Homo sapiens
agctgaagatccagggttgggg

SEQ ID NO: 8060997 - DNA, 20 bp, Homo sapiens
agctgaagatctggatgggg

SEQ ID NO: 8060998 - DNA, 22 bp, Homo sapiens
agcgccactgcactccagcctg

SEQ ID NO: 8060999 - DNA, 22 bp, Homo sapiens
agggctgacaaatggcagtgac

SEQ ID NO: 8061000 - DNA, 22 bp, Homo sapiens
ccactcagttgctctctgtttt

SEQ ID NO: 8061001 - DNA, 17 bp, Homo sapiens
ccactcagtaatttctc

SEQ ID NO: 8061002 - DNA, 22 bp, Homo sapiens
ccactcaggcctcctgctctcc

SEQ ID NO: 8061003 - DNA, 22 bp, Homo sapiens
ccactcaggagcttatctatgc

SEQ ID NO: 8061004 - DNA, 20 bp, Homo sapiens
ccactcagctgtattctcag

SEQ ID NO: 8061005 - DNA, 22 bp, Homo sapiens
ccactcagaccaacgacccttc

SEQ ID NO: 8061006 - DNA, 22 bp, Homo sapiens
ccactcagcacagtggatgcag

SEQ ID NO: 8061007 - DNA, 22 bp, Homo sapiens
aggacagagggaccagagccca

SEQ ID NO: 8061008 - DNA, 22 bp, Homo sapiens
cctcagggtggcatcagatctt

SEQ ID NO: 8061009 - DNA, 22 bp, Homo sapiens
agggctgagcccaggcatgtag

SEQ ID NO: 8061010 - DNA, 22 bp, Homo sapiens
agggctgacagtggcgtggcgt

SEQ ID NO: 8061011 - DNA, 20 bp, Homo sapiens
ccactccgcccccagagggc

SEQ ID NO: 8061012 - DNA, 22 bp, Homo sapiens
ccagctccaggtagatgggcag

SEQ ID NO: 8061013 - DNA, 22 bp, Homo sapiens
ccagctcccctcagcaggtaat

SEQ ID NO: 8061014 - DNA, 23 bp, Homo sapiens
ccagctcccaggtctgaggactg

SEQ ID NO: 8061015 - DNA, 22 bp, Homo sapiens
ccagctccctgaagcctggtct

SEQ ID NO: 8061016 - DNA, 20 bp, Homo sapiens
ctccagggaacagactggag

SEQ ID NO: 8061017 - DNA, 22 bp, Homo sapiens
ctcctgggtcattgccagcaaa

SEQ ID NO: 8061018 - DNA, 22 bp, Homo sapiens
ctcctgggggacagcggcaggg

SEQ ID NO: 8061019 - DNA, 22 bp, Homo sapiens
ctcctgggaaatgaaggggcag

SEQ ID NO: 8061020 - DNA, 22 bp, Homo sapiens
ctccagggaaaggggcgtccgc

SEQ ID NO: 8061021 - DNA, 22 bp, Homo sapiens
ctgaaggaagcaggtggcctgt

SEQ ID NO: 8061022 - DNA, 22 bp, Homo sapiens
cagagggctgtgtaaggatgtt

SEQ ID NO: 8061023 - DNA, 22 bp, Homo sapiens
ggcttagcaactcctgaggctc

SEQ ID NO: 8061024 - DNA, 22 bp, Homo sapiens
cagctagaaagtctgttaggga

SEQ ID NO: 8061025 - DNA, 22 bp, Homo sapiens
ggactggggccaacacctccct

SEQ ID NO: 8061026 - DNA, 22 bp, Homo sapiens
ggactgggtaggagcccagggc

SEQ ID NO: 8061027 - DNA, 22 bp, Homo sapiens
cacagaggatgcccaagcgatc

SEQ ID NO: 8061028 - DNA, 22 bp, Homo sapiens
gagagaggcctccatgtactga

SEQ ID NO: 8061029 - DNA, 22 bp, Homo sapiens
gcagtgttacttggagtactaa

SEQ ID NO: 8061030 - DNA, 22 bp, Homo sapiens
gcagtgttacttggtttgcaga

SEQ ID NO: 8061031 - DNA, 22 bp, Homo sapiens
gcagtgttaccttgggctggtt

SEQ ID NO: 8061032 - DNA, 22 bp, Homo sapiens
gcagtgttacctcttcagtggg

SEQ ID NO: 8061033 - DNA, 22 bp, Homo sapiens
gcagtgttaatgcgagtgttca

SEQ ID NO: 8061034 - DNA, 22 bp, Homo sapiens
gcagtgttaaacaactgctgct

SEQ ID NO: 8061035 - DNA, 22 bp, Homo sapiens
ccaggaggttgaggctgcagtg

SEQ ID NO: 8061036 - DNA, 22 bp, Homo sapiens
tgacagtgtcagtttcctaata

SEQ ID NO: 8061037 - DNA, 23 bp, Homo sapiens
cagctcagcacataggaggtact

SEQ ID NO: 8061038 - DNA, 22 bp, Homo sapiens
tcagagagtgcaaaatatagct

SEQ ID NO: 8061039 - DNA, 21 bp, Homo sapiens
tcagagagtcacagtgaactg

SEQ ID NO: 8061040 - DNA, 16 bp, Homo sapiens
tcctaacgtgcagcca

SEQ ID NO: 8061041 - DNA, 22 bp, Homo sapiens
tcctaacgtataatttcaggtt

SEQ ID NO: 8061042 - DNA, 22 bp, Homo sapiens
ctgaccactgttctcctggggt

SEQ ID NO: 8061043 - DNA, 22 bp, Homo sapiens
ctacagagtatctaaagaggta

SEQ ID NO: 8061044 - DNA, 22 bp, Homo sapiens
gagctgaattgctgccatttgc

SEQ ID NO: 8061045 - DNA, 22 bp, Homo sapiens
gtccactcccagtgcctgaggc

SEQ ID NO: 8061046 - DNA, 22 bp, Homo sapiens
gtgcagtggcagatcctagctc

SEQ ID NO: 8061047 - DNA, 22 bp, Homo sapiens
gtgagagaaattggagggaatg

SEQ ID NO: 8061048 - DNA, 22 bp, Homo sapiens
ggtggcctgaattagctcaggg

SEQ ID NO: 8061049 - DNA, 22 bp, Homo sapiens
gggtaggcaaagcaatgacgtt

SEQ ID NO: 8061050 - DNA, 22 bp, Homo sapiens
ggccacagaacagctacaggac

SEQ ID NO: 8061051 - DNA, 22 bp, Homo sapiens
ggcctcagtgggccgctgcagg

SEQ ID NO: 8061052 - DNA, 22 bp, Homo sapiens
ggcctcagggtcactctgtaga

SEQ ID NO: 8061053 - DNA, 22 bp, Homo sapiens
ggagagagacctccatgcccag

SEQ ID NO: 8061054 - DNA, 22 bp, Homo sapiens
ggagagagagattgtgtttatt

SEQ ID NO: 8061055 - DNA, 22 bp, Homo sapiens
ggacacagctgcagccacaccc

SEQ ID NO: 8061056 - DNA, 22 bp, Homo sapiens
gctactgattgaccttggagag

SEQ ID NO: 8061057 - DNA, 20 bp, Homo sapiens
taacggaagctgtaaaatct

SEQ ID NO: 8061058 - DNA, 22 bp, Homo sapiens
tccagagaggtttctccatgct

SEQ ID NO: 8061059 - DNA, 22 bp, Homo sapiens
tccagagatcacactgggcagg

SEQ ID NO: 8061060 - DNA, 22 bp, Homo sapiens
tcagctcctcatgcaggggata

SEQ ID NO: 8061061 - DNA, 22 bp, Homo sapiens
tcagctcctcagagcctcagtt

SEQ ID NO: 8061062 - DNA, 22 bp, Homo sapiens
tcagctccagagttgcacagtg

SEQ ID NO: 8061063 - DNA, 22 bp, Homo sapiens
tcaataatggcaggataaattt

SEQ ID NO: 8061064 - DNA, 22 bp, Homo sapiens
tttgcagcctccctggcagaag

SEQ ID NO: 8061065 - DNA, 22 bp, Homo sapiens
ttcctaactggcctttatggat

SEQ ID NO: 8061066 - DNA, 22 bp, Homo sapiens
ttcctaactctggcacctagtc

SEQ ID NO: 8061067 - DNA, 22 bp, Homo sapiens
ttcctaacgccagtattttcat

SEQ ID NO: 8061068 - DNA, 22 bp, Homo sapiens
ttcctaacctctagctgcatat

SEQ ID NO: 8061069 - DNA, 22 bp, Homo sapiens
ttcctaacacagtgtaagcaag

SEQ ID NO: 8061070 - DNA, 22 bp, Homo sapiens
ttcctaacaagtctatctttga

SEQ ID NO: 8061071 - DNA, 22 bp, Homo sapiens
ttcctaacaaggggtattcatc

SEQ ID NO: 8061072 - DNA, 22 bp, Homo sapiens
tgttcctaaatatgaatggaga

SEQ ID NO: 8061073 - DNA, 22 bp, Homo sapiens
tgtggacattttttgtcagtag

SEQ ID NO: 8061074 - DNA, 18 bp, Homo sapiens
tgtggacatggctcttca

SEQ ID NO: 8061075 - DNA, 22 bp, Homo sapiens
tgtggacatactaggcctaggc

SEQ ID NO: 8061076 - DNA, 22 bp, Homo sapiens
tgtggacagtgatccctagtca

SEQ ID NO: 8061077 - DNA, 22 bp, Homo sapiens
tgtggacaggcagttggtggga

SEQ ID NO: 8061078 - DNA, 22 bp, Homo sapiens
tgtggacatagaagcatgtgga

SEQ ID NO: 8061079 - DNA, 22 bp, Homo sapiens
tgtggacagagcagaaggtcat

SEQ ID NO: 8061080 - DNA, 22 bp, Homo sapiens
tgtggacactagcagatacggt

SEQ ID NO: 8061081 - DNA, 22 bp, Homo sapiens
tgtggacactacgataggggaa

SEQ ID NO: 8061082 - DNA, 22 bp, Homo sapiens
tgtggacacctattaccagtga

SEQ ID NO: 8061083 - DNA, 22 bp, Homo sapiens
tgtggacagctcttcccatatg

SEQ ID NO: 8061084 - DNA, 22 bp, Homo sapiens
tgtggacagctctttgagtgct

SEQ ID NO: 8061085 - DNA, 22 bp, Homo sapiens
tgtggacagagccctggtttgg

SEQ ID NO: 8061086 - DNA, 22 bp, Homo sapiens
gcagtgtgtttctgagatatgg

SEQ ID NO: 8061087 - DNA, 22 bp, Homo sapiens
gcagtgtgtggtgagggctgcc

SEQ ID NO: 8061088 - DNA, 22 bp, Homo sapiens
gcatacagagaggatgtggcat

SEQ ID NO: 8061089 - DNA, 22 bp, Homo sapiens
gcagtgtgtctcttggcttcct

SEQ ID NO: 8061090 - DNA, 22 bp, Homo sapiens
gcagtgtgcatggcttttggcc

SEQ ID NO: 8061091 - DNA, 22 bp, Homo sapiens
gcagtgtgtagagtttaggaaa

SEQ ID NO: 8061092 - DNA, 23 bp, Homo sapiens
gcagtgtgaatccagtgtttcag

SEQ ID NO: 8061093 - DNA, 22 bp, Homo sapiens
gcagtgtgatgcttccagccac

SEQ ID NO: 8061094 - DNA, 22 bp, Homo sapiens
gcagtgtgaccgagcttgcttc

SEQ ID NO: 8061095 - DNA, 20 bp, Homo sapiens
gcagtgctggtgcctctgct

SEQ ID NO: 8061096 - DNA, 23 bp, Homo sapiens
gcagtgcttggcacagctgggtc

SEQ ID NO: 8061097 - DNA, 22 bp, Homo sapiens
gcatcagaatcatccggggaat

SEQ ID NO: 8061098 - DNA, 20 bp, Homo sapiens
attgtcagccttcagaggag

SEQ ID NO: 8061099 - DNA, 20 bp, Homo sapiens
gccaacgcgctggggctgcc

SEQ ID NO: 8061100 - DNA, 22 bp, Homo sapiens
attgtctttggtgcttccagga

SEQ ID NO: 8061101 - DNA, 22 bp, Homo sapiens
attgtctttggtgcttccagga

SEQ ID NO: 8061102 - DNA, 22 bp, Homo sapiens
attgtcttctggtcttatcttt

SEQ ID NO: 8061103 - DNA, 22 bp, Homo sapiens
gccaaagcagtcttgcctctgc

SEQ ID NO: 8061104 - DNA, 22 bp, Homo sapiens
gcagctggaagtgacactctgt

SEQ ID NO: 8061105 - DNA, 22 bp, Homo sapiens
gcagctgctgtggcatcaagct

SEQ ID NO: 8061106 - DNA, 22 bp, Homo sapiens
gcagctggacccacacggctta

SEQ ID NO: 8061107 - DNA, 22 bp, Homo sapiens
gcagctgccttcagctggatgg

SEQ ID NO: 8061108 - DNA, 22 bp, Homo sapiens
gcagctgcctattcagggcttg

SEQ ID NO: 8061109 - DNA, 22 bp, Homo sapiens
attctttaattcaattgaagga

SEQ ID NO: 8061110 - DNA, 22 bp, Homo sapiens
attctttacattggcttcttcc

SEQ ID NO: 8061111 - DNA, 22 bp, Homo sapiens
attcttgtttaatttgcatccc

SEQ ID NO: 8061112 - DNA, 22 bp, Homo sapiens
attctttagccagcaggtatat

SEQ ID NO: 8061113 - DNA, 18 bp, Homo sapiens
gcagggctgcacacgcat

SEQ ID NO: 8061114 - DNA, 22 bp, Homo sapiens
gatttccaggacgggaggtggg

SEQ ID NO: 8061115 - DNA, 22 bp, Homo sapiens
attacatatgttggcaacattt

SEQ ID NO: 8061116 - DNA, 22 bp, Homo sapiens
attcataacggcaaatgtcacc

SEQ ID NO: 8061117 - DNA, 22 bp, Homo sapiens
attcagtttcatggcacagcta

SEQ ID NO: 8061118 - DNA, 22 bp, Homo sapiens
gcagcagagtagacagagccct

SEQ ID NO: 8061119 - DNA, 22 bp, Homo sapiens
gcagcagagtttgggagatggt

SEQ ID NO: 8061120 - DNA, 22 bp, Homo sapiens
gcagcagagtttgggagatggt

SEQ ID NO: 8061121 - DNA, 22 bp, Homo sapiens
gcagcagatgctttcatggaca

SEQ ID NO: 8061122 - DNA, 22 bp, Homo sapiens
gcagcagatgctttcatggaca

SEQ ID NO: 8061123 - DNA, 22 bp, Homo sapiens
gcagatggaaagtgcttgaggg

SEQ ID NO: 8061124 - DNA, 22 bp, Homo sapiens
gcagatgctgtggtgatagaag

SEQ ID NO: 8061125 - DNA, 22 bp, Homo sapiens
attcagaattgtgggcagtaca

SEQ ID NO: 8061126 - DNA, 23 bp, Homo sapiens
attcagaattgtgtgtttgtata

SEQ ID NO: 8061127 - DNA, 22 bp, Homo sapiens
attcagaattttggggagctaa

SEQ ID NO: 8061128 - DNA, 22 bp, Homo sapiens
attcagaagctattcttagttc

SEQ ID NO: 8061129 - DNA, 22 bp, Homo sapiens
attcagaatggcaaacttctag

SEQ ID NO: 8061130 - DNA, 20 bp, Homo sapiens
attcagaataggcatgtaaa

SEQ ID NO: 8061131 - DNA, 22 bp, Homo sapiens
gcagcagagctttgtcctggct

SEQ ID NO: 8061132 - DNA, 22 bp, Homo sapiens
gcagcagagctttgtcctggct

SEQ ID NO: 8061133 - DNA, 22 bp, Homo sapiens
gcagcagaggccctactctttg

SEQ ID NO: 8061134 - DNA, 21 bp, Homo sapiens
gcagcagaggcttgacagaca

SEQ ID NO: 8061135 - DNA, 22 bp, Homo sapiens
gcagcagagaccccaggaagga

SEQ ID NO: 8061136 - DNA, 17 bp, Homo sapiens
gcagcagagagaccctc

SEQ ID NO: 8061137 - DNA, 22 bp, Homo sapiens
gcagcagagaacacaatgatgg

SEQ ID NO: 8061138 - DNA, 22 bp, Homo sapiens
gcagcagagaacacaatgatgg

SEQ ID NO: 8061139 - DNA, 22 bp, Homo sapiens
attcaagattaattctatgtca

SEQ ID NO: 8061140 - DNA, 22 bp, Homo sapiens
attcaagctgaatggtgacaga

SEQ ID NO: 8061141 - DNA, 22 bp, Homo sapiens
attcagaaactctgggcagaac

SEQ ID NO: 8061142 - DNA, 22 bp, Homo sapiens
attcagaaagatatgcctggtt

SEQ ID NO: 8061143 - DNA, 22 bp, Homo sapiens
attcagaaagcaagtgctgggt

SEQ ID NO: 8061144 - DNA, 22 bp, Homo sapiens
attcagaaagggttgcctggtt

SEQ ID NO: 8061145 - DNA, 22 bp, Homo sapiens
attcagaaagttgtcatatttg

SEQ ID NO: 8061146 - DNA, 22 bp, Homo sapiens
caaatgatacctattactaggc

SEQ ID NO: 8061147 - DNA, 22 bp, Homo sapiens
caaatgcatagtttataagaag

SEQ ID NO: 8061148 - DNA, 22 bp, Homo sapiens
caaatgctaacttctttccaaa

SEQ ID NO: 8061149 - DNA, 22 bp, Homo sapiens
caaatgcatgagaaataagagg

SEQ ID NO: 8061150 - DNA, 22 bp, Homo sapiens
caaatactgggtaagttaattt

SEQ ID NO: 8061151 - DNA, 22 bp, Homo sapiens
caaaggaggtaatgggtgtgag

SEQ ID NO: 8061152 - DNA, 22 bp, Homo sapiens
caaagtgctggaattacaggtg

SEQ ID NO: 8061153 - DNA, 22 bp, Homo sapiens
caaatactaaacataagatttt

SEQ ID NO: 8061154 - DNA, 22 bp, Homo sapiens
caaagcctctgatttcacttgt

SEQ ID NO: 8061155 - DNA, 22 bp, Homo sapiens
caaagcctctgatttcacttgt

SEQ ID NO: 8061156 - DNA, 18 bp, Homo sapiens
caaagctcacgttccatc

SEQ ID NO: 8061157 - DNA, 22 bp, Homo sapiens
caaagctcatgctcttagccat

SEQ ID NO: 8061158 - DNA, 22 bp, Homo sapiens
caaagctgtgaattcctacaaa

SEQ ID NO: 8061159 - DNA, 22 bp, Homo sapiens
caaaattgatgaatgtatgatt

SEQ ID NO: 8061160 - DNA, 22 bp, Homo sapiens
caaaattgatgaatgtatgatt

SEQ ID NO: 8061161 - DNA, 22 bp, Homo sapiens
caaaattgttgatgctgctttg

SEQ ID NO: 8061162 - DNA, 22 bp, Homo sapiens
caaaatgatgtgattttattgt

SEQ ID NO: 8061163 - DNA, 20 bp, Homo sapiens
caaagcagtaggataaaaat

SEQ ID NO: 8061164 - DNA, 22 bp, Homo sapiens
atttttgccctgcagtacataa

SEQ ID NO: 8061165 - DNA, 19 bp, Homo sapiens
atttttcttcctctgtgca

SEQ ID NO: 8061166 - DNA, 22 bp, Homo sapiens
atttttctctttccactgagat

SEQ ID NO: 8061167 - DNA, 22 bp, Homo sapiens
atttttctctcacacttaccag

SEQ ID NO: 8061168 - DNA, 22 bp, Homo sapiens
atttttctctccactccattaa

SEQ ID NO: 8061169 - DNA, 22 bp, Homo sapiens
atttttctctcacacttaccag

SEQ ID NO: 8061170 - DNA, 22 bp, Homo sapiens
attttgctttatgtaaatatgt

SEQ ID NO: 8061171 - DNA, 22 bp, Homo sapiens
atttttccatgatacttatctg

SEQ ID NO: 8061172 - DNA, 22 bp, Homo sapiens
atttttccaattaggataaaga

SEQ ID NO: 8061173 - DNA, 22 bp, Homo sapiens
gcctggattccttgtttctcag

SEQ ID NO: 8061174 - DNA, 22 bp, Homo sapiens
gcctggagttgtggtgaagcca

SEQ ID NO: 8061175 - DNA, 22 bp, Homo sapiens
gcctgaagtttcatgcctctat

SEQ ID NO: 8061176 - DNA, 22 bp, Homo sapiens
atttggaagtttggagtgaagg

SEQ ID NO: 8061177 - DNA, 22 bp, Homo sapiens
atttggaatagctgtagaaata

SEQ ID NO: 8061178 - DNA, 22 bp, Homo sapiens
gcctattttattatgcatgtaa

SEQ ID NO: 8061179 - DNA, 19 bp, Homo sapiens
gcctctgagggcaggacac

SEQ ID NO: 8061180 - DNA, 22 bp, Homo sapiens
gcctgaagaacagctgtgagga

SEQ ID NO: 8061181 - DNA, 22 bp, Homo sapiens
gcctaggagtacagaatggttt

SEQ ID NO: 8061182 - DNA, 22 bp, Homo sapiens
gcctaggagtggggatggcggt

SEQ ID NO: 8061183 - DNA, 22 bp, Homo sapiens
gcctaggagacaagcgtgaaag

SEQ ID NO: 8061184 - DNA, 22 bp, Homo sapiens
atttggaacttataataagttt

SEQ ID NO: 8061185 - DNA, 22 bp, Homo sapiens
atttggaaatgtaagaatgcaa

SEQ ID NO: 8061186 - DNA, 22 bp, Homo sapiens
atttggaaatgcatctcttgag

SEQ ID NO: 8061187 - DNA, 22 bp, Homo sapiens
gccccctctttggagccagcca

SEQ ID NO: 8061188 - DNA, 22 bp, Homo sapiens
gccccctctttggagccagcca

SEQ ID NO: 8061189 - DNA, 22 bp, Homo sapiens
gccccaggttgcctgtcccagg

SEQ ID NO: 8061190 - DNA, 22 bp, Homo sapiens
gcccacctaacctgctcacctt

SEQ ID NO: 8061191 - DNA, 22 bp, Homo sapiens
atttctggctgttggaaagttc

SEQ ID NO: 8061192 - DNA, 22 bp, Homo sapiens
atttccatgtcggtattttata

SEQ ID NO: 8061193 - DNA, 22 bp, Homo sapiens
atttccatgtccaaaaattagt

SEQ ID NO: 8061194 - DNA, 22 bp, Homo sapiens
atttccattatcatgacaaatt

SEQ ID NO: 8061195 - DNA, 22 bp, Homo sapiens
atttccattttcagccattact

SEQ ID NO: 8061196 - DNA, 22 bp, Homo sapiens
atttccatgccttagcttaagg

SEQ ID NO: 8061197 - DNA, 22 bp, Homo sapiens
atttccatgaattcccactcat

SEQ ID NO: 8061198 - DNA, 22 bp, Homo sapiens
atttccatgaagtttagttata

SEQ ID NO: 8061199 - DNA, 22 bp, Homo sapiens
atttccatgaaggcagatttta

SEQ ID NO: 8061200 - DNA, 22 bp, Homo sapiens
atttccatcatcattaggccta

SEQ ID NO: 8061201 - DNA, 22 bp, Homo sapiens
atttccatagagcgtctcacag

SEQ ID NO: 8061202 - DNA, 22 bp, Homo sapiens
atttccatacacccatttctga

SEQ ID NO: 8061203 - DNA, 22 bp, Homo sapiens
gccaggtgcatggctgagtctc

SEQ ID NO: 8061204 - DNA, 22 bp, Homo sapiens
gccaggctggtcttgaactcct

SEQ ID NO: 8061205 - DNA, 22 bp, Homo sapiens
gccaggctggtgcaaggatatt

SEQ ID NO: 8061206 - DNA, 22 bp, Homo sapiens
gccaggctggccagcaccttct

SEQ ID NO: 8061207 - DNA, 22 bp, Homo sapiens
gccaggctggaaagaacagaca

SEQ ID NO: 8061208 - DNA, 22 bp, Homo sapiens
gccaggctggcaaaaggaaacc

SEQ ID NO: 8061209 - DNA, 22 bp, Homo sapiens
gagagagctctgtgcctgggat

SEQ ID NO: 8061210 - DNA, 22 bp, Homo sapiens
gagagcacatgaacatggagga

SEQ ID NO: 8061211 - DNA, 22 bp, Homo sapiens
gagacatggcaaaagcactggt

SEQ ID NO: 8061212 - DNA, 22 bp, Homo sapiens
atggagggtggtaagacagaga

SEQ ID NO: 8061213 - DNA, 22 bp, Homo sapiens
gagatggggtcagctgggacat

SEQ ID NO: 8061214 - DNA, 22 bp, Homo sapiens
gagatggggaataggagcaagc

SEQ ID NO: 8061215 - DNA, 17 bp, Homo sapiens
gagatgggtggatcacc

SEQ ID NO: 8061216 - DNA, 22 bp, Homo sapiens
atggcttggcaccatctccttg

SEQ ID NO: 8061217 - DNA, 22 bp, Homo sapiens
atggggagagaagggctgagct

SEQ ID NO: 8061218 - DNA, 22 bp, Homo sapiens
atggggagagaagggctgagct

SEQ ID NO: 8061219 - DNA, 22 bp, Homo sapiens
atggggagagcctctgtcccca

SEQ ID NO: 8061220 - DNA, 22 bp, Homo sapiens
atggggagagaagggctgagct

SEQ ID NO: 8061221 - DNA, 22 bp, Homo sapiens
atggggagctcaccacctgttt

SEQ ID NO: 8061222 - DNA, 22 bp, Homo sapiens
atgggcagggcagtgtataaga

SEQ ID NO: 8061223 - DNA, 22 bp, Homo sapiens
gaggcagcctcagtggacctcg

SEQ ID NO: 8061224 - DNA, 22 bp, Homo sapiens
gaggcagcctcagtggacctcg

SEQ ID NO: 8061225 - DNA, 22 bp, Homo sapiens
gaggcagcatggtaccttggag

SEQ ID NO: 8061226 - DNA, 22 bp, Homo sapiens
gaggcagcatctatggtgggaa

SEQ ID NO: 8061227 - DNA, 21 bp, Homo sapiens
atggtggcacaaatttgatct

SEQ ID NO: 8061228 - DNA, 22 bp, Homo sapiens
gaggtggccaagcgaggaaggg

SEQ ID NO: 8061229 - DNA, 22 bp, Homo sapiens
gaggtggcctcaagcagtcttc

SEQ ID NO: 8061230 - DNA, 22 bp, Homo sapiens
gaggtggcactgtgaggagcac

SEQ ID NO: 8061231 - DNA, 22 bp, Homo sapiens
atgttctgttttgtaattcata

SEQ ID NO: 8061232 - DNA, 22 bp, Homo sapiens
atgttctgaataatgtgcatta

SEQ ID NO: 8061233 - DNA, 22 bp, Homo sapiens
atgttctgtttcttaatcttga

SEQ ID NO: 8061234 - DNA, 20 bp, Homo sapiens
atgttctgtggctgtcatgg

SEQ ID NO: 8061235 - DNA, 22 bp, Homo sapiens
atgttctgaatcaagcaactct

SEQ ID NO: 8061236 - DNA, 19 bp, Homo sapiens
atgttctgaattactgtaa

SEQ ID NO: 8061237 - DNA, 22 bp, Homo sapiens
atgttctgcctccattttgagt

SEQ ID NO: 8061238 - DNA, 22 bp, Homo sapiens
atgttggctggattttagattt

SEQ ID NO: 8061239 - DNA, 22 bp, Homo sapiens
atgttgtagcatatgaaatata

SEQ ID NO: 8061240 - DNA, 22 bp, Homo sapiens
atgttgcccattccaggagata

SEQ ID NO: 8061241 - DNA, 22 bp, Homo sapiens
atgttgtgtttgactgttaccc

SEQ ID NO: 8061242 - DNA, 22 bp, Homo sapiens
atgtttaaagggttgagaaata

SEQ ID NO: 8061243 - DNA, 22 bp, Homo sapiens
gagttcagtagttatagtctag

SEQ ID NO: 8061244 - DNA, 22 bp, Homo sapiens
gagttcagtgtttctagtagtg

SEQ ID NO: 8061245 - DNA, 22 bp, Homo sapiens
atgtgaaatattaagccgagga

SEQ ID NO: 8061246 - DNA, 21 bp, Homo sapiens
atgtgaaatatcatcagagca

SEQ ID NO: 8061247 - DNA, 22 bp, Homo sapiens
atgtgaaatagctggatatgaa

SEQ ID NO: 8061248 - DNA, 22 bp, Homo sapiens
atgtgaaagaggtgttcagtgg

SEQ ID NO: 8061249 - DNA, 22 bp, Homo sapiens
atgtcctcggctctgtgctgct

SEQ ID NO: 8061250 - DNA, 23 bp, Homo sapiens
atgtccccttcttgatgcctggc

SEQ ID NO: 8061251 - DNA, 22 bp, Homo sapiens
gaggcagcggctcacagagaaa

SEQ ID NO: 8061252 - DNA, 22 bp, Homo sapiens
atgtcgcctgaagcggaggctc

SEQ ID NO: 8061253 - DNA, 22 bp, Homo sapiens
atgctctggagtacgtgaaatt

SEQ ID NO: 8061254 - DNA, 22 bp, Homo sapiens
atgctcctcgagtgtctcacag

SEQ ID NO: 8061255 - DNA, 18 bp, Homo sapiens
atgctcctatctctgagc

SEQ ID NO: 8061256 - DNA, 22 bp, Homo sapiens
gacgagagactccatccaccac

SEQ ID NO: 8061257 - DNA, 22 bp, Homo sapiens
gacactaaagtatagggtatct

SEQ ID NO: 8061258 - DNA, 21 bp, Homo sapiens
gacacaaagggtagtaatggt

SEQ ID NO: 8061259 - DNA, 22 bp, Homo sapiens
gacacaaagtttgtcagaaatt

SEQ ID NO: 8061260 - DNA, 22 bp, Homo sapiens
gacaatttctcaatatagaaac

SEQ ID NO: 8061261 - DNA, 22 bp, Homo sapiens
gacataaagttcttgcttgaat

SEQ ID NO: 8061262 - DNA, 22 bp, Homo sapiens
gacataaatgaagtttgactat

SEQ ID NO: 8061263 - DNA, 22 bp, Homo sapiens
gaacaaacacatcccagcagtg

SEQ ID NO: 8061264 - DNA, 22 bp, Homo sapiens
gaacaaattggagaaatcagga

SEQ ID NO: 8061265 - DNA, 22 bp, Homo sapiens
gaaggctggctttctgagagca

SEQ ID NO: 8061266 - DNA, 22 bp, Homo sapiens
gaacaaggattcccaaagaaga

SEQ ID NO: 8061267 - DNA, 21 bp, Homo sapiens
gacaatgcagtcttttttgga

SEQ ID NO: 8061268 - DNA, 22 bp, Homo sapiens
gacaatgcagaagtacttgttc

SEQ ID NO: 8061269 - DNA, 22 bp, Homo sapiens
gaatcagataataagcaagcat

SEQ ID NO: 8061270 - DNA, 22 bp, Homo sapiens
gaatcagactgacctgagttca

SEQ ID NO: 8061271 - DNA, 22 bp, Homo sapiens
gaatacaaacttaaggctttac

SEQ ID NO: 8061272 - DNA, 22 bp, Homo sapiens
cttctttactttctagaaataa

SEQ ID NO: 8061273 - DNA, 22 bp, Homo sapiens
cttctttaccaagagatagagt

SEQ ID NO: 8061274 - DNA, 22 bp, Homo sapiens
cttctttaatgtatacaaaaga

SEQ ID NO: 8061275 - DNA, 22 bp, Homo sapiens
ctttccctgcttagaaggattt

SEQ ID NO: 8061276 - DNA, 22 bp, Homo sapiens
ctttccccagtatatcattgcc

SEQ ID NO: 8061277 - DNA, 22 bp, Homo sapiens
ctttccccaagcaccacagtgc

SEQ ID NO: 8061278 - DNA, 22 bp, Homo sapiens
ctttcccttagccccattctat

SEQ ID NO: 8061279 - DNA, 22 bp, Homo sapiens
ctttcctagatggccatctttc

SEQ ID NO: 8061280 - DNA, 22 bp, Homo sapiens
ctttctcttgagcaagagctgt

SEQ ID NO: 8061281 - DNA, 22 bp, Homo sapiens
atgaagaaactgttctgggtgg

SEQ ID NO: 8061282 - DNA, 22 bp, Homo sapiens
atgaaacagtgaattagtcaag

SEQ ID NO: 8061283 - DNA, 22 bp, Homo sapiens
atgaaacagtgtgtatagcaaa

SEQ ID NO: 8061284 - DNA, 22 bp, Homo sapiens
atgacataagtgaaaaacatca

SEQ ID NO: 8061285 - DNA, 22 bp, Homo sapiens
atgacataagtgaaaaacatca

SEQ ID NO: 8061286 - DNA, 22 bp, Homo sapiens
atgatgctgtttatcatatact

SEQ ID NO: 8061287 - DNA, 18 bp, Homo sapiens
atgatcttagcaaatatt

SEQ ID NO: 8061288 - DNA, 19 bp, Homo sapiens
gaaagtcatagagcttgtc

SEQ ID NO: 8061289 - DNA, 22 bp, Homo sapiens
cacagaggcaaccttctggggt

SEQ ID NO: 8061290 - DNA, 22 bp, Homo sapiens
cacagaggctcaaagccaggtg

SEQ ID NO: 8061291 - DNA, 22 bp, Homo sapiens
cacagagctcaagtcttagaaa

SEQ ID NO: 8061292 - DNA, 22 bp, Homo sapiens
cacagagagctacgtgcagcgt

SEQ ID NO: 8061293 - DNA, 22 bp, Homo sapiens
cacagaggaaaggcagttggta

SEQ ID NO: 8061294 - DNA, 22 bp, Homo sapiens
cacagaggactgtagcggggag

SEQ ID NO: 8061295 - DNA, 22 bp, Homo sapiens
ggactggggccaacacctccct

SEQ ID NO: 8061296 - DNA, 22 bp, Homo sapiens
ggactgggagaatggaggcaag

SEQ ID NO: 8061297 - DNA, 22 bp, Homo sapiens
cacagagaaaatgttggtgctt

SEQ ID NO: 8061298 - DNA, 22 bp, Homo sapiens
cacacaggagagtgctggaggt

SEQ ID NO: 8061299 - DNA, 22 bp, Homo sapiens
ggaagggcctcgggcgtgggac

SEQ ID NO: 8061300 - DNA, 22 bp, Homo sapiens
cacacagcaacaagaatagcca

SEQ ID NO: 8061301 - DNA, 22 bp, Homo sapiens
cacacagctagtgacaggagaa

SEQ ID NO: 8061302 - DNA, 22 bp, Homo sapiens
cacacagctagtgacaggagaa

SEQ ID NO: 8061303 - DNA, 21 bp, Homo sapiens
ggaagggctctgaggacggct

SEQ ID NO: 8061304 - DNA, 22 bp, Homo sapiens
ggaaggggagctggaaagggta

SEQ ID NO: 8061305 - DNA, 22 bp, Homo sapiens
cacagcttgtttagtgactcac

SEQ ID NO: 8061306 - DNA, 22 bp, Homo sapiens
ggaggccaaggcaggcggatca

SEQ ID NO: 8061307 - DNA, 22 bp, Homo sapiens
ggaggccaaggcaggtggatca

SEQ ID NO: 8061308 - DNA, 22 bp, Homo sapiens
ggaggccaaggaggagcttgcc

SEQ ID NO: 8061309 - DNA, 22 bp, Homo sapiens
ggaggccaaggagggcggatca

SEQ ID NO: 8061310 - DNA, 22 bp, Homo sapiens
ggaggcaggaaagacaggttca

SEQ ID NO: 8061311 - DNA, 22 bp, Homo sapiens
ggaggccaaagtgtgggcggct

SEQ ID NO: 8061312 - DNA, 22 bp, Homo sapiens
cacaggcttgtcagcatgaggc

SEQ ID NO: 8061313 - DNA, 20 bp, Homo sapiens
cacaggcttacagtttagat

SEQ ID NO: 8061314 - DNA, 22 bp, Homo sapiens
cacaggcttccagtccccagct

SEQ ID NO: 8061315 - DNA, 22 bp, Homo sapiens
cacagatgaagtaaacaactct

SEQ ID NO: 8061316 - DNA, 22 bp, Homo sapiens
ggagcctgcgggagctcccatt

SEQ ID NO: 8061317 - DNA, 22 bp, Homo sapiens
ggagcctgacagtgcccagcat

SEQ ID NO: 8061318 - DNA, 22 bp, Homo sapiens
ggagcctgagggccctcttgga

SEQ ID NO: 8061319 - DNA, 22 bp, Homo sapiens
ggagcctgagcggcccagggcc

SEQ ID NO: 8061320 - DNA, 22 bp, Homo sapiens
caaatgtaattgcggtttttgc

SEQ ID NO: 8061321 - DNA, 22 bp, Homo sapiens
caaggcaggaagcctgtcttat

SEQ ID NO: 8061322 - DNA, 22 bp, Homo sapiens
gctggctgtatcacctggccag

SEQ ID NO: 8061323 - DNA, 22 bp, Homo sapiens
gctggctgggtccctgagaggc

SEQ ID NO: 8061324 - DNA, 22 bp, Homo sapiens
caagggtggtattgggagcata

SEQ ID NO: 8061325 - DNA, 22 bp, Homo sapiens
caaggtgccatgctgggcgggg

SEQ ID NO: 8061326 - DNA, 22 bp, Homo sapiens
caaggtcacataacttgtcaaa

SEQ ID NO: 8061327 - DNA, 20 bp, Homo sapiens
caagggtttgcattggcttt

SEQ ID NO: 8061328 - DNA, 22 bp, Homo sapiens
caagtaatggttttataatagt

SEQ ID NO: 8061329 - DNA, 22 bp, Homo sapiens
caagtacaaaatgatatttagt

SEQ ID NO: 8061330 - DNA, 22 bp, Homo sapiens
caagtaaagaatcacatttctt

SEQ ID NO: 8061331 - DNA, 22 bp, Homo sapiens
gctgttcccttgtgcctctgtc

SEQ ID NO: 8061332 - DNA, 22 bp, Homo sapiens
gctgttcattagaaatagaatg

SEQ ID NO: 8061333 - DNA, 19 bp, Homo sapiens
gctgttctgaccatcaccc

SEQ ID NO: 8061334 - DNA, 22 bp, Homo sapiens
gctgttctgcaccagacttcag

SEQ ID NO: 8061335 - DNA, 22 bp, Homo sapiens
gctgttctgcgtcccaggctgg

SEQ ID NO: 8061336 - DNA, 22 bp, Homo sapiens
gctgttctgtccccatgggtaa

SEQ ID NO: 8061337 - DNA, 22 bp, Homo sapiens
gctgttctctgtaacatgcatt

SEQ ID NO: 8061338 - DNA, 20 bp, Homo sapiens
gctgttctgaagcagaaggc

SEQ ID NO: 8061339 - DNA, 22 bp, Homo sapiens
gctgttctagcttcagtttcgc

SEQ ID NO: 8061340 - DNA, 22 bp, Homo sapiens
gctgttctaggagctgtgagca

SEQ ID NO: 8061341 - DNA, 21 bp, Homo sapiens
gctgttctttcagctggtctt

SEQ ID NO: 8061342 - DNA, 22 bp, Homo sapiens
gctgttctttgcatctctggtg

SEQ ID NO: 8061343 - DNA, 18 bp, Homo sapiens
gctgttcttcgcactggc

SEQ ID NO: 8061344 - DNA, 22 bp, Homo sapiens
gctgttctttggtcaaaggtat

SEQ ID NO: 8061345 - DNA, 22 bp, Homo sapiens
caagtttacaatgtgtatgtgt

SEQ ID NO: 8061346 - DNA, 22 bp, Homo sapiens
gctttgcctccaaagaaaaagt

SEQ ID NO: 8061347 - DNA, 22 bp, Homo sapiens
gctttgcctgtagcattggcct

SEQ ID NO: 8061348 - DNA, 22 bp, Homo sapiens
caatgttccctgtactgctttt

SEQ ID NO: 8061349 - DNA, 19 bp, Homo sapiens
ggctgtctggcgtgtggat

SEQ ID NO: 8061350 - DNA, 22 bp, Homo sapiens
ggctgttcctctgagagctgat

SEQ ID NO: 8061351 - DNA, 22 bp, Homo sapiens
ggctgtccttggccaaggcact

SEQ ID NO: 8061352 - DNA, 21 bp, Homo sapiens
ggctggtgtttagctgtgata

SEQ ID NO: 8061353 - DNA, 22 bp, Homo sapiens
ggctggtgttgagtgcctgtag

SEQ ID NO: 8061354 - DNA, 22 bp, Homo sapiens
ggctgggaggatgacttgctac

SEQ ID NO: 8061355 - DNA, 22 bp, Homo sapiens
cagaaaggcacccactgggtct

SEQ ID NO: 8061356 - DNA, 22 bp, Homo sapiens
cagaaaggacagagtgagggtg

SEQ ID NO: 8061357 - DNA, 22 bp, Homo sapiens
cagaaacaggcaacgtgtgcac

SEQ ID NO: 8061358 - DNA, 22 bp, Homo sapiens
ggctgcctactttcccagagtt

SEQ ID NO: 8061359 - DNA, 22 bp, Homo sapiens
cagaaagcagagctgagccttt

SEQ ID NO: 8061360 - DNA, 23 bp, Homo sapiens
cagaaaacccagagctcagtccc

SEQ ID NO: 8061361 - DNA, 22 bp, Homo sapiens
cagaaaacctgactctagaact

SEQ ID NO: 8061362 - DNA, 22 bp, Homo sapiens
ggctccaggtttaagggtatgt

SEQ ID NO: 8061363 - DNA, 22 bp, Homo sapiens
ggcctctctccttggcttgcag

SEQ ID NO: 8061364 - DNA, 21 bp, Homo sapiens
ggcctgagcacctgtccacct

SEQ ID NO: 8061365 - DNA, 22 bp, Homo sapiens
ggcctgtgagcccttgcatgta

SEQ ID NO: 8061366 - DNA, 22 bp, Homo sapiens
ggcctgtgtctgtgcctgtcct

SEQ ID NO: 8061367 - DNA, 22 bp, Homo sapiens
ggctcaatgcaacttctgcctc

SEQ ID NO: 8061368 - DNA, 22 bp, Homo sapiens
ggctcaggctggagtgcagtgg

SEQ ID NO: 8061369 - DNA, 22 bp, Homo sapiens
ggctcagggaatgaggaagaat

SEQ ID NO: 8061370 - DNA, 22 bp, Homo sapiens
cacataaatggtgccatgtttt

SEQ ID NO: 8061371 - DNA, 22 bp, Homo sapiens
ggaggtggaggttgcaatgagc

SEQ ID NO: 8061372 - DNA, 22 bp, Homo sapiens
ggaggtgaggccgtagggtgtg

SEQ ID NO: 8061373 - DNA, 22 bp, Homo sapiens
cacatttagaggttagcatggt

SEQ ID NO: 8061374 - DNA, 22 bp, Homo sapiens
ggcaggcagtgtggtgtgaaac

SEQ ID NO: 8061375 - DNA, 22 bp, Homo sapiens
ggcagggaggaggtgaaagtga

SEQ ID NO: 8061376 - DNA, 22 bp, Homo sapiens
ggcatcaggagcttcttcaggt

SEQ ID NO: 8061377 - DNA, 22 bp, Homo sapiens
ggcatcaggatctgtcttgctt

SEQ ID NO: 8061378 - DNA, 22 bp, Homo sapiens
ggccactccgctgctactggaa

SEQ ID NO: 8061379 - DNA, 22 bp, Homo sapiens
ggccactgcctccgccatggct

SEQ ID NO: 8061380 - DNA, 22 bp, Homo sapiens
ggccactgtcctctagcccaga

SEQ ID NO: 8061381 - DNA, 22 bp, Homo sapiens
ggccactgtttcctgggcagtt

SEQ ID NO: 8061382 - DNA, 22 bp, Homo sapiens
ggccccaggtagaagatataga

SEQ ID NO: 8061383 - DNA, 22 bp, Homo sapiens
ggcctctctccctggcttgcag

SEQ ID NO: 8061384 - DNA, 22 bp, Homo sapiens
cacgcatgtggatcagatgaag

SEQ ID NO: 8061385 - DNA, 22 bp, Homo sapiens
cacctgttcattacccatccca

SEQ ID NO: 8061386 - DNA, 22 bp, Homo sapiens
cacctgttgtttattcatctct

SEQ ID NO: 8061387 - DNA, 22 bp, Homo sapiens
cagcctgtagaatacagtaaat

SEQ ID NO: 8061388 - DNA, 22 bp, Homo sapiens
cagcctggacagcgaccagagt

SEQ ID NO: 8061389 - DNA, 22 bp, Homo sapiens
cagcctggagccacagcccagg

SEQ ID NO: 8061390 - DNA, 20 bp, Homo sapiens
cagcctgcatcatctgcagc

SEQ ID NO: 8061391 - DNA, 22 bp, Homo sapiens
cagcctgcatttgtatctgtat

SEQ ID NO: 8061392 - DNA, 22 bp, Homo sapiens
cagcctgcaggaggccgtcagc

SEQ ID NO: 8061393 - DNA, 22 bp, Homo sapiens
cagcctctttccacatcaggca

SEQ ID NO: 8061394 - DNA, 22 bp, Homo sapiens
cagccctggaacagctgactca

SEQ ID NO: 8061395 - DNA, 23 bp, Homo sapiens
cagccctggagatgtgggaggca

SEQ ID NO: 8061396 - DNA, 22 bp, Homo sapiens
cagccctgcagccatggcctgt

SEQ ID NO: 8061397 - DNA, 22 bp, Homo sapiens
cagccctgctggttttgggcaa

SEQ ID NO: 8061398 - DNA, 22 bp, Homo sapiens
cagccctgctcttagtgtctcc

SEQ ID NO: 8061399 - DNA, 22 bp, Homo sapiens
cagccctgctgacactgtctga

SEQ ID NO: 8061400 - DNA, 18 bp, Homo sapiens
gtgctgtgggcagtggcc

SEQ ID NO: 8061401 - DNA, 22 bp, Homo sapiens
cagcaggcgttgggagaaagac

SEQ ID NO: 8061402 - DNA, 22 bp, Homo sapiens
cagcaggctctgagtggctgcc

SEQ ID NO: 8061403 - DNA, 22 bp, Homo sapiens
cagcagcttttgcattctcatt

SEQ ID NO: 8061404 - DNA, 22 bp, Homo sapiens
cagccaggtatgggcgtgcggg

SEQ ID NO: 8061405 - DNA, 22 bp, Homo sapiens
cagccagggagggcaaatgaga

SEQ ID NO: 8061406 - DNA, 22 bp, Homo sapiens
cagccagggtcaggcagcttct

SEQ ID NO: 8061407 - DNA, 22 bp, Homo sapiens
cagccagggtcaggcagcttct

SEQ ID NO: 8061408 - DNA, 22 bp, Homo sapiens
cagcccctcacagagctgtcct

SEQ ID NO: 8061409 - DNA, 22 bp, Homo sapiens
cagcccctccctcaggcaggtg

SEQ ID NO: 8061410 - DNA, 22 bp, Homo sapiens
cagccctcaggtcctcagcagc

SEQ ID NO: 8061411 - DNA, 22 bp, Homo sapiens
gtctgtctccctgtgactgaga

SEQ ID NO: 8061412 - DNA, 22 bp, Homo sapiens
gtctgtctgttgttgagaagca

SEQ ID NO: 8061413 - DNA, 22 bp, Homo sapiens
gtctgtctctctccagagtgca

SEQ ID NO: 8061414 - DNA, 22 bp, Homo sapiens
gtctgtctctctccagagtgca

SEQ ID NO: 8061415 - DNA, 22 bp, Homo sapiens
gtccctggtctaccgtggcttc

SEQ ID NO: 8061416 - DNA, 22 bp, Homo sapiens
gtcccttggctcacaaacagct

SEQ ID NO: 8061417 - DNA, 22 bp, Homo sapiens
gtccctggggaatcagctggag

SEQ ID NO: 8061418 - DNA, 22 bp, Homo sapiens
gtccctgggatgcccttctggg

SEQ ID NO: 8061419 - DNA, 22 bp, Homo sapiens
cagccaggcctggtgaccaaag

SEQ ID NO: 8061420 - DNA, 22 bp, Homo sapiens
cagccagggagcaaagagttga

SEQ ID NO: 8061421 - DNA, 22 bp, Homo sapiens
cagaccctcgggtgagttggcc

SEQ ID NO: 8061422 - DNA, 22 bp, Homo sapiens
cagacccttttctgagaggacc

SEQ ID NO: 8061423 - DNA, 22 bp, Homo sapiens
gggcagcagagccctgccgagt

SEQ ID NO: 8061424 - DNA, 22 bp, Homo sapiens
gggcagcatgaggaccctcatc

SEQ ID NO: 8061425 - DNA, 22 bp, Homo sapiens
gggcagcatgtcactagcatgg

SEQ ID NO: 8061426 - DNA, 22 bp, Homo sapiens
cagagacagaaaatggatctag

SEQ ID NO: 8061427 - DNA, 22 bp, Homo sapiens
cagagacagcaagttgatttcc

SEQ ID NO: 8061428 - DNA, 22 bp, Homo sapiens
gggcagcagcaggaggtctctg

SEQ ID NO: 8061429 - DNA, 21 bp, Homo sapiens
gggcagcagcagcaacaaggg

SEQ ID NO: 8061430 - DNA, 22 bp, Homo sapiens
gggcagcagaggatcccttaat

SEQ ID NO: 8061431 - DNA, 22 bp, Homo sapiens
gggcagcagagccctgccgagt

SEQ ID NO: 8061432 - DNA, 22 bp, Homo sapiens
gggcagcatcaggaggggcttt

SEQ ID NO: 8061433 - DNA, 22 bp, Homo sapiens
gggcagtggttacacagctgag

SEQ ID NO: 8061434 - DNA, 22 bp, Homo sapiens
gggcagtggttacacagctgag

SEQ ID NO: 8061435 - DNA, 22 bp, Homo sapiens
gggcagtggtccaggctacagc

SEQ ID NO: 8061436 - DNA, 22 bp, Homo sapiens
gggcagtggtccaggctacagc

SEQ ID NO: 8061437 - DNA, 22 bp, Homo sapiens
gggcagtgggtggctgcagcct

SEQ ID NO: 8061438 - DNA, 20 bp, Homo sapiens
gggcagtggcgctatctcag

SEQ ID NO: 8061439 - DNA, 20 bp, Homo sapiens
gggcagtggcgctatctcag

SEQ ID NO: 8061440 - DNA, 22 bp, Homo sapiens
gggcagtggctcacgcctgtaa

SEQ ID NO: 8061441 - DNA, 22 bp, Homo sapiens
gggcagtggctcacgcctgtaa

SEQ ID NO: 8061442 - DNA, 22 bp, Homo sapiens
gggcagtgggaccaggcaccag

SEQ ID NO: 8061443 - DNA, 22 bp, Homo sapiens
cagagacagtttcacagggtct

SEQ ID NO: 8061444 - DNA, 22 bp, Homo sapiens
cagagacagggcagggagtgtg

SEQ ID NO: 8061445 - DNA, 22 bp, Homo sapiens
cagagacaggagtgctcccagt

SEQ ID NO: 8061446 - DNA, 22 bp, Homo sapiens
cagagcctcagaatcctgtgga

SEQ ID NO: 8061447 - DNA, 22 bp, Homo sapiens
cagagcctcagaatcctgtgga

SEQ ID NO: 8061448 - DNA, 19 bp, Homo sapiens
cagagcctcagagctagaa

SEQ ID NO: 8061449 - DNA, 22 bp, Homo sapiens
cagagcctcatcatccactcca

SEQ ID NO: 8061450 - DNA, 19 bp, Homo sapiens
cagagcctcagagctagaa

SEQ ID NO: 8061451 - DNA, 22 bp, Homo sapiens
gggctgactctgcactgagcca

SEQ ID NO: 8061452 - DNA, 22 bp, Homo sapiens
gggccagagcttggcagctggg

SEQ ID NO: 8061453 - DNA, 22 bp, Homo sapiens
gggcagtgtctgcaaatgaaca

SEQ ID NO: 8061454 - DNA, 22 bp, Homo sapiens
gggcagtgtggtcgtgcctttg

SEQ ID NO: 8061455 - DNA, 22 bp, Homo sapiens
gggcagtgtctggcccccaggc

SEQ ID NO: 8061456 - DNA, 22 bp, Homo sapiens
gggcagtgtcgaggtctggtcc

SEQ ID NO: 8061457 - DNA, 22 bp, Homo sapiens
gggcagtgtcggggcccaggga

SEQ ID NO: 8061458 - DNA, 22 bp, Homo sapiens
cagagcctctcagccccttggg

SEQ ID NO: 8061459 - DNA, 22 bp, Homo sapiens
cagagcctctgccctgggcact

SEQ ID NO: 8061460 - DNA, 22 bp, Homo sapiens
cagagcctgcctctggctgtgg

SEQ ID NO: 8061461 - DNA, 22 bp, Homo sapiens
cagagcctgccacctttctccc

SEQ ID NO: 8061462 - DNA, 23 bp, Homo sapiens
cagagctggctcagagctgcctg

SEQ ID NO: 8061463 - DNA, 22 bp, Homo sapiens
cagagctgcttcccagtttgtg

SEQ ID NO: 8061464 - DNA, 22 bp, Homo sapiens
cagagctggctctgcatgtaca

SEQ ID NO: 8061465 - DNA, 22 bp, Homo sapiens
cagagcctgctcacgtctctgt

SEQ ID NO: 8061466 - DNA, 20 bp, Homo sapiens
cagagctgggatttgaacac

SEQ ID NO: 8061467 - DNA, 22 bp, Homo sapiens
cagagctgggcatggtgaaagg

SEQ ID NO: 8061468 - DNA, 22 bp, Homo sapiens
cagagctggggactgttggatg

SEQ ID NO: 8061469 - DNA, 23 bp, Homo sapiens
cagagctggcttcatgggtgtgc

SEQ ID NO: 8061470 - DNA, 22 bp, Homo sapiens
cagagctgggatcccatgggcg

SEQ ID NO: 8061471 - DNA, 22 bp, Homo sapiens
cagagctgggtttgggaaacct

SEQ ID NO: 8061472 - DNA, 22 bp, Homo sapiens
gggctgaggggtatctcatggg

SEQ ID NO: 8061473 - DNA, 22 bp, Homo sapiens
cagagggctcttggctgcctgc

SEQ ID NO: 8061474 - DNA, 22 bp, Homo sapiens
cagagggctcagtcctgctgga

SEQ ID NO: 8061475 - DNA, 21 bp, Homo sapiens
cagaggggctagcctggctgc

SEQ ID NO: 8061476 - DNA, 21 bp, Homo sapiens
cagaggggctagcctggctgc

SEQ ID NO: 8061477 - DNA, 22 bp, Homo sapiens
cagaggggctgacacccttggc

SEQ ID NO: 8061478 - DNA, 22 bp, Homo sapiens
cagaggggataacaggtgtaga

SEQ ID NO: 8061479 - DNA, 22 bp, Homo sapiens
cagaggggataacaggtgtaga

SEQ ID NO: 8061480 - DNA, 22 bp, Homo sapiens
cagaggggtgtagagatcactg

SEQ ID NO: 8061481 - DNA, 22 bp, Homo sapiens
ggggagagtcctttccagttcc

SEQ ID NO: 8061482 - DNA, 22 bp, Homo sapiens
cagaggcacagtgcgggccact

SEQ ID NO: 8061483 - DNA, 22 bp, Homo sapiens
ggggagcaggctgggctgtctg

SEQ ID NO: 8061484 - DNA, 22 bp, Homo sapiens
cagagtcttgtgtgttcagccc

SEQ ID NO: 8061485 - DNA, 22 bp, Homo sapiens
cagagtcctggacacagagaca

SEQ ID NO: 8061486 - DNA, 19 bp, Homo sapiens
cagagtccttgaccagtcc

SEQ ID NO: 8061487 - DNA, 22 bp, Homo sapiens
cagcaagatttttaaagcaagg

SEQ ID NO: 8061488 - DNA, 17 bp, Homo sapiens
ggtgagacctcccactc

SEQ ID NO: 8061489 - DNA, 22 bp, Homo sapiens
ggtgactggtttatctggcagt

SEQ ID NO: 8061490 - DNA, 22 bp, Homo sapiens
ggtgactggagggacccaggcc

SEQ ID NO: 8061491 - DNA, 19 bp, Homo sapiens
ggtgaccacctggtcagtg

SEQ ID NO: 8061492 - DNA, 22 bp, Homo sapiens
ggtgacctcacctggtcccacc

SEQ ID NO: 8061493 - DNA, 22 bp, Homo sapiens
ggtgacagtggttaaaatttgt

SEQ ID NO: 8061494 - DNA, 22 bp, Homo sapiens
cagcaccatttgcagcctcttt

SEQ ID NO: 8061495 - DNA, 22 bp, Homo sapiens
ggtgctggacacgtggcactcc

SEQ ID NO: 8061496 - DNA, 22 bp, Homo sapiens
ctgacacactgagcatttgata

SEQ ID NO: 8061497 - DNA, 22 bp, Homo sapiens
ctgaattctgccttgaggcctt

SEQ ID NO: 8061498 - DNA, 22 bp, Homo sapiens
ctgaatgtcgatcagcttgggt

SEQ ID NO: 8061499 - DNA, 22 bp, Homo sapiens
ctgagcagatgttgcccagaag

SEQ ID NO: 8061500 - DNA, 22 bp, Homo sapiens
ctgagcagcaccttcaagaaac

SEQ ID NO: 8061501 - DNA, 22 bp, Homo sapiens
ctgagcagcacagggcgccagg

SEQ ID NO: 8061502 - DNA, 22 bp, Homo sapiens
ctgaggagaggtggcctgtgtt

SEQ ID NO: 8061503 - DNA, 22 bp, Homo sapiens
agttaactctgaaaagacattt

SEQ ID NO: 8061504 - DNA, 22 bp, Homo sapiens
agttaagagtgtgaaaatgtta

SEQ ID NO: 8061505 - DNA, 22 bp, Homo sapiens
agttagaatataattatgttaa

SEQ ID NO: 8061506 - DNA, 22 bp, Homo sapiens
agttagcagcttattagaaaca

SEQ ID NO: 8061507 - DNA, 22 bp, Homo sapiens
ctctggctttgctcatgcatcc

SEQ ID NO: 8061508 - DNA, 22 bp, Homo sapiens
ctctggcttgttaatgcatatt

SEQ ID NO: 8061509 - DNA, 22 bp, Homo sapiens
ctctggctttaaggatgccaca

SEQ ID NO: 8061510 - DNA, 22 bp, Homo sapiens
ctgaaagggttacatagtaagt

SEQ ID NO: 8061511 - DNA, 22 bp, Homo sapiens
ctgaaaggtataaataagactt

SEQ ID NO: 8061512 - DNA, 22 bp, Homo sapiens
ctctgggcttgttgacctgcac

SEQ ID NO: 8061513 - DNA, 22 bp, Homo sapiens
ctctgctgagccagagtcccca

SEQ ID NO: 8061514 - DNA, 22 bp, Homo sapiens
ctctgcaggccttgagtgtggt

SEQ ID NO: 8061515 - DNA, 22 bp, Homo sapiens
ctctcaggcttgggtcgtggca

SEQ ID NO: 8061516 - DNA, 22 bp, Homo sapiens
ctctgagcccgctgcagcccca

SEQ ID NO: 8061517 - DNA, 22 bp, Homo sapiens
ctccagcttctgcccagagact

SEQ ID NO: 8061518 - DNA, 22 bp, Homo sapiens
ctccagctgagtaagaacacta

SEQ ID NO: 8061519 - DNA, 22 bp, Homo sapiens
agtcttcccagaggaggtgcca

SEQ ID NO: 8061520 - DNA, 22 bp, Homo sapiens
agtcttccctgtgccagagtgt

SEQ ID NO: 8061521 - DNA, 22 bp, Homo sapiens
agtcttccctgtgccagagtgt

SEQ ID NO: 8061522 - DNA, 23 bp, Homo sapiens
agtcttcattgtatttccagacc

SEQ ID NO: 8061523 - DNA, 22 bp, Homo sapiens
agtcctggccccaaggaaggat

SEQ ID NO: 8061524 - DNA, 22 bp, Homo sapiens
ctcatggatataagaactgttt

SEQ ID NO: 8061525 - DNA, 22 bp, Homo sapiens
ctcattgcccagatccccacag

SEQ ID NO: 8061526 - DNA, 22 bp, Homo sapiens
agtccctgtactttccactgcc

SEQ ID NO: 8061527 - DNA, 20 bp, Homo sapiens
agtccctttggtcaggtatt

SEQ ID NO: 8061528 - DNA, 22 bp, Homo sapiens
ctcctgggaatttagttgtgag

SEQ ID NO: 8061529 - DNA, 22 bp, Homo sapiens
agtggcagagctgtgtcttgaa

SEQ ID NO: 8061530 - DNA, 22 bp, Homo sapiens
agtggcagaggttgactgcagt

SEQ ID NO: 8061531 - DNA, 22 bp, Homo sapiens
agtggcagatctctggtctgga

SEQ ID NO: 8061532 - DNA, 22 bp, Homo sapiens
ctccagggaaaggggcgtccgc

SEQ ID NO: 8061533 - DNA, 22 bp, Homo sapiens
ctccagggaaaggggcgtccgc

SEQ ID NO: 8061534 - DNA, 20 bp, Homo sapiens
ctccagggaacagactggag

SEQ ID NO: 8061535 - DNA, 20 bp, Homo sapiens
ctccagggaacagactggag

SEQ ID NO: 8061536 - DNA, 18 bp, Homo sapiens
ctccagggaactcagtca

SEQ ID NO: 8061537 - DNA, 22 bp, Homo sapiens
ctcccaggttgattctttccct

SEQ ID NO: 8061538 - DNA, 22 bp, Homo sapiens
ctccctctcaccggagccctgg

SEQ ID NO: 8061539 - DNA, 22 bp, Homo sapiens
ctccctctcaccggagccctgg

SEQ ID NO: 8061540 - DNA, 22 bp, Homo sapiens
ctccctctcaccggagccctgg

SEQ ID NO: 8061541 - DNA, 22 bp, Homo sapiens
ctcctcactttccagactgggc

SEQ ID NO: 8061542 - DNA, 22 bp, Homo sapiens
ctcctcacacccactgcaacca

SEQ ID NO: 8061543 - DNA, 22 bp, Homo sapiens
ctcctacattccaccttggact

SEQ ID NO: 8061544 - DNA, 22 bp, Homo sapiens
ctcctacagtgtttgagtccag

SEQ ID NO: 8061545 - DNA, 22 bp, Homo sapiens
cctggatgatccatgtcatgga

SEQ ID NO: 8061546 - DNA, 23 bp, Homo sapiens
cctggagtactaaggggatggaa

SEQ ID NO: 8061547 - DNA, 22 bp, Homo sapiens
cctggagttttttggttgactc

SEQ ID NO: 8061548 - DNA, 22 bp, Homo sapiens
cctgccagcatggcttatctcc

SEQ ID NO: 8061549 - DNA, 22 bp, Homo sapiens
cctgccagcccgcgttcatgcc

SEQ ID NO: 8061550 - DNA, 22 bp, Homo sapiens
cctgccagatcccctgagctga

SEQ ID NO: 8061551 - DNA, 22 bp, Homo sapiens
cctgcagctccggatttctggg

SEQ ID NO: 8061552 - DNA, 21 bp, Homo sapiens
cctgcagcaccagaaggagat

SEQ ID NO: 8061553 - DNA, 21 bp, Homo sapiens
cctgccaggaaactgagtgtc

SEQ ID NO: 8061554 - DNA, 21 bp, Homo sapiens
cctgccaggaaactgagtgtc

SEQ ID NO: 8061555 - DNA, 22 bp, Homo sapiens
aggtagggttaatggagatata

SEQ ID NO: 8061556 - DNA, 22 bp, Homo sapiens
aggtggggcccaccaatttgca

SEQ ID NO: 8061557 - DNA, 21 bp, Homo sapiens
aggtggggctgcacctctgct

SEQ ID NO: 8061558 - DNA, 21 bp, Homo sapiens
aggtggggctgcacctctgct

SEQ ID NO: 8061559 - DNA, 22 bp, Homo sapiens
aggtggggccaaatgctacagt

SEQ ID NO: 8061560 - DNA, 22 bp, Homo sapiens
aggtggggccaaatgctacagt

SEQ ID NO: 8061561 - DNA, 22 bp, Homo sapiens
aggtggggagtatatgtaattg

SEQ ID NO: 8061562 - DNA, 22 bp, Homo sapiens
aggtggggaggagtgtctcttt

SEQ ID NO: 8061563 - DNA, 22 bp, Homo sapiens
aggtggggaggagtgtctcttt

SEQ ID NO: 8061564 - DNA, 22 bp, Homo sapiens
cctgtcctccaagagcacatct

SEQ ID NO: 8061565 - DNA, 22 bp, Homo sapiens
cctgtcctccaagagcacatct

SEQ ID NO: 8061566 - DNA, 22 bp, Homo sapiens
cctgtgacattagaatttcatt

SEQ ID NO: 8061567 - DNA, 22 bp, Homo sapiens
cctgtgaggtcatctgtggtaa

SEQ ID NO: 8061568 - DNA, 22 bp, Homo sapiens
cctgtgcatccggtggtcattg

SEQ ID NO: 8061569 - DNA, 22 bp, Homo sapiens
cctgggcataaatcactccaag

SEQ ID NO: 8061570 - DNA, 22 bp, Homo sapiens
cctgggcataaatcactccaag

SEQ ID NO: 8061571 - DNA, 22 bp, Homo sapiens
agtccagggctctctgtgggat

SEQ ID NO: 8061572 - DNA, 22 bp, Homo sapiens
ctagaacagtcaaagtgagctc

SEQ ID NO: 8061573 - DNA, 22 bp, Homo sapiens
ctagtccagtctcaaaatgcta

SEQ ID NO: 8061574 - DNA, 22 bp, Homo sapiens
ctagtccactgtcctgcctcca

SEQ ID NO: 8061575 - DNA, 22 bp, Homo sapiens
agtatttagagacacaagatgg

SEQ ID NO: 8061576 - DNA, 22 bp, Homo sapiens
agtatttagagacacaagatgg

SEQ ID NO: 8061577 - DNA, 22 bp, Homo sapiens
ctacccagatccaggatggcta

SEQ ID NO: 8061578 - DNA, 22 bp, Homo sapiens
ctacattttaataagctgctta

SEQ ID NO: 8061579 - DNA, 22 bp, Homo sapiens
ctacattttgtgattatgaaat

SEQ ID NO: 8061580 - DNA, 22 bp, Homo sapiens
ctacatttgttcaaataagctg

SEQ ID NO: 8061581 - DNA, 22 bp, Homo sapiens
ctacatttgttctatagctttt

SEQ ID NO: 8061582 - DNA, 22 bp, Homo sapiens
ctacatttcccagctgccttcc

SEQ ID NO: 8061583 - DNA, 22 bp, Homo sapiens
cgggcagatcacacagggcttg

SEQ ID NO: 8061584 - DNA, 22 bp, Homo sapiens
cgggcagattgggaaggttcat

SEQ ID NO: 8061585 - DNA, 21 bp, Homo sapiens
cgggctggccgggccctcacc

SEQ ID NO: 8061586 - DNA, 22 bp, Homo sapiens
agtacacacagtagaatagagt

SEQ ID NO: 8061587 - DNA, 22 bp, Homo sapiens
cctgttcactttgacttctcca

SEQ ID NO: 8061588 - DNA, 22 bp, Homo sapiens
cctgttcactgcacagtttccg

SEQ ID NO: 8061589 - DNA, 20 bp, Homo sapiens
cctgttcactgcgcagtttc

SEQ ID NO: 8061590 - DNA, 22 bp, Homo sapiens
cctgttcaccatggtcacgtgc

SEQ ID NO: 8061591 - DNA, 22 bp, Homo sapiens
cctgttcaccctccatgcacag

SEQ ID NO: 8061592 - DNA, 22 bp, Homo sapiens
cctgttcagagctaagcatcat

SEQ ID NO: 8061593 - DNA, 19 bp, Homo sapiens
cctgttcatgactctgtcc

SEQ ID NO: 8061594 - DNA, 22 bp, Homo sapiens
cctgttcattttttgactctgc

SEQ ID NO: 8061595 - DNA, 22 bp, Homo sapiens
cctgttcaatgccctggcttca

SEQ ID NO: 8061596 - DNA, 22 bp, Homo sapiens
cctgttcaatattcttccttgt

SEQ ID NO: 8061597 - DNA, 21 bp, Homo sapiens
cctgttcacagatctgtaact

SEQ ID NO: 8061598 - DNA, 22 bp, Homo sapiens
cctgttcaagggatgattgacc

SEQ ID NO: 8061599 - DNA, 22 bp, Homo sapiens
ctggctggccggaggcatccct

SEQ ID NO: 8061600 - DNA, 22 bp, Homo sapiens
ctggctgggagcgagctgctca

SEQ ID NO: 8061601 - DNA, 22 bp, Homo sapiens
ctggcttcctcaggagcagtgg

SEQ ID NO: 8061602 - DNA, 22 bp, Homo sapiens
ctggcttccatgctgtagtggc

SEQ ID NO: 8061603 - DNA, 22 bp, Homo sapiens
ctgggctcagatgagaggaagg

SEQ ID NO: 8061604 - DNA, 22 bp, Homo sapiens
atatgcagtctcttgcccttct

SEQ ID NO: 8061605 - DNA, 22 bp, Homo sapiens
atattgaaccctacagactgta

SEQ ID NO: 8061606 - DNA, 22 bp, Homo sapiens
atattgatcttggaactgattt

SEQ ID NO: 8061607 - DNA, 22 bp, Homo sapiens
atatttaaacagggtaccaata

SEQ ID NO: 8061608 - DNA, 22 bp, Homo sapiens
atattgggatgtttggaaatgc

SEQ ID NO: 8061609 - DNA, 22 bp, Homo sapiens
atattgtactagggttacatgt

SEQ ID NO: 8061610 - DNA, 22 bp, Homo sapiens
atattgtactagggttacatgt

SEQ ID NO: 8061611 - DNA, 20 bp, Homo sapiens
atcaaaggctgattcagtcc

SEQ ID NO: 8061612 - DNA, 23 bp, Homo sapiens
atcaaaggatgtagagaagaagc

SEQ ID NO: 8061613 - DNA, 22 bp, Homo sapiens
atcagaaagttcatcatgtttg

SEQ ID NO: 8061614 - DNA, 22 bp, Homo sapiens
atcagaaaggtgggcaagcaga

SEQ ID NO: 8061615 - DNA, 22 bp, Homo sapiens
atcagaaatagtcatgttactt

SEQ ID NO: 8061616 - DNA, 21 bp, Homo sapiens
atcagaaaatgtaatggagca

SEQ ID NO: 8061617 - DNA, 22 bp, Homo sapiens
atcagaaactcttagagcaggg

SEQ ID NO: 8061618 - DNA, 22 bp, Homo sapiens
atcagaaactcttagagcaggg

SEQ ID NO: 8061619 - DNA, 22 bp, Homo sapiens
atcagaaaatacccagtgttta

SEQ ID NO: 8061620 - DNA, 22 bp, Homo sapiens
atcagaatagtgggggacagtc

SEQ ID NO: 8061621 - DNA, 21 bp, Homo sapiens
atcagaagttttggtcagtag

SEQ ID NO: 8061622 - DNA, 22 bp, Homo sapiens
atcagaagaaatggatgtgact

SEQ ID NO: 8061623 - DNA, 22 bp, Homo sapiens
atcagaaattgcccagctgttt

SEQ ID NO: 8061624 - DNA, 22 bp, Homo sapiens
atcagaaattgcccagctgttt

SEQ ID NO: 8061625 - DNA, 22 bp, Homo sapiens
atcagaagcttgtagtctctct

SEQ ID NO: 8061626 - DNA, 22 bp, Homo sapiens
cttcctcctccatctcgaaggc

SEQ ID NO: 8061627 - DNA, 22 bp, Homo sapiens
cttcttaatgacagattaaaat

SEQ ID NO: 8061628 - DNA, 22 bp, Homo sapiens
cttcttgctgggggcctcagtg

SEQ ID NO: 8061629 - DNA, 22 bp, Homo sapiens
cttcttgcaattttcatcttat

SEQ ID NO: 8061630 - DNA, 19 bp, Homo sapiens
atctgaggcctcatctggg

SEQ ID NO: 8061631 - DNA, 22 bp, Homo sapiens
atctgagtctctgacagcatgt

SEQ ID NO: 8061632 - DNA, 22 bp, Homo sapiens
cttagaaattgttactcattca

SEQ ID NO: 8061633 - DNA, 21 bp, Homo sapiens
cttcccaaggcttcaaagcct

SEQ ID NO: 8061634 - DNA, 22 bp, Homo sapiens
cttccaggtgctggcctggcct

SEQ ID NO: 8061635 - DNA, 22 bp, Homo sapiens
cttcccactagtatcacagagc

SEQ ID NO: 8061636 - DNA, 22 bp, Homo sapiens
cttcctcacggtgcaacaggaa

SEQ ID NO: 8061637 - DNA, 22 bp, Homo sapiens
cttcctcccccacacactcact

SEQ ID NO: 8061638 - DNA, 22 bp, Homo sapiens
cttcctcccggcccatgctctg

SEQ ID NO: 8061639 - DNA, 22 bp, Homo sapiens
ctgtgggagaagctagcacagg

SEQ ID NO: 8061640 - DNA, 22 bp, Homo sapiens
ctgtgggaatactgcgagtgta

SEQ ID NO: 8061641 - DNA, 22 bp, Homo sapiens
ctgtggctcaaaatcccatgat

SEQ ID NO: 8061642 - DNA, 22 bp, Homo sapiens
ctgtggctaggaagctgtggga

SEQ ID NO: 8061643 - DNA, 22 bp, Homo sapiens
ctgtggctatggtgtacatact

SEQ ID NO: 8061644 - DNA, 22 bp, Homo sapiens
atcagaattagccagtgaggct

SEQ ID NO: 8061645 - DNA, 22 bp, Homo sapiens
atcagagacaaaaccagcactt

SEQ ID NO: 8061646 - DNA, 22 bp, Homo sapiens
atcagagaccggtcaagtcatg

SEQ ID NO: 8061647 - DNA, 22 bp, Homo sapiens
atccagggataaaagtaaggtt

SEQ ID NO: 8061648 - DNA, 22 bp, Homo sapiens
atccagggtgtggagagagctc

SEQ ID NO: 8061649 - DNA, 19 bp, Homo sapiens
atccaggtcatgtagttct

SEQ ID NO: 8061650 - DNA, 22 bp, Homo sapiens
atcctgaaaacttacgaagtgg

SEQ ID NO: 8061651 - DNA, 22 bp, Homo sapiens
atagcaaactggcagcttgtgg

SEQ ID NO: 8061652 - DNA, 22 bp, Homo sapiens
atagcaaactggagcttgcttt

SEQ ID NO: 8061653 - DNA, 22 bp, Homo sapiens
atactagactgttctgttatca

SEQ ID NO: 8061654 - DNA, 22 bp, Homo sapiens
atagatttgaatttaagacttg

SEQ ID NO: 8061655 - DNA, 22 bp, Homo sapiens
atactacattattagagcctgg

SEQ ID NO: 8061656 - DNA, 22 bp, Homo sapiens
ctggctcccagctttcagggag

SEQ ID NO: 8061657 - DNA, 22 bp, Homo sapiens
ctggctccatccttgagctctg

SEQ ID NO: 8061658 - DNA, 22 bp, Homo sapiens
ctggctccatcactgggtgatg

SEQ ID NO: 8061659 - DNA, 22 bp, Homo sapiens
ctggctggccatgcagcgccag

SEQ ID NO: 8061660 - DNA, 22 bp, Homo sapiens
atagcactggtttttcttggtt

SEQ ID NO: 8061661 - DNA, 22 bp, Homo sapiens
ctggagaagaggtagtatgtag

SEQ ID NO: 8061662 - DNA, 22 bp, Homo sapiens
ctggaatgcctccctgtcagag

SEQ ID NO: 8061663 - DNA, 22 bp, Homo sapiens
ctggaatgcctccctgtcagag

SEQ ID NO: 8061664 - DNA, 18 bp, Homo sapiens
ctgctgcaggcactcagg

SEQ ID NO: 8061665 - DNA, 22 bp, Homo sapiens
ctgctgcaggatgggcactctg

SEQ ID NO: 8061666 - DNA, 22 bp, Homo sapiens
ctgctgccaagggtgccacagg

SEQ ID NO: 8061667 - DNA, 22 bp, Homo sapiens
ctggaagagcatttgcataggg

SEQ ID NO: 8061668 - DNA, 22 bp, Homo sapiens
atacctgtgtatccacaagcgt

SEQ ID NO: 8061669 - DNA, 22 bp, Homo sapiens
ataccatttccatgttacatta

SEQ ID NO: 8061670 - DNA, 17 bp, Homo sapiens
atacattgttaaagtat

SEQ ID NO: 8061671 - DNA, 17 bp, Homo sapiens
atacattgttaaagtat

SEQ ID NO: 8061672 - DNA, 22 bp, Homo sapiens
atacattgagttttgatgttct

SEQ ID NO: 8061673 - DNA, 22 bp, Homo sapiens
atacatacatgtacacataaat

SEQ ID NO: 8061674 - DNA, 22 bp, Homo sapiens
agttatattccatagattcaga

SEQ ID NO: 8061675 - DNA, 22 bp, Homo sapiens
ctgaggagcaaccccgtgccct

SEQ ID NO: 8061676 - DNA, 22 bp, Homo sapiens
agttatcaggtgttttcatgga

SEQ ID NO: 8061677 - DNA, 22 bp, Homo sapiens
ctgcatctcaggagacgggtct

SEQ ID NO: 8061678 - DNA, 22 bp, Homo sapiens
ctgcatgctgagccaacagtga

SEQ ID NO: 8061679 - DNA, 22 bp, Homo sapiens
ctgcatggttcaaatgagctaa

SEQ ID NO: 8061680 - DNA, 22 bp, Homo sapiens
ctgcatctctgctagtcagtca

SEQ ID NO: 8061681 - DNA, 22 bp, Homo sapiens
ctgcagagacctaggtcaggtt

SEQ ID NO: 8061682 - DNA, 22 bp, Homo sapiens
ataaatgattcagcaggaaata

SEQ ID NO: 8061683 - DNA, 22 bp, Homo sapiens
ctgcctctcaggtccctgagat

SEQ ID NO: 8061684 - DNA, 22 bp, Homo sapiens
ctgcctctccccagagtggccc

SEQ ID NO: 8061685 - DNA, 22 bp, Homo sapiens
ctgccctttatttcacaaagta

SEQ ID NO: 8061686 - DNA, 20 bp, Homo sapiens
ctgccgaccacagccatgga

SEQ ID NO: 8061687 - DNA, 22 bp, Homo sapiens
ctgccctttatttcacaaagta

SEQ ID NO: 8061688 - DNA, 22 bp, Homo sapiens
ctgccctttgaaagaacgtctt

SEQ ID NO: 8061689 - DNA, 22 bp, Homo sapiens
ataacagagagctactgaactg

SEQ ID NO: 8061690 - DNA, 22 bp, Homo sapiens
ataacagatactctctgtgagg

SEQ ID NO: 8061691 - DNA, 22 bp, Homo sapiens
ctgctgaggtccttgctcagac

SEQ ID NO: 8061692 - DNA, 22 bp, Homo sapiens
ctgctgcaatctggcttccatg

SEQ ID NO: 8061693 - DNA, 22 bp, Homo sapiens
ccagctcccgcaggctgcacag

SEQ ID NO: 8061694 - DNA, 22 bp, Homo sapiens
ccagctccctgaagcctggtct

SEQ ID NO: 8061695 - DNA, 22 bp, Homo sapiens
ccagctccaggtagatgggcag

SEQ ID NO: 8061696 - DNA, 21 bp, Homo sapiens
aggccctggaggtcagagaaa

SEQ ID NO: 8061697 - DNA, 22 bp, Homo sapiens
aggccctgctttccagagctca

SEQ ID NO: 8061698 - DNA, 22 bp, Homo sapiens
aggccctgctttccagagctca

SEQ ID NO: 8061699 - DNA, 22 bp, Homo sapiens
ccaggaggggtctctgtctccc

SEQ ID NO: 8061700 - DNA, 22 bp, Homo sapiens
aggctcagaggtgagcatctgc

SEQ ID NO: 8061701 - DNA, 20 bp, Homo sapiens
ccaggcactgtcccatgcag

SEQ ID NO: 8061702 - DNA, 22 bp, Homo sapiens
aggcctgggtgttcaccagaag

SEQ ID NO: 8061703 - DNA, 22 bp, Homo sapiens
aggcctggtgtgccggatgcag

SEQ ID NO: 8061704 - DNA, 22 bp, Homo sapiens
aggctagaggcttctggcttca

SEQ ID NO: 8061705 - DNA, 20 bp, Homo sapiens
ccagagctgatggctgcccg

SEQ ID NO: 8061706 - DNA, 22 bp, Homo sapiens
ccagaggcatgttcaaagcaat

SEQ ID NO: 8061707 - DNA, 21 bp, Homo sapiens
ccagaggcctctcttggccac

SEQ ID NO: 8061708 - DNA, 22 bp, Homo sapiens
ccagccaggctggctgtggagg

SEQ ID NO: 8061709 - DNA, 22 bp, Homo sapiens
ccagccaggcattgcaaactga

SEQ ID NO: 8061710 - DNA, 22 bp, Homo sapiens
ccagccaggcattgcaaactga

SEQ ID NO: 8061711 - DNA, 22 bp, Homo sapiens
ccagccagccttgatctgagta

SEQ ID NO: 8061712 - DNA, 22 bp, Homo sapiens
ccagccagctgcccttggggcc

SEQ ID NO: 8061713 - DNA, 22 bp, Homo sapiens
ccagccagatgataagctctat

SEQ ID NO: 8061714 - DNA, 22 bp, Homo sapiens
ccagccagaagtccgggcttct

SEQ ID NO: 8061715 - DNA, 22 bp, Homo sapiens
ccagagtctatgagtcctcatt

SEQ ID NO: 8061716 - DNA, 22 bp, Homo sapiens
aggccctgcccagtgccacaag

SEQ ID NO: 8061717 - DNA, 22 bp, Homo sapiens
aggccctgcccagagctcctcg

SEQ ID NO: 8061718 - DNA, 22 bp, Homo sapiens
ccagccctgattagagaatgtc

SEQ ID NO: 8061719 - DNA, 22 bp, Homo sapiens
ccagccctgaaccctgctgcat

SEQ ID NO: 8061720 - DNA, 22 bp, Homo sapiens
ccagccctgaaccctgctgcat

SEQ ID NO: 8061721 - DNA, 23 bp, Homo sapiens
ccagccctccaccagctctaggc

SEQ ID NO: 8061722 - DNA, 22 bp, Homo sapiens
ccagccctcctccatcagagga

SEQ ID NO: 8061723 - DNA, 17 bp, Homo sapiens
ccagccctcgcgctttt

SEQ ID NO: 8061724 - DNA, 22 bp, Homo sapiens
ccagccctcctccatcagagga

SEQ ID NO: 8061725 - DNA, 22 bp, Homo sapiens
ccagggcacttaggcccagccc

SEQ ID NO: 8061726 - DNA, 22 bp, Homo sapiens
ccagggcagaaaaagagggaat

SEQ ID NO: 8061727 - DNA, 22 bp, Homo sapiens
ccagggcagcgcccctccacgc

SEQ ID NO: 8061728 - DNA, 22 bp, Homo sapiens
ccaggtggtgaaagtgggccct

SEQ ID NO: 8061729 - DNA, 22 bp, Homo sapiens
ccagggcagcagaattggggca

SEQ ID NO: 8061730 - DNA, 22 bp, Homo sapiens
ccagggcagccaacccagatgc

SEQ ID NO: 8061731 - DNA, 22 bp, Homo sapiens
ccaggtggttcaggtcaccata

SEQ ID NO: 8061732 - DNA, 20 bp, Homo sapiens
ccaggtggtgcctggagagg

SEQ ID NO: 8061733 - DNA, 18 bp, Homo sapiens
ccaggtggtgacagagat

SEQ ID NO: 8061734 - DNA, 20 bp, Homo sapiens
aggctctgcctgcaggccca

SEQ ID NO: 8061735 - DNA, 22 bp, Homo sapiens
aggctcagcccaaggtggagag

SEQ ID NO: 8061736 - DNA, 22 bp, Homo sapiens
aggctctggttggcaagtaaag

SEQ ID NO: 8061737 - DNA, 22 bp, Homo sapiens
aggctctggtgcagctgtaact

SEQ ID NO: 8061738 - DNA, 22 bp, Homo sapiens
aggctctgggaagcagtgagtt

SEQ ID NO: 8061739 - DNA, 22 bp, Homo sapiens
ccaggcctcccttttccagcca

SEQ ID NO: 8061740 - DNA, 20 bp, Homo sapiens
ccaggcctgggcctgctcta

SEQ ID NO: 8061741 - DNA, 22 bp, Homo sapiens
ccaggccttccagtacgcagaa

SEQ ID NO: 8061742 - DNA, 21 bp, Homo sapiens
aggctgcatgcatgagtgtgg

SEQ ID NO: 8061743 - DNA, 22 bp, Homo sapiens
aggctgcagaggtgctgccaga

SEQ ID NO: 8061744 - DNA, 22 bp, Homo sapiens
ccagtgggtaggccatggtgag

SEQ ID NO: 8061745 - DNA, 22 bp, Homo sapiens
ccagtgggtgctgggctctgcc

SEQ ID NO: 8061746 - DNA, 22 bp, Homo sapiens
ccagtgtgattgttgcaagaat

SEQ ID NO: 8061747 - DNA, 22 bp, Homo sapiens
ccagtgtgattgttgcaagaat

SEQ ID NO: 8061748 - DNA, 22 bp, Homo sapiens
ccagtgtgaccatctgttagct

SEQ ID NO: 8061749 - DNA, 22 bp, Homo sapiens
cccaagtattcctcctctgccc

SEQ ID NO: 8061750 - DNA, 22 bp, Homo sapiens
cccagaggtgcttcagaggtgc

SEQ ID NO: 8061751 - DNA, 22 bp, Homo sapiens
cccacgtcgaacttgctccaga

SEQ ID NO: 8061752 - DNA, 22 bp, Homo sapiens
cccactccctgcacgcctgccg

SEQ ID NO: 8061753 - DNA, 22 bp, Homo sapiens
cctcagggtggcatcagatctt

SEQ ID NO: 8061754 - DNA, 22 bp, Homo sapiens
cctcaggggcttttcgttgttg

SEQ ID NO: 8061755 - DNA, 22 bp, Homo sapiens
cctcaggggtgcccacagctgc

SEQ ID NO: 8061756 - DNA, 18 bp, Homo sapiens
cctcaggggacctggcag

SEQ ID NO: 8061757 - DNA, 22 bp, Homo sapiens
cctcagggccatctctgtccct

SEQ ID NO: 8061758 - DNA, 22 bp, Homo sapiens
cctcagggaggcctctgtggct

SEQ ID NO: 8061759 - DNA, 22 bp, Homo sapiens
agggctgggctgcttgttgtca

SEQ ID NO: 8061760 - DNA, 22 bp, Homo sapiens
agggcccatagatcgtcagctt

SEQ ID NO: 8061761 - DNA, 22 bp, Homo sapiens
ccctggcatgcatgtccctggc

SEQ ID NO: 8061762 - DNA, 22 bp, Homo sapiens
ccctggccagctcatgtctgag

SEQ ID NO: 8061763 - DNA, 19 bp, Homo sapiens
ccctggcaggcaagcctgg

SEQ ID NO: 8061764 - DNA, 22 bp, Homo sapiens
ccctggcataaaacttctccag

SEQ ID NO: 8061765 - DNA, 22 bp, Homo sapiens
ccctggcagaatgtctctgggc

SEQ ID NO: 8061766 - DNA, 22 bp, Homo sapiens
agggcctgtctgtagaactgaa

SEQ ID NO: 8061767 - DNA, 22 bp, Homo sapiens
agggcctgtccgctcccgcccg

SEQ ID NO: 8061768 - DNA, 22 bp, Homo sapiens
agggcctggcttcactttctca

SEQ ID NO: 8061769 - DNA, 22 bp, Homo sapiens
agggcctgggaagaggaaccct

SEQ ID NO: 8061770 - DNA, 22 bp, Homo sapiens
agggcctgtcagcggtgtcctg

SEQ ID NO: 8061771 - DNA, 21 bp, Homo sapiens
agggcctgtgctctccaggtc

SEQ ID NO: 8061772 - DNA, 22 bp, Homo sapiens
agggcctgtgaattctccctgc

SEQ ID NO: 8061773 - DNA, 22 bp, Homo sapiens
agggcctgtgctgagtagacga

SEQ ID NO: 8061774 - DNA, 22 bp, Homo sapiens
agggcctgtgcttcctgagata

SEQ ID NO: 8061775 - DNA, 20 bp, Homo sapiens
agggcctgttgcaagcgttt

SEQ ID NO: 8061776 - DNA, 22 bp, Homo sapiens
agggggtgctacttccagagtt

SEQ ID NO: 8061777 - DNA, 22 bp, Homo sapiens
aggggtgaaagagggccctcaa

SEQ ID NO: 8061778 - DNA, 22 bp, Homo sapiens
aggggcctggttggcctctgtt

SEQ ID NO: 8061779 - DNA, 22 bp, Homo sapiens
aggggctcagttactttggcag

SEQ ID NO: 8061780 - DNA, 22 bp, Homo sapiens
aggggcgtgctcttccccgacg

SEQ ID NO: 8061781 - DNA, 22 bp, Homo sapiens
aggggctgactggaaagtgcca

SEQ ID NO: 8061782 - DNA, 22 bp, Homo sapiens
aggggctgactggaaagtgcca

SEQ ID NO: 8061783 - DNA, 22 bp, Homo sapiens
aggggctcctttgtgctgcgtc

SEQ ID NO: 8061784 - DNA, 22 bp, Homo sapiens
cctcctggtgggcgcttctggc

SEQ ID NO: 8061785 - DNA, 22 bp, Homo sapiens
cctcgacctccccaggctcagg

SEQ ID NO: 8061786 - DNA, 22 bp, Homo sapiens
cccaggtggcagaagctgcagt

SEQ ID NO: 8061787 - DNA, 22 bp, Homo sapiens
cccaggtgggttggcctctgtc

SEQ ID NO: 8061788 - DNA, 22 bp, Homo sapiens
agggcagaaaccaccttgatgg

SEQ ID NO: 8061789 - DNA, 22 bp, Homo sapiens
agggatggtggaggttgcaagt

SEQ ID NO: 8061790 - DNA, 21 bp, Homo sapiens
cccctgggagccctgtcagta

SEQ ID NO: 8061791 - DNA, 22 bp, Homo sapiens
agggcagagaaatgtagttgag

SEQ ID NO: 8061792 - DNA, 22 bp, Homo sapiens
agggcagaaatattgatactgt

SEQ ID NO: 8061793 - DNA, 22 bp, Homo sapiens
agggcagaaatcgattacacct

SEQ ID NO: 8061794 - DNA, 22 bp, Homo sapiens
agggcagaagtacagacactta

SEQ ID NO: 8061795 - DNA, 22 bp, Homo sapiens
agggcagaccacgtgcaaggat

SEQ ID NO: 8061796 - DNA, 22 bp, Homo sapiens
agggcagactaggatggaagtg

SEQ ID NO: 8061797 - DNA, 22 bp, Homo sapiens
agggcagactaggatggaagtg

SEQ ID NO: 8061798 - DNA, 22 bp, Homo sapiens
agggcagaccacgtgcaaggat

SEQ ID NO: 8061799 - DNA, 22 bp, Homo sapiens
ccctgaggggagtggtgaggtg

SEQ ID NO: 8061800 - DNA, 22 bp, Homo sapiens
agggcccaggacagcatcaggg

SEQ ID NO: 8061801 - DNA, 22 bp, Homo sapiens
agggccagggaagctgtatttt

SEQ ID NO: 8061802 - DNA, 23 bp, Homo sapiens
agggcccaagcctggacagcagg

SEQ ID NO: 8061803 - DNA, 22 bp, Homo sapiens
ccccttcagagtagccacatta

SEQ ID NO: 8061804 - DNA, 22 bp, Homo sapiens
agggagctgtggtcagctcagt

SEQ ID NO: 8061805 - DNA, 22 bp, Homo sapiens
agggagcttccgaactacagct

SEQ ID NO: 8061806 - DNA, 22 bp, Homo sapiens
agggagctgctctgcttccgtg

SEQ ID NO: 8061807 - DNA, 22 bp, Homo sapiens
cccaggcctggtctgggccagt

SEQ ID NO: 8061808 - DNA, 22 bp, Homo sapiens
cccaggccccagggcttgtcag

SEQ ID NO: 8061809 - DNA, 22 bp, Homo sapiens
cccaggccagaacttggttgct

SEQ ID NO: 8061810 - DNA, 22 bp, Homo sapiens
agggacagttacatcatcagac

SEQ ID NO: 8061811 - DNA, 22 bp, Homo sapiens
agggacagtctactgttcactg

SEQ ID NO: 8061812 - DNA, 22 bp, Homo sapiens
agggacagtctactgttcactg

SEQ ID NO: 8061813 - DNA, 22 bp, Homo sapiens
agggaaagtaagcatttcatta

SEQ ID NO: 8061814 - DNA, 23 bp, Homo sapiens
agggaaagtagtaatggcctttg

SEQ ID NO: 8061815 - DNA, 21 bp, Homo sapiens
agggaaaaggctgagtgaggg

SEQ ID NO: 8061816 - DNA, 22 bp, Homo sapiens
agggaaaggtagtgaggtcaca

SEQ ID NO: 8061817 - DNA, 22 bp, Homo sapiens
agggaaaggctgatgctgtggg

SEQ ID NO: 8061818 - DNA, 21 bp, Homo sapiens
agggaaagaaaatgagctaat

SEQ ID NO: 8061819 - DNA, 22 bp, Homo sapiens
aggacactttgtggttgttgat

SEQ ID NO: 8061820 - DNA, 22 bp, Homo sapiens
aggacacttaggttattcaact

SEQ ID NO: 8061821 - DNA, 22 bp, Homo sapiens
aggacacttgagagtccagtca

SEQ ID NO: 8061822 - DNA, 22 bp, Homo sapiens
aggaatcccgcaccagctgctg

SEQ ID NO: 8061823 - DNA, 21 bp, Homo sapiens
aggaagtggccagattgggaa

SEQ ID NO: 8061824 - DNA, 22 bp, Homo sapiens
caggtgggccatgaaaaatgac

SEQ ID NO: 8061825 - DNA, 22 bp, Homo sapiens
caggtgggccatgaaaaatgac

SEQ ID NO: 8061826 - DNA, 22 bp, Homo sapiens
caggtgggattttgctgcttga

SEQ ID NO: 8061827 - DNA, 22 bp, Homo sapiens
caggtgggccggggtttgttct

SEQ ID NO: 8061828 - DNA, 22 bp, Homo sapiens
cagggctgttagctgctgctct

SEQ ID NO: 8061829 - DNA, 18 bp, Homo sapiens
cagggctgtggggtcact

SEQ ID NO: 8061830 - DNA, 23 bp, Homo sapiens
cagggctgggcttggtgttaggc

SEQ ID NO: 8061831 - DNA, 22 bp, Homo sapiens
agctttcttgattttgcctgta

SEQ ID NO: 8061832 - DNA, 22 bp, Homo sapiens
agctttctgtcacctgtgcttg

SEQ ID NO: 8061833 - DNA, 22 bp, Homo sapiens
cagggctggctcatgaaaagtt

SEQ ID NO: 8061834 - DNA, 22 bp, Homo sapiens
cagggctggctgtggcaatctc

SEQ ID NO: 8061835 - DNA, 22 bp, Homo sapiens
cagggcaggatgctgtgattat

SEQ ID NO: 8061836 - DNA, 22 bp, Homo sapiens
cagggcagtaacgggaacatct

SEQ ID NO: 8061837 - DNA, 22 bp, Homo sapiens
cagggcagggccacaccccctg

SEQ ID NO: 8061838 - DNA, 22 bp, Homo sapiens
cagggcagggatgttgcggcag

SEQ ID NO: 8061839 - DNA, 22 bp, Homo sapiens
cagggcagggagcttagaatga

SEQ ID NO: 8061840 - DNA, 22 bp, Homo sapiens
cagctgggtttagtggggtgtg

SEQ ID NO: 8061841 - DNA, 22 bp, Homo sapiens
caggactgaagggcacagggaa

SEQ ID NO: 8061842 - DNA, 22 bp, Homo sapiens
caggcagagtgaggtggtctaa

SEQ ID NO: 8061843 - DNA, 20 bp, Homo sapiens
caggcacactcattcctgct

SEQ ID NO: 8061844 - DNA, 22 bp, Homo sapiens
caggatggtcagatgcattgtc

SEQ ID NO: 8061845 - DNA, 22 bp, Homo sapiens
caggatggtcagatgcattgtc

SEQ ID NO: 8061846 - DNA, 22 bp, Homo sapiens
caggatgggtgtcggccagcac

SEQ ID NO: 8061847 - DNA, 22 bp, Homo sapiens
caggatgggatgtagtgggccc

SEQ ID NO: 8061848 - DNA, 22 bp, Homo sapiens
caggatggccccggggctgtgc

SEQ ID NO: 8061849 - DNA, 22 bp, Homo sapiens
caggatgggatgtagtgggccc

SEQ ID NO: 8061850 - DNA, 22 bp, Homo sapiens
caggagcccagagtcctcagct

SEQ ID NO: 8061851 - DNA, 22 bp, Homo sapiens
caggatggagggagggctgtta

SEQ ID NO: 8061852 - DNA, 22 bp, Homo sapiens
caggatggagagtgaggggtca

SEQ ID NO: 8061853 - DNA, 22 bp, Homo sapiens
caggatggagggagggctgtta

SEQ ID NO: 8061854 - DNA, 22 bp, Homo sapiens
caggatggcagagaaaagggtg

SEQ ID NO: 8061855 - DNA, 22 bp, Homo sapiens
caggatggcagagaaaagggtg

SEQ ID NO: 8061856 - DNA, 22 bp, Homo sapiens
caggatggccccggggctgtgc

SEQ ID NO: 8061857 - DNA, 22 bp, Homo sapiens
caggagcaaggagcagtgggat

SEQ ID NO: 8061858 - DNA, 22 bp, Homo sapiens
caggcagggagctggaaaggat

SEQ ID NO: 8061859 - DNA, 22 bp, Homo sapiens
caggcagggagctggaaaggat

SEQ ID NO: 8061860 - DNA, 22 bp, Homo sapiens
caggcagctcgatgccttgttg

SEQ ID NO: 8061861 - DNA, 22 bp, Homo sapiens
caggcagctcaaccttgggagc

SEQ ID NO: 8061862 - DNA, 22 bp, Homo sapiens
caggcagccttctcgtctcaca

SEQ ID NO: 8061863 - DNA, 22 bp, Homo sapiens
caggcagcctgcggtctgcaca

SEQ ID NO: 8061864 - DNA, 22 bp, Homo sapiens
agctggtggagaagcagacctc

SEQ ID NO: 8061865 - DNA, 22 bp, Homo sapiens
caggcaggtcagtgaagaagga

SEQ ID NO: 8061866 - DNA, 22 bp, Homo sapiens
agctgtatgcccaagatgctat

SEQ ID NO: 8061867 - DNA, 22 bp, Homo sapiens
agctgtctctggtattatgtga

SEQ ID NO: 8061868 - DNA, 22 bp, Homo sapiens
agctgtctccagatacaggatt

SEQ ID NO: 8061869 - DNA, 22 bp, Homo sapiens
agctgtctacctgcagagtcct

SEQ ID NO: 8061870 - DNA, 22 bp, Homo sapiens
agctgtcagtgctgtgcctgta

SEQ ID NO: 8061871 - DNA, 22 bp, Homo sapiens
agctgtctttctgcctcctgat

SEQ ID NO: 8061872 - DNA, 22 bp, Homo sapiens
agcttctcaggagtctgaggca

SEQ ID NO: 8061873 - DNA, 22 bp, Homo sapiens
agcttcctcacctcagaggtct

SEQ ID NO: 8061874 - DNA, 22 bp, Homo sapiens
agcttcctacaaccatctcaga

SEQ ID NO: 8061875 - DNA, 21 bp, Homo sapiens
agcttcctgcagtgggaggtc

SEQ ID NO: 8061876 - DNA, 22 bp, Homo sapiens
agcttcctgatgcaagagggct

SEQ ID NO: 8061877 - DNA, 22 bp, Homo sapiens
agcttccttggcgctgaggcct

SEQ ID NO: 8061878 - DNA, 22 bp, Homo sapiens
agcttcctgttgagagagggag

SEQ ID NO: 8061879 - DNA, 22 bp, Homo sapiens
ccacgctcatcctctctgagag

SEQ ID NO: 8061880 - DNA, 20 bp, Homo sapiens
ccacctggccaaggctgtgc

SEQ ID NO: 8061881 - DNA, 22 bp, Homo sapiens
ccacccagccagatgcaggaag

SEQ ID NO: 8061882 - DNA, 22 bp, Homo sapiens
ccacccagccagatgcaggaag

SEQ ID NO: 8061883 - DNA, 21 bp, Homo sapiens
ccaccaggtcttctgctcggg

SEQ ID NO: 8061884 - DNA, 21 bp, Homo sapiens
ccaccaggtcttctgctcggg

SEQ ID NO: 8061885 - DNA, 20 bp, Homo sapiens
ccacagtggagactggagac

SEQ ID NO: 8061886 - DNA, 17 bp, Homo sapiens
aggcaggagattggaga

SEQ ID NO: 8061887 - DNA, 22 bp, Homo sapiens
aggcaggaaccctgtgtgcgcc

SEQ ID NO: 8061888 - DNA, 22 bp, Homo sapiens
aggcaggaggatcatggatgca

SEQ ID NO: 8061889 - DNA, 22 bp, Homo sapiens
ccaatgatggtgcccacgatga

SEQ ID NO: 8061890 - DNA, 22 bp, Homo sapiens
aggcaagggggcgccaccttcc

SEQ ID NO: 8061891 - DNA, 22 bp, Homo sapiens
aggcaatcccctgaggatactt

SEQ ID NO: 8061892 - DNA, 22 bp, Homo sapiens
cattgcaggagagtaaataaaa

SEQ ID NO: 8061893 - DNA, 22 bp, Homo sapiens
cattgctttgtgcatatttaaa

SEQ ID NO: 8061894 - DNA, 23 bp, Homo sapiens
aggatgtaggatgtatggcagag

SEQ ID NO: 8061895 - DNA, 22 bp, Homo sapiens
aggatgggcctgggatatgctt

SEQ ID NO: 8061896 - DNA, 22 bp, Homo sapiens
catcttgtgaatttctgattct

SEQ ID NO: 8061897 - DNA, 22 bp, Homo sapiens
catcttgtgaggaccttcttgc

SEQ ID NO: 8061898 - DNA, 22 bp, Homo sapiens
catgagcataaatcagtcacga

SEQ ID NO: 8061899 - DNA, 23 bp, Homo sapiens
aggatgtaggatgtatggcagag

SEQ ID NO: 8061900 - DNA, 19 bp, Homo sapiens
catctcccacagccacaca

SEQ ID NO: 8061901 - DNA, 22 bp, Homo sapiens
catctccaggagttctactcat

SEQ ID NO: 8061902 - DNA, 22 bp, Homo sapiens
catctcagtgtacagggagtct

SEQ ID NO: 8061903 - DNA, 22 bp, Homo sapiens
catctcatcagtgagagtcagc

SEQ ID NO: 8061904 - DNA, 22 bp, Homo sapiens
catacataccactgctgtcttt

SEQ ID NO: 8061905 - DNA, 22 bp, Homo sapiens
catacaatcaagttctttatta

SEQ ID NO: 8061906 - DNA, 22 bp, Homo sapiens
aggagccagtggagttcctgcc

SEQ ID NO: 8061907 - DNA, 22 bp, Homo sapiens
cataacattaagcctctatttc

SEQ ID NO: 8061908 - DNA, 22 bp, Homo sapiens
cataacatgtacatataaatgc

SEQ ID NO: 8061909 - DNA, 22 bp, Homo sapiens
cataagaaatttaacagaactt

SEQ ID NO: 8061910 - DNA, 22 bp, Homo sapiens
cataatatactacattgatgaa

SEQ ID NO: 8061911 - DNA, 22 bp, Homo sapiens
cataagaaggtaacatccttaa

SEQ ID NO: 8061912 - DNA, 22 bp, Homo sapiens
cataagaatattccatcctttg

SEQ ID NO: 8061913 - DNA, 22 bp, Homo sapiens
cagtccaggcctggaggagcca

SEQ ID NO: 8061914 - DNA, 22 bp, Homo sapiens
cagtgtggagggagagagcctg

SEQ ID NO: 8061915 - DNA, 22 bp, Homo sapiens
aggggagctaacaccagagccc

SEQ ID NO: 8061916 - DNA, 22 bp, Homo sapiens
aggggagccgaggggcatctgt

SEQ ID NO: 8061917 - DNA, 22 bp, Homo sapiens
aggggagcaaggccgtggtgta

SEQ ID NO: 8061918 - DNA, 22 bp, Homo sapiens
aggggagcccctggtcctggtg

SEQ ID NO: 8061919 - DNA, 22 bp, Homo sapiens
accctttcttactcacacgctc

SEQ ID NO: 8061920 - DNA, 21 bp, Homo sapiens
acctcaagcaacaaccaaggt

SEQ ID NO: 8061921 - DNA, 22 bp, Homo sapiens
acctcaggatgtggacacagaa

SEQ ID NO: 8061922 - DNA, 22 bp, Homo sapiens
acctcccagctctgagcttggg

SEQ ID NO: 8061923 - DNA, 22 bp, Homo sapiens
aggggtggcctgccttactccc

SEQ ID NO: 8061924 - DNA, 22 bp, Homo sapiens
aggggtggagagtgttgccagt

SEQ ID NO: 8061925 - DNA, 22 bp, Homo sapiens
aggggtgatttgggacaggaca

SEQ ID NO: 8061926 - DNA, 22 bp, Homo sapiens
aggggtgtgcatcctggaggat

SEQ ID NO: 8061927 - DNA, 23 bp, Homo sapiens
aggggtggtcagtacccgcagtg

SEQ ID NO: 8061928 - DNA, 22 bp, Homo sapiens
accagagcgctcaagccttccc

SEQ ID NO: 8061929 - DNA, 22 bp, Homo sapiens
accagagcccatctgctcctag

SEQ ID NO: 8061930 - DNA, 22 bp, Homo sapiens
agggaggatctgctccttgtct

SEQ ID NO: 8061931 - DNA, 22 bp, Homo sapiens
agggaggatctgctccttgtct

SEQ ID NO: 8061932 - DNA, 22 bp, Homo sapiens
agggaggatagtagtcagttta

SEQ ID NO: 8061933 - DNA, 22 bp, Homo sapiens
accagagcagactactggaggt

SEQ ID NO: 8061934 - DNA, 22 bp, Homo sapiens
accagagatggggcttctctgt

SEQ ID NO: 8061935 - DNA, 20 bp, Homo sapiens
accagagacctgaatcagtt

SEQ ID NO: 8061936 - DNA, 22 bp, Homo sapiens
accagagaaaacacagcaggct

SEQ ID NO: 8061937 - DNA, 22 bp, Homo sapiens
accagagaaaacacagcaggct

SEQ ID NO: 8061938 - DNA, 22 bp, Homo sapiens
agggcaagttgagtgtgcgtgg

SEQ ID NO: 8061939 - DNA, 22 bp, Homo sapiens
agggcacatctgctgggaatgg

SEQ ID NO: 8061940 - DNA, 22 bp, Homo sapiens
agggcactggcttgcaaactca

SEQ ID NO: 8061941 - DNA, 22 bp, Homo sapiens
agggccagcactcctggcagga

SEQ ID NO: 8061942 - DNA, 22 bp, Homo sapiens
agggccagcccataatgccaaa

SEQ ID NO: 8061943 - DNA, 22 bp, Homo sapiens
agggcctgtcagcggtgtcctg

SEQ ID NO: 8061944 - DNA, 22 bp, Homo sapiens
aggctctggacagtgaggagtt

SEQ ID NO: 8061945 - DNA, 22 bp, Homo sapiens
acattaaaaaatgttgcatgaa

SEQ ID NO: 8061946 - DNA, 22 bp, Homo sapiens
acattaaatttcatagtgatta

SEQ ID NO: 8061947 - DNA, 22 bp, Homo sapiens
aggctccagtctcctctggcag

SEQ ID NO: 8061948 - DNA, 22 bp, Homo sapiens
acatgtggtcaatctgtgtagg

SEQ ID NO: 8061949 - DNA, 20 bp, Homo sapiens
aggctcagctgagctcttgg

SEQ ID NO: 8061950 - DNA, 22 bp, Homo sapiens
acatgtattgacattatattct

SEQ ID NO: 8061951 - DNA, 22 bp, Homo sapiens
aggctgtgagttttgtctcaga

SEQ ID NO: 8061952 - DNA, 22 bp, Homo sapiens
aggctgggaaacctgaagttgt

SEQ ID NO: 8061953 - DNA, 22 bp, Homo sapiens
aggctgggaaatgtagtcttcc

SEQ ID NO: 8061954 - DNA, 22 bp, Homo sapiens
aggctgggaaatgtattccagc

SEQ ID NO: 8061955 - DNA, 22 bp, Homo sapiens
accactgggcgggcagcctgct

SEQ ID NO: 8061956 - DNA, 22 bp, Homo sapiens
aggctggcttggctctcctgtg

SEQ ID NO: 8061957 - DNA, 23 bp, Homo sapiens
aggctggcttcaggagcctctcc

SEQ ID NO: 8061958 - DNA, 22 bp, Homo sapiens
aggctgctctgcgaagtcagct

SEQ ID NO: 8061959 - DNA, 22 bp, Homo sapiens
aggctgcagaacagtcaggtgc

SEQ ID NO: 8061960 - DNA, 22 bp, Homo sapiens
aggctgctggcaggcgtggacg

SEQ ID NO: 8061961 - DNA, 21 bp, Homo sapiens
acagcatgtttgtgtgtttgc

SEQ ID NO: 8061962 - DNA, 22 bp, Homo sapiens
acagcatgagagatgaacattc

SEQ ID NO: 8061963 - DNA, 22 bp, Homo sapiens
acagcatgagagtagcaaaagg

SEQ ID NO: 8061964 - DNA, 22 bp, Homo sapiens
acagcatggataacaaggcact

SEQ ID NO: 8061965 - DNA, 22 bp, Homo sapiens
acagcatgtctagttaaatact

SEQ ID NO: 8061966 - DNA, 22 bp, Homo sapiens
acagcagttaacgatcagactc

SEQ ID NO: 8061967 - DNA, 20 bp, Homo sapiens
acagccagaggaggcagaca

SEQ ID NO: 8061968 - DNA, 22 bp, Homo sapiens
agcttcttgaccaagcctgtaa

SEQ ID NO: 8061969 - DNA, 18 bp, Homo sapiens
aggaaagaaaggcaggtg

SEQ ID NO: 8061970 - DNA, 23 bp, Homo sapiens
acagggcattgctggcctcgagg

SEQ ID NO: 8061971 - DNA, 22 bp, Homo sapiens
acagggcatttcctctatgtgt

SEQ ID NO: 8061972 - DNA, 21 bp, Homo sapiens
acagggcatgcagctggctgt

SEQ ID NO: 8061973 - DNA, 22 bp, Homo sapiens
acagggcatgtgcaagagacat

SEQ ID NO: 8061974 - DNA, 22 bp, Homo sapiens
acaggctctcagccagttggca

SEQ ID NO: 8061975 - DNA, 21 bp, Homo sapiens
acaggctcacgatccatttct

SEQ ID NO: 8061976 - DNA, 21 bp, Homo sapiens
acaggctctggggatgctggg

SEQ ID NO: 8061977 - DNA, 22 bp, Homo sapiens
acagggcaggtggctactggtc

SEQ ID NO: 8061978 - DNA, 22 bp, Homo sapiens
acagggcagtgtcttgaaaaat

SEQ ID NO: 8061979 - DNA, 19 bp, Homo sapiens
aggaaaggtggccttagca

SEQ ID NO: 8061980 - DNA, 22 bp, Homo sapiens
aggactgggtgcagagggcatc

SEQ ID NO: 8061981 - DNA, 22 bp, Homo sapiens
acagggccattatctgttctag

SEQ ID NO: 8061982 - DNA, 22 bp, Homo sapiens
acagggccagcctgggacctgg

SEQ ID NO: 8061983 - DNA, 22 bp, Homo sapiens
acagggccaggtgagaggtgct

SEQ ID NO: 8061984 - DNA, 22 bp, Homo sapiens
acagggcccttgccagcacaag

SEQ ID NO: 8061985 - DNA, 22 bp, Homo sapiens
acagggcctcagctgattctgg

SEQ ID NO: 8061986 - DNA, 22 bp, Homo sapiens
acagggcctcagccagggcaga

SEQ ID NO: 8061987 - DNA, 22 bp, Homo sapiens
aggactgttttttcttctaggg

SEQ ID NO: 8061988 - DNA, 22 bp, Homo sapiens
acagtgcttctgatatgatgcc

SEQ ID NO: 8061989 - DNA, 19 bp, Homo sapiens
acagtgcttctgagtgagg

SEQ ID NO: 8061990 - DNA, 21 bp, Homo sapiens
aggcaccacatctccctcccc

SEQ ID NO: 8061991 - DNA, 22 bp, Homo sapiens
aggcaccagtaagagtagaact

SEQ ID NO: 8061992 - DNA, 22 bp, Homo sapiens
acagtggagaaggcatgaggct

SEQ ID NO: 8061993 - DNA, 22 bp, Homo sapiens
aggcagcaagattatttaatcc

SEQ ID NO: 8061994 - DNA, 22 bp, Homo sapiens
aggcagcaaatgtctggaacag

SEQ ID NO: 8061995 - DNA, 22 bp, Homo sapiens
aggcagcaaagaaatgatgctg

SEQ ID NO: 8061996 - DNA, 22 bp, Homo sapiens
aggcagcaatgaatgaaatgga

SEQ ID NO: 8061997 - DNA, 22 bp, Homo sapiens
aggcaggggagctggaagggta

SEQ ID NO: 8061998 - DNA, 22 bp, Homo sapiens
aggcagaatgttggaaaggaag

SEQ ID NO: 8061999 - DNA, 20 bp, Homo sapiens
aggcagacaaggagtctgtt

SEQ ID NO: 8062000 - DNA, 22 bp, Homo sapiens
aggcagagaaaaaccagatatg

SEQ ID NO: 8062001 - DNA, 22 bp, Homo sapiens
aggcagtgtattgctagcggct

SEQ ID NO: 8062002 - DNA, 22 bp, Homo sapiens
aggcagtgtattgctagcggct

SEQ ID NO: 8062003 - DNA, 23 bp, Homo sapiens
aggcagtgtctcttatcctgtcc

SEQ ID NO: 8062004 - DNA, 20 bp, Homo sapiens
aggcagtgtagagatgagta

SEQ ID NO: 8062005 - DNA, 22 bp, Homo sapiens
aggcagtgtgtagctggaagag

SEQ ID NO: 8062006 - DNA, 22 bp, Homo sapiens
aggcagtgtgtagctggaagag

SEQ ID NO: 8062007 - DNA, 22 bp, Homo sapiens
aggcagtgtggagggctgttgc

SEQ ID NO: 8062008 - DNA, 22 bp, Homo sapiens
aggcagtgtgggccaagcttcc

SEQ ID NO: 8062009 - DNA, 22 bp, Homo sapiens
aggcagtggtgtttgctggtgg

SEQ ID NO: 8062010 - DNA, 22 bp, Homo sapiens
acatataagggatcagtgacag

SEQ ID NO: 8062011 - DNA, 22 bp, Homo sapiens
agaagccaaaggggccagatat

SEQ ID NO: 8062012 - DNA, 22 bp, Homo sapiens
agaagcagttattttttgcaca

SEQ ID NO: 8062013 - DNA, 22 bp, Homo sapiens
agaaatgtggaggaacagggct

SEQ ID NO: 8062014 - DNA, 22 bp, Homo sapiens
atcctgcttgttacttatagag

SEQ ID NO: 8062015 - DNA, 22 bp, Homo sapiens
atcctgaagcatgaatgtcaaa

SEQ ID NO: 8062016 - DNA, 22 bp, Homo sapiens
agaagctgacagatgcagcagg

SEQ ID NO: 8062017 - DNA, 22 bp, Homo sapiens
agaagccattgaagcagacctc

SEQ ID NO: 8062018 - DNA, 22 bp, Homo sapiens
agaagccattgaagcagacctc

SEQ ID NO: 8062019 - DNA, 22 bp, Homo sapiens
agaagccatgtttagtaggatg

SEQ ID NO: 8062020 - DNA, 22 bp, Homo sapiens
agaagccattccctgtaggctc

SEQ ID NO: 8062021 - DNA, 22 bp, Homo sapiens
agaagccattccctgtaggctc

SEQ ID NO: 8062022 - DNA, 22 bp, Homo sapiens
agaaatatgctgattagatgaa

SEQ ID NO: 8062023 - DNA, 22 bp, Homo sapiens
atattaattatttacacatgag

SEQ ID NO: 8062024 - DNA, 22 bp, Homo sapiens
atattaatgagcaagtaagtga

SEQ ID NO: 8062025 - DNA, 17 bp, Homo sapiens
agaaagaggatccacag

SEQ ID NO: 8062026 - DNA, 22 bp, Homo sapiens
agaaagaacgcacttgtgctgc

SEQ ID NO: 8062027 - DNA, 22 bp, Homo sapiens
agaaaagggcaggagggataca

SEQ ID NO: 8062028 - DNA, 22 bp, Homo sapiens
agaaacttcagctattcttttg

SEQ ID NO: 8062029 - DNA, 17 bp, Homo sapiens
agaaactgaggctcagt

SEQ ID NO: 8062030 - DNA, 22 bp, Homo sapiens
atacttaactgtggagtcattg

SEQ ID NO: 8062031 - DNA, 23 bp, Homo sapiens
atagaagattattgcaacagtcc

SEQ ID NO: 8062032 - DNA, 22 bp, Homo sapiens
atagaatagcatagaaaattga

SEQ ID NO: 8062033 - DNA, 20 bp, Homo sapiens
ataggaaagggaggggcttt

SEQ ID NO: 8062034 - DNA, 22 bp, Homo sapiens
agaaaagggcaggagggataca

SEQ ID NO: 8062035 - DNA, 22 bp, Homo sapiens
agttgcagacgcagagatgttg

SEQ ID NO: 8062036 - DNA, 22 bp, Homo sapiens
ataacactaaatgtatgtaaca

SEQ ID NO: 8062037 - DNA, 22 bp, Homo sapiens
ataaattttcttgctgtactta

SEQ ID NO: 8062038 - DNA, 22 bp, Homo sapiens
ataaatttataattgtttcctg

SEQ ID NO: 8062039 - DNA, 23 bp, Homo sapiens
agttcactgaggttgaccactgg

SEQ ID NO: 8062040 - DNA, 22 bp, Homo sapiens
agttcactgcttaagcctttga

SEQ ID NO: 8062041 - DNA, 22 bp, Homo sapiens
agttcaggcataaggcatgaac

SEQ ID NO: 8062042 - DNA, 22 bp, Homo sapiens
agttcacagaatggccagaact

SEQ ID NO: 8062043 - DNA, 22 bp, Homo sapiens
agttcagtagtccttcattgta

SEQ ID NO: 8062044 - DNA, 22 bp, Homo sapiens
atacaagttgtgataatgtaaa

SEQ ID NO: 8062045 - DNA, 22 bp, Homo sapiens
atacaagttgtgataatgtaaa

SEQ ID NO: 8062046 - DNA, 22 bp, Homo sapiens
atacacagccattatgaattag

SEQ ID NO: 8062047 - DNA, 22 bp, Homo sapiens
atacacagcgatgagaggaggc

SEQ ID NO: 8062048 - DNA, 22 bp, Homo sapiens
atacacagctacattgaacaat

SEQ ID NO: 8062049 - DNA, 22 bp, Homo sapiens
atacactaatcatgtgctcagt

SEQ ID NO: 8062050 - DNA, 19 bp, Homo sapiens
atacacgtgtatacataca

SEQ ID NO: 8062051 - DNA, 22 bp, Homo sapiens
atacaatgagtgagtgaatggg

SEQ ID NO: 8062052 - DNA, 22 bp, Homo sapiens
atacaatgataatagtacttta

SEQ ID NO: 8062053 - DNA, 22 bp, Homo sapiens
atacaatgaagtatagatgaaa

SEQ ID NO: 8062054 - DNA, 22 bp, Homo sapiens
actctggggtgatgtctctgag

SEQ ID NO: 8062055 - DNA, 22 bp, Homo sapiens
agtccttcaagaaatctggaaa

SEQ ID NO: 8062056 - DNA, 22 bp, Homo sapiens
agtccttcccatctgacaccct

SEQ ID NO: 8062057 - DNA, 22 bp, Homo sapiens
agtccttcacgtcctgcttatt

SEQ ID NO: 8062058 - DNA, 22 bp, Homo sapiens
agtcctgtctctcccagggcca

SEQ ID NO: 8062059 - DNA, 22 bp, Homo sapiens
actctgggcccaccctcagagt

SEQ ID NO: 8062060 - DNA, 22 bp, Homo sapiens
agtccaggagttgggtgacatt

SEQ ID NO: 8062061 - DNA, 22 bp, Homo sapiens
actcagaggcagctgctcaccc

SEQ ID NO: 8062062 - DNA, 22 bp, Homo sapiens
aggtgggtcctggctctgccat

SEQ ID NO: 8062063 - DNA, 22 bp, Homo sapiens
aggtgggtatcatgagagatta

SEQ ID NO: 8062064 - DNA, 19 bp, Homo sapiens
aggtggtctaggctggaga

SEQ ID NO: 8062065 - DNA, 17 bp, Homo sapiens
aggtgggtggatcacct

SEQ ID NO: 8062066 - DNA, 22 bp, Homo sapiens
aggtggaacgttcaggtgctag

SEQ ID NO: 8062067 - DNA, 22 bp, Homo sapiens
aggtggagaagagatgggcagt

SEQ ID NO: 8062068 - DNA, 22 bp, Homo sapiens
aggtggagacccagagaaggcg

SEQ ID NO: 8062069 - DNA, 22 bp, Homo sapiens
agggtgcatgtttgcaagagtg

SEQ ID NO: 8062070 - DNA, 22 bp, Homo sapiens
agggtcccgaaggagacagcaa

SEQ ID NO: 8062071 - DNA, 22 bp, Homo sapiens
agggtccatcaaggactgcaca

SEQ ID NO: 8062072 - DNA, 19 bp, Homo sapiens
agggtccagggagcggctc

SEQ ID NO: 8062073 - DNA, 18 bp, Homo sapiens
agggtcagtgtcactggc

SEQ ID NO: 8062074 - DNA, 22 bp, Homo sapiens
agtggcagagcaggtgctggaa

SEQ ID NO: 8062075 - DNA, 22 bp, Homo sapiens
agtggcagaagtcactgggtag

SEQ ID NO: 8062076 - DNA, 22 bp, Homo sapiens
agtgcttcttaaacctttctac

SEQ ID NO: 8062077 - DNA, 22 bp, Homo sapiens
agtgcttctggtgggcgtgagg

SEQ ID NO: 8062078 - DNA, 22 bp, Homo sapiens
agtgggaggcggctgacgggcg

SEQ ID NO: 8062079 - DNA, 17 bp, Homo sapiens
agtgagaatgtcatgta

SEQ ID NO: 8062080 - DNA, 22 bp, Homo sapiens
agtccttcttttagttgcttgg

SEQ ID NO: 8062081 - DNA, 18 bp, Homo sapiens
agtccttcttggttttac

SEQ ID NO: 8062082 - DNA, 22 bp, Homo sapiens
agtccttccggcagatttcact

SEQ ID NO: 8062083 - DNA, 22 bp, Homo sapiens
agtgagcatcttcaggagccaa

SEQ ID NO: 8062084 - DNA, 22 bp, Homo sapiens
agtgaggaaatccattatcaag

SEQ ID NO: 8062085 - DNA, 22 bp, Homo sapiens
agtgctgaagactggctaggga

SEQ ID NO: 8062086 - DNA, 22 bp, Homo sapiens
agtggggcggacaggaccagga

SEQ ID NO: 8062087 - DNA, 22 bp, Homo sapiens
agtggggccggtgaggccgagg

SEQ ID NO: 8062088 - DNA, 20 bp, Homo sapiens
agtgtctggtgcagggcctc

SEQ ID NO: 8062089 - DNA, 22 bp, Homo sapiens
agtgtctgaaccaccggggcat

SEQ ID NO: 8062090 - DNA, 22 bp, Homo sapiens
agtgtgggtgagggaggccctc

SEQ ID NO: 8062091 - DNA, 22 bp, Homo sapiens
agtgtgggttttatggagccct

SEQ ID NO: 8062092 - DNA, 22 bp, Homo sapiens
actggttgaagaaaagctagta

SEQ ID NO: 8062093 - DNA, 22 bp, Homo sapiens
agcgccactgcactccagcctg

SEQ ID NO: 8062094 - DNA, 22 bp, Homo sapiens
cagcatggtgccagtgagtcca

SEQ ID NO: 8062095 - DNA, 22 bp, Homo sapiens
cagcatggggcttggagtcagc

SEQ ID NO: 8062096 - DNA, 22 bp, Homo sapiens
cagcatcaccgccatttctgat

SEQ ID NO: 8062097 - DNA, 22 bp, Homo sapiens
cagcatggggatcactgtaggc

SEQ ID NO: 8062098 - DNA, 22 bp, Homo sapiens
cagcccagagatgttatctagt

SEQ ID NO: 8062099 - DNA, 22 bp, Homo sapiens
cagcccacgtcagggccactca

SEQ ID NO: 8062100 - DNA, 22 bp, Homo sapiens
cagccatcagtaaagacagctt

SEQ ID NO: 8062101 - DNA, 22 bp, Homo sapiens
cagccagctggcactgtgagta

SEQ ID NO: 8062102 - DNA, 22 bp, Homo sapiens
cagccctggtgaggttggctat

SEQ ID NO: 8062103 - DNA, 22 bp, Homo sapiens
cagcctctctgtatctcaggat

SEQ ID NO: 8062104 - DNA, 22 bp, Homo sapiens
agctgagcatttgatccacctc

SEQ ID NO: 8062105 - DNA, 22 bp, Homo sapiens
agctgagccagcagcaacagga

SEQ ID NO: 8062106 - DNA, 22 bp, Homo sapiens
agctgagctgcagatgactgta

SEQ ID NO: 8062107 - DNA, 22 bp, Homo sapiens
agctgagctgcagatgactgta

SEQ ID NO: 8062108 - DNA, 22 bp, Homo sapiens
agctgagctcaggctgatgtaa

SEQ ID NO: 8062109 - DNA, 22 bp, Homo sapiens
agctgagccagcagcaacagga

SEQ ID NO: 8062110 - DNA, 21 bp, Homo sapiens
agctgagcccagaagactggt

SEQ ID NO: 8062111 - DNA, 22 bp, Homo sapiens
cagctggcagaacctgcatcca

SEQ ID NO: 8062112 - DNA, 22 bp, Homo sapiens
cagctggatgggagaccatgtt

SEQ ID NO: 8062113 - DNA, 22 bp, Homo sapiens
cagctggcaagtggagcagggt

SEQ ID NO: 8062114 - DNA, 22 bp, Homo sapiens
cagctggacttttgatagaagt

SEQ ID NO: 8062115 - DNA, 22 bp, Homo sapiens
cagctggaggagcagcttccag

SEQ ID NO: 8062116 - DNA, 22 bp, Homo sapiens
cagctggatccctgcagaactt

SEQ ID NO: 8062117 - DNA, 22 bp, Homo sapiens
agctctggaataatgatgtgat

SEQ ID NO: 8062118 - DNA, 22 bp, Homo sapiens
cagctgccccgctggctgacca

SEQ ID NO: 8062119 - DNA, 22 bp, Homo sapiens
cagctgcccaggccacctggag

SEQ ID NO: 8062120 - DNA, 22 bp, Homo sapiens
cagctgcccaggccacctggag

SEQ ID NO: 8062121 - DNA, 22 bp, Homo sapiens
cagctgccccataaatcacagt

SEQ ID NO: 8062122 - DNA, 22 bp, Homo sapiens
cagctgagcatcactagtctgg

SEQ ID NO: 8062123 - DNA, 22 bp, Homo sapiens
cagctgccatgacatgtcctgc

SEQ ID NO: 8062124 - DNA, 22 bp, Homo sapiens
cagcggaggacagatgggagct

SEQ ID NO: 8062125 - DNA, 22 bp, Homo sapiens
cagcctctgagccttggcagat

SEQ ID NO: 8062126 - DNA, 22 bp, Homo sapiens
cagccttctgaatgaacgtact

SEQ ID NO: 8062127 - DNA, 22 bp, Homo sapiens
cagccttgatggatgaggaagt

SEQ ID NO: 8062128 - DNA, 22 bp, Homo sapiens
agccagggaggtggaggttgca

SEQ ID NO: 8062129 - DNA, 22 bp, Homo sapiens
agccagggatggcagtgcccag

SEQ ID NO: 8062130 - DNA, 23 bp, Homo sapiens
agccagggcactggtggagattg

SEQ ID NO: 8062131 - DNA, 22 bp, Homo sapiens
agccagggctgcgagcagacag

SEQ ID NO: 8062132 - DNA, 22 bp, Homo sapiens
agccagggacgctgcaggctac

SEQ ID NO: 8062133 - DNA, 22 bp, Homo sapiens
agccaggctcaaggcctgctcc

SEQ ID NO: 8062134 - DNA, 22 bp, Homo sapiens
cagagcagtaaatctggggcac

SEQ ID NO: 8062135 - DNA, 22 bp, Homo sapiens
cagagccaggcctgccctcttt

SEQ ID NO: 8062136 - DNA, 22 bp, Homo sapiens
cagagccaggtctaggagtctc

SEQ ID NO: 8062137 - DNA, 22 bp, Homo sapiens
cagagccagggttgcacccctg

SEQ ID NO: 8062138 - DNA, 22 bp, Homo sapiens
cagagccatccaggtgcctgtt

SEQ ID NO: 8062139 - DNA, 22 bp, Homo sapiens
cagagccattatggagacttgc

SEQ ID NO: 8062140 - DNA, 22 bp, Homo sapiens
cagagccatggtatgggcttgt

SEQ ID NO: 8062141 - DNA, 23 bp, Homo sapiens
cagagctggctcagagctgcctg

SEQ ID NO: 8062142 - DNA, 21 bp, Homo sapiens
cagagctgtccaaaccctgac

SEQ ID NO: 8062143 - DNA, 22 bp, Homo sapiens
cagagctgtcatttgccagtga

SEQ ID NO: 8062144 - DNA, 22 bp, Homo sapiens
cagagctgttactattcatgaa

SEQ ID NO: 8062145 - DNA, 20 bp, Homo sapiens
cagagctgttatggatgatg

SEQ ID NO: 8062146 - DNA, 22 bp, Homo sapiens
cagagctgttgcggggcttggc

SEQ ID NO: 8062147 - DNA, 22 bp, Homo sapiens
cagagctgtccaaaccctgaca

SEQ ID NO: 8062148 - DNA, 22 bp, Homo sapiens
cagagctgttactattcatgaa

SEQ ID NO: 8062149 - DNA, 22 bp, Homo sapiens
cagagctgtgataaatagatat

SEQ ID NO: 8062150 - DNA, 22 bp, Homo sapiens
cagatgaactctatcctgtggc

SEQ ID NO: 8062151 - DNA, 22 bp, Homo sapiens
cagatgaactaggctgcacttg

SEQ ID NO: 8062152 - DNA, 22 bp, Homo sapiens
agcctggaccaggggcctcaga

SEQ ID NO: 8062153 - DNA, 22 bp, Homo sapiens
agcccttgagtgtatctcaaat

SEQ ID NO: 8062154 - DNA, 23 bp, Homo sapiens
agcccttgataataaagcaccag

SEQ ID NO: 8062155 - DNA, 22 bp, Homo sapiens
agcccttcaacctgcctactcc

SEQ ID NO: 8062156 - DNA, 22 bp, Homo sapiens
cagatcctttatagcagtgtcc

SEQ ID NO: 8062157 - DNA, 22 bp, Homo sapiens
cagatcaagctgtatggtcaga

SEQ ID NO: 8062158 - DNA, 22 bp, Homo sapiens
agccctcttcccagatgcctca

SEQ ID NO: 8062159 - DNA, 22 bp, Homo sapiens
agccctctctttagagatctga

SEQ ID NO: 8062160 - DNA, 20 bp, Homo sapiens
agccctcttccagatgaagg

SEQ ID NO: 8062161 - DNA, 22 bp, Homo sapiens
cagagtggcagtcccaggccca

SEQ ID NO: 8062162 - DNA, 22 bp, Homo sapiens
cactggggaaaacaggcttctt

SEQ ID NO: 8062163 - DNA, 22 bp, Homo sapiens
cactgggcgtgtcctgggtgag

SEQ ID NO: 8062164 - DNA, 22 bp, Homo sapiens
cactggggtgggcctggtagag

SEQ ID NO: 8062165 - DNA, 22 bp, Homo sapiens
agccaaagtccaaatgcagtgt

SEQ ID NO: 8062166 - DNA, 22 bp, Homo sapiens
agcatttatttcttagaaattg

SEQ ID NO: 8062167 - DNA, 22 bp, Homo sapiens
cacctgagtgtcagtattctca

SEQ ID NO: 8062168 - DNA, 22 bp, Homo sapiens
cacgtgagaccttgcagaggtg

SEQ ID NO: 8062169 - DNA, 22 bp, Homo sapiens
agcaggctaatcttgctgaaca

SEQ ID NO: 8062170 - DNA, 22 bp, Homo sapiens
cacaggctccggccttgcagcc

SEQ ID NO: 8062171 - DNA, 18 bp, Homo sapiens
cacaggctcccagtgagg

SEQ ID NO: 8062172 - DNA, 19 bp, Homo sapiens
agcaggctaggctgcctct

SEQ ID NO: 8062173 - DNA, 20 bp, Homo sapiens
cacaggctatatgagagcca

SEQ ID NO: 8062174 - DNA, 22 bp, Homo sapiens
cacatgggcgtaatgtccatgg

SEQ ID NO: 8062175 - DNA, 22 bp, Homo sapiens
cacatgggcacagagaacttgg

SEQ ID NO: 8062176 - DNA, 22 bp, Homo sapiens
cacatggggcgctgcattggcc

SEQ ID NO: 8062177 - DNA, 22 bp, Homo sapiens
cacatgggtgtgcctggaggaa

SEQ ID NO: 8062178 - DNA, 22 bp, Homo sapiens
cacatgcttagatttcagtgga

SEQ ID NO: 8062179 - DNA, 22 bp, Homo sapiens
cacaggctcttctcacttgatt

SEQ ID NO: 8062180 - DNA, 22 bp, Homo sapiens
cacaggctgcccgcagctggga

SEQ ID NO: 8062181 - DNA, 22 bp, Homo sapiens
cacagaaaaaggcttgaaaatc

SEQ ID NO: 8062182 - DNA, 22 bp, Homo sapiens
agcaggcaggcccagcggctgg

SEQ ID NO: 8062183 - DNA, 22 bp, Homo sapiens
cacagaacaccaaagaaccttc

SEQ ID NO: 8062184 - DNA, 22 bp, Homo sapiens
cacagaaatattgtgtcccttg

SEQ ID NO: 8062185 - DNA, 22 bp, Homo sapiens
cacagctgccatgcagtcagtg

SEQ ID NO: 8062186 - DNA, 22 bp, Homo sapiens
cacagctgccatggctgcactt

SEQ ID NO: 8062187 - DNA, 22 bp, Homo sapiens
cacagctgccctactccatgtg

SEQ ID NO: 8062188 - DNA, 22 bp, Homo sapiens
cacagctgccctactccatgtg

SEQ ID NO: 8062189 - DNA, 22 bp, Homo sapiens
agcaattttcccttagtctttg

SEQ ID NO: 8062190 - DNA, 21 bp, Homo sapiens
agcagacagatgcacgcacac

SEQ ID NO: 8062191 - DNA, 21 bp, Homo sapiens
agcagacacttgtgaccttcc

SEQ ID NO: 8062192 - DNA, 22 bp, Homo sapiens
agcagacaggctgccacagtgc

SEQ ID NO: 8062193 - DNA, 22 bp, Homo sapiens
agcagacaggtaggaggataaa

SEQ ID NO: 8062194 - DNA, 22 bp, Homo sapiens
caagggaaggctaagggcaaca

SEQ ID NO: 8062195 - DNA, 22 bp, Homo sapiens
agcagagaagacacaggcttca

SEQ ID NO: 8062196 - DNA, 22 bp, Homo sapiens
caagggctcttttgaggaatgt

SEQ ID NO: 8062197 - DNA, 22 bp, Homo sapiens
caagggcttcaagtggccaaga

SEQ ID NO: 8062198 - DNA, 22 bp, Homo sapiens
caagtcattactgaaatgtcac

SEQ ID NO: 8062199 - DNA, 22 bp, Homo sapiens
caagggcctccaccttgctcgt

SEQ ID NO: 8062200 - DNA, 22 bp, Homo sapiens
caagggctcacggtctgctggg

SEQ ID NO: 8062201 - DNA, 22 bp, Homo sapiens
caagggacctgagatggtctct

SEQ ID NO: 8062202 - DNA, 22 bp, Homo sapiens
caagggagttactgagggcggg

SEQ ID NO: 8062203 - DNA, 22 bp, Homo sapiens
caatgtttttccttccttaata

SEQ ID NO: 8062204 - DNA, 22 bp, Homo sapiens
caagtctgacctctgggtgaag

SEQ ID NO: 8062205 - DNA, 22 bp, Homo sapiens
agaggccggccgagcccatggg

SEQ ID NO: 8062206 - DNA, 22 bp, Homo sapiens
agaggcctaaccaagatgtcct

SEQ ID NO: 8062207 - DNA, 22 bp, Homo sapiens
attatttgagttcctctctacc

SEQ ID NO: 8062208 - DNA, 22 bp, Homo sapiens
agaggccagggacactgctcaa

SEQ ID NO: 8062209 - DNA, 22 bp, Homo sapiens
agagctgtttgtctagagagtg

SEQ ID NO: 8062210 - DNA, 23 bp, Homo sapiens
agagctttctaaaatgtaaatct

SEQ ID NO: 8062211 - DNA, 22 bp, Homo sapiens
attctaaatgtaatttagaatt

SEQ ID NO: 8062212 - DNA, 22 bp, Homo sapiens
attctaaagcttgtggagctta

SEQ ID NO: 8062213 - DNA, 22 bp, Homo sapiens
attgtatgcagcattaagcaat

SEQ ID NO: 8062214 - DNA, 22 bp, Homo sapiens
attgtggctagacagtcacaat

SEQ ID NO: 8062215 - DNA, 22 bp, Homo sapiens
attgtggtgtcagttataggca

SEQ ID NO: 8062216 - DNA, 22 bp, Homo sapiens
attgtattataattaggccaaa

SEQ ID NO: 8062217 - DNA, 22 bp, Homo sapiens
attgtatttaggagaaaagggt

SEQ ID NO: 8062218 - DNA, 22 bp, Homo sapiens
attgtattagcacaatacaatt

SEQ ID NO: 8062219 - DNA, 22 bp, Homo sapiens
attgtattagcacaatacaatt

SEQ ID NO: 8062220 - DNA, 22 bp, Homo sapiens
agatacaaggcagagatgtgca

SEQ ID NO: 8062221 - DNA, 22 bp, Homo sapiens
agataatttgagtaaattaatt

SEQ ID NO: 8062222 - DNA, 22 bp, Homo sapiens
agataattatttacttcaaagt

SEQ ID NO: 8062223 - DNA, 22 bp, Homo sapiens
attttttcagattgagtgttaa

SEQ ID NO: 8062224 - DNA, 22 bp, Homo sapiens
agcaagatgcattatttcttat

SEQ ID NO: 8062225 - DNA, 22 bp, Homo sapiens
attttttgttaactcaggatag

SEQ ID NO: 8062226 - DNA, 22 bp, Homo sapiens
attttttctgtaaactggcctt

SEQ ID NO: 8062227 - DNA, 20 bp, Homo sapiens
agcaaggctggagcttatgg

SEQ ID NO: 8062228 - DNA, 22 bp, Homo sapiens
caaagtgctgggattacaggct

SEQ ID NO: 8062229 - DNA, 22 bp, Homo sapiens
caaagggctctagactcagcag

SEQ ID NO: 8062230 - DNA, 22 bp, Homo sapiens
caaagtgctgggattacaggtg

SEQ ID NO: 8062231 - DNA, 22 bp, Homo sapiens
agattggatcaagcagcagttg

SEQ ID NO: 8062232 - DNA, 22 bp, Homo sapiens
agatgtttgtgttatctccatt

SEQ ID NO: 8062233 - DNA, 22 bp, Homo sapiens
atttcttttcaagagggtgctt

SEQ ID NO: 8062234 - DNA, 22 bp, Homo sapiens
agatgactaacatagtattgct

SEQ ID NO: 8062235 - DNA, 21 bp, Homo sapiens
agatgaggatactgaggccta

SEQ ID NO: 8062236 - DNA, 22 bp, Homo sapiens
agatgaggggtagaaaggactt

SEQ ID NO: 8062237 - DNA, 23 bp, Homo sapiens
agatgaggcttctccatgttggt

SEQ ID NO: 8062238 - DNA, 22 bp, Homo sapiens
atgccaggagatggagcagagt

SEQ ID NO: 8062239 - DNA, 22 bp, Homo sapiens
atgccaggccccacgctgggca

SEQ ID NO: 8062240 - DNA, 22 bp, Homo sapiens
atgccacttcattccagcctcg

SEQ ID NO: 8062241 - DNA, 22 bp, Homo sapiens
atgccatctgaaatctgtcata

SEQ ID NO: 8062242 - DNA, 22 bp, Homo sapiens
atgccattgtatattcattgat

SEQ ID NO: 8062243 - DNA, 22 bp, Homo sapiens
agacataagtgctatgacattg

SEQ ID NO: 8062244 - DNA, 22 bp, Homo sapiens
agacataagtgctatgacattg

SEQ ID NO: 8062245 - DNA, 22 bp, Homo sapiens
agagaaaagagttcaggctttg

SEQ ID NO: 8062246 - DNA, 22 bp, Homo sapiens
atgcttctgtgtatgtttcagg

SEQ ID NO: 8062247 - DNA, 22 bp, Homo sapiens
agagaacacgtgcatctgcaat

SEQ ID NO: 8062248 - DNA, 22 bp, Homo sapiens
atgctgataactttcagtgaca

SEQ ID NO: 8062249 - DNA, 18 bp, Homo sapiens
atgctgccctctgagggt

SEQ ID NO: 8062250 - DNA, 22 bp, Homo sapiens
atgctgcacaagccacatgtag

SEQ ID NO: 8062251 - DNA, 22 bp, Homo sapiens
atgctgattttatagaataaag

SEQ ID NO: 8062252 - DNA, 22 bp, Homo sapiens
atgattgaaaatgacattgcca

SEQ ID NO: 8062253 - DNA, 22 bp, Homo sapiens
atgattctcattttataaactt

SEQ ID NO: 8062254 - DNA, 22 bp, Homo sapiens
atgcaaattaacatatagtaga

SEQ ID NO: 8062255 - DNA, 22 bp, Homo sapiens
atgcaaatgtcaccacttctaa

SEQ ID NO: 8062256 - DNA, 21 bp, Homo sapiens
atgactgtggcacttaggagg

SEQ ID NO: 8062257 - DNA, 22 bp, Homo sapiens
atctgtttaattcattttcaca

SEQ ID NO: 8062258 - DNA, 22 bp, Homo sapiens
atctgggttcaccatgctcctg

SEQ ID NO: 8062259 - DNA, 22 bp, Homo sapiens
agagccaggatctgttttgggg

SEQ ID NO: 8062260 - DNA, 22 bp, Homo sapiens
agagccaggactgtgtctcact

SEQ ID NO: 8062261 - DNA, 22 bp, Homo sapiens
atgttattttggaaaatacaaa

SEQ ID NO: 8062262 - DNA, 22 bp, Homo sapiens
agagccaggatgtcttctgggg

SEQ ID NO: 8062263 - DNA, 22 bp, Homo sapiens
agagccagccttctcagcttac

SEQ ID NO: 8062264 - DNA, 22 bp, Homo sapiens
agagccagcatttgggccctgc

SEQ ID NO: 8062265 - DNA, 22 bp, Homo sapiens
agagccagcatttgacactggc

SEQ ID NO: 8062266 - DNA, 22 bp, Homo sapiens
agagatggtagaacagtcataa

SEQ ID NO: 8062267 - DNA, 22 bp, Homo sapiens
atgtcttctctgtaggtaaatt

SEQ ID NO: 8062268 - DNA, 22 bp, Homo sapiens
atgtcttctgtggagacaggta

SEQ ID NO: 8062269 - DNA, 22 bp, Homo sapiens
atgtgcataaacatattgttgg

SEQ ID NO: 8062270 - DNA, 22 bp, Homo sapiens
agagctctggcctattggggcc

SEQ ID NO: 8062271 - DNA, 22 bp, Homo sapiens
agagctcaagacgctcacagta

SEQ ID NO: 8062272 - DNA, 22 bp, Homo sapiens
agagctatatacagattattga

SEQ ID NO: 8062273 - DNA, 22 bp, Homo sapiens
agagccttgaagatctggaaaa

SEQ ID NO: 8062274 - DNA, 22 bp, Homo sapiens
atgttctacagatggaaagggg

SEQ ID NO: 8062275 - DNA, 21 bp, Homo sapiens
agagcggcggggcgcgtctgc

SEQ ID NO: 8062276 - DNA, 20 bp, Homo sapiens
agagccttgaggaagatgat

SEQ ID NO: 8062277 - DNA, 22 bp, Homo sapiens
atgttcattagtcaacatttct

SEQ ID NO: 8062278 - DNA, 22 bp, Homo sapiens
atgttcatttgacaagtagtga

SEQ ID NO: 8062279 - DNA, 22 bp, Homo sapiens
atgttcatccatgtcgtagcag

SEQ ID NO: 8062280 - DNA, 18 bp, Homo sapiens
atgggaggggccaagaga

SEQ ID NO: 8062281 - DNA, 18 bp, Homo sapiens
atgggaggggccaagaga

SEQ ID NO: 8062282 - DNA, 22 bp, Homo sapiens
atgggcatgatattagtaccta

SEQ ID NO: 8062283 - DNA, 22 bp, Homo sapiens
agagaagacttacagccacagt

SEQ ID NO: 8062284 - DNA, 22 bp, Homo sapiens
agagaacatattttgtatgatt

SEQ ID NO: 8062285 - DNA, 22 bp, Homo sapiens
agagaacagcctcctagagaaa

SEQ ID NO: 8062286 - DNA, 22 bp, Homo sapiens
agagactggagatgggcagtgt

SEQ ID NO: 8062287 - DNA, 22 bp, Homo sapiens
agagactgtaatgagaggtaca

SEQ ID NO: 8062288 - DNA, 22 bp, Homo sapiens
agagactttgtctattttgttc

SEQ ID NO: 8062289 - DNA, 22 bp, Homo sapiens
agagacttaaaactgttttcac

SEQ ID NO: 8062290 - DNA, 21 bp, Homo sapiens
agagactgtcactgcagtacc

SEQ ID NO: 8062291 - DNA, 17 bp, Homo sapiens
atgtatattaactctga

SEQ ID NO: 8062292 - DNA, 22 bp, Homo sapiens
atgtataatgctaattagctag

SEQ ID NO: 8062293 - DNA, 22 bp, Homo sapiens
atgtatatgaagctagtatttt

SEQ ID NO: 8062294 - DNA, 18 bp, Homo sapiens
actctttctgcccacagg

SEQ ID NO: 8062295 - DNA, 22 bp, Homo sapiens
acctgcctctaagcagcaggtg

SEQ ID NO: 8062296 - DNA, 22 bp, Homo sapiens
acctgcctcagtgcagctggat

SEQ ID NO: 8062297 - DNA, 22 bp, Homo sapiens
aagtgtgagacacacaaaatta

SEQ ID NO: 8062298 - DNA, 22 bp, Homo sapiens
actcttgtctcaacttttgtat

SEQ ID NO: 8062299 - DNA, 22 bp, Homo sapiens
aagtgttaaagacttgaacact

SEQ ID NO: 8062300 - DNA, 22 bp, Homo sapiens
actgggagggtcttgaagaggg

SEQ ID NO: 8062301 - DNA, 22 bp, Homo sapiens
actgggaggcatctggagctga

SEQ ID NO: 8062302 - DNA, 22 bp, Homo sapiens
actgggaggcatctggagctga

SEQ ID NO: 8062303 - DNA, 22 bp, Homo sapiens
actgggaggcaaagagcaagga

SEQ ID NO: 8062304 - DNA, 22 bp, Homo sapiens
actgggaggcaaagagcaagga

SEQ ID NO: 8062305 - DNA, 22 bp, Homo sapiens
aataaaatgaactggtagagtt

SEQ ID NO: 8062306 - DNA, 22 bp, Homo sapiens
aataaaatgaactggtagagtt

SEQ ID NO: 8062307 - DNA, 22 bp, Homo sapiens
aataatagcagagtttacaatc

SEQ ID NO: 8062308 - DNA, 22 bp, Homo sapiens
aataataagatactaagggagt

SEQ ID NO: 8062309 - DNA, 22 bp, Homo sapiens
aataatacatgagattaatgtt

SEQ ID NO: 8062310 - DNA, 22 bp, Homo sapiens
aataataagatactaagggagt

SEQ ID NO: 8062311 - DNA, 22 bp, Homo sapiens
actgggcaccatcatgagatag

SEQ ID NO: 8062312 - DNA, 22 bp, Homo sapiens
actgggcaccatcatgagatgg

SEQ ID NO: 8062313 - DNA, 22 bp, Homo sapiens
actgggcaaggatatgatgggt

SEQ ID NO: 8062314 - DNA, 22 bp, Homo sapiens
actgggagttctccatgtccct

SEQ ID NO: 8062315 - DNA, 22 bp, Homo sapiens
aatagcatcctgtatctcttcc

SEQ ID NO: 8062316 - DNA, 22 bp, Homo sapiens
aatagaatgtaatctaatacat

SEQ ID NO: 8062317 - DNA, 22 bp, Homo sapiens
actgtccttttaatgcagccgt

SEQ ID NO: 8062318 - DNA, 22 bp, Homo sapiens
agaaaggcagggatgaggattg

SEQ ID NO: 8062319 - DNA, 21 bp, Homo sapiens
aatccttaatgaggagttggt

SEQ ID NO: 8062320 - DNA, 22 bp, Homo sapiens
aatcggttgaacccaggaagtg

SEQ ID NO: 8062321 - DNA, 22 bp, Homo sapiens
aatcgcttggtaattttaaaag

SEQ ID NO: 8062322 - DNA, 22 bp, Homo sapiens
agaaagggagagccagcacacg

SEQ ID NO: 8062323 - DNA, 22 bp, Homo sapiens
agaaagggagcgtggatcaatt

SEQ ID NO: 8062324 - DNA, 22 bp, Homo sapiens
agaaagggatgaggtagctgct

SEQ ID NO: 8062325 - DNA, 22 bp, Homo sapiens
agaaagggaactggcaaagcca

SEQ ID NO: 8062326 - DNA, 22 bp, Homo sapiens
agaaagggaccagttcttttga

SEQ ID NO: 8062327 - DNA, 22 bp, Homo sapiens
actttgcaaaaggaaatcacct

SEQ ID NO: 8062328 - DNA, 22 bp, Homo sapiens
acttttaaatgagtttcagttg

SEQ ID NO: 8062329 - DNA, 22 bp, Homo sapiens
acttttaaggggccttgattta

SEQ ID NO: 8062330 - DNA, 22 bp, Homo sapiens
aatagcttttgtatgatgaaat

SEQ ID NO: 8062331 - DNA, 22 bp, Homo sapiens
aatagctttctcatgacttcac

SEQ ID NO: 8062332 - DNA, 22 bp, Homo sapiens
aatagcttattgacagtgaatt

SEQ ID NO: 8062333 - DNA, 22 bp, Homo sapiens
aatagcttggacccattgcttt

SEQ ID NO: 8062334 - DNA, 22 bp, Homo sapiens
aatagcttagtcctgattctgt

SEQ ID NO: 8062335 - DNA, 22 bp, Homo sapiens
aatagctcactgatttctcttt

SEQ ID NO: 8062336 - DNA, 22 bp, Homo sapiens
aatagcatgtaagtttaaaaga

SEQ ID NO: 8062337 - DNA, 22 bp, Homo sapiens
aatgcattttattatatgtgac

SEQ ID NO: 8062338 - DNA, 18 bp, Homo sapiens
aatgcatttatggagatg

SEQ ID NO: 8062339 - DNA, 22 bp, Homo sapiens
aatgccagtgtgttgattccag

SEQ ID NO: 8062340 - DNA, 22 bp, Homo sapiens
aatgccttcaagtatctgagga

SEQ ID NO: 8062341 - DNA, 22 bp, Homo sapiens
aatgcattgttgatttggagtg

SEQ ID NO: 8062342 - DNA, 22 bp, Homo sapiens
aatgcattctcggtttgtgtgt

SEQ ID NO: 8062343 - DNA, 22 bp, Homo sapiens
aatgcacaaaggtgtctattgc

SEQ ID NO: 8062344 - DNA, 22 bp, Homo sapiens
agaagccagcttcagctgcccg

SEQ ID NO: 8062345 - DNA, 22 bp, Homo sapiens
aatgcacaaaaattgtatgtaa

SEQ ID NO: 8062346 - DNA, 22 bp, Homo sapiens
agaagccaccagctgaggaaga

SEQ ID NO: 8062347 - DNA, 22 bp, Homo sapiens
agaagccactgctcccagtgag

SEQ ID NO: 8062348 - DNA, 22 bp, Homo sapiens
agaagccactggaggttgagat

SEQ ID NO: 8062349 - DNA, 22 bp, Homo sapiens
agaacaattgccccaaagcttg

SEQ ID NO: 8062350 - DNA, 22 bp, Homo sapiens
agaagaaactgtcggggatatt

SEQ ID NO: 8062351 - DNA, 22 bp, Homo sapiens
agaagaaactgtcggggatatt

SEQ ID NO: 8062352 - DNA, 22 bp, Homo sapiens
aagggcagaatagagaagatgg

SEQ ID NO: 8062353 - DNA, 20 bp, Homo sapiens
aagggcagagggaacagact

SEQ ID NO: 8062354 - DNA, 22 bp, Homo sapiens
aagggcagagggaatcccacat

SEQ ID NO: 8062355 - DNA, 22 bp, Homo sapiens
acatttcagatgtaatgtgatg

SEQ ID NO: 8062356 - DNA, 22 bp, Homo sapiens
aagggcagaaagggacgctttg

SEQ ID NO: 8062357 - DNA, 22 bp, Homo sapiens
aagggaggtaaagctatttaaa

SEQ ID NO: 8062358 - DNA, 22 bp, Homo sapiens
acatttcagtaagtgttaattt

SEQ ID NO: 8062359 - DNA, 22 bp, Homo sapiens
acatttcagcgtgcatgacatg

SEQ ID NO: 8062360 - DNA, 19 bp, Homo sapiens
aagggctgggcacctcact

SEQ ID NO: 8062361 - DNA, 22 bp, Homo sapiens
accagagctggctctgagcacc

SEQ ID NO: 8062362 - DNA, 22 bp, Homo sapiens
acctcctggcctcaagcaatcc

SEQ ID NO: 8062363 - DNA, 22 bp, Homo sapiens
acctcctggctgctcatggaac

SEQ ID NO: 8062364 - DNA, 22 bp, Homo sapiens
acctcctggtgcccaagtgttt

SEQ ID NO: 8062365 - DNA, 22 bp, Homo sapiens
acctcctggcttatcatggaca

SEQ ID NO: 8062366 - DNA, 22 bp, Homo sapiens
aagtagttggaaataagacaga

SEQ ID NO: 8062367 - DNA, 22 bp, Homo sapiens
aagtagttagtccgcctgctct

SEQ ID NO: 8062368 - DNA, 22 bp, Homo sapiens
aagtagttgtccctgaggaacg

SEQ ID NO: 8062369 - DNA, 22 bp, Homo sapiens
aagtcatagtcgggaaagacat

SEQ ID NO: 8062370 - DNA, 22 bp, Homo sapiens
aagtccagtttttccaggtggt

SEQ ID NO: 8062371 - DNA, 22 bp, Homo sapiens
aagtccatctctgccccacaca

SEQ ID NO: 8062372 - DNA, 22 bp, Homo sapiens
aagtccagtgctttagattcca

SEQ ID NO: 8062373 - DNA, 22 bp, Homo sapiens
aagtccagtttcatttgaggtc

SEQ ID NO: 8062374 - DNA, 22 bp, Homo sapiens
aagtccttaggaagcagtcgtt

SEQ ID NO: 8062375 - DNA, 22 bp, Homo sapiens
aagtccttgtatacagaatcaa

SEQ ID NO: 8062376 - DNA, 22 bp, Homo sapiens
acctgcctagttggttctgccc

SEQ ID NO: 8062377 - DNA, 22 bp, Homo sapiens
acctgcctatcagctgcctgct

SEQ ID NO: 8062378 - DNA, 22 bp, Homo sapiens
acctgcctatggagccacatgg

SEQ ID NO: 8062379 - DNA, 23 bp, Homo sapiens
aagcttccttcacgtctcctggg

SEQ ID NO: 8062380 - DNA, 22 bp, Homo sapiens
aagcttcttagaatgcatgtgc

SEQ ID NO: 8062381 - DNA, 21 bp, Homo sapiens
aagcttccctgctctccaggg

SEQ ID NO: 8062382 - DNA, 22 bp, Homo sapiens
aagcttcctgaatgctcattta

SEQ ID NO: 8062383 - DNA, 22 bp, Homo sapiens
aagctgttaatggcttgcagct

SEQ ID NO: 8062384 - DNA, 22 bp, Homo sapiens
acagctggaggtctgtgagcac

SEQ ID NO: 8062385 - DNA, 22 bp, Homo sapiens
acagctggaggccccattgtcc

SEQ ID NO: 8062386 - DNA, 22 bp, Homo sapiens
aagctgtgaagagcaagtgagg

SEQ ID NO: 8062387 - DNA, 22 bp, Homo sapiens
aagctgtgcaggaactgcttgc

SEQ ID NO: 8062388 - DNA, 22 bp, Homo sapiens
aaggaagggaaatagtgatgtc

SEQ ID NO: 8062389 - DNA, 22 bp, Homo sapiens
aaggcattacctaagtttggga

SEQ ID NO: 8062390 - DNA, 22 bp, Homo sapiens
acatgaagtggtcagatcaaac

SEQ ID NO: 8062391 - DNA, 22 bp, Homo sapiens
acatctcagaactgagtaaccg

SEQ ID NO: 8062392 - DNA, 22 bp, Homo sapiens
acatgaaatgcagcctgtaacc

SEQ ID NO: 8062393 - DNA, 20 bp, Homo sapiens
acatcctggtgactagaact

SEQ ID NO: 8062394 - DNA, 22 bp, Homo sapiens
acatcccacagaaacatacata

SEQ ID NO: 8062395 - DNA, 22 bp, Homo sapiens
acatcccatgcgcatctggcaa

SEQ ID NO: 8062396 - DNA, 22 bp, Homo sapiens
agagaagggcctgtatgtaatc

SEQ ID NO: 8062397 - DNA, 21 bp, Homo sapiens
agagaagggactcttccagtc

SEQ ID NO: 8062398 - DNA, 22 bp, Homo sapiens
agagcaaagggacatggaagag

SEQ ID NO: 8062399 - DNA, 22 bp, Homo sapiens
agacatgagaaacccaccagag

SEQ ID NO: 8062400 - DNA, 22 bp, Homo sapiens
agacatcctggggagggcaatg

SEQ ID NO: 8062401 - DNA, 22 bp, Homo sapiens
agacatcagcttgtgtgcaggg

SEQ ID NO: 8062402 - DNA, 22 bp, Homo sapiens
aatgctcaaaatgtttcatcta

SEQ ID NO: 8062403 - DNA, 22 bp, Homo sapiens
aatgcctttccactgggtatca

SEQ ID NO: 8062404 - DNA, 22 bp, Homo sapiens
aatgccttggagagcctagagg

SEQ ID NO: 8062405 - DNA, 22 bp, Homo sapiens
aatgtatgacagttctagtggt

SEQ ID NO: 8062406 - DNA, 22 bp, Homo sapiens
aatgtatgtgattattcctcta

SEQ ID NO: 8062407 - DNA, 23 bp, Homo sapiens
aatgtatgttagtatcttagaga

SEQ ID NO: 8062408 - DNA, 18 bp, Homo sapiens
aatttccatatgaattgc

SEQ ID NO: 8062409 - DNA, 22 bp, Homo sapiens
agaggaggtccttttctgatgt

SEQ ID NO: 8062410 - DNA, 22 bp, Homo sapiens
agagctgagcaccaagcatggt

SEQ ID NO: 8062411 - DNA, 22 bp, Homo sapiens
agagctgaatttgggtggtgga

SEQ ID NO: 8062412 - DNA, 22 bp, Homo sapiens
agagctgaggatccagctgagc

SEQ ID NO: 8062413 - DNA, 22 bp, Homo sapiens
agagctgatttgattacagtgc

SEQ ID NO: 8062414 - DNA, 22 bp, Homo sapiens
agagctgcaatttcatgtggtg

SEQ ID NO: 8062415 - DNA, 22 bp, Homo sapiens
agagctgcagggtggacccagg

SEQ ID NO: 8062416 - DNA, 22 bp, Homo sapiens
agagctgcccacacagcagatt

SEQ ID NO: 8062417 - DNA, 22 bp, Homo sapiens
agagctgccgagctggggccat

SEQ ID NO: 8062418 - DNA, 22 bp, Homo sapiens
agcacaggaccaaggaagctgt

SEQ ID NO: 8062419 - DNA, 22 bp, Homo sapiens
agcacaggctttggtgtgaggg

SEQ ID NO: 8062420 - DNA, 22 bp, Homo sapiens
acacaacagaagagcaattgca

SEQ ID NO: 8062421 - DNA, 22 bp, Homo sapiens
agcacacaggacttgattcatg

SEQ ID NO: 8062422 - DNA, 22 bp, Homo sapiens
acaacatttaaggaggcactga

SEQ ID NO: 8062423 - DNA, 22 bp, Homo sapiens
agcaaagttaaggtttctcttt

SEQ ID NO: 8062424 - DNA, 22 bp, Homo sapiens
agcaaagtcagtggaaccatcc

SEQ ID NO: 8062425 - DNA, 22 bp, Homo sapiens
agcaaagtagctgctgttctta

SEQ ID NO: 8062426 - DNA, 20 bp, Homo sapiens
acaatacaggttgtgtctga

SEQ ID NO: 8062427 - DNA, 22 bp, Homo sapiens
acaacagggtaaggcaggccat

SEQ ID NO: 8062428 - DNA, 22 bp, Homo sapiens
acaacagggtaaggcaggccat

SEQ ID NO: 8062429 - DNA, 22 bp, Homo sapiens
acaaagtcacaataattaacct

SEQ ID NO: 8062430 - DNA, 22 bp, Homo sapiens
acaaagtcaaattgcagccgcc

SEQ ID NO: 8062431 - DNA, 22 bp, Homo sapiens
acaaagtgaattgcatcgagtt

SEQ ID NO: 8062432 - DNA, 22 bp, Homo sapiens
acaaagtctctaataatcttct

SEQ ID NO: 8062433 - DNA, 22 bp, Homo sapiens
acaaagtcctggtgtatggcca

SEQ ID NO: 8062434 - DNA, 22 bp, Homo sapiens
acaaagtctgaaacctgaggca

SEQ ID NO: 8062435 - DNA, 22 bp, Homo sapiens
acaaagtcttttacaacagtca

SEQ ID NO: 8062436 - DNA, 22 bp, Homo sapiens
acaaagtgcacaagatgagaac

SEQ ID NO: 8062437 - DNA, 18 bp, Homo sapiens
aatttctttgacaactta

SEQ ID NO: 8062438 - DNA, 22 bp, Homo sapiens
aatttgtatacatgttacattt

SEQ ID NO: 8062439 - DNA, 22 bp, Homo sapiens
agagtggtacttctttttcttc

SEQ ID NO: 8062440 - DNA, 22 bp, Homo sapiens
agagtgtttttctgtcaaggac

SEQ ID NO: 8062441 - DNA, 22 bp, Homo sapiens
agagtgtaccaaatatcctaca

SEQ ID NO: 8062442 - DNA, 22 bp, Homo sapiens
agagttaagacgtacatgagtg

SEQ ID NO: 8062443 - DNA, 22 bp, Homo sapiens
agccagagctgatgtcattctc

SEQ ID NO: 8062444 - DNA, 20 bp, Homo sapiens
acactgttcttcacacattt

SEQ ID NO: 8062445 - DNA, 22 bp, Homo sapiens
agccagctggagaccactgttt

SEQ ID NO: 8062446 - DNA, 22 bp, Homo sapiens
agccagaggccagcctgcctca

SEQ ID NO: 8062447 - DNA, 22 bp, Homo sapiens
agccaggaaccagctacagtct

SEQ ID NO: 8062448 - DNA, 22 bp, Homo sapiens
agccaggaagaaggtcacacca

SEQ ID NO: 8062449 - DNA, 22 bp, Homo sapiens
agccaaggcagctagagctctg

SEQ ID NO: 8062450 - DNA, 22 bp, Homo sapiens
acacccagctgggccacctcca

SEQ ID NO: 8062451 - DNA, 22 bp, Homo sapiens
acacccagattatgcacacaaa

SEQ ID NO: 8062452 - DNA, 22 bp, Homo sapiens
agccaaggacacggagcctcct

SEQ ID NO: 8062453 - DNA, 22 bp, Homo sapiens
agcaggtgtcactttcactcca

SEQ ID NO: 8062454 - DNA, 18 bp, Homo sapiens
acacagtggatgcctggt

SEQ ID NO: 8062455 - DNA, 22 bp, Homo sapiens
acacacacaagcaggttgtgga

SEQ ID NO: 8062456 - DNA, 19 bp, Homo sapiens
acacagggctagagttaca

SEQ ID NO: 8062457 - DNA, 22 bp, Homo sapiens
acacaagattgtgtattgaatt

SEQ ID NO: 8062458 - DNA, 23 bp, Homo sapiens
acacaagggtaactgccagccat

SEQ ID NO: 8062459 - DNA, 22 bp, Homo sapiens
agcaggcttgttatgtctgaga

SEQ ID NO: 8062460 - DNA, 22 bp, Homo sapiens
agcaggctttccacagaaggag

SEQ ID NO: 8062461 - DNA, 22 bp, Homo sapiens
acacatcagaaatatgaatgag

SEQ ID NO: 8062462 - DNA, 22 bp, Homo sapiens
acagcagcgtcaacttaaaatt

SEQ ID NO: 8062463 - DNA, 22 bp, Homo sapiens
acagcagcgtgaagtgtgttat

SEQ ID NO: 8062464 - DNA, 22 bp, Homo sapiens
acagcagccttgttggtttcga

SEQ ID NO: 8062465 - DNA, 22 bp, Homo sapiens
acagcagcgtcaacttaaaatt

SEQ ID NO: 8062466 - DNA, 22 bp, Homo sapiens
agctgagcacattcaaacaggt

SEQ ID NO: 8062467 - DNA, 22 bp, Homo sapiens
agctgagttaattcatcactta

SEQ ID NO: 8062468 - DNA, 22 bp, Homo sapiens
acagcagcataaactgactaag

SEQ ID NO: 8062469 - DNA, 22 bp, Homo sapiens
acagcagccagccactgtgagc

SEQ ID NO: 8062470 - DNA, 21 bp, Homo sapiens
acagcagcaatctgtctttcc

SEQ ID NO: 8062471 - DNA, 22 bp, Homo sapiens
acagcagcaatagcagtgacat

SEQ ID NO: 8062472 - DNA, 22 bp, Homo sapiens
acagcagattacattctgctat

SEQ ID NO: 8062473 - DNA, 22 bp, Homo sapiens
acagcagatgacaactatttat

SEQ ID NO: 8062474 - DNA, 20 bp, Homo sapiens
acagcagataccacaactat

SEQ ID NO: 8062475 - DNA, 22 bp, Homo sapiens
acagcagaccccagtgccatgg

SEQ ID NO: 8062476 - DNA, 22 bp, Homo sapiens
acagcagagtgtgagatagcca

SEQ ID NO: 8062477 - DNA, 22 bp, Homo sapiens
agcgtatgaatatttgaagaga

SEQ ID NO: 8062478 - DNA, 20 bp, Homo sapiens
agcggcagcttcctgcttcg

SEQ ID NO: 8062479 - DNA, 22 bp, Homo sapiens
agccttcaacctagctagagca

SEQ ID NO: 8062480 - DNA, 22 bp, Homo sapiens
agccttcactgggaccttggat

SEQ ID NO: 8062481 - DNA, 22 bp, Homo sapiens
agcgggtgctgtgtcagccctc

SEQ ID NO: 8062482 - DNA, 22 bp, Homo sapiens
acagaggccccgtgggagagcc

SEQ ID NO: 8062483 - DNA, 22 bp, Homo sapiens
acagagctgtacatgtgccatg

SEQ ID NO: 8062484 - DNA, 22 bp, Homo sapiens
acagaaggcggggacaaggcgg

SEQ ID NO: 8062485 - DNA, 19 bp, Homo sapiens
acagaagcatagaaaagga

SEQ ID NO: 8062486 - DNA, 22 bp, Homo sapiens
aaatacatacactgtacgtggc

SEQ ID NO: 8062487 - DNA, 22 bp, Homo sapiens
aaatacataaaggttgtaccag

SEQ ID NO: 8062488 - DNA, 22 bp, Homo sapiens
aaatatagtaaatgcatagttc

SEQ ID NO: 8062489 - DNA, 22 bp, Homo sapiens
aagagtttcttactggcatcta

SEQ ID NO: 8062490 - DNA, 22 bp, Homo sapiens
aagagtttgacctgtgccatcc

SEQ ID NO: 8062491 - DNA, 22 bp, Homo sapiens
aagagttttctctgatggcatt

SEQ ID NO: 8062492 - DNA, 22 bp, Homo sapiens
aagagtttttggagtgtgagtt

SEQ ID NO: 8062493 - DNA, 22 bp, Homo sapiens
aagagagacaataggtagcatt

SEQ ID NO: 8062494 - DNA, 22 bp, Homo sapiens
aagagagagcattcttctgtta

SEQ ID NO: 8062495 - DNA, 22 bp, Homo sapiens
aaatgaacagttgcattctctg

SEQ ID NO: 8062496 - DNA, 23 bp, Homo sapiens
aaatgacatatggtttctgaagg

SEQ ID NO: 8062497 - DNA, 22 bp, Homo sapiens
aaatcagagaatatatttagaa

SEQ ID NO: 8062498 - DNA, 22 bp, Homo sapiens
aaatcagacacagtgaaagtta

SEQ ID NO: 8062499 - DNA, 22 bp, Homo sapiens
aaatgatgattaaaatgaggta

SEQ ID NO: 8062500 - DNA, 22 bp, Homo sapiens
aaatattggtaggatgcttgtt

SEQ ID NO: 8062501 - DNA, 22 bp, Homo sapiens
aaatgatgtggagtgaaattgt

SEQ ID NO: 8062502 - DNA, 22 bp, Homo sapiens
aaatgatggtactcatgtttag

SEQ ID NO: 8062503 - DNA, 23 bp, Homo sapiens
aaatgatgtgtgttgtcccattc

SEQ ID NO: 8062504 - DNA, 22 bp, Homo sapiens
aaatgatggaaatgaggctgaa

SEQ ID NO: 8062505 - DNA, 20 bp, Homo sapiens
aaatgatgggaataatctat

SEQ ID NO: 8062506 - DNA, 22 bp, Homo sapiens
aaatgatgctcacagattagtg

SEQ ID NO: 8062507 - DNA, 22 bp, Homo sapiens
aaatgatgctacagttttccca

SEQ ID NO: 8062508 - DNA, 22 bp, Homo sapiens
aaatgatgttataagaccagga

SEQ ID NO: 8062509 - DNA, 22 bp, Homo sapiens
aaatgcaaggattttgttaggc

SEQ ID NO: 8062510 - DNA, 22 bp, Homo sapiens
aaatgcaagttcatattttgtt

SEQ ID NO: 8062511 - DNA, 22 bp, Homo sapiens
aaatgcttagaggtgttcaaat

SEQ ID NO: 8062512 - DNA, 22 bp, Homo sapiens
aaatgcttagaggtgttcaaat

SEQ ID NO: 8062513 - DNA, 22 bp, Homo sapiens
aaatgcttattagtgtcacaaa

SEQ ID NO: 8062514 - DNA, 22 bp, Homo sapiens
aaatgcttattagtgtcacaaa

SEQ ID NO: 8062515 - DNA, 22 bp, Homo sapiens
aaatgctgcagctagtgtgttt

SEQ ID NO: 8062516 - DNA, 22 bp, Homo sapiens
aaatgctgtaactgatattctg

SEQ ID NO: 8062517 - DNA, 21 bp, Homo sapiens
aaatgctttgtatatatctgt

SEQ ID NO: 8062518 - DNA, 22 bp, Homo sapiens
aaatgcttgctcttgattattt

SEQ ID NO: 8062519 - DNA, 22 bp, Homo sapiens
aaatgcttgtaaattttccatg

SEQ ID NO: 8062520 - DNA, 22 bp, Homo sapiens
aaatgcttcacctcattaaact

SEQ ID NO: 8062521 - DNA, 22 bp, Homo sapiens
aaatgcttgctcttgattattt

SEQ ID NO: 8062522 - DNA, 22 bp, Homo sapiens
aaagcatttcatgtctagaaag

SEQ ID NO: 8062523 - DNA, 22 bp, Homo sapiens
aacttcttggtcctgagctgtt

SEQ ID NO: 8062524 - DNA, 22 bp, Homo sapiens
aaagtctgagcagaatttctca

SEQ ID NO: 8062525 - DNA, 20 bp, Homo sapiens
aaagtctgtttatctctgga

SEQ ID NO: 8062526 - DNA, 22 bp, Homo sapiens
aaaggcatgattaattctgtgt

SEQ ID NO: 8062527 - DNA, 22 bp, Homo sapiens
aaaggcatgattaattctgtgt

SEQ ID NO: 8062528 - DNA, 22 bp, Homo sapiens
aaaggctccttctcccatgacc

SEQ ID NO: 8062529 - DNA, 18 bp, Homo sapiens
aaaggctgaatatagaag

SEQ ID NO: 8062530 - DNA, 22 bp, Homo sapiens
aaaggctggggactgaggaagg

SEQ ID NO: 8062531 - DNA, 22 bp, Homo sapiens
aaaggcttcagtgagtgggtat

SEQ ID NO: 8062532 - DNA, 22 bp, Homo sapiens
aaaggcttgtccagtaagggga

SEQ ID NO: 8062533 - DNA, 22 bp, Homo sapiens
aaagctcacagtaatacaaggc

SEQ ID NO: 8062534 - DNA, 22 bp, Homo sapiens
aaagctatgaggcatgcatttc

SEQ ID NO: 8062535 - DNA, 22 bp, Homo sapiens
aaagtcattgctgttatcaatg

SEQ ID NO: 8062536 - DNA, 22 bp, Homo sapiens
aaagtcattggaatattaatga

SEQ ID NO: 8062537 - DNA, 22 bp, Homo sapiens
aaagttcattgatgactgaggt

SEQ ID NO: 8062538 - DNA, 22 bp, Homo sapiens
aaagtcattgtaatatatgcta

SEQ ID NO: 8062539 - DNA, 22 bp, Homo sapiens
aaagtcatccaaatttttatgt

SEQ ID NO: 8062540 - DNA, 22 bp, Homo sapiens
aaagtcatcatttcttttcaaa

SEQ ID NO: 8062541 - DNA, 22 bp, Homo sapiens
aaagtcatctaggagcagattt

SEQ ID NO: 8062542 - DNA, 22 bp, Homo sapiens
aaagtcatgtaatgatatgatt

SEQ ID NO: 8062543 - DNA, 22 bp, Homo sapiens
aaagtcatggaaaatcttggaa

SEQ ID NO: 8062544 - DNA, 22 bp, Homo sapiens
aaagtcatgcagttgaactttt

SEQ ID NO: 8062545 - DNA, 22 bp, Homo sapiens
aaagtcatgatgaaccaccgta

SEQ ID NO: 8062546 - DNA, 22 bp, Homo sapiens
aaagtcatcagaaccttccaga

SEQ ID NO: 8062547 - DNA, 22 bp, Homo sapiens
aaagtcatacatggtgcttact

SEQ ID NO: 8062548 - DNA, 22 bp, Homo sapiens
aaagtacatgcaattcttctga

SEQ ID NO: 8062549 - DNA, 22 bp, Homo sapiens
aaagtacaaggaaaggatctga

SEQ ID NO: 8062550 - DNA, 21 bp, Homo sapiens
aaatgaatgtggtagtgcaag

SEQ ID NO: 8062551 - DNA, 22 bp, Homo sapiens
aaatgaactcaatgatctccca

SEQ ID NO: 8062552 - DNA, 22 bp, Homo sapiens
aaatgaacatcaagaatagcct

SEQ ID NO: 8062553 - DNA, 22 bp, Homo sapiens
aaactgtgcttcccaaatgccc

SEQ ID NO: 8062554 - DNA, 21 bp, Homo sapiens
aaatacagatgcaaatctgtt

SEQ ID NO: 8062555 - DNA, 20 bp, Homo sapiens
aaatccagtgtgtattttac

SEQ ID NO: 8062556 - DNA, 22 bp, Homo sapiens
aaagacacacagccagcaagtg

SEQ ID NO: 8062557 - DNA, 22 bp, Homo sapiens
aaagacagacggaaacctgagg

SEQ ID NO: 8062558 - DNA, 22 bp, Homo sapiens
aaatggtgttgtatttagtctc

SEQ ID NO: 8062559 - DNA, 22 bp, Homo sapiens
aaaacagtttaggcatcacagt

SEQ ID NO: 8062560 - DNA, 22 bp, Homo sapiens
aaaacagtttttgctaactgct

SEQ ID NO: 8062561 - DNA, 22 bp, Homo sapiens
aaaacagacagccagtgtagag

SEQ ID NO: 8062562 - DNA, 22 bp, Homo sapiens
aaaacagacagccagtgtagag

SEQ ID NO: 8062563 - DNA, 22 bp, Homo sapiens
aaaacagacagccagtgtagag

SEQ ID NO: 8062564 - DNA, 22 bp, Homo sapiens
aaaacactgcaaagctgattgg

SEQ ID NO: 8062565 - DNA, 22 bp, Homo sapiens
aaaagcaagttgcctaggttga

SEQ ID NO: 8062566 - DNA, 22 bp, Homo sapiens
aaaagcaattgcagttcttgcc

SEQ ID NO: 8062567 - DNA, 22 bp, Homo sapiens
aaaagcagttatctgggaggaa

SEQ ID NO: 8062568 - DNA, 22 bp, Homo sapiens
aaaagcaaggcagtctgtctga

SEQ ID NO: 8062569 - DNA, 22 bp, Homo sapiens
aaaaatgttatctactgtccga

SEQ ID NO: 8062570 - DNA, 22 bp, Homo sapiens
aaaacatgtccatacagaaact

SEQ ID NO: 8062571 - DNA, 22 bp, Homo sapiens
aaaacatgtccatacagaaact

SEQ ID NO: 8062572 - DNA, 22 bp, Homo sapiens
aaaagaggttaaccaggtgtgt

SEQ ID NO: 8062573 - DNA, 22 bp, Homo sapiens
aaaaccacttccttgctattgg

SEQ ID NO: 8062574 - DNA, 22 bp, Homo sapiens
aaaaccacagttacttttgcac

SEQ ID NO: 8062575 - DNA, 22 bp, Homo sapiens
aaaaccacaattacttttgcac

SEQ ID NO: 8062576 - DNA, 22 bp, Homo sapiens
aaaaccacaatgacttttgcag

SEQ ID NO: 8062577 - DNA, 22 bp, Homo sapiens
aaaaccacaatgacttttgcac

SEQ ID NO: 8062578 - DNA, 22 bp, Homo sapiens
aaaatacacatactaggggaaa

SEQ ID NO: 8062579 - DNA, 22 bp, Homo sapiens
aaaagtgttcaggaagaataat

SEQ ID NO: 8062580 - DNA, 22 bp, Homo sapiens
aaaagctctttctgctgtagat

SEQ ID NO: 8062581 - DNA, 22 bp, Homo sapiens
aaaatgctatttcatggaggag

SEQ ID NO: 8062582 - DNA, 22 bp, Homo sapiens
aaaatgcatgagaatgtgctcg

SEQ ID NO: 8062583 - DNA, 18 bp, Homo sapiens
aaaatgcaggcgacatgg

SEQ ID NO: 8062584 - DNA, 22 bp, Homo sapiens
aaaatgctgggaaagttggaat

SEQ ID NO: 8062585 - DNA, 22 bp, Homo sapiens
aaaatgctatttcatggaggag

SEQ ID NO: 8062586 - DNA, 22 bp, Homo sapiens
aaaatgcaaacctacctacata

SEQ ID NO: 8062587 - DNA, 20 bp, Homo sapiens
aaaatgatgggcagggcagg

SEQ ID NO: 8062588 - DNA, 22 bp, Homo sapiens
aaaatgatgctgtaatttggca

SEQ ID NO: 8062589 - DNA, 22 bp, Homo sapiens
aaaatgatatcctgacttttat

SEQ ID NO: 8062590 - DNA, 22 bp, Homo sapiens
aaggagtctcagctgggcctga

SEQ ID NO: 8062591 - DNA, 22 bp, Homo sapiens
aaggagtctgggccattcagag

SEQ ID NO: 8062592 - DNA, 22 bp, Homo sapiens
aaggagtgcatgactcagagta

SEQ ID NO: 8062593 - DNA, 22 bp, Homo sapiens
aaggagtggggcatatcacaga

SEQ ID NO: 8062594 - DNA, 22 bp, Homo sapiens
aaatggatggaattgacattta

SEQ ID NO: 8062595 - DNA, 22 bp, Homo sapiens
aagggcaggcagagatcatata

SEQ ID NO: 8062596 - DNA, 22 bp, Homo sapiens
aagggcaggcacccaccctcac

SEQ ID NO: 8062597 - DNA, 22 bp, Homo sapiens
aagggcaggagaagacggatat

SEQ ID NO: 8062598 - DNA, 22 bp, Homo sapiens
aagggcaggagaagacggatat

SEQ ID NO: 8062599 - DNA, 22 bp, Homo sapiens
aagggaggggatgtaagcctgg

SEQ ID NO: 8062600 - DNA, 22 bp, Homo sapiens
aagggcaggaaaagatggatgt

SEQ ID NO: 8062601 - DNA, 22 bp, Homo sapiens
aagggcaggaaaagatggatgt

SEQ ID NO: 8062602 - DNA, 22 bp, Homo sapiens
aagggaggccagaggttttgca

SEQ ID NO: 8062603 - DNA, 22 bp, Homo sapiens
aaggccctaatagagcacatat

SEQ ID NO: 8062604 - DNA, 22 bp, Homo sapiens
aaggccctggcaggaagcagga

SEQ ID NO: 8062605 - DNA, 22 bp, Homo sapiens
aaggccctggccccagcttctt

SEQ ID NO: 8062606 - DNA, 22 bp, Homo sapiens
aagggcaggtgggcatttctgg

SEQ ID NO: 8062607 - DNA, 22 bp, Homo sapiens
aagggcagggagtttgtgtcta

SEQ ID NO: 8062608 - DNA, 22 bp, Homo sapiens
aagggctgccagggggtgccag

SEQ ID NO: 8062609 - DNA, 21 bp, Homo sapiens
aagtaatgtgtctcttctacc

SEQ ID NO: 8062610 - DNA, 22 bp, Homo sapiens
aagtaatggttaaataattcta

SEQ ID NO: 8062611 - DNA, 22 bp, Homo sapiens
aagtccaggtcctcattccatc

SEQ ID NO: 8062612 - DNA, 22 bp, Homo sapiens
aacagtgctgcattcattgagc

SEQ ID NO: 8062613 - DNA, 22 bp, Homo sapiens
aacagtgtgtacacatcatagg

SEQ ID NO: 8062614 - DNA, 22 bp, Homo sapiens
aagtgaaacatgtatctcttta

SEQ ID NO: 8062615 - DNA, 22 bp, Homo sapiens
aagtctggaagtctcagttttc

SEQ ID NO: 8062616 - DNA, 22 bp, Homo sapiens
aagtctgtttgagtgtcacact

SEQ ID NO: 8062617 - DNA, 22 bp, Homo sapiens
aatattgtttcaagatcacaga

SEQ ID NO: 8062618 - DNA, 22 bp, Homo sapiens
aatatttatatttctcttccct

SEQ ID NO: 8062619 - DNA, 22 bp, Homo sapiens
aatacataataagttttgtctg

SEQ ID NO: 8062620 - DNA, 22 bp, Homo sapiens
aataatgagacagcttatttaa

SEQ ID NO: 8062621 - DNA, 22 bp, Homo sapiens
aataatgaacatttaaaacctg

SEQ ID NO: 8062622 - DNA, 22 bp, Homo sapiens
aataatgataatggttatagct

SEQ ID NO: 8062623 - DNA, 22 bp, Homo sapiens
aataatatttgaagcttcaaag

SEQ ID NO: 8062624 - DNA, 22 bp, Homo sapiens
aataatctccctttttgtatgt

SEQ ID NO: 8062625 - DNA, 22 bp, Homo sapiens
aatacagaggggtcacaattca

SEQ ID NO: 8062626 - DNA, 22 bp, Homo sapiens
aataatgtctgctattttaaaa

SEQ ID NO: 8062627 - DNA, 22 bp, Homo sapiens
aataatgtaggatgataaatga

SEQ ID NO: 8062628 - DNA, 22 bp, Homo sapiens
aatgaaatgtagcttatccata

SEQ ID NO: 8062629 - DNA, 22 bp, Homo sapiens
aatgcacatatatttccttatt

SEQ ID NO: 8062630 - DNA, 22 bp, Homo sapiens
aatgcttatgggttccataata

SEQ ID NO: 8062631 - DNA, 22 bp, Homo sapiens
aatgcttaattcaatactgtgt

SEQ ID NO: 8062632 - DNA, 22 bp, Homo sapiens
aatgcttatacctaatgatctt

SEQ ID NO: 8062633 - DNA, 22 bp, Homo sapiens
aatgcttataacgttagaatgt

SEQ ID NO: 8062634 - DNA, 22 bp, Homo sapiens
aatgcttatacctaatgatctt

SEQ ID NO: 8062635 - DNA, 22 bp, Homo sapiens
aatgcagtttcatttgtagaat

SEQ ID NO: 8062636 - DNA, 22 bp, Homo sapiens
acacttgataggtcaaatcagt

SEQ ID NO: 8062637 - DNA, 22 bp, Homo sapiens
acacttctattccctgcacaaa

SEQ ID NO: 8062638 - DNA, 18 bp, Homo sapiens
acacttcctggtggtgtg

SEQ ID NO: 8062639 - DNA, 22 bp, Homo sapiens
acacataagcctaatcatctcc

SEQ ID NO: 8062640 - DNA, 23 bp, Homo sapiens
acagacaacactgatgagagaaa

SEQ ID NO: 8062641 - DNA, 22 bp, Homo sapiens
aagcccagctgaaagcattttt

SEQ ID NO: 8062642 - DNA, 22 bp, Homo sapiens
aagcccagtaccttcagtgagg

SEQ ID NO: 8062643 - DNA, 19 bp, Homo sapiens
aagcccagtgtatgctctt

SEQ ID NO: 8062644 - DNA, 22 bp, Homo sapiens
aagcccataaaaagaggtccct

SEQ ID NO: 8062645 - DNA, 23 bp, Homo sapiens
aagccccaaggaacttcctggga

SEQ ID NO: 8062646 - DNA, 22 bp, Homo sapiens
acagccaggcccagcacgcagg

SEQ ID NO: 8062647 - DNA, 22 bp, Homo sapiens
aagccaggttccatggaggagc

SEQ ID NO: 8062648 - DNA, 22 bp, Homo sapiens
aagcccagatgtgagaactgag

SEQ ID NO: 8062649 - DNA, 22 bp, Homo sapiens
acagccaggagccatgggcagg

SEQ ID NO: 8062650 - DNA, 22 bp, Homo sapiens
acagccaggagccatgggcagg

SEQ ID NO: 8062651 - DNA, 23 bp, Homo sapiens
acagccaggatgggagcagaagc

SEQ ID NO: 8062652 - DNA, 20 bp, Homo sapiens
acaatatgtagatgaatagc

SEQ ID NO: 8062653 - DNA, 22 bp, Homo sapiens
acaatatagtccatgagcatgc

SEQ ID NO: 8062654 - DNA, 22 bp, Homo sapiens
acacagagccaaaccatatcac

SEQ ID NO: 8062655 - DNA, 22 bp, Homo sapiens
acacagagcaaatcatgacaga

SEQ ID NO: 8062656 - DNA, 22 bp, Homo sapiens
acacagagcttctcaactggga

SEQ ID NO: 8062657 - DNA, 22 bp, Homo sapiens
acacagagctggaactgcttca

SEQ ID NO: 8062658 - DNA, 22 bp, Homo sapiens
acacagagctggaactgcttca

SEQ ID NO: 8062659 - DNA, 22 bp, Homo sapiens
acacagcaacttgcagtatgga

SEQ ID NO: 8062660 - DNA, 22 bp, Homo sapiens
acacagcaacttgcagtatgga

SEQ ID NO: 8062661 - DNA, 22 bp, Homo sapiens
acacagcaacttgcagtatgga

SEQ ID NO: 8062662 - DNA, 22 bp, Homo sapiens
acacagccagggtagtaaggct

SEQ ID NO: 8062663 - DNA, 22 bp, Homo sapiens
acacagcaaggtctgactttgg

SEQ ID NO: 8062664 - DNA, 22 bp, Homo sapiens
aagataatgtgtctgtctttgc

SEQ ID NO: 8062665 - DNA, 22 bp, Homo sapiens
aagagtttccagttgtggctca

SEQ ID NO: 8062666 - DNA, 22 bp, Homo sapiens
aagataatattcattaactaga

SEQ ID NO: 8062667 - DNA, 22 bp, Homo sapiens
aattttatctctaagcaggctt

SEQ ID NO: 8062668 - DNA, 22 bp, Homo sapiens
aagaacatttatgatggcattt

SEQ ID NO: 8062669 - DNA, 22 bp, Homo sapiens
aagaacattcgaactattttct

SEQ ID NO: 8062670 - DNA, 22 bp, Homo sapiens
acaaatgaacctgaaatctcag

SEQ ID NO: 8062671 - DNA, 22 bp, Homo sapiens
acaaaacagtgttcctgcccct

SEQ ID NO: 8062672 - DNA, 22 bp, Homo sapiens
tcaataatggcaggataaattt

SEQ ID NO: 8062673 - DNA, 22 bp, Homo sapiens
tcaataaaattgttttcctatc

SEQ ID NO: 8062674 - DNA, 22 bp, Homo sapiens
tcaaggctaaactttcagagta

SEQ ID NO: 8062675 - DNA, 19 bp, Homo sapiens
tcaaggctccctgagggat

SEQ ID NO: 8062676 - DNA, 22 bp, Homo sapiens
tatttcttgagtggtcagtttc

SEQ ID NO: 8062677 - DNA, 22 bp, Homo sapiens
tcaagagaaggggaaatagact

SEQ ID NO: 8062678 - DNA, 18 bp, Homo sapiens
tcaagacatcatgaaata

SEQ ID NO: 8062679 - DNA, 22 bp, Homo sapiens
tcaagagaagtgctccacagta

SEQ ID NO: 8062680 - DNA, 22 bp, Homo sapiens
tcaagagacaggacgtgtttca

SEQ ID NO: 8062681 - DNA, 22 bp, Homo sapiens
tcaagagattgaataataactg

SEQ ID NO: 8062682 - DNA, 22 bp, Homo sapiens
tcaagagagtgctgcttggggt

SEQ ID NO: 8062683 - DNA, 22 bp, Homo sapiens
tcaagacatcactgtgcatttt

SEQ ID NO: 8062684 - DNA, 22 bp, Homo sapiens
tcacaaggttcactataaattg

SEQ ID NO: 8062685 - DNA, 23 bp, Homo sapiens
tcacagggcactggctggggttg

SEQ ID NO: 8062686 - DNA, 22 bp, Homo sapiens
tcacagggatggaatagaaata

SEQ ID NO: 8062687 - DNA, 22 bp, Homo sapiens
tcacaggctccagggcctggat

SEQ ID NO: 8062688 - DNA, 22 bp, Homo sapiens
tcacagggcattatggctccag

SEQ ID NO: 8062689 - DNA, 20 bp, Homo sapiens
tcacaggggaccaggagcag

SEQ ID NO: 8062690 - DNA, 23 bp, Homo sapiens
tcacaggggccagcgctctgtgg

SEQ ID NO: 8062691 - DNA, 22 bp, Homo sapiens
tcacagggtgtacatcacctat

SEQ ID NO: 8062692 - DNA, 22 bp, Homo sapiens
tcacagggtatctgggatggat

SEQ ID NO: 8062693 - DNA, 22 bp, Homo sapiens
tcacagggtttggaagcctcct

SEQ ID NO: 8062694 - DNA, 22 bp, Homo sapiens
tcacagctccagactgcaactc

SEQ ID NO: 8062695 - DNA, 22 bp, Homo sapiens
tcacagctggacacgttggcat

SEQ ID NO: 8062696 - DNA, 19 bp, Homo sapiens
tcacaggcatctccccaga

SEQ ID NO: 8062697 - DNA, 23 bp, Homo sapiens
tcaccagaaggggtcaataaaga

SEQ ID NO: 8062698 - DNA, 22 bp, Homo sapiens
tcaccagacagttactgcatgt

SEQ ID NO: 8062699 - DNA, 22 bp, Homo sapiens
tcaccaaggcattttcacagca

SEQ ID NO: 8062700 - DNA, 22 bp, Homo sapiens
tcaccagatctctctgtaatgg

SEQ ID NO: 8062701 - DNA, 22 bp, Homo sapiens
tcaccagatgatttttcttcag

SEQ ID NO: 8062702 - DNA, 22 bp, Homo sapiens
tcactgaagactgggctctaaa

SEQ ID NO: 8062703 - DNA, 22 bp, Homo sapiens
tcactgaatacttgtctcatcc

SEQ ID NO: 8062704 - DNA, 22 bp, Homo sapiens
tcagaaaagagaaaatcttata

SEQ ID NO: 8062705 - DNA, 22 bp, Homo sapiens
tcacttttgatccctatgcagt

SEQ ID NO: 8062706 - DNA, 22 bp, Homo sapiens
tcagacctctgaccttgccaaa

SEQ ID NO: 8062707 - DNA, 23 bp, Homo sapiens
tcagagaactcgggcagatgacc

SEQ ID NO: 8062708 - DNA, 23 bp, Homo sapiens
tcagagaactcgggcagatgacc

SEQ ID NO: 8062709 - DNA, 22 bp, Homo sapiens
tcagagaagctgccaggcgagc

SEQ ID NO: 8062710 - DNA, 20 bp, Homo sapiens
tcagagcagttggcttgtct

SEQ ID NO: 8062711 - DNA, 22 bp, Homo sapiens
tcagagcagactttgaaggagg

SEQ ID NO: 8062712 - DNA, 22 bp, Homo sapiens
tcagagcatgtgggctgcagtt

SEQ ID NO: 8062713 - DNA, 22 bp, Homo sapiens
tcagagcccctccgctgtccca

SEQ ID NO: 8062714 - DNA, 22 bp, Homo sapiens
tcagagctaaggggagagcaaa

SEQ ID NO: 8062715 - DNA, 22 bp, Homo sapiens
tcagagctttggagaccaggaa

SEQ ID NO: 8062716 - DNA, 22 bp, Homo sapiens
tcagagctgcccatgcaagggg

SEQ ID NO: 8062717 - DNA, 22 bp, Homo sapiens
tcagaggaaaggtcagatggct

SEQ ID NO: 8062718 - DNA, 22 bp, Homo sapiens
tcagcctggtgattcctctgtc

SEQ ID NO: 8062719 - DNA, 22 bp, Homo sapiens
tcagctcctcatgcaggggata

SEQ ID NO: 8062720 - DNA, 21 bp, Homo sapiens
tcagcagcttttgcagtccct

SEQ ID NO: 8062721 - DNA, 21 bp, Homo sapiens
tcagcagcttttgcagtccct

SEQ ID NO: 8062722 - DNA, 21 bp, Homo sapiens
tcagcagaaagcaaggtcagt

SEQ ID NO: 8062723 - DNA, 21 bp, Homo sapiens
tcagcaggcaccagaaggctg

SEQ ID NO: 8062724 - DNA, 22 bp, Homo sapiens
tcaggaaggcaaattgcatgat

SEQ ID NO: 8062725 - DNA, 22 bp, Homo sapiens
tcaggaaggcgccccatcagga

SEQ ID NO: 8062726 - DNA, 22 bp, Homo sapiens
tcaggagtcctgcctgcagcct

SEQ ID NO: 8062727 - DNA, 22 bp, Homo sapiens
tcaggagtaaagacagagttcc

SEQ ID NO: 8062728 - DNA, 22 bp, Homo sapiens
tcaggaagaaattctgtatctt

SEQ ID NO: 8062729 - DNA, 22 bp, Homo sapiens
tcaggaagcatcctgaggtgtc

SEQ ID NO: 8062730 - DNA, 22 bp, Homo sapiens
tcaggaagccactccacagaga

SEQ ID NO: 8062731 - DNA, 22 bp, Homo sapiens
tcaggaagctcttgctgattct

SEQ ID NO: 8062732 - DNA, 22 bp, Homo sapiens
tcaggaagctactgccagcagc

SEQ ID NO: 8062733 - DNA, 22 bp, Homo sapiens
tcaggctggaatgcagtggggc

SEQ ID NO: 8062734 - DNA, 20 bp, Homo sapiens
tcaggcagtggggaaaggca

SEQ ID NO: 8062735 - DNA, 20 bp, Homo sapiens
tcaggcagtggggaaaggca

SEQ ID NO: 8062736 - DNA, 19 bp, Homo sapiens
tcaggcagttattcacaaa

SEQ ID NO: 8062737 - DNA, 22 bp, Homo sapiens
tcaggccacggctcactgagac

SEQ ID NO: 8062738 - DNA, 22 bp, Homo sapiens
tcaggccacttcacaggtgatt

SEQ ID NO: 8062739 - DNA, 19 bp, Homo sapiens
tcaggagttagttgtgctc

SEQ ID NO: 8062740 - DNA, 22 bp, Homo sapiens
tcaggcagtctgactccggagg

SEQ ID NO: 8062741 - DNA, 22 bp, Homo sapiens
tcatatgattgtaatgagaata

SEQ ID NO: 8062742 - DNA, 22 bp, Homo sapiens
tcatataagtttaaaactatct

SEQ ID NO: 8062743 - DNA, 22 bp, Homo sapiens
tcatggccaaagtcaggagtgt

SEQ ID NO: 8062744 - DNA, 22 bp, Homo sapiens
tcatggagactttgagcctgtt

SEQ ID NO: 8062745 - DNA, 22 bp, Homo sapiens
tcatggcacttagcacagtcct

SEQ ID NO: 8062746 - DNA, 22 bp, Homo sapiens
tcattcaggttgggcaagtgtc

SEQ ID NO: 8062747 - DNA, 19 bp, Homo sapiens
tcattcaggaccagtggat

SEQ ID NO: 8062748 - DNA, 22 bp, Homo sapiens
tcattattttggactggagtgt

SEQ ID NO: 8062749 - DNA, 22 bp, Homo sapiens
tcagtgtgttattctactttca

SEQ ID NO: 8062750 - DNA, 22 bp, Homo sapiens
tcagtgtgttcaattggatagg

SEQ ID NO: 8062751 - DNA, 22 bp, Homo sapiens
tcagtgtgttactttctcctat

SEQ ID NO: 8062752 - DNA, 22 bp, Homo sapiens
tcagtgatttctggggtgaggg

SEQ ID NO: 8062753 - DNA, 22 bp, Homo sapiens
tcagggacatttagacactgat

SEQ ID NO: 8062754 - DNA, 22 bp, Homo sapiens
tcaggtgttagaagaaatttca

SEQ ID NO: 8062755 - DNA, 22 bp, Homo sapiens
tccagagatcacactgggcagg

SEQ ID NO: 8062756 - DNA, 22 bp, Homo sapiens
tccagagcaggtggtcagaagg

SEQ ID NO: 8062757 - DNA, 18 bp, Homo sapiens
tccagagctactgtggtg

SEQ ID NO: 8062758 - DNA, 22 bp, Homo sapiens
tccagagcctatatgttcaact

SEQ ID NO: 8062759 - DNA, 20 bp, Homo sapiens
tccagacatctagctcagtt

SEQ ID NO: 8062760 - DNA, 22 bp, Homo sapiens
tccagaatactctgaaatcatt

SEQ ID NO: 8062761 - DNA, 19 bp, Homo sapiens
tccagaagtccctgagcgg

SEQ ID NO: 8062762 - DNA, 22 bp, Homo sapiens
tcattgaatttcacagctttat

SEQ ID NO: 8062763 - DNA, 22 bp, Homo sapiens
tccagaggctccaaagggagat

SEQ ID NO: 8062764 - DNA, 22 bp, Homo sapiens
tccagagggcgatggctggggg

SEQ ID NO: 8062765 - DNA, 22 bp, Homo sapiens
tccagctcagggttggctcaag

SEQ ID NO: 8062766 - DNA, 22 bp, Homo sapiens
tccagctcagggttggctcaag

SEQ ID NO: 8062767 - DNA, 18 bp, Homo sapiens
tccagctcacagatgggc

SEQ ID NO: 8062768 - DNA, 22 bp, Homo sapiens
tccagctcacagatagcgtggg

SEQ ID NO: 8062769 - DNA, 22 bp, Homo sapiens
tccagcctttctactcactgag

SEQ ID NO: 8062770 - DNA, 22 bp, Homo sapiens
tccagctcaaagtgctcctgtc

SEQ ID NO: 8062771 - DNA, 22 bp, Homo sapiens
tccagctcaaagtgctcctgtc

SEQ ID NO: 8062772 - DNA, 22 bp, Homo sapiens
tccagctcctctacccgatgcg

SEQ ID NO: 8062773 - DNA, 17 bp, Homo sapiens
tccagctcctcattgtt

SEQ ID NO: 8062774 - DNA, 20 bp, Homo sapiens
tccagctccgtgttcttcct

SEQ ID NO: 8062775 - DNA, 23 bp, Homo sapiens
tccagctcccttcaatggcactg

SEQ ID NO: 8062776 - DNA, 23 bp, Homo sapiens
tccagctcccttcaatggcactg

SEQ ID NO: 8062777 - DNA, 22 bp, Homo sapiens
tccagctcccactctcactgct

SEQ ID NO: 8062778 - DNA, 22 bp, Homo sapiens
tccagctcatctgtctccatta

SEQ ID NO: 8062779 - DNA, 22 bp, Homo sapiens
tccagcctttctactcactgag

SEQ ID NO: 8062780 - DNA, 22 bp, Homo sapiens
tccagcatttttcaatagaatt

SEQ ID NO: 8062781 - DNA, 22 bp, Homo sapiens
tccagcatatatagagaatgag

SEQ ID NO: 8062782 - DNA, 22 bp, Homo sapiens
tccagcatgaaggggcttttat

SEQ ID NO: 8062783 - DNA, 22 bp, Homo sapiens
tccagctctggcttggctagct

SEQ ID NO: 8062784 - DNA, 22 bp, Homo sapiens
tccagctctggcttggctagct

SEQ ID NO: 8062785 - DNA, 21 bp, Homo sapiens
tccagctcttatgttcatgaa

SEQ ID NO: 8062786 - DNA, 18 bp, Homo sapiens
tccagctctgccacttac

SEQ ID NO: 8062787 - DNA, 22 bp, Homo sapiens
tccagctctgctgtgcgccggt

SEQ ID NO: 8062788 - DNA, 22 bp, Homo sapiens
tccagctctaacatgctgggcc

SEQ ID NO: 8062789 - DNA, 22 bp, Homo sapiens
tccagctctaaggctgatagcc

SEQ ID NO: 8062790 - DNA, 22 bp, Homo sapiens
tccagctctaaggctgatagcc

SEQ ID NO: 8062791 - DNA, 22 bp, Homo sapiens
tccagctcctgagttcactgct

SEQ ID NO: 8062792 - DNA, 22 bp, Homo sapiens
tcccaagtgtcttggaccaggg

SEQ ID NO: 8062793 - DNA, 22 bp, Homo sapiens
tcccacacagcccgctcaccgg

SEQ ID NO: 8062794 - DNA, 21 bp, Homo sapiens
tcccacagcgccagctcctgt

SEQ ID NO: 8062795 - DNA, 22 bp, Homo sapiens
tcccaagcttagggctctcagt

SEQ ID NO: 8062796 - DNA, 21 bp, Homo sapiens
tcccaagctgctggctcagct

SEQ ID NO: 8062797 - DNA, 22 bp, Homo sapiens
tcccaagccctggatgcctcag

SEQ ID NO: 8062798 - DNA, 22 bp, Homo sapiens
tccatgcagagtccaggcctca

SEQ ID NO: 8062799 - DNA, 22 bp, Homo sapiens
tccatgcagaggagctggtggc

SEQ ID NO: 8062800 - DNA, 22 bp, Homo sapiens
tccatgcaaacagtggctagct

SEQ ID NO: 8062801 - DNA, 22 bp, Homo sapiens
tccatgcagagaactgaagtac

SEQ ID NO: 8062802 - DNA, 20 bp, Homo sapiens
tccagggctagggagctcat

SEQ ID NO: 8062803 - DNA, 21 bp, Homo sapiens
tccaggagtggctgggcaggg

SEQ ID NO: 8062804 - DNA, 22 bp, Homo sapiens
tccaggagtcctgggtggcccc

SEQ ID NO: 8062805 - DNA, 22 bp, Homo sapiens
tccaggaggtttggaggaagca

SEQ ID NO: 8062806 - DNA, 22 bp, Homo sapiens
tccaggagtcagacagatggtg

SEQ ID NO: 8062807 - DNA, 22 bp, Homo sapiens
tccaggagggttttctgccttc

SEQ ID NO: 8062808 - DNA, 22 bp, Homo sapiens
tccaggaggtatgagtggcccc

SEQ ID NO: 8062809 - DNA, 19 bp, Homo sapiens
tccccaagagttctagctc

SEQ ID NO: 8062810 - DNA, 22 bp, Homo sapiens
tccccacctaagatacccatct

SEQ ID NO: 8062811 - DNA, 22 bp, Homo sapiens
tccccacctacacactgctcct

SEQ ID NO: 8062812 - DNA, 22 bp, Homo sapiens
tcccagggactgggctaggctt

SEQ ID NO: 8062813 - DNA, 22 bp, Homo sapiens
tcccacagcttcgtgcttcccc

SEQ ID NO: 8062814 - DNA, 22 bp, Homo sapiens
tcccagggtgcgcctgccctcg

SEQ ID NO: 8062815 - DNA, 22 bp, Homo sapiens
tcccagtggtgggtgcacattt

SEQ ID NO: 8062816 - DNA, 19 bp, Homo sapiens
tcccagtggggagaggtgt

SEQ ID NO: 8062817 - DNA, 22 bp, Homo sapiens
tcccagtttttctccactaagg

SEQ ID NO: 8062818 - DNA, 22 bp, Homo sapiens
tcccagtgagatgaaacaggta

SEQ ID NO: 8062819 - DNA, 22 bp, Homo sapiens
taactaactagtgttcaaaata

SEQ ID NO: 8062820 - DNA, 22 bp, Homo sapiens
taactgatattgaaaaacatca

SEQ ID NO: 8062821 - DNA, 22 bp, Homo sapiens
taactccacacccctcttggtg

SEQ ID NO: 8062822 - DNA, 22 bp, Homo sapiens
taactccatctctgtgtctgct

SEQ ID NO: 8062823 - DNA, 22 bp, Homo sapiens
taaagtgtcctagctaggaggc

SEQ ID NO: 8062824 - DNA, 22 bp, Homo sapiens
taaattatgtcacatgactctg

SEQ ID NO: 8062825 - DNA, 22 bp, Homo sapiens
gttttgcagagtgcaataaatc

SEQ ID NO: 8062826 - DNA, 22 bp, Homo sapiens
gttttccactggattgtttgga

SEQ ID NO: 8062827 - DNA, 22 bp, Homo sapiens
gttttcttcctgcaattggcat

SEQ ID NO: 8062828 - DNA, 22 bp, Homo sapiens
taaacagaatgcgtaagaagtg

SEQ ID NO: 8062829 - DNA, 22 bp, Homo sapiens
taaaggcttttagtgatggtaa

SEQ ID NO: 8062830 - DNA, 22 bp, Homo sapiens
taaaatgtttgcaagagaccag

SEQ ID NO: 8062831 - DNA, 22 bp, Homo sapiens
taaaattgcggtgaatatttcc

SEQ ID NO: 8062832 - DNA, 22 bp, Homo sapiens
taaaatgccagaccagttcacg

SEQ ID NO: 8062833 - DNA, 22 bp, Homo sapiens
taaaatgcacagcagttgaaag

SEQ ID NO: 8062834 - DNA, 22 bp, Homo sapiens
taaaatgcacagcagttgaaag

SEQ ID NO: 8062835 - DNA, 22 bp, Homo sapiens
gtgctctgtgtattaggatgtc

SEQ ID NO: 8062836 - DNA, 22 bp, Homo sapiens
gtgctctggctggtctcccggt

SEQ ID NO: 8062837 - DNA, 21 bp, Homo sapiens
gtgctctgggcagcagagggc

SEQ ID NO: 8062838 - DNA, 22 bp, Homo sapiens
gtgctgaaatggacctcaggaa

SEQ ID NO: 8062839 - DNA, 22 bp, Homo sapiens
gtgtgccactgcctgaggaccc

SEQ ID NO: 8062840 - DNA, 22 bp, Homo sapiens
gtgtgccatttgcttcctgtta

SEQ ID NO: 8062841 - DNA, 22 bp, Homo sapiens
gtgtgccagtcctgactcctga

SEQ ID NO: 8062842 - DNA, 22 bp, Homo sapiens
gtgtgccagacatgatgctatg

SEQ ID NO: 8062843 - DNA, 22 bp, Homo sapiens
gtgtgccaggaactggctgctg

SEQ ID NO: 8062844 - DNA, 22 bp, Homo sapiens
gtgtgccaccagtcaaggtgaa

SEQ ID NO: 8062845 - DNA, 22 bp, Homo sapiens
gtgtgccaccactgacaggatt

SEQ ID NO: 8062846 - DNA, 23 bp, Homo sapiens
gtgtgccaagcactgtgccagga

SEQ ID NO: 8062847 - DNA, 22 bp, Homo sapiens
gtgtgccaactatattaatatt

SEQ ID NO: 8062848 - DNA, 22 bp, Homo sapiens
gtgtgccaacaaaagacagtgc

SEQ ID NO: 8062849 - DNA, 22 bp, Homo sapiens
gtgtgccaagagatagttgctg

SEQ ID NO: 8062850 - DNA, 22 bp, Homo sapiens
gtgctctcctggctgccctgac

SEQ ID NO: 8062851 - DNA, 22 bp, Homo sapiens
gtgctccctccttcctcaagga

SEQ ID NO: 8062852 - DNA, 22 bp, Homo sapiens
gtgctcagggcctggctgggga

SEQ ID NO: 8062853 - DNA, 22 bp, Homo sapiens
gtgctcaggttcccatgagtgc

SEQ ID NO: 8062854 - DNA, 22 bp, Homo sapiens
gtgctccctccttcctcaagga

SEQ ID NO: 8062855 - DNA, 22 bp, Homo sapiens
gtgtgcctcgccaagctgtcgg

SEQ ID NO: 8062856 - DNA, 22 bp, Homo sapiens
gtgtggctacctcagaggagca

SEQ ID NO: 8062857 - DNA, 22 bp, Homo sapiens
gtgtggctgtgggagatgttca

SEQ ID NO: 8062858 - DNA, 22 bp, Homo sapiens
gtgtggctgccagccaagaggc

SEQ ID NO: 8062859 - DNA, 22 bp, Homo sapiens
gttaagaatcaagacttatctt

SEQ ID NO: 8062860 - DNA, 22 bp, Homo sapiens
gttcatttatgatgtaacatgt

SEQ ID NO: 8062861 - DNA, 22 bp, Homo sapiens
gttgagtgggttaggatgctga

SEQ ID NO: 8062862 - DNA, 22 bp, Homo sapiens
gttgagtgggttaggatgctga

SEQ ID NO: 8062863 - DNA, 18 bp, Homo sapiens
gttcatctttttctaaag

SEQ ID NO: 8062864 - DNA, 22 bp, Homo sapiens
gttcagggagggacagatgaag

SEQ ID NO: 8062865 - DNA, 22 bp, Homo sapiens
gttgtacagcatccagtgcaga

SEQ ID NO: 8062866 - DNA, 22 bp, Homo sapiens
taaggtaactgcttttggctga

SEQ ID NO: 8062867 - DNA, 22 bp, Homo sapiens
taagtgagctagcagaagtgac

SEQ ID NO: 8062868 - DNA, 22 bp, Homo sapiens
taatacattacctaacctctct

SEQ ID NO: 8062869 - DNA, 22 bp, Homo sapiens
taatacatgtattccagagagt

SEQ ID NO: 8062870 - DNA, 22 bp, Homo sapiens
taatacatcattcatctaagga

SEQ ID NO: 8062871 - DNA, 22 bp, Homo sapiens
taattataacagttacatctta

SEQ ID NO: 8062872 - DNA, 22 bp, Homo sapiens
taattatagccgctattttgct

SEQ ID NO: 8062873 - DNA, 22 bp, Homo sapiens
taatagaatagtggaaacattg

SEQ ID NO: 8062874 - DNA, 22 bp, Homo sapiens
taatggcagagtcatgctttct

SEQ ID NO: 8062875 - DNA, 22 bp, Homo sapiens
tacaaagtaatgtataatatcg

SEQ ID NO: 8062876 - DNA, 22 bp, Homo sapiens
tacaaagtagaaattcagtaaa

SEQ ID NO: 8062877 - DNA, 22 bp, Homo sapiens
tacaaagtatatttctagctgt

SEQ ID NO: 8062878 - DNA, 22 bp, Homo sapiens
tacaaagatagtgttagagtaa

SEQ ID NO: 8062879 - DNA, 22 bp, Homo sapiens
tacatagaacatgtttaatgtc

SEQ ID NO: 8062880 - DNA, 22 bp, Homo sapiens
tacagtaagatgaaatagcaat

SEQ ID NO: 8062881 - DNA, 22 bp, Homo sapiens
tacagtaatctggacatgattt

SEQ ID NO: 8062882 - DNA, 22 bp, Homo sapiens
tacattctggaaaggcacagac

SEQ ID NO: 8062883 - DNA, 22 bp, Homo sapiens
tacattctactttttcactccc

SEQ ID NO: 8062884 - DNA, 20 bp, Homo sapiens
tacagaaacaggacttttgg

SEQ ID NO: 8062885 - DNA, 22 bp, Homo sapiens
tacaaagtttggggtcctcaaa

SEQ ID NO: 8062886 - DNA, 22 bp, Homo sapiens
tacaaagttttcttggattgag

SEQ ID NO: 8062887 - DNA, 22 bp, Homo sapiens
tacaaagtttgagaatgctttc

SEQ ID NO: 8062888 - DNA, 22 bp, Homo sapiens
tacaaagtgtgcccatgctgag

SEQ ID NO: 8062889 - DNA, 22 bp, Homo sapiens
tacaaagtgagcaacctctttt

SEQ ID NO: 8062890 - DNA, 22 bp, Homo sapiens
tacaaagtcaccagcttcttgc

SEQ ID NO: 8062891 - DNA, 22 bp, Homo sapiens
tacagaaatcacatcgctttga

SEQ ID NO: 8062892 - DNA, 22 bp, Homo sapiens
taggaaaacgtgattttctcac

SEQ ID NO: 8062893 - DNA, 22 bp, Homo sapiens
taggaaaatatctcttattggg

SEQ ID NO: 8062894 - DNA, 22 bp, Homo sapiens
tagggcagagcttgtacacgat

SEQ ID NO: 8062895 - DNA, 22 bp, Homo sapiens
tagggaggctacttcttgtagg

SEQ ID NO: 8062896 - DNA, 22 bp, Homo sapiens
taggcactggttgtggatagtt

SEQ ID NO: 8062897 - DNA, 22 bp, Homo sapiens
taggcactgggctaggacaggt

SEQ ID NO: 8062898 - DNA, 22 bp, Homo sapiens
taggcactgaccttctcagatt

SEQ ID NO: 8062899 - DNA, 22 bp, Homo sapiens
tagccttctcaagacaaagttg

SEQ ID NO: 8062900 - DNA, 22 bp, Homo sapiens
tagccccagctactcggaagct

SEQ ID NO: 8062901 - DNA, 21 bp, Homo sapiens
tagcccttctccacctcgccc

SEQ ID NO: 8062902 - DNA, 22 bp, Homo sapiens
tagaggtgacactgagaccata

SEQ ID NO: 8062903 - DNA, 18 bp, Homo sapiens
tagagggggcctgggcat

SEQ ID NO: 8062904 - DNA, 20 bp, Homo sapiens
tagaggggacaatcattgcc

SEQ ID NO: 8062905 - DNA, 18 bp, Homo sapiens
tagaggggaagaccttta

SEQ ID NO: 8062906 - DNA, 22 bp, Homo sapiens
tagaggggaatctgcctcctct

SEQ ID NO: 8062907 - DNA, 22 bp, Homo sapiens
tagaggtgtcactttgggaagt

SEQ ID NO: 8062908 - DNA, 23 bp, Homo sapiens
tagcagcatttttagcctctgtc

SEQ ID NO: 8062909 - DNA, 22 bp, Homo sapiens
tagcagagcagggatcagagcc

SEQ ID NO: 8062910 - DNA, 22 bp, Homo sapiens
tagaaacacagatctggtgtca

SEQ ID NO: 8062911 - DNA, 22 bp, Homo sapiens
tagaaacaatgacatgcttgta

SEQ ID NO: 8062912 - DNA, 22 bp, Homo sapiens
tagaaacatcagctaaccaaaa

SEQ ID NO: 8062913 - DNA, 22 bp, Homo sapiens
taccaaaagcttgtttcataca

SEQ ID NO: 8062914 - DNA, 22 bp, Homo sapiens
taccaaaaccaagccattatct

SEQ ID NO: 8062915 - DNA, 22 bp, Homo sapiens
tacattttctaggggaccaaga

SEQ ID NO: 8062916 - DNA, 22 bp, Homo sapiens
tagaaaagataacattctgtgc

SEQ ID NO: 8062917 - DNA, 19 bp, Homo sapiens
tactttttcaggacagagt

SEQ ID NO: 8062918 - DNA, 22 bp, Homo sapiens
tactttttgtctctttgaatgt

SEQ ID NO: 8062919 - DNA, 22 bp, Homo sapiens
tagaaaactaatacatgcttga

SEQ ID NO: 8062920 - DNA, 22 bp, Homo sapiens
tagaaaggatattgagatgaat

SEQ ID NO: 8062921 - DNA, 22 bp, Homo sapiens
tagaaaggcaagcgtgaaatat

SEQ ID NO: 8062922 - DNA, 22 bp, Homo sapiens
tagaaaggaagctacttagggg

SEQ ID NO: 8062923 - DNA, 22 bp, Homo sapiens
tagaaatgattttgatgcttca

SEQ ID NO: 8062924 - DNA, 22 bp, Homo sapiens
tagaggggaaaatgcgtattaa

SEQ ID NO: 8062925 - DNA, 22 bp, Homo sapiens
tagaggggaaaatgcgtattaa

SEQ ID NO: 8062926 - DNA, 22 bp, Homo sapiens
tagacacaaatctcagtgacac

SEQ ID NO: 8062927 - DNA, 22 bp, Homo sapiens
tagaatgtaaattccaagggca

SEQ ID NO: 8062928 - DNA, 22 bp, Homo sapiens
tatacacatcctccaaagatag

SEQ ID NO: 8062929 - DNA, 22 bp, Homo sapiens
tatacaagtaatgctgaatgat

SEQ ID NO: 8062930 - DNA, 22 bp, Homo sapiens
tatacaatgagtacattctggg

SEQ ID NO: 8062931 - DNA, 22 bp, Homo sapiens
tatacaatggctgaatcatcca

SEQ ID NO: 8062932 - DNA, 22 bp, Homo sapiens
tatacacaaggtgtgcatttgt

SEQ ID NO: 8062933 - DNA, 22 bp, Homo sapiens
tataaatgccaggactttagat

SEQ ID NO: 8062934 - DNA, 20 bp, Homo sapiens
tataacagtgttgggtgtgt

SEQ ID NO: 8062935 - DNA, 22 bp, Homo sapiens
tataacaggaagtattcaaaca

SEQ ID NO: 8062936 - DNA, 22 bp, Homo sapiens
taggggtgaggccaggcatcag

SEQ ID NO: 8062937 - DNA, 22 bp, Homo sapiens
taggtgggtgacttccatgggg

SEQ ID NO: 8062938 - DNA, 21 bp, Homo sapiens
taggtgggagccccagtatgc

SEQ ID NO: 8062939 - DNA, 22 bp, Homo sapiens
tatatcatggagattaacattc

SEQ ID NO: 8062940 - DNA, 22 bp, Homo sapiens
tatatcaccaaaaacagttctg

SEQ ID NO: 8062941 - DNA, 22 bp, Homo sapiens
tatagctaaggtcagactgttt

SEQ ID NO: 8062942 - DNA, 22 bp, Homo sapiens
tatagcatctaggatgattgca

SEQ ID NO: 8062943 - DNA, 22 bp, Homo sapiens
tatagttagtttcataatcatg

SEQ ID NO: 8062944 - DNA, 22 bp, Homo sapiens
tattcttaattgctgagctgaa

SEQ ID NO: 8062945 - DNA, 22 bp, Homo sapiens
tatttattggacagtgttgctg

SEQ ID NO: 8062946 - DNA, 22 bp, Homo sapiens
tatttataccaggtgatcggag

SEQ ID NO: 8062947 - DNA, 22 bp, Homo sapiens
tatttataatctgccaaagaga

SEQ ID NO: 8062948 - DNA, 22 bp, Homo sapiens
tatttataacagtgagaacggg

SEQ ID NO: 8062949 - DNA, 22 bp, Homo sapiens
tattagaaaggctattgcatag

SEQ ID NO: 8062950 - DNA, 22 bp, Homo sapiens
tatgagctttggaatgagaaac

SEQ ID NO: 8062951 - DNA, 22 bp, Homo sapiens
gctacctgagcaagagcttcaa

SEQ ID NO: 8062952 - DNA, 22 bp, Homo sapiens
gctcagccgaacttcagagcag

SEQ ID NO: 8062953 - DNA, 22 bp, Homo sapiens
gctcagcactttctccaaccac

SEQ ID NO: 8062954 - DNA, 22 bp, Homo sapiens
gctccaggtatttgccctttta

SEQ ID NO: 8062955 - DNA, 22 bp, Homo sapiens
gctcccacaaccttcttgctcc

SEQ ID NO: 8062956 - DNA, 22 bp, Homo sapiens
gctcccactgcagccctgagcc

SEQ ID NO: 8062957 - DNA, 22 bp, Homo sapiens
gctcccacgcaattcttttcag

SEQ ID NO: 8062958 - DNA, 22 bp, Homo sapiens
gctcccacctccagcctgagtt

SEQ ID NO: 8062959 - DNA, 22 bp, Homo sapiens
gctcccaccttaaccttcacat

SEQ ID NO: 8062960 - DNA, 22 bp, Homo sapiens
gctcccacctttgctatcagta

SEQ ID NO: 8062961 - DNA, 22 bp, Homo sapiens
gctcccaccaggcagacctacc

SEQ ID NO: 8062962 - DNA, 22 bp, Homo sapiens
gctcccacctccagcctgagtt

SEQ ID NO: 8062963 - DNA, 22 bp, Homo sapiens
gctcccaccgccgctatgggta

SEQ ID NO: 8062964 - DNA, 22 bp, Homo sapiens
gctccctgactcagttcctgag

SEQ ID NO: 8062965 - DNA, 22 bp, Homo sapiens
gctccctgcagctgagagttcc

SEQ ID NO: 8062966 - DNA, 21 bp, Homo sapiens
gctccctgctcagctcctggg

SEQ ID NO: 8062967 - DNA, 22 bp, Homo sapiens
gccttggccaacaccttgcaaa

SEQ ID NO: 8062968 - DNA, 22 bp, Homo sapiens
gccttggctgatgtgcgaatga

SEQ ID NO: 8062969 - DNA, 22 bp, Homo sapiens
gcctgagccgcctgagcggcgg

SEQ ID NO: 8062970 - DNA, 20 bp, Homo sapiens
gcctgagctattgccaggat

SEQ ID NO: 8062971 - DNA, 19 bp, Homo sapiens
gcctgagccagccatgcaa

SEQ ID NO: 8062972 - DNA, 22 bp, Homo sapiens
gcctgagcaggcgtggaccatg

SEQ ID NO: 8062973 - DNA, 22 bp, Homo sapiens
gcctctggtccctcatgctgtg

SEQ ID NO: 8062974 - DNA, 22 bp, Homo sapiens
gcctttcagttccatcaaagga

SEQ ID NO: 8062975 - DNA, 22 bp, Homo sapiens
gcctttatcttgggccaagttt

SEQ ID NO: 8062976 - DNA, 22 bp, Homo sapiens
gcctttatccctgtacaaggtg

SEQ ID NO: 8062977 - DNA, 22 bp, Homo sapiens
gcgtcttttagattttacatct

SEQ ID NO: 8062978 - DNA, 22 bp, Homo sapiens
gctcctctcccagagctgcagg

SEQ ID NO: 8062979 - DNA, 22 bp, Homo sapiens
gctctgggaactgactgccttc

SEQ ID NO: 8062980 - DNA, 22 bp, Homo sapiens
gctctgggctgccctctggaca

SEQ ID NO: 8062981 - DNA, 22 bp, Homo sapiens
gctctgggattaccagccttag

SEQ ID NO: 8062982 - DNA, 22 bp, Homo sapiens
gctgcttcctttcctgctgacc

SEQ ID NO: 8062983 - DNA, 22 bp, Homo sapiens
gctgcttcagggacgtgccagc

SEQ ID NO: 8062984 - DNA, 22 bp, Homo sapiens
gctgcttctctgatggagtcca

SEQ ID NO: 8062985 - DNA, 22 bp, Homo sapiens
gctgctcatttgtatcctttgt

SEQ ID NO: 8062986 - DNA, 22 bp, Homo sapiens
gctgctccgtctgagctctggt

SEQ ID NO: 8062987 - DNA, 22 bp, Homo sapiens
gctgcctgtctgtttcttttat

SEQ ID NO: 8062988 - DNA, 22 bp, Homo sapiens
gctgcctgtgcactttctcgta

SEQ ID NO: 8062989 - DNA, 22 bp, Homo sapiens
gctgcctgtggcccttctgggt

SEQ ID NO: 8062990 - DNA, 22 bp, Homo sapiens
gctgcctgtggcccttctgggt

SEQ ID NO: 8062991 - DNA, 22 bp, Homo sapiens
gctgcctgtgtggccactcact

SEQ ID NO: 8062992 - DNA, 22 bp, Homo sapiens
gctgcctgtgtggccactcact

SEQ ID NO: 8062993 - DNA, 22 bp, Homo sapiens
gctgccctgtctgcagcaggac

SEQ ID NO: 8062994 - DNA, 22 bp, Homo sapiens
gctgccgttggctcttcaggcc

SEQ ID NO: 8062995 - DNA, 22 bp, Homo sapiens
gctgcccagggtggagccggct

SEQ ID NO: 8062996 - DNA, 22 bp, Homo sapiens
gctgagggctgtaacagcagag

SEQ ID NO: 8062997 - DNA, 22 bp, Homo sapiens
gctgagggcatgtgtggcgact

SEQ ID NO: 8062998 - DNA, 22 bp, Homo sapiens
ggaattctgtagctcttcctct

SEQ ID NO: 8062999 - DNA, 22 bp, Homo sapiens
ggaattctgcatgttcagttgg

SEQ ID NO: 8063000 - DNA, 22 bp, Homo sapiens
ggaatcagagcagaggctgtta

SEQ ID NO: 8063001 - DNA, 22 bp, Homo sapiens
ggaatcagcaaggaggctcacc

SEQ ID NO: 8063002 - DNA, 22 bp, Homo sapiens
ggaatcagatgaggggcagagc

SEQ ID NO: 8063003 - DNA, 22 bp, Homo sapiens
ggaagaggctgagccaggtccc

SEQ ID NO: 8063004 - DNA, 22 bp, Homo sapiens
gctttggaatgtgctgttatag

SEQ ID NO: 8063005 - DNA, 22 bp, Homo sapiens
gctttggagcctgtgttctgcc

SEQ ID NO: 8063006 - DNA, 22 bp, Homo sapiens
gctttggagggcaagagctgtt

SEQ ID NO: 8063007 - DNA, 22 bp, Homo sapiens
gctttcctggccctgtccctgc

SEQ ID NO: 8063008 - DNA, 17 bp, Homo sapiens
gctttggaaagccttcc

SEQ ID NO: 8063009 - DNA, 22 bp, Homo sapiens
ggagcagcactgccacacagag

SEQ ID NO: 8063010 - DNA, 22 bp, Homo sapiens
ggagcagatgtcttcatggcct

SEQ ID NO: 8063011 - DNA, 22 bp, Homo sapiens
ggagcatgtggggtgagcaggg

SEQ ID NO: 8063012 - DNA, 22 bp, Homo sapiens
ggagagaatctgaacctgctcc

SEQ ID NO: 8063013 - DNA, 22 bp, Homo sapiens
ggagacagtggtagggcctaag

SEQ ID NO: 8063014 - DNA, 22 bp, Homo sapiens
ggacaggtgtgaggctggcaca

SEQ ID NO: 8063015 - DNA, 22 bp, Homo sapiens
ggacacagggctcactctctct

SEQ ID NO: 8063016 - DNA, 22 bp, Homo sapiens
ggacagggtaagtactagtgtg

SEQ ID NO: 8063017 - DNA, 22 bp, Homo sapiens
ggacacaggtaaataccactga

SEQ ID NO: 8063018 - DNA, 19 bp, Homo sapiens
ggaccaggtcctgggcagc

SEQ ID NO: 8063019 - DNA, 20 bp, Homo sapiens
ggaccaggtggggcggtggc

SEQ ID NO: 8063020 - DNA, 22 bp, Homo sapiens
gctggggagggcgtcaaggcca

SEQ ID NO: 8063021 - DNA, 22 bp, Homo sapiens
gctggggcctgaacagtcagct

SEQ ID NO: 8063022 - DNA, 22 bp, Homo sapiens
gctgggcttggtttccctgctt

SEQ ID NO: 8063023 - DNA, 22 bp, Homo sapiens
gctggggaggcagcagagaaca

SEQ ID NO: 8063024 - DNA, 22 bp, Homo sapiens
gctgtgctatatctctgagtgt

SEQ ID NO: 8063025 - DNA, 22 bp, Homo sapiens
gctggggcctgaacagtcagct

SEQ ID NO: 8063026 - DNA, 22 bp, Homo sapiens
gctggggctgggctgaggaaga

SEQ ID NO: 8063027 - DNA, 22 bp, Homo sapiens
gcttgctcaacccccgtctctc

SEQ ID NO: 8063028 - DNA, 22 bp, Homo sapiens
gcttgctggtgcctgcaggctc

SEQ ID NO: 8063029 - DNA, 22 bp, Homo sapiens
gctgtgtatcagatgccacggg

SEQ ID NO: 8063030 - DNA, 22 bp, Homo sapiens
gctggctgtgttccttctgcca

SEQ ID NO: 8063031 - DNA, 22 bp, Homo sapiens
gctggctgtgtttcatctctga

SEQ ID NO: 8063032 - DNA, 22 bp, Homo sapiens
gctggctgttggaggtacctgc

SEQ ID NO: 8063033 - DNA, 22 bp, Homo sapiens
gctgggcttcacctccagagtt

SEQ ID NO: 8063034 - DNA, 22 bp, Homo sapiens
gctgggaacacagccatgagag

SEQ ID NO: 8063035 - DNA, 22 bp, Homo sapiens
gctggctgcgtcatcacagggc

SEQ ID NO: 8063036 - DNA, 22 bp, Homo sapiens
gctggagaaactgcagctgagg

SEQ ID NO: 8063037 - DNA, 22 bp, Homo sapiens
gcccagcacattgctgaggacc

SEQ ID NO: 8063038 - DNA, 22 bp, Homo sapiens
gcccagcacagctggaagagtc

SEQ ID NO: 8063039 - DNA, 21 bp, Homo sapiens
gcccagcaaggtgagaaggcc

SEQ ID NO: 8063040 - DNA, 22 bp, Homo sapiens
gccagggttcgaatccgtatgg

SEQ ID NO: 8063041 - DNA, 22 bp, Homo sapiens
gccaggggacgcggagcgacga

SEQ ID NO: 8063042 - DNA, 22 bp, Homo sapiens
gccagggggtcagcaggcactt

SEQ ID NO: 8063043 - DNA, 22 bp, Homo sapiens
gcccagcacctctctcagggtt

SEQ ID NO: 8063044 - DNA, 22 bp, Homo sapiens
gcccagcagctggtggagaagg

SEQ ID NO: 8063045 - DNA, 22 bp, Homo sapiens
gcccagccctgaggtcacagct

SEQ ID NO: 8063046 - DNA, 22 bp, Homo sapiens
gcccagcctccaagctccaagg

SEQ ID NO: 8063047 - DNA, 22 bp, Homo sapiens
gcccagccctgaggtcacagct

SEQ ID NO: 8063048 - DNA, 22 bp, Homo sapiens
gcccagcctccaagctccaagg

SEQ ID NO: 8063049 - DNA, 22 bp, Homo sapiens
gcccagcctccaagctccaagg

SEQ ID NO: 8063050 - DNA, 22 bp, Homo sapiens
gcctcctgagtagctgggattg

SEQ ID NO: 8063051 - DNA, 22 bp, Homo sapiens
gcctcctgcccagatgagtgat

SEQ ID NO: 8063052 - DNA, 22 bp, Homo sapiens
gcctcctggattttagtgccat

SEQ ID NO: 8063053 - DNA, 22 bp, Homo sapiens
gcctcctggattttagtgccat

SEQ ID NO: 8063054 - DNA, 22 bp, Homo sapiens
gcctcctgacttacactgagct

SEQ ID NO: 8063055 - DNA, 22 bp, Homo sapiens
gcctcctggttgcttctccaac

SEQ ID NO: 8063056 - DNA, 22 bp, Homo sapiens
gcctcctggggtgccatcatct

SEQ ID NO: 8063057 - DNA, 22 bp, Homo sapiens
gcctcctggcctttgctcctca

SEQ ID NO: 8063058 - DNA, 22 bp, Homo sapiens
gcctcctggcctttgctcctca

SEQ ID NO: 8063059 - DNA, 22 bp, Homo sapiens
gcctcctgaaaggaagagctcc

SEQ ID NO: 8063060 - DNA, 22 bp, Homo sapiens
gcctcctgaaaggaagagctcc

SEQ ID NO: 8063061 - DNA, 22 bp, Homo sapiens
gcctcctgaagtgctgggatta

SEQ ID NO: 8063062 - DNA, 20 bp, Homo sapiens
gccctggagccttgtcctgg

SEQ ID NO: 8063063 - DNA, 22 bp, Homo sapiens
gccccagctctgccacaactag

SEQ ID NO: 8063064 - DNA, 22 bp, Homo sapiens
gccccagaaagttcaaggcaca

SEQ ID NO: 8063065 - DNA, 22 bp, Homo sapiens
gccctgggattgggtggaggct

SEQ ID NO: 8063066 - DNA, 22 bp, Homo sapiens
gccctggccttcatctcagaca

SEQ ID NO: 8063067 - DNA, 22 bp, Homo sapiens
gccaggcagatatgtgagctta

SEQ ID NO: 8063068 - DNA, 22 bp, Homo sapiens
gccaggcagagccccgtgcagc

SEQ ID NO: 8063069 - DNA, 22 bp, Homo sapiens
gccaggcagatatgtgagctta

SEQ ID NO: 8063070 - DNA, 22 bp, Homo sapiens
gccaggcagcaggaagccagtg

SEQ ID NO: 8063071 - DNA, 22 bp, Homo sapiens
gccaggcagccaccctctgcga

SEQ ID NO: 8063072 - DNA, 22 bp, Homo sapiens
gccaggcagcagcgaggatggt

SEQ ID NO: 8063073 - DNA, 22 bp, Homo sapiens
gccaggcagcaggaagccagtg

SEQ ID NO: 8063074 - DNA, 22 bp, Homo sapiens
gccaggcagctagcaacccctg

SEQ ID NO: 8063075 - DNA, 22 bp, Homo sapiens
gccaggcagctgggagggtgcc

SEQ ID NO: 8063076 - DNA, 22 bp, Homo sapiens
gccaggcaggccacgctgtgtt

SEQ ID NO: 8063077 - DNA, 22 bp, Homo sapiens
gccaggcaggtgtcggagccct

SEQ ID NO: 8063078 - DNA, 22 bp, Homo sapiens
gccagggaacccaagggcctca

SEQ ID NO: 8063079 - DNA, 21 bp, Homo sapiens
gccagggaagagagttggctg

SEQ ID NO: 8063080 - DNA, 22 bp, Homo sapiens
gccagggaggctgtagggtcct

SEQ ID NO: 8063081 - DNA, 22 bp, Homo sapiens
gccagggcaggggagcatctgc

SEQ ID NO: 8063082 - DNA, 22 bp, Homo sapiens
gccagggagtctgggccacaga

SEQ ID NO: 8063083 - DNA, 22 bp, Homo sapiens
gccagggctcgcggtccctcgt

SEQ ID NO: 8063084 - DNA, 20 bp, Homo sapiens
gccagccctgacacaggagc

SEQ ID NO: 8063085 - DNA, 20 bp, Homo sapiens
gccagccctgacacaggagc

SEQ ID NO: 8063086 - DNA, 21 bp, Homo sapiens
gccacccctggcacaggtgct

SEQ ID NO: 8063087 - DNA, 22 bp, Homo sapiens
gccacccccaagtaggtggtct

SEQ ID NO: 8063088 - DNA, 23 bp, Homo sapiens
gccagccttgctctcctgcagcc

SEQ ID NO: 8063089 - DNA, 21 bp, Homo sapiens
gccagcctgtttacctgtggt

SEQ ID NO: 8063090 - DNA, 22 bp, Homo sapiens
gccagccttctgtggcctgcaa

SEQ ID NO: 8063091 - DNA, 22 bp, Homo sapiens
gccagcctgtgcttggccaggc

SEQ ID NO: 8063092 - DNA, 22 bp, Homo sapiens
gccagcctgtgggggctctgtg

SEQ ID NO: 8063093 - DNA, 22 bp, Homo sapiens
gccagctcccaagtgagcccct

SEQ ID NO: 8063094 - DNA, 22 bp, Homo sapiens
gccagctcccaagtgagcccct

SEQ ID NO: 8063095 - DNA, 22 bp, Homo sapiens
gccagctctgtggctgtacttg

SEQ ID NO: 8063096 - DNA, 22 bp, Homo sapiens
gccagctccgcaggatggcgcg

SEQ ID NO: 8063097 - DNA, 22 bp, Homo sapiens
gccagctcagtgccaggcccct

SEQ ID NO: 8063098 - DNA, 22 bp, Homo sapiens
gccagctcagatgcaggaagga

SEQ ID NO: 8063099 - DNA, 22 bp, Homo sapiens
gccagctcagatgcaggaagga

SEQ ID NO: 8063100 - DNA, 22 bp, Homo sapiens
gccaggcactgctctaagccct

SEQ ID NO: 8063101 - DNA, 20 bp, Homo sapiens
gccaggcactgttctcaata

SEQ ID NO: 8063102 - DNA, 22 bp, Homo sapiens
gccaggcagacaggtcatcagg

SEQ ID NO: 8063103 - DNA, 22 bp, Homo sapiens
gcatggccttgctgtagtggta

SEQ ID NO: 8063104 - DNA, 22 bp, Homo sapiens
gcatgcagtcaaccagtaaggg

SEQ ID NO: 8063105 - DNA, 22 bp, Homo sapiens
gcatgcagtaaaattcagcaac

SEQ ID NO: 8063106 - DNA, 22 bp, Homo sapiens
gcatgcagtaaaattcagcaac

SEQ ID NO: 8063107 - DNA, 19 bp, Homo sapiens
gcatgcagagtaagaaggt

SEQ ID NO: 8063108 - DNA, 22 bp, Homo sapiens
gcatgcagagaatacctgtgat

SEQ ID NO: 8063109 - DNA, 22 bp, Homo sapiens
gcatgcagacagtctgagacca

SEQ ID NO: 8063110 - DNA, 22 bp, Homo sapiens
gcatgcagggagggtctggctg

SEQ ID NO: 8063111 - DNA, 22 bp, Homo sapiens
gcatgcagggagggtctggctg

SEQ ID NO: 8063112 - DNA, 22 bp, Homo sapiens
gcatgcaggataggttgagctc

SEQ ID NO: 8063113 - DNA, 22 bp, Homo sapiens
gcatgcaggagagaaagacggc

SEQ ID NO: 8063114 - DNA, 22 bp, Homo sapiens
gcatgcagaaaatgaacaacga

SEQ ID NO: 8063115 - DNA, 22 bp, Homo sapiens
gcatgcagacagtctgagacca

SEQ ID NO: 8063116 - DNA, 22 bp, Homo sapiens
gcagtgggaaggttggcacatg

SEQ ID NO: 8063117 - DNA, 22 bp, Homo sapiens
gcaggggagtccactctatgca

SEQ ID NO: 8063118 - DNA, 22 bp, Homo sapiens
gcaggggagtggatgatggatt

SEQ ID NO: 8063119 - DNA, 22 bp, Homo sapiens
gcaggggagtggcaggcccgga

SEQ ID NO: 8063120 - DNA, 22 bp, Homo sapiens
gcagtgacagggctgctgcctt

SEQ ID NO: 8063121 - DNA, 22 bp, Homo sapiens
gcagtgctttagtctgtccttt

SEQ ID NO: 8063122 - DNA, 21 bp, Homo sapiens
gcagggacaaagcttcaggag

SEQ ID NO: 8063123 - DNA, 22 bp, Homo sapiens
gcaggcagatcacctgtcagga

SEQ ID NO: 8063124 - DNA, 22 bp, Homo sapiens
gcaggcagatcacctgtcagga

SEQ ID NO: 8063125 - DNA, 22 bp, Homo sapiens
gcaggcagatcacctgtcagga

SEQ ID NO: 8063126 - DNA, 22 bp, Homo sapiens
gcaggcagccacgattcccttg

SEQ ID NO: 8063127 - DNA, 22 bp, Homo sapiens
gcaggcagaggtggaggagaca

SEQ ID NO: 8063128 - DNA, 22 bp, Homo sapiens
gcaggcagaggtggaggagaca

SEQ ID NO: 8063129 - DNA, 22 bp, Homo sapiens
gcagggcttgcagcagctagac

SEQ ID NO: 8063130 - DNA, 22 bp, Homo sapiens
gcagggacctgccactgctgtc

SEQ ID NO: 8063131 - DNA, 22 bp, Homo sapiens
gcagggacaaggcaggtgttct

SEQ ID NO: 8063132 - DNA, 22 bp, Homo sapiens
gcagggacaactgtgcacctga

SEQ ID NO: 8063133 - DNA, 22 bp, Homo sapiens
gcagggacatctttgtctagta

SEQ ID NO: 8063134 - DNA, 22 bp, Homo sapiens
gcagggacagggcagggccttt

SEQ ID NO: 8063135 - DNA, 22 bp, Homo sapiens
gcagggacagggcagggccttt

SEQ ID NO: 8063136 - DNA, 22 bp, Homo sapiens
gcagggacacctttgtgaagct

SEQ ID NO: 8063137 - DNA, 22 bp, Homo sapiens
gcagctttgtggagaggcccat

SEQ ID NO: 8063138 - DNA, 22 bp, Homo sapiens
gcaggaaaggttgagactttgc

SEQ ID NO: 8063139 - DNA, 22 bp, Homo sapiens
gcaggaaaggttgagactttgc

SEQ ID NO: 8063140 - DNA, 22 bp, Homo sapiens
gcagctttttggatgtcagtta

SEQ ID NO: 8063141 - DNA, 19 bp, Homo sapiens
gcaggaaatgagtgattgc

SEQ ID NO: 8063142 - DNA, 22 bp, Homo sapiens
gcaggaagatgagctcaggtaa

SEQ ID NO: 8063143 - DNA, 22 bp, Homo sapiens
gcagcctcaaactccccagctc

SEQ ID NO: 8063144 - DNA, 22 bp, Homo sapiens
gcagcctcagggcactcagatg

SEQ ID NO: 8063145 - DNA, 22 bp, Homo sapiens
gcagctgtcgctaggagctgtg

SEQ ID NO: 8063146 - DNA, 22 bp, Homo sapiens
gcagctgtcatttacaacaggg

SEQ ID NO: 8063147 - DNA, 22 bp, Homo sapiens
gcagctttctaagctttattgc

SEQ ID NO: 8063148 - DNA, 22 bp, Homo sapiens
gcagatggctcagacactgggg

SEQ ID NO: 8063149 - DNA, 22 bp, Homo sapiens
gcagatggctgagcctgcagat

SEQ ID NO: 8063150 - DNA, 22 bp, Homo sapiens
gcagatggtggggcaggaaaat

SEQ ID NO: 8063151 - DNA, 22 bp, Homo sapiens
gcagatggcagcccaggctggg

SEQ ID NO: 8063152 - DNA, 23 bp, Homo sapiens
gcagatggccccagagtgctgcc

SEQ ID NO: 8063153 - DNA, 22 bp, Homo sapiens
gcagccccaggagacgcccagg

SEQ ID NO: 8063154 - DNA, 22 bp, Homo sapiens
gcagcccagagcgcaggacccc

SEQ ID NO: 8063155 - DNA, 22 bp, Homo sapiens
gcagatggtgggggaggagtac

SEQ ID NO: 8063156 - DNA, 22 bp, Homo sapiens
gcagcccaggtgtagctctttg

SEQ ID NO: 8063157 - DNA, 22 bp, Homo sapiens
gcagagggtcctgtgccagcag

SEQ ID NO: 8063158 - DNA, 22 bp, Homo sapiens
gcagagggtcctgtgccagcag

SEQ ID NO: 8063159 - DNA, 22 bp, Homo sapiens
gcagagggggtacttcggccct

SEQ ID NO: 8063160 - DNA, 22 bp, Homo sapiens
gcagaggccatcaactttgcca

SEQ ID NO: 8063161 - DNA, 22 bp, Homo sapiens
gcagaggcatttctgacgctgc

SEQ ID NO: 8063162 - DNA, 22 bp, Homo sapiens
gcagagcaggaaggaagtcagg

SEQ ID NO: 8063163 - DNA, 22 bp, Homo sapiens
gcagagaaagttttgtcctcag

SEQ ID NO: 8063164 - DNA, 22 bp, Homo sapiens
gcagagaacccagcagattggc

SEQ ID NO: 8063165 - DNA, 22 bp, Homo sapiens
gcagagcaccctgcagtggtat

SEQ ID NO: 8063166 - DNA, 18 bp, Homo sapiens
gcagagcagaagctcaag

SEQ ID NO: 8063167 - DNA, 18 bp, Homo sapiens
gcagagcagaagctcaag

SEQ ID NO: 8063168 - DNA, 19 bp, Homo sapiens
gcacaccctgcaccaccat

SEQ ID NO: 8063169 - DNA, 22 bp, Homo sapiens
gcacaccctctcaccagcactg

SEQ ID NO: 8063170 - DNA, 22 bp, Homo sapiens
gcacagggctgccaggcggctt

SEQ ID NO: 8063171 - DNA, 22 bp, Homo sapiens
gcacacagtactatatgctaca

SEQ ID NO: 8063172 - DNA, 22 bp, Homo sapiens
gcaaaggccactggggcgatgg

SEQ ID NO: 8063173 - DNA, 22 bp, Homo sapiens
gcaaaggctagagacacaggga

SEQ ID NO: 8063174 - DNA, 22 bp, Homo sapiens
gcaaaggcttcttttattctcc

SEQ ID NO: 8063175 - DNA, 21 bp, Homo sapiens
gcaaagtgtgggcataaacag

SEQ ID NO: 8063176 - DNA, 22 bp, Homo sapiens
gcaaagtctcaagacccaagtg

SEQ ID NO: 8063177 - DNA, 22 bp, Homo sapiens
gcaaagtctgcatctggatcag

SEQ ID NO: 8063178 - DNA, 22 bp, Homo sapiens
gcaaagctgggtgtgaatgcac

SEQ ID NO: 8063179 - DNA, 23 bp, Homo sapiens
ggcctcagtgatgatgggttaaa

SEQ ID NO: 8063180 - DNA, 22 bp, Homo sapiens
ggcctcagtgggccgctgcagg

SEQ ID NO: 8063181 - DNA, 22 bp, Homo sapiens
ggcctcagtttctccatgggtt

SEQ ID NO: 8063182 - DNA, 22 bp, Homo sapiens
ggcctcagtttcttcaactgta

SEQ ID NO: 8063183 - DNA, 21 bp, Homo sapiens
ggcctctgtcatcctgggaag

SEQ ID NO: 8063184 - DNA, 23 bp, Homo sapiens
ggcctctgtgttctgcccacatg

SEQ ID NO: 8063185 - DNA, 22 bp, Homo sapiens
ggcctctgttctgcattcctcc

SEQ ID NO: 8063186 - DNA, 22 bp, Homo sapiens
ggcctctgttctgcattcctcc

SEQ ID NO: 8063187 - DNA, 22 bp, Homo sapiens
ggcctctgtttggagccaggat

SEQ ID NO: 8063188 - DNA, 22 bp, Homo sapiens
ggcctgagggtgggctctcagt

SEQ ID NO: 8063189 - DNA, 22 bp, Homo sapiens
ggcctgagtcccacctggctgt

SEQ ID NO: 8063190 - DNA, 22 bp, Homo sapiens
ggcctgcacagaggtggctcta

SEQ ID NO: 8063191 - DNA, 22 bp, Homo sapiens
ggcctttgcgtccacgccgctt

SEQ ID NO: 8063192 - DNA, 22 bp, Homo sapiens
ggcgaggccgggacaggctgga

SEQ ID NO: 8063193 - DNA, 22 bp, Homo sapiens
ggcgctggccacggtggctctg

SEQ ID NO: 8063194 - DNA, 22 bp, Homo sapiens
ggccaatgggaatggccagtag

SEQ ID NO: 8063195 - DNA, 22 bp, Homo sapiens
ggccagggggcttcagactcca

SEQ ID NO: 8063196 - DNA, 22 bp, Homo sapiens
ggccagggcctggggactgtcc

SEQ ID NO: 8063197 - DNA, 22 bp, Homo sapiens
ggcaggcagaggctgagacagg

SEQ ID NO: 8063198 - DNA, 22 bp, Homo sapiens
ggcaggtggcactgctgctccc

SEQ ID NO: 8063199 - DNA, 22 bp, Homo sapiens
ggcatgggccgaggtgcctcct

SEQ ID NO: 8063200 - DNA, 22 bp, Homo sapiens
ggcatggggtgtatgtggcacg

SEQ ID NO: 8063201 - DNA, 22 bp, Homo sapiens
ggcatggctcggagtcagaaca

SEQ ID NO: 8063202 - DNA, 22 bp, Homo sapiens
ggcatggctgggttctggtgag

SEQ ID NO: 8063203 - DNA, 22 bp, Homo sapiens
ggcatgggagtgagcaacctta

SEQ ID NO: 8063204 - DNA, 22 bp, Homo sapiens
ggcagtgaatgaaacagaggct

SEQ ID NO: 8063205 - DNA, 22 bp, Homo sapiens
ggcagtgaaaaagtatgtttcc

SEQ ID NO: 8063206 - DNA, 22 bp, Homo sapiens
ggagccagcagggtgacactga

SEQ ID NO: 8063207 - DNA, 22 bp, Homo sapiens
ggagccagaggctgctgctgtg

SEQ ID NO: 8063208 - DNA, 22 bp, Homo sapiens
ggagccagagggatgcagttga

SEQ ID NO: 8063209 - DNA, 22 bp, Homo sapiens
ggagccagagtctgcagtgtaa

SEQ ID NO: 8063210 - DNA, 22 bp, Homo sapiens
ggagtcaggagcaggctgggct

SEQ ID NO: 8063211 - DNA, 21 bp, Homo sapiens
ggagtcagggtctggctgggg

SEQ ID NO: 8063212 - DNA, 22 bp, Homo sapiens
ggagtcagcctgtcagagtgta

SEQ ID NO: 8063213 - DNA, 22 bp, Homo sapiens
ggagtcccagcaaagccttccc

SEQ ID NO: 8063214 - DNA, 22 bp, Homo sapiens
ggcaaagttttcatctcataac

SEQ ID NO: 8063215 - DNA, 22 bp, Homo sapiens
ggagtgagtactggagtagctg

SEQ ID NO: 8063216 - DNA, 23 bp, Homo sapiens
ggagtgcaatggcgccatctcgg

SEQ ID NO: 8063217 - DNA, 23 bp, Homo sapiens
ggagtgcaatggcgccatctcgg

SEQ ID NO: 8063218 - DNA, 22 bp, Homo sapiens
ggcaaagagacatgcatcgggg

SEQ ID NO: 8063219 - DNA, 22 bp, Homo sapiens
ggcaccagcaggcaccgatgcc

SEQ ID NO: 8063220 - DNA, 22 bp, Homo sapiens
ggcaccagcacttgggatggct

SEQ ID NO: 8063221 - DNA, 17 bp, Homo sapiens
ggcaccagacggagagt

SEQ ID NO: 8063222 - DNA, 22 bp, Homo sapiens
ggcagaggagctggaaacatgg

SEQ ID NO: 8063223 - DNA, 22 bp, Homo sapiens
ggcaccaggacatgactcccag

SEQ ID NO: 8063224 - DNA, 23 bp, Homo sapiens
ggcaccaggccatggagcgggag

SEQ ID NO: 8063225 - DNA, 20 bp, Homo sapiens
ggcaccaggctaggattgga

SEQ ID NO: 8063226 - DNA, 22 bp, Homo sapiens
ggcaggcaacggaccactagtc

SEQ ID NO: 8063227 - DNA, 22 bp, Homo sapiens
ggcaggaggtgagtggcgggtg

SEQ ID NO: 8063228 - DNA, 22 bp, Homo sapiens
ggcagaggtagctggaaccagg

SEQ ID NO: 8063229 - DNA, 22 bp, Homo sapiens
gggatggggtcaacatgtacct

SEQ ID NO: 8063230 - DNA, 22 bp, Homo sapiens
gggatggggtcaacatgtacct

SEQ ID NO: 8063231 - DNA, 22 bp, Homo sapiens
gggatgtcactgtgcctggcac

SEQ ID NO: 8063232 - DNA, 22 bp, Homo sapiens
gggatggggtcgggaccctgct

SEQ ID NO: 8063233 - DNA, 19 bp, Homo sapiens
gggcaaagtgatcgtcctg

SEQ ID NO: 8063234 - DNA, 22 bp, Homo sapiens
gggcaaagtggtggaggcagtt

SEQ ID NO: 8063235 - DNA, 22 bp, Homo sapiens
gggaggagcttggagattcact

SEQ ID NO: 8063236 - DNA, 22 bp, Homo sapiens
gggatggggggaagcgtccatg

SEQ ID NO: 8063237 - DNA, 22 bp, Homo sapiens
gggaggaaagagaagtggtcca

SEQ ID NO: 8063238 - DNA, 22 bp, Homo sapiens
gggcaggatgcagtttcagaga

SEQ ID NO: 8063239 - DNA, 22 bp, Homo sapiens
gggcatggaggtctgtctgcag

SEQ ID NO: 8063240 - DNA, 22 bp, Homo sapiens
gggcagctgcagggatggtgac

SEQ ID NO: 8063241 - DNA, 22 bp, Homo sapiens
gggcagctgcagggatggtgac

SEQ ID NO: 8063242 - DNA, 22 bp, Homo sapiens
gggcagctctggctgtgggaag

SEQ ID NO: 8063243 - DNA, 22 bp, Homo sapiens
gggcacagctgctacccagtgc

SEQ ID NO: 8063244 - DNA, 22 bp, Homo sapiens
gggcagctgccaagtgcatcgc

SEQ ID NO: 8063245 - DNA, 22 bp, Homo sapiens
gggcagctgccaagtgcatcgc

SEQ ID NO: 8063246 - DNA, 22 bp, Homo sapiens
gggcagctgcccctctctgggc

SEQ ID NO: 8063247 - DNA, 22 bp, Homo sapiens
gggcagctgccagaggccatgg

SEQ ID NO: 8063248 - DNA, 22 bp, Homo sapiens
gggagctggttcctgccctcca

SEQ ID NO: 8063249 - DNA, 22 bp, Homo sapiens
gggagctgtagtccagataccg

SEQ ID NO: 8063250 - DNA, 22 bp, Homo sapiens
gggagaggttacccgagcaact

SEQ ID NO: 8063251 - DNA, 22 bp, Homo sapiens
gggagaggttacccgagcaact

SEQ ID NO: 8063252 - DNA, 22 bp, Homo sapiens
gggagagcgggaggtgccacag

SEQ ID NO: 8063253 - DNA, 22 bp, Homo sapiens
gggagagagagctcatgttgaa

SEQ ID NO: 8063254 - DNA, 22 bp, Homo sapiens
gggagagagaaaacgtggcgca

SEQ ID NO: 8063255 - DNA, 22 bp, Homo sapiens
gggagacacgctgcaggcataa

SEQ ID NO: 8063256 - DNA, 22 bp, Homo sapiens
gggacatggaggcgcgcaggca

SEQ ID NO: 8063257 - DNA, 23 bp, Homo sapiens
gggaccagctagggctgtgacct

SEQ ID NO: 8063258 - DNA, 23 bp, Homo sapiens
gggagaatatgaggatgatggtg

SEQ ID NO: 8063259 - DNA, 22 bp, Homo sapiens
gggacatctttctagtcagggt

SEQ ID NO: 8063260 - DNA, 22 bp, Homo sapiens
gggacatgaagcatcggaggca

SEQ ID NO: 8063261 - DNA, 22 bp, Homo sapiens
gggacaggcccctcgctagctt

SEQ ID NO: 8063262 - DNA, 22 bp, Homo sapiens
gggaatgtaatcatggaatgct

SEQ ID NO: 8063263 - DNA, 22 bp, Homo sapiens
gggaatgtgaaacagtaaggga

SEQ ID NO: 8063264 - DNA, 22 bp, Homo sapiens
gggacagctgtagtgcttggct

SEQ ID NO: 8063265 - DNA, 22 bp, Homo sapiens
ggcttggcctgataaatgcatg

SEQ ID NO: 8063266 - DNA, 22 bp, Homo sapiens
ggctgggctccgggagcatgcg

SEQ ID NO: 8063267 - DNA, 22 bp, Homo sapiens
ggctgggctcgctgattggctg

SEQ ID NO: 8063268 - DNA, 22 bp, Homo sapiens
ggctgggcctctccctcagctg

SEQ ID NO: 8063269 - DNA, 22 bp, Homo sapiens
ggctgggcaggtctgcacaggg

SEQ ID NO: 8063270 - DNA, 22 bp, Homo sapiens
ggctgggcaggtctgcacaggg

SEQ ID NO: 8063271 - DNA, 22 bp, Homo sapiens
ggctgggccagggcctgtggac

SEQ ID NO: 8063272 - DNA, 22 bp, Homo sapiens
ggctgggcatccatccatgaga

SEQ ID NO: 8063273 - DNA, 22 bp, Homo sapiens
ggcttctctcttcacatggctt

SEQ ID NO: 8063274 - DNA, 22 bp, Homo sapiens
ggcttctctcccccagctccac

SEQ ID NO: 8063275 - DNA, 22 bp, Homo sapiens
ggcttctcgtgccgaagcaaga

SEQ ID NO: 8063276 - DNA, 22 bp, Homo sapiens
ggcttctcccctttgagtcttc

SEQ ID NO: 8063277 - DNA, 22 bp, Homo sapiens
ggctgggaggccgtgctgacct

SEQ ID NO: 8063278 - DNA, 22 bp, Homo sapiens
ggctctgctcacagcccgcagc

SEQ ID NO: 8063279 - DNA, 22 bp, Homo sapiens
ggcgggggtccaggagcctgca

SEQ ID NO: 8063280 - DNA, 22 bp, Homo sapiens
ggctccaccctgcttccagaag

SEQ ID NO: 8063281 - DNA, 22 bp, Homo sapiens
ggctctggcaaggggaggctac

SEQ ID NO: 8063282 - DNA, 22 bp, Homo sapiens
gggtggaggagaacaggcccca

SEQ ID NO: 8063283 - DNA, 22 bp, Homo sapiens
ggggctggtggtggtttctcca

SEQ ID NO: 8063284 - DNA, 22 bp, Homo sapiens
ggggtgggcgtgcagggacacc

SEQ ID NO: 8063285 - DNA, 22 bp, Homo sapiens
ggggtggggttactcattgtgc

SEQ ID NO: 8063286 - DNA, 22 bp, Homo sapiens
ggggctggctcactaagagact

SEQ ID NO: 8063287 - DNA, 22 bp, Homo sapiens
ggggctgggatttgaacccagg

SEQ ID NO: 8063288 - DNA, 22 bp, Homo sapiens
gggctgctgccaccaggtggat

SEQ ID NO: 8063289 - DNA, 22 bp, Homo sapiens
gggctgctgcccaggaggcacc

SEQ ID NO: 8063290 - DNA, 22 bp, Homo sapiens
gggctgctgtagagaacatgtt

SEQ ID NO: 8063291 - DNA, 22 bp, Homo sapiens
gggctgctgctgccagcgacac

SEQ ID NO: 8063292 - DNA, 22 bp, Homo sapiens
gggctgcatcagcaggacccgg

SEQ ID NO: 8063293 - DNA, 22 bp, Homo sapiens
gggctgctgccaatcacagcct

SEQ ID NO: 8063294 - DNA, 23 bp, Homo sapiens
gggctgctccaggccaaggctgg

SEQ ID NO: 8063295 - DNA, 22 bp, Homo sapiens
gggctgcctttcttctgggagc

SEQ ID NO: 8063296 - DNA, 22 bp, Homo sapiens
gggctgagagctggaatctgag

SEQ ID NO: 8063297 - DNA, 22 bp, Homo sapiens
gggctgagctaagctgggttga

SEQ ID NO: 8063298 - DNA, 22 bp, Homo sapiens
gggctgagctgttctgagttta

SEQ ID NO: 8063299 - DNA, 22 bp, Homo sapiens
gggcatggtggtgcacacctgt

SEQ ID NO: 8063300 - DNA, 22 bp, Homo sapiens
gggcatggtggcaggcacctgt

SEQ ID NO: 8063301 - DNA, 18 bp, Homo sapiens
gggcatggatgcagcatc

SEQ ID NO: 8063302 - DNA, 22 bp, Homo sapiens
gggcatggtgatgtgcacctgt

SEQ ID NO: 8063303 - DNA, 22 bp, Homo sapiens
ggtggcctctgcaggcctcgac

SEQ ID NO: 8063304 - DNA, 22 bp, Homo sapiens
ggtggcctctcatgcaaggtag

SEQ ID NO: 8063305 - DNA, 22 bp, Homo sapiens
ggtggcctcggtggtgcacagg

SEQ ID NO: 8063306 - DNA, 22 bp, Homo sapiens
ggtggcctccagggcataggtg

SEQ ID NO: 8063307 - DNA, 17 bp, Homo sapiens
ggtggcctgcagtggct

SEQ ID NO: 8063308 - DNA, 22 bp, Homo sapiens
ggtggcctgccctgatccctgg

SEQ ID NO: 8063309 - DNA, 22 bp, Homo sapiens
ggtggcctttcagtggatcagg

SEQ ID NO: 8063310 - DNA, 22 bp, Homo sapiens
ggtggccttttatgagcagggt

SEQ ID NO: 8063311 - DNA, 18 bp, Homo sapiens
ggtggctcagtcatgggg

SEQ ID NO: 8063312 - DNA, 22 bp, Homo sapiens
ggtctctgttgcctccatcaag

SEQ ID NO: 8063313 - DNA, 22 bp, Homo sapiens
ggtggctctccctggactcagc

SEQ ID NO: 8063314 - DNA, 22 bp, Homo sapiens
ggtggctcggccagtgcaggcc

SEQ ID NO: 8063315 - DNA, 17 bp, Homo sapiens
ggtggctcgggcgcggc

SEQ ID NO: 8063316 - DNA, 22 bp, Homo sapiens
ggtggctctcttaagggcagcg

SEQ ID NO: 8063317 - DNA, 22 bp, Homo sapiens
ggtgttgcagttgaagactggt

SEQ ID NO: 8063318 - DNA, 22 bp, Homo sapiens
ggtgtgtggtcctctcacttag

SEQ ID NO: 8063319 - DNA, 22 bp, Homo sapiens
ggtgtgtgaggagtcacttagt

SEQ ID NO: 8063320 - DNA, 22 bp, Homo sapiens
ggtccctggttccctctgagct

SEQ ID NO: 8063321 - DNA, 22 bp, Homo sapiens
ggtccttcagtaggttccagac

SEQ ID NO: 8063322 - DNA, 22 bp, Homo sapiens
gggtggcactgataatgagacg

SEQ ID NO: 8063323 - DNA, 22 bp, Homo sapiens
gggtggcacaggtgcagagggt

SEQ ID NO: 8063324 - DNA, 20 bp, Homo sapiens
gggtggagttgcggtctgtg

SEQ ID NO: 8063325 - DNA, 22 bp, Homo sapiens
gggtggctcctatgggcatagc

SEQ ID NO: 8063326 - DNA, 22 bp, Homo sapiens
ggtcacgtgaccgcacctgcct

SEQ ID NO: 8063327 - DNA, 22 bp, Homo sapiens
gtgactcacacaggcctgggct

SEQ ID NO: 8063328 - DNA, 22 bp, Homo sapiens
gtgactctgcattttatggatc

SEQ ID NO: 8063329 - DNA, 22 bp, Homo sapiens
gtgactcttacctacccagcct

SEQ ID NO: 8063330 - DNA, 22 bp, Homo sapiens
gtgactgtgatcttatttgcaa

SEQ ID NO: 8063331 - DNA, 22 bp, Homo sapiens
gtgcagagaaatgagaagtcga

SEQ ID NO: 8063332 - DNA, 22 bp, Homo sapiens
gtgcagtgagcagtgcagcacc

SEQ ID NO: 8063333 - DNA, 22 bp, Homo sapiens
gtgcagtgaaaaaagaatgtcc

SEQ ID NO: 8063334 - DNA, 22 bp, Homo sapiens
gtgcagtgaccctggagagctg

SEQ ID NO: 8063335 - DNA, 22 bp, Homo sapiens
gtgcaggtggttggcccagccg

SEQ ID NO: 8063336 - DNA, 20 bp, Homo sapiens
gtgcatttcacctgtactgt

SEQ ID NO: 8063337 - DNA, 22 bp, Homo sapiens
gtgcatttatatttgcctttgg

SEQ ID NO: 8063338 - DNA, 22 bp, Homo sapiens
gtgctaggattacaggcatggg

SEQ ID NO: 8063339 - DNA, 22 bp, Homo sapiens
gtctgccctgcagacatgcctc

SEQ ID NO: 8063340 - DNA, 22 bp, Homo sapiens
gtctggaggaggaagaaggcac

SEQ ID NO: 8063341 - DNA, 22 bp, Homo sapiens
gtctgctggtgcctggcctgcg

SEQ ID NO: 8063342 - DNA, 22 bp, Homo sapiens
gtctgctggtgcctggcctgcg

SEQ ID NO: 8063343 - DNA, 22 bp, Homo sapiens
gtctgctgtgggtccccaggag

SEQ ID NO: 8063344 - DNA, 22 bp, Homo sapiens
gtctgctgcagtcgtggctcta

SEQ ID NO: 8063345 - DNA, 22 bp, Homo sapiens
gtctgctggcacgtcacagata

SEQ ID NO: 8063346 - DNA, 22 bp, Homo sapiens
gtctgcctggaggcagctgctg

SEQ ID NO: 8063347 - DNA, 22 bp, Homo sapiens
gtctgctgcagagcatggcttt

SEQ ID NO: 8063348 - DNA, 22 bp, Homo sapiens
gtgaaggaggggccacagatat

SEQ ID NO: 8063349 - DNA, 22 bp, Homo sapiens
gtgaagagctgttgcagagatt

SEQ ID NO: 8063350 - DNA, 22 bp, Homo sapiens
gtgaaatatttaacgtccaggt

SEQ ID NO: 8063351 - DNA, 18 bp, Homo sapiens
gtctggaggtcaggagct

SEQ ID NO: 8063352 - DNA, 22 bp, Homo sapiens
gtctggagtggggcctgagaat

SEQ ID NO: 8063353 - DNA, 18 bp, Homo sapiens
gtccacagattcttcact

SEQ ID NO: 8063354 - DNA, 22 bp, Homo sapiens
gtccacagctctgaggtctccc

SEQ ID NO: 8063355 - DNA, 22 bp, Homo sapiens
gtccacaacatcagactaactg

SEQ ID NO: 8063356 - DNA, 22 bp, Homo sapiens
gtccaagagtcaagaagggggc

SEQ ID NO: 8063357 - DNA, 22 bp, Homo sapiens
gtcccctcagccacccatgggg

SEQ ID NO: 8063358 - DNA, 22 bp, Homo sapiens
gtccccgacgtttggcttgatg

SEQ ID NO: 8063359 - DNA, 22 bp, Homo sapiens
gtccccagctaatctctttgcc

SEQ ID NO: 8063360 - DNA, 22 bp, Homo sapiens
gtccctggaatggactctgcgc

SEQ ID NO: 8063361 - DNA, 22 bp, Homo sapiens
gtatttaattccattaagttag

SEQ ID NO: 8063362 - DNA, 22 bp, Homo sapiens
ggtttgttggggtccaggccca

SEQ ID NO: 8063363 - DNA, 22 bp, Homo sapiens
gtacatttaggattcattgaaa

SEQ ID NO: 8063364 - DNA, 22 bp, Homo sapiens
gtacatttcagtttccttaaga

SEQ ID NO: 8063365 - DNA, 22 bp, Homo sapiens
gtacattttgaggttaaaacaa

SEQ ID NO: 8063366 - DNA, 22 bp, Homo sapiens
gtacatttctcccaacactaaa

SEQ ID NO: 8063367 - DNA, 22 bp, Homo sapiens
gtacattttactttgtttgaat

SEQ ID NO: 8063368 - DNA, 22 bp, Homo sapiens
gtacatttctcttgttcttatt

SEQ ID NO: 8063369 - DNA, 22 bp, Homo sapiens
gagctgaaggagaaagcagggg

SEQ ID NO: 8063370 - DNA, 22 bp, Homo sapiens
gagcttcctcagcctttctcac

SEQ ID NO: 8063371 - DNA, 22 bp, Homo sapiens
gagcttcctgatgccgaccagt

SEQ ID NO: 8063372 - DNA, 22 bp, Homo sapiens
gagcttccatggacgccatctg

SEQ ID NO: 8063373 - DNA, 22 bp, Homo sapiens
gagcttccactctagaaggagt

SEQ ID NO: 8063374 - DNA, 22 bp, Homo sapiens
gagcttaaatggctaaatataa

SEQ ID NO: 8063375 - DNA, 21 bp, Homo sapiens
gagctctcaggcaagaagcag

SEQ ID NO: 8063376 - DNA, 22 bp, Homo sapiens
gagctctgactgctgggtgaca

SEQ ID NO: 8063377 - DNA, 22 bp, Homo sapiens
gagctctgtgtagcctgagggt

SEQ ID NO: 8063378 - DNA, 22 bp, Homo sapiens
gagcctgcctctagtctctaga

SEQ ID NO: 8063379 - DNA, 22 bp, Homo sapiens
gagcctggacatctcaggccca

SEQ ID NO: 8063380 - DNA, 22 bp, Homo sapiens
gagcggcaggagccacctgcct

SEQ ID NO: 8063381 - DNA, 22 bp, Homo sapiens
gagcctggattgaagtgggtgg

SEQ ID NO: 8063382 - DNA, 22 bp, Homo sapiens
gagcctggatagccttgttcca

SEQ ID NO: 8063383 - DNA, 22 bp, Homo sapiens
gagcctcctcctggtgtgccga

SEQ ID NO: 8063384 - DNA, 22 bp, Homo sapiens
gagcctgcccagccctgtccac

SEQ ID NO: 8063385 - DNA, 22 bp, Homo sapiens
gaggcagaagttgcagtgagca

SEQ ID NO: 8063386 - DNA, 22 bp, Homo sapiens
gaggcagaggaaggtggtctct

SEQ ID NO: 8063387 - DNA, 22 bp, Homo sapiens
gaggaggctaagtgggctctgg

SEQ ID NO: 8063388 - DNA, 22 bp, Homo sapiens
gaggagcctggccccacatcca

SEQ ID NO: 8063389 - DNA, 18 bp, Homo sapiens
gaggagccgtccctacta

SEQ ID NO: 8063390 - DNA, 22 bp, Homo sapiens
gagcagcaggtggctgtgatgg

SEQ ID NO: 8063391 - DNA, 22 bp, Homo sapiens
gagcagagtctatttccacact

SEQ ID NO: 8063392 - DNA, 22 bp, Homo sapiens
gagcagagtctatttccacact

SEQ ID NO: 8063393 - DNA, 21 bp, Homo sapiens
gagatttagaaggatcaattt

SEQ ID NO: 8063394 - DNA, 22 bp, Homo sapiens
gagattggatttaatggccaaa

SEQ ID NO: 8063395 - DNA, 22 bp, Homo sapiens
gagattggcctggcttgccaac

SEQ ID NO: 8063396 - DNA, 22 bp, Homo sapiens
gagatggagtctttttctgtca

SEQ ID NO: 8063397 - DNA, 22 bp, Homo sapiens
gagccagggtttgaaactagac

SEQ ID NO: 8063398 - DNA, 16 bp, Homo sapiens
gagccaggtgccttga

SEQ ID NO: 8063399 - DNA, 22 bp, Homo sapiens
gagccaggtcgggccgcggcga

SEQ ID NO: 8063400 - DNA, 22 bp, Homo sapiens
gagccaggttggaggctgcagt

SEQ ID NO: 8063401 - DNA, 22 bp, Homo sapiens
gagccagccgcaagagctgtga

SEQ ID NO: 8063402 - DNA, 22 bp, Homo sapiens
gagccaagcaccacattaagtt

SEQ ID NO: 8063403 - DNA, 22 bp, Homo sapiens
gagacaaaagttggagtgcaag

SEQ ID NO: 8063404 - DNA, 22 bp, Homo sapiens
gagaatctccagatgaagtcct

SEQ ID NO: 8063405 - DNA, 22 bp, Homo sapiens
gagaaggctgatccttggagtt

SEQ ID NO: 8063406 - DNA, 22 bp, Homo sapiens
gacctctgaaggcagagcaggg

SEQ ID NO: 8063407 - DNA, 19 bp, Homo sapiens
gagaggcctgtgcttgaag

SEQ ID NO: 8063408 - DNA, 22 bp, Homo sapiens
gagaggccacctgacgagcagt

SEQ ID NO: 8063409 - DNA, 22 bp, Homo sapiens
gagaggccaaaatccctgcccc

SEQ ID NO: 8063410 - DNA, 22 bp, Homo sapiens
gagaggcaggcgctgcaatggt

SEQ ID NO: 8063411 - DNA, 22 bp, Homo sapiens
gagatcggtaaagagcatgcac

SEQ ID NO: 8063412 - DNA, 22 bp, Homo sapiens
gaagccagtactgtgctctgca

SEQ ID NO: 8063413 - DNA, 22 bp, Homo sapiens
gaagagctgtcagaaaagctaa

SEQ ID NO: 8063414 - DNA, 22 bp, Homo sapiens
gaagagctgtgattcaggctta

SEQ ID NO: 8063415 - DNA, 22 bp, Homo sapiens
gaaatgcaaattctctctcgct

SEQ ID NO: 8063416 - DNA, 22 bp, Homo sapiens
gaaatgcagaacctgagaccat

SEQ ID NO: 8063417 - DNA, 22 bp, Homo sapiens
gaaatgcaggcttggattcagc

SEQ ID NO: 8063418 - DNA, 22 bp, Homo sapiens
gaaatgcagattctgattctgt

SEQ ID NO: 8063419 - DNA, 22 bp, Homo sapiens
gaaatgcatggatcttggcaga

SEQ ID NO: 8063420 - DNA, 22 bp, Homo sapiens
gaaatgcataatcttagtagat

SEQ ID NO: 8063421 - DNA, 22 bp, Homo sapiens
gaacatttggatttgtaaattt

SEQ ID NO: 8063422 - DNA, 22 bp, Homo sapiens
gaacagcttcttgggagctggg

SEQ ID NO: 8063423 - DNA, 22 bp, Homo sapiens
gaacagctgctagagatctgtg

SEQ ID NO: 8063424 - DNA, 22 bp, Homo sapiens
gaaatatttctcttgagcccct

SEQ ID NO: 8063425 - DNA, 20 bp, Homo sapiens
gaaatcagttaatgatggtt

SEQ ID NO: 8063426 - DNA, 22 bp, Homo sapiens
ctttcattcttagatattagtg

SEQ ID NO: 8063427 - DNA, 22 bp, Homo sapiens
ctttcataaggggttttataat

SEQ ID NO: 8063428 - DNA, 22 bp, Homo sapiens
ctttccaactctagtgaaattt

SEQ ID NO: 8063429 - DNA, 23 bp, Homo sapiens
ctttcattgtggtttcacagagc

SEQ ID NO: 8063430 - DNA, 22 bp, Homo sapiens
ctttcagaggttactcaggaaa

SEQ ID NO: 8063431 - DNA, 18 bp, Homo sapiens
ctttcagatggatatgct

SEQ ID NO: 8063432 - DNA, 22 bp, Homo sapiens
ctttcacacacatacatttgga

SEQ ID NO: 8063433 - DNA, 22 bp, Homo sapiens
gacaggggtccctctgggctgt

SEQ ID NO: 8063434 - DNA, 21 bp, Homo sapiens
gacaggggaagaagcaaggag

SEQ ID NO: 8063435 - DNA, 22 bp, Homo sapiens
gacacagaaggtcacatgttca

SEQ ID NO: 8063436 - DNA, 22 bp, Homo sapiens
gacagggtacgggctaggcaca

SEQ ID NO: 8063437 - DNA, 22 bp, Homo sapiens
gacaggtggggaaactaaggta

SEQ ID NO: 8063438 - DNA, 22 bp, Homo sapiens
gaccctgtttctacaaataatt

SEQ ID NO: 8063439 - DNA, 22 bp, Homo sapiens
gacctagattaacattctgtga

SEQ ID NO: 8063440 - DNA, 22 bp, Homo sapiens
gacagtcccccagcagcaaacc

SEQ ID NO: 8063441 - DNA, 22 bp, Homo sapiens
gaatacatgtgtgtatagaggt

SEQ ID NO: 8063442 - DNA, 22 bp, Homo sapiens
gaatacatgttgtttccctgga

SEQ ID NO: 8063443 - DNA, 22 bp, Homo sapiens
gaatacatgatacatgaactgc

SEQ ID NO: 8063444 - DNA, 22 bp, Homo sapiens
gaatacatgattaaagtttgat

SEQ ID NO: 8063445 - DNA, 22 bp, Homo sapiens
gaatacatggcagggagtcatc

SEQ ID NO: 8063446 - DNA, 22 bp, Homo sapiens
gaatacatgcacgacacggggg

SEQ ID NO: 8063447 - DNA, 22 bp, Homo sapiens
gaatacatttgccgtggttctc

SEQ ID NO: 8063448 - DNA, 22 bp, Homo sapiens
gaatacattggaaatcagaata

SEQ ID NO: 8063449 - DNA, 22 bp, Homo sapiens
gaatagcttccttttttccaaa

SEQ ID NO: 8063450 - DNA, 22 bp, Homo sapiens
gaatagcttgacaattattttt

SEQ ID NO: 8063451 - DNA, 22 bp, Homo sapiens
gaatagcttagattccttagtg

SEQ ID NO: 8063452 - DNA, 22 bp, Homo sapiens
gaatagctgtaggctagtgtct

SEQ ID NO: 8063453 - DNA, 22 bp, Homo sapiens
gaatattagtatcagttatacc

SEQ ID NO: 8063454 - DNA, 22 bp, Homo sapiens
gaatacatgaaccctcctgtgg

SEQ ID NO: 8063455 - DNA, 22 bp, Homo sapiens
gaatacatctgaaggctatgaa

SEQ ID NO: 8063456 - DNA, 22 bp, Homo sapiens
gaatacatccagagcagggctg

SEQ ID NO: 8063457 - DNA, 22 bp, Homo sapiens
gaatacatatcagatgtgtttc

SEQ ID NO: 8063458 - DNA, 22 bp, Homo sapiens
cttcagccagctggggatgcgg

SEQ ID NO: 8063459 - DNA, 22 bp, Homo sapiens
cttcagcccagcctccgcctcc

SEQ ID NO: 8063460 - DNA, 22 bp, Homo sapiens
cttcagaagagttaagtgtgag

SEQ ID NO: 8063461 - DNA, 22 bp, Homo sapiens
cttcagaaccagccagaagagg

SEQ ID NO: 8063462 - DNA, 22 bp, Homo sapiens
cttcaaacccagattaaatgca

SEQ ID NO: 8063463 - DNA, 22 bp, Homo sapiens
ctgttgtctcctctcagattat

SEQ ID NO: 8063464 - DNA, 22 bp, Homo sapiens
ctgttgtccctgggagctcagc

SEQ ID NO: 8063465 - DNA, 22 bp, Homo sapiens
ctgttgtcttcattgtcatatc

SEQ ID NO: 8063466 - DNA, 22 bp, Homo sapiens
cttatattttaggaacagacaa

SEQ ID NO: 8063467 - DNA, 22 bp, Homo sapiens
cttatattttaggaacagacaa

SEQ ID NO: 8063468 - DNA, 22 bp, Homo sapiens
cttatatttgtcaactttacaa

SEQ ID NO: 8063469 - DNA, 22 bp, Homo sapiens
cttcagccctgagtgccagcag

SEQ ID NO: 8063470 - DNA, 22 bp, Homo sapiens
cttcagcctcaactactatggt

SEQ ID NO: 8063471 - DNA, 22 bp, Homo sapiens
cttcagcctcatctcagcccgt

SEQ ID NO: 8063472 - DNA, 22 bp, Homo sapiens
cttcagcctcgttactcctgcg

SEQ ID NO: 8063473 - DNA, 22 bp, Homo sapiens
cttcagctgcagttatgtttag

SEQ ID NO: 8063474 - DNA, 20 bp, Homo sapiens
cttcaggacccatcctcccc

SEQ ID NO: 8063475 - DNA, 22 bp, Homo sapiens
cttcagtgattgcagaaagcct

SEQ ID NO: 8063476 - DNA, 18 bp, Homo sapiens
cttcagtgacagtctggc

SEQ ID NO: 8063477 - DNA, 22 bp, Homo sapiens
cttcctgaacaatgccatcaat

SEQ ID NO: 8063478 - DNA, 21 bp, Homo sapiens
cttgtctgcagtgtttatagc

SEQ ID NO: 8063479 - DNA, 22 bp, Homo sapiens
cttgtctgctataaaaatccag

SEQ ID NO: 8063480 - DNA, 22 bp, Homo sapiens
cttgtctgggcagcttgggagt

SEQ ID NO: 8063481 - DNA, 22 bp, Homo sapiens
cttgtctgataatggggccaac

SEQ ID NO: 8063482 - DNA, 22 bp, Homo sapiens
cttgtcctttacttgagactca

SEQ ID NO: 8063483 - DNA, 22 bp, Homo sapiens
cttgtctgtgtcggataaaact

SEQ ID NO: 8063484 - DNA, 16 bp, Homo sapiens
cttgtctgttgctcat

SEQ ID NO: 8063485 - DNA, 22 bp, Homo sapiens
cttgtattaagcttagagaggc

SEQ ID NO: 8063486 - DNA, 22 bp, Homo sapiens
cttgtattaggaagaatgcttt

SEQ ID NO: 8063487 - DNA, 22 bp, Homo sapiens
cttgtattcccctatctctaaa

SEQ ID NO: 8063488 - DNA, 22 bp, Homo sapiens
cttgcatgcatttgaagatcat

SEQ ID NO: 8063489 - DNA, 20 bp, Homo sapiens
cttgtacatgataaagattt

SEQ ID NO: 8063490 - DNA, 22 bp, Homo sapiens
cttgatggaggggccaggcttt

SEQ ID NO: 8063491 - DNA, 22 bp, Homo sapiens
cttgcaggcagggcctcctgga

SEQ ID NO: 8063492 - DNA, 23 bp, Homo sapiens
cttgcagggctggaggcttagaa

SEQ ID NO: 8063493 - DNA, 22 bp, Homo sapiens
cttgcaggattttgctgctgta

SEQ ID NO: 8063494 - DNA, 22 bp, Homo sapiens
cttcctgcattgtgccagagtt

SEQ ID NO: 8063495 - DNA, 22 bp, Homo sapiens
cttcctgcaggacagccatctg

SEQ ID NO: 8063496 - DNA, 23 bp, Homo sapiens
ctgtgtctatgcagccatatcca

SEQ ID NO: 8063497 - DNA, 22 bp, Homo sapiens
ctgtggtgggccctgggcttca

SEQ ID NO: 8063498 - DNA, 20 bp, Homo sapiens
ctgtggctcatgcatctgcc

SEQ ID NO: 8063499 - DNA, 22 bp, Homo sapiens
ctgtggctgcagccttggtcct

SEQ ID NO: 8063500 - DNA, 22 bp, Homo sapiens
ctgtggctgcagccttggtcct

SEQ ID NO: 8063501 - DNA, 23 bp, Homo sapiens
ctgtggctgagtcctgttggagt

SEQ ID NO: 8063502 - DNA, 19 bp, Homo sapiens
ctgtggctgacctctggcc

SEQ ID NO: 8063503 - DNA, 22 bp, Homo sapiens
ctgttctttagttccactgcaa

SEQ ID NO: 8063504 - DNA, 22 bp, Homo sapiens
ctgttctttagttccactgcaa

SEQ ID NO: 8063505 - DNA, 22 bp, Homo sapiens
ctgttcttctagtccactgaca

SEQ ID NO: 8063506 - DNA, 22 bp, Homo sapiens
ctgttcttctagtccactgaca

SEQ ID NO: 8063507 - DNA, 22 bp, Homo sapiens
ctgttctgtaagctgctgttgt

SEQ ID NO: 8063508 - DNA, 22 bp, Homo sapiens
ctgttctgtctcatgttgcaca

SEQ ID NO: 8063509 - DNA, 22 bp, Homo sapiens
ctgttctgaccagtgcagggat

SEQ ID NO: 8063510 - DNA, 22 bp, Homo sapiens
ctgttctgctgcataaaaactt

SEQ ID NO: 8063511 - DNA, 22 bp, Homo sapiens
ctgttctggagacactgatgaa

SEQ ID NO: 8063512 - DNA, 22 bp, Homo sapiens
ctgttctgaactgcctgcatgc

SEQ ID NO: 8063513 - DNA, 22 bp, Homo sapiens
ctgttcagatggcacattcagt

SEQ ID NO: 8063514 - DNA, 22 bp, Homo sapiens
ctgttcatggaaaaatagttgg

SEQ ID NO: 8063515 - DNA, 22 bp, Homo sapiens
ctgtgtctgaataactctgtgt

SEQ ID NO: 8063516 - DNA, 22 bp, Homo sapiens
ctgtgtctctacctccccatcc

SEQ ID NO: 8063517 - DNA, 22 bp, Homo sapiens
ctgtgtctcgttaaagcattgg

SEQ ID NO: 8063518 - DNA, 22 bp, Homo sapiens
ctgttacaagagagagacatga

SEQ ID NO: 8063519 - DNA, 22 bp, Homo sapiens
ctgtgtcttctgcttacagtct

SEQ ID NO: 8063520 - DNA, 22 bp, Homo sapiens
ctgtgtcttcaatgtactggga

SEQ ID NO: 8063521 - DNA, 22 bp, Homo sapiens
ctgtgccaggcccgggtgggtg

SEQ ID NO: 8063522 - DNA, 22 bp, Homo sapiens
ctgtgccagggtctattccaga

SEQ ID NO: 8063523 - DNA, 22 bp, Homo sapiens
ctgtgccaggcccagctgactt

SEQ ID NO: 8063524 - DNA, 22 bp, Homo sapiens
ctgtgccatccgcttgacctgg

SEQ ID NO: 8063525 - DNA, 22 bp, Homo sapiens
ctgtgccagtgtattcctgtga

SEQ ID NO: 8063526 - DNA, 22 bp, Homo sapiens
ctgtgccatcctagggctgctg

SEQ ID NO: 8063527 - DNA, 22 bp, Homo sapiens
ctgtgccatctgcactctcgtc

SEQ ID NO: 8063528 - DNA, 22 bp, Homo sapiens
ctgtgccatctttttgctacct

SEQ ID NO: 8063529 - DNA, 22 bp, Homo sapiens
ctgtgccattctttgtagcatg

SEQ ID NO: 8063530 - DNA, 22 bp, Homo sapiens
ctgtgccacctgagggactcta

SEQ ID NO: 8063531 - DNA, 22 bp, Homo sapiens
ctgtgccacaaactcgcgaaaa

SEQ ID NO: 8063532 - DNA, 22 bp, Homo sapiens
ctgtgcattgtcttgtctgtag

SEQ ID NO: 8063533 - DNA, 22 bp, Homo sapiens
ctgtgccactgccctgccacgc

SEQ ID NO: 8063534 - DNA, 22 bp, Homo sapiens
ctgtgccactgccccaggcctc

SEQ ID NO: 8063535 - DNA, 22 bp, Homo sapiens
ctgtgccactgggggccggcaa

SEQ ID NO: 8063536 - DNA, 21 bp, Homo sapiens
ctgtgccagcagaagaaagct

SEQ ID NO: 8063537 - DNA, 22 bp, Homo sapiens
ctgtgccagagggtgaccaagg

SEQ ID NO: 8063538 - DNA, 22 bp, Homo sapiens
ctgtgccagcctgtcccaggag

SEQ ID NO: 8063539 - DNA, 22 bp, Homo sapiens
ctgggtgaatttgaaggaaagg

SEQ ID NO: 8063540 - DNA, 22 bp, Homo sapiens
ctgggtgagctggccagagggt

SEQ ID NO: 8063541 - DNA, 22 bp, Homo sapiens
ctgggtgagctggccagagggt

SEQ ID NO: 8063542 - DNA, 22 bp, Homo sapiens
ctgggtgacagagtgagatggt

SEQ ID NO: 8063543 - DNA, 22 bp, Homo sapiens
ctgtccctgagcaactcctgtt

SEQ ID NO: 8063544 - DNA, 22 bp, Homo sapiens
ctgtcctggagggcataggacg

SEQ ID NO: 8063545 - DNA, 22 bp, Homo sapiens
ctgtcctggggaaagccagccc

SEQ ID NO: 8063546 - DNA, 22 bp, Homo sapiens
ctgtcctgcagttgggggcagg

SEQ ID NO: 8063547 - DNA, 22 bp, Homo sapiens
ctgtcctgatggtgccactggt

SEQ ID NO: 8063548 - DNA, 22 bp, Homo sapiens
ctgggaggcggagcttgcagtg

SEQ ID NO: 8063549 - DNA, 22 bp, Homo sapiens
ctgggaggcagtctctctagaa

SEQ ID NO: 8063550 - DNA, 22 bp, Homo sapiens
ctgggaggcccacgttgggaag

SEQ ID NO: 8063551 - DNA, 22 bp, Homo sapiens
ctgggaggcactattcaggagg

SEQ ID NO: 8063552 - DNA, 22 bp, Homo sapiens
ctgggaggcagaggttgcagtg

SEQ ID NO: 8063553 - DNA, 22 bp, Homo sapiens
ctgggaggcagaggttgtagtg

SEQ ID NO: 8063554 - DNA, 22 bp, Homo sapiens
ctgggcatgaaaaggatgccag

SEQ ID NO: 8063555 - DNA, 22 bp, Homo sapiens
ctgggcatggacagctgcacag

SEQ ID NO: 8063556 - DNA, 22 bp, Homo sapiens
ctgggcaggagggctctatgga

SEQ ID NO: 8063557 - DNA, 22 bp, Homo sapiens
ctgggcaggagggctctatgga

SEQ ID NO: 8063558 - DNA, 22 bp, Homo sapiens
ctgggcagtttattcagttctg

SEQ ID NO: 8063559 - DNA, 22 bp, Homo sapiens
ctgggcagttttacatcattgc

SEQ ID NO: 8063560 - DNA, 22 bp, Homo sapiens
ctgggcagttttacatcattgc

SEQ ID NO: 8063561 - DNA, 22 bp, Homo sapiens
ctggctttacctcactggggct

SEQ ID NO: 8063562 - DNA, 22 bp, Homo sapiens
ctggctttcattcattcaggcc

SEQ ID NO: 8063563 - DNA, 22 bp, Homo sapiens
ctggctttccttgtctgcatcc

SEQ ID NO: 8063564 - DNA, 22 bp, Homo sapiens
ctggctttgctggactgggagt

SEQ ID NO: 8063565 - DNA, 22 bp, Homo sapiens
ctggctttctatttggtgctat

SEQ ID NO: 8063566 - DNA, 22 bp, Homo sapiens
ctggctttccttgtctgcatcc

SEQ ID NO: 8063567 - DNA, 22 bp, Homo sapiens
ctggctttctctgtggtgttca

SEQ ID NO: 8063568 - DNA, 22 bp, Homo sapiens
ctggctttctgcaaatctccat

SEQ ID NO: 8063569 - DNA, 22 bp, Homo sapiens
ctgggagctagctctgagctga

SEQ ID NO: 8063570 - DNA, 22 bp, Homo sapiens
ctgggagctagctctgagctga

SEQ ID NO: 8063571 - DNA, 22 bp, Homo sapiens
ctgggaggattcattgaggtga

SEQ ID NO: 8063572 - DNA, 22 bp, Homo sapiens
ctgggaggcaccgcgtcgtgct

SEQ ID NO: 8063573 - DNA, 22 bp, Homo sapiens
ctggcttttcctaaactgggaa

SEQ ID NO: 8063574 - DNA, 22 bp, Homo sapiens
ctggctttggtcatgtgatcat

SEQ ID NO: 8063575 - DNA, 22 bp, Homo sapiens
ctggcttttttcccattatgca

SEQ ID NO: 8063576 - DNA, 22 bp, Homo sapiens
ctggcttttggaaacaggctca

SEQ ID NO: 8063577 - DNA, 20 bp, Homo sapiens
ctggggaggaggatgtgttc

SEQ ID NO: 8063578 - DNA, 22 bp, Homo sapiens
ctggggctctctggaatgcttg

SEQ ID NO: 8063579 - DNA, 22 bp, Homo sapiens
ctggggctgcagcgatcttcat

SEQ ID NO: 8063580 - DNA, 22 bp, Homo sapiens
ctggggtgtgctcagagcaggg

SEQ ID NO: 8063581 - DNA, 22 bp, Homo sapiens
ctggggtgtgctcagagcaggg

SEQ ID NO: 8063582 - DNA, 22 bp, Homo sapiens
ctgggccagatccagcctcaca

SEQ ID NO: 8063583 - DNA, 22 bp, Homo sapiens
ctgggctgcagttcctggtcct

SEQ ID NO: 8063584 - DNA, 22 bp, Homo sapiens
ctgggctgcagcgggagcgacg

SEQ ID NO: 8063585 - DNA, 20 bp, Homo sapiens
ctgggctgcccagctatggg

SEQ ID NO: 8063586 - DNA, 20 bp, Homo sapiens
ctgggctgcccagctatggg

SEQ ID NO: 8063587 - DNA, 22 bp, Homo sapiens
ctgggctgcgggcgcccctcca

SEQ ID NO: 8063588 - DNA, 22 bp, Homo sapiens
ctggcaggaagaggaaaggtca

SEQ ID NO: 8063589 - DNA, 22 bp, Homo sapiens
ctggcagcttcctttgcatctg

SEQ ID NO: 8063590 - DNA, 22 bp, Homo sapiens
ctggcagcttcaggacactcgg

SEQ ID NO: 8063591 - DNA, 22 bp, Homo sapiens
ctggcagcccaacctagagtct

SEQ ID NO: 8063592 - DNA, 22 bp, Homo sapiens
ctggcaggaagaggaaaggtca

SEQ ID NO: 8063593 - DNA, 22 bp, Homo sapiens
ctggcaggaagttagatggtaa

SEQ ID NO: 8063594 - DNA, 22 bp, Homo sapiens
ctggcagccaagtgggatactc

SEQ ID NO: 8063595 - DNA, 22 bp, Homo sapiens
ctggcagccaagtgggatactc

SEQ ID NO: 8063596 - DNA, 22 bp, Homo sapiens
ctgccagctcgccacaatgaca

SEQ ID NO: 8063597 - DNA, 22 bp, Homo sapiens
ctgccagcaatgtgaccatgct

SEQ ID NO: 8063598 - DNA, 22 bp, Homo sapiens
ctgccagcactgcctcctgagg

SEQ ID NO: 8063599 - DNA, 22 bp, Homo sapiens
ctgccagccaggccaggtaggc

SEQ ID NO: 8063600 - DNA, 22 bp, Homo sapiens
ctgccagcagaggccagcgctg

SEQ ID NO: 8063601 - DNA, 22 bp, Homo sapiens
ctgccacaggggagcaggcaga

SEQ ID NO: 8063602 - DNA, 22 bp, Homo sapiens
ctgcatccatgttgctgcaaag

SEQ ID NO: 8063603 - DNA, 22 bp, Homo sapiens
ctgcatccatgttgctgcaaag

SEQ ID NO: 8063604 - DNA, 22 bp, Homo sapiens
ctgcatccatgttgctgcaaag

SEQ ID NO: 8063605 - DNA, 22 bp, Homo sapiens
ctggcaggcactcatgaaataa

SEQ ID NO: 8063606 - DNA, 22 bp, Homo sapiens
ctggcaggagcattcacagagg

SEQ ID NO: 8063607 - DNA, 20 bp, Homo sapiens
ctggcaggagcgagtctacc

SEQ ID NO: 8063608 - DNA, 22 bp, Homo sapiens
ctggcaggcggcagagcccagg

SEQ ID NO: 8063609 - DNA, 22 bp, Homo sapiens
ctggcaggcagacttctgcaag

SEQ ID NO: 8063610 - DNA, 22 bp, Homo sapiens
ctggcctggtctggcctctcca

SEQ ID NO: 8063611 - DNA, 22 bp, Homo sapiens
ctggctgccacttcagggtctt

SEQ ID NO: 8063612 - DNA, 22 bp, Homo sapiens
ctggctgcgtctgctctgacag

SEQ ID NO: 8063613 - DNA, 22 bp, Homo sapiens
ctggctgctggcctgaggatgc

SEQ ID NO: 8063614 - DNA, 22 bp, Homo sapiens
ctggctgcttgtagactcgact

SEQ ID NO: 8063615 - DNA, 22 bp, Homo sapiens
ctggctgcaggatgaggctgcc

SEQ ID NO: 8063616 - DNA, 22 bp, Homo sapiens
ctggctgcaggaaggagtgggc

SEQ ID NO: 8063617 - DNA, 22 bp, Homo sapiens
ttccaggagccacacaggggcg

SEQ ID NO: 8063618 - DNA, 22 bp, Homo sapiens
ttccaggactcgttctggctca

SEQ ID NO: 8063619 - DNA, 22 bp, Homo sapiens
ttccaggacaagatgtttcagg

SEQ ID NO: 8063620 - DNA, 22 bp, Homo sapiens
ttccaggaccaggaagagggga

SEQ ID NO: 8063621 - DNA, 22 bp, Homo sapiens
ctaaatgacttccagtggttat

SEQ ID NO: 8063622 - DNA, 22 bp, Homo sapiens
ctaaatgacttccagtggttat

SEQ ID NO: 8063623 - DNA, 22 bp, Homo sapiens
ctagaaaaatactttattgtga

SEQ ID NO: 8063624 - DNA, 22 bp, Homo sapiens
ctacttctgtgatgaaactaca

SEQ ID NO: 8063625 - DNA, 22 bp, Homo sapiens
ctacccaggctggagtgcagta

SEQ ID NO: 8063626 - DNA, 22 bp, Homo sapiens
ctacatttcatccagggagagc

SEQ ID NO: 8063627 - DNA, 22 bp, Homo sapiens
ctcacagagctcatactgggag

SEQ ID NO: 8063628 - DNA, 22 bp, Homo sapiens
ctcacagatgctgtgggtcagg

SEQ ID NO: 8063629 - DNA, 21 bp, Homo sapiens
ctcacaggatgcagtgttact

SEQ ID NO: 8063630 - DNA, 22 bp, Homo sapiens
ctcacaggcatctcatcaggct

SEQ ID NO: 8063631 - DNA, 22 bp, Homo sapiens
ctcacaggtaccagcaccctcc

SEQ ID NO: 8063632 - DNA, 22 bp, Homo sapiens
ctcacaggagaaagtcatggtc

SEQ ID NO: 8063633 - DNA, 22 bp, Homo sapiens
ctattatttcctcatctataaa

SEQ ID NO: 8063634 - DNA, 22 bp, Homo sapiens
cggtctcccgtgtgtgtgcgct

SEQ ID NO: 8063635 - DNA, 22 bp, Homo sapiens
ctaaacttttataacattgaga

SEQ ID NO: 8063636 - DNA, 22 bp, Homo sapiens
ctaaataatccctctggtctta

SEQ ID NO: 8063637 - DNA, 22 bp, Homo sapiens
ctaaagcaactgagacacatag

SEQ ID NO: 8063638 - DNA, 22 bp, Homo sapiens
ttcacagaattgtcttgactgg

SEQ ID NO: 8063639 - DNA, 22 bp, Homo sapiens
ttcagaaagtgaatcttgttat

SEQ ID NO: 8063640 - DNA, 22 bp, Homo sapiens
ttcagatgtggctttgtcaggc

SEQ ID NO: 8063641 - DNA, 22 bp, Homo sapiens
ttcagatgtggctttgtcaggc

SEQ ID NO: 8063642 - DNA, 22 bp, Homo sapiens
cggggctgtagcacagctgagc

SEQ ID NO: 8063643 - DNA, 22 bp, Homo sapiens
cgcatccagggcgcaggatctg

SEQ ID NO: 8063644 - DNA, 22 bp, Homo sapiens
cgccaggcttggtagctcatgc

SEQ ID NO: 8063645 - DNA, 22 bp, Homo sapiens
cctttcagatgggcatggaccg

SEQ ID NO: 8063646 - DNA, 22 bp, Homo sapiens
cctttcccgctttgagggcaag

SEQ ID NO: 8063647 - DNA, 22 bp, Homo sapiens
cctttcctttttagtgtgggag

SEQ ID NO: 8063648 - DNA, 22 bp, Homo sapiens
ttcacacagaatctgaggagct

SEQ ID NO: 8063649 - DNA, 21 bp, Homo sapiens
ttcaatactatttcaatagtc

SEQ ID NO: 8063650 - DNA, 22 bp, Homo sapiens
ttcaatacaaagaaaggaattt

SEQ ID NO: 8063651 - DNA, 22 bp, Homo sapiens
ttcaataggatgcatgatataa

SEQ ID NO: 8063652 - DNA, 23 bp, Homo sapiens
tggggccaagtgaggaagggtct

SEQ ID NO: 8063653 - DNA, 22 bp, Homo sapiens
tggggctgtccttagtctgaga

SEQ ID NO: 8063654 - DNA, 22 bp, Homo sapiens
tggggctgtgagactacaggat

SEQ ID NO: 8063655 - DNA, 22 bp, Homo sapiens
tggggctgtggattctcacgaa

SEQ ID NO: 8063656 - DNA, 22 bp, Homo sapiens
tgggggactgcactggcgtcag

SEQ ID NO: 8063657 - DNA, 21 bp, Homo sapiens
tgggggagaattggttgcttt

SEQ ID NO: 8063658 - DNA, 22 bp, Homo sapiens
tgggggacaccagtctctctct

SEQ ID NO: 8063659 - DNA, 22 bp, Homo sapiens
cctgggagtgtcagacttgctt

SEQ ID NO: 8063660 - DNA, 22 bp, Homo sapiens
cctgggagtgtgccatctctgt

SEQ ID NO: 8063661 - DNA, 22 bp, Homo sapiens
cctgggagtggcactcacagca

SEQ ID NO: 8063662 - DNA, 22 bp, Homo sapiens
cctgggcaacatagtgagacct

SEQ ID NO: 8063663 - DNA, 22 bp, Homo sapiens
cctgggcaacatagtgagaccc

SEQ ID NO: 8063664 - DNA, 22 bp, Homo sapiens
cctgggcaaatgccagagacaa

SEQ ID NO: 8063665 - DNA, 22 bp, Homo sapiens
tgtgtattaatgtttgtatatg

SEQ ID NO: 8063666 - DNA, 22 bp, Homo sapiens
cctggtggacagcagccagcag

SEQ ID NO: 8063667 - DNA, 22 bp, Homo sapiens
cctggtttaatgctcactgttg

SEQ ID NO: 8063668 - DNA, 22 bp, Homo sapiens
cctggtttatgccagatcctgt

SEQ ID NO: 8063669 - DNA, 21 bp, Homo sapiens
cctggttggcgtagctcagtc

SEQ ID NO: 8063670 - DNA, 22 bp, Homo sapiens
cctggtttcaggaacataatct

SEQ ID NO: 8063671 - DNA, 22 bp, Homo sapiens
cctggtttctccatgtctcatt

SEQ ID NO: 8063672 - DNA, 22 bp, Homo sapiens
cctggtttgggtgccagtgagt

SEQ ID NO: 8063673 - DNA, 23 bp, Homo sapiens
tgttccagatacgccttttcctc

SEQ ID NO: 8063674 - DNA, 23 bp, Homo sapiens
tgttccagatacgccttttcctc

SEQ ID NO: 8063675 - DNA, 22 bp, Homo sapiens
tgttcatttggcccttttgtat

SEQ ID NO: 8063676 - DNA, 22 bp, Homo sapiens
tgttcattctgtgacctggttc

SEQ ID NO: 8063677 - DNA, 22 bp, Homo sapiens
tgttcattgccccctgtgtaaa

SEQ ID NO: 8063678 - DNA, 22 bp, Homo sapiens
tgttcattagtggaagtaagtt

SEQ ID NO: 8063679 - DNA, 22 bp, Homo sapiens
tgttcattccggggagggctaa

SEQ ID NO: 8063680 - DNA, 22 bp, Homo sapiens
tgttcattcgctattgtctatg

SEQ ID NO: 8063681 - DNA, 22 bp, Homo sapiens
tgttcattaaactactgtgtgg

SEQ ID NO: 8063682 - DNA, 22 bp, Homo sapiens
tgttcagccctctattaatcag

SEQ ID NO: 8063683 - DNA, 22 bp, Homo sapiens
tgtgtctgcccttagtacatct

SEQ ID NO: 8063684 - DNA, 22 bp, Homo sapiens
tgtgttctcctacagataagga

SEQ ID NO: 8063685 - DNA, 22 bp, Homo sapiens
tgttacaaggaagaatgtaggt

SEQ ID NO: 8063686 - DNA, 22 bp, Homo sapiens
cctgtggttacgcctgtttcca

SEQ ID NO: 8063687 - DNA, 22 bp, Homo sapiens
cctgtggtttacgtacagctcc

SEQ ID NO: 8063688 - DNA, 22 bp, Homo sapiens
cctgtgtcagcccctgcctcca

SEQ ID NO: 8063689 - DNA, 22 bp, Homo sapiens
ttaaagtccctgccttaattcc

SEQ ID NO: 8063690 - DNA, 23 bp, Homo sapiens
ttaaaggcagatgttgagtatta

SEQ ID NO: 8063691 - DNA, 22 bp, Homo sapiens
ttaaagctggcgttacagtttg

SEQ ID NO: 8063692 - DNA, 22 bp, Homo sapiens
ttaaagctgtagagttacttgc

SEQ ID NO: 8063693 - DNA, 22 bp, Homo sapiens
ttaaagctggcgttacagtttg

SEQ ID NO: 8063694 - DNA, 22 bp, Homo sapiens
cctgtctgtatcggttcagagt

SEQ ID NO: 8063695 - DNA, 22 bp, Homo sapiens
cctgtctgtattggtttgctat

SEQ ID NO: 8063696 - DNA, 22 bp, Homo sapiens
cctgtctgtcctctcatgagcc

SEQ ID NO: 8063697 - DNA, 22 bp, Homo sapiens
cctgtctggaacatggcctgtt

SEQ ID NO: 8063698 - DNA, 20 bp, Homo sapiens
cctgtctggagacaaagaga

SEQ ID NO: 8063699 - DNA, 22 bp, Homo sapiens
cctgtctggccaccagggcgat

SEQ ID NO: 8063700 - DNA, 22 bp, Homo sapiens
cctgtctggccttccacggggg

SEQ ID NO: 8063701 - DNA, 23 bp, Homo sapiens
cctgtctgtgctgggtggacaca

SEQ ID NO: 8063702 - DNA, 19 bp, Homo sapiens
cctgtctgtcttcagctag

SEQ ID NO: 8063703 - DNA, 22 bp, Homo sapiens
cctgtctgcatgatccctgcca

SEQ ID NO: 8063704 - DNA, 22 bp, Homo sapiens
cctgtctgcggaggagtggaag

SEQ ID NO: 8063705 - DNA, 22 bp, Homo sapiens
cctgtctgcatgagtgagcata

SEQ ID NO: 8063706 - DNA, 22 bp, Homo sapiens
cctgtctgcagatatctcaggt

SEQ ID NO: 8063707 - DNA, 22 bp, Homo sapiens
cctgtctgaggaggtgctcttt

SEQ ID NO: 8063708 - DNA, 20 bp, Homo sapiens
cctgtctgcaatggaggtca

SEQ ID NO: 8063709 - DNA, 22 bp, Homo sapiens
cctgtctgagccagggtgggca

SEQ ID NO: 8063710 - DNA, 22 bp, Homo sapiens
cctgtctgaaggcagggggatg

SEQ ID NO: 8063711 - DNA, 22 bp, Homo sapiens
tgtttataaattttcttgccat

SEQ ID NO: 8063712 - DNA, 22 bp, Homo sapiens
ttagaagtgggcctatagtcct

SEQ ID NO: 8063713 - DNA, 22 bp, Homo sapiens
ttagaaaacataagtggtaaag

SEQ ID NO: 8063714 - DNA, 22 bp, Homo sapiens
ttagaaaaatgttcagtagttt

SEQ ID NO: 8063715 - DNA, 22 bp, Homo sapiens
ttagaaaaaggctgtggtctta

SEQ ID NO: 8063716 - DNA, 22 bp, Homo sapiens
ttagaaaatggaggtgggaggg

SEQ ID NO: 8063717 - DNA, 22 bp, Homo sapiens
ttagaaaaaacgtcttctagtg

SEQ ID NO: 8063718 - DNA, 22 bp, Homo sapiens
ttagaaaaaacgtcttctagtg

SEQ ID NO: 8063719 - DNA, 22 bp, Homo sapiens
ttactaagagaagtaaatattt

SEQ ID NO: 8063720 - DNA, 22 bp, Homo sapiens
cctgtgtcttccccactggtgt

SEQ ID NO: 8063721 - DNA, 20 bp, Homo sapiens
cctgtgtggccagctgaggc

SEQ ID NO: 8063722 - DNA, 22 bp, Homo sapiens
cctgtgtggccaggctggagtc

SEQ ID NO: 8063723 - DNA, 18 bp, Homo sapiens
ccttcagctctggttttc

SEQ ID NO: 8063724 - DNA, 22 bp, Homo sapiens
ccttcccatgcagcctgtctga

SEQ ID NO: 8063725 - DNA, 22 bp, Homo sapiens
ccttcctggctgtccgcctgat

SEQ ID NO: 8063726 - DNA, 19 bp, Homo sapiens
ccttcctccccagggccat

SEQ ID NO: 8063727 - DNA, 22 bp, Homo sapiens
ccttcctggagcccatgcagat

SEQ ID NO: 8063728 - DNA, 22 bp, Homo sapiens
ctgaccatcatggtgaaacccc

SEQ ID NO: 8063729 - DNA, 17 bp, Homo sapiens
ctctttataaagagtta

SEQ ID NO: 8063730 - DNA, 21 bp, Homo sapiens
ctctttatatagtaaagatat

SEQ ID NO: 8063731 - DNA, 22 bp, Homo sapiens
ctctttcagttctgatagtctc

SEQ ID NO: 8063732 - DNA, 22 bp, Homo sapiens
ctctttccagggtaccccaggt

SEQ ID NO: 8063733 - DNA, 22 bp, Homo sapiens
ctctttcctcagccacagtcta

SEQ ID NO: 8063734 - DNA, 22 bp, Homo sapiens
ctgagccatgagcctgcgccca

SEQ ID NO: 8063735 - DNA, 20 bp, Homo sapiens
ctgagcccccagcctgcagg

SEQ ID NO: 8063736 - DNA, 22 bp, Homo sapiens
ctgcagggcagggcctcctggc

SEQ ID NO: 8063737 - DNA, 22 bp, Homo sapiens
ctgcactgaagaaaggagctct

SEQ ID NO: 8063738 - DNA, 22 bp, Homo sapiens
ctgcactgagaccctctttgct

SEQ ID NO: 8063739 - DNA, 22 bp, Homo sapiens
ctcttcagataaaagggatatt

SEQ ID NO: 8063740 - DNA, 22 bp, Homo sapiens
ctcttcagcctatttgagtgca

SEQ ID NO: 8063741 - DNA, 22 bp, Homo sapiens
ttttaagatgctagtatttcag

SEQ ID NO: 8063742 - DNA, 22 bp, Homo sapiens
ttttaagttaatataattgagg

SEQ ID NO: 8063743 - DNA, 22 bp, Homo sapiens
tttgctctctcaggctcctggg

SEQ ID NO: 8063744 - DNA, 22 bp, Homo sapiens
ctctgctttcctcttacacact

SEQ ID NO: 8063745 - DNA, 22 bp, Homo sapiens
ctctggaaaaccactagcagga

SEQ ID NO: 8063746 - DNA, 19 bp, Homo sapiens
tttgccttgcagctgtgtg

SEQ ID NO: 8063747 - DNA, 22 bp, Homo sapiens
tttgctaaaaggccattgattt

SEQ ID NO: 8063748 - DNA, 22 bp, Homo sapiens
tttgctattgtgaatagtgcca

SEQ ID NO: 8063749 - DNA, 22 bp, Homo sapiens
tttgccagtattttattgatga

SEQ ID NO: 8063750 - DNA, 22 bp, Homo sapiens
tttgccaggtaagtactatgct

SEQ ID NO: 8063751 - DNA, 22 bp, Homo sapiens
tttgggaatctttgtgcatgac

SEQ ID NO: 8063752 - DNA, 22 bp, Homo sapiens
ctctggaattaaggaagcctgt

SEQ ID NO: 8063753 - DNA, 22 bp, Homo sapiens
ctctggaatgtttacatgccct

SEQ ID NO: 8063754 - DNA, 22 bp, Homo sapiens
ctctgcccacgtcttgcccaga

SEQ ID NO: 8063755 - DNA, 22 bp, Homo sapiens
ctctgccctcgcacatctgcca

SEQ ID NO: 8063756 - DNA, 22 bp, Homo sapiens
ctctgccctcgcacatctgcca

SEQ ID NO: 8063757 - DNA, 19 bp, Homo sapiens
ctctgcctccctcctgggt

SEQ ID NO: 8063758 - DNA, 22 bp, Homo sapiens
tttgcaaataaataagtgctcg

SEQ ID NO: 8063759 - DNA, 22 bp, Homo sapiens
ctctgcccgcggatgccacgtc

SEQ ID NO: 8063760 - DNA, 22 bp, Homo sapiens
ctctgcccgcggatgccacgtc

SEQ ID NO: 8063761 - DNA, 22 bp, Homo sapiens
ctccaccacacatctgtccacc

SEQ ID NO: 8063762 - DNA, 22 bp, Homo sapiens
ctccagcagaaagggcgagtgg

SEQ ID NO: 8063763 - DNA, 22 bp, Homo sapiens
ctccagatgtatactttccaag

SEQ ID NO: 8063764 - DNA, 22 bp, Homo sapiens
ttgtacaacgttttaaatttga

SEQ ID NO: 8063765 - DNA, 22 bp, Homo sapiens
ctcatttactactcatgtgacc

SEQ ID NO: 8063766 - DNA, 22 bp, Homo sapiens
ctcatttactgtagaacagtta

SEQ ID NO: 8063767 - DNA, 22 bp, Homo sapiens
ctcatttacctttgcaatcaag

SEQ ID NO: 8063768 - DNA, 22 bp, Homo sapiens
ctcatttacactatgggaacta

SEQ ID NO: 8063769 - DNA, 22 bp, Homo sapiens
ctcatttaacagattaaaaagt

SEQ ID NO: 8063770 - DNA, 21 bp, Homo sapiens
ctcatttatttttgtgtccaa

SEQ ID NO: 8063771 - DNA, 22 bp, Homo sapiens
ctcatttatccaaaagccagtt

SEQ ID NO: 8063772 - DNA, 22 bp, Homo sapiens
ttgtctttggaaatttaatgtt

SEQ ID NO: 8063773 - DNA, 22 bp, Homo sapiens
ttgtctgtcccagcttgtgcat

SEQ ID NO: 8063774 - DNA, 22 bp, Homo sapiens
ttgtctgtgaaatggaaatagt

SEQ ID NO: 8063775 - DNA, 23 bp, Homo sapiens
ttgtctgtgcttttccagttgct

SEQ ID NO: 8063776 - DNA, 22 bp, Homo sapiens
ctccagcctcagatgacggtac

SEQ ID NO: 8063777 - DNA, 22 bp, Homo sapiens
ttgtctgtccaggcaccccaag

SEQ ID NO: 8063778 - DNA, 23 bp, Homo sapiens
ttgtgggcagattccatggggag

SEQ ID NO: 8063779 - DNA, 22 bp, Homo sapiens
ctcccagagaccaagctgagaa

SEQ ID NO: 8063780 - DNA, 22 bp, Homo sapiens
ctcccagccttcgccagtctga

SEQ ID NO: 8063781 - DNA, 22 bp, Homo sapiens
ctcccactcctggctcaccaca

SEQ ID NO: 8063782 - DNA, 22 bp, Homo sapiens
ctcccaagctgtgctgaactgt

SEQ ID NO: 8063783 - DNA, 22 bp, Homo sapiens
ctcccaaggggtaagggagctg

SEQ ID NO: 8063784 - DNA, 22 bp, Homo sapiens
ctccattgaacatcctctcaga

SEQ ID NO: 8063785 - DNA, 22 bp, Homo sapiens
ctcccaggcacagggaggagcc

SEQ ID NO: 8063786 - DNA, 22 bp, Homo sapiens
tttaatactatggggatgaaca

SEQ ID NO: 8063787 - DNA, 22 bp, Homo sapiens
tttaatacagaacttgtcaggg

SEQ ID NO: 8063788 - DNA, 22 bp, Homo sapiens
tttaatagggcccaatgagact

SEQ ID NO: 8063789 - DNA, 22 bp, Homo sapiens
tttagtatataaaaagagaagt

SEQ ID NO: 8063790 - DNA, 22 bp, Homo sapiens
tttagtatgtatttaatggact

SEQ ID NO: 8063791 - DNA, 20 bp, Homo sapiens
ctcccctctacagagggctg

SEQ ID NO: 8063792 - DNA, 23 bp, Homo sapiens
ctccccagtgtcctcatgcatct

SEQ ID NO: 8063793 - DNA, 22 bp, Homo sapiens
ctcctccagtgggtccctcagg

SEQ ID NO: 8063794 - DNA, 22 bp, Homo sapiens
tttattccatgtgtctatgacc

SEQ ID NO: 8063795 - DNA, 22 bp, Homo sapiens
tttcacataaatattatgccta

SEQ ID NO: 8063796 - DNA, 22 bp, Homo sapiens
tttcacagttagcatgaggact

SEQ ID NO: 8063797 - DNA, 22 bp, Homo sapiens
tttccagagcatgtctgctcag

SEQ ID NO: 8063798 - DNA, 22 bp, Homo sapiens
tttcacaaactgaggagacaat

SEQ ID NO: 8063799 - DNA, 22 bp, Homo sapiens
ctctctgaggaaggagcatctg

SEQ ID NO: 8063800 - DNA, 22 bp, Homo sapiens
ctctctggaagggggagctgat

SEQ ID NO: 8063801 - DNA, 22 bp, Homo sapiens
ctctctgaggcaggcctgtggg

SEQ ID NO: 8063802 - DNA, 22 bp, Homo sapiens
ctctctgagtgagggacaagct

SEQ ID NO: 8063803 - DNA, 22 bp, Homo sapiens
tccctgggtcctgcttgctctc

SEQ ID NO: 8063804 - DNA, 22 bp, Homo sapiens
tccctggaacagagagacaacg

SEQ ID NO: 8063805 - DNA, 22 bp, Homo sapiens
catttattgagtggccacagtg

SEQ ID NO: 8063806 - DNA, 22 bp, Homo sapiens
tccctctccctattgcctggag

SEQ ID NO: 8063807 - DNA, 22 bp, Homo sapiens
tcccactcccaggcaggcctct

SEQ ID NO: 8063808 - DNA, 22 bp, Homo sapiens
tcccactcccaggcaggcctct

SEQ ID NO: 8063809 - DNA, 22 bp, Homo sapiens
catttaatccatagaggaatgt

SEQ ID NO: 8063810 - DNA, 22 bp, Homo sapiens
cattctgagatatgggctgaag

SEQ ID NO: 8063811 - DNA, 22 bp, Homo sapiens
cattctgcatttggaaggggca

SEQ ID NO: 8063812 - DNA, 22 bp, Homo sapiens
cattctgcgatcctcaagcaca

SEQ ID NO: 8063813 - DNA, 22 bp, Homo sapiens
tcccacatgtgaatcctcaggt

SEQ ID NO: 8063814 - DNA, 22 bp, Homo sapiens
catgggaggtctgcaaggtgct

SEQ ID NO: 8063815 - DNA, 22 bp, Homo sapiens
catgggaggttggcttggcatg

SEQ ID NO: 8063816 - DNA, 23 bp, Homo sapiens
catgggagtgagaatgccagctc

SEQ ID NO: 8063817 - DNA, 22 bp, Homo sapiens
catgggaggttggcttggcatg

SEQ ID NO: 8063818 - DNA, 22 bp, Homo sapiens
tccaggagaggtgtggggactg

SEQ ID NO: 8063819 - DNA, 22 bp, Homo sapiens
tccaggagaggcctgaccaggt

SEQ ID NO: 8063820 - DNA, 22 bp, Homo sapiens
tccatttagctggcaaacaatg

SEQ ID NO: 8063821 - DNA, 22 bp, Homo sapiens
catgggcagttggcagggctca

SEQ ID NO: 8063822 - DNA, 22 bp, Homo sapiens
ccagagacaaggagctggagtc

SEQ ID NO: 8063823 - DNA, 22 bp, Homo sapiens
ccagagaccagaacatggggat

SEQ ID NO: 8063824 - DNA, 22 bp, Homo sapiens
ccactgtcagaggggctgtgcc

SEQ ID NO: 8063825 - DNA, 22 bp, Homo sapiens
ccactgtcttttccaggctgaa

SEQ ID NO: 8063826 - DNA, 22 bp, Homo sapiens
tccttgtaaaggagctctaaca

SEQ ID NO: 8063827 - DNA, 22 bp, Homo sapiens
tcctttaaactcctttcaagtc

SEQ ID NO: 8063828 - DNA, 22 bp, Homo sapiens
tccttcctgcaggccaagtcct

SEQ ID NO: 8063829 - DNA, 22 bp, Homo sapiens
tccttcagttaaagatctcaca

SEQ ID NO: 8063830 - DNA, 22 bp, Homo sapiens
tccttcagttatcacagtactg

SEQ ID NO: 8063831 - DNA, 22 bp, Homo sapiens
tccttcagttatcacagtactg

SEQ ID NO: 8063832 - DNA, 21 bp, Homo sapiens
tccttcagttctgcactttct

SEQ ID NO: 8063833 - DNA, 21 bp, Homo sapiens
tccttcagttctgcactttct

SEQ ID NO: 8063834 - DNA, 22 bp, Homo sapiens
tccttcagttcaattagtccgt

SEQ ID NO: 8063835 - DNA, 22 bp, Homo sapiens
tccttcagttcaattagtccgt

SEQ ID NO: 8063836 - DNA, 22 bp, Homo sapiens
tccttcagtgtcccgctcaggt

SEQ ID NO: 8063837 - DNA, 22 bp, Homo sapiens
tccttcagttaaagatctcaca

SEQ ID NO: 8063838 - DNA, 22 bp, Homo sapiens
tccttcagtgtcccgctcaggt

SEQ ID NO: 8063839 - DNA, 17 bp, Homo sapiens
tccttcagtgcctctgc

SEQ ID NO: 8063840 - DNA, 17 bp, Homo sapiens
tccttcagtgcctctgc

SEQ ID NO: 8063841 - DNA, 22 bp, Homo sapiens
tccttcagtcttctgagccata

SEQ ID NO: 8063842 - DNA, 22 bp, Homo sapiens
tccttcagtcttctgagccata

SEQ ID NO: 8063843 - DNA, 21 bp, Homo sapiens
tccttcagtctagatgattgt

SEQ ID NO: 8063844 - DNA, 22 bp, Homo sapiens
ccaaggctggagtgcagtggcg

SEQ ID NO: 8063845 - DNA, 22 bp, Homo sapiens
ccaaggcttcccagagatgctc

SEQ ID NO: 8063846 - DNA, 22 bp, Homo sapiens
ccaaggagtagagcaggaagct

SEQ ID NO: 8063847 - DNA, 22 bp, Homo sapiens
ccaaggaggccccaggtcagct

SEQ ID NO: 8063848 - DNA, 22 bp, Homo sapiens
ccaaggcaacgttggtgtcagg

SEQ ID NO: 8063849 - DNA, 22 bp, Homo sapiens
tcctagaaagatgtcttttcac

SEQ ID NO: 8063850 - DNA, 22 bp, Homo sapiens
ccaaggagaatgacaccatgga

SEQ ID NO: 8063851 - DNA, 22 bp, Homo sapiens
ccaaggagcaaggctcaacaag

SEQ ID NO: 8063852 - DNA, 22 bp, Homo sapiens
tcctgggagagtgggactgtat

SEQ ID NO: 8063853 - DNA, 22 bp, Homo sapiens
tcagagcaaattcctgtgagcc

SEQ ID NO: 8063854 - DNA, 22 bp, Homo sapiens
tcagagatgcagtgccacctac

SEQ ID NO: 8063855 - DNA, 22 bp, Homo sapiens
tcaatgaaagagcatgcatttt

SEQ ID NO: 8063856 - DNA, 22 bp, Homo sapiens
cagttcttatttggccagtgtc

SEQ ID NO: 8063857 - DNA, 22 bp, Homo sapiens
tcagatgagtgctttcagctgc

SEQ ID NO: 8063858 - DNA, 22 bp, Homo sapiens
cagtttttcaaaattacatgat

SEQ ID NO: 8063859 - DNA, 22 bp, Homo sapiens
cagtttttgccattaagagtaa

SEQ ID NO: 8063860 - DNA, 23 bp, Homo sapiens
cataaaatattagtatggtagca

SEQ ID NO: 8063861 - DNA, 23 bp, Homo sapiens
cataaaatattagtatggtagca

SEQ ID NO: 8063862 - DNA, 22 bp, Homo sapiens
tcagaggagccaaagttctgag

SEQ ID NO: 8063863 - DNA, 23 bp, Homo sapiens
tcagagcaagatgatgtatgagc

SEQ ID NO: 8063864 - DNA, 17 bp, Homo sapiens
tcaggctgtgcctggta

SEQ ID NO: 8063865 - DNA, 22 bp, Homo sapiens
tcaggctgtgggcactggccat

SEQ ID NO: 8063866 - DNA, 22 bp, Homo sapiens
catagaaacttgcagcaagcac

SEQ ID NO: 8063867 - DNA, 22 bp, Homo sapiens
catagaaactgagacaaggatt

SEQ ID NO: 8063868 - DNA, 22 bp, Homo sapiens
tcaggcagagtggaagctgcaa

SEQ ID NO: 8063869 - DNA, 22 bp, Homo sapiens
cataattactgatatgctgatt

SEQ ID NO: 8063870 - DNA, 22 bp, Homo sapiens
cataatatctccgattacttgc

SEQ ID NO: 8063871 - DNA, 22 bp, Homo sapiens
cataatcagatgtgtacataag

SEQ ID NO: 8063872 - DNA, 22 bp, Homo sapiens
cataacatccttgctactttga

SEQ ID NO: 8063873 - DNA, 22 bp, Homo sapiens
catgaaaataacattgttgtga

SEQ ID NO: 8063874 - DNA, 21 bp, Homo sapiens
catctcagtgggttggtggat

SEQ ID NO: 8063875 - DNA, 22 bp, Homo sapiens
catctgcaggggaagccagttt

SEQ ID NO: 8063876 - DNA, 19 bp, Homo sapiens
catctggatgattctcctg

SEQ ID NO: 8063877 - DNA, 19 bp, Homo sapiens
catctggatgattctcctg

SEQ ID NO: 8063878 - DNA, 22 bp, Homo sapiens
catgcatgccgggctgacagag

SEQ ID NO: 8063879 - DNA, 22 bp, Homo sapiens
catgagaaggggtggagttaga

SEQ ID NO: 8063880 - DNA, 22 bp, Homo sapiens
catgaaggaccatttcacggtc

SEQ ID NO: 8063881 - DNA, 22 bp, Homo sapiens
catgaaggaataattgtttaga

SEQ ID NO: 8063882 - DNA, 22 bp, Homo sapiens
catggcaggtgcagattctgtg

SEQ ID NO: 8063883 - DNA, 22 bp, Homo sapiens
catggcaggtgcagattctgtg

SEQ ID NO: 8063884 - DNA, 22 bp, Homo sapiens
catggcaggaggctgctggcag

SEQ ID NO: 8063885 - DNA, 20 bp, Homo sapiens
tccagctgggaacagctgat

SEQ ID NO: 8063886 - DNA, 22 bp, Homo sapiens
catggcagcaattttcctgact

SEQ ID NO: 8063887 - DNA, 22 bp, Homo sapiens
catggcagagaaggggaactgg

SEQ ID NO: 8063888 - DNA, 22 bp, Homo sapiens
catggaaggcaaaagacacaga

SEQ ID NO: 8063889 - DNA, 22 bp, Homo sapiens
catgcatgtttactacagtgac

SEQ ID NO: 8063890 - DNA, 22 bp, Homo sapiens
taagtcatcacattgcagagat

SEQ ID NO: 8063891 - DNA, 22 bp, Homo sapiens
taagtcataagtcatgatgtta

SEQ ID NO: 8063892 - DNA, 18 bp, Homo sapiens
taagtcattttgccagca

SEQ ID NO: 8063893 - DNA, 22 bp, Homo sapiens
gtgcttcaagttcttaatgttt

SEQ ID NO: 8063894 - DNA, 22 bp, Homo sapiens
gtgcttctcttcacacccaact

SEQ ID NO: 8063895 - DNA, 22 bp, Homo sapiens
caggcagcagaggagtgtggga

SEQ ID NO: 8063896 - DNA, 22 bp, Homo sapiens
caggcagatttgctgccctcca

SEQ ID NO: 8063897 - DNA, 21 bp, Homo sapiens
taataattccactacagagta

SEQ ID NO: 8063898 - DNA, 22 bp, Homo sapiens
caggcaccccaggtgagcactg

SEQ ID NO: 8063899 - DNA, 22 bp, Homo sapiens
caggcaccccaggtgagcactg

SEQ ID NO: 8063900 - DNA, 22 bp, Homo sapiens
caggcagagttagagcaactgg

SEQ ID NO: 8063901 - DNA, 22 bp, Homo sapiens
caggccagggttgagaagagaa

SEQ ID NO: 8063902 - DNA, 22 bp, Homo sapiens
caggccaggtggcaggcaaaac

SEQ ID NO: 8063903 - DNA, 22 bp, Homo sapiens
caggccaggtggcaggcaaaac

SEQ ID NO: 8063904 - DNA, 22 bp, Homo sapiens
caggcattagagaattgtgata

SEQ ID NO: 8063905 - DNA, 22 bp, Homo sapiens
taatgtgaagacataaatcaga

SEQ ID NO: 8063906 - DNA, 22 bp, Homo sapiens
taatgtactgatgggaagtggt

SEQ ID NO: 8063907 - DNA, 22 bp, Homo sapiens
taatgtacctccagatgttgta

SEQ ID NO: 8063908 - DNA, 22 bp, Homo sapiens
taatccaaaactgaatctgtgg

SEQ ID NO: 8063909 - DNA, 22 bp, Homo sapiens
caggcctgatacactgaactct

SEQ ID NO: 8063910 - DNA, 22 bp, Homo sapiens
tacattgctttctaatacatct

SEQ ID NO: 8063911 - DNA, 22 bp, Homo sapiens
caggcctgaccctgagcttcac

SEQ ID NO: 8063912 - DNA, 22 bp, Homo sapiens
caggcctctccttagtctggca

SEQ ID NO: 8063913 - DNA, 18 bp, Homo sapiens
tactttattccccctcca

SEQ ID NO: 8063914 - DNA, 22 bp, Homo sapiens
tacattgtgatgtttcaataca

SEQ ID NO: 8063915 - DNA, 22 bp, Homo sapiens
caggctgccgtgaagcaggcct

SEQ ID NO: 8063916 - DNA, 22 bp, Homo sapiens
caggctgcagtgcagtggctat

SEQ ID NO: 8063917 - DNA, 22 bp, Homo sapiens
caggctgggactgacccctgct

SEQ ID NO: 8063918 - DNA, 22 bp, Homo sapiens
caggctgggaacgccacccgct

SEQ ID NO: 8063919 - DNA, 22 bp, Homo sapiens
caggctggcaatgcgtcaagca

SEQ ID NO: 8063920 - DNA, 22 bp, Homo sapiens
caggctggagttcagtggtgtg

SEQ ID NO: 8063921 - DNA, 22 bp, Homo sapiens
caggctgtctgaatggaggccc

SEQ ID NO: 8063922 - DNA, 22 bp, Homo sapiens
tagaaacaaagacctgggtgct

SEQ ID NO: 8063923 - DNA, 22 bp, Homo sapiens
caggcttggcagggaggctggt

SEQ ID NO: 8063924 - DNA, 22 bp, Homo sapiens
caggcttgggagcagagccact

SEQ ID NO: 8063925 - DNA, 22 bp, Homo sapiens
caggcttgtgtctcagctgcag

SEQ ID NO: 8063926 - DNA, 22 bp, Homo sapiens
cagggacaatggcagagcctga

SEQ ID NO: 8063927 - DNA, 22 bp, Homo sapiens
cagggctgaaatcaaggtgtag

SEQ ID NO: 8063928 - DNA, 22 bp, Homo sapiens
cagggctgagaatttagagaca

SEQ ID NO: 8063929 - DNA, 22 bp, Homo sapiens
cagggctgtaaattagtgctga

SEQ ID NO: 8063930 - DNA, 22 bp, Homo sapiens
cagggctggtttgtcgaagaaa

SEQ ID NO: 8063931 - DNA, 23 bp, Homo sapiens
cagggctggtagggaagagcgtg

SEQ ID NO: 8063932 - DNA, 22 bp, Homo sapiens
cagggggctcaaaggagagtgc

SEQ ID NO: 8063933 - DNA, 22 bp, Homo sapiens
caggggcttaagtgacagaagg

SEQ ID NO: 8063934 - DNA, 22 bp, Homo sapiens
caggggcttttcctctataagg

SEQ ID NO: 8063935 - DNA, 22 bp, Homo sapiens
caggggctgtttgcctcaggcc

SEQ ID NO: 8063936 - DNA, 22 bp, Homo sapiens
cagggctgtggctttgtgctgt

SEQ ID NO: 8063937 - DNA, 22 bp, Homo sapiens
cagggctgtgcccatcttcccc

SEQ ID NO: 8063938 - DNA, 17 bp, Homo sapiens
cagggctgtctgcctag

SEQ ID NO: 8063939 - DNA, 22 bp, Homo sapiens
cagggtccatctttcatcactg

SEQ ID NO: 8063940 - DNA, 22 bp, Homo sapiens
caggggtggctgcagcagaggt

SEQ ID NO: 8063941 - DNA, 22 bp, Homo sapiens
cagggtagacagtaggtgtctg

SEQ ID NO: 8063942 - DNA, 22 bp, Homo sapiens
cagggtacagagttttctaaac

SEQ ID NO: 8063943 - DNA, 22 bp, Homo sapiens
caggggtgtttttggccaggag

SEQ ID NO: 8063944 - DNA, 22 bp, Homo sapiens
tagcttctaatacttaccaatt

SEQ ID NO: 8063945 - DNA, 22 bp, Homo sapiens
tagcttatcccacagtgcccag

SEQ ID NO: 8063946 - DNA, 22 bp, Homo sapiens
tagcttctggagtgtttgaaaa

SEQ ID NO: 8063947 - DNA, 22 bp, Homo sapiens
taggaggcttaaagctgctcag

SEQ ID NO: 8063948 - DNA, 22 bp, Homo sapiens
cagggcctcatcctcagagatt

SEQ ID NO: 8063949 - DNA, 18 bp, Homo sapiens
cagggccccagaattatc

SEQ ID NO: 8063950 - DNA, 22 bp, Homo sapiens
cagggcccaggccactgggttg

SEQ ID NO: 8063951 - DNA, 22 bp, Homo sapiens
cagggcccaagacacaatgagg

SEQ ID NO: 8063952 - DNA, 22 bp, Homo sapiens
taggccagaggagcagctttgg

SEQ ID NO: 8063953 - DNA, 22 bp, Homo sapiens
cagggccatatcttgtgcacca

SEQ ID NO: 8063954 - DNA, 22 bp, Homo sapiens
tagcttaacagcaaaactgttg

SEQ ID NO: 8063955 - DNA, 22 bp, Homo sapiens
cagggccattggcgtggctgtc

SEQ ID NO: 8063956 - DNA, 22 bp, Homo sapiens
cagggccatgaggcacagggtc

SEQ ID NO: 8063957 - DNA, 22 bp, Homo sapiens
cagggccagttctcgcagcagt

SEQ ID NO: 8063958 - DNA, 22 bp, Homo sapiens
cagggagatcttggctcctggt

SEQ ID NO: 8063959 - DNA, 22 bp, Homo sapiens
caggtggcagtgcctgcattct

SEQ ID NO: 8063960 - DNA, 22 bp, Homo sapiens
caggtggatctctaaggactga

SEQ ID NO: 8063961 - DNA, 22 bp, Homo sapiens
caggtggagctgactgagggca

SEQ ID NO: 8063962 - DNA, 22 bp, Homo sapiens
caggtggccttgccatctcctg

SEQ ID NO: 8063963 - DNA, 22 bp, Homo sapiens
caggtggcattgtcccgccagc

SEQ ID NO: 8063964 - DNA, 22 bp, Homo sapiens
caggtggcatgactgcctacaa

SEQ ID NO: 8063965 - DNA, 19 bp, Homo sapiens
caggtggcgctctacaggg

SEQ ID NO: 8063966 - DNA, 23 bp, Homo sapiens
caggtggctccacgaggggtggg

SEQ ID NO: 8063967 - DNA, 22 bp, Homo sapiens
tattagtagcttgaaattggtg

SEQ ID NO: 8063968 - DNA, 22 bp, Homo sapiens
tattaaatgttatttgggttgt

SEQ ID NO: 8063969 - DNA, 22 bp, Homo sapiens
caggtgggtacatcacagagac

SEQ ID NO: 8063970 - DNA, 18 bp, Homo sapiens
caggtgggtctcctgccc

SEQ ID NO: 8063971 - DNA, 22 bp, Homo sapiens
caggtgggtacatcacagagac

SEQ ID NO: 8063972 - DNA, 22 bp, Homo sapiens
tattatcattaactgttgaatt

SEQ ID NO: 8063973 - DNA, 18 bp, Homo sapiens
caggtcagcctggcctca

SEQ ID NO: 8063974 - DNA, 22 bp, Homo sapiens
caggtgctcccagagaagtgct

SEQ ID NO: 8063975 - DNA, 22 bp, Homo sapiens
caggtcagagtccccctgtcct

SEQ ID NO: 8063976 - DNA, 22 bp, Homo sapiens
caggtcagaggcgcagccccca

SEQ ID NO: 8063977 - DNA, 22 bp, Homo sapiens
caggtcagaggcgcagccccca

SEQ ID NO: 8063978 - DNA, 22 bp, Homo sapiens
tcaaaacaatcattggatgtgc

SEQ ID NO: 8063979 - DNA, 19 bp, Homo sapiens
tcaaaacacaaatggttga

SEQ ID NO: 8063980 - DNA, 22 bp, Homo sapiens
tcaaaacactattacctttaat

SEQ ID NO: 8063981 - DNA, 19 bp, Homo sapiens
tcaaaacacaaatggttga

SEQ ID NO: 8063982 - DNA, 22 bp, Homo sapiens
tcaagcagggtagcaagctggt

SEQ ID NO: 8063983 - DNA, 19 bp, Homo sapiens
caggtggtaatctgagcct

SEQ ID NO: 8063984 - DNA, 22 bp, Homo sapiens
caggtgggtgtatgaatgcaaa

SEQ ID NO: 8063985 - DNA, 22 bp, Homo sapiens
caggtgggtgtatgaatgcaaa

SEQ ID NO: 8063986 - DNA, 22 bp, Homo sapiens
tattttaaagtgaagggtcttg

SEQ ID NO: 8063987 - DNA, 22 bp, Homo sapiens
tgacataagttggtagaaagga

SEQ ID NO: 8063988 - DNA, 22 bp, Homo sapiens
tgacataaatctaaaggaaagg

SEQ ID NO: 8063989 - DNA, 22 bp, Homo sapiens
tgacataaaccagtgagcaaaa

SEQ ID NO: 8063990 - DNA, 22 bp, Homo sapiens
tgacatcagaatggcatagaaa

SEQ ID NO: 8063991 - DNA, 21 bp, Homo sapiens
tgacataatccatagtacaaa

SEQ ID NO: 8063992 - DNA, 22 bp, Homo sapiens
tgagaaaaggttgagatgataa

SEQ ID NO: 8063993 - DNA, 22 bp, Homo sapiens
tgagaaaaggttgagatgataa

SEQ ID NO: 8063994 - DNA, 22 bp, Homo sapiens
ccaggggaaacagggagcactc

SEQ ID NO: 8063995 - DNA, 21 bp, Homo sapiens
ccagggtccagctgccatggt

SEQ ID NO: 8063996 - DNA, 19 bp, Homo sapiens
ccaggtggaactgaggtag

SEQ ID NO: 8063997 - DNA, 17 bp, Homo sapiens
ccaggtggaatcgtgga

SEQ ID NO: 8063998 - DNA, 22 bp, Homo sapiens
ccaggtggaaggtctgtgctct

SEQ ID NO: 8063999 - DNA, 22 bp, Homo sapiens
tgagaatgaatcttttgctttc

SEQ ID NO: 8064000 - DNA, 22 bp, Homo sapiens
ccaggggctggtgctgagctgg

SEQ ID NO: 8064001 - DNA, 19 bp, Homo sapiens
tgagaaggcagtggggagc

SEQ ID NO: 8064002 - DNA, 17 bp, Homo sapiens
ccaggtgggaggtgggg

SEQ ID NO: 8064003 - DNA, 22 bp, Homo sapiens
ccatgcatataatagtgcctgg

SEQ ID NO: 8064004 - DNA, 22 bp, Homo sapiens
ccatgctgtgacacagtagtta

SEQ ID NO: 8064005 - DNA, 22 bp, Homo sapiens
ccatgccccaccaggacgctgc

SEQ ID NO: 8064006 - DNA, 22 bp, Homo sapiens
ccatgcctggactccactctca

SEQ ID NO: 8064007 - DNA, 22 bp, Homo sapiens
tgaggtaggtggtaagagatac

SEQ ID NO: 8064008 - DNA, 22 bp, Homo sapiens
ccagtctcctaagagcccctga

SEQ ID NO: 8064009 - DNA, 22 bp, Homo sapiens
ccagtcctgctccctgaccacc

SEQ ID NO: 8064010 - DNA, 22 bp, Homo sapiens
ccagtcctttgagccagttctg

SEQ ID NO: 8064011 - DNA, 22 bp, Homo sapiens
tgagggctgcttccagagctag

SEQ ID NO: 8064012 - DNA, 22 bp, Homo sapiens
tgagggcacctgggattaatgg

SEQ ID NO: 8064013 - DNA, 19 bp, Homo sapiens
ccattgtaaagaaaaatgt

SEQ ID NO: 8064014 - DNA, 23 bp, Homo sapiens
ccattcccactgtgccttccctg

SEQ ID NO: 8064015 - DNA, 22 bp, Homo sapiens
cccacccctggacaggtgagtg

SEQ ID NO: 8064016 - DNA, 22 bp, Homo sapiens
cccactgtttccctgaggctct

SEQ ID NO: 8064017 - DNA, 22 bp, Homo sapiens
ccaggaggttgaggctgcagtg

SEQ ID NO: 8064018 - DNA, 22 bp, Homo sapiens
ccaggagtcaataaaggaagct

SEQ ID NO: 8064019 - DNA, 22 bp, Homo sapiens
ccaggagtctggatgaggtgtc

SEQ ID NO: 8064020 - DNA, 22 bp, Homo sapiens
tcttcacatggagaagcaactc

SEQ ID NO: 8064021 - DNA, 22 bp, Homo sapiens
tcttcacattttagtggtttgt

SEQ ID NO: 8064022 - DNA, 22 bp, Homo sapiens
tcttcactgatgtctctcaaat

SEQ ID NO: 8064023 - DNA, 22 bp, Homo sapiens
tcttcacatggaacatgaagct

SEQ ID NO: 8064024 - DNA, 22 bp, Homo sapiens
tcttcagagtgaaagtctgtga

SEQ ID NO: 8064025 - DNA, 22 bp, Homo sapiens
tcttcagataaagggagagtat

SEQ ID NO: 8064026 - DNA, 22 bp, Homo sapiens
tcttcagacccttagctgtgat

SEQ ID NO: 8064027 - DNA, 21 bp, Homo sapiens
ccaggctcctgaggctggtca

SEQ ID NO: 8064028 - DNA, 22 bp, Homo sapiens
ccaggctgctgttggtgtccgc

SEQ ID NO: 8064029 - DNA, 22 bp, Homo sapiens
ccaggctggagtgcaatggtgc

SEQ ID NO: 8064030 - DNA, 22 bp, Homo sapiens
ccaggcctggaccatgccaggg

SEQ ID NO: 8064031 - DNA, 19 bp, Homo sapiens
ccaggccatcccagttccc

SEQ ID NO: 8064032 - DNA, 22 bp, Homo sapiens
ccaggcccaccttggccactta

SEQ ID NO: 8064033 - DNA, 22 bp, Homo sapiens
ccagagactggctgagagatct

SEQ ID NO: 8064034 - DNA, 22 bp, Homo sapiens
ccagagacgtcggtcagggcgc

SEQ ID NO: 8064035 - DNA, 22 bp, Homo sapiens
ccagagacgtcggtcagggcgc

SEQ ID NO: 8064036 - DNA, 22 bp, Homo sapiens
ccagagaccagaacatggggat

SEQ ID NO: 8064037 - DNA, 22 bp, Homo sapiens
ccagctctcagcgggagactca

SEQ ID NO: 8064038 - DNA, 22 bp, Homo sapiens
ccagctctcagcgggagactca

SEQ ID NO: 8064039 - DNA, 22 bp, Homo sapiens
ccagctctgcagggcctggggt

SEQ ID NO: 8064040 - DNA, 22 bp, Homo sapiens
ccagctctgcagggcctggggt

SEQ ID NO: 8064041 - DNA, 22 bp, Homo sapiens
ccagctctgcatgtttcccttg

SEQ ID NO: 8064042 - DNA, 22 bp, Homo sapiens
ccagctctgattttgacctcca

SEQ ID NO: 8064043 - DNA, 22 bp, Homo sapiens
ccagctctgattttgacctcca

SEQ ID NO: 8064044 - DNA, 22 bp, Homo sapiens
ccagctgattcggtggtggttg

SEQ ID NO: 8064045 - DNA, 22 bp, Homo sapiens
ccagctctgccaagcgtcagct

SEQ ID NO: 8064046 - DNA, 20 bp, Homo sapiens
ccagctgagccaaggggaga

SEQ ID NO: 8064047 - DNA, 22 bp, Homo sapiens
ccagctgaggcagccacacagg

SEQ ID NO: 8064048 - DNA, 22 bp, Homo sapiens
tctggaggccatagggaaggat

SEQ ID NO: 8064049 - DNA, 22 bp, Homo sapiens
ccagctgctgtgcagggaggct

SEQ ID NO: 8064050 - DNA, 22 bp, Homo sapiens
tctggcaggggttctgcacttg

SEQ ID NO: 8064051 - DNA, 22 bp, Homo sapiens
tctggcctatttctgtcagatc

SEQ ID NO: 8064052 - DNA, 22 bp, Homo sapiens
tctggcctactggagtccatga

SEQ ID NO: 8064053 - DNA, 22 bp, Homo sapiens
tctggcctgggcctgccggtgc

SEQ ID NO: 8064054 - DNA, 22 bp, Homo sapiens
tctggccttatctgtccaagcc

SEQ ID NO: 8064055 - DNA, 22 bp, Homo sapiens
tctggcctgaaagtccatgctt

SEQ ID NO: 8064056 - DNA, 22 bp, Homo sapiens
tctggcaggcaatcggctctgg

SEQ ID NO: 8064057 - DNA, 17 bp, Homo sapiens
tctggccttcctgaact

SEQ ID NO: 8064058 - DNA, 22 bp, Homo sapiens
tctgggagcagatgatggtata

SEQ ID NO: 8064059 - DNA, 22 bp, Homo sapiens
tctggtaacctttatccctcct

SEQ ID NO: 8064060 - DNA, 22 bp, Homo sapiens
tctggtgtcaggctgtcctcgg

SEQ ID NO: 8064061 - DNA, 21 bp, Homo sapiens
tgctggcctcaagggtgactt

SEQ ID NO: 8064062 - DNA, 22 bp, Homo sapiens
tgctggccctggctcagggaac

SEQ ID NO: 8064063 - DNA, 22 bp, Homo sapiens
tgctggcccagtatggactgca

SEQ ID NO: 8064064 - DNA, 22 bp, Homo sapiens
ccccttccgtctcttgagtgtc

SEQ ID NO: 8064065 - DNA, 22 bp, Homo sapiens
ccccttccttcctcagacagcc

SEQ ID NO: 8064066 - DNA, 23 bp, Homo sapiens
cccctctggtggctcagctcctg

SEQ ID NO: 8064067 - DNA, 22 bp, Homo sapiens
tgctggctttttggtccttgct

SEQ ID NO: 8064068 - DNA, 22 bp, Homo sapiens
cccaggtcccggggccagctgc

SEQ ID NO: 8064069 - DNA, 22 bp, Homo sapiens
cccaggtcccgccccagctcta

SEQ ID NO: 8064070 - DNA, 22 bp, Homo sapiens
cccaggtcccgccccagctcta

SEQ ID NO: 8064071 - DNA, 22 bp, Homo sapiens
cccattttgcttatgctgctgt

SEQ ID NO: 8064072 - DNA, 22 bp, Homo sapiens
cccatttgtatagagccttata

SEQ ID NO: 8064073 - DNA, 22 bp, Homo sapiens
cccatttgtccaaagtataaaa

SEQ ID NO: 8064074 - DNA, 22 bp, Homo sapiens
tgctgtgttcctcagtttcatg

SEQ ID NO: 8064075 - DNA, 22 bp, Homo sapiens
tgctgtgtggatgtgaagaatc

SEQ ID NO: 8064076 - DNA, 22 bp, Homo sapiens
ccctcctggaggcggatgccca

SEQ ID NO: 8064077 - DNA, 22 bp, Homo sapiens
ccctcctgtgcctgaggccagc

SEQ ID NO: 8064078 - DNA, 22 bp, Homo sapiens
tggaatgtcataccataaaaga

SEQ ID NO: 8064079 - DNA, 22 bp, Homo sapiens
tggaatgtaaactctgtgaggg

SEQ ID NO: 8064080 - DNA, 22 bp, Homo sapiens
tggagcaagctggagagaacat

SEQ ID NO: 8064081 - DNA, 22 bp, Homo sapiens
tggagcaggactgctgccctca

SEQ ID NO: 8064082 - DNA, 22 bp, Homo sapiens
ccctgagagtgagtgccacctt

SEQ ID NO: 8064083 - DNA, 22 bp, Homo sapiens
ccctgagatgcctcaccctagt

SEQ ID NO: 8064084 - DNA, 22 bp, Homo sapiens
ccctgagcccatagttgacatt

SEQ ID NO: 8064085 - DNA, 20 bp, Homo sapiens
ccctgagaccagagagcagc

SEQ ID NO: 8064086 - DNA, 20 bp, Homo sapiens
ccctgagacaaaggaggggc

SEQ ID NO: 8064087 - DNA, 22 bp, Homo sapiens
ccctctacagggaagcgctttc

SEQ ID NO: 8064088 - DNA, 18 bp, Homo sapiens
ccctctcctgctagtggg

SEQ ID NO: 8064089 - DNA, 22 bp, Homo sapiens
tgccaggagagtgcatgcaggg

SEQ ID NO: 8064090 - DNA, 22 bp, Homo sapiens
tgccaggaggaggtgggacaga

SEQ ID NO: 8064091 - DNA, 22 bp, Homo sapiens
tgccagctccgaggagctgcag

SEQ ID NO: 8064092 - DNA, 22 bp, Homo sapiens
tgccaggctaagtggaggactt

SEQ ID NO: 8064093 - DNA, 23 bp, Homo sapiens
cccaggctacaaattatgctctg

SEQ ID NO: 8064094 - DNA, 22 bp, Homo sapiens
cccaggcagtgtgtgcatgcgt

SEQ ID NO: 8064095 - DNA, 22 bp, Homo sapiens
cccaggctcagactggcttgtt

SEQ ID NO: 8064096 - DNA, 22 bp, Homo sapiens
cccaggctggagggcagtgtca

SEQ ID NO: 8064097 - DNA, 22 bp, Homo sapiens
cccagggaatgactctggcctt

SEQ ID NO: 8064098 - DNA, 22 bp, Homo sapiens
cccagggaatgactctggcctt

SEQ ID NO: 8064099 - DNA, 22 bp, Homo sapiens
cccaggctggtcctgaactcct

SEQ ID NO: 8064100 - DNA, 21 bp, Homo sapiens
cccagggaagccgcagtcacc

SEQ ID NO: 8064101 - DNA, 22 bp, Homo sapiens
tgcctgttgcccacctgataaa

SEQ ID NO: 8064102 - DNA, 22 bp, Homo sapiens
tgccttcaatcaggatggtctc

SEQ ID NO: 8064103 - DNA, 22 bp, Homo sapiens
cccagggattataaaggtgaaa

SEQ ID NO: 8064104 - DNA, 22 bp, Homo sapiens
cccagggacagctaggtggggc

SEQ ID NO: 8064105 - DNA, 22 bp, Homo sapiens
cccagggacagatgggcagcta

SEQ ID NO: 8064106 - DNA, 22 bp, Homo sapiens
cccagggtccctgctctctgtg

SEQ ID NO: 8064107 - DNA, 22 bp, Homo sapiens
cccagggttgcctgcctctgct

SEQ ID NO: 8064108 - DNA, 22 bp, Homo sapiens
tggcaggtacccattggctgta

SEQ ID NO: 8064109 - DNA, 22 bp, Homo sapiens
cctcagaggtgaacatcagtgc

SEQ ID NO: 8064110 - DNA, 22 bp, Homo sapiens
tggcagggtgggcttcagcccc

SEQ ID NO: 8064111 - DNA, 22 bp, Homo sapiens
cctaggagagggaaaatctagg

SEQ ID NO: 8064112 - DNA, 20 bp, Homo sapiens
cctaggcatgctgagtctcc

SEQ ID NO: 8064113 - DNA, 22 bp, Homo sapiens
tggcagggtggcaacttttggt

SEQ ID NO: 8064114 - DNA, 22 bp, Homo sapiens
tggcagaggctctgtgatgttg

SEQ ID NO: 8064115 - DNA, 19 bp, Homo sapiens
tggcagaggcagtttgtac

SEQ ID NO: 8064116 - DNA, 22 bp, Homo sapiens
tggcagaggaggctcagattga

SEQ ID NO: 8064117 - DNA, 22 bp, Homo sapiens
tggcagaggagaattaagatta

SEQ ID NO: 8064118 - DNA, 22 bp, Homo sapiens
cctagagctctgctttatctaa

SEQ ID NO: 8064119 - DNA, 22 bp, Homo sapiens
cctagcaataaagatatcattt

SEQ ID NO: 8064120 - DNA, 22 bp, Homo sapiens
cctagccttcggcctacccatc

SEQ ID NO: 8064121 - DNA, 22 bp, Homo sapiens
tggagcaggccggaagtggctt

SEQ ID NO: 8064122 - DNA, 22 bp, Homo sapiens
tggagcagggcatcactgtgcg

SEQ ID NO: 8064123 - DNA, 22 bp, Homo sapiens
ccctgcagccttgcatgccttc

SEQ ID NO: 8064124 - DNA, 19 bp, Homo sapiens
tggagcagggcccttgttt

SEQ ID NO: 8064125 - DNA, 22 bp, Homo sapiens
tggagcagggcatcactgtgcg

SEQ ID NO: 8064126 - DNA, 22 bp, Homo sapiens
ccctgcaggggacctgcagcct

SEQ ID NO: 8064127 - DNA, 22 bp, Homo sapiens
ccctgcagcttttgcatagtca

SEQ ID NO: 8064128 - DNA, 22 bp, Homo sapiens
cccttcccttctgggagatcca

SEQ ID NO: 8064129 - DNA, 22 bp, Homo sapiens
cccttcctcaaggagctgtgtt

SEQ ID NO: 8064130 - DNA, 22 bp, Homo sapiens
cccttcctcccaggcttctgtg

SEQ ID NO: 8064131 - DNA, 22 bp, Homo sapiens
tggctctgtcaaactgcacaca

SEQ ID NO: 8064132 - DNA, 22 bp, Homo sapiens
tggctctggtgcgggctcctgc

SEQ ID NO: 8064133 - DNA, 21 bp, Homo sapiens
tggctctgggtaggagagtgc

SEQ ID NO: 8064134 - DNA, 22 bp, Homo sapiens
tggcctgggcctgccggtgcaa

SEQ ID NO: 8064135 - DNA, 22 bp, Homo sapiens
tggcctggggaagaccatgggc

SEQ ID NO: 8064136 - DNA, 18 bp, Homo sapiens
cctccaagtccccagcct

SEQ ID NO: 8064137 - DNA, 22 bp, Homo sapiens
tggcctggctcacagtgagatt

SEQ ID NO: 8064138 - DNA, 22 bp, Homo sapiens
cctcagggactccatgctgcag

SEQ ID NO: 8064139 - DNA, 22 bp, Homo sapiens
cctcaggcttacgggcaatgga

SEQ ID NO: 8064140 - DNA, 22 bp, Homo sapiens
tggctctgtcactgtgagctat

SEQ ID NO: 8064141 - DNA, 17 bp, Homo sapiens
tggctctgtcctcagct

SEQ ID NO: 8064142 - DNA, 19 bp, Homo sapiens
tggctctgtcgaaggcaca

SEQ ID NO: 8064143 - DNA, 22 bp, Homo sapiens
tggctggctagtgggcaggatt

SEQ ID NO: 8064144 - DNA, 22 bp, Homo sapiens
tggctgctcaagggaggaggct

SEQ ID NO: 8064145 - DNA, 22 bp, Homo sapiens
tggctgctagccagagcttcag

SEQ ID NO: 8064146 - DNA, 22 bp, Homo sapiens
tggctggcttgttcactgactg

SEQ ID NO: 8064147 - DNA, 22 bp, Homo sapiens
tggcttccaaaggaatgggcct

SEQ ID NO: 8064148 - DNA, 21 bp, Homo sapiens
cctctgctcgggcatgcgttt

SEQ ID NO: 8064149 - DNA, 20 bp, Homo sapiens
cctctgcctttctagtctga

SEQ ID NO: 8064150 - DNA, 22 bp, Homo sapiens
cctctgcctgcacatcatcctg

SEQ ID NO: 8064151 - DNA, 22 bp, Homo sapiens
cctctgtggccctgactctctt

SEQ ID NO: 8064152 - DNA, 22 bp, Homo sapiens
cctctgctgctgttgagcaccg

SEQ ID NO: 8064153 - DNA, 18 bp, Homo sapiens
cctgagccctgcttactt

SEQ ID NO: 8064154 - DNA, 22 bp, Homo sapiens
cctgagcattagacatccatca

SEQ ID NO: 8064155 - DNA, 23 bp, Homo sapiens
tgggagtgttgggatctctgctc

SEQ ID NO: 8064156 - DNA, 22 bp, Homo sapiens
cctgagcaaaggcccagaggga

SEQ ID NO: 8064157 - DNA, 22 bp, Homo sapiens
tgggagtgttcttggcttgctt

SEQ ID NO: 8064158 - DNA, 22 bp, Homo sapiens
cctcttctgagtgagactccct

SEQ ID NO: 8064159 - DNA, 22 bp, Homo sapiens
cctcttccttctcactgtggaa

SEQ ID NO: 8064160 - DNA, 22 bp, Homo sapiens
tgggctggcccaccacacctcg

SEQ ID NO: 8064161 - DNA, 22 bp, Homo sapiens
tgggctgcttcctcagctgaga

SEQ ID NO: 8064162 - DNA, 22 bp, Homo sapiens
tgggctggagcttgttgcttcc

SEQ ID NO: 8064163 - DNA, 22 bp, Homo sapiens
tgggcccaagagagtctccaac

SEQ ID NO: 8064164 - DNA, 22 bp, Homo sapiens
tgggctgctgcggtgctcttgg

SEQ ID NO: 8064165 - DNA, 22 bp, Homo sapiens
tcccctctggaggctgcagggg

SEQ ID NO: 8064166 - DNA, 22 bp, Homo sapiens
tcccctctggttgacccaggag

SEQ ID NO: 8064167 - DNA, 22 bp, Homo sapiens
tgtggacgtcattaaagcagtg

SEQ ID NO: 8064168 - DNA, 22 bp, Homo sapiens
tgtggagactatagccataaca

SEQ ID NO: 8064169 - DNA, 22 bp, Homo sapiens
tcccccactctaaaggagcctt

SEQ ID NO: 8064170 - DNA, 22 bp, Homo sapiens
tcccccaggctggagtgcagtg

SEQ ID NO: 8064171 - DNA, 23 bp, Homo sapiens
tcccctcaggcagccagtgccct

SEQ ID NO: 8064172 - DNA, 22 bp, Homo sapiens
tccccctcattacctcattcaa

SEQ ID NO: 8064173 - DNA, 22 bp, Homo sapiens
tccccctccaattgccatgtta

SEQ ID NO: 8064174 - DNA, 22 bp, Homo sapiens
tgtggccaggcccctgatggtg

SEQ ID NO: 8064175 - DNA, 22 bp, Homo sapiens
tgtggcagtctcactggagggc

SEQ ID NO: 8064176 - DNA, 22 bp, Homo sapiens
tgtggcagaactgggactcaaa

SEQ ID NO: 8064177 - DNA, 22 bp, Homo sapiens
tgtgtcccttggaacctcagct

SEQ ID NO: 8064178 - DNA, 22 bp, Homo sapiens
tgtgtgaaggaatatatactca

SEQ ID NO: 8064179 - DNA, 22 bp, Homo sapiens
tgtgtgaatctattgaatatat

SEQ ID NO: 8064180 - DNA, 22 bp, Homo sapiens
tgtgtgaatggattattctatt

SEQ ID NO: 8064181 - DNA, 22 bp, Homo sapiens
tgtgtcttaagttccaagacat

SEQ ID NO: 8064182 - DNA, 22 bp, Homo sapiens
tgtgtctttgttccaggtacga

SEQ ID NO: 8064183 - DNA, 17 bp, Homo sapiens
tgtggccttctgagctt

SEQ ID NO: 8064184 - DNA, 22 bp, Homo sapiens
tgtggcctcaaggctgccctca

SEQ ID NO: 8064185 - DNA, 22 bp, Homo sapiens
tgtggcctccccacttctgggg

SEQ ID NO: 8064186 - DNA, 22 bp, Homo sapiens
tgtggcctcctgttcctgggta

SEQ ID NO: 8064187 - DNA, 22 bp, Homo sapiens
tgtggcctctaagctcacgaag

SEQ ID NO: 8064188 - DNA, 22 bp, Homo sapiens
tgtggcctggaaggggctgctc

SEQ ID NO: 8064189 - DNA, 22 bp, Homo sapiens
tgtgggtggcatcgtcctggcc

SEQ ID NO: 8064190 - DNA, 22 bp, Homo sapiens
tgtggtctcgttatgttgccca

SEQ ID NO: 8064191 - DNA, 22 bp, Homo sapiens
tgtggtgccgagagtctggacg

SEQ ID NO: 8064192 - DNA, 22 bp, Homo sapiens
tgtggtgagaaactggtagatt

SEQ ID NO: 8064193 - DNA, 22 bp, Homo sapiens
tgtggttttggttcagaaacaa

SEQ ID NO: 8064194 - DNA, 22 bp, Homo sapiens
tgtggttggaatgcagccatgc

SEQ ID NO: 8064195 - DNA, 22 bp, Homo sapiens
tgtggtggctattctggtctca

SEQ ID NO: 8064196 - DNA, 22 bp, Homo sapiens
tgtggtggggtctggtattcca

SEQ ID NO: 8064197 - DNA, 20 bp, Homo sapiens
tgtggtttttgccagttgaa

SEQ ID NO: 8064198 - DNA, 22 bp, Homo sapiens
tgtgtaaaatctgattaatact

SEQ ID NO: 8064199 - DNA, 21 bp, Homo sapiens
tgtgtaaagttgaaatcctgt

SEQ ID NO: 8064200 - DNA, 22 bp, Homo sapiens
tgtgtaaatggcatctctcagc

SEQ ID NO: 8064201 - DNA, 22 bp, Homo sapiens
tgtgtaaatttatttacataaa

SEQ ID NO: 8064202 - DNA, 22 bp, Homo sapiens
tgttcctggttcctgcatgatg

SEQ ID NO: 8064203 - DNA, 22 bp, Homo sapiens
tgttcacacacggaggccacag

SEQ ID NO: 8064204 - DNA, 22 bp, Homo sapiens
tgttcacaaggtgatgctttga

SEQ ID NO: 8064205 - DNA, 22 bp, Homo sapiens
tgttcacaagatgtctgtggct

SEQ ID NO: 8064206 - DNA, 22 bp, Homo sapiens
tgttcacatcgatggattttgc

SEQ ID NO: 8064207 - DNA, 22 bp, Homo sapiens
tgttatttatctgagcatttat

SEQ ID NO: 8064208 - DNA, 22 bp, Homo sapiens
tgttatctcagactgagttact

SEQ ID NO: 8064209 - DNA, 22 bp, Homo sapiens
tgttatataacttacaacctgt

SEQ ID NO: 8064210 - DNA, 22 bp, Homo sapiens
tgttatctgcacgtagagtttt

SEQ ID NO: 8064211 - DNA, 19 bp, Homo sapiens
tgttatgactttgcctttt

SEQ ID NO: 8064212 - DNA, 22 bp, Homo sapiens
tgttatctggttgtctgattac

SEQ ID NO: 8064213 - DNA, 22 bp, Homo sapiens
tgttatgaacttctagaaaaca

SEQ ID NO: 8064214 - DNA, 22 bp, Homo sapiens
tgtgttttggaaggaacatgca

SEQ ID NO: 8064215 - DNA, 22 bp, Homo sapiens
tgtgttttccagaatggtgttt

SEQ ID NO: 8064216 - DNA, 22 bp, Homo sapiens
tgtgtttgaggcatgttgcaga

SEQ ID NO: 8064217 - DNA, 22 bp, Homo sapiens
tgtgttctggctgtgacagctg

SEQ ID NO: 8064218 - DNA, 22 bp, Homo sapiens
tgtgttcttaaaagcagtgata

SEQ ID NO: 8064219 - DNA, 22 bp, Homo sapiens
tgtgttcttaaaagcagtgata

SEQ ID NO: 8064220 - DNA, 22 bp, Homo sapiens
tgtgttctggaaagctcactga

SEQ ID NO: 8064221 - DNA, 22 bp, Homo sapiens
tgtgttctgaaggagaagagtg

SEQ ID NO: 8064222 - DNA, 22 bp, Homo sapiens
tgttctctctggctgccagtac

SEQ ID NO: 8064223 - DNA, 22 bp, Homo sapiens
tgttctggggttgagagacaat

SEQ ID NO: 8064224 - DNA, 22 bp, Homo sapiens
tgttctgtgcatctagccagta

SEQ ID NO: 8064225 - DNA, 22 bp, Homo sapiens
tgttctatgctctttaaggtga

SEQ ID NO: 8064226 - DNA, 21 bp, Homo sapiens
tgttctatcagctcaggtgtc

SEQ ID NO: 8064227 - DNA, 22 bp, Homo sapiens
tgttctagcaacacagttttgg

SEQ ID NO: 8064228 - DNA, 22 bp, Homo sapiens
tgtttaattcaccatcatgttc

SEQ ID NO: 8064229 - DNA, 22 bp, Homo sapiens
tgtttaattcaccatcatgttc

SEQ ID NO: 8064230 - DNA, 22 bp, Homo sapiens
tgtttaatttcacaaagttgac

SEQ ID NO: 8064231 - DNA, 22 bp, Homo sapiens
tgtttaatgaagatggtttttc

SEQ ID NO: 8064232 - DNA, 22 bp, Homo sapiens
tgtttaatcttcaggacagtct

SEQ ID NO: 8064233 - DNA, 22 bp, Homo sapiens
tgtttaatctataaaatggaga

SEQ ID NO: 8064234 - DNA, 21 bp, Homo sapiens
tgtttaatacatatttgtgga

SEQ ID NO: 8064235 - DNA, 22 bp, Homo sapiens
tgtttaataattctatgatagt

SEQ ID NO: 8064236 - DNA, 22 bp, Homo sapiens
tgtttaataattctatgatagt

SEQ ID NO: 8064237 - DNA, 22 bp, Homo sapiens
tgtttacatgcataagcttaag

SEQ ID NO: 8064238 - DNA, 22 bp, Homo sapiens
tgtttcatgattgctgtcattt

SEQ ID NO: 8064239 - DNA, 22 bp, Homo sapiens
tgtttcttgataaagcagaaaa

SEQ ID NO: 8064240 - DNA, 22 bp, Homo sapiens
tgtttgagttctagcgcattta

SEQ ID NO: 8064241 - DNA, 16 bp, Homo sapiens
tgtttgcaaagcaatc

SEQ ID NO: 8064242 - DNA, 22 bp, Homo sapiens
ttaactattattagcatctttg

SEQ ID NO: 8064243 - DNA, 22 bp, Homo sapiens
ttaatttatacataatcacagg

SEQ ID NO: 8064244 - DNA, 22 bp, Homo sapiens
ttaattcagtcaaagaaaccat

SEQ ID NO: 8064245 - DNA, 22 bp, Homo sapiens
ttaagtgagcttgaataatctt

SEQ ID NO: 8064246 - DNA, 22 bp, Homo sapiens
tgttttctgatggttaatgagt

SEQ ID NO: 8064247 - DNA, 22 bp, Homo sapiens
ttaaagcatgctgcttttccat

SEQ ID NO: 8064248 - DNA, 22 bp, Homo sapiens
ttaaatctgttctcatgtctgt

SEQ ID NO: 8064249 - DNA, 22 bp, Homo sapiens
ttaaatgacgggactgggtttt

SEQ ID NO: 8064250 - DNA, 22 bp, Homo sapiens
ttaaatgacttttattattctc

SEQ ID NO: 8064251 - DNA, 22 bp, Homo sapiens
ttaaatgagatgttcagatatt

SEQ ID NO: 8064252 - DNA, 22 bp, Homo sapiens
ttaaatgagatgttcagatatt

SEQ ID NO: 8064253 - DNA, 22 bp, Homo sapiens
ttaaatgaggctgatgtagatt

SEQ ID NO: 8064254 - DNA, 22 bp, Homo sapiens
ttaaatgatgcatatcatttag

SEQ ID NO: 8064255 - DNA, 22 bp, Homo sapiens
ttacacagttggtaggggcaga

SEQ ID NO: 8064256 - DNA, 22 bp, Homo sapiens
ttacacagatggttagtagagg

SEQ ID NO: 8064257 - DNA, 17 bp, Homo sapiens
ttacacaggagagctct

SEQ ID NO: 8064258 - DNA, 21 bp, Homo sapiens
ttaatttattcatgatagcta

SEQ ID NO: 8064259 - DNA, 22 bp, Homo sapiens
ttaatttttatgtatagtgtgt

SEQ ID NO: 8064260 - DNA, 22 bp, Homo sapiens
ttacaggggacattggggacat

SEQ ID NO: 8064261 - DNA, 22 bp, Homo sapiens
ttagagccagttacaaggtcaa

SEQ ID NO: 8064262 - DNA, 22 bp, Homo sapiens
ttagaaaatttgcttctttgga

SEQ ID NO: 8064263 - DNA, 20 bp, Homo sapiens
ttagaaagagcgtgataaga

SEQ ID NO: 8064264 - DNA, 22 bp, Homo sapiens
ttactttagaaatagtcatcaa

SEQ ID NO: 8064265 - DNA, 22 bp, Homo sapiens
ttactcgtgacaatgtccttga

SEQ ID NO: 8064266 - DNA, 22 bp, Homo sapiens
ttacattttggggtaaggataa

SEQ ID NO: 8064267 - DNA, 22 bp, Homo sapiens
ttccagaattttgttctgcttg

SEQ ID NO: 8064268 - DNA, 22 bp, Homo sapiens
ttccagaattttgttctgcttg

SEQ ID NO: 8064269 - DNA, 22 bp, Homo sapiens
ttccagaattgggagccttgag

SEQ ID NO: 8064270 - DNA, 23 bp, Homo sapiens
ttccacaatgaaaataaagcagg

SEQ ID NO: 8064271 - DNA, 22 bp, Homo sapiens
ttccacaatgccaggggcatca

SEQ ID NO: 8064272 - DNA, 17 bp, Homo sapiens
ttccacaatagtttgtc

SEQ ID NO: 8064273 - DNA, 22 bp, Homo sapiens
ttccacaagtgatatctagctg

SEQ ID NO: 8064274 - DNA, 22 bp, Homo sapiens
ttccacaattcagattgttgcc

SEQ ID NO: 8064275 - DNA, 22 bp, Homo sapiens
ttccacaatggttaagctcgtt

SEQ ID NO: 8064276 - DNA, 22 bp, Homo sapiens
ttccacaatgtatgaataagat

SEQ ID NO: 8064277 - DNA, 22 bp, Homo sapiens
ttccacaaggccttgtcctgct

SEQ ID NO: 8064278 - DNA, 22 bp, Homo sapiens
ttccacaagatgtttcttagaa

SEQ ID NO: 8064279 - DNA, 22 bp, Homo sapiens
ttccacaagacttgggttaaga

SEQ ID NO: 8064280 - DNA, 22 bp, Homo sapiens
ttccacaacaaccaagcatata

SEQ ID NO: 8064281 - DNA, 22 bp, Homo sapiens
ttccacaaatcaattctgctga

SEQ ID NO: 8064282 - DNA, 22 bp, Homo sapiens
ttccacaaacacatcctgagca

SEQ ID NO: 8064283 - DNA, 22 bp, Homo sapiens
ttccacaaatacactccacatt

SEQ ID NO: 8064284 - DNA, 22 bp, Homo sapiens
ttccacagatgtatgaagtggt

SEQ ID NO: 8064285 - DNA, 16 bp, Homo sapiens
ttccacagtcgaggtg

SEQ ID NO: 8064286 - DNA, 22 bp, Homo sapiens
ttccacagtcatcctgggaatt

SEQ ID NO: 8064287 - DNA, 22 bp, Homo sapiens
ttcctagggcagagccgctggg

SEQ ID NO: 8064288 - DNA, 22 bp, Homo sapiens
ttcctagacagttcttcccaaa

SEQ ID NO: 8064289 - DNA, 22 bp, Homo sapiens
ttcctagaatggttagaaaata

SEQ ID NO: 8064290 - DNA, 22 bp, Homo sapiens
ttcctccacgtgacaggagcca

SEQ ID NO: 8064291 - DNA, 22 bp, Homo sapiens
ttccttctcagccctcgaggat

SEQ ID NO: 8064292 - DNA, 23 bp, Homo sapiens
ttccttaactgttaagattgtct

SEQ ID NO: 8064293 - DNA, 22 bp, Homo sapiens
ttcctgtgcctcaggtctcagc

SEQ ID NO: 8064294 - DNA, 22 bp, Homo sapiens
ttcctgtggccttacatctgtg

SEQ ID NO: 8064295 - DNA, 17 bp, Homo sapiens
ttcctgtggtttgatct

SEQ ID NO: 8064296 - DNA, 22 bp, Homo sapiens
ttcctgtgtcctatttcgactt

SEQ ID NO: 8064297 - DNA, 22 bp, Homo sapiens
ttcctgtgtgactcaagtggtt

SEQ ID NO: 8064298 - DNA, 22 bp, Homo sapiens
ttcctctttctctgtgctatgt

SEQ ID NO: 8064299 - DNA, 22 bp, Homo sapiens
ttcaactagatttatacaattc

SEQ ID NO: 8064300 - DNA, 22 bp, Homo sapiens
ttcaacacaggaacatgatata

SEQ ID NO: 8064301 - DNA, 23 bp, Homo sapiens
ttcaaagcttaagctctttccac

SEQ ID NO: 8064302 - DNA, 22 bp, Homo sapiens
ttcaaagtaaaaatgtgttcac

SEQ ID NO: 8064303 - DNA, 22 bp, Homo sapiens
ttcaatttagtgatgttgttgg

SEQ ID NO: 8064304 - DNA, 22 bp, Homo sapiens
ttcaattctaaactaatattct

SEQ ID NO: 8064305 - DNA, 22 bp, Homo sapiens
ttcaattcaattctaaatatat

SEQ ID NO: 8064306 - DNA, 22 bp, Homo sapiens
ttcatgtgtctgtagcacatat

SEQ ID NO: 8064307 - DNA, 22 bp, Homo sapiens
ttcaggagctggctgcgaagga

SEQ ID NO: 8064308 - DNA, 22 bp, Homo sapiens
ttcagtcctcacaacctcacta

SEQ ID NO: 8064309 - DNA, 20 bp, Homo sapiens
ttcagtctcctgcttccttc

SEQ ID NO: 8064310 - DNA, 22 bp, Homo sapiens
ttcttctttcctataattaatt

SEQ ID NO: 8064311 - DNA, 22 bp, Homo sapiens
ttcttgaccatgtatgtggtcc

SEQ ID NO: 8064312 - DNA, 18 bp, Homo sapiens
ttctttaattcagtttga

SEQ ID NO: 8064313 - DNA, 22 bp, Homo sapiens
ttctttaaatgaattctctgta

SEQ ID NO: 8064314 - DNA, 22 bp, Homo sapiens
ttctttatatctgctagtgggt

SEQ ID NO: 8064315 - DNA, 22 bp, Homo sapiens
ttctttaggtagatccagtttt

SEQ ID NO: 8064316 - DNA, 23 bp, Homo sapiens
ttctttataaatcaatgggatgt

SEQ ID NO: 8064317 - DNA, 22 bp, Homo sapiens
ttctttatagctattggatgag

SEQ ID NO: 8064318 - DNA, 22 bp, Homo sapiens
ttctttaaaatagtgagaaaga

SEQ ID NO: 8064319 - DNA, 22 bp, Homo sapiens
ttctggggccaattgccactgc

SEQ ID NO: 8064320 - DNA, 22 bp, Homo sapiens
ttctgagatacaaaatttactt

SEQ ID NO: 8064321 - DNA, 22 bp, Homo sapiens
ttctgagagttgtagtgtatcc

SEQ ID NO: 8064322 - DNA, 22 bp, Homo sapiens
ttctgagatgcgttagaaattt

SEQ ID NO: 8064323 - DNA, 22 bp, Homo sapiens
ttctgagatgtgaatctgtcaa

SEQ ID NO: 8064324 - DNA, 22 bp, Homo sapiens
ttctgagacttgagattaattt

SEQ ID NO: 8064325 - DNA, 22 bp, Homo sapiens
ttctgagagtaaacatagcctg

SEQ ID NO: 8064326 - DNA, 22 bp, Homo sapiens
ttctgagagagcctctcatgtt

SEQ ID NO: 8064327 - DNA, 22 bp, Homo sapiens
ttctgagaagtaaaatggcgtt

SEQ ID NO: 8064328 - DNA, 22 bp, Homo sapiens
ttctgagaaggctgtggacaca

SEQ ID NO: 8064329 - DNA, 22 bp, Homo sapiens
ttctgcttctgtgtgtcccagg

SEQ ID NO: 8064330 - DNA, 21 bp, Homo sapiens
ttctgctgtgccatgcctctg

SEQ ID NO: 8064331 - DNA, 21 bp, Homo sapiens
ttctgctgtgccatgcctctg

SEQ ID NO: 8064332 - DNA, 21 bp, Homo sapiens
ttctgctgttcaccaccaccc

SEQ ID NO: 8064333 - DNA, 22 bp, Homo sapiens
ttctgctgcgacccaggagtta

SEQ ID NO: 8064334 - DNA, 22 bp, Homo sapiens
ttctgctgctgctgcacccaat

SEQ ID NO: 8064335 - DNA, 22 bp, Homo sapiens
ttctgagattgttaggcactaa

SEQ ID NO: 8064336 - DNA, 22 bp, Homo sapiens
ttgatcatctaagagtaatagt

SEQ ID NO: 8064337 - DNA, 22 bp, Homo sapiens
ttgagttccaggatggttgtta

SEQ ID NO: 8064338 - DNA, 22 bp, Homo sapiens
ttgagttcaggggttgattgga

SEQ ID NO: 8064339 - DNA, 20 bp, Homo sapiens
ttgattcaagggctgatgga

SEQ ID NO: 8064340 - DNA, 22 bp, Homo sapiens
ttgaattagactttgctacagg

SEQ ID NO: 8064341 - DNA, 21 bp, Homo sapiens
ttctttccccagaggactaaa

SEQ ID NO: 8064342 - DNA, 22 bp, Homo sapiens
ttctttcccttccagcagctcc

SEQ ID NO: 8064343 - DNA, 22 bp, Homo sapiens
ttctttccccatggagttcgga

SEQ ID NO: 8064344 - DNA, 22 bp, Homo sapiens
ttctttcctcccagcctttgga

SEQ ID NO: 8064345 - DNA, 22 bp, Homo sapiens
ttctttattagtttagtgagct

SEQ ID NO: 8064346 - DNA, 22 bp, Homo sapiens
ttctttatgttaatgaatctat

SEQ ID NO: 8064347 - DNA, 22 bp, Homo sapiens
ttctttatgcttctgtttaggc

SEQ ID NO: 8064348 - DNA, 22 bp, Homo sapiens
ttctttatggaatggtgatagt

SEQ ID NO: 8064349 - DNA, 22 bp, Homo sapiens
ttctttatcctatttgtaggtg

SEQ ID NO: 8064350 - DNA, 22 bp, Homo sapiens
ttctttatcctatttgtaggtg

SEQ ID NO: 8064351 - DNA, 22 bp, Homo sapiens
ttctttatcagttactcatagg

SEQ ID NO: 8064352 - DNA, 22 bp, Homo sapiens
ttctttattgagacttcattgt

SEQ ID NO: 8064353 - DNA, 22 bp, Homo sapiens
ttctttcccagtagatgtgaaa

SEQ ID NO: 8064354 - DNA, 22 bp, Homo sapiens
ttctttcccagaagatatgttt

SEQ ID NO: 8064355 - DNA, 22 bp, Homo sapiens
ttctttccaaccagatattggt

SEQ ID NO: 8064356 - DNA, 22 bp, Homo sapiens
ttctttccacagaggggatgat

SEQ ID NO: 8064357 - DNA, 22 bp, Homo sapiens
tttgcaatgtgaaattaaagaa

SEQ ID NO: 8064358 - DNA, 22 bp, Homo sapiens
tttctttatcctcctttgcaca

SEQ ID NO: 8064359 - DNA, 22 bp, Homo sapiens
tttggcagagtgtgggcatttg

SEQ ID NO: 8064360 - DNA, 22 bp, Homo sapiens
tttggcaatatctgaattatag

SEQ ID NO: 8064361 - DNA, 22 bp, Homo sapiens
tttggaagggaaccaaaacatg

SEQ ID NO: 8064362 - DNA, 22 bp, Homo sapiens
tttggaaggtgaggcatgaagg

SEQ ID NO: 8064363 - DNA, 22 bp, Homo sapiens
tttggcaaaactgtgtctatct

SEQ ID NO: 8064364 - DNA, 22 bp, Homo sapiens
tttgttttcaatgtgtcattca

SEQ ID NO: 8064365 - DNA, 22 bp, Homo sapiens
tttgtttagatggtaaatcagt

SEQ ID NO: 8064366 - DNA, 22 bp, Homo sapiens
tttgtttagaaagagattggtg

SEQ ID NO: 8064367 - DNA, 22 bp, Homo sapiens
tttgtttagagaattgaagcag

SEQ ID NO: 8064368 - DNA, 22 bp, Homo sapiens
tttgttttcaatgtgtcattca

SEQ ID NO: 8064369 - DNA, 22 bp, Homo sapiens
ttttatcaatcattaagacatt

SEQ ID NO: 8064370 - DNA, 22 bp, Homo sapiens
ttttatatggcacattggttgg

SEQ ID NO: 8064371 - DNA, 22 bp, Homo sapiens
ttttatatggcacattggttgg

SEQ ID NO: 8064372 - DNA, 22 bp, Homo sapiens
ttttatattgagtgagagttcc

SEQ ID NO: 8064373 - DNA, 22 bp, Homo sapiens
ttttataaagagagtcagttgg

SEQ ID NO: 8064374 - DNA, 22 bp, Homo sapiens
tttgtattacaaagtcacagta

SEQ ID NO: 8064375 - DNA, 22 bp, Homo sapiens
tttgtatttttcccagctagct

SEQ ID NO: 8064376 - DNA, 22 bp, Homo sapiens
tttgtattccatatcatgccat

SEQ ID NO: 8064377 - DNA, 22 bp, Homo sapiens
tttgtttacaaaaataagcagt

SEQ ID NO: 8064378 - DNA, 22 bp, Homo sapiens
tttttgaaggctgatgtgatta

SEQ ID NO: 8064379 - DNA, 22 bp, Homo sapiens
tttttcttgtgctggatctaat

SEQ ID NO: 8064380 - DNA, 22 bp, Homo sapiens
tttttgaaggctgatgtgatta

SEQ ID NO: 8064381 - DNA, 22 bp, Homo sapiens
ttttgaaagggtgatttggctt

SEQ ID NO: 8064382 - DNA, 22 bp, Homo sapiens
ttttgaaagccaggtttgtatg

SEQ ID NO: 8064383 - DNA, 22 bp, Homo sapiens
ttttgaaagagtcctgctacag

SEQ ID NO: 8064384 - DNA, 23 bp, Homo sapiens
ttttgacaggaggaaggtgttga

SEQ ID NO: 8064385 - DNA, 22 bp, Homo sapiens
tttttcctagcgatttgtcagc

SEQ ID NO: 8064386 - DNA, 22 bp, Homo sapiens
tttttccaccgtacttcctgag

SEQ ID NO: 8064387 - DNA, 22 bp, Homo sapiens
tttttcattgcagcctctctcc

SEQ ID NO: 8064388 - DNA, 22 bp, Homo sapiens
tttttcatgagactagaagtca

SEQ ID NO: 8064389 - DNA, 22 bp, Homo sapiens
tttttcatctgattgataactc

SEQ ID NO: 8064390 - DNA, 22 bp, Homo sapiens
ttttctaacatctagtaatttg

SEQ ID NO: 8064391 - DNA, 22 bp, Homo sapiens
ttttctttaatctggtggggtg

SEQ ID NO: 8064392 - DNA, 22 bp, Homo sapiens
ttttcttctacctgctgtccaa

SEQ ID NO: 8064393 - DNA, 22 bp, Homo sapiens
tttatagtcgtctcagtaataa

SEQ ID NO: 8064394 - DNA, 22 bp, Homo sapiens
tttatagttatatacagatgtt

SEQ ID NO: 8064395 - DNA, 22 bp, Homo sapiens
tttattaaaactgttggctctg

SEQ ID NO: 8064396 - DNA, 21 bp, Homo sapiens
tttattaacaactgtggacgt

SEQ ID NO: 8064397 - DNA, 21 bp, Homo sapiens
tttattaacaactgtggacgt

SEQ ID NO: 8064398 - DNA, 22 bp, Homo sapiens
tttattaagatgcgaatgctga

SEQ ID NO: 8064399 - DNA, 22 bp, Homo sapiens
tttattaagatgcgaatgctga

SEQ ID NO: 8064400 - DNA, 22 bp, Homo sapiens
tttattaatgtagcatccatgg

SEQ ID NO: 8064401 - DNA, 22 bp, Homo sapiens
tttataaaatagactgggtcta

SEQ ID NO: 8064402 - DNA, 22 bp, Homo sapiens
tttataaacagtaccacggtgc

SEQ ID NO: 8064403 - DNA, 21 bp, Homo sapiens
tttagttcaagtacagaacca

SEQ ID NO: 8064404 - DNA, 22 bp, Homo sapiens
tttatacatggagaatttttgc

SEQ ID NO: 8064405 - DNA, 17 bp, Homo sapiens
tttataattggcctctt

SEQ ID NO: 8064406 - DNA, 22 bp, Homo sapiens
tttattattctgttctctctac

SEQ ID NO: 8064407 - DNA, 22 bp, Homo sapiens
tttattattctctggagaatgt

SEQ ID NO: 8064408 - DNA, 22 bp, Homo sapiens
tttattatccagtgttgtcatg

SEQ ID NO: 8064409 - DNA, 22 bp, Homo sapiens
tttattaattagtgacccaatg

SEQ ID NO: 8064410 - DNA, 22 bp, Homo sapiens
tttattacaccaggttaactca

SEQ ID NO: 8064411 - DNA, 23 bp, Homo sapiens
ttgtttttagaggtggcatgaga

SEQ ID NO: 8064412 - DNA, 22 bp, Homo sapiens
tttaattatatctgggcagtta

SEQ ID NO: 8064413 - DNA, 22 bp, Homo sapiens
tttaattttctgggcccagcag

SEQ ID NO: 8064414 - DNA, 22 bp, Homo sapiens
tttactttctcaagtatatagg

SEQ ID NO: 8064415 - DNA, 22 bp, Homo sapiens
tttacaacctcatattctgatg

SEQ ID NO: 8064416 - DNA, 22 bp, Homo sapiens
ttggtttgttcaccatcaagca

SEQ ID NO: 8064417 - DNA, 22 bp, Homo sapiens
ttgtctaatgagctccacttca

SEQ ID NO: 8064418 - DNA, 22 bp, Homo sapiens
ttgtctgtaaagacggccacca

SEQ ID NO: 8064419 - DNA, 22 bp, Homo sapiens
ttgtctatttgttcaggtaagg

SEQ ID NO: 8064420 - DNA, 20 bp, Homo sapiens
ttggtcagtggttcagtttg

SEQ ID NO: 8064421 - DNA, 22 bp, Homo sapiens
ttggggtgttggatggagcaag

SEQ ID NO: 8064422 - DNA, 22 bp, Homo sapiens
ttgtttctctggtcttgagtga

SEQ ID NO: 8064423 - DNA, 20 bp, Homo sapiens
ttgtttctgctattttctaa

SEQ ID NO: 8064424 - DNA, 22 bp, Homo sapiens
ttgtttctcctggtgcctgata

SEQ ID NO: 8064425 - DNA, 23 bp, Homo sapiens
ttgtttctttgtattgtctctat

SEQ ID NO: 8064426 - DNA, 17 bp, Homo sapiens
ttgtttcttctctgtgg

SEQ ID NO: 8064427 - DNA, 22 bp, Homo sapiens
ttgttacagcagtgatttcaga

SEQ ID NO: 8064428 - DNA, 22 bp, Homo sapiens
ttgtgtttctggccaagatgga

SEQ ID NO: 8064429 - DNA, 22 bp, Homo sapiens
ttgtgttaaggtgcatctagtg

SEQ ID NO: 8064430 - DNA, 19 bp, Homo sapiens
ttgtgtgtcagtcagagtt

SEQ ID NO: 8064431 - DNA, 22 bp, Homo sapiens
tttcatttcatagaattgtgtt

SEQ ID NO: 8064432 - DNA, 22 bp, Homo sapiens
tttcctcttctggcaggcaggg

SEQ ID NO: 8064433 - DNA, 20 bp, Homo sapiens
tttcaaaggcacctatgaag

SEQ ID NO: 8064434 - DNA, 22 bp, Homo sapiens
tttcaaaggaggctgagaggat

SEQ ID NO: 8064435 - DNA, 22 bp, Homo sapiens
tttcagccagtgatgctgaaga

SEQ ID NO: 8064436 - DNA, 22 bp, Homo sapiens
tttcctggaagttattcctcat

SEQ ID NO: 8064437 - DNA, 22 bp, Homo sapiens
tttctcagctgtggagcctatc

SEQ ID NO: 8064438 - DNA, 22 bp, Homo sapiens
tttctccatcaccccctcggtg

SEQ ID NO: 8064439 - DNA, 22 bp, Homo sapiens
tttctccacttctcttgccaac

SEQ ID NO: 8064440 - DNA, 22 bp, Homo sapiens
tttctccacgccagcttgctta

SEQ ID NO: 8064441 - DNA, 22 bp, Homo sapiens
tttctcatttagagtggcaggg

SEQ ID NO: 8064442 - DNA, 22 bp, Homo sapiens
tttctttaaaggaactctgttt

SEQ ID NO: 8064443 - DNA, 22 bp, Homo sapiens
tttctttaggctgtgttgccaa

SEQ ID NO: 8064444 - DNA, 22 bp, Homo sapiens
tttctttaattctcacagcaat

SEQ ID NO: 8064445 - DNA, 22 bp, Homo sapiens
tttctttatcatagcatctttg

SEQ ID NO: 8064446 - DNA, 22 bp, Homo sapiens
tttcttctctaatctcaatgat

SEQ ID NO: 8064447 - DNA, 22 bp, Homo sapiens
tttcttctgagatcagggagaa

SEQ ID NO: 8064448 - DNA, 22 bp, Homo sapiens
tttcttccttaccttactagag

SEQ ID NO: 8064449 - DNA, 22 bp, Homo sapiens
tttcttcctgctttgtcccatg

SEQ ID NO: 8064450 - DNA, 22 bp, Homo sapiens
tttcttctcacccaggacagag

SEQ ID NO: 8064451 - DNA, 22 bp, Homo sapiens
tttcttctcatccctgaaatca

SEQ ID NO: 8064452 - DNA, 22 bp, Homo sapiens
tttcttccccactgcaggctct

SEQ ID NO: 8064453 - DNA, 22 bp, Homo sapiens
tttcttccaaaggcacgttctc

SEQ ID NO: 8064454 - DNA, 22 bp, Homo sapiens
tttcttcatagaccttgtcttg

SEQ ID NO: 8064455 - DNA, 22 bp, Homo sapiens
tttctctttcaatctgcagtac

SEQ ID NO: 8064456 - DNA, 22 bp, Homo sapiens
tttctcttgcgatatgctacac

SEQ ID NO: 8064457 - DNA, 22 bp, Homo sapiens
tttctcttcactgtgtgcctca

SEQ ID NO: 8064458 - DNA, 22 bp, Homo sapiens
tttctctaaatagggaggctta

SEQ ID NO: 8064459 - DNA, 22 bp, Homo sapiens
tttctggcagcgggacaggggt

SEQ ID NO: 8064460 - DNA, 21 bp, Homo sapiens
cactcagggtatgtgccaggc

SEQ ID NO: 8064461 - DNA, 22 bp, Homo sapiens
cactcaggctgtgtcaggagga

SEQ ID NO: 8064462 - DNA, 22 bp, Homo sapiens
cactcagaggtttgattgctca

SEQ ID NO: 8064463 - DNA, 22 bp, Homo sapiens
cactagtcctggtttcatgcta

SEQ ID NO: 8064464 - DNA, 22 bp, Homo sapiens
cactccagcctcagtgacagag

SEQ ID NO: 8064465 - DNA, 21 bp, Homo sapiens
cactccacttagaacagggtt

SEQ ID NO: 8064466 - DNA, 22 bp, Homo sapiens
cactctgactggccctgcagga

SEQ ID NO: 8064467 - DNA, 22 bp, Homo sapiens
cactctgactggccctgcagga

SEQ ID NO: 8064468 - DNA, 22 bp, Homo sapiens
ggccaggctggtctcagacttc

SEQ ID NO: 8064469 - DNA, 22 bp, Homo sapiens
cacctggctggaagtgctccgg

SEQ ID NO: 8064470 - DNA, 22 bp, Homo sapiens
cacctgggctaaactatgcagg

SEQ ID NO: 8064471 - DNA, 22 bp, Homo sapiens
caccaggctggagtgcagaggt

SEQ ID NO: 8064472 - DNA, 22 bp, Homo sapiens
cacctgcctgcaggggctccac

SEQ ID NO: 8064473 - DNA, 22 bp, Homo sapiens
caccaggctgaaccagagggga

SEQ ID NO: 8064474 - DNA, 20 bp, Homo sapiens
caccaggcgctctgagaaca

SEQ ID NO: 8064475 - DNA, 20 bp, Homo sapiens
ggctctggaatctggtgggc

SEQ ID NO: 8064476 - DNA, 20 bp, Homo sapiens
ggctctgcttgtgagcagcc

SEQ ID NO: 8064477 - DNA, 22 bp, Homo sapiens
ggctctgctggtaagatgcctc

SEQ ID NO: 8064478 - DNA, 22 bp, Homo sapiens
ggctctgcttcagaaggctcat

SEQ ID NO: 8064479 - DNA, 22 bp, Homo sapiens
ggctctgcttcagaaggctcat

SEQ ID NO: 8064480 - DNA, 22 bp, Homo sapiens
ggctctgctggattgaggccag

SEQ ID NO: 8064481 - DNA, 22 bp, Homo sapiens
cactgggcaattctgagcctaa

SEQ ID NO: 8064482 - DNA, 22 bp, Homo sapiens
cacagtcctgccagagggcctt

SEQ ID NO: 8064483 - DNA, 22 bp, Homo sapiens
cacaggtgtgtgccttatcaaa

SEQ ID NO: 8064484 - DNA, 23 bp, Homo sapiens
cacaggtgtttcatcttctcagt

SEQ ID NO: 8064485 - DNA, 22 bp, Homo sapiens
cacaggtgtttgttatactcag

SEQ ID NO: 8064486 - DNA, 22 bp, Homo sapiens
cacaggtgttcttgcagtgaaa

SEQ ID NO: 8064487 - DNA, 21 bp, Homo sapiens
cacaggtgggtcagtgaggcc

SEQ ID NO: 8064488 - DNA, 22 bp, Homo sapiens
cacaggtggctccaagttagag

SEQ ID NO: 8064489 - DNA, 22 bp, Homo sapiens
cacaggtggcttctttcatctt

SEQ ID NO: 8064490 - DNA, 22 bp, Homo sapiens
cacaggtgtatgaatatgtcca

SEQ ID NO: 8064491 - DNA, 17 bp, Homo sapiens
cacaggtgtggtttgag

SEQ ID NO: 8064492 - DNA, 22 bp, Homo sapiens
cacagtgcatgatgggcagaag

SEQ ID NO: 8064493 - DNA, 22 bp, Homo sapiens
cacaggaggttaggaagtggtc

SEQ ID NO: 8064494 - DNA, 22 bp, Homo sapiens
cacagggcaggtactctcagag

SEQ ID NO: 8064495 - DNA, 22 bp, Homo sapiens
cacaggggcaaactgtagggga

SEQ ID NO: 8064496 - DNA, 22 bp, Homo sapiens
cacagggttgttctgaggattc

SEQ ID NO: 8064497 - DNA, 22 bp, Homo sapiens
cacaggtgctcctcggggagct

SEQ ID NO: 8064498 - DNA, 22 bp, Homo sapiens
cacaggtgccatctcttcatgg

SEQ ID NO: 8064499 - DNA, 20 bp, Homo sapiens
cacaggccttgtgagcagac

SEQ ID NO: 8064500 - DNA, 20 bp, Homo sapiens
cacaggccttgtgagcagac

SEQ ID NO: 8064501 - DNA, 22 bp, Homo sapiens
cacatgctccatacagaatggg

SEQ ID NO: 8064502 - DNA, 22 bp, Homo sapiens
ggcagagtggagtgcggcctcc

SEQ ID NO: 8064503 - DNA, 22 bp, Homo sapiens
caccaggagcatctaggaggcg

SEQ ID NO: 8064504 - DNA, 22 bp, Homo sapiens
caccagctttgcccactgccca

SEQ ID NO: 8064505 - DNA, 22 bp, Homo sapiens
cacatgtgtatatgtgaggggg

SEQ ID NO: 8064506 - DNA, 22 bp, Homo sapiens
cacacaggagagtgctggaggt

SEQ ID NO: 8064507 - DNA, 22 bp, Homo sapiens
ggaccagagaagtgagcacctg

SEQ ID NO: 8064508 - DNA, 22 bp, Homo sapiens
ggaccagagctcgggcttctca

SEQ ID NO: 8064509 - DNA, 22 bp, Homo sapiens
cacacaggatgaagcagcagaa

SEQ ID NO: 8064510 - DNA, 22 bp, Homo sapiens
cacacaggatgaagcagcagaa

SEQ ID NO: 8064511 - DNA, 22 bp, Homo sapiens
cacacaggtatatatatgtaca

SEQ ID NO: 8064512 - DNA, 22 bp, Homo sapiens
ggagagaggagcccactgctgt

SEQ ID NO: 8064513 - DNA, 20 bp, Homo sapiens
ggagagcagggaagacagta

SEQ ID NO: 8064514 - DNA, 22 bp, Homo sapiens
ggagaaggtgctggtcactgtg

SEQ ID NO: 8064515 - DNA, 22 bp, Homo sapiens
ggagaaggtgctggtcactgtg

SEQ ID NO: 8064516 - DNA, 22 bp, Homo sapiens
ggagaagggacagactcagctt

SEQ ID NO: 8064517 - DNA, 22 bp, Homo sapiens
ggagaagggacagactcagctt

SEQ ID NO: 8064518 - DNA, 22 bp, Homo sapiens
cacaaatccaatttaattctgg

SEQ ID NO: 8064519 - DNA, 22 bp, Homo sapiens
cacaactgccatctgagcagca

SEQ ID NO: 8064520 - DNA, 19 bp, Homo sapiens
caatatatagtgagtggat

SEQ ID NO: 8064521 - DNA, 22 bp, Homo sapiens
gctggggagctagacctcagca

SEQ ID NO: 8064522 - DNA, 22 bp, Homo sapiens
gctggggagctagacctcagca

SEQ ID NO: 8064523 - DNA, 22 bp, Homo sapiens
caaggctgcaaaactacatggg

SEQ ID NO: 8064524 - DNA, 22 bp, Homo sapiens
caaggctgtgcagggtccatat

SEQ ID NO: 8064525 - DNA, 22 bp, Homo sapiens
caaggctgctggcttctgagct

SEQ ID NO: 8064526 - DNA, 22 bp, Homo sapiens
caatagaaaactcaatacttaa

SEQ ID NO: 8064527 - DNA, 22 bp, Homo sapiens
caagctctgcgggctccaagat

SEQ ID NO: 8064528 - DNA, 22 bp, Homo sapiens
gctggggactccccaccatagc

SEQ ID NO: 8064529 - DNA, 22 bp, Homo sapiens
gctggctgaggtctagctcttt

SEQ ID NO: 8064530 - DNA, 22 bp, Homo sapiens
gctgcctgccctgggtcatctg

SEQ ID NO: 8064531 - DNA, 22 bp, Homo sapiens
gctgcctgcctagttccacagt

SEQ ID NO: 8064532 - DNA, 22 bp, Homo sapiens
gctgcctgcacagagctgcttt

SEQ ID NO: 8064533 - DNA, 18 bp, Homo sapiens
gctgcctgcattcctcac

SEQ ID NO: 8064534 - DNA, 22 bp, Homo sapiens
gctggaaggctaggctcagttg

SEQ ID NO: 8064535 - DNA, 22 bp, Homo sapiens
caagacaagatctaagcatgct

SEQ ID NO: 8064536 - DNA, 22 bp, Homo sapiens
gctgccctgtccggctctcctg

SEQ ID NO: 8064537 - DNA, 22 bp, Homo sapiens
caaattttgtgtgttctctagt

SEQ ID NO: 8064538 - DNA, 22 bp, Homo sapiens
gctgcctgatgtccagcaggac

SEQ ID NO: 8064539 - DNA, 22 bp, Homo sapiens
caaagtcctagaacagtgcttg

SEQ ID NO: 8064540 - DNA, 22 bp, Homo sapiens
caaagtcctagaacagtgcttg

SEQ ID NO: 8064541 - DNA, 22 bp, Homo sapiens
caaagtcccagctgcttagaga

SEQ ID NO: 8064542 - DNA, 22 bp, Homo sapiens
caaagtccatagtttacaatag

SEQ ID NO: 8064543 - DNA, 22 bp, Homo sapiens
caaagtcctagaacagtgcttg

SEQ ID NO: 8064544 - DNA, 22 bp, Homo sapiens
caaagtcatggggatgcaggtc

SEQ ID NO: 8064545 - DNA, 22 bp, Homo sapiens
gctctggactggggcctgagaa

SEQ ID NO: 8064546 - DNA, 22 bp, Homo sapiens
gctctggagatggagccttgag

SEQ ID NO: 8064547 - DNA, 22 bp, Homo sapiens
gctctggaagcatctgagagga

SEQ ID NO: 8064548 - DNA, 22 bp, Homo sapiens
gctctgcttgcatcatgactgc

SEQ ID NO: 8064549 - DNA, 21 bp, Homo sapiens
gctgccctggctcagcattca

SEQ ID NO: 8064550 - DNA, 22 bp, Homo sapiens
caaagtgctaggattacaggcc

SEQ ID NO: 8064551 - DNA, 22 bp, Homo sapiens
caaagtgctaggattacaggcg

SEQ ID NO: 8064552 - DNA, 22 bp, Homo sapiens
gtagaaaaagcagtaagtctca

SEQ ID NO: 8064553 - DNA, 22 bp, Homo sapiens
gtagaaaattaggatgaggctt

SEQ ID NO: 8064554 - DNA, 22 bp, Homo sapiens
gtacacagatgcttgagaatct

SEQ ID NO: 8064555 - DNA, 22 bp, Homo sapiens
gtacacagagtggtggaagaaa

SEQ ID NO: 8064556 - DNA, 22 bp, Homo sapiens
gtacacaggcagcccagtgctg

SEQ ID NO: 8064557 - DNA, 22 bp, Homo sapiens
cagcagcccacgcgtgctgtcc

SEQ ID NO: 8064558 - DNA, 22 bp, Homo sapiens
cagcagcctacaatgcacagaa

SEQ ID NO: 8064559 - DNA, 22 bp, Homo sapiens
cagcagcctacaatgcacagaa

SEQ ID NO: 8064560 - DNA, 22 bp, Homo sapiens
cagcagccatgtaccacactca

SEQ ID NO: 8064561 - DNA, 22 bp, Homo sapiens
cagcagccagacaagatacatc

SEQ ID NO: 8064562 - DNA, 22 bp, Homo sapiens
cagcaaaatttgaggattgcct

SEQ ID NO: 8064563 - DNA, 22 bp, Homo sapiens
cagcaaaggtagaagcacagga

SEQ ID NO: 8064564 - DNA, 22 bp, Homo sapiens
cagcagccactagagggctcac

SEQ ID NO: 8064565 - DNA, 22 bp, Homo sapiens
cagcagcagccccaggaaggtt

SEQ ID NO: 8064566 - DNA, 22 bp, Homo sapiens
cagatttaagagataaacagtg

SEQ ID NO: 8064567 - DNA, 22 bp, Homo sapiens
cagcatctcctgtgcagaggga

SEQ ID NO: 8064568 - DNA, 22 bp, Homo sapiens
cagcatctctgggagaagcatc

SEQ ID NO: 8064569 - DNA, 22 bp, Homo sapiens
cagcatctgttcccaacgagat

SEQ ID NO: 8064570 - DNA, 22 bp, Homo sapiens
cagccagctgtcccaagtgcct

SEQ ID NO: 8064571 - DNA, 22 bp, Homo sapiens
cagccagcttcagatccaagcc

SEQ ID NO: 8064572 - DNA, 22 bp, Homo sapiens
cagccaggacagggaaactagt

SEQ ID NO: 8064573 - DNA, 22 bp, Homo sapiens
cagccaggagcctctgcaacta

SEQ ID NO: 8064574 - DNA, 22 bp, Homo sapiens
cagccaggagcctctgcaacta

SEQ ID NO: 8064575 - DNA, 22 bp, Homo sapiens
cagccaggagctccccctgctc

SEQ ID NO: 8064576 - DNA, 22 bp, Homo sapiens
gtcagcagaaacgccacatgca

SEQ ID NO: 8064577 - DNA, 22 bp, Homo sapiens
gtcagcagtgtcagctctgggg

SEQ ID NO: 8064578 - DNA, 22 bp, Homo sapiens
gtcagcagggtccccttgagtg

SEQ ID NO: 8064579 - DNA, 21 bp, Homo sapiens
gtcagcagatccagcacttgt

SEQ ID NO: 8064580 - DNA, 22 bp, Homo sapiens
gtcacaggcctggatgaggggc

SEQ ID NO: 8064581 - DNA, 22 bp, Homo sapiens
gtcacaggcctggatgaggggc

SEQ ID NO: 8064582 - DNA, 22 bp, Homo sapiens
cagccctgtccctgagggacct

SEQ ID NO: 8064583 - DNA, 22 bp, Homo sapiens
cagccctgaaacaacctcctct

SEQ ID NO: 8064584 - DNA, 22 bp, Homo sapiens
cagccctggtgccaaggttccc

SEQ ID NO: 8064585 - DNA, 22 bp, Homo sapiens
cagccctgtccaatgtctgctc

SEQ ID NO: 8064586 - DNA, 20 bp, Homo sapiens
cagccctccagtggaggcag

SEQ ID NO: 8064587 - DNA, 22 bp, Homo sapiens
cagccctctctgggccccaagg

SEQ ID NO: 8064588 - DNA, 22 bp, Homo sapiens
cagccctctgaagaggcgcttg

SEQ ID NO: 8064589 - DNA, 23 bp, Homo sapiens
gtgagcagcaccatgaggctaga

SEQ ID NO: 8064590 - DNA, 22 bp, Homo sapiens
cagccaggcccccgagtcgttg

SEQ ID NO: 8064591 - DNA, 22 bp, Homo sapiens
gtgagagggctgggctcatgat

SEQ ID NO: 8064592 - DNA, 22 bp, Homo sapiens
ggggccttggatctgtgccccg

SEQ ID NO: 8064593 - DNA, 19 bp, Homo sapiens
ggggcctgtgatggtcaca

SEQ ID NO: 8064594 - DNA, 22 bp, Homo sapiens
ggggcctgcgaggttcaacttc

SEQ ID NO: 8064595 - DNA, 22 bp, Homo sapiens
ggggcctgcgaggttcaacttc

SEQ ID NO: 8064596 - DNA, 22 bp, Homo sapiens
ggggcctgtagagcttcaggga

SEQ ID NO: 8064597 - DNA, 22 bp, Homo sapiens
ggggcctgtagagcttcaggga

SEQ ID NO: 8064598 - DNA, 22 bp, Homo sapiens
gggtacaaagatttcataagat

SEQ ID NO: 8064599 - DNA, 22 bp, Homo sapiens
gggtaagctgctttatctctct

SEQ ID NO: 8064600 - DNA, 22 bp, Homo sapiens
gggtaattggggccttgcagtg

SEQ ID NO: 8064601 - DNA, 20 bp, Homo sapiens
ggggttggctggcacaggga

SEQ ID NO: 8064602 - DNA, 22 bp, Homo sapiens
ggggttggtttaaatgcttgag

SEQ ID NO: 8064603 - DNA, 22 bp, Homo sapiens
ggggcagagtctggactgttgt

SEQ ID NO: 8064604 - DNA, 22 bp, Homo sapiens
ggggcagatggaacagagcaca

SEQ ID NO: 8064605 - DNA, 23 bp, Homo sapiens
ggggcctgcaccggtctgcgcgg

SEQ ID NO: 8064606 - DNA, 23 bp, Homo sapiens
ggggcctgcaccggtctgcgcgg

SEQ ID NO: 8064607 - DNA, 22 bp, Homo sapiens
ggggcagagtagctggggtgtg

SEQ ID NO: 8064608 - DNA, 22 bp, Homo sapiens
ggggcagagcatagctccaatt

SEQ ID NO: 8064609 - DNA, 21 bp, Homo sapiens
ggggcagagctaggccctgca

SEQ ID NO: 8064610 - DNA, 22 bp, Homo sapiens
ggggcagaagtagtgcccctga

SEQ ID NO: 8064611 - DNA, 22 bp, Homo sapiens
ggggcagagagaaggaagcttg

SEQ ID NO: 8064612 - DNA, 22 bp, Homo sapiens
ggggcagagaataaaaacctaa

SEQ ID NO: 8064613 - DNA, 22 bp, Homo sapiens
cagagccagaactagaccttgt

SEQ ID NO: 8064614 - DNA, 22 bp, Homo sapiens
cagagccactgtctgccaggca

SEQ ID NO: 8064615 - DNA, 22 bp, Homo sapiens
gggctggaggaccggcctcgga

SEQ ID NO: 8064616 - DNA, 22 bp, Homo sapiens
cagagccagcagtggggacagg

SEQ ID NO: 8064617 - DNA, 22 bp, Homo sapiens
cagagccagcccactgttcccg

SEQ ID NO: 8064618 - DNA, 22 bp, Homo sapiens
gggctggaggagatccagaggc

SEQ ID NO: 8064619 - DNA, 22 bp, Homo sapiens
gggctgtgagagtggggctgct

SEQ ID NO: 8064620 - DNA, 22 bp, Homo sapiens
gggctgtcatgtgtcagtgacc

SEQ ID NO: 8064621 - DNA, 22 bp, Homo sapiens
gggctgtgctgagtaggaggtg

SEQ ID NO: 8064622 - DNA, 22 bp, Homo sapiens
gggctgtgggacccggcacttt

SEQ ID NO: 8064623 - DNA, 22 bp, Homo sapiens
gggctgtggagccgcgagggct

SEQ ID NO: 8064624 - DNA, 22 bp, Homo sapiens
ggtcctgcctgctgtccttcaa

SEQ ID NO: 8064625 - DNA, 23 bp, Homo sapiens
ggtcctgcccccggtcgcccaaa

SEQ ID NO: 8064626 - DNA, 22 bp, Homo sapiens
cagatgcagcaaaatgacaggc

SEQ ID NO: 8064627 - DNA, 22 bp, Homo sapiens
ggtcctgcgtctggctcgcccg

SEQ ID NO: 8064628 - DNA, 22 bp, Homo sapiens
ggtcctgcgtctggctcgcccg

SEQ ID NO: 8064629 - DNA, 19 bp, Homo sapiens
cagatgttttcagttcatt

SEQ ID NO: 8064630 - DNA, 22 bp, Homo sapiens
cagatgaggggcatataacaat

SEQ ID NO: 8064631 - DNA, 22 bp, Homo sapiens
cagatgaggacagatgactggg

SEQ ID NO: 8064632 - DNA, 22 bp, Homo sapiens
ggtcaaagggtgagatggcagg

SEQ ID NO: 8064633 - DNA, 22 bp, Homo sapiens
ggtcaaagtgaggagtcaggtt

SEQ ID NO: 8064634 - DNA, 22 bp, Homo sapiens
ggtcaaagttgaagaagggcat

SEQ ID NO: 8064635 - DNA, 22 bp, Homo sapiens
gggtccaggtcttcaggcagag

SEQ ID NO: 8064636 - DNA, 22 bp, Homo sapiens
gggtgggatctgtggagcctca

SEQ ID NO: 8064637 - DNA, 22 bp, Homo sapiens
ggtatgaattcactacttccaa

SEQ ID NO: 8064638 - DNA, 22 bp, Homo sapiens
cagagcacccaaggagcatttg

SEQ ID NO: 8064639 - DNA, 22 bp, Homo sapiens
cagagcacctgctcattgccag

SEQ ID NO: 8064640 - DNA, 22 bp, Homo sapiens
cagagcagaaacctgggtgatt

SEQ ID NO: 8064641 - DNA, 22 bp, Homo sapiens
cagagcagaagcggtcctcaca

SEQ ID NO: 8064642 - DNA, 22 bp, Homo sapiens
cagagcagaaacctgggtgatt

SEQ ID NO: 8064643 - DNA, 22 bp, Homo sapiens
cagagacagaaaatggatctag

SEQ ID NO: 8064644 - DNA, 22 bp, Homo sapiens
cagagacaatgtctctgcttgt

SEQ ID NO: 8064645 - DNA, 22 bp, Homo sapiens
cagagacaacaagtttaactat

SEQ ID NO: 8064646 - DNA, 22 bp, Homo sapiens
cagacttgacggcagctgcttt

SEQ ID NO: 8064647 - DNA, 22 bp, Homo sapiens
cagagcaggcccactgccctcc

SEQ ID NO: 8064648 - DNA, 22 bp, Homo sapiens
gggcaggggtagcattccaagt

SEQ ID NO: 8064649 - DNA, 22 bp, Homo sapiens
cagagcagtggggttggtcaga

SEQ ID NO: 8064650 - DNA, 19 bp, Homo sapiens
cagagcagtggttcctgaa

SEQ ID NO: 8064651 - DNA, 22 bp, Homo sapiens
cagagcatgaataaaagttaca

SEQ ID NO: 8064652 - DNA, 20 bp, Homo sapiens
cagagccaagagcagcatct

SEQ ID NO: 8064653 - DNA, 22 bp, Homo sapiens
cagagccaacgccacctgccca

SEQ ID NO: 8064654 - DNA, 22 bp, Homo sapiens
cagagccaaacctcagggcccg

SEQ ID NO: 8064655 - DNA, 22 bp, Homo sapiens
cagagccaaatgctgtggttat

SEQ ID NO: 8064656 - DNA, 22 bp, Homo sapiens
cagagccaaacctcagggcccg

SEQ ID NO: 8064657 - DNA, 22 bp, Homo sapiens
cagacagaaggaaggccaacat

SEQ ID NO: 8064658 - DNA, 22 bp, Homo sapiens
gggagccaaggagagaggcctt

SEQ ID NO: 8064659 - DNA, 22 bp, Homo sapiens
cagacacagcaattctgtgttg

SEQ ID NO: 8064660 - DNA, 22 bp, Homo sapiens
cagacacaccaggcccattctg

SEQ ID NO: 8064661 - DNA, 22 bp, Homo sapiens
cagacacagatatgcatatggc

SEQ ID NO: 8064662 - DNA, 22 bp, Homo sapiens
gggaggagggtgctggctaaac

SEQ ID NO: 8064663 - DNA, 21 bp, Homo sapiens
gggagctggaaactgggtgac

SEQ ID NO: 8064664 - DNA, 22 bp, Homo sapiens
gggaggcagtgctggaggctgg

SEQ ID NO: 8064665 - DNA, 19 bp, Homo sapiens
ggctggcaagtgacagtgt

SEQ ID NO: 8064666 - DNA, 22 bp, Homo sapiens
ggctggcaagtgtctgctcatg

SEQ ID NO: 8064667 - DNA, 22 bp, Homo sapiens
ggctggcactctgtccagtgtc

SEQ ID NO: 8064668 - DNA, 22 bp, Homo sapiens
ggctggcactgaggagagctct

SEQ ID NO: 8064669 - DNA, 21 bp, Homo sapiens
gagacagcccagtgccagggc

SEQ ID NO: 8064670 - DNA, 22 bp, Homo sapiens
gagacagcagggccagggcctg

SEQ ID NO: 8064671 - DNA, 22 bp, Homo sapiens
atgcttaactctgtacatagtt

SEQ ID NO: 8064672 - DNA, 22 bp, Homo sapiens
gagaaggggtgatgtgggtaat

SEQ ID NO: 8064673 - DNA, 22 bp, Homo sapiens
gagaaggggtgatgtgggtaat

SEQ ID NO: 8064674 - DNA, 22 bp, Homo sapiens
gagaagtcatttgaccacctag

SEQ ID NO: 8064675 - DNA, 22 bp, Homo sapiens
gagaaggtggacctgaaggagc

SEQ ID NO: 8064676 - DNA, 22 bp, Homo sapiens
gagaaggtggacctgaaggagc

SEQ ID NO: 8064677 - DNA, 22 bp, Homo sapiens
atgggatgcatggctgtggcca

SEQ ID NO: 8064678 - DNA, 22 bp, Homo sapiens
atgggatgaacttgatctgctt

SEQ ID NO: 8064679 - DNA, 22 bp, Homo sapiens
gagccccaccctagacattctg

SEQ ID NO: 8064680 - DNA, 22 bp, Homo sapiens
gagccccaggacagctctagtt

SEQ ID NO: 8064681 - DNA, 22 bp, Homo sapiens
gagccctccatggagccaggca

SEQ ID NO: 8064682 - DNA, 19 bp, Homo sapiens
gagccctctccatggccac

SEQ ID NO: 8064683 - DNA, 22 bp, Homo sapiens
gagccctctctgtaggcaagta

SEQ ID NO: 8064684 - DNA, 22 bp, Homo sapiens
gagctgagttacctccagatca

SEQ ID NO: 8064685 - DNA, 22 bp, Homo sapiens
gagctgcagacttgatacagga

SEQ ID NO: 8064686 - DNA, 22 bp, Homo sapiens
gagctgcagacatagataagcg

SEQ ID NO: 8064687 - DNA, 22 bp, Homo sapiens
gagcacagctggaggtagcatt

SEQ ID NO: 8064688 - DNA, 19 bp, Homo sapiens
gagcacagcggcatttggt

SEQ ID NO: 8064689 - DNA, 22 bp, Homo sapiens
gagcacagccaaagtaagaagg

SEQ ID NO: 8064690 - DNA, 22 bp, Homo sapiens
gagcacaggctttggtggacac

SEQ ID NO: 8064691 - DNA, 22 bp, Homo sapiens
atgggagaaacatcatgaggca

SEQ ID NO: 8064692 - DNA, 22 bp, Homo sapiens
atgggaggaagagaagatgtct

SEQ ID NO: 8064693 - DNA, 22 bp, Homo sapiens
atgggagtgacagggccactgg

SEQ ID NO: 8064694 - DNA, 22 bp, Homo sapiens
atgggagttttctctgatgctc

SEQ ID NO: 8064695 - DNA, 22 bp, Homo sapiens
atgggagggtggaaaggctctg

SEQ ID NO: 8064696 - DNA, 22 bp, Homo sapiens
atgggcagcagctgccattcat

SEQ ID NO: 8064697 - DNA, 22 bp, Homo sapiens
gaggttagaggtcagtgcagtc

SEQ ID NO: 8064698 - DNA, 22 bp, Homo sapiens
atgttatagttataaaatgagg

SEQ ID NO: 8064699 - DNA, 22 bp, Homo sapiens
atgttacatagtccttatttgt

SEQ ID NO: 8064700 - DNA, 22 bp, Homo sapiens
atgttaaaaaccagtacagttg

SEQ ID NO: 8064701 - DNA, 22 bp, Homo sapiens
atgtcacttttctccctgctgg

SEQ ID NO: 8064702 - DNA, 22 bp, Homo sapiens
atgtcactgtgaggcagctgtc

SEQ ID NO: 8064703 - DNA, 22 bp, Homo sapiens
atgtgccaacgtgcaggtttgt

SEQ ID NO: 8064704 - DNA, 22 bp, Homo sapiens
atgtgccacatgatattgtctc

SEQ ID NO: 8064705 - DNA, 22 bp, Homo sapiens
atgtgccaatttatagaggctc

SEQ ID NO: 8064706 - DNA, 22 bp, Homo sapiens
atgtgccagtgccaggtctcta

SEQ ID NO: 8064707 - DNA, 22 bp, Homo sapiens
atgtgccatctactgtcccaag

SEQ ID NO: 8064708 - DNA, 19 bp, Homo sapiens
atgtgcccaggggaaagaa

SEQ ID NO: 8064709 - DNA, 22 bp, Homo sapiens
atgagaggtttcgtcagaggaa

SEQ ID NO: 8064710 - DNA, 22 bp, Homo sapiens
atgagaggtttcgtcagaggaa

SEQ ID NO: 8064711 - DNA, 23 bp, Homo sapiens
atgacactcctgtgcgcaccctg

SEQ ID NO: 8064712 - DNA, 23 bp, Homo sapiens
atgacactcctgtgcgcaccctg

SEQ ID NO: 8064713 - DNA, 22 bp, Homo sapiens
ctttgcctcctagagcacgttc

SEQ ID NO: 8064714 - DNA, 20 bp, Homo sapiens
ctttgcctattctctgcctg

SEQ ID NO: 8064715 - DNA, 22 bp, Homo sapiens
ctttgcttctccaacctgctca

SEQ ID NO: 8064716 - DNA, 19 bp, Homo sapiens
ctttgcttgtttctgtgtc

SEQ ID NO: 8064717 - DNA, 21 bp, Homo sapiens
atctttattacgcagagaaga

SEQ ID NO: 8064718 - DNA, 22 bp, Homo sapiens
atctttatttattgagcactta

SEQ ID NO: 8064719 - DNA, 22 bp, Homo sapiens
atctttcaatcaggaaaaatct

SEQ ID NO: 8064720 - DNA, 18 bp, Homo sapiens
atctttccatagcatgtt

SEQ ID NO: 8064721 - DNA, 22 bp, Homo sapiens
atctttctccatatacatcttt

SEQ ID NO: 8064722 - DNA, 22 bp, Homo sapiens
cttctcctctgagtcctgggag

SEQ ID NO: 8064723 - DNA, 22 bp, Homo sapiens
cttctccctgggggctctttat

SEQ ID NO: 8064724 - DNA, 22 bp, Homo sapiens
cttctcccaagtatgcagtttg

SEQ ID NO: 8064725 - DNA, 22 bp, Homo sapiens
ctttattagatgtagactttct

SEQ ID NO: 8064726 - DNA, 22 bp, Homo sapiens
gaatttcctctaaacccctgag

SEQ ID NO: 8064727 - DNA, 22 bp, Homo sapiens
gaatttggggtgtgttatttca

SEQ ID NO: 8064728 - DNA, 22 bp, Homo sapiens
atgcctggatttgggactcaaa

SEQ ID NO: 8064729 - DNA, 22 bp, Homo sapiens
atgctaaatccagaagcagtca

SEQ ID NO: 8064730 - DNA, 22 bp, Homo sapiens
atgctaaatggccagtaccaaa

SEQ ID NO: 8064731 - DNA, 22 bp, Homo sapiens
atgctaaaggggtaggcctcct

SEQ ID NO: 8064732 - DNA, 22 bp, Homo sapiens
atgctaaagctttgctttcatt

SEQ ID NO: 8064733 - DNA, 22 bp, Homo sapiens
atgctaatgagctaaggagtcc

SEQ ID NO: 8064734 - DNA, 22 bp, Homo sapiens
atgctaatgtttgtggaagata

SEQ ID NO: 8064735 - DNA, 22 bp, Homo sapiens
atgctaattccatgagcacagg

SEQ ID NO: 8064736 - DNA, 22 bp, Homo sapiens
atgctaaatgttaatgttacct

SEQ ID NO: 8064737 - DNA, 22 bp, Homo sapiens
atgctaaattcagacagggtta

SEQ ID NO: 8064738 - DNA, 23 bp, Homo sapiens
atgctctgggctgtgggacctgc

SEQ ID NO: 8064739 - DNA, 22 bp, Homo sapiens
atgctctgggcaggagccctgg

SEQ ID NO: 8064740 - DNA, 22 bp, Homo sapiens
atgctgcctcctcttcagccgc

SEQ ID NO: 8064741 - DNA, 22 bp, Homo sapiens
atgccactgcactccagcctgg

SEQ ID NO: 8064742 - DNA, 22 bp, Homo sapiens
atgccactgcactccagcctag

SEQ ID NO: 8064743 - DNA, 22 bp, Homo sapiens
gaagtctgctgctcaggagttt

SEQ ID NO: 8064744 - DNA, 22 bp, Homo sapiens
gaagtctggctgacgagagtta

SEQ ID NO: 8064745 - DNA, 22 bp, Homo sapiens
gaagtctgactctttgtaagct

SEQ ID NO: 8064746 - DNA, 22 bp, Homo sapiens
atgatgtcatgaatatattagt

SEQ ID NO: 8064747 - DNA, 22 bp, Homo sapiens
atgagctcatccgagtcacact

SEQ ID NO: 8064748 - DNA, 22 bp, Homo sapiens
atgagctgggccatccagtgat

SEQ ID NO: 8064749 - DNA, 22 bp, Homo sapiens
atgagcaggaagagcacaaaga

SEQ ID NO: 8064750 - DNA, 22 bp, Homo sapiens
caaagactgcataacacatgaa

SEQ ID NO: 8064751 - DNA, 22 bp, Homo sapiens
caaagacacgggaaacaacgtt

SEQ ID NO: 8064752 - DNA, 22 bp, Homo sapiens
caaagaagagatttacagagct

SEQ ID NO: 8064753 - DNA, 22 bp, Homo sapiens
gctcccagggcagcgcagaaga

SEQ ID NO: 8064754 - DNA, 22 bp, Homo sapiens
gctcccagttcccaaagtgacc

SEQ ID NO: 8064755 - DNA, 22 bp, Homo sapiens
attttgctggtctgaattactt

SEQ ID NO: 8064756 - DNA, 22 bp, Homo sapiens
gccttccagaatacacatagca

SEQ ID NO: 8064757 - DNA, 17 bp, Homo sapiens
gccttccagcatgtggg

SEQ ID NO: 8064758 - DNA, 22 bp, Homo sapiens
attttcctctggtttccccaga

SEQ ID NO: 8064759 - DNA, 20 bp, Homo sapiens
gccttccagttcagtggcac

SEQ ID NO: 8064760 - DNA, 22 bp, Homo sapiens
gccttcccaccctgcgaggctg

SEQ ID NO: 8064761 - DNA, 22 bp, Homo sapiens
gccttcctgcagctctgagcgt

SEQ ID NO: 8064762 - DNA, 22 bp, Homo sapiens
attttccatctccacaccaggg

SEQ ID NO: 8064763 - DNA, 22 bp, Homo sapiens
atttgtctaatgagtgtgtact

SEQ ID NO: 8064764 - DNA, 22 bp, Homo sapiens
atttgtatcttctaatattatc

SEQ ID NO: 8064765 - DNA, 22 bp, Homo sapiens
atttgtagtgaagtgaaaataa

SEQ ID NO: 8064766 - DNA, 22 bp, Homo sapiens
atttgtatatttaagagggtag

SEQ ID NO: 8064767 - DNA, 22 bp, Homo sapiens
atttgtatcaatctcaatatat

SEQ ID NO: 8064768 - DNA, 22 bp, Homo sapiens
atttggttactcagttgtctga

SEQ ID NO: 8064769 - DNA, 22 bp, Homo sapiens
atttcttcctctgtcagtaact

SEQ ID NO: 8064770 - DNA, 22 bp, Homo sapiens
atttggaatgtgtttgatcacc

SEQ ID NO: 8064771 - DNA, 22 bp, Homo sapiens
atttcttccattgcctcttcaa

SEQ ID NO: 8064772 - DNA, 22 bp, Homo sapiens
gcccaggtttcatctgctccgt

SEQ ID NO: 8064773 - DNA, 22 bp, Homo sapiens
atttcaaggctattaatataaa

SEQ ID NO: 8064774 - DNA, 22 bp, Homo sapiens
gccatgactctccataccaaag

SEQ ID NO: 8064775 - DNA, 22 bp, Homo sapiens
gccatcctctgagcactaggca

SEQ ID NO: 8064776 - DNA, 22 bp, Homo sapiens
gccatcctggattcagaccaaa

SEQ ID NO: 8064777 - DNA, 22 bp, Homo sapiens
atttcttacataacaaattgtt

SEQ ID NO: 8064778 - DNA, 22 bp, Homo sapiens
atttcttatctgaggtctacat

SEQ ID NO: 8064779 - DNA, 22 bp, Homo sapiens
atttcttcaggttcttctagga

SEQ ID NO: 8064780 - DNA, 22 bp, Homo sapiens
atttcttcaggtcagaaataga

SEQ ID NO: 8064781 - DNA, 22 bp, Homo sapiens
gccctgtcccttggcttctagg

SEQ ID NO: 8064782 - DNA, 22 bp, Homo sapiens
gccagccagggaagggagagac

SEQ ID NO: 8064783 - DNA, 22 bp, Homo sapiens
gccagccagagtggctgtgtgt

SEQ ID NO: 8064784 - DNA, 22 bp, Homo sapiens
gccagccagtttgctgatggct

SEQ ID NO: 8064785 - DNA, 18 bp, Homo sapiens
atttatgctaatgggata

SEQ ID NO: 8064786 - DNA, 22 bp, Homo sapiens
atttattacctcggagtttctg

SEQ ID NO: 8064787 - DNA, 22 bp, Homo sapiens
gccatcatatcccctgtgacct

SEQ ID NO: 8064788 - DNA, 22 bp, Homo sapiens
gccagctggagtgagagtgggc

SEQ ID NO: 8064789 - DNA, 22 bp, Homo sapiens
atttagtttaggaaaagtaggt

SEQ ID NO: 8064790 - DNA, 22 bp, Homo sapiens
atttatattttgggagctcctg

SEQ ID NO: 8064791 - DNA, 22 bp, Homo sapiens
atttatctctggaaactaagca

SEQ ID NO: 8064792 - DNA, 22 bp, Homo sapiens
gcagcttggatttctgtagttt

SEQ ID NO: 8064793 - DNA, 22 bp, Homo sapiens
gcagcttggtgaaaggtgatgg

SEQ ID NO: 8064794 - DNA, 22 bp, Homo sapiens
gcaggcaggagcccaactgcct

SEQ ID NO: 8064795 - DNA, 22 bp, Homo sapiens
gcaggcaggagcccaactgcct

SEQ ID NO: 8064796 - DNA, 22 bp, Homo sapiens
gcaggcaggcttccttgaactg

SEQ ID NO: 8064797 - DNA, 22 bp, Homo sapiens
gcagctgtgggttccaagtcta

SEQ ID NO: 8064798 - DNA, 19 bp, Homo sapiens
attcatttttgccttctaa

SEQ ID NO: 8064799 - DNA, 22 bp, Homo sapiens
attccaaaaggatgttagaatg

SEQ ID NO: 8064800 - DNA, 22 bp, Homo sapiens
attccaaagacagaagcagctg

SEQ ID NO: 8064801 - DNA, 22 bp, Homo sapiens
attccaaacagtgctgcagact

SEQ ID NO: 8064802 - DNA, 22 bp, Homo sapiens
attcacaaaatgatatagatac

SEQ ID NO: 8064803 - DNA, 22 bp, Homo sapiens
attccacacagtaatactcaat

SEQ ID NO: 8064804 - DNA, 22 bp, Homo sapiens
attccacaagaccataaattag

SEQ ID NO: 8064805 - DNA, 22 bp, Homo sapiens
attccaaggtctttctagattg

SEQ ID NO: 8064806 - DNA, 22 bp, Homo sapiens
attccaaaggctggcctggagg

SEQ ID NO: 8064807 - DNA, 22 bp, Homo sapiens
attccaaagcacatcagaacta

SEQ ID NO: 8064808 - DNA, 22 bp, Homo sapiens
attccacagaggactccgattg

SEQ ID NO: 8064809 - DNA, 17 bp, Homo sapiens
attccacagggaatctg

SEQ ID NO: 8064810 - DNA, 22 bp, Homo sapiens
attccacaggagctggttttct

SEQ ID NO: 8064811 - DNA, 22 bp, Homo sapiens
attccacagctcagcctctctt

SEQ ID NO: 8064812 - DNA, 22 bp, Homo sapiens
attccacagctacgttttgagc

SEQ ID NO: 8064813 - DNA, 22 bp, Homo sapiens
attccacagtgccttccgtgaa

SEQ ID NO: 8064814 - DNA, 22 bp, Homo sapiens
attccacagtgtgtggtgagga

SEQ ID NO: 8064815 - DNA, 22 bp, Homo sapiens
attccacataggccttcatgac

SEQ ID NO: 8064816 - DNA, 22 bp, Homo sapiens
attctggaaagctattctctct

SEQ ID NO: 8064817 - DNA, 20 bp, Homo sapiens
gcaggcagggaatgggggtg

SEQ ID NO: 8064818 - DNA, 22 bp, Homo sapiens
gcatgcttttatatctgtttaa

SEQ ID NO: 8064819 - DNA, 19 bp, Homo sapiens
gcatcagagcagaaggggt

SEQ ID NO: 8064820 - DNA, 22 bp, Homo sapiens
gcatcagcaccaaccttccagg

SEQ ID NO: 8064821 - DNA, 19 bp, Homo sapiens
gcatcagagcagaaggggt

SEQ ID NO: 8064822 - DNA, 22 bp, Homo sapiens
gcaggtgtggagtggggtgagc

SEQ ID NO: 8064823 - DNA, 22 bp, Homo sapiens
gcacagggcctggcacataaga

SEQ ID NO: 8064824 - DNA, 22 bp, Homo sapiens
gcaccaggaggcccttctcatc

SEQ ID NO: 8064825 - DNA, 22 bp, Homo sapiens
gcacacagactaaccatatttc

SEQ ID NO: 8064826 - DNA, 22 bp, Homo sapiens
gcacacagattaggaaacagaa

SEQ ID NO: 8064827 - DNA, 22 bp, Homo sapiens
attatatttgaaaggttggaag

SEQ ID NO: 8064828 - DNA, 22 bp, Homo sapiens
attatattgagtataaccagag

SEQ ID NO: 8064829 - DNA, 22 bp, Homo sapiens
attatataggacttgcccttcc

SEQ ID NO: 8064830 - DNA, 22 bp, Homo sapiens
gcacccagaataaggacaggac

SEQ ID NO: 8064831 - DNA, 22 bp, Homo sapiens
attcaagtggctgctatgttaa

SEQ ID NO: 8064832 - DNA, 22 bp, Homo sapiens
gcagagactagtagtgcagact

SEQ ID NO: 8064833 - DNA, 22 bp, Homo sapiens
gcagagactccactgtcttgtg

SEQ ID NO: 8064834 - DNA, 22 bp, Homo sapiens
gatgtggggttgagggaccagc

SEQ ID NO: 8064835 - DNA, 22 bp, Homo sapiens
gatgtgagtggtagctgggatt

SEQ ID NO: 8064836 - DNA, 22 bp, Homo sapiens
gattcttacttctaagcaagct

SEQ ID NO: 8064837 - DNA, 22 bp, Homo sapiens
gagtggggcgtggatccagcgt

SEQ ID NO: 8064838 - DNA, 22 bp, Homo sapiens
gagtggggcccactgctgggtg

SEQ ID NO: 8064839 - DNA, 22 bp, Homo sapiens
gagtggggaaagccaggacaga

SEQ ID NO: 8064840 - DNA, 22 bp, Homo sapiens
gatggcaggtagtggtctcatc

SEQ ID NO: 8064841 - DNA, 22 bp, Homo sapiens
gatggcaggtagtggtctcatc

SEQ ID NO: 8064842 - DNA, 22 bp, Homo sapiens
gatggcagtcaaccaggtgagg

SEQ ID NO: 8064843 - DNA, 22 bp, Homo sapiens
aggtctggtgagagcaggtgct

SEQ ID NO: 8064844 - DNA, 22 bp, Homo sapiens
aggtctggtgttgggcctgaaa

SEQ ID NO: 8064845 - DNA, 22 bp, Homo sapiens
aggtattattagcatctctatt

SEQ ID NO: 8064846 - DNA, 22 bp, Homo sapiens
aggtgcttggctcgtgcacaca

SEQ ID NO: 8064847 - DNA, 22 bp, Homo sapiens
aggtgcttggctcgtgcacaca

SEQ ID NO: 8064848 - DNA, 22 bp, Homo sapiens
cctgggtgtcatgggcagctgg

SEQ ID NO: 8064849 - DNA, 23 bp, Homo sapiens
aggtgcactgtggtggcagtggc

SEQ ID NO: 8064850 - DNA, 22 bp, Homo sapiens
aggtgcagaaaaaagtccttta

SEQ ID NO: 8064851 - DNA, 22 bp, Homo sapiens
aggtgagtgtgactgcaagaga

SEQ ID NO: 8064852 - DNA, 22 bp, Homo sapiens
aggtgagttggtaggaagtttg

SEQ ID NO: 8064853 - DNA, 22 bp, Homo sapiens
aggtgagttacaggaggaggtc

SEQ ID NO: 8064854 - DNA, 22 bp, Homo sapiens
aggtgagttacaggaggaggtc

SEQ ID NO: 8064855 - DNA, 22 bp, Homo sapiens
aggtgatgtccacagcttgcag

SEQ ID NO: 8064856 - DNA, 19 bp, Homo sapiens
aggtgatgtgactctagaa

SEQ ID NO: 8064857 - DNA, 22 bp, Homo sapiens
cctgggcagggctggactctca

SEQ ID NO: 8064858 - DNA, 22 bp, Homo sapiens
cctgggcagggagaccaggctc

SEQ ID NO: 8064859 - DNA, 22 bp, Homo sapiens
cctgggcaggatgggcccggtg

SEQ ID NO: 8064860 - DNA, 22 bp, Homo sapiens
cctgggcaggccggacgctggg

SEQ ID NO: 8064861 - DNA, 22 bp, Homo sapiens
cctgggcaggtgtggcttcccc

SEQ ID NO: 8064862 - DNA, 22 bp, Homo sapiens
cctggctcaaggcgaggactcc

SEQ ID NO: 8064863 - DNA, 22 bp, Homo sapiens
cctggagcccctctggccagcc

SEQ ID NO: 8064864 - DNA, 22 bp, Homo sapiens
agggtggccaccaagtatgtca

SEQ ID NO: 8064865 - DNA, 22 bp, Homo sapiens
agggtggccatgagggagagat

SEQ ID NO: 8064866 - DNA, 22 bp, Homo sapiens
cctggccttaagggcagggagc

SEQ ID NO: 8064867 - DNA, 22 bp, Homo sapiens
agggtggcaccacatatcatag

SEQ ID NO: 8064868 - DNA, 20 bp, Homo sapiens
agggtggcaagttagtgaca

SEQ ID NO: 8064869 - DNA, 22 bp, Homo sapiens
agggtggcacctggaagggatg

SEQ ID NO: 8064870 - DNA, 22 bp, Homo sapiens
agggtggcagttactggagcaa

SEQ ID NO: 8064871 - DNA, 22 bp, Homo sapiens
cctgcctgcggcccgcggggag

SEQ ID NO: 8064872 - DNA, 22 bp, Homo sapiens
aggggctgtggaaaccaactct

SEQ ID NO: 8064873 - DNA, 18 bp, Homo sapiens
cctggacctgtctccttt

SEQ ID NO: 8064874 - DNA, 22 bp, Homo sapiens
cctggagcaggagctgcagagg

SEQ ID NO: 8064875 - DNA, 22 bp, Homo sapiens
cctgcctgctttctgctttgca

SEQ ID NO: 8064876 - DNA, 22 bp, Homo sapiens
cctgcctgcgtcctctgagggc

SEQ ID NO: 8064877 - DNA, 22 bp, Homo sapiens
cctgcctggatcagccatcctg

SEQ ID NO: 8064878 - DNA, 22 bp, Homo sapiens
cctgcctggagctgagtgtgga

SEQ ID NO: 8064879 - DNA, 22 bp, Homo sapiens
aggtgtggcttgaagtctctat

SEQ ID NO: 8064880 - DNA, 22 bp, Homo sapiens
aggtggggttcagtctcagccg

SEQ ID NO: 8064881 - DNA, 22 bp, Homo sapiens
aggttgggatgagtgggtgagc

SEQ ID NO: 8064882 - DNA, 22 bp, Homo sapiens
cctttatactaaggcatacaat

SEQ ID NO: 8064883 - DNA, 22 bp, Homo sapiens
cgcctggaacctctaggaccag

SEQ ID NO: 8064884 - DNA, 22 bp, Homo sapiens
cgcctgctctgtttccatgtgg

SEQ ID NO: 8064885 - DNA, 22 bp, Homo sapiens
cgcctgctctcactggacagct

SEQ ID NO: 8064886 - DNA, 22 bp, Homo sapiens
agtaatgattatgtacagaatg

SEQ ID NO: 8064887 - DNA, 21 bp, Homo sapiens
ctacacagctttctataggaa

SEQ ID NO: 8064888 - DNA, 20 bp, Homo sapiens
ctacacagggttcgctgggc

SEQ ID NO: 8064889 - DNA, 22 bp, Homo sapiens
ctacacagttctgcctaatggc

SEQ ID NO: 8064890 - DNA, 22 bp, Homo sapiens
agtcagttaacctcacagcatc

SEQ ID NO: 8064891 - DNA, 22 bp, Homo sapiens
agtcataaagccagtgggaggc

SEQ ID NO: 8064892 - DNA, 22 bp, Homo sapiens
agtcagtgttctgggttgtaat

SEQ ID NO: 8064893 - DNA, 23 bp, Homo sapiens
agtcagagcagaagggctgcttg

SEQ ID NO: 8064894 - DNA, 22 bp, Homo sapiens
agtcagagaatgttttcatgga

SEQ ID NO: 8064895 - DNA, 22 bp, Homo sapiens
agtcactttatgagagaaccat

SEQ ID NO: 8064896 - DNA, 22 bp, Homo sapiens
agtcagagttttgaggtgtgac

SEQ ID NO: 8064897 - DNA, 22 bp, Homo sapiens
ctacacagagcctacttctgca

SEQ ID NO: 8064898 - DNA, 22 bp, Homo sapiens
agtcagagtctattgctgtggt

SEQ ID NO: 8064899 - DNA, 17 bp, Homo sapiens
agtcagaggagtatctg

SEQ ID NO: 8064900 - DNA, 22 bp, Homo sapiens
cgtgccactgcactctagcctg

SEQ ID NO: 8064901 - DNA, 22 bp, Homo sapiens
cgtgcgcctcagcctcgtgcgc

SEQ ID NO: 8064902 - DNA, 22 bp, Homo sapiens
cgtgccactgcactctagcctg

SEQ ID NO: 8064903 - DNA, 22 bp, Homo sapiens
cgtggcctttgagtgagctccc

SEQ ID NO: 8064904 - DNA, 22 bp, Homo sapiens
ctaaacaatgaacaaagcactg

SEQ ID NO: 8064905 - DNA, 22 bp, Homo sapiens
ctaaacaagggattataattga

SEQ ID NO: 8064906 - DNA, 22 bp, Homo sapiens
ctccagggagctgcgggagcca

SEQ ID NO: 8064907 - DNA, 22 bp, Homo sapiens
ctccagggagctgcgggagcca

SEQ ID NO: 8064908 - DNA, 22 bp, Homo sapiens
ctccagttggccccagttggtt

SEQ ID NO: 8064909 - DNA, 22 bp, Homo sapiens
agtgactgacacctgtaatccc

SEQ ID NO: 8064910 - DNA, 22 bp, Homo sapiens
agtgactgggcagggcagggcc

SEQ ID NO: 8064911 - DNA, 22 bp, Homo sapiens
ctcctccctgcgattgctctgc

SEQ ID NO: 8064912 - DNA, 22 bp, Homo sapiens
ctcctccctctttgccacacat

SEQ ID NO: 8064913 - DNA, 22 bp, Homo sapiens
ctcccaggttacatctgagcct

SEQ ID NO: 8064914 - DNA, 22 bp, Homo sapiens
ctcccagggtagggagagacta

SEQ ID NO: 8064915 - DNA, 22 bp, Homo sapiens
agtgcagccgagatcaggtgct

SEQ ID NO: 8064916 - DNA, 22 bp, Homo sapiens
agtcttaactatgcaagtacta

SEQ ID NO: 8064917 - DNA, 22 bp, Homo sapiens
agtcttaatagagaaaaactgt

SEQ ID NO: 8064918 - DNA, 23 bp, Homo sapiens
agtctgtgcttggtgggagggcc

SEQ ID NO: 8064919 - DNA, 22 bp, Homo sapiens
agtccaaagcagatgagggcca

SEQ ID NO: 8064920 - DNA, 22 bp, Homo sapiens
agtcattttgccagtcttcagg

SEQ ID NO: 8064921 - DNA, 22 bp, Homo sapiens
agtctgcattcacagcaattat

SEQ ID NO: 8064922 - DNA, 22 bp, Homo sapiens
ctctctggtacatagagtttgg

SEQ ID NO: 8064923 - DNA, 18 bp, Homo sapiens
ctctctgggtgaggacaa

SEQ ID NO: 8064924 - DNA, 22 bp, Homo sapiens
ctctctggcttggcacggagat

SEQ ID NO: 8064925 - DNA, 22 bp, Homo sapiens
ctctctgggggccatgccaaga

SEQ ID NO: 8064926 - DNA, 22 bp, Homo sapiens
ctctgagacttttcacctccca

SEQ ID NO: 8064927 - DNA, 22 bp, Homo sapiens
ctctgagaggctgccctgccat

SEQ ID NO: 8064928 - DNA, 22 bp, Homo sapiens
ctctgagaagccttgatgggga

SEQ ID NO: 8064929 - DNA, 22 bp, Homo sapiens
ctctgagaagagttcaagtaaa

SEQ ID NO: 8064930 - DNA, 22 bp, Homo sapiens
ctctgagaaagctgtgagctaa

SEQ ID NO: 8064931 - DNA, 22 bp, Homo sapiens
ctctgagactcaagtgagtggg

SEQ ID NO: 8064932 - DNA, 22 bp, Homo sapiens
ctctgagacttagcatctacat

SEQ ID NO: 8064933 - DNA, 22 bp, Homo sapiens
ctgagagcatcgctggagatag

SEQ ID NO: 8064934 - DNA, 22 bp, Homo sapiens
ctgagaaagtgagggttaaaca

SEQ ID NO: 8064935 - DNA, 22 bp, Homo sapiens
agtggggaggtccaggccaccc

SEQ ID NO: 8064936 - DNA, 22 bp, Homo sapiens
agtggggaagagcatgggccct

SEQ ID NO: 8064937 - DNA, 22 bp, Homo sapiens
agtggggacttatgccagcatt

SEQ ID NO: 8064938 - DNA, 22 bp, Homo sapiens
agtgtctgaactgggtgctgac

SEQ ID NO: 8064939 - DNA, 22 bp, Homo sapiens
agtgtctgaacctgcagtggga

SEQ ID NO: 8064940 - DNA, 23 bp, Homo sapiens
agtgtctgagtgcaggctgtgca

SEQ ID NO: 8064941 - DNA, 22 bp, Homo sapiens
ctcttaatgaccttaattcaag

SEQ ID NO: 8064942 - DNA, 22 bp, Homo sapiens
agtgtctgccaactgcatggtc

SEQ ID NO: 8064943 - DNA, 22 bp, Homo sapiens
agtgtctgccagctgccaggtg

SEQ ID NO: 8064944 - DNA, 22 bp, Homo sapiens
atattttgaagttaataatgtg

SEQ ID NO: 8064945 - DNA, 22 bp, Homo sapiens
ctgtcatttaagacattctgga

SEQ ID NO: 8064946 - DNA, 22 bp, Homo sapiens
ctgtatttagttaaaatgctaa

SEQ ID NO: 8064947 - DNA, 22 bp, Homo sapiens
ctggggcagagcctttagcaaa

SEQ ID NO: 8064948 - DNA, 19 bp, Homo sapiens
ctggtcctgactgaggggt

SEQ ID NO: 8064949 - DNA, 22 bp, Homo sapiens
ctggggcagagcctttagcaaa

SEQ ID NO: 8064950 - DNA, 22 bp, Homo sapiens
ctggtggggagtcctggtctcc

SEQ ID NO: 8064951 - DNA, 22 bp, Homo sapiens
ctggtggcaatgaggcgtcact

SEQ ID NO: 8064952 - DNA, 22 bp, Homo sapiens
ctggggaggcagggctgcccct

SEQ ID NO: 8064953 - DNA, 22 bp, Homo sapiens
ctggggagtgaaggtaattaca

SEQ ID NO: 8064954 - DNA, 22 bp, Homo sapiens
ctgggctgtggtgtggcccaaa

SEQ ID NO: 8064955 - DNA, 22 bp, Homo sapiens
ctgggctgtcaatggccctctg

SEQ ID NO: 8064956 - DNA, 22 bp, Homo sapiens
ctgggccagggaggtgtctgta

SEQ ID NO: 8064957 - DNA, 22 bp, Homo sapiens
ctgggcagtttacattcctacc

SEQ ID NO: 8064958 - DNA, 22 bp, Homo sapiens
ctgggcctgggaggccaggtct

SEQ ID NO: 8064959 - DNA, 22 bp, Homo sapiens
atatcaaagctagtggaaattt

SEQ ID NO: 8064960 - DNA, 22 bp, Homo sapiens
atatattttttgagacagagtc

SEQ ID NO: 8064961 - DNA, 22 bp, Homo sapiens
atatattttgcggtcacgtggc

SEQ ID NO: 8064962 - DNA, 22 bp, Homo sapiens
cttcagaattcctcagcctcag

SEQ ID NO: 8064963 - DNA, 22 bp, Homo sapiens
atccttcagtggaagacagtag

SEQ ID NO: 8064964 - DNA, 22 bp, Homo sapiens
atccttcaattagaaccaattg

SEQ ID NO: 8064965 - DNA, 22 bp, Homo sapiens
cttcagtttatcccatcatcca

SEQ ID NO: 8064966 - DNA, 21 bp, Homo sapiens
atctggaaattctgccagaga

SEQ ID NO: 8064967 - DNA, 22 bp, Homo sapiens
cttcatgagggtaatctacaaa

SEQ ID NO: 8064968 - DNA, 22 bp, Homo sapiens
ctgttatttgagagtgttgaat

SEQ ID NO: 8064969 - DNA, 22 bp, Homo sapiens
ctgtttatctaggagttgcagg

SEQ ID NO: 8064970 - DNA, 22 bp, Homo sapiens
ctgtttattacgtaattaatat

SEQ ID NO: 8064971 - DNA, 22 bp, Homo sapiens
ctgtttatggaggtaaggcatc

SEQ ID NO: 8064972 - DNA, 20 bp, Homo sapiens
ctgtttattagaagtggatt

SEQ ID NO: 8064973 - DNA, 22 bp, Homo sapiens
ctgtttattctcatctaaaatg

SEQ ID NO: 8064974 - DNA, 22 bp, Homo sapiens
ctgtttattgagcaatctgcca

SEQ ID NO: 8064975 - DNA, 22 bp, Homo sapiens
ctgtgggagcacatgacagata

SEQ ID NO: 8064976 - DNA, 22 bp, Homo sapiens
atcaggaattaggtgagatgga

SEQ ID NO: 8064977 - DNA, 22 bp, Homo sapiens
atcaggatcagggctagcagag

SEQ ID NO: 8064978 - DNA, 22 bp, Homo sapiens
atcaggaatcttttgtcagaca

SEQ ID NO: 8064979 - DNA, 20 bp, Homo sapiens
atcaggaagagagactgacc

SEQ ID NO: 8064980 - DNA, 22 bp, Homo sapiens
ctgtgcctggggggcagagctg

SEQ ID NO: 8064981 - DNA, 22 bp, Homo sapiens
ctgtgcctgccttgttcactga

SEQ ID NO: 8064982 - DNA, 22 bp, Homo sapiens
ctgtgccttggcgctgtgccac

SEQ ID NO: 8064983 - DNA, 22 bp, Homo sapiens
ctgtgcctaagatgcatgtctc

SEQ ID NO: 8064984 - DNA, 22 bp, Homo sapiens
ctgtgcctaagatgcatgtctc

SEQ ID NO: 8064985 - DNA, 22 bp, Homo sapiens
agtgttcatttattcattcact

SEQ ID NO: 8064986 - DNA, 22 bp, Homo sapiens
agtgttagtgaaaggtgtttat

SEQ ID NO: 8064987 - DNA, 22 bp, Homo sapiens
agtgttagattcttactcagtt

SEQ ID NO: 8064988 - DNA, 22 bp, Homo sapiens
ctgagttctaggctgccacctt

SEQ ID NO: 8064989 - DNA, 22 bp, Homo sapiens
agttttattccaatgtgcagca

SEQ ID NO: 8064990 - DNA, 22 bp, Homo sapiens
agtttcagttctgtcatttata

SEQ ID NO: 8064991 - DNA, 22 bp, Homo sapiens
ataagtttgtctttgtaaagat

SEQ ID NO: 8064992 - DNA, 22 bp, Homo sapiens
ctgccctgtgagggtccttggg

SEQ ID NO: 8064993 - DNA, 22 bp, Homo sapiens
ctgccctgtctttttctgatga

SEQ ID NO: 8064994 - DNA, 22 bp, Homo sapiens
ctgccctgtggctctgagtcat

SEQ ID NO: 8064995 - DNA, 22 bp, Homo sapiens
ctgcctgcttaccatgcatcag

SEQ ID NO: 8064996 - DNA, 22 bp, Homo sapiens
ctgcctgctgcctgtggagggt

SEQ ID NO: 8064997 - DNA, 18 bp, Homo sapiens
ctgcctgctctccagctt

SEQ ID NO: 8064998 - DNA, 18 bp, Homo sapiens
ctgcctgctctccagctt

SEQ ID NO: 8064999 - DNA, 22 bp, Homo sapiens
ctgcctgctgattagtattgtc

SEQ ID NO: 8065000 - DNA, 22 bp, Homo sapiens
ctgcctgctgacattctttata

SEQ ID NO: 8065001 - DNA, 22 bp, Homo sapiens
ctgccctctagaggaggactga

SEQ ID NO: 8065002 - DNA, 22 bp, Homo sapiens
atacatctatgcctttctgaca

SEQ ID NO: 8065003 - DNA, 22 bp, Homo sapiens
ctggaagacgtttgaagccatg

SEQ ID NO: 8065004 - DNA, 22 bp, Homo sapiens
ctggaagaactccagttctgtg

SEQ ID NO: 8065005 - DNA, 22 bp, Homo sapiens
ctggaacacctgagttaccact

SEQ ID NO: 8065006 - DNA, 21 bp, Homo sapiens
ctggaacaaatactagcaaac

SEQ ID NO: 8065007 - DNA, 22 bp, Homo sapiens
ctggaacaagtggccttgcaag

SEQ ID NO: 8065008 - DNA, 22 bp, Homo sapiens
ctggagctggcttccttccact

SEQ ID NO: 8065009 - DNA, 22 bp, Homo sapiens
ataatttacaactgcttttaat

SEQ ID NO: 8065010 - DNA, 22 bp, Homo sapiens
ataatggtagatgtccacgcag

SEQ ID NO: 8065011 - DNA, 20 bp, Homo sapiens
atagaatcacaagtcctgaa

SEQ ID NO: 8065012 - DNA, 22 bp, Homo sapiens
atagaaaacagatgtccttaaa

SEQ ID NO: 8065013 - DNA, 22 bp, Homo sapiens
atagacgcggccgctgatgcag

SEQ ID NO: 8065014 - DNA, 22 bp, Homo sapiens
atagacattttgcattcaagca

SEQ ID NO: 8065015 - DNA, 22 bp, Homo sapiens
atagaatcatctgtgcactagt

SEQ ID NO: 8065016 - DNA, 22 bp, Homo sapiens
ccacagcttcgcagtctgctgc

SEQ ID NO: 8065017 - DNA, 22 bp, Homo sapiens
aggcaggggagctggaagggta

SEQ ID NO: 8065018 - DNA, 22 bp, Homo sapiens
ccagagcagatgtggccttggt

SEQ ID NO: 8065019 - DNA, 22 bp, Homo sapiens
ccagagcagatgtggccttggt

SEQ ID NO: 8065020 - DNA, 22 bp, Homo sapiens
ccagagtctttatattcctgaa

SEQ ID NO: 8065021 - DNA, 22 bp, Homo sapiens
ccagcagaggcatcatccttcc

SEQ ID NO: 8065022 - DNA, 22 bp, Homo sapiens
aggccagagaggggaccagcct

SEQ ID NO: 8065023 - DNA, 19 bp, Homo sapiens
ccagcagaagccactcctg

SEQ ID NO: 8065024 - DNA, 19 bp, Homo sapiens
ccagcagacacagctgccc

SEQ ID NO: 8065025 - DNA, 18 bp, Homo sapiens
aggccctggcctcgaaca

SEQ ID NO: 8065026 - DNA, 22 bp, Homo sapiens
ccaggacaagtgtggccatggc

SEQ ID NO: 8065027 - DNA, 22 bp, Homo sapiens
aggccctgggcagttctgtagc

SEQ ID NO: 8065028 - DNA, 22 bp, Homo sapiens
aggccctggcactgcctgggag

SEQ ID NO: 8065029 - DNA, 22 bp, Homo sapiens
ccagcttgtttgaagctcgtca

SEQ ID NO: 8065030 - DNA, 22 bp, Homo sapiens
ccagcttgaagatgtgctggtt

SEQ ID NO: 8065031 - DNA, 22 bp, Homo sapiens
ccagcctggactgggtcttgtg

SEQ ID NO: 8065032 - DNA, 22 bp, Homo sapiens
ccagcctcatcgcctgcctgtc

SEQ ID NO: 8065033 - DNA, 22 bp, Homo sapiens
ccagcctccatgtagatagctg

SEQ ID NO: 8065034 - DNA, 22 bp, Homo sapiens
ccagcctgaaatgcctcatcct

SEQ ID NO: 8065035 - DNA, 23 bp, Homo sapiens
ccagcctctgggtcttcatccag

SEQ ID NO: 8065036 - DNA, 22 bp, Homo sapiens
ccagcctgaaatgcctcatcct

SEQ ID NO: 8065037 - DNA, 22 bp, Homo sapiens
aggctctgtgacaatcaagctg

SEQ ID NO: 8065038 - DNA, 22 bp, Homo sapiens
aggctctgtcaggcggagcagc

SEQ ID NO: 8065039 - DNA, 22 bp, Homo sapiens
cccagagcatgtgctgcctttg

SEQ ID NO: 8065040 - DNA, 22 bp, Homo sapiens
cccagagccgctcccctacttc

SEQ ID NO: 8065041 - DNA, 19 bp, Homo sapiens
cccagagcatcctgaactt

SEQ ID NO: 8065042 - DNA, 19 bp, Homo sapiens
cccagagcatcctgaactt

SEQ ID NO: 8065043 - DNA, 23 bp, Homo sapiens
cccagagcacagcctccagatgc

SEQ ID NO: 8065044 - DNA, 17 bp, Homo sapiens
aggctggctcacaggga

SEQ ID NO: 8065045 - DNA, 22 bp, Homo sapiens
aggctcagcctgggcctagagc

SEQ ID NO: 8065046 - DNA, 22 bp, Homo sapiens
aggctcagtatagctggcaagt

SEQ ID NO: 8065047 - DNA, 22 bp, Homo sapiens
aggctccaccagtcaggtgcat

SEQ ID NO: 8065048 - DNA, 22 bp, Homo sapiens
aggctccaccagtcaggtgcat

SEQ ID NO: 8065049 - DNA, 22 bp, Homo sapiens
aggctccaccctacagagctcc

SEQ ID NO: 8065050 - DNA, 22 bp, Homo sapiens
aggctccaccccgccagacctt

SEQ ID NO: 8065051 - DNA, 22 bp, Homo sapiens
aggctccaccccgccagacctt

SEQ ID NO: 8065052 - DNA, 22 bp, Homo sapiens
aggctccaccctacagagctcc

SEQ ID NO: 8065053 - DNA, 22 bp, Homo sapiens
aggctcattcttgcctctgagc

SEQ ID NO: 8065054 - DNA, 16 bp, Homo sapiens
aggctccaagagctgt

SEQ ID NO: 8065055 - DNA, 23 bp, Homo sapiens
aggctccacatgggcactttgca

SEQ ID NO: 8065056 - DNA, 22 bp, Homo sapiens
aggctccaagaggttaagtcac

SEQ ID NO: 8065057 - DNA, 22 bp, Homo sapiens
aggctccaaattaccaagctct

SEQ ID NO: 8065058 - DNA, 22 bp, Homo sapiens
ccagggtgaggaggctcccacg

SEQ ID NO: 8065059 - DNA, 22 bp, Homo sapiens
ccagggtgagaaaaggctggat

SEQ ID NO: 8065060 - DNA, 22 bp, Homo sapiens
ccagggtcttggagaggagtgc

SEQ ID NO: 8065061 - DNA, 22 bp, Homo sapiens
ccagggagcctggtgtgtcagc

SEQ ID NO: 8065062 - DNA, 22 bp, Homo sapiens
ccagggagcggggctgggtctc

SEQ ID NO: 8065063 - DNA, 22 bp, Homo sapiens
cctcctggaaaaattccctggc

SEQ ID NO: 8065064 - DNA, 22 bp, Homo sapiens
cctcctgcacctccaggaactc

SEQ ID NO: 8065065 - DNA, 22 bp, Homo sapiens
cctcctgcactgcaagcttgag

SEQ ID NO: 8065066 - DNA, 22 bp, Homo sapiens
cctcctgcacttgctttccttc

SEQ ID NO: 8065067 - DNA, 22 bp, Homo sapiens
cctcctgcggcgtccgcgctct

SEQ ID NO: 8065068 - DNA, 22 bp, Homo sapiens
cctctgggaagccagtcctgct

SEQ ID NO: 8065069 - DNA, 22 bp, Homo sapiens
cctctggcttactgttgggttt

SEQ ID NO: 8065070 - DNA, 22 bp, Homo sapiens
agggctgcaggcaagatatggc

SEQ ID NO: 8065071 - DNA, 22 bp, Homo sapiens
cctctgggagactgctactgag

SEQ ID NO: 8065072 - DNA, 22 bp, Homo sapiens
cctctgggcggagatctgctgc

SEQ ID NO: 8065073 - DNA, 22 bp, Homo sapiens
aggggacacggcttctccaggg

SEQ ID NO: 8065074 - DNA, 21 bp, Homo sapiens
aggggacagagtagctccagg

SEQ ID NO: 8065075 - DNA, 22 bp, Homo sapiens
aggggctgcctggcttggcact

SEQ ID NO: 8065076 - DNA, 22 bp, Homo sapiens
aggggctgctgggtccgcccct

SEQ ID NO: 8065077 - DNA, 22 bp, Homo sapiens
aggggctggagttcgaggttac

SEQ ID NO: 8065078 - DNA, 22 bp, Homo sapiens
aggggctggagttcgaggttac

SEQ ID NO: 8065079 - DNA, 22 bp, Homo sapiens
aggggctggcttatctgagagt

SEQ ID NO: 8065080 - DNA, 22 bp, Homo sapiens
aggggctgggacagagccaagc

SEQ ID NO: 8065081 - DNA, 22 bp, Homo sapiens
aggggctgggacagagccaagc

SEQ ID NO: 8065082 - DNA, 22 bp, Homo sapiens
agggctctggggtggcagagat

SEQ ID NO: 8065083 - DNA, 22 bp, Homo sapiens
agggctctgagtgggaaagagg

SEQ ID NO: 8065084 - DNA, 22 bp, Homo sapiens
agggctctgtccccagaggccc

SEQ ID NO: 8065085 - DNA, 22 bp, Homo sapiens
cctcctctgtgcagctgtgggt

SEQ ID NO: 8065086 - DNA, 22 bp, Homo sapiens
agggccctccccgctcagggca

SEQ ID NO: 8065087 - DNA, 22 bp, Homo sapiens
agggccctctggcaggccaggc

SEQ ID NO: 8065088 - DNA, 22 bp, Homo sapiens
agggccagaggcaccttgcagc

SEQ ID NO: 8065089 - DNA, 22 bp, Homo sapiens
agggccagaatccctcagtcta

SEQ ID NO: 8065090 - DNA, 22 bp, Homo sapiens
ccctggaggcaaaggttgcagt

SEQ ID NO: 8065091 - DNA, 22 bp, Homo sapiens
ccctggaggcggatgttgcagt

SEQ ID NO: 8065092 - DNA, 22 bp, Homo sapiens
ccctggagggacagctgctcta

SEQ ID NO: 8065093 - DNA, 22 bp, Homo sapiens
ccctttcccttctggctcaggg

SEQ ID NO: 8065094 - DNA, 22 bp, Homo sapiens
cccttcagtgcgtgagaatgag

SEQ ID NO: 8065095 - DNA, 22 bp, Homo sapiens
cccttcagtgctaggctgcctg

SEQ ID NO: 8065096 - DNA, 22 bp, Homo sapiens
cccttcagtgctaggctgcctg

SEQ ID NO: 8065097 - DNA, 22 bp, Homo sapiens
agggaaattaatgtgagcaatg

SEQ ID NO: 8065098 - DNA, 22 bp, Homo sapiens
agggaagaaaatccatcgctgc

SEQ ID NO: 8065099 - DNA, 22 bp, Homo sapiens
agggaagaaaatccatcgctgc

SEQ ID NO: 8065100 - DNA, 22 bp, Homo sapiens
cccagggcttttctcactagac

SEQ ID NO: 8065101 - DNA, 22 bp, Homo sapiens
aggctggctgacttctgaagca

SEQ ID NO: 8065102 - DNA, 22 bp, Homo sapiens
aggcttcctggaggaagaggta

SEQ ID NO: 8065103 - DNA, 22 bp, Homo sapiens
aggcttcctcgtgccttagata

SEQ ID NO: 8065104 - DNA, 22 bp, Homo sapiens
agggcagagacatgcttcctga

SEQ ID NO: 8065105 - DNA, 22 bp, Homo sapiens
agggcagagagatgaatgggat

SEQ ID NO: 8065106 - DNA, 22 bp, Homo sapiens
agggcagagcactgaattggga

SEQ ID NO: 8065107 - DNA, 22 bp, Homo sapiens
agggcagagattaattaagaca

SEQ ID NO: 8065108 - DNA, 22 bp, Homo sapiens
agggcagagatctgagtgggca

SEQ ID NO: 8065109 - DNA, 22 bp, Homo sapiens
ccctggaggagcttagagcttg

SEQ ID NO: 8065110 - DNA, 22 bp, Homo sapiens
ccctggaaggttctctggctca

SEQ ID NO: 8065111 - DNA, 20 bp, Homo sapiens
agggcagagggattacaggc

SEQ ID NO: 8065112 - DNA, 22 bp, Homo sapiens
agggcagaggcggacacggaag

SEQ ID NO: 8065113 - DNA, 22 bp, Homo sapiens
agggcagagctgtctaaatggc

SEQ ID NO: 8065114 - DNA, 22 bp, Homo sapiens
agggatggatcttggccctgga

SEQ ID NO: 8065115 - DNA, 22 bp, Homo sapiens
agggatggcaagttaacctgag

SEQ ID NO: 8065116 - DNA, 22 bp, Homo sapiens
ccctctgacctcctgccacagt

SEQ ID NO: 8065117 - DNA, 22 bp, Homo sapiens
ccctctggctcttctcaggccg

SEQ ID NO: 8065118 - DNA, 22 bp, Homo sapiens
agggactggctctctgagcagg

SEQ ID NO: 8065119 - DNA, 22 bp, Homo sapiens
agggactgagctaggatctagt

SEQ ID NO: 8065120 - DNA, 22 bp, Homo sapiens
agggagaacagttgcagcagac

SEQ ID NO: 8065121 - DNA, 22 bp, Homo sapiens
agggagaaaattggatgcacaa

SEQ ID NO: 8065122 - DNA, 22 bp, Homo sapiens
agggagaagagaacaaagccct

SEQ ID NO: 8065123 - DNA, 22 bp, Homo sapiens
agggagtgtaaatggtgctcag

SEQ ID NO: 8065124 - DNA, 22 bp, Homo sapiens
agggatggagcccagctgttct

SEQ ID NO: 8065125 - DNA, 22 bp, Homo sapiens
agggatggaagctcgtctgcaa

SEQ ID NO: 8065126 - DNA, 22 bp, Homo sapiens
agctgcagaggtttgtgcaaca

SEQ ID NO: 8065127 - DNA, 22 bp, Homo sapiens
agctgcagaggtttgtgcaaca

SEQ ID NO: 8065128 - DNA, 18 bp, Homo sapiens
agctgcagaccaggaggt

SEQ ID NO: 8065129 - DNA, 22 bp, Homo sapiens
caggaaggaccgtccagatcag

SEQ ID NO: 8065130 - DNA, 22 bp, Homo sapiens
agctgcagtgaactgttttgtc

SEQ ID NO: 8065131 - DNA, 22 bp, Homo sapiens
agctgccaagttggagtagcaa

SEQ ID NO: 8065132 - DNA, 22 bp, Homo sapiens
agctgccacagagcctggccag

SEQ ID NO: 8065133 - DNA, 22 bp, Homo sapiens
agctgccacatgcccaagggca

SEQ ID NO: 8065134 - DNA, 22 bp, Homo sapiens
cagctgaattcttcagactcca

SEQ ID NO: 8065135 - DNA, 22 bp, Homo sapiens
agctgattccactttttcccca

SEQ ID NO: 8065136 - DNA, 22 bp, Homo sapiens
cagctgagaccagaatgcaggt

SEQ ID NO: 8065137 - DNA, 18 bp, Homo sapiens
agctggccctggctgccg

SEQ ID NO: 8065138 - DNA, 22 bp, Homo sapiens
caggccagcttcctgacatcct

SEQ ID NO: 8065139 - DNA, 22 bp, Homo sapiens
caggccagcttcctgacatcct

SEQ ID NO: 8065140 - DNA, 22 bp, Homo sapiens
caggccagcagggcctccgtgg

SEQ ID NO: 8065141 - DNA, 22 bp, Homo sapiens
caggccagggagaatatgaagc

SEQ ID NO: 8065142 - DNA, 22 bp, Homo sapiens
caggcactgtgctagatccttg

SEQ ID NO: 8065143 - DNA, 22 bp, Homo sapiens
caggaggattgcttgaggccag

SEQ ID NO: 8065144 - DNA, 22 bp, Homo sapiens
caggaggaggtgaggtagaact

SEQ ID NO: 8065145 - DNA, 21 bp, Homo sapiens
agctgccaccctagcttctga

SEQ ID NO: 8065146 - DNA, 22 bp, Homo sapiens
caggaggagcattagcgtctca

SEQ ID NO: 8065147 - DNA, 22 bp, Homo sapiens
caggggctagcacttaatgttt

SEQ ID NO: 8065148 - DNA, 22 bp, Homo sapiens
caggggctccctgggtgccagt

SEQ ID NO: 8065149 - DNA, 22 bp, Homo sapiens
cagggcctcctaaggcatctaa

SEQ ID NO: 8065150 - DNA, 23 bp, Homo sapiens
cagggccaggcagcagctgtcac

SEQ ID NO: 8065151 - DNA, 22 bp, Homo sapiens
cagggcctccccggcagtcttt

SEQ ID NO: 8065152 - DNA, 22 bp, Homo sapiens
cagggcctgagggctgctctgc

SEQ ID NO: 8065153 - DNA, 22 bp, Homo sapiens
cagggcctctcctccaggaact

SEQ ID NO: 8065154 - DNA, 22 bp, Homo sapiens
caggtcctggcatcaggcaggt

SEQ ID NO: 8065155 - DNA, 22 bp, Homo sapiens
cagggtgcgccactcagatgta

SEQ ID NO: 8065156 - DNA, 22 bp, Homo sapiens
cagggtgccaaagaacaaatat

SEQ ID NO: 8065157 - DNA, 22 bp, Homo sapiens
cagggtgcctcccgctcgccgg

SEQ ID NO: 8065158 - DNA, 22 bp, Homo sapiens
cagggtgcctgtcctcagcaaa

SEQ ID NO: 8065159 - DNA, 22 bp, Homo sapiens
caggggctctgggtgatgtgag

SEQ ID NO: 8065160 - DNA, 22 bp, Homo sapiens
caggggctctaatgcatgatca

SEQ ID NO: 8065161 - DNA, 22 bp, Homo sapiens
caggggctgtggcacatggtgt

SEQ ID NO: 8065162 - DNA, 22 bp, Homo sapiens
cagggtgactgccctggccact

SEQ ID NO: 8065163 - DNA, 22 bp, Homo sapiens
cagggtgcagtgtcgctgctag

SEQ ID NO: 8065164 - DNA, 22 bp, Homo sapiens
cagggagaaatctccaggaggt

SEQ ID NO: 8065165 - DNA, 22 bp, Homo sapiens
caggctggagttacctttaggg

SEQ ID NO: 8065166 - DNA, 22 bp, Homo sapiens
caggctggagtgcagtggtgcc

SEQ ID NO: 8065167 - DNA, 22 bp, Homo sapiens
cagggatgggatggagtcagtt

SEQ ID NO: 8065168 - DNA, 18 bp, Homo sapiens
agctggggcctctggtcc

SEQ ID NO: 8065169 - DNA, 22 bp, Homo sapiens
caggctcagtcagaaaatgtat

SEQ ID NO: 8065170 - DNA, 22 bp, Homo sapiens
agctgtgattatccactggaat

SEQ ID NO: 8065171 - DNA, 22 bp, Homo sapiens
agctgtgaccttcaagagctac

SEQ ID NO: 8065172 - DNA, 22 bp, Homo sapiens
caggctgcggtcggctctggtc

SEQ ID NO: 8065173 - DNA, 22 bp, Homo sapiens
aggcactgtgcagtcccaagca

SEQ ID NO: 8065174 - DNA, 22 bp, Homo sapiens
aggcactgtgctgatgtcttat

SEQ ID NO: 8065175 - DNA, 22 bp, Homo sapiens
cattaaattccttgttctcaaa

SEQ ID NO: 8065176 - DNA, 22 bp, Homo sapiens
cattaaattccttgttctcaaa

SEQ ID NO: 8065177 - DNA, 22 bp, Homo sapiens
cattaaatatcaacctagacta

SEQ ID NO: 8065178 - DNA, 22 bp, Homo sapiens
catttgaaattcttagaacaaa

SEQ ID NO: 8065179 - DNA, 19 bp, Homo sapiens
aggcagcaggccagggatg

SEQ ID NO: 8065180 - DNA, 21 bp, Homo sapiens
aggcagcaggatccagggaca

SEQ ID NO: 8065181 - DNA, 22 bp, Homo sapiens
aggcagcagggccactggctga

SEQ ID NO: 8065182 - DNA, 23 bp, Homo sapiens
aggcagcaggttgtccagggtga

SEQ ID NO: 8065183 - DNA, 22 bp, Homo sapiens
ccaaaggccaggcactgaggtt

SEQ ID NO: 8065184 - DNA, 21 bp, Homo sapiens
ccaaaggctatgtatcttctg

SEQ ID NO: 8065185 - DNA, 22 bp, Homo sapiens
ccaaaggcggaactgagtctct

SEQ ID NO: 8065186 - DNA, 22 bp, Homo sapiens
ccaagcctagtcgtgcacacag

SEQ ID NO: 8065187 - DNA, 22 bp, Homo sapiens
ccaagcaggatattctgtgtca

SEQ ID NO: 8065188 - DNA, 22 bp, Homo sapiens
ccaagtcctgctgccactctac

SEQ ID NO: 8065189 - DNA, 20 bp, Homo sapiens
ccaataaagctctataggga

SEQ ID NO: 8065190 - DNA, 22 bp, Homo sapiens
ccaagggctgctgaggtgtcca

SEQ ID NO: 8065191 - DNA, 22 bp, Homo sapiens
ccaagggctctgacttgcctgc

SEQ ID NO: 8065192 - DNA, 20 bp, Homo sapiens
aggaggggatagaatcaaag

SEQ ID NO: 8065193 - DNA, 22 bp, Homo sapiens
catgctaaaatatctgaagatt

SEQ ID NO: 8065194 - DNA, 21 bp, Homo sapiens
aggagggcacaaggccaggaa

SEQ ID NO: 8065195 - DNA, 22 bp, Homo sapiens
catggcagaaacctgagctgct

SEQ ID NO: 8065196 - DNA, 22 bp, Homo sapiens
catggcagaaacctgagctgct

SEQ ID NO: 8065197 - DNA, 22 bp, Homo sapiens
catggaattttctaggcataaa

SEQ ID NO: 8065198 - DNA, 22 bp, Homo sapiens
catggaatggttgaatgacgaa

SEQ ID NO: 8065199 - DNA, 22 bp, Homo sapiens
catgctaaaccagaacatagga

SEQ ID NO: 8065200 - DNA, 22 bp, Homo sapiens
catggggagacacctagggaaa

SEQ ID NO: 8065201 - DNA, 22 bp, Homo sapiens
catgggggtctggacaacaggc

SEQ ID NO: 8065202 - DNA, 22 bp, Homo sapiens
aggcactgcagattacaggcgc

SEQ ID NO: 8065203 - DNA, 22 bp, Homo sapiens
catgtatagttggaactacatc

SEQ ID NO: 8065204 - DNA, 18 bp, Homo sapiens
catgggtgacaggtggat

SEQ ID NO: 8065205 - DNA, 21 bp, Homo sapiens
cagtgctcaggaatagagaga

SEQ ID NO: 8065206 - DNA, 22 bp, Homo sapiens
cagtgcctcaggccagcctgca

SEQ ID NO: 8065207 - DNA, 19 bp, Homo sapiens
aggactctggaggcatgag

SEQ ID NO: 8065208 - DNA, 22 bp, Homo sapiens
cagtggccatggtggcaggggt

SEQ ID NO: 8065209 - DNA, 22 bp, Homo sapiens
caggtgcagctggatggaagcc

SEQ ID NO: 8065210 - DNA, 22 bp, Homo sapiens
caggtgggaccatgatagggca

SEQ ID NO: 8065211 - DNA, 22 bp, Homo sapiens
caggtgggagccacagcgtaca

SEQ ID NO: 8065212 - DNA, 22 bp, Homo sapiens
caggtgggagccacagcgtaca

SEQ ID NO: 8065213 - DNA, 22 bp, Homo sapiens
caggtgggaccatgatagggca

SEQ ID NO: 8065214 - DNA, 22 bp, Homo sapiens
caggtggcttctctgcagcctt

SEQ ID NO: 8065215 - DNA, 22 bp, Homo sapiens
caggtgggagcgaggagctact

SEQ ID NO: 8065216 - DNA, 22 bp, Homo sapiens
caggtgggagcgaggagctact

SEQ ID NO: 8065217 - DNA, 22 bp, Homo sapiens
caggtgggagcggagactgatt

SEQ ID NO: 8065218 - DNA, 22 bp, Homo sapiens
caggtgggagcggagactgatt

SEQ ID NO: 8065219 - DNA, 22 bp, Homo sapiens
aggacaggattgagctgaactg

SEQ ID NO: 8065220 - DNA, 22 bp, Homo sapiens
aggaccaacatagcagcagtgg

SEQ ID NO: 8065221 - DNA, 22 bp, Homo sapiens
aggaccagtatgagagcatctg

SEQ ID NO: 8065222 - DNA, 22 bp, Homo sapiens
aggaccctgagcgggcatgccg

SEQ ID NO: 8065223 - DNA, 22 bp, Homo sapiens
aggacccagaggcagaggacgt

SEQ ID NO: 8065224 - DNA, 22 bp, Homo sapiens
aggacctgactggctcctgctt

SEQ ID NO: 8065225 - DNA, 22 bp, Homo sapiens
aggacctgtacctcagcatcta

SEQ ID NO: 8065226 - DNA, 22 bp, Homo sapiens
aggacctgtagggcctgcatcc

SEQ ID NO: 8065227 - DNA, 22 bp, Homo sapiens
catataaatacaacatgtgtta

SEQ ID NO: 8065228 - DNA, 22 bp, Homo sapiens
catataaatacaacatgtgtta

SEQ ID NO: 8065229 - DNA, 22 bp, Homo sapiens
catattaaggtctgtaaggggt

SEQ ID NO: 8065230 - DNA, 22 bp, Homo sapiens
catatttatagatctggcattt

SEQ ID NO: 8065231 - DNA, 22 bp, Homo sapiens
catatttattcttctgccagtg

SEQ ID NO: 8065232 - DNA, 22 bp, Homo sapiens
cagtggtgaagagcaggggctc

SEQ ID NO: 8065233 - DNA, 22 bp, Homo sapiens
cagtggtggaatgaggaattgt

SEQ ID NO: 8065234 - DNA, 22 bp, Homo sapiens
cagtttcagaatcaaaacatca

SEQ ID NO: 8065235 - DNA, 22 bp, Homo sapiens
agctgagagcccctgccctgtg

SEQ ID NO: 8065236 - DNA, 22 bp, Homo sapiens
agctgactctggcctctggtcc

SEQ ID NO: 8065237 - DNA, 22 bp, Homo sapiens
agctgactgatgaagaggcctt

SEQ ID NO: 8065238 - DNA, 22 bp, Homo sapiens
agctgacttcttgatccaatga

SEQ ID NO: 8065239 - DNA, 22 bp, Homo sapiens
agctgaaggctagaacagctgg

SEQ ID NO: 8065240 - DNA, 22 bp, Homo sapiens
acagctggcaggggggcatgaa

SEQ ID NO: 8065241 - DNA, 22 bp, Homo sapiens
agctgagaggtggcaagctgta

SEQ ID NO: 8065242 - DNA, 22 bp, Homo sapiens
acagctgtatccccagagctca

SEQ ID NO: 8065243 - DNA, 22 bp, Homo sapiens
acagctgggtgctgctcagagc

SEQ ID NO: 8065244 - DNA, 22 bp, Homo sapiens
agctggaggggccagcaggtgt

SEQ ID NO: 8065245 - DNA, 22 bp, Homo sapiens
acaggcacaggtgtgccccacc

SEQ ID NO: 8065246 - DNA, 22 bp, Homo sapiens
agctggcagagcatttgtggcc

SEQ ID NO: 8065247 - DNA, 22 bp, Homo sapiens
acaggagggacaccttcctgct

SEQ ID NO: 8065248 - DNA, 22 bp, Homo sapiens
acaggcagcaaaatcagcctca

SEQ ID NO: 8065249 - DNA, 22 bp, Homo sapiens
acaggcagggacctcttgagtt

SEQ ID NO: 8065250 - DNA, 22 bp, Homo sapiens
acaggggattgattggaagtct

SEQ ID NO: 8065251 - DNA, 22 bp, Homo sapiens
acaggggaatttactgtcatta

SEQ ID NO: 8065252 - DNA, 22 bp, Homo sapiens
aggaagaatgtttacatatcaa

SEQ ID NO: 8065253 - DNA, 22 bp, Homo sapiens
aggacacagctcttcagtaaga

SEQ ID NO: 8065254 - DNA, 22 bp, Homo sapiens
aggacacacttctgaggtcttt

SEQ ID NO: 8065255 - DNA, 18 bp, Homo sapiens
acagtaaagaaaggaatt

SEQ ID NO: 8065256 - DNA, 22 bp, Homo sapiens
acagtaaataatgcatgttgat

SEQ ID NO: 8065257 - DNA, 22 bp, Homo sapiens
acagtaaaacatttttattagg

SEQ ID NO: 8065258 - DNA, 19 bp, Homo sapiens
aggagcactgccagcacca

SEQ ID NO: 8065259 - DNA, 22 bp, Homo sapiens
aggagcactaattcctgcagag

SEQ ID NO: 8065260 - DNA, 22 bp, Homo sapiens
aggagcactgagccagcatggg

SEQ ID NO: 8065261 - DNA, 22 bp, Homo sapiens
acagtcctagctgcaaagaagt

SEQ ID NO: 8065262 - DNA, 20 bp, Homo sapiens
acagtcctgcactggtgttt

SEQ ID NO: 8065263 - DNA, 22 bp, Homo sapiens
acagtcctgtacaggccatatc

SEQ ID NO: 8065264 - DNA, 22 bp, Homo sapiens
acagtcctgttgtcaaagcaat

SEQ ID NO: 8065265 - DNA, 22 bp, Homo sapiens
acagtccttgtgtggaacatta

SEQ ID NO: 8065266 - DNA, 22 bp, Homo sapiens
acagtccttgtttcggtcagat

SEQ ID NO: 8065267 - DNA, 20 bp, Homo sapiens
acagtcgcctatcaaccagg

SEQ ID NO: 8065268 - DNA, 22 bp, Homo sapiens
acagtcctaagataattgtctc

SEQ ID NO: 8065269 - DNA, 23 bp, Homo sapiens
acagtgtctgctgcaagatatct

SEQ ID NO: 8065270 - DNA, 22 bp, Homo sapiens
acagtgtgacaattgtgtcaga

SEQ ID NO: 8065271 - DNA, 22 bp, Homo sapiens
acagtgtgcaagaaatggggga

SEQ ID NO: 8065272 - DNA, 22 bp, Homo sapiens
acagtgtgatgggcctgcctga

SEQ ID NO: 8065273 - DNA, 16 bp, Homo sapiens
acagtgtgctaagcat

SEQ ID NO: 8065274 - DNA, 21 bp, Homo sapiens
acagtgtgcttctctccctcc

SEQ ID NO: 8065275 - DNA, 22 bp, Homo sapiens
acagtgtgggacattaggaaat

SEQ ID NO: 8065276 - DNA, 22 bp, Homo sapiens
acagtgtggaaagtcaacttga

SEQ ID NO: 8065277 - DNA, 22 bp, Homo sapiens
acagtgtggggtgagatggaac

SEQ ID NO: 8065278 - DNA, 22 bp, Homo sapiens
acagtgtggtgatggcacttgc

SEQ ID NO: 8065279 - DNA, 22 bp, Homo sapiens
acagtgtggtttgagcactggg

SEQ ID NO: 8065280 - DNA, 22 bp, Homo sapiens
acagtgtgtcctaaaggtctgg

SEQ ID NO: 8065281 - DNA, 22 bp, Homo sapiens
acagtgtgtgctttcccttacg

SEQ ID NO: 8065282 - DNA, 22 bp, Homo sapiens
acagtgtgtgggaaatgtgact

SEQ ID NO: 8065283 - DNA, 22 bp, Homo sapiens
acagtgtggttgtttctggtta

SEQ ID NO: 8065284 - DNA, 23 bp, Homo sapiens
acagtgtggtggacaaggagcag

SEQ ID NO: 8065285 - DNA, 20 bp, Homo sapiens
aggcactggatttcttatat

SEQ ID NO: 8065286 - DNA, 22 bp, Homo sapiens
aggcactgggaatatgctgagg

SEQ ID NO: 8065287 - DNA, 22 bp, Homo sapiens
acagtgtgttggaggagactgt

SEQ ID NO: 8065288 - DNA, 22 bp, Homo sapiens
acagtgtgttctgggacctcca

SEQ ID NO: 8065289 - DNA, 21 bp, Homo sapiens
acatacattatctttttaaaa

SEQ ID NO: 8065290 - DNA, 22 bp, Homo sapiens
acatagaacttcgatgtctttt

SEQ ID NO: 8065291 - DNA, 17 bp, Homo sapiens
aggcagctcagaacatc

SEQ ID NO: 8065292 - DNA, 22 bp, Homo sapiens
acatcacagagcccagataaag

SEQ ID NO: 8065293 - DNA, 22 bp, Homo sapiens
acatcagattatgctttgctta

SEQ ID NO: 8065294 - DNA, 22 bp, Homo sapiens
acatccactatccttgcttgtt

SEQ ID NO: 8065295 - DNA, 22 bp, Homo sapiens
acatccacatttattcagtcat

SEQ ID NO: 8065296 - DNA, 22 bp, Homo sapiens
acatccaccacatgccaggctc

SEQ ID NO: 8065297 - DNA, 21 bp, Homo sapiens
acatccagggtcctcactgcc

SEQ ID NO: 8065298 - DNA, 22 bp, Homo sapiens
acatccagatctcagcatggct

SEQ ID NO: 8065299 - DNA, 22 bp, Homo sapiens
aggccagggtcccacactcgca

SEQ ID NO: 8065300 - DNA, 22 bp, Homo sapiens
acatgttcatgcatgcacaggt

SEQ ID NO: 8065301 - DNA, 22 bp, Homo sapiens
aggcctcttcagggagcatgga

SEQ ID NO: 8065302 - DNA, 21 bp, Homo sapiens
aggcctcttcatggccatgat

SEQ ID NO: 8065303 - DNA, 22 bp, Homo sapiens
aggctctgttattctagagggc

SEQ ID NO: 8065304 - DNA, 18 bp, Homo sapiens
aggcctgcccagcactgt

SEQ ID NO: 8065305 - DNA, 17 bp, Homo sapiens
acatttcctaactgaag

SEQ ID NO: 8065306 - DNA, 22 bp, Homo sapiens
acatttcttgatgcctctgtga

SEQ ID NO: 8065307 - DNA, 22 bp, Homo sapiens
agggggcccttgcaggtgagcg

SEQ ID NO: 8065308 - DNA, 22 bp, Homo sapiens
agggggaggctgtgctgcgtct

SEQ ID NO: 8065309 - DNA, 22 bp, Homo sapiens
agggggcatcaggtcctggctc

SEQ ID NO: 8065310 - DNA, 22 bp, Homo sapiens
agggggcaggagagacctgctg

SEQ ID NO: 8065311 - DNA, 22 bp, Homo sapiens
agggctgcctgactccagagcc

SEQ ID NO: 8065312 - DNA, 22 bp, Homo sapiens
acccagccacagcattgaggga

SEQ ID NO: 8065313 - DNA, 22 bp, Homo sapiens
acccagccatgttcagttctct

SEQ ID NO: 8065314 - DNA, 22 bp, Homo sapiens
acccagcatgacacctgcacat

SEQ ID NO: 8065315 - DNA, 22 bp, Homo sapiens
acccagcccagaatctggggcc

SEQ ID NO: 8065316 - DNA, 22 bp, Homo sapiens
acccagcctacaaagctcacct

SEQ ID NO: 8065317 - DNA, 19 bp, Homo sapiens
acccagcccaggagtggca

SEQ ID NO: 8065318 - DNA, 22 bp, Homo sapiens
acccagcctacaaagctcacct

SEQ ID NO: 8065319 - DNA, 22 bp, Homo sapiens
acccagagccagggtcaggagc

SEQ ID NO: 8065320 - DNA, 22 bp, Homo sapiens
accaggctgtgaagtgagacta

SEQ ID NO: 8065321 - DNA, 22 bp, Homo sapiens
accaggctggagtgcagtggcg

SEQ ID NO: 8065322 - DNA, 22 bp, Homo sapiens
acccagctggatgcatggaggc

SEQ ID NO: 8065323 - DNA, 22 bp, Homo sapiens
agggctgcccagtgtgagagct

SEQ ID NO: 8065324 - DNA, 21 bp, Homo sapiens
agggcagattagctgtaagag

SEQ ID NO: 8065325 - DNA, 22 bp, Homo sapiens
agggagagacatttccttcttg

SEQ ID NO: 8065326 - DNA, 22 bp, Homo sapiens
accagcctggccaacatggcaa

SEQ ID NO: 8065327 - DNA, 22 bp, Homo sapiens
accagcctcctagctgctcctg

SEQ ID NO: 8065328 - DNA, 17 bp, Homo sapiens
accagcctctcctgggg

SEQ ID NO: 8065329 - DNA, 22 bp, Homo sapiens
accagagctggcagagtatcaa

SEQ ID NO: 8065330 - DNA, 22 bp, Homo sapiens
accagcagagttgaggaggaca

SEQ ID NO: 8065331 - DNA, 21 bp, Homo sapiens
accagcaggagatcagaagga

SEQ ID NO: 8065332 - DNA, 22 bp, Homo sapiens
agggagacacatgaggaagtca

SEQ ID NO: 8065333 - DNA, 19 bp, Homo sapiens
agggagaattccaagagga

SEQ ID NO: 8065334 - DNA, 22 bp, Homo sapiens
actcctgtgggcatggcacccc

SEQ ID NO: 8065335 - DNA, 22 bp, Homo sapiens
actcctggtttgtgtcctggct

SEQ ID NO: 8065336 - DNA, 22 bp, Homo sapiens
actcctgggttgcagtcctcaa

SEQ ID NO: 8065337 - DNA, 22 bp, Homo sapiens
actgagctgcttgaagtgaact

SEQ ID NO: 8065338 - DNA, 22 bp, Homo sapiens
actgagctgtgacaatgcttaa

SEQ ID NO: 8065339 - DNA, 20 bp, Homo sapiens
actgagctgcatggagagga

SEQ ID NO: 8065340 - DNA, 22 bp, Homo sapiens
actgagctgcaagtcagggagg

SEQ ID NO: 8065341 - DNA, 22 bp, Homo sapiens
actgagctcttgactgggagtt

SEQ ID NO: 8065342 - DNA, 22 bp, Homo sapiens
agtgcagtggttaggagccagg

SEQ ID NO: 8065343 - DNA, 22 bp, Homo sapiens
actcttatgggaacaaggatta

SEQ ID NO: 8065344 - DNA, 22 bp, Homo sapiens
actgcacttcagcctgggtgac

SEQ ID NO: 8065345 - DNA, 22 bp, Homo sapiens
agtggcagtagatgagctggtt

SEQ ID NO: 8065346 - DNA, 22 bp, Homo sapiens
actgcagaggtggggtgcagag

SEQ ID NO: 8065347 - DNA, 22 bp, Homo sapiens
actgcacttcagcctgggtgtc

SEQ ID NO: 8065348 - DNA, 22 bp, Homo sapiens
actggaagccagttgacaatca

SEQ ID NO: 8065349 - DNA, 22 bp, Homo sapiens
agtgtttaaactgaagtgatga

SEQ ID NO: 8065350 - DNA, 22 bp, Homo sapiens
agtgtttagcatgaagttcatt

SEQ ID NO: 8065351 - DNA, 22 bp, Homo sapiens
agtgtttatattatggaaatat

SEQ ID NO: 8065352 - DNA, 22 bp, Homo sapiens
agtgtttaccccaatcagttta

SEQ ID NO: 8065353 - DNA, 22 bp, Homo sapiens
agtcaaagggtatttggattga

SEQ ID NO: 8065354 - DNA, 22 bp, Homo sapiens
agtcaaagaagatggttccaaa

SEQ ID NO: 8065355 - DNA, 22 bp, Homo sapiens
agtcaaagatgaccgagttcct

SEQ ID NO: 8065356 - DNA, 22 bp, Homo sapiens
acgatgctggattatctcaagg

SEQ ID NO: 8065357 - DNA, 22 bp, Homo sapiens
acgatgctcaactatatgaatt

SEQ ID NO: 8065358 - DNA, 22 bp, Homo sapiens
acgcctgtaatcccagcacttt

SEQ ID NO: 8065359 - DNA, 22 bp, Homo sapiens
agtaaaatttctgctgaggaga

SEQ ID NO: 8065360 - DNA, 22 bp, Homo sapiens
agtaaaatcttaagcacagtgg

SEQ ID NO: 8065361 - DNA, 22 bp, Homo sapiens
agtaaacagtaggaactgagaa

SEQ ID NO: 8065362 - DNA, 21 bp, Homo sapiens
actagcaaaagcctattatcc

SEQ ID NO: 8065363 - DNA, 22 bp, Homo sapiens
acctgccagaatccaagccaca

SEQ ID NO: 8065364 - DNA, 22 bp, Homo sapiens
acctgaggctgttagtctaggt

SEQ ID NO: 8065365 - DNA, 22 bp, Homo sapiens
acctgagggcccaaacttggta

SEQ ID NO: 8065366 - DNA, 22 bp, Homo sapiens
acctgaggcctccccagcagac

SEQ ID NO: 8065367 - DNA, 22 bp, Homo sapiens
accctccccaagaggtcgtgcc

SEQ ID NO: 8065368 - DNA, 19 bp, Homo sapiens
accctctcagtgcctgagg

SEQ ID NO: 8065369 - DNA, 22 bp, Homo sapiens
acctctggccttcaggcatcat

SEQ ID NO: 8065370 - DNA, 22 bp, Homo sapiens
acctctggccaagactcgtgtt

SEQ ID NO: 8065371 - DNA, 22 bp, Homo sapiens
acctcctgatgagagtaaagga

SEQ ID NO: 8065372 - DNA, 22 bp, Homo sapiens
aggtggccggtgccagccgggc

SEQ ID NO: 8065373 - DNA, 23 bp, Homo sapiens
aggtggccaccagaatgttaagg

SEQ ID NO: 8065374 - DNA, 22 bp, Homo sapiens
aggtggccaataaatgttggag

SEQ ID NO: 8065375 - DNA, 22 bp, Homo sapiens
aggtggccaagactgtttgaca

SEQ ID NO: 8065376 - DNA, 22 bp, Homo sapiens
aggtggcatttacaccatggga

SEQ ID NO: 8065377 - DNA, 22 bp, Homo sapiens
aggtggcatgcctgagacataa

SEQ ID NO: 8065378 - DNA, 22 bp, Homo sapiens
acctggcatgaagcatgcctta

SEQ ID NO: 8065379 - DNA, 22 bp, Homo sapiens
acctggcactacaggcacctgt

SEQ ID NO: 8065380 - DNA, 22 bp, Homo sapiens
ataatgaatgcagagttatttt

SEQ ID NO: 8065381 - DNA, 22 bp, Homo sapiens
ataaacagtagagaaaggtggt

SEQ ID NO: 8065382 - DNA, 22 bp, Homo sapiens
ataaaatttgctactgttaaat

SEQ ID NO: 8065383 - DNA, 22 bp, Homo sapiens
actgtcacttgcaactgtgagg

SEQ ID NO: 8065384 - DNA, 22 bp, Homo sapiens
atacagcttacagttctaatgc

SEQ ID NO: 8065385 - DNA, 22 bp, Homo sapiens
acttagaaattcagttttgtca

SEQ ID NO: 8065386 - DNA, 22 bp, Homo sapiens
ataatggattcagaaccgtcaa

SEQ ID NO: 8065387 - DNA, 22 bp, Homo sapiens
acttcttgggaccctggcaccg

SEQ ID NO: 8065388 - DNA, 22 bp, Homo sapiens
acttctggtgtcatactgcatt

SEQ ID NO: 8065389 - DNA, 22 bp, Homo sapiens
atactgtaatacctaaatgaac

SEQ ID NO: 8065390 - DNA, 22 bp, Homo sapiens
atactgaattaggtaaagcata

SEQ ID NO: 8065391 - DNA, 22 bp, Homo sapiens
actttcatggtagttgtattct

SEQ ID NO: 8065392 - DNA, 22 bp, Homo sapiens
actttctatggcttattatgag

SEQ ID NO: 8065393 - DNA, 22 bp, Homo sapiens
atatgaaagtaagcatgtgtgt

SEQ ID NO: 8065394 - DNA, 22 bp, Homo sapiens
atatgcttccccttctttttgg

SEQ ID NO: 8065395 - DNA, 22 bp, Homo sapiens
atatgcttatgatgtctcaagt

SEQ ID NO: 8065396 - DNA, 22 bp, Homo sapiens
atatgcttatgatggttaattt

SEQ ID NO: 8065397 - DNA, 22 bp, Homo sapiens
atatgaaagtaagcatgtgtgt

SEQ ID NO: 8065398 - DNA, 22 bp, Homo sapiens
agaaaaggttgaaagtaggatt

SEQ ID NO: 8065399 - DNA, 22 bp, Homo sapiens
atatgctttgggattagatcat

SEQ ID NO: 8065400 - DNA, 22 bp, Homo sapiens
atatgcttgggactgatacagt

SEQ ID NO: 8065401 - DNA, 22 bp, Homo sapiens
atatttataagcaagcaggact

SEQ ID NO: 8065402 - DNA, 21 bp, Homo sapiens
agaaaagtatttgaatcaaga

SEQ ID NO: 8065403 - DNA, 22 bp, Homo sapiens
agaaagggctattttgaggtag

SEQ ID NO: 8065404 - DNA, 22 bp, Homo sapiens
agaaagggtcactgaaagagga

SEQ ID NO: 8065405 - DNA, 22 bp, Homo sapiens
agaaagggttctctgaggtgct

SEQ ID NO: 8065406 - DNA, 22 bp, Homo sapiens
agaacagcagcacgtcaagctg

SEQ ID NO: 8065407 - DNA, 22 bp, Homo sapiens
agaacagcagtagtatacagta

SEQ ID NO: 8065408 - DNA, 22 bp, Homo sapiens
agaacacttttaaatggcttgt

SEQ ID NO: 8065409 - DNA, 22 bp, Homo sapiens
atctaaacaggtgttctttaga

SEQ ID NO: 8065410 - DNA, 22 bp, Homo sapiens
atctaaagtgtttcatgaaaga

SEQ ID NO: 8065411 - DNA, 22 bp, Homo sapiens
atctaaactatagtacctagtc

SEQ ID NO: 8065412 - DNA, 22 bp, Homo sapiens
atctcaaatgattacaccaagc

SEQ ID NO: 8065413 - DNA, 22 bp, Homo sapiens
agcagggtatgttagagctgta

SEQ ID NO: 8065414 - DNA, 22 bp, Homo sapiens
agcagggttccaggagttgcag

SEQ ID NO: 8065415 - DNA, 22 bp, Homo sapiens
agcagggtttggggattggcac

SEQ ID NO: 8065416 - DNA, 22 bp, Homo sapiens
cacccaggctggagagcagtgg

SEQ ID NO: 8065417 - DNA, 22 bp, Homo sapiens
cacccaggctggagtgcagggg

SEQ ID NO: 8065418 - DNA, 22 bp, Homo sapiens
agcagggctggggcacgagcca

SEQ ID NO: 8065419 - DNA, 22 bp, Homo sapiens
agcaggggtaacagaaggaaag

SEQ ID NO: 8065420 - DNA, 22 bp, Homo sapiens
cacctacttccaagagtttcca

SEQ ID NO: 8065421 - DNA, 21 bp, Homo sapiens
agcagctgcagtttctatctg

SEQ ID NO: 8065422 - DNA, 22 bp, Homo sapiens
agcagctgccagagagagttcc

SEQ ID NO: 8065423 - DNA, 22 bp, Homo sapiens
agcagctgatcaaagcacttat

SEQ ID NO: 8065424 - DNA, 21 bp, Homo sapiens
agcaggcaaaggtgaagtctt

SEQ ID NO: 8065425 - DNA, 17 bp, Homo sapiens
agcaggcacgtcagcac

SEQ ID NO: 8065426 - DNA, 22 bp, Homo sapiens
agcaggcacgctccctgcgcga

SEQ ID NO: 8065427 - DNA, 22 bp, Homo sapiens
agcaggcaccagggctcgtcct

SEQ ID NO: 8065428 - DNA, 22 bp, Homo sapiens
agcaggcaggaaggcagcactg

SEQ ID NO: 8065429 - DNA, 22 bp, Homo sapiens
cacagtcctacagagatcagag

SEQ ID NO: 8065430 - DNA, 19 bp, Homo sapiens
cacagtcctatgtttatca

SEQ ID NO: 8065431 - DNA, 22 bp, Homo sapiens
cacagtcccgtgcttaccatgt

SEQ ID NO: 8065432 - DNA, 22 bp, Homo sapiens
cacagtcccattcgagagtaat

SEQ ID NO: 8065433 - DNA, 17 bp, Homo sapiens
agcaggctgcagaggcc

SEQ ID NO: 8065434 - DNA, 22 bp, Homo sapiens
agcaggctgatgggcatgcttg

SEQ ID NO: 8065435 - DNA, 23 bp, Homo sapiens
agcagcaggaggtattgataagg

SEQ ID NO: 8065436 - DNA, 22 bp, Homo sapiens
agcagcaggattttcgttggga

SEQ ID NO: 8065437 - DNA, 22 bp, Homo sapiens
agcagcaggctagggaactgct

SEQ ID NO: 8065438 - DNA, 22 bp, Homo sapiens
agcagcaggctgggatgagtct

SEQ ID NO: 8065439 - DNA, 22 bp, Homo sapiens
agcagcaggctgtgtggactga

SEQ ID NO: 8065440 - DNA, 22 bp, Homo sapiens
agcagcagctctgttgccctac

SEQ ID NO: 8065441 - DNA, 20 bp, Homo sapiens
agcagcagatgttggaggtg

SEQ ID NO: 8065442 - DNA, 22 bp, Homo sapiens
agcagcaggaggctgtccacca

SEQ ID NO: 8065443 - DNA, 22 bp, Homo sapiens
agcagcaggagccgtggggtga

SEQ ID NO: 8065444 - DNA, 22 bp, Homo sapiens
agcagcaggagccgtggggtga

SEQ ID NO: 8065445 - DNA, 22 bp, Homo sapiens
agcagcaggaggccattgtctt

SEQ ID NO: 8065446 - DNA, 22 bp, Homo sapiens
caagagctaccctgtgccatat

SEQ ID NO: 8065447 - DNA, 22 bp, Homo sapiens
caagagctagaaattggttaga

SEQ ID NO: 8065448 - DNA, 22 bp, Homo sapiens
agcagccacagtctgggacagg

SEQ ID NO: 8065449 - DNA, 22 bp, Homo sapiens
agcagccacacgcctccttctc

SEQ ID NO: 8065450 - DNA, 22 bp, Homo sapiens
agcagccagaaatccagaggtg

SEQ ID NO: 8065451 - DNA, 22 bp, Homo sapiens
cacaaggaggtcctgaggaagc

SEQ ID NO: 8065452 - DNA, 22 bp, Homo sapiens
cacaaggactggatggagtggg

SEQ ID NO: 8065453 - DNA, 22 bp, Homo sapiens
agcagcaggcttaaggaaaagt

SEQ ID NO: 8065454 - DNA, 21 bp, Homo sapiens
agcagcagggaagcctcatcc

SEQ ID NO: 8065455 - DNA, 22 bp, Homo sapiens
agcagcagggacaaaggaacag

SEQ ID NO: 8065456 - DNA, 22 bp, Homo sapiens
agcagcagggcatgtcttactc

SEQ ID NO: 8065457 - DNA, 22 bp, Homo sapiens
agcagcagggctctgcccgtgc

SEQ ID NO: 8065458 - DNA, 22 bp, Homo sapiens
agcagcagggtgatagtgccca

SEQ ID NO: 8065459 - DNA, 22 bp, Homo sapiens
agcagcagggtcattgctcttt

SEQ ID NO: 8065460 - DNA, 22 bp, Homo sapiens
cacaagaaataagctgcctttc

SEQ ID NO: 8065461 - DNA, 22 bp, Homo sapiens
cacaagacttatttgtgtagaa

SEQ ID NO: 8065462 - DNA, 22 bp, Homo sapiens
agcaccagcaactatgggctgc

SEQ ID NO: 8065463 - DNA, 23 bp, Homo sapiens
agcaccaggaacagtgtggtcct

SEQ ID NO: 8065464 - DNA, 22 bp, Homo sapiens
agcacattcttgccttaacctc

SEQ ID NO: 8065465 - DNA, 22 bp, Homo sapiens
agcaccagagctatgggcctgc

SEQ ID NO: 8065466 - DNA, 21 bp, Homo sapiens
agcacagctttaagccatgtg

SEQ ID NO: 8065467 - DNA, 22 bp, Homo sapiens
caaaagtctgtcctttaacttc

SEQ ID NO: 8065468 - DNA, 19 bp, Homo sapiens
cagctcagtttgattctct

SEQ ID NO: 8065469 - DNA, 22 bp, Homo sapiens
agctcagcttcctctccatgct

SEQ ID NO: 8065470 - DNA, 21 bp, Homo sapiens
agctcagccgggcacagtggc

SEQ ID NO: 8065471 - DNA, 22 bp, Homo sapiens
cagcagtgtggaagctgagggg

SEQ ID NO: 8065472 - DNA, 22 bp, Homo sapiens
cagcagtgtggaagctgagggg

SEQ ID NO: 8065473 - DNA, 21 bp, Homo sapiens
cagcagtgtgtctgagctaga

SEQ ID NO: 8065474 - DNA, 22 bp, Homo sapiens
cagcagttcaggctccttcccg

SEQ ID NO: 8065475 - DNA, 22 bp, Homo sapiens
cagcagggtatacagggaattt

SEQ ID NO: 8065476 - DNA, 22 bp, Homo sapiens
cagcagggtaggttgtatcagt

SEQ ID NO: 8065477 - DNA, 22 bp, Homo sapiens
cagccctgcacgctgcctccgc

SEQ ID NO: 8065478 - DNA, 23 bp, Homo sapiens
cagccctgaaatcgaggtgacac

SEQ ID NO: 8065479 - DNA, 22 bp, Homo sapiens
cagccctgagagaaccatctat

SEQ ID NO: 8065480 - DNA, 22 bp, Homo sapiens
cagcagcattgctctggattcc

SEQ ID NO: 8065481 - DNA, 22 bp, Homo sapiens
agcctgagccccatccagctga

SEQ ID NO: 8065482 - DNA, 22 bp, Homo sapiens
cagcaggatatggtggagagag

SEQ ID NO: 8065483 - DNA, 22 bp, Homo sapiens
agcctggcactgccccatccat

SEQ ID NO: 8065484 - DNA, 22 bp, Homo sapiens
agcctggcactgaggcagggcg

SEQ ID NO: 8065485 - DNA, 22 bp, Homo sapiens
agcctggattcgtgcatccaca

SEQ ID NO: 8065486 - DNA, 22 bp, Homo sapiens
agcctggatcctaggctcagct

SEQ ID NO: 8065487 - DNA, 22 bp, Homo sapiens
cagaggtgcatacaggtcatta

SEQ ID NO: 8065488 - DNA, 22 bp, Homo sapiens
agcctcctggagtttctgggat

SEQ ID NO: 8065489 - DNA, 22 bp, Homo sapiens
agcctctggccctagactgctt

SEQ ID NO: 8065490 - DNA, 22 bp, Homo sapiens
agcctctgcttatgcaaaggta

SEQ ID NO: 8065491 - DNA, 21 bp, Homo sapiens
cagaggcaggtcctgggacgg

SEQ ID NO: 8065492 - DNA, 22 bp, Homo sapiens
cagaggcatactcccagtcttg

SEQ ID NO: 8065493 - DNA, 22 bp, Homo sapiens
agcccaggctggagtgcagtgg

SEQ ID NO: 8065494 - DNA, 22 bp, Homo sapiens
agcccaggctggagtgcagtgg

SEQ ID NO: 8065495 - DNA, 20 bp, Homo sapiens
agcccaggcctgtgtgagtc

SEQ ID NO: 8065496 - DNA, 22 bp, Homo sapiens
cagaggctcttcctcactgccc

SEQ ID NO: 8065497 - DNA, 22 bp, Homo sapiens
cagagggagccctccaggagca

SEQ ID NO: 8065498 - DNA, 22 bp, Homo sapiens
agcccagcaaagggaggttcag

SEQ ID NO: 8065499 - DNA, 22 bp, Homo sapiens
agccatcatttctgtcactggc

SEQ ID NO: 8065500 - DNA, 22 bp, Homo sapiens
cagactttcaaggagtgaaggc

SEQ ID NO: 8065501 - DNA, 22 bp, Homo sapiens
agcatatacaaactcatataca

SEQ ID NO: 8065502 - DNA, 22 bp, Homo sapiens
agccacctcctgctctgctcac

SEQ ID NO: 8065503 - DNA, 22 bp, Homo sapiens
agccactcagtgctgtattgac

SEQ ID NO: 8065504 - DNA, 22 bp, Homo sapiens
agccactccttcagcgtctgct

SEQ ID NO: 8065505 - DNA, 19 bp, Homo sapiens
cagaaatagcgaagtgtaa

SEQ ID NO: 8065506 - DNA, 22 bp, Homo sapiens
cagacatatgttttaacagatt

SEQ ID NO: 8065507 - DNA, 22 bp, Homo sapiens
agccagagagccccaggttcta

SEQ ID NO: 8065508 - DNA, 22 bp, Homo sapiens
agccagagactttacctgtgca

SEQ ID NO: 8065509 - DNA, 22 bp, Homo sapiens
cagaatgtatatgatctaaggt

SEQ ID NO: 8065510 - DNA, 22 bp, Homo sapiens
cagaatgcagaatgttcatttt

SEQ ID NO: 8065511 - DNA, 21 bp, Homo sapiens
cagaatgcattctttgaagga

SEQ ID NO: 8065512 - DNA, 22 bp, Homo sapiens
cagaatgcattgcttctgatgg

SEQ ID NO: 8065513 - DNA, 22 bp, Homo sapiens
cagaatgcagaatgttcatttt

SEQ ID NO: 8065514 - DNA, 22 bp, Homo sapiens
agacagcatgatacatgatgct

SEQ ID NO: 8065515 - DNA, 22 bp, Homo sapiens
agacagcatggagctgataaca

SEQ ID NO: 8065516 - DNA, 22 bp, Homo sapiens
agacagcatgagcctgctgatg

SEQ ID NO: 8065517 - DNA, 22 bp, Homo sapiens
agacagcaggggagtctggttt

SEQ ID NO: 8065518 - DNA, 22 bp, Homo sapiens
agacagcaggggagtctggttt

SEQ ID NO: 8065519 - DNA, 22 bp, Homo sapiens
agacagctgctcgcagagctat

SEQ ID NO: 8065520 - DNA, 22 bp, Homo sapiens
agacatttggaagatacacata

SEQ ID NO: 8065521 - DNA, 22 bp, Homo sapiens
agacatttattgaacacctagc

SEQ ID NO: 8065522 - DNA, 22 bp, Homo sapiens
agacatatggtgaaacatttta

SEQ ID NO: 8065523 - DNA, 22 bp, Homo sapiens
atgcacccagtgtctggactat

SEQ ID NO: 8065524 - DNA, 22 bp, Homo sapiens
atgcactgcccctctgcacctc

SEQ ID NO: 8065525 - DNA, 22 bp, Homo sapiens
atgcactgtaagactagccatg

SEQ ID NO: 8065526 - DNA, 22 bp, Homo sapiens
atgcacctgaactccatcagct

SEQ ID NO: 8065527 - DNA, 21 bp, Homo sapiens
agaagtcaattgaactgaaat

SEQ ID NO: 8065528 - DNA, 22 bp, Homo sapiens
agaagtcaagtggtctatgaaa

SEQ ID NO: 8065529 - DNA, 22 bp, Homo sapiens
agaagtcaatagttgtttgatg

SEQ ID NO: 8065530 - DNA, 22 bp, Homo sapiens
agaagttaccacatacttctct

SEQ ID NO: 8065531 - DNA, 22 bp, Homo sapiens
atctttgtgctaatgtagttct

SEQ ID NO: 8065532 - DNA, 22 bp, Homo sapiens
agacaaagaaaccgtagaagca

SEQ ID NO: 8065533 - DNA, 22 bp, Homo sapiens
agacaaagacagcatctcaggt

SEQ ID NO: 8065534 - DNA, 22 bp, Homo sapiens
agacaaaggattaatgatgatg

SEQ ID NO: 8065535 - DNA, 22 bp, Homo sapiens
agacaaaggattaatgatgatg

SEQ ID NO: 8065536 - DNA, 22 bp, Homo sapiens
agacaaagacagcatctcaggt

SEQ ID NO: 8065537 - DNA, 22 bp, Homo sapiens
atgaacaacttgaagctccatg

SEQ ID NO: 8065538 - DNA, 22 bp, Homo sapiens
atggcagcctgtggacagtcaa

SEQ ID NO: 8065539 - DNA, 22 bp, Homo sapiens
agagaagagcaatgataaattt

SEQ ID NO: 8065540 - DNA, 22 bp, Homo sapiens
atggcctgggcccgcttcagat

SEQ ID NO: 8065541 - DNA, 22 bp, Homo sapiens
atggcctggccagagctctgct

SEQ ID NO: 8065542 - DNA, 22 bp, Homo sapiens
agagacagggttttgtcgtgtt

SEQ ID NO: 8065543 - DNA, 22 bp, Homo sapiens
agagcctgtacttttctgtgaa

SEQ ID NO: 8065544 - DNA, 22 bp, Homo sapiens
agagcctgtctgcctttctacc

SEQ ID NO: 8065545 - DNA, 22 bp, Homo sapiens
agagcctgtctgcctttctacc

SEQ ID NO: 8065546 - DNA, 22 bp, Homo sapiens
agagcctgtcaattgtaaagag

SEQ ID NO: 8065547 - DNA, 22 bp, Homo sapiens
agagcctgtaacatctttctta

SEQ ID NO: 8065548 - DNA, 22 bp, Homo sapiens
agagcctgtgattgtcatcacc

SEQ ID NO: 8065549 - DNA, 22 bp, Homo sapiens
agagccagcaactctagccctg

SEQ ID NO: 8065550 - DNA, 22 bp, Homo sapiens
agagccagcaagtgaatagtga

SEQ ID NO: 8065551 - DNA, 22 bp, Homo sapiens
agagcctgggcagctcctctgg

SEQ ID NO: 8065552 - DNA, 22 bp, Homo sapiens
agagcctgggaatttgcatgtt

SEQ ID NO: 8065553 - DNA, 22 bp, Homo sapiens
atgggtggagggtgacacggat

SEQ ID NO: 8065554 - DNA, 22 bp, Homo sapiens
atgggtggaggagaaaggcatc

SEQ ID NO: 8065555 - DNA, 22 bp, Homo sapiens
atggggtggagtccgggcagcg

SEQ ID NO: 8065556 - DNA, 22 bp, Homo sapiens
agagccagagacctgggttcac

SEQ ID NO: 8065557 - DNA, 22 bp, Homo sapiens
agagccactgggagacagagca

SEQ ID NO: 8065558 - DNA, 22 bp, Homo sapiens
atggggtgagactaggattaaa

SEQ ID NO: 8065559 - DNA, 20 bp, Homo sapiens
atggggtgagtgacgccctc

SEQ ID NO: 8065560 - DNA, 22 bp, Homo sapiens
atggggtgaccatgagcattta

SEQ ID NO: 8065561 - DNA, 22 bp, Homo sapiens
atggggctgttctctgccctgc

SEQ ID NO: 8065562 - DNA, 22 bp, Homo sapiens
atgggggcctgaacaggcaaaa

SEQ ID NO: 8065563 - DNA, 22 bp, Homo sapiens
agaggcaggaggttgacttgag

SEQ ID NO: 8065564 - DNA, 22 bp, Homo sapiens
attcattagccactaactagca

SEQ ID NO: 8065565 - DNA, 22 bp, Homo sapiens
agaggctcctagccactggctt

SEQ ID NO: 8065566 - DNA, 19 bp, Homo sapiens
attgcagctatagactgcc

SEQ ID NO: 8065567 - DNA, 22 bp, Homo sapiens
attgcagctcagggtgatgact

SEQ ID NO: 8065568 - DNA, 22 bp, Homo sapiens
attccattgtgtaaggatatcg

SEQ ID NO: 8065569 - DNA, 23 bp, Homo sapiens
attattaaggacatggactttgt

SEQ ID NO: 8065570 - DNA, 22 bp, Homo sapiens
attataggcttgagccaccgtg

SEQ ID NO: 8065571 - DNA, 22 bp, Homo sapiens
attattcaacacttgagaaatt

SEQ ID NO: 8065572 - DNA, 22 bp, Homo sapiens
agaggaggctctgggatcgtcc

SEQ ID NO: 8065573 - DNA, 22 bp, Homo sapiens
agaggaggctgggtccagataa

SEQ ID NO: 8065574 - DNA, 22 bp, Homo sapiens
agaggaggcagcttaactcagt

SEQ ID NO: 8065575 - DNA, 22 bp, Homo sapiens
agaggaggccaggcccacacct

SEQ ID NO: 8065576 - DNA, 22 bp, Homo sapiens
agaggacaaaatgagaagtgct

SEQ ID NO: 8065577 - DNA, 22 bp, Homo sapiens
atgtttatggagcaggtattag

SEQ ID NO: 8065578 - DNA, 22 bp, Homo sapiens
atgtttatgcaaacatgtgagt

SEQ ID NO: 8065579 - DNA, 22 bp, Homo sapiens
agagctgttaattttgcactgg

SEQ ID NO: 8065580 - DNA, 22 bp, Homo sapiens
atttgtttatcgtcgattgtag

SEQ ID NO: 8065581 - DNA, 22 bp, Homo sapiens
atttgtctttggacctgtgaga

SEQ ID NO: 8065582 - DNA, 22 bp, Homo sapiens
atttggcagtataaattctggc

SEQ ID NO: 8065583 - DNA, 18 bp, Homo sapiens
atttggcagatgatgaac

SEQ ID NO: 8065584 - DNA, 22 bp, Homo sapiens
agagttctgtctgccacacgaa

SEQ ID NO: 8065585 - DNA, 21 bp, Homo sapiens
agagttcttgctgagcaagcc

SEQ ID NO: 8065586 - DNA, 22 bp, Homo sapiens
agagtgggtgatctctgttgtc

SEQ ID NO: 8065587 - DNA, 22 bp, Homo sapiens
agaggtgacataggagaggctc

SEQ ID NO: 8065588 - DNA, 22 bp, Homo sapiens
agatacattagtagttacttgt

SEQ ID NO: 8065589 - DNA, 22 bp, Homo sapiens
agataaattcctaagatttcag

SEQ ID NO: 8065590 - DNA, 22 bp, Homo sapiens
agagtttgtactttaccctgag

SEQ ID NO: 8065591 - DNA, 22 bp, Homo sapiens
agagtttgggtgggacagcttg

SEQ ID NO: 8065592 - DNA, 22 bp, Homo sapiens
agagtttggagagggtgaggca

SEQ ID NO: 8065593 - DNA, 22 bp, Homo sapiens
agagtttggaggtgttcctgga

SEQ ID NO: 8065594 - DNA, 22 bp, Homo sapiens
agagtttgaattttgaaaagat

SEQ ID NO: 8065595 - DNA, 23 bp, Homo sapiens
agagtttgtttctaatgagtgag

SEQ ID NO: 8065596 - DNA, 22 bp, Homo sapiens
aataagatcttaaaggttatat

SEQ ID NO: 8065597 - DNA, 22 bp, Homo sapiens
aataagattgacacaagtacct

SEQ ID NO: 8065598 - DNA, 22 bp, Homo sapiens
actgcctgtgtcccttcagtgc

SEQ ID NO: 8065599 - DNA, 22 bp, Homo sapiens
actgcctgtttggcatggcccc

SEQ ID NO: 8065600 - DNA, 23 bp, Homo sapiens
actgcctgtgccgatctctctca

SEQ ID NO: 8065601 - DNA, 22 bp, Homo sapiens
aataattagtgggacagagaac

SEQ ID NO: 8065602 - DNA, 22 bp, Homo sapiens
aatacaagatttatagttgttt

SEQ ID NO: 8065603 - DNA, 22 bp, Homo sapiens
aagtttcattgttcatgtaaca

SEQ ID NO: 8065604 - DNA, 22 bp, Homo sapiens
aataagaattgccagatttgaa

SEQ ID NO: 8065605 - DNA, 22 bp, Homo sapiens
aataacttcagttcttacatta

SEQ ID NO: 8065606 - DNA, 22 bp, Homo sapiens
aataagaatttacttgtcaaga

SEQ ID NO: 8065607 - DNA, 22 bp, Homo sapiens
actcccactccagagtagaagc

SEQ ID NO: 8065608 - DNA, 22 bp, Homo sapiens
actcccaggttgcctggcaggc

SEQ ID NO: 8065609 - DNA, 22 bp, Homo sapiens
aagttactggcaagggctgcag

SEQ ID NO: 8065610 - DNA, 22 bp, Homo sapiens
actaacatgttaatcaaaagaa

SEQ ID NO: 8065611 - DNA, 22 bp, Homo sapiens
aagtcacagagttggaagtcag

SEQ ID NO: 8065612 - DNA, 22 bp, Homo sapiens
aagtcacattctgaggtattgg

SEQ ID NO: 8065613 - DNA, 22 bp, Homo sapiens
aatccaggtggcggaggttgtg

SEQ ID NO: 8065614 - DNA, 22 bp, Homo sapiens
acttgtctaccatgaatattta

SEQ ID NO: 8065615 - DNA, 22 bp, Homo sapiens
acttgtctttaatccgaatgta

SEQ ID NO: 8065616 - DNA, 22 bp, Homo sapiens
acttgtctatggttacatccta

SEQ ID NO: 8065617 - DNA, 22 bp, Homo sapiens
acttgtctggcagatcatgcaa

SEQ ID NO: 8065618 - DNA, 22 bp, Homo sapiens
acttgtctttgtaaaatagaaa

SEQ ID NO: 8065619 - DNA, 22 bp, Homo sapiens
aatgagatggaattcccgccta

SEQ ID NO: 8065620 - DNA, 22 bp, Homo sapiens
aatgagctgctgctgttccacc

SEQ ID NO: 8065621 - DNA, 22 bp, Homo sapiens
agaagggaactcagagatgatt

SEQ ID NO: 8065622 - DNA, 21 bp, Homo sapiens
agaagggattgtggtaaagat

SEQ ID NO: 8065623 - DNA, 18 bp, Homo sapiens
agaaggagctatgggcag

SEQ ID NO: 8065624 - DNA, 19 bp, Homo sapiens
aatgagttccatgaaaaga

SEQ ID NO: 8065625 - DNA, 22 bp, Homo sapiens
aatgaacagatacacataggca

SEQ ID NO: 8065626 - DNA, 22 bp, Homo sapiens
aatgaacatcaaatgcctacca

SEQ ID NO: 8065627 - DNA, 22 bp, Homo sapiens
aatgaacatgggagtactaata

SEQ ID NO: 8065628 - DNA, 22 bp, Homo sapiens
aatgaacacatgtggtcagttt

SEQ ID NO: 8065629 - DNA, 22 bp, Homo sapiens
aatgaacacagccctctacttt

SEQ ID NO: 8065630 - DNA, 22 bp, Homo sapiens
agaaaacattacataggtgtgt

SEQ ID NO: 8065631 - DNA, 22 bp, Homo sapiens
agaaaacattacataggtgtgt

SEQ ID NO: 8065632 - DNA, 22 bp, Homo sapiens
agaaaacagaaagtcattggtg

SEQ ID NO: 8065633 - DNA, 22 bp, Homo sapiens
acaggcaggtcctgtcccagct

SEQ ID NO: 8065634 - DNA, 22 bp, Homo sapiens
aagccaggtgttgtggtaagag

SEQ ID NO: 8065635 - DNA, 22 bp, Homo sapiens
aagccaggtgtttaggccagcg

SEQ ID NO: 8065636 - DNA, 22 bp, Homo sapiens
aagccaggctgcacttgctggg

SEQ ID NO: 8065637 - DNA, 22 bp, Homo sapiens
aagccagggattcctgagggag

SEQ ID NO: 8065638 - DNA, 22 bp, Homo sapiens
aagccaggcatgcttggacagt

SEQ ID NO: 8065639 - DNA, 22 bp, Homo sapiens
aagccagggtcaggggcctcct

SEQ ID NO: 8065640 - DNA, 22 bp, Homo sapiens
aagccaggggctgcttaggaga

SEQ ID NO: 8065641 - DNA, 22 bp, Homo sapiens
acaggcagttgaggtttgtgtg

SEQ ID NO: 8065642 - DNA, 21 bp, Homo sapiens
aaggcagaagcatggaatgag

SEQ ID NO: 8065643 - DNA, 22 bp, Homo sapiens
aaggtgaactggtaatgacaga

SEQ ID NO: 8065644 - DNA, 22 bp, Homo sapiens
accatcagtcattgtcagtggg

SEQ ID NO: 8065645 - DNA, 22 bp, Homo sapiens
accatgggtcagccacctcagc

SEQ ID NO: 8065646 - DNA, 23 bp, Homo sapiens
aagtacatatatttagatagtga

SEQ ID NO: 8065647 - DNA, 23 bp, Homo sapiens
aagtacatatatttagatagtga

SEQ ID NO: 8065648 - DNA, 22 bp, Homo sapiens
aagtacatatatttatgattct

SEQ ID NO: 8065649 - DNA, 22 bp, Homo sapiens
aagtacatcctagtctctttca

SEQ ID NO: 8065650 - DNA, 22 bp, Homo sapiens
aagtacatgctgtaatgattgg

SEQ ID NO: 8065651 - DNA, 22 bp, Homo sapiens
aaggctgaggctggagaattac

SEQ ID NO: 8065652 - DNA, 22 bp, Homo sapiens
aaggctcttggagtgaatgcag

SEQ ID NO: 8065653 - DNA, 22 bp, Homo sapiens
aaggcataggacaaatcagtga

SEQ ID NO: 8065654 - DNA, 22 bp, Homo sapiens
aaggctgcctctgccagaggag

SEQ ID NO: 8065655 - DNA, 22 bp, Homo sapiens
aagggaaatcatatggtgcagt

SEQ ID NO: 8065656 - DNA, 22 bp, Homo sapiens
aagggcctgccagctcttcatg

SEQ ID NO: 8065657 - DNA, 19 bp, Homo sapiens
aagggcctctgctgtcttc

SEQ ID NO: 8065658 - DNA, 22 bp, Homo sapiens
aagggccataacttgcagtgtt

SEQ ID NO: 8065659 - DNA, 22 bp, Homo sapiens
agctctccacacataggactag

SEQ ID NO: 8065660 - DNA, 22 bp, Homo sapiens
agctctcaagataagaaagaac

SEQ ID NO: 8065661 - DNA, 22 bp, Homo sapiens
agcctgcaggatgggcagcacc

SEQ ID NO: 8065662 - DNA, 17 bp, Homo sapiens
agcctgccccatgctgc

SEQ ID NO: 8065663 - DNA, 22 bp, Homo sapiens
agcctgctggaccaagctcatg

SEQ ID NO: 8065664 - DNA, 17 bp, Homo sapiens
agcctgctgatctcaca

SEQ ID NO: 8065665 - DNA, 17 bp, Homo sapiens
agcctgctgatctcaca

SEQ ID NO: 8065666 - DNA, 22 bp, Homo sapiens
agcctgcgatcccacctggcct

SEQ ID NO: 8065667 - DNA, 22 bp, Homo sapiens
agcctgccttgggctgcttgag

SEQ ID NO: 8065668 - DNA, 22 bp, Homo sapiens
agctagttcagagagatatgta

SEQ ID NO: 8065669 - DNA, 22 bp, Homo sapiens
agctatgtccctatgaattctg

SEQ ID NO: 8065670 - DNA, 22 bp, Homo sapiens
agctatgtttgacagaaagtga

SEQ ID NO: 8065671 - DNA, 22 bp, Homo sapiens
agccacagtcaacctgtccata

SEQ ID NO: 8065672 - DNA, 22 bp, Homo sapiens
agccacagtcaacctgtccata

SEQ ID NO: 8065673 - DNA, 22 bp, Homo sapiens
agccacagtctgatgcctgaga

SEQ ID NO: 8065674 - DNA, 22 bp, Homo sapiens
agccatggcgccactagaggga

SEQ ID NO: 8065675 - DNA, 22 bp, Homo sapiens
agccatttcatacacctgcagc

SEQ ID NO: 8065676 - DNA, 22 bp, Homo sapiens
agccattttggtaatgataaca

SEQ ID NO: 8065677 - DNA, 22 bp, Homo sapiens
agccattttcctgaaatataac

SEQ ID NO: 8065678 - DNA, 22 bp, Homo sapiens
agccatttcctgaactctggac

SEQ ID NO: 8065679 - DNA, 22 bp, Homo sapiens
agccatttggacttctggtagg

SEQ ID NO: 8065680 - DNA, 17 bp, Homo sapiens
agcccctcagcgtcacc

SEQ ID NO: 8065681 - DNA, 22 bp, Homo sapiens
agcccctctgtggctctgcctc

SEQ ID NO: 8065682 - DNA, 22 bp, Homo sapiens
agcccctgggagtagctgctgc

SEQ ID NO: 8065683 - DNA, 22 bp, Homo sapiens
acagagttaatggataggcagg

SEQ ID NO: 8065684 - DNA, 20 bp, Homo sapiens
agcagtgtggggagactgtg

SEQ ID NO: 8065685 - DNA, 22 bp, Homo sapiens
agcagtgtgcttcgtttcatga

SEQ ID NO: 8065686 - DNA, 22 bp, Homo sapiens
agcagtgttggtgggagcatct

SEQ ID NO: 8065687 - DNA, 20 bp, Homo sapiens
agcagtgtttcttgactcta

SEQ ID NO: 8065688 - DNA, 22 bp, Homo sapiens
agcagtgttctaatctggctag

SEQ ID NO: 8065689 - DNA, 22 bp, Homo sapiens
agcagtgttttgattctgggag

SEQ ID NO: 8065690 - DNA, 22 bp, Homo sapiens
agccacaggaaacagagacagc

SEQ ID NO: 8065691 - DNA, 22 bp, Homo sapiens
acagaacaagacctgcttattg

SEQ ID NO: 8065692 - DNA, 23 bp, Homo sapiens
agcagggccagaatacttgctgt

SEQ ID NO: 8065693 - DNA, 23 bp, Homo sapiens
agcagggccagaatacttgctgt

SEQ ID NO: 8065694 - DNA, 22 bp, Homo sapiens
acactgtctgggactcaggagt

SEQ ID NO: 8065695 - DNA, 18 bp, Homo sapiens
acactgcagcagtctgct

SEQ ID NO: 8065696 - DNA, 22 bp, Homo sapiens
agcagcaggtgcttctggatct

SEQ ID NO: 8065697 - DNA, 22 bp, Homo sapiens
agcagcaggtgacctcgatgcc

SEQ ID NO: 8065698 - DNA, 22 bp, Homo sapiens
agcagcagtcatgcctatgctc

SEQ ID NO: 8065699 - DNA, 22 bp, Homo sapiens
agcagcagtatccttccccggc

SEQ ID NO: 8065700 - DNA, 22 bp, Homo sapiens
agcagcagtacatataagacta

SEQ ID NO: 8065701 - DNA, 23 bp, Homo sapiens
agcagcagtgagaggtgtcttac

SEQ ID NO: 8065702 - DNA, 22 bp, Homo sapiens
agcagcagtgtggtttggggaa

SEQ ID NO: 8065703 - DNA, 22 bp, Homo sapiens
agcagcagtcctttgtgtaatt

SEQ ID NO: 8065704 - DNA, 22 bp, Homo sapiens
agcagcagtgacagccgaaagc

SEQ ID NO: 8065705 - DNA, 22 bp, Homo sapiens
acacataagaaactacaaagag

SEQ ID NO: 8065706 - DNA, 22 bp, Homo sapiens
agcagcagtgttctggaattct

SEQ ID NO: 8065707 - DNA, 22 bp, Homo sapiens
agcagcagtgtgtggtcatgtt

SEQ ID NO: 8065708 - DNA, 22 bp, Homo sapiens
acaatttgtgtcttttgcttat

SEQ ID NO: 8065709 - DNA, 22 bp, Homo sapiens
acaatttggacatgtgcaggat

SEQ ID NO: 8065710 - DNA, 22 bp, Homo sapiens
acacagatgggtagaaaacaga

SEQ ID NO: 8065711 - DNA, 22 bp, Homo sapiens
acacagattttacatgttatgc

SEQ ID NO: 8065712 - DNA, 22 bp, Homo sapiens
acacagatttcactggaataga

SEQ ID NO: 8065713 - DNA, 22 bp, Homo sapiens
acaattctgatggtttcccagt

SEQ ID NO: 8065714 - DNA, 22 bp, Homo sapiens
agcacctgcctgcattggctat

SEQ ID NO: 8065715 - DNA, 22 bp, Homo sapiens
agcacctgctatgtgtcaggga

SEQ ID NO: 8065716 - DNA, 21 bp, Homo sapiens
agcaccctcccttctggaggg

SEQ ID NO: 8065717 - DNA, 22 bp, Homo sapiens
agcacctgcacagtggaggaaa

SEQ ID NO: 8065718 - DNA, 19 bp, Homo sapiens
agatggggaagagtgtgag

SEQ ID NO: 8065719 - DNA, 22 bp, Homo sapiens
agatggggcagaatggagccat

SEQ ID NO: 8065720 - DNA, 19 bp, Homo sapiens
acaagtcacttacttagta

SEQ ID NO: 8065721 - DNA, 19 bp, Homo sapiens
acaagggcaggcaaggtga

SEQ ID NO: 8065722 - DNA, 22 bp, Homo sapiens
agcacaggtacggagatgctac

SEQ ID NO: 8065723 - DNA, 22 bp, Homo sapiens
agcaaggcagtcagctggctgg

SEQ ID NO: 8065724 - DNA, 22 bp, Homo sapiens
agcacaggtacggagatgctac

SEQ ID NO: 8065725 - DNA, 22 bp, Homo sapiens
agcaagattgaggcttcctcag

SEQ ID NO: 8065726 - DNA, 22 bp, Homo sapiens
agatggggctcagtgtggaggc

SEQ ID NO: 8065727 - DNA, 22 bp, Homo sapiens
agatggggtttcatcatgttgg

SEQ ID NO: 8065728 - DNA, 22 bp, Homo sapiens
agatgggtaactggagtctgct

SEQ ID NO: 8065729 - DNA, 22 bp, Homo sapiens
agaggccatctgctctgtgggg

SEQ ID NO: 8065730 - DNA, 22 bp, Homo sapiens
agaggccatctgctctgtgggg

SEQ ID NO: 8065731 - DNA, 22 bp, Homo sapiens
agaggccagtggctgtgctgtc

SEQ ID NO: 8065732 - DNA, 22 bp, Homo sapiens
agaggccagtggctgtgctgtc

SEQ ID NO: 8065733 - DNA, 22 bp, Homo sapiens
aatttgtgttagtccacgttca

SEQ ID NO: 8065734 - DNA, 22 bp, Homo sapiens
aatttgtggccacattgtggaa

SEQ ID NO: 8065735 - DNA, 22 bp, Homo sapiens
aatttgtggccacattgtggaa

SEQ ID NO: 8065736 - DNA, 22 bp, Homo sapiens
aatttgtgaatctgtctcttga

SEQ ID NO: 8065737 - DNA, 22 bp, Homo sapiens
acaaaccagcttaagcaagatg

SEQ ID NO: 8065738 - DNA, 22 bp, Homo sapiens
acaaacagagttgaaaaatagg

SEQ ID NO: 8065739 - DNA, 22 bp, Homo sapiens
acaaaattgtgttaaactttat

SEQ ID NO: 8065740 - DNA, 22 bp, Homo sapiens
acaaaattacctagttattttc

SEQ ID NO: 8065741 - DNA, 22 bp, Homo sapiens
acaaatgactatttggtacagg

SEQ ID NO: 8065742 - DNA, 22 bp, Homo sapiens
acaaatgactcaaacaccactt

SEQ ID NO: 8065743 - DNA, 19 bp, Homo sapiens
acaaatgatgttgcactga

SEQ ID NO: 8065744 - DNA, 22 bp, Homo sapiens
acaaatgcagcataaagtgaac

SEQ ID NO: 8065745 - DNA, 22 bp, Homo sapiens
acaaatgccatgtgacctacca

SEQ ID NO: 8065746 - DNA, 22 bp, Homo sapiens
acaaatgccatatataaattct

SEQ ID NO: 8065747 - DNA, 22 bp, Homo sapiens
aatttatatgtaattaggcaca

SEQ ID NO: 8065748 - DNA, 22 bp, Homo sapiens
aatgttgttggctcttcatgat

SEQ ID NO: 8065749 - DNA, 22 bp, Homo sapiens
aatgttgtacctatgctgagag

SEQ ID NO: 8065750 - DNA, 22 bp, Homo sapiens
aatgttcattgattaaatgaat

SEQ ID NO: 8065751 - DNA, 22 bp, Homo sapiens
aatgttcaaacagatcacttag

SEQ ID NO: 8065752 - DNA, 22 bp, Homo sapiens
aatgttcagtagaataggaatg

SEQ ID NO: 8065753 - DNA, 22 bp, Homo sapiens
aatgtctgctctactcaggagg

SEQ ID NO: 8065754 - DNA, 22 bp, Homo sapiens
aatgtctgaaaatcagactgca

SEQ ID NO: 8065755 - DNA, 22 bp, Homo sapiens
aatgtcttcagtgtatacatgg

SEQ ID NO: 8065756 - DNA, 22 bp, Homo sapiens
agacagggtcttgatcagagct

SEQ ID NO: 8065757 - DNA, 22 bp, Homo sapiens
agacaggccactctggtctggt

SEQ ID NO: 8065758 - DNA, 21 bp, Homo sapiens
agacagagtgcagtctacata

SEQ ID NO: 8065759 - DNA, 21 bp, Homo sapiens
agacactggtttagcattcat

SEQ ID NO: 8065760 - DNA, 22 bp, Homo sapiens
aagagagggacttattaaagtc

SEQ ID NO: 8065761 - DNA, 22 bp, Homo sapiens
acaaggaggtctggggggccct

SEQ ID NO: 8065762 - DNA, 22 bp, Homo sapiens
aagagatgaaggtcctgactgt

SEQ ID NO: 8065763 - DNA, 22 bp, Homo sapiens
aagagagaactcccttcgccag

SEQ ID NO: 8065764 - DNA, 22 bp, Homo sapiens
acaaagctagagaagagaattg

SEQ ID NO: 8065765 - DNA, 20 bp, Homo sapiens
acaaagactggaaaagcaag

SEQ ID NO: 8065766 - DNA, 22 bp, Homo sapiens
aagacatgcaattagcaaggaa

SEQ ID NO: 8065767 - DNA, 22 bp, Homo sapiens
aagagcttcctctttcattgct

SEQ ID NO: 8065768 - DNA, 18 bp, Homo sapiens
aagagcttcgcatataca

SEQ ID NO: 8065769 - DNA, 22 bp, Homo sapiens
aagaggaaatgattgactatat

SEQ ID NO: 8065770 - DNA, 22 bp, Homo sapiens
aagaggaactgggggctgagtc

SEQ ID NO: 8065771 - DNA, 22 bp, Homo sapiens
aagagctggtcacaggtccatt

SEQ ID NO: 8065772 - DNA, 22 bp, Homo sapiens
aagagctggagctgctacagga

SEQ ID NO: 8065773 - DNA, 22 bp, Homo sapiens
acaaggctgtggggagaactga

SEQ ID NO: 8065774 - DNA, 22 bp, Homo sapiens
acaaggctgaacagtgaagccg

SEQ ID NO: 8065775 - DNA, 22 bp, Homo sapiens
acaaggctaatttggaagatac

SEQ ID NO: 8065776 - DNA, 19 bp, Homo sapiens
aagagcagggaaagaattg

SEQ ID NO: 8065777 - DNA, 22 bp, Homo sapiens
acaaggctgttggtcacaaacc

SEQ ID NO: 8065778 - DNA, 22 bp, Homo sapiens
aagagctgcacatatttatatc

SEQ ID NO: 8065779 - DNA, 20 bp, Homo sapiens
aagagctgactcacagtggt

SEQ ID NO: 8065780 - DNA, 22 bp, Homo sapiens
aagagctgattaagtcatgagg

SEQ ID NO: 8065781 - DNA, 22 bp, Homo sapiens
aagacagtgatctctgagagat

SEQ ID NO: 8065782 - DNA, 22 bp, Homo sapiens
aagacagtgacagtcacaattg

SEQ ID NO: 8065783 - DNA, 22 bp, Homo sapiens
aattgtaactacattgagaaca

SEQ ID NO: 8065784 - DNA, 20 bp, Homo sapiens
aagaagttggtaagcagtgc

SEQ ID NO: 8065785 - DNA, 22 bp, Homo sapiens
aagaagcactttcctacatgtt

SEQ ID NO: 8065786 - DNA, 22 bp, Homo sapiens
aatgttttgcattagttttcta

SEQ ID NO: 8065787 - DNA, 22 bp, Homo sapiens
aatgttttctctgtgaacacat

SEQ ID NO: 8065788 - DNA, 22 bp, Homo sapiens
aatgttttatagctcaagcaat

SEQ ID NO: 8065789 - DNA, 22 bp, Homo sapiens
aatgttttagattactgctggg

SEQ ID NO: 8065790 - DNA, 22 bp, Homo sapiens
aagaaatacatggtttttgagt

SEQ ID NO: 8065791 - DNA, 18 bp, Homo sapiens
aacttcaactacaatgga

SEQ ID NO: 8065792 - DNA, 22 bp, Homo sapiens
aagccaggaagagagccttcac

SEQ ID NO: 8065793 - DNA, 22 bp, Homo sapiens
aagccaagttggaagactgaat

SEQ ID NO: 8065794 - DNA, 22 bp, Homo sapiens
acagcagctgccttcaggctct

SEQ ID NO: 8065795 - DNA, 22 bp, Homo sapiens
acagcagcttgtctgttcttta

SEQ ID NO: 8065796 - DNA, 22 bp, Homo sapiens
acagcagctaaaggtgtctcct

SEQ ID NO: 8065797 - DNA, 22 bp, Homo sapiens
aagcatttgtgaaattcagatg

SEQ ID NO: 8065798 - DNA, 22 bp, Homo sapiens
aagcatttggttctgaagactc

SEQ ID NO: 8065799 - DNA, 22 bp, Homo sapiens
aagcatcaacactatattgatg

SEQ ID NO: 8065800 - DNA, 22 bp, Homo sapiens
aagcatttatagataagaattt

SEQ ID NO: 8065801 - DNA, 22 bp, Homo sapiens
aagcagcctggcatgatgcttt

SEQ ID NO: 8065802 - DNA, 19 bp, Homo sapiens
aagcagccctggcaagagc

SEQ ID NO: 8065803 - DNA, 23 bp, Homo sapiens
acagagtacagtgtgcttagtgg

SEQ ID NO: 8065804 - DNA, 18 bp, Homo sapiens
acagacaaaatggaaatg

SEQ ID NO: 8065805 - DNA, 22 bp, Homo sapiens
acacaggttccatctccacctt

SEQ ID NO: 8065806 - DNA, 22 bp, Homo sapiens
acacaggggaaagtggagctga

SEQ ID NO: 8065807 - DNA, 22 bp, Homo sapiens
acacagggctgcgcctgacccc

SEQ ID NO: 8065808 - DNA, 22 bp, Homo sapiens
acacagggtctagagttaggcc

SEQ ID NO: 8065809 - DNA, 22 bp, Homo sapiens
acacagggggcattctaggagt

SEQ ID NO: 8065810 - DNA, 22 bp, Homo sapiens
acacaggggctcggctgggtgc

SEQ ID NO: 8065811 - DNA, 22 bp, Homo sapiens
aagcacagggactttaggaata

SEQ ID NO: 8065812 - DNA, 22 bp, Homo sapiens
aagcacagaaaaggagcatgga

SEQ ID NO: 8065813 - DNA, 22 bp, Homo sapiens
acactgcatttcaacaaggccc

SEQ ID NO: 8065814 - DNA, 21 bp, Homo sapiens
acactgcaggtgaagtgcact

SEQ ID NO: 8065815 - DNA, 21 bp, Homo sapiens
acactgctgtagcatattggg

SEQ ID NO: 8065816 - DNA, 22 bp, Homo sapiens
aacgtcttctctccaagtaaat

SEQ ID NO: 8065817 - DNA, 20 bp, Homo sapiens
aatataattctctgaattta

SEQ ID NO: 8065818 - DNA, 22 bp, Homo sapiens
aatcataattttgtgaatgtag

SEQ ID NO: 8065819 - DNA, 22 bp, Homo sapiens
aatcatgtactgctgtggcttt

SEQ ID NO: 8065820 - DNA, 22 bp, Homo sapiens
aatcatgtccatcttaactttc

SEQ ID NO: 8065821 - DNA, 22 bp, Homo sapiens
aacttaggaaaataaggcatga

SEQ ID NO: 8065822 - DNA, 22 bp, Homo sapiens
aacttaaacccactcatgtaga

SEQ ID NO: 8065823 - DNA, 22 bp, Homo sapiens
aacatgtaaatatcattgtact

SEQ ID NO: 8065824 - DNA, 22 bp, Homo sapiens
aataagaaagagtcagcttcag

SEQ ID NO: 8065825 - DNA, 22 bp, Homo sapiens
aacaggccctaggaattgggcc

SEQ ID NO: 8065826 - DNA, 22 bp, Homo sapiens
aacaggcctatagggaaggcgc

SEQ ID NO: 8065827 - DNA, 22 bp, Homo sapiens
aacaggcaacagttgactctga

SEQ ID NO: 8065828 - DNA, 20 bp, Homo sapiens
aacagggggctgcagagggc

SEQ ID NO: 8065829 - DNA, 22 bp, Homo sapiens
aagtcattggtagcttgatagg

SEQ ID NO: 8065830 - DNA, 22 bp, Homo sapiens
aagtccagaactcctgtgatag

SEQ ID NO: 8065831 - DNA, 22 bp, Homo sapiens
aagtccagactcctttgcgtgg

SEQ ID NO: 8065832 - DNA, 22 bp, Homo sapiens
aagtccagcagtgcttgttgat

SEQ ID NO: 8065833 - DNA, 17 bp, Homo sapiens
aagtccagagttgagca

SEQ ID NO: 8065834 - DNA, 17 bp, Homo sapiens
aagtccagcctgcagct

SEQ ID NO: 8065835 - DNA, 22 bp, Homo sapiens
aacaaatggaacacaaatcttt

SEQ ID NO: 8065836 - DNA, 22 bp, Homo sapiens
aaattcttcaggtaattttgat

SEQ ID NO: 8065837 - DNA, 22 bp, Homo sapiens
aaattgaatttgggaaacattg

SEQ ID NO: 8065838 - DNA, 22 bp, Homo sapiens
aaattctttcatggctaataag

SEQ ID NO: 8065839 - DNA, 22 bp, Homo sapiens
aacaaagaagactggttatttt

SEQ ID NO: 8065840 - DNA, 22 bp, Homo sapiens
aacaaagatgggtgggaaagag

SEQ ID NO: 8065841 - DNA, 21 bp, Homo sapiens
aacaaagggatgctcatcttt

SEQ ID NO: 8065842 - DNA, 22 bp, Homo sapiens
aacaaacagttaagtgtggatg

SEQ ID NO: 8065843 - DNA, 22 bp, Homo sapiens
aacaaacattacctggtgctgg

SEQ ID NO: 8065844 - DNA, 22 bp, Homo sapiens
aaatgttaggttgtactgagtc

SEQ ID NO: 8065845 - DNA, 22 bp, Homo sapiens
aagctgaggcccatggcaaggt

SEQ ID NO: 8065846 - DNA, 22 bp, Homo sapiens
aaatgtggggctggaggcagga

SEQ ID NO: 8065847 - DNA, 22 bp, Homo sapiens
aaacagtgcctggcatggagga

SEQ ID NO: 8065848 - DNA, 18 bp, Homo sapiens
aaacagtgcctaagtgtc

SEQ ID NO: 8065849 - DNA, 22 bp, Homo sapiens
aaaggtggagttgtgcccattt

SEQ ID NO: 8065850 - DNA, 22 bp, Homo sapiens
aaaggtgactgcagcagctatt

SEQ ID NO: 8065851 - DNA, 22 bp, Homo sapiens
aaaggtgacactctgccagctg

SEQ ID NO: 8065852 - DNA, 22 bp, Homo sapiens
aaagagttcacggaggccaaag

SEQ ID NO: 8065853 - DNA, 22 bp, Homo sapiens
aaagagttgaggcagttatcca

SEQ ID NO: 8065854 - DNA, 22 bp, Homo sapiens
aaagagttcttgtagctttgag

SEQ ID NO: 8065855 - DNA, 22 bp, Homo sapiens
aaagaggaaccaagagcacgtg

SEQ ID NO: 8065856 - DNA, 22 bp, Homo sapiens
aaatgcagcctagctcagtttt

SEQ ID NO: 8065857 - DNA, 22 bp, Homo sapiens
aaatgcactgaacacatgttgt

SEQ ID NO: 8065858 - DNA, 22 bp, Homo sapiens
aaatgcagatccctgaatctca

SEQ ID NO: 8065859 - DNA, 22 bp, Homo sapiens
aaactgataaaataagtacatt

SEQ ID NO: 8065860 - DNA, 21 bp, Homo sapiens
aaagaacaggcagatgttctt

SEQ ID NO: 8065861 - DNA, 21 bp, Homo sapiens
aaactgaccttgcctgagaca

SEQ ID NO: 8065862 - DNA, 22 bp, Homo sapiens
aaactcttttgcatattagagg

SEQ ID NO: 8065863 - DNA, 20 bp, Homo sapiens
aaaaacagtaatgctgaaga

SEQ ID NO: 8065864 - DNA, 22 bp, Homo sapiens
aaaaaccattgtcttcagtctc

SEQ ID NO: 8065865 - DNA, 23 bp, Homo sapiens
aaaaaaccatgtaggcactcagt

SEQ ID NO: 8065866 - DNA, 22 bp, Homo sapiens
aaaaaatcagatctttggttaa

SEQ ID NO: 8065867 - DNA, 22 bp, Homo sapiens
aaaaacacaactgtctttctct

SEQ ID NO: 8065868 - DNA, 22 bp, Homo sapiens
aaaaacacaagtggcttggtct

SEQ ID NO: 8065869 - DNA, 20 bp, Homo sapiens
aaaaacagtaatgctgaaga

SEQ ID NO: 8065870 - DNA, 22 bp, Homo sapiens
aaaaacagaatgtgtctaactc

SEQ ID NO: 8065871 - DNA, 20 bp, Homo sapiens
aaaaacagtaatgctgaaga

SEQ ID NO: 8065872 - DNA, 22 bp, Homo sapiens
aaacagagagatgtatgtggag

SEQ ID NO: 8065873 - DNA, 22 bp, Homo sapiens
aaacagactgcactgccagtca

SEQ ID NO: 8065874 - DNA, 22 bp, Homo sapiens
aaacagaagggtaggtaaacat

SEQ ID NO: 8065875 - DNA, 22 bp, Homo sapiens
aaaagacatatgtgggcattct

SEQ ID NO: 8065876 - DNA, 22 bp, Homo sapiens
aaaagacatctatttcaggcag

SEQ ID NO: 8065877 - DNA, 22 bp, Homo sapiens
aaacagaaatttcctcatgctc

SEQ ID NO: 8065878 - DNA, 22 bp, Homo sapiens
aaacagaaatttcctcatgctc

SEQ ID NO: 8065879 - DNA, 22 bp, Homo sapiens
aaaatgacattccagtgatatt

SEQ ID NO: 8065880 - DNA, 22 bp, Homo sapiens
aaacaagtgtaaactagtctgt

SEQ ID NO: 8065881 - DNA, 22 bp, Homo sapiens
aaaatcagtacactttattttg

SEQ ID NO: 8065882 - DNA, 22 bp, Homo sapiens
aaaatcctgctgactcgagatg

SEQ ID NO: 8065883 - DNA, 22 bp, Homo sapiens
aaagacattgaagaaggactta

SEQ ID NO: 8065884 - DNA, 22 bp, Homo sapiens
aaagacattagattaacgtaca

SEQ ID NO: 8065885 - DNA, 22 bp, Homo sapiens
aaagacattagcttagatgtca

SEQ ID NO: 8065886 - DNA, 22 bp, Homo sapiens
aaagacatggaactagagatgg

SEQ ID NO: 8065887 - DNA, 22 bp, Homo sapiens
aaagacatggaactagagatgg

SEQ ID NO: 8065888 - DNA, 22 bp, Homo sapiens
aactaaatctggcatttagagc

SEQ ID NO: 8065889 - DNA, 22 bp, Homo sapiens
aactaacagtcattaaaagaac

SEQ ID NO: 8065890 - DNA, 22 bp, Homo sapiens
aaagtagtataaaattcatgtg

SEQ ID NO: 8065891 - DNA, 22 bp, Homo sapiens
aaagtagtccttggagcgaaat

SEQ ID NO: 8065892 - DNA, 22 bp, Homo sapiens
aaagtagttagtcatgtgaaaa

SEQ ID NO: 8065893 - DNA, 22 bp, Homo sapiens
aaagtgtactatgtcatgaaca

SEQ ID NO: 8065894 - DNA, 22 bp, Homo sapiens
aacaaaacatttgtcttgtttc

SEQ ID NO: 8065895 - DNA, 22 bp, Homo sapiens
aaattgtggcgtctgtaagagt

SEQ ID NO: 8065896 - DNA, 22 bp, Homo sapiens
aaagatatgtctccaaagagat

SEQ ID NO: 8065897 - DNA, 22 bp, Homo sapiens
aaagccatcagtaaaatgattt

SEQ ID NO: 8065898 - DNA, 22 bp, Homo sapiens
aaagccataagcctaatactaa

SEQ ID NO: 8065899 - DNA, 22 bp, Homo sapiens
aaagccatctgtattaagtgaa

SEQ ID NO: 8065900 - DNA, 22 bp, Homo sapiens
aaagccatgaatgttatagagg

SEQ ID NO: 8065901 - DNA, 22 bp, Homo sapiens
aaagctgctgccaatcaggctt

SEQ ID NO: 8065902 - DNA, 18 bp, Homo sapiens
aaagctgttattccagaa

SEQ ID NO: 8065903 - DNA, 22 bp, Homo sapiens
aaagcttatttgtatgcatgtt

SEQ ID NO: 8065904 - DNA, 22 bp, Homo sapiens
aaatagattgctgaggcattac

SEQ ID NO: 8065905 - DNA, 22 bp, Homo sapiens
aaatactgtagataatagagtt

SEQ ID NO: 8065906 - DNA, 23 bp, Homo sapiens
aaataggagtatctggatcatga

SEQ ID NO: 8065907 - DNA, 22 bp, Homo sapiens
aaatcagatcttacacaattgt

SEQ ID NO: 8065908 - DNA, 22 bp, Homo sapiens
aaatagcataaaataggaagct

SEQ ID NO: 8065909 - DNA, 22 bp, Homo sapiens
aaataggagcttaagcacttct

SEQ ID NO: 8065910 - DNA, 22 bp, Homo sapiens
aaataattatagcgagtctatc

SEQ ID NO: 8065911 - DNA, 22 bp, Homo sapiens
aaataagttaaactagaatgat

SEQ ID NO: 8065912 - DNA, 21 bp, Homo sapiens
aaagtgttcagaccagttctg

SEQ ID NO: 8065913 - DNA, 23 bp, Homo sapiens
aaagtgtagccaggttaagaacc

SEQ ID NO: 8065914 - DNA, 22 bp, Homo sapiens
aaagtgttgggaagaaagtgca

SEQ ID NO: 8065915 - DNA, 22 bp, Homo sapiens
aaagtgttttccatgcaatgaa

SEQ ID NO: 8065916 - DNA, 19 bp, Homo sapiens
aagcatggtgcctcacctc

SEQ ID NO: 8065917 - DNA, 22 bp, Homo sapiens
aagcatcaacctgtatgctgca

SEQ ID NO: 8065918 - DNA, 22 bp, Homo sapiens
aaatcctttggaggacatgatg

SEQ ID NO: 8065919 - DNA, 22 bp, Homo sapiens
aaatccttttctatacagcata

SEQ ID NO: 8065920 - DNA, 22 bp, Homo sapiens
aaatgcacaggttttaaatcct

SEQ ID NO: 8065921 - DNA, 22 bp, Homo sapiens
aaatgcaggaaattatgctttt

SEQ ID NO: 8065922 - DNA, 22 bp, Homo sapiens
aaatgcatgagaaagtattctg

SEQ ID NO: 8065923 - DNA, 22 bp, Homo sapiens
aaatgcatcagctcataagaga

SEQ ID NO: 8065924 - DNA, 22 bp, Homo sapiens
aaatgcatatcaaagacttgaa

SEQ ID NO: 8065925 - DNA, 22 bp, Homo sapiens
aaatgcaggtagtatttatttt

SEQ ID NO: 8065926 - DNA, 22 bp, Homo sapiens
ggcaccaggctgggcataggcc

SEQ ID NO: 8065927 - DNA, 22 bp, Homo sapiens
ggcaccagggacaatcctcttc

SEQ ID NO: 8065928 - DNA, 22 bp, Homo sapiens
ggcaccagggcaagggtctttc

SEQ ID NO: 8065929 - DNA, 22 bp, Homo sapiens
ggcaccagggaaggaaggctgg

SEQ ID NO: 8065930 - DNA, 22 bp, Homo sapiens
ggcaccaggggatgtaatgtcc

SEQ ID NO: 8065931 - DNA, 22 bp, Homo sapiens
ggcacctgctcatctggactca

SEQ ID NO: 8065932 - DNA, 17 bp, Homo sapiens
ggaggcaacagacaggg

SEQ ID NO: 8065933 - DNA, 22 bp, Homo sapiens
ggaggatgccaagctgtgcaca

SEQ ID NO: 8065934 - DNA, 22 bp, Homo sapiens
ggaggatgagctacgaggagct

SEQ ID NO: 8065935 - DNA, 22 bp, Homo sapiens
ggcacgtgcctaaggagcaggc

SEQ ID NO: 8065936 - DNA, 23 bp, Homo sapiens
ggcactgaagctacaatggtgag

SEQ ID NO: 8065937 - DNA, 22 bp, Homo sapiens
ggcagcagaactggccctgtat

SEQ ID NO: 8065938 - DNA, 22 bp, Homo sapiens
ggcagcagaactggccctgtat

SEQ ID NO: 8065939 - DNA, 22 bp, Homo sapiens
ggcagcagaactggccctgtat

SEQ ID NO: 8065940 - DNA, 22 bp, Homo sapiens
ggcagcaactcggagagaagag

SEQ ID NO: 8065941 - DNA, 22 bp, Homo sapiens
ggcagcctccagggcactggtg

SEQ ID NO: 8065942 - DNA, 21 bp, Homo sapiens
ggcagcccgccctctcctggc

SEQ ID NO: 8065943 - DNA, 22 bp, Homo sapiens
ggcagtgcctgatgctgcagga

SEQ ID NO: 8065944 - DNA, 22 bp, Homo sapiens
ggcagtggaggaccctgtgtct

SEQ ID NO: 8065945 - DNA, 22 bp, Homo sapiens
ggcagtggaggaccctgtgtct

SEQ ID NO: 8065946 - DNA, 22 bp, Homo sapiens
ggcagtgcaaggctggcacagt

SEQ ID NO: 8065947 - DNA, 18 bp, Homo sapiens
ggcagtgcagtctcaggg

SEQ ID NO: 8065948 - DNA, 22 bp, Homo sapiens
ggcagtgactgttcagacgtcc

SEQ ID NO: 8065949 - DNA, 22 bp, Homo sapiens
ggcaggggtcctggtgttgact

SEQ ID NO: 8065950 - DNA, 22 bp, Homo sapiens
ggcagggcttgtctctgtgatg

SEQ ID NO: 8065951 - DNA, 22 bp, Homo sapiens
ggcagggagagcatgctgataa

SEQ ID NO: 8065952 - DNA, 22 bp, Homo sapiens
ggcagggaaacagctgatccca

SEQ ID NO: 8065953 - DNA, 22 bp, Homo sapiens
ggccacagtgggaaatcctggg

SEQ ID NO: 8065954 - DNA, 22 bp, Homo sapiens
ggccacctaggagccacagtga

SEQ ID NO: 8065955 - DNA, 19 bp, Homo sapiens
ggccacctctcttcccagg

SEQ ID NO: 8065956 - DNA, 22 bp, Homo sapiens
ggcccatctcttgctctgggtt

SEQ ID NO: 8065957 - DNA, 22 bp, Homo sapiens
ggcccagctgtgcttccagccc

SEQ ID NO: 8065958 - DNA, 22 bp, Homo sapiens
ggcctctggcaggcaggccctc

SEQ ID NO: 8065959 - DNA, 22 bp, Homo sapiens
ggcctctggcaggcaggccctc

SEQ ID NO: 8065960 - DNA, 22 bp, Homo sapiens
ggcctctgccccagccacacct

SEQ ID NO: 8065961 - DNA, 22 bp, Homo sapiens
ggcctctgccctcactcctgtc

SEQ ID NO: 8065962 - DNA, 21 bp, Homo sapiens
ggcctctgccttgccccactc

SEQ ID NO: 8065963 - DNA, 22 bp, Homo sapiens
ggcctctgcctcatctgggcac

SEQ ID NO: 8065964 - DNA, 22 bp, Homo sapiens
ggcctctgaggacagccttggc

SEQ ID NO: 8065965 - DNA, 22 bp, Homo sapiens
ggctctgcctgcccagcagcac

SEQ ID NO: 8065966 - DNA, 22 bp, Homo sapiens
ggctctgcccaggtggacagca

SEQ ID NO: 8065967 - DNA, 22 bp, Homo sapiens
ggctctgcccgcggctgcccac

SEQ ID NO: 8065968 - DNA, 22 bp, Homo sapiens
ggctctgcccagatgaagagga

SEQ ID NO: 8065969 - DNA, 22 bp, Homo sapiens
ggctctgcagtgacttgagggg

SEQ ID NO: 8065970 - DNA, 22 bp, Homo sapiens
ggctctgcatgtgagtgggtgg

SEQ ID NO: 8065971 - DNA, 22 bp, Homo sapiens
ggctctctccttggctttcaga

SEQ ID NO: 8065972 - DNA, 19 bp, Homo sapiens
ggctctcttaaagctgttt

SEQ ID NO: 8065973 - DNA, 22 bp, Homo sapiens
ggctctctgaggaaacccttcc

SEQ ID NO: 8065974 - DNA, 22 bp, Homo sapiens
ggctggcagtgtgagagaggga

SEQ ID NO: 8065975 - DNA, 22 bp, Homo sapiens
ggctggagtgggctccagagtt

SEQ ID NO: 8065976 - DNA, 22 bp, Homo sapiens
ggctgcctgaggctgaggcccg

SEQ ID NO: 8065977 - DNA, 22 bp, Homo sapiens
ggctgcctgaggcagtgagaga

SEQ ID NO: 8065978 - DNA, 22 bp, Homo sapiens
ggctgcctggacctcctctttc

SEQ ID NO: 8065979 - DNA, 22 bp, Homo sapiens
ggctgcctgctcctcctgcacg

SEQ ID NO: 8065980 - DNA, 22 bp, Homo sapiens
ggctggagatatgtctggaaca

SEQ ID NO: 8065981 - DNA, 22 bp, Homo sapiens
ggctgcataggcagaagctgtg

SEQ ID NO: 8065982 - DNA, 22 bp, Homo sapiens
ggctgcagtttgtcttttgctt

SEQ ID NO: 8065983 - DNA, 20 bp, Homo sapiens
ggctgcctccttcctttcct

SEQ ID NO: 8065984 - DNA, 22 bp, Homo sapiens
ggctctgcgcggtaaagtgact

SEQ ID NO: 8065985 - DNA, 22 bp, Homo sapiens
ggctgcaggcttccctccagca

SEQ ID NO: 8065986 - DNA, 22 bp, Homo sapiens
ggctgcaggttggttggcagct

SEQ ID NO: 8065987 - DNA, 22 bp, Homo sapiens
ggctgtgggccagctagaccct

SEQ ID NO: 8065988 - DNA, 22 bp, Homo sapiens
ggctgtgggtgtgacaggcctc

SEQ ID NO: 8065989 - DNA, 23 bp, Homo sapiens
gggagccaggacctcgcgcccca

SEQ ID NO: 8065990 - DNA, 23 bp, Homo sapiens
gggagccatgggtggtcatggag

SEQ ID NO: 8065991 - DNA, 22 bp, Homo sapiens
gggagccatgctggtcttcttt

SEQ ID NO: 8065992 - DNA, 23 bp, Homo sapiens
gggagccatgggtggtcatggag

SEQ ID NO: 8065993 - DNA, 22 bp, Homo sapiens
gggagtggattatgtggaccca

SEQ ID NO: 8065994 - DNA, 22 bp, Homo sapiens
gggagtggagagcaatggatga

SEQ ID NO: 8065995 - DNA, 22 bp, Homo sapiens
gggaggttgaggctgcagtgag

SEQ ID NO: 8065996 - DNA, 22 bp, Homo sapiens
gggagccttgggagtgccagcc

SEQ ID NO: 8065997 - DNA, 22 bp, Homo sapiens
gggatcagaaacatagccctga

SEQ ID NO: 8065998 - DNA, 23 bp, Homo sapiens
gggatatggaccttggaggagtc

SEQ ID NO: 8065999 - DNA, 22 bp, Homo sapiens
gggagtgttgagcgccctgcca

SEQ ID NO: 8066000 - DNA, 22 bp, Homo sapiens
gggagtgggtttggcctaggcc

SEQ ID NO: 8066001 - DNA, 20 bp, Homo sapiens
gggagtggtggtagcctgtg

SEQ ID NO: 8066002 - DNA, 22 bp, Homo sapiens
gggcagagagctggaactcctt

SEQ ID NO: 8066003 - DNA, 20 bp, Homo sapiens
gggcagagccagccagtccc

SEQ ID NO: 8066004 - DNA, 22 bp, Homo sapiens
gggcagagactcagaaacagaa

SEQ ID NO: 8066005 - DNA, 21 bp, Homo sapiens
gggcagaggggcctcctgggt

SEQ ID NO: 8066006 - DNA, 22 bp, Homo sapiens
gggcagaggctctggcccatcc

SEQ ID NO: 8066007 - DNA, 22 bp, Homo sapiens
gggctcagctccttccttccta

SEQ ID NO: 8066008 - DNA, 22 bp, Homo sapiens
gggctctggaaggtgcaccatg

SEQ ID NO: 8066009 - DNA, 22 bp, Homo sapiens
gggctccaacggtgagcatgga

SEQ ID NO: 8066010 - DNA, 22 bp, Homo sapiens
gggccccttgtatctctggctc

SEQ ID NO: 8066011 - DNA, 22 bp, Homo sapiens
gggccccaaaatgccaggctct

SEQ ID NO: 8066012 - DNA, 22 bp, Homo sapiens
gtcaaacagcctcctgttctaa

SEQ ID NO: 8066013 - DNA, 22 bp, Homo sapiens
gtcaaacatagggactttgtgg

SEQ ID NO: 8066014 - DNA, 22 bp, Homo sapiens
gtcaaacaaattaacatatcca

SEQ ID NO: 8066015 - DNA, 22 bp, Homo sapiens
gtcagaggaatggatgagtgat

SEQ ID NO: 8066016 - DNA, 20 bp, Homo sapiens
gtcagaggaccctagagcga

SEQ ID NO: 8066017 - DNA, 22 bp, Homo sapiens
gtcactggaattacaggcatgc

SEQ ID NO: 8066018 - DNA, 22 bp, Homo sapiens
gtcactggggccacatgcagaa

SEQ ID NO: 8066019 - DNA, 22 bp, Homo sapiens
gtcagaaaaagcaaggctgggc

SEQ ID NO: 8066020 - DNA, 22 bp, Homo sapiens
gtcagacaggaatgttgcaagt

SEQ ID NO: 8066021 - DNA, 22 bp, Homo sapiens
gtgctgcctccatatccgtcag

SEQ ID NO: 8066022 - DNA, 22 bp, Homo sapiens
gtgctgccggcatagcagtgaa

SEQ ID NO: 8066023 - DNA, 22 bp, Homo sapiens
gtgctgctcacatctggaggta

SEQ ID NO: 8066024 - DNA, 22 bp, Homo sapiens
gtgctgcctgccagcttctggg

SEQ ID NO: 8066025 - DNA, 22 bp, Homo sapiens
gtgctggcacccctctccagtt

SEQ ID NO: 8066026 - DNA, 22 bp, Homo sapiens
gtgctgcagagtctcgtgccgc

SEQ ID NO: 8066027 - DNA, 22 bp, Homo sapiens
gtgctgcagggcctcctgcacc

SEQ ID NO: 8066028 - DNA, 22 bp, Homo sapiens
gtgccagggagtggaggagctt

SEQ ID NO: 8066029 - DNA, 22 bp, Homo sapiens
gtgccaggtgctaagctgtgct

SEQ ID NO: 8066030 - DNA, 22 bp, Homo sapiens
gtgccaggtgctaagctgtgct

SEQ ID NO: 8066031 - DNA, 22 bp, Homo sapiens
gtgccagctctccccacatctg

SEQ ID NO: 8066032 - DNA, 17 bp, Homo sapiens
gtgcagggatgaaggat

SEQ ID NO: 8066033 - DNA, 22 bp, Homo sapiens
gtgccacttacctgggaggagt

SEQ ID NO: 8066034 - DNA, 22 bp, Homo sapiens
gtgcaggggatcaggttgcagc

SEQ ID NO: 8066035 - DNA, 22 bp, Homo sapiens
gtgcagggagcccagaaggtcc

SEQ ID NO: 8066036 - DNA, 19 bp, Homo sapiens
gtgaggatactgctcagag

SEQ ID NO: 8066037 - DNA, 22 bp, Homo sapiens
gtgaggagtctgaagcacataa

SEQ ID NO: 8066038 - DNA, 22 bp, Homo sapiens
gtctttatttgagattgtcatt

SEQ ID NO: 8066039 - DNA, 22 bp, Homo sapiens
gtctttattacaaatccttttc

SEQ ID NO: 8066040 - DNA, 16 bp, Homo sapiens
gtctttattcacttag

SEQ ID NO: 8066041 - DNA, 22 bp, Homo sapiens
gtgagcagggcaggactgggga

SEQ ID NO: 8066042 - DNA, 23 bp, Homo sapiens
gtctttatagtggggcactttgt

SEQ ID NO: 8066043 - DNA, 22 bp, Homo sapiens
gtctttatctttgaaattagtc

SEQ ID NO: 8066044 - DNA, 22 bp, Homo sapiens
gtctttatatttactaaagaat

SEQ ID NO: 8066045 - DNA, 22 bp, Homo sapiens
gtctttatggtatgaaaactga

SEQ ID NO: 8066046 - DNA, 20 bp, Homo sapiens
gtctttatgttttatgacct

SEQ ID NO: 8066047 - DNA, 22 bp, Homo sapiens
gtcttgatctcctgaccttgtg

SEQ ID NO: 8066048 - DNA, 20 bp, Homo sapiens
gtctacacgggcagtgtaga

SEQ ID NO: 8066049 - DNA, 22 bp, Homo sapiens
ggggaggctgatgtgggcaaag

SEQ ID NO: 8066050 - DNA, 22 bp, Homo sapiens
ggggagaattaccaaaagcgct

SEQ ID NO: 8066051 - DNA, 19 bp, Homo sapiens
ggggagaactagagacagc

SEQ ID NO: 8066052 - DNA, 22 bp, Homo sapiens
ggggagtgacgcagggccatag

SEQ ID NO: 8066053 - DNA, 22 bp, Homo sapiens
gggcttctagaccagcagtgag

SEQ ID NO: 8066054 - DNA, 22 bp, Homo sapiens
gggcttctcttatgctaactgg

SEQ ID NO: 8066055 - DNA, 22 bp, Homo sapiens
gggcttctccctaaggactctg

SEQ ID NO: 8066056 - DNA, 19 bp, Homo sapiens
gggcttctgggatcaagag

SEQ ID NO: 8066057 - DNA, 22 bp, Homo sapiens
gggcttctctttagtgagctga

SEQ ID NO: 8066058 - DNA, 22 bp, Homo sapiens
gggctctgggattcagagcaag

SEQ ID NO: 8066059 - DNA, 22 bp, Homo sapiens
gggctctgggatgctcttagag

SEQ ID NO: 8066060 - DNA, 19 bp, Homo sapiens
gggctctggcctcagtggg

SEQ ID NO: 8066061 - DNA, 18 bp, Homo sapiens
gggctgtgttcatgccca

SEQ ID NO: 8066062 - DNA, 16 bp, Homo sapiens
gggctgggggattctg

SEQ ID NO: 8066063 - DNA, 21 bp, Homo sapiens
gggtggggttccagccttttc

SEQ ID NO: 8066064 - DNA, 22 bp, Homo sapiens
ggggtggattcctacaggtcca

SEQ ID NO: 8066065 - DNA, 20 bp, Homo sapiens
ggggcccaagccctcttgcc

SEQ ID NO: 8066066 - DNA, 22 bp, Homo sapiens
ggggcccagcacccctcctcgc

SEQ ID NO: 8066067 - DNA, 22 bp, Homo sapiens
gggttggggcccagcagtctgc

SEQ ID NO: 8066068 - DNA, 22 bp, Homo sapiens
gggttggggcccagcagtctgc

SEQ ID NO: 8066069 - DNA, 22 bp, Homo sapiens
ggtcccaggaatctgtgttcta

SEQ ID NO: 8066070 - DNA, 22 bp, Homo sapiens
ggtcccagctgctcaagaggct

SEQ ID NO: 8066071 - DNA, 22 bp, Homo sapiens
ggtcccagctggtcactgtcag

SEQ ID NO: 8066072 - DNA, 22 bp, Homo sapiens
ggtccctgaagaggcctggggt

SEQ ID NO: 8066073 - DNA, 22 bp, Homo sapiens
ggtccccgtggaggctggagcg

SEQ ID NO: 8066074 - DNA, 22 bp, Homo sapiens
ggtccccgtggaggctggagcg

SEQ ID NO: 8066075 - DNA, 20 bp, Homo sapiens
ggtccctgccctctgtcatc

SEQ ID NO: 8066076 - DNA, 22 bp, Homo sapiens
ggtccccagcagtggctgcttc

SEQ ID NO: 8066077 - DNA, 22 bp, Homo sapiens
ggtgaggcccagtgatctgtgt

SEQ ID NO: 8066078 - DNA, 22 bp, Homo sapiens
ggtgaggcaggtggctgctgag

SEQ ID NO: 8066079 - DNA, 22 bp, Homo sapiens
ggtgaggctaagtgacacaggg

SEQ ID NO: 8066080 - DNA, 22 bp, Homo sapiens
ggtgagcactgccctgggtctc

SEQ ID NO: 8066081 - DNA, 22 bp, Homo sapiens
ggtgagcagctgtctgtatgga

SEQ ID NO: 8066082 - DNA, 22 bp, Homo sapiens
ggtccctgctgaagccttggtg

SEQ ID NO: 8066083 - DNA, 22 bp, Homo sapiens
ggtggggattcctgatcactgt

SEQ ID NO: 8066084 - DNA, 22 bp, Homo sapiens
ggtggggccagggctccaacct

SEQ ID NO: 8066085 - DNA, 22 bp, Homo sapiens
ggtggggcccaggcatctgatg

SEQ ID NO: 8066086 - DNA, 22 bp, Homo sapiens
ggtggggccctggcactggtat

SEQ ID NO: 8066087 - DNA, 22 bp, Homo sapiens
ggtggggccctggcactggtat

SEQ ID NO: 8066088 - DNA, 22 bp, Homo sapiens
ggtggggctaggacctcaggat

SEQ ID NO: 8066089 - DNA, 22 bp, Homo sapiens
ggtggggcctgctccagcggcc

SEQ ID NO: 8066090 - DNA, 22 bp, Homo sapiens
ggtggggcctgctccagcggcc

SEQ ID NO: 8066091 - DNA, 22 bp, Homo sapiens
ggtggagctgtggacaggaagg

SEQ ID NO: 8066092 - DNA, 22 bp, Homo sapiens
ggtggagctggaccaggagagg

SEQ ID NO: 8066093 - DNA, 21 bp, Homo sapiens
ggttggtgtgtccagtggcca

SEQ ID NO: 8066094 - DNA, 22 bp, Homo sapiens
ggttggtgagtgcagggtgtta

SEQ ID NO: 8066095 - DNA, 22 bp, Homo sapiens
ggttggaggtgggaatagctag

SEQ ID NO: 8066096 - DNA, 22 bp, Homo sapiens
ggttcagtggaatgtgttgacc

SEQ ID NO: 8066097 - DNA, 22 bp, Homo sapiens
ggtgtttgcatggggccagttt

SEQ ID NO: 8066098 - DNA, 22 bp, Homo sapiens
ggtgggtttggaagagcaggct

SEQ ID NO: 8066099 - DNA, 23 bp, Homo sapiens
ggtggtgctcatatctcaggcct

SEQ ID NO: 8066100 - DNA, 22 bp, Homo sapiens
gctctgtgggtgagtagaatct

SEQ ID NO: 8066101 - DNA, 22 bp, Homo sapiens
gctgcctcccccatggctggaa

SEQ ID NO: 8066102 - DNA, 22 bp, Homo sapiens
gctgcctctgcacagctcactc

SEQ ID NO: 8066103 - DNA, 22 bp, Homo sapiens
gctgcctctgcgactctgggcg

SEQ ID NO: 8066104 - DNA, 22 bp, Homo sapiens
gctgcctcctgaaagcgctctg

SEQ ID NO: 8066105 - DNA, 22 bp, Homo sapiens
gctgctgcttgaaggctcggag

SEQ ID NO: 8066106 - DNA, 22 bp, Homo sapiens
gctgcctgaagtgtctacactg

SEQ ID NO: 8066107 - DNA, 23 bp, Homo sapiens
gctgcctctgttggtcttcagtt

SEQ ID NO: 8066108 - DNA, 22 bp, Homo sapiens
gctgcctctgtagctttggacc

SEQ ID NO: 8066109 - DNA, 18 bp, Homo sapiens
gctgctggtggagggagc

SEQ ID NO: 8066110 - DNA, 22 bp, Homo sapiens
gctggagcttgagaggacaggg

SEQ ID NO: 8066111 - DNA, 22 bp, Homo sapiens
gctggaggtttcacctgagttt

SEQ ID NO: 8066112 - DNA, 22 bp, Homo sapiens
gctggcagtcccatcagctggg

SEQ ID NO: 8066113 - DNA, 22 bp, Homo sapiens
gctggcaggtccaagatagagc

SEQ ID NO: 8066114 - DNA, 22 bp, Homo sapiens
gctcccagatttcagccttgtg

SEQ ID NO: 8066115 - DNA, 19 bp, Homo sapiens
gctaggtgaccagctggat

SEQ ID NO: 8066116 - DNA, 20 bp, Homo sapiens
gcctggcacccggggctggc

SEQ ID NO: 8066117 - DNA, 22 bp, Homo sapiens
gcctggagttcagccaagtccc

SEQ ID NO: 8066118 - DNA, 22 bp, Homo sapiens
gcctggcaggcctcatgagggg

SEQ ID NO: 8066119 - DNA, 22 bp, Homo sapiens
gctctctgttattaagatcttt

SEQ ID NO: 8066120 - DNA, 22 bp, Homo sapiens
gctctctgtcgttatgcttcat

SEQ ID NO: 8066121 - DNA, 22 bp, Homo sapiens
gctctgtacgcaggatgagggg

SEQ ID NO: 8066122 - DNA, 22 bp, Homo sapiens
gctctgggtagccactgcctgg

SEQ ID NO: 8066123 - DNA, 22 bp, Homo sapiens
gctctctgggtggtgggcaaca

SEQ ID NO: 8066124 - DNA, 22 bp, Homo sapiens
gctctctggttccagtcaggaa

SEQ ID NO: 8066125 - DNA, 22 bp, Homo sapiens
gctctctggaggccatggacag

SEQ ID NO: 8066126 - DNA, 22 bp, Homo sapiens
gctctctgccatatgaggatac

SEQ ID NO: 8066127 - DNA, 22 bp, Homo sapiens
gctctctgcctttctcaatgac

SEQ ID NO: 8066128 - DNA, 19 bp, Homo sapiens
gctctgtgatgctgagggg

SEQ ID NO: 8066129 - DNA, 22 bp, Homo sapiens
gctctgtgcagttcagggacac

SEQ ID NO: 8066130 - DNA, 22 bp, Homo sapiens
gctctgtgccacatgcagtgtt

SEQ ID NO: 8066131 - DNA, 22 bp, Homo sapiens
gctctgtcaacagctagctgtg

SEQ ID NO: 8066132 - DNA, 22 bp, Homo sapiens
gctctgtcaacagctagctgtg

SEQ ID NO: 8066133 - DNA, 21 bp, Homo sapiens
gctctgtccctgctgtgtgtc

SEQ ID NO: 8066134 - DNA, 22 bp, Homo sapiens
gctccctccatgaggcagaccg

SEQ ID NO: 8066135 - DNA, 22 bp, Homo sapiens
gctccccttggtcctcctggga

SEQ ID NO: 8066136 - DNA, 20 bp, Homo sapiens
gctcccagcctgcagtcccc

SEQ ID NO: 8066137 - DNA, 22 bp, Homo sapiens
gctcccagctggagcctcaaca

SEQ ID NO: 8066138 - DNA, 20 bp, Homo sapiens
gctcccagcctgcagtcccc

SEQ ID NO: 8066139 - DNA, 22 bp, Homo sapiens
gctcccagcattgcttcccagg

SEQ ID NO: 8066140 - DNA, 22 bp, Homo sapiens
gctcccagcattgctgctgaat

SEQ ID NO: 8066141 - DNA, 19 bp, Homo sapiens
gctctccctctcagttgag

SEQ ID NO: 8066142 - DNA, 22 bp, Homo sapiens
gctctcccgcagcctggtgggc

SEQ ID NO: 8066143 - DNA, 22 bp, Homo sapiens
gctccctctgctcaggcacttg

SEQ ID NO: 8066144 - DNA, 22 bp, Homo sapiens
gctctctcttggggattcagca

SEQ ID NO: 8066145 - DNA, 22 bp, Homo sapiens
gctctctgaggtgctggcagag

SEQ ID NO: 8066146 - DNA, 22 bp, Homo sapiens
ggactggactctcaggctcaca

SEQ ID NO: 8066147 - DNA, 22 bp, Homo sapiens
ggactggccggcgctgaggccc

SEQ ID NO: 8066148 - DNA, 22 bp, Homo sapiens
ggactgtctactaacaagaagc

SEQ ID NO: 8066149 - DNA, 22 bp, Homo sapiens
ggagaaagaaatttttgattgg

SEQ ID NO: 8066150 - DNA, 22 bp, Homo sapiens
ggacttgggctggtctgtttct

SEQ ID NO: 8066151 - DNA, 22 bp, Homo sapiens
ggactttaggaagggccaagtg

SEQ ID NO: 8066152 - DNA, 23 bp, Homo sapiens
ggacagggccctgccctatggcc

SEQ ID NO: 8066153 - DNA, 22 bp, Homo sapiens
ggaaggaagtgcagactttaaa

SEQ ID NO: 8066154 - DNA, 22 bp, Homo sapiens
ggaaaaatgacacatatctcaa

SEQ ID NO: 8066155 - DNA, 22 bp, Homo sapiens
ggaaggaggggcaaagcagttc

SEQ ID NO: 8066156 - DNA, 22 bp, Homo sapiens
ggaaggagggcggcaatgatga

SEQ ID NO: 8066157 - DNA, 22 bp, Homo sapiens
ggacagagggttgacagagtat

SEQ ID NO: 8066158 - DNA, 22 bp, Homo sapiens
ggagctgttggcagctatcttg

SEQ ID NO: 8066159 - DNA, 22 bp, Homo sapiens
ggagctgtctgtagggcacagg

SEQ ID NO: 8066160 - DNA, 22 bp, Homo sapiens
ggagctgtaacgagccattgct

SEQ ID NO: 8066161 - DNA, 22 bp, Homo sapiens
ggagctgtgggacgctgtccca

SEQ ID NO: 8066162 - DNA, 22 bp, Homo sapiens
ggagctgtgctgggtgatcagg

SEQ ID NO: 8066163 - DNA, 22 bp, Homo sapiens
ggagctggtcagccttgagcat

SEQ ID NO: 8066164 - DNA, 22 bp, Homo sapiens
ggagctggggttggcatcttcc

SEQ ID NO: 8066165 - DNA, 20 bp, Homo sapiens
ggagctgccctgggctggag

SEQ ID NO: 8066166 - DNA, 22 bp, Homo sapiens
ggagctggctacagagaactcc

SEQ ID NO: 8066167 - DNA, 22 bp, Homo sapiens
ggagctgggaccctgtcatctg

SEQ ID NO: 8066168 - DNA, 22 bp, Homo sapiens
ggagctgggaactatgtagtat

SEQ ID NO: 8066169 - DNA, 22 bp, Homo sapiens
ggagctgggaattggatcatct

SEQ ID NO: 8066170 - DNA, 22 bp, Homo sapiens
ggagcctggcaatgctgcgtcc

SEQ ID NO: 8066171 - DNA, 22 bp, Homo sapiens
ggagcctggcaatgctgcgtcc

SEQ ID NO: 8066172 - DNA, 22 bp, Homo sapiens
ggagccagtgccctctggtgga

SEQ ID NO: 8066173 - DNA, 22 bp, Homo sapiens
ggagccagtttagacctcagtt

SEQ ID NO: 8066174 - DNA, 18 bp, Homo sapiens
ggagccagtctgtctctg

SEQ ID NO: 8066175 - DNA, 22 bp, Homo sapiens
ggagccagggaagctgcttcct

SEQ ID NO: 8066176 - DNA, 22 bp, Homo sapiens
ggagccagtatttagtggtctt

SEQ ID NO: 8066177 - DNA, 22 bp, Homo sapiens
ggagccaggggaccttcacaga

SEQ ID NO: 8066178 - DNA, 22 bp, Homo sapiens
ggagccaggcaatctgtacttt

SEQ ID NO: 8066179 - DNA, 20 bp, Homo sapiens
gcttggaccttctgctctgt

SEQ ID NO: 8066180 - DNA, 23 bp, Homo sapiens
gctttatagttctcccaacatta

SEQ ID NO: 8066181 - DNA, 22 bp, Homo sapiens
gctttatagccctattacatga

SEQ ID NO: 8066182 - DNA, 22 bp, Homo sapiens
gcttttggccagatggggaaac

SEQ ID NO: 8066183 - DNA, 22 bp, Homo sapiens
gctttttcaaatgaaagctggt

SEQ ID NO: 8066184 - DNA, 20 bp, Homo sapiens
gctttttctaatagcagtcc

SEQ ID NO: 8066185 - DNA, 22 bp, Homo sapiens
gctttgtgtagaaggaggatgg

SEQ ID NO: 8066186 - DNA, 22 bp, Homo sapiens
gctgtcctgggaacaggcacta

SEQ ID NO: 8066187 - DNA, 22 bp, Homo sapiens
gctgtctcatacaaggccctgc

SEQ ID NO: 8066188 - DNA, 22 bp, Homo sapiens
gctgtctcatacaaggccctgc

SEQ ID NO: 8066189 - DNA, 22 bp, Homo sapiens
gctgtctgctgtgcactgagca

SEQ ID NO: 8066190 - DNA, 22 bp, Homo sapiens
gctgtcctcttggactcagggc

SEQ ID NO: 8066191 - DNA, 22 bp, Homo sapiens
gctgtcctctgatctctggagg

SEQ ID NO: 8066192 - DNA, 23 bp, Homo sapiens
gctgtccccatgctccatccctg

SEQ ID NO: 8066193 - DNA, 22 bp, Homo sapiens
gctgtcccatggttgcaagatg

SEQ ID NO: 8066194 - DNA, 22 bp, Homo sapiens
gctgtctggaggctctgaggga

SEQ ID NO: 8066195 - DNA, 22 bp, Homo sapiens
gctgtctgggaggcctccactt

SEQ ID NO: 8066196 - DNA, 22 bp, Homo sapiens
gctgtctgggatgtcactgctg

SEQ ID NO: 8066197 - DNA, 20 bp, Homo sapiens
gctgtctggattagaagcct

SEQ ID NO: 8066198 - DNA, 22 bp, Homo sapiens
gctgtctgtctctgtgacttaa

SEQ ID NO: 8066199 - DNA, 22 bp, Homo sapiens
gctgtctgtcttcacatctcgc

SEQ ID NO: 8066200 - DNA, 22 bp, Homo sapiens
gctgtctgtggtgtcagctgac

SEQ ID NO: 8066201 - DNA, 22 bp, Homo sapiens
gctgtctgggttgagggccctg

SEQ ID NO: 8066202 - DNA, 23 bp, Homo sapiens
gctgtctgtcatctctgcgggag

SEQ ID NO: 8066203 - DNA, 22 bp, Homo sapiens
gctgtctgtctctgtcccacca

SEQ ID NO: 8066204 - DNA, 22 bp, Homo sapiens
gctggtccactccctggaggct

SEQ ID NO: 8066205 - DNA, 22 bp, Homo sapiens
gctggtccagggcctctgtggg

SEQ ID NO: 8066206 - DNA, 22 bp, Homo sapiens
gctgtatttattttctagggtt

SEQ ID NO: 8066207 - DNA, 22 bp, Homo sapiens
gctgtatttaacaactggctca

SEQ ID NO: 8066208 - DNA, 22 bp, Homo sapiens
gctgtattcctgcactgtatag

SEQ ID NO: 8066209 - DNA, 22 bp, Homo sapiens
gctgtcacatttggagcactgg

SEQ ID NO: 8066210 - DNA, 22 bp, Homo sapiens
gcagtgtttttcaatgcttcca

SEQ ID NO: 8066211 - DNA, 22 bp, Homo sapiens
gcagtgtttgtgttctcacatg

SEQ ID NO: 8066212 - DNA, 22 bp, Homo sapiens
gcagtgttgtgatccaggtctt

SEQ ID NO: 8066213 - DNA, 22 bp, Homo sapiens
gccacctctctcttgactcgag

SEQ ID NO: 8066214 - DNA, 22 bp, Homo sapiens
gccacctctttgtctctgccgc

SEQ ID NO: 8066215 - DNA, 22 bp, Homo sapiens
gccacctctttgtctctgccgc

SEQ ID NO: 8066216 - DNA, 20 bp, Homo sapiens
gccacctctctagcagtaga

SEQ ID NO: 8066217 - DNA, 21 bp, Homo sapiens
gccacctcgtctcggagcagc

SEQ ID NO: 8066218 - DNA, 21 bp, Homo sapiens
gccacctcgtctcggagcagc

SEQ ID NO: 8066219 - DNA, 22 bp, Homo sapiens
gccacctcggctttctctgctc

SEQ ID NO: 8066220 - DNA, 23 bp, Homo sapiens
gccacctcctggtcagaaagagg

SEQ ID NO: 8066221 - DNA, 22 bp, Homo sapiens
gccacctcccaggacgaggctg

SEQ ID NO: 8066222 - DNA, 22 bp, Homo sapiens
gccacctggacagctgtgccct

SEQ ID NO: 8066223 - DNA, 22 bp, Homo sapiens
gccacctggactcagagccagg

SEQ ID NO: 8066224 - DNA, 22 bp, Homo sapiens
gccagaaacatacacatcactt

SEQ ID NO: 8066225 - DNA, 22 bp, Homo sapiens
gccagaaagaggaggacctggg

SEQ ID NO: 8066226 - DNA, 22 bp, Homo sapiens
gccagagaatgaaaatcagatt

SEQ ID NO: 8066227 - DNA, 22 bp, Homo sapiens
gccagctggtaggcacctagcc

SEQ ID NO: 8066228 - DNA, 22 bp, Homo sapiens
gccagctggtaggcacctagcc

SEQ ID NO: 8066229 - DNA, 22 bp, Homo sapiens
gccaggctccccggatccctgg

SEQ ID NO: 8066230 - DNA, 23 bp, Homo sapiens
gccaggctccggtctgtggccac

SEQ ID NO: 8066231 - DNA, 22 bp, Homo sapiens
gccaggctccaggccctcctga

SEQ ID NO: 8066232 - DNA, 22 bp, Homo sapiens
gccaggcattattccgatccct

SEQ ID NO: 8066233 - DNA, 22 bp, Homo sapiens
gccaggcatgtcctctgcagaa

SEQ ID NO: 8066234 - DNA, 22 bp, Homo sapiens
gccaggctcagcagtcaacctg

SEQ ID NO: 8066235 - DNA, 22 bp, Homo sapiens
gccaggctctcagtgactgccc

SEQ ID NO: 8066236 - DNA, 22 bp, Homo sapiens
gcctgcagtgagtgcagaaggt

SEQ ID NO: 8066237 - DNA, 20 bp, Homo sapiens
gcctgcaggttggatgggat

SEQ ID NO: 8066238 - DNA, 22 bp, Homo sapiens
gcctgcagggtgatgggctgcc

SEQ ID NO: 8066239 - DNA, 22 bp, Homo sapiens
gcctgcagttctgtgctaggca

SEQ ID NO: 8066240 - DNA, 22 bp, Homo sapiens
gcctggagacagcagaggcggc

SEQ ID NO: 8066241 - DNA, 22 bp, Homo sapiens
gcctggagaagatggaactagc

SEQ ID NO: 8066242 - DNA, 22 bp, Homo sapiens
gcctggagaaaggaaggtggga

SEQ ID NO: 8066243 - DNA, 22 bp, Homo sapiens
gcctggagtggacttggcccct

SEQ ID NO: 8066244 - DNA, 16 bp, Homo sapiens
gcctggagtggcaggg

SEQ ID NO: 8066245 - DNA, 22 bp, Homo sapiens
gcctggagcccagtgtggggct

SEQ ID NO: 8066246 - DNA, 22 bp, Homo sapiens
gcctggagtagcatggcaagcc

SEQ ID NO: 8066247 - DNA, 22 bp, Homo sapiens
gcctggagagcactgtgcgctt

SEQ ID NO: 8066248 - DNA, 22 bp, Homo sapiens
gcctggagaggaagccggtgga

SEQ ID NO: 8066249 - DNA, 18 bp, Homo sapiens
gcctgcaggcacgggggt

SEQ ID NO: 8066250 - DNA, 22 bp, Homo sapiens
gcctgcagatatataggatggt

SEQ ID NO: 8066251 - DNA, 19 bp, Homo sapiens
gcctgcagaaaaggcaggg

SEQ ID NO: 8066252 - DNA, 22 bp, Homo sapiens
gcctgagtttgaactctagctc

SEQ ID NO: 8066253 - DNA, 22 bp, Homo sapiens
gcctgagtgcatctgcagacat

SEQ ID NO: 8066254 - DNA, 21 bp, Homo sapiens
gcctgcagaccccaccaggct

SEQ ID NO: 8066255 - DNA, 22 bp, Homo sapiens
gcctgcagaactgtgaggcaat

SEQ ID NO: 8066256 - DNA, 20 bp, Homo sapiens
gcctgcagagaaggtcagag

SEQ ID NO: 8066257 - DNA, 22 bp, Homo sapiens
gcctccctgttcttccacaata

SEQ ID NO: 8066258 - DNA, 18 bp, Homo sapiens
gcctccctggctacactt

SEQ ID NO: 8066259 - DNA, 22 bp, Homo sapiens
gcctccctggcccacagcagcg

SEQ ID NO: 8066260 - DNA, 22 bp, Homo sapiens
gcctcccctgcaattgtccttg

SEQ ID NO: 8066261 - DNA, 22 bp, Homo sapiens
gccctgctgctggcagaggcgc

SEQ ID NO: 8066262 - DNA, 22 bp, Homo sapiens
gccctgctgtttagagagctac

SEQ ID NO: 8066263 - DNA, 23 bp, Homo sapiens
gccctgctcctggctgggaggga

SEQ ID NO: 8066264 - DNA, 22 bp, Homo sapiens
gccctggaatctctccatggga

SEQ ID NO: 8066265 - DNA, 22 bp, Homo sapiens
gcccctggctggccagctcctc

SEQ ID NO: 8066266 - DNA, 22 bp, Homo sapiens
gcccctctcccttgaggcaggc

SEQ ID NO: 8066267 - DNA, 22 bp, Homo sapiens
gcccctcccagtcaggagcact

SEQ ID NO: 8066268 - DNA, 22 bp, Homo sapiens
gcccacagctcgttcctctcct

SEQ ID NO: 8066269 - DNA, 22 bp, Homo sapiens
gcccacacaccagctcaggagg

SEQ ID NO: 8066270 - DNA, 22 bp, Homo sapiens
gcccgtgtgcagagtgggagct

SEQ ID NO: 8066271 - DNA, 22 bp, Homo sapiens
gccccttgtctccaggccccaa

SEQ ID NO: 8066272 - DNA, 22 bp, Homo sapiens
gccccttctctgaggaacctgc

SEQ ID NO: 8066273 - DNA, 22 bp, Homo sapiens
gcccctgggagcagagccacca

SEQ ID NO: 8066274 - DNA, 22 bp, Homo sapiens
gccctcagaggacagctgactt

SEQ ID NO: 8066275 - DNA, 22 bp, Homo sapiens
gcagagtgaagcatttctttct

SEQ ID NO: 8066276 - DNA, 22 bp, Homo sapiens
gcagagtgggagcccagggctg

SEQ ID NO: 8066277 - DNA, 22 bp, Homo sapiens
gcagacaggcccagtggaggga

SEQ ID NO: 8066278 - DNA, 22 bp, Homo sapiens
gcacccagatattgccttgacc

SEQ ID NO: 8066279 - DNA, 22 bp, Homo sapiens
gcacccagcccagggcgtgatg

SEQ ID NO: 8066280 - DNA, 22 bp, Homo sapiens
gcaccagcctgagcctcttgca

SEQ ID NO: 8066281 - DNA, 22 bp, Homo sapiens
gcaccagagggggctctgcagg

SEQ ID NO: 8066282 - DNA, 22 bp, Homo sapiens
gcaccacatcaatgaggggagc

SEQ ID NO: 8066283 - DNA, 22 bp, Homo sapiens
gcaaggagactgtagggccaag

SEQ ID NO: 8066284 - DNA, 22 bp, Homo sapiens
gcaaggacctttgagcgtgcca

SEQ ID NO: 8066285 - DNA, 22 bp, Homo sapiens
gcaaggatgtactgcaatagga

SEQ ID NO: 8066286 - DNA, 20 bp, Homo sapiens
gcaaggcacagtgaggaggg

SEQ ID NO: 8066287 - DNA, 22 bp, Homo sapiens
gcaaggcagcgcggagtagcta

SEQ ID NO: 8066288 - DNA, 22 bp, Homo sapiens
gcaataaataacatggaagaca

SEQ ID NO: 8066289 - DNA, 22 bp, Homo sapiens
gcacagagtgggtgagatgtgg

SEQ ID NO: 8066290 - DNA, 22 bp, Homo sapiens
gcacagagacagtcctgagatc

SEQ ID NO: 8066291 - DNA, 22 bp, Homo sapiens
gcacagagggcagtgagcctct

SEQ ID NO: 8066292 - DNA, 22 bp, Homo sapiens
gcacagagggcagtgagcctct

SEQ ID NO: 8066293 - DNA, 22 bp, Homo sapiens
gcagctgtactggcagcattgt

SEQ ID NO: 8066294 - DNA, 22 bp, Homo sapiens
gcaggcagttgcagttttctag

SEQ ID NO: 8066295 - DNA, 22 bp, Homo sapiens
gcagctgtcactttcacaatgc

SEQ ID NO: 8066296 - DNA, 22 bp, Homo sapiens
gcagctgtcactttcacaatgc

SEQ ID NO: 8066297 - DNA, 22 bp, Homo sapiens
gcagggcagccacaggccccct

SEQ ID NO: 8066298 - DNA, 22 bp, Homo sapiens
gcagggcagcttagtccctgtc

SEQ ID NO: 8066299 - DNA, 22 bp, Homo sapiens
gcagggccagtgcagagaggaa

SEQ ID NO: 8066300 - DNA, 22 bp, Homo sapiens
gcagggccagggctcaggctgt

SEQ ID NO: 8066301 - DNA, 22 bp, Homo sapiens
gcagggcatgggccctgtctgc

SEQ ID NO: 8066302 - DNA, 22 bp, Homo sapiens
gcagctggtctggcctagagta

SEQ ID NO: 8066303 - DNA, 22 bp, Homo sapiens
gcagctggtgcaaatgtcactc

SEQ ID NO: 8066304 - DNA, 22 bp, Homo sapiens
gcagctggttaatgggagaatt

SEQ ID NO: 8066305 - DNA, 22 bp, Homo sapiens
gcagctgggacactgaggccag

SEQ ID NO: 8066306 - DNA, 22 bp, Homo sapiens
gcagctggctcagagaggtggg

SEQ ID NO: 8066307 - DNA, 22 bp, Homo sapiens
gcagcccaatggactgagacag

SEQ ID NO: 8066308 - DNA, 17 bp, Homo sapiens
gcagccagtgcagcagg

SEQ ID NO: 8066309 - DNA, 22 bp, Homo sapiens
gcagccagtatcctctgagatt

SEQ ID NO: 8066310 - DNA, 22 bp, Homo sapiens
gcagccaggaaagctggaccct

SEQ ID NO: 8066311 - DNA, 22 bp, Homo sapiens
gcagccaggtttgaggaccact

SEQ ID NO: 8066312 - DNA, 22 bp, Homo sapiens
gcagccagtgggatgagaaaga

SEQ ID NO: 8066313 - DNA, 17 bp, Homo sapiens
gcagccagtgcagcagg

SEQ ID NO: 8066314 - DNA, 17 bp, Homo sapiens
gcagccagtgcagcagg

SEQ ID NO: 8066315 - DNA, 22 bp, Homo sapiens
gcagcccaaaaaagaggtagat

SEQ ID NO: 8066316 - DNA, 22 bp, Homo sapiens
gcagccagcccctctgacctct

SEQ ID NO: 8066317 - DNA, 22 bp, Homo sapiens
gcagccagaagactcagaacaa

SEQ ID NO: 8066318 - DNA, 21 bp, Homo sapiens
gcagccagccgagaccatgcc

SEQ ID NO: 8066319 - DNA, 21 bp, Homo sapiens
gcagccagccgagaccatgcc

SEQ ID NO: 8066320 - DNA, 22 bp, Homo sapiens
gcagccagccctagtcccactt

SEQ ID NO: 8066321 - DNA, 22 bp, Homo sapiens
gcagccagcccctctgacctct

SEQ ID NO: 8066322 - DNA, 22 bp, Homo sapiens
gcagcagcccagggctctcaga

SEQ ID NO: 8066323 - DNA, 22 bp, Homo sapiens
gcagcagcaggcgctcggccgt

SEQ ID NO: 8066324 - DNA, 22 bp, Homo sapiens
gcagcagcaggcgctcggccgt

SEQ ID NO: 8066325 - DNA, 22 bp, Homo sapiens
gcagcagaagtagaagtacagg

SEQ ID NO: 8066326 - DNA, 22 bp, Homo sapiens
gcagcacatataaacaaagaga

SEQ ID NO: 8066327 - DNA, 21 bp, Homo sapiens
tccagggaacttctcaggaat

SEQ ID NO: 8066328 - DNA, 22 bp, Homo sapiens
tccaggctgggctgaagggtgc

SEQ ID NO: 8066329 - DNA, 22 bp, Homo sapiens
tccagggaaggtgtgaggctgg

SEQ ID NO: 8066330 - DNA, 22 bp, Homo sapiens
tccagggaagagcagaggctac

SEQ ID NO: 8066331 - DNA, 22 bp, Homo sapiens
tccagggacacagagtccttct

SEQ ID NO: 8066332 - DNA, 22 bp, Homo sapiens
tccagggctgacttgggagagg

SEQ ID NO: 8066333 - DNA, 22 bp, Homo sapiens
tccagggctgggttggctcagc

SEQ ID NO: 8066334 - DNA, 22 bp, Homo sapiens
tccagtatgactgatgtccttc

SEQ ID NO: 8066335 - DNA, 22 bp, Homo sapiens
tccagggcttggctgggacggt

SEQ ID NO: 8066336 - DNA, 22 bp, Homo sapiens
tccacaaggcagctcctccagg

SEQ ID NO: 8066337 - DNA, 22 bp, Homo sapiens
tccacaaggcagctcctccagg

SEQ ID NO: 8066338 - DNA, 22 bp, Homo sapiens
tccacaaggcagctcctccagg

SEQ ID NO: 8066339 - DNA, 22 bp, Homo sapiens
tccaggctggacatgaggcggg

SEQ ID NO: 8066340 - DNA, 22 bp, Homo sapiens
tccaggctaggtttacaggaca

SEQ ID NO: 8066341 - DNA, 22 bp, Homo sapiens
tccattggtctctgtgcccagg

SEQ ID NO: 8066342 - DNA, 22 bp, Homo sapiens
tcccaaagctactcttctgact

SEQ ID NO: 8066343 - DNA, 22 bp, Homo sapiens
tcccaaagctactcttctgact

SEQ ID NO: 8066344 - DNA, 22 bp, Homo sapiens
tccatttagctggcaaacaatg

SEQ ID NO: 8066345 - DNA, 22 bp, Homo sapiens
tccatggggcccaggatgagag

SEQ ID NO: 8066346 - DNA, 22 bp, Homo sapiens
tccatgtgccaaggggcagagg

SEQ ID NO: 8066347 - DNA, 22 bp, Homo sapiens
tccatgggtagccctggttgag

SEQ ID NO: 8066348 - DNA, 22 bp, Homo sapiens
tccatgtggccagacactggca

SEQ ID NO: 8066349 - DNA, 22 bp, Homo sapiens
tcccagagatttcctctccttc

SEQ ID NO: 8066350 - DNA, 22 bp, Homo sapiens
tcccaagacctggcatccaagt

SEQ ID NO: 8066351 - DNA, 22 bp, Homo sapiens
tcccaaatataatgcaagagac

SEQ ID NO: 8066352 - DNA, 22 bp, Homo sapiens
tcccagcccaggtatgatgata

SEQ ID NO: 8066353 - DNA, 22 bp, Homo sapiens
tcccagccacaggtgtagccct

SEQ ID NO: 8066354 - DNA, 22 bp, Homo sapiens
tcccagcctcctgacagttttg

SEQ ID NO: 8066355 - DNA, 23 bp, Homo sapiens
tcccagcctcttctcttgcatac

SEQ ID NO: 8066356 - DNA, 22 bp, Homo sapiens
tcccagccggtgcctgggtccc

SEQ ID NO: 8066357 - DNA, 22 bp, Homo sapiens
tcccagaggctccagtctctat

SEQ ID NO: 8066358 - DNA, 22 bp, Homo sapiens
tcccagcataacaaactgcccg

SEQ ID NO: 8066359 - DNA, 22 bp, Homo sapiens
tcccaggccacacttggggaac

SEQ ID NO: 8066360 - DNA, 22 bp, Homo sapiens
tcccagccttccttgtggtgaa

SEQ ID NO: 8066361 - DNA, 22 bp, Homo sapiens
tcccagcctttctttctccagc

SEQ ID NO: 8066362 - DNA, 22 bp, Homo sapiens
tcccagccttatctcccctggc

SEQ ID NO: 8066363 - DNA, 22 bp, Homo sapiens
tcccagccttccagtctggttt

SEQ ID NO: 8066364 - DNA, 22 bp, Homo sapiens
tcccagcctggaccctgccagt

SEQ ID NO: 8066365 - DNA, 22 bp, Homo sapiens
tcccagcctgacagtgcatcaa

SEQ ID NO: 8066366 - DNA, 22 bp, Homo sapiens
tcccagcctggaccctgccagt

SEQ ID NO: 8066367 - DNA, 22 bp, Homo sapiens
tcctaggatctggggtgttttt

SEQ ID NO: 8066368 - DNA, 22 bp, Homo sapiens
tcctagaataatctttgactgc

SEQ ID NO: 8066369 - DNA, 22 bp, Homo sapiens
tcctagaaggatcattctagtg

SEQ ID NO: 8066370 - DNA, 20 bp, Homo sapiens
tccctggaggtggtggcatc

SEQ ID NO: 8066371 - DNA, 22 bp, Homo sapiens
tccctggacaacagacttcact

SEQ ID NO: 8066372 - DNA, 22 bp, Homo sapiens
tccctggacagccttgcctggg

SEQ ID NO: 8066373 - DNA, 22 bp, Homo sapiens
tccctggagataacttctggga

SEQ ID NO: 8066374 - DNA, 23 bp, Homo sapiens
tccctggaggcaggtccagggcc

SEQ ID NO: 8066375 - DNA, 22 bp, Homo sapiens
tccctggctgggggctgccttg

SEQ ID NO: 8066376 - DNA, 19 bp, Homo sapiens
tccctggcgcctctcgggc

SEQ ID NO: 8066377 - DNA, 22 bp, Homo sapiens
tccctggccattcctctaggcc

SEQ ID NO: 8066378 - DNA, 22 bp, Homo sapiens
tccctggctgtgttcaggtgcg

SEQ ID NO: 8066379 - DNA, 22 bp, Homo sapiens
tcctcaggtcaaagcaggagaa

SEQ ID NO: 8066380 - DNA, 22 bp, Homo sapiens
tcctcagggggccaacccagcc

SEQ ID NO: 8066381 - DNA, 21 bp, Homo sapiens
tcctcagggccccagagcact

SEQ ID NO: 8066382 - DNA, 22 bp, Homo sapiens
tcctcagggcggcctccgtctt

SEQ ID NO: 8066383 - DNA, 19 bp, Homo sapiens
tcctcaggggctcacagac

SEQ ID NO: 8066384 - DNA, 22 bp, Homo sapiens
tcctcacaagcaagcacaggta

SEQ ID NO: 8066385 - DNA, 22 bp, Homo sapiens
tcctcacatggtgagccacaca

SEQ ID NO: 8066386 - DNA, 22 bp, Homo sapiens
tccctgaaacataatagatgcc

SEQ ID NO: 8066387 - DNA, 22 bp, Homo sapiens
tccctctgtgttgggcatgcct

SEQ ID NO: 8066388 - DNA, 22 bp, Homo sapiens
tcccagggacaccaagctgttt

SEQ ID NO: 8066389 - DNA, 23 bp, Homo sapiens
tcccagggaaggtgagcgaggct

SEQ ID NO: 8066390 - DNA, 19 bp, Homo sapiens
tcccgcccactgagcgtgc

SEQ ID NO: 8066391 - DNA, 22 bp, Homo sapiens
tcccagggactctctgccttcc

SEQ ID NO: 8066392 - DNA, 22 bp, Homo sapiens
tcctgcaggcctgttcccagta

SEQ ID NO: 8066393 - DNA, 22 bp, Homo sapiens
tcctgcctagcaggtgacctat

SEQ ID NO: 8066394 - DNA, 22 bp, Homo sapiens
tcctgcctaccttgcggaggtg

SEQ ID NO: 8066395 - DNA, 22 bp, Homo sapiens
tcctgcctcaggctctggagta

SEQ ID NO: 8066396 - DNA, 22 bp, Homo sapiens
tcctgcctcacagttgaagttt

SEQ ID NO: 8066397 - DNA, 22 bp, Homo sapiens
tcctgcctctccatgctaacta

SEQ ID NO: 8066398 - DNA, 22 bp, Homo sapiens
tcctgcctgagcgtggaggagg

SEQ ID NO: 8066399 - DNA, 22 bp, Homo sapiens
tcctgcctgcaatcccagcact

SEQ ID NO: 8066400 - DNA, 22 bp, Homo sapiens
tcctgcctcttgccttcttcac

SEQ ID NO: 8066401 - DNA, 22 bp, Homo sapiens
tcctgcctcttttcttattcca

SEQ ID NO: 8066402 - DNA, 22 bp, Homo sapiens
tcctgagatccttttagggatc

SEQ ID NO: 8066403 - DNA, 22 bp, Homo sapiens
tcctgagatgagacagtgctgc

SEQ ID NO: 8066404 - DNA, 20 bp, Homo sapiens
tcctgagaggctcttggaga

SEQ ID NO: 8066405 - DNA, 22 bp, Homo sapiens
tcctgagagtcaagaatgcagg

SEQ ID NO: 8066406 - DNA, 22 bp, Homo sapiens
tcctgagataaatctcatgtga

SEQ ID NO: 8066407 - DNA, 22 bp, Homo sapiens
tcctgatggaggggtcatcttt

SEQ ID NO: 8066408 - DNA, 22 bp, Homo sapiens
tcctcttctgcccatcagaggc

SEQ ID NO: 8066409 - DNA, 22 bp, Homo sapiens
tcctcaggtgactaggtatctt

SEQ ID NO: 8066410 - DNA, 22 bp, Homo sapiens
tcctgagaatagagttgcatgt

SEQ ID NO: 8066411 - DNA, 22 bp, Homo sapiens
tcctgaaattctggttgtcact

SEQ ID NO: 8066412 - DNA, 19 bp, Homo sapiens
tcctgaaaacttctggaat

SEQ ID NO: 8066413 - DNA, 22 bp, Homo sapiens
tcctgaaaataatttcacaaga

SEQ ID NO: 8066414 - DNA, 22 bp, Homo sapiens
tcctgaaaaattacatgttcag

SEQ ID NO: 8066415 - DNA, 22 bp, Homo sapiens
tcaggacatttgtcagcaggag

SEQ ID NO: 8066416 - DNA, 22 bp, Homo sapiens
tcaggagaacttccttctaccc

SEQ ID NO: 8066417 - DNA, 22 bp, Homo sapiens
tcaggagaatcagggctgtcct

SEQ ID NO: 8066418 - DNA, 22 bp, Homo sapiens
tcaggacagccagggtgcagac

SEQ ID NO: 8066419 - DNA, 22 bp, Homo sapiens
tcaggacagaaggctgccaggg

SEQ ID NO: 8066420 - DNA, 22 bp, Homo sapiens
tcagctggatgtggaagtgcta

SEQ ID NO: 8066421 - DNA, 22 bp, Homo sapiens
tcagcatcaggttgtctgaatt

SEQ ID NO: 8066422 - DNA, 22 bp, Homo sapiens
tcagcatgttcttaggtcacag

SEQ ID NO: 8066423 - DNA, 20 bp, Homo sapiens
tcagcatgctcctcagacat

SEQ ID NO: 8066424 - DNA, 22 bp, Homo sapiens
tcagcatgtacttctcctccat

SEQ ID NO: 8066425 - DNA, 20 bp, Homo sapiens
tcagcatgttctcctccggt

SEQ ID NO: 8066426 - DNA, 19 bp, Homo sapiens
tcagcatcaatttggtcct

SEQ ID NO: 8066427 - DNA, 22 bp, Homo sapiens
tcagccagaaagtgattttcag

SEQ ID NO: 8066428 - DNA, 22 bp, Homo sapiens
tcagccagaggcttcttggttt

SEQ ID NO: 8066429 - DNA, 22 bp, Homo sapiens
tcagccagagggggcaaaggaa

SEQ ID NO: 8066430 - DNA, 22 bp, Homo sapiens
tcagccagaggtggatgagtca

SEQ ID NO: 8066431 - DNA, 22 bp, Homo sapiens
tcagccagcattacccctgact

SEQ ID NO: 8066432 - DNA, 22 bp, Homo sapiens
tcagccagcatcagctaagtgc

SEQ ID NO: 8066433 - DNA, 22 bp, Homo sapiens
tcagccagccagctacaggctt

SEQ ID NO: 8066434 - DNA, 20 bp, Homo sapiens
tcagccagctaacatgggga

SEQ ID NO: 8066435 - DNA, 20 bp, Homo sapiens
tcagccagctaacatgggga

SEQ ID NO: 8066436 - DNA, 22 bp, Homo sapiens
tcagccagctcttggactctga

SEQ ID NO: 8066437 - DNA, 22 bp, Homo sapiens
tcagccagctgtgtgcttctgc

SEQ ID NO: 8066438 - DNA, 22 bp, Homo sapiens
tcagccaggcacaatggcagct

SEQ ID NO: 8066439 - DNA, 22 bp, Homo sapiens
tcagccaggcagccccctggtc

SEQ ID NO: 8066440 - DNA, 22 bp, Homo sapiens
tcagccaggccaccttcagctt

SEQ ID NO: 8066441 - DNA, 17 bp, Homo sapiens
tcagcaaagacaaagga

SEQ ID NO: 8066442 - DNA, 22 bp, Homo sapiens
tcagcaaaggaccagcacaggc

SEQ ID NO: 8066443 - DNA, 22 bp, Homo sapiens
tcagcaggcggttccttgtggg

SEQ ID NO: 8066444 - DNA, 22 bp, Homo sapiens
tcagcaggcaggaggcatgcca

SEQ ID NO: 8066445 - DNA, 22 bp, Homo sapiens
tcagcagggaggctctgtgccc

SEQ ID NO: 8066446 - DNA, 22 bp, Homo sapiens
tcagcagggagaggagaatgca

SEQ ID NO: 8066447 - DNA, 22 bp, Homo sapiens
tcagcagggcctccttgtgcag

SEQ ID NO: 8066448 - DNA, 22 bp, Homo sapiens
tcagacaagttgatgtacctgg

SEQ ID NO: 8066449 - DNA, 22 bp, Homo sapiens
tcagacaactctggaggctggc

SEQ ID NO: 8066450 - DNA, 20 bp, Homo sapiens
tcagaagtttcctggagcat

SEQ ID NO: 8066451 - DNA, 22 bp, Homo sapiens
tcagaataaacatgggcatggg

SEQ ID NO: 8066452 - DNA, 22 bp, Homo sapiens
tcagaagccgggcaggttttgg

SEQ ID NO: 8066453 - DNA, 22 bp, Homo sapiens
tcagaagccggaagtgctcctc

SEQ ID NO: 8066454 - DNA, 22 bp, Homo sapiens
tcagaacaggttgtactatgtc

SEQ ID NO: 8066455 - DNA, 22 bp, Homo sapiens
tcagaacagcacagggtgattt

SEQ ID NO: 8066456 - DNA, 22 bp, Homo sapiens
tcagaaagaacacaggcagtag

SEQ ID NO: 8066457 - DNA, 22 bp, Homo sapiens
tcagaaagctatatggtgtgtc

SEQ ID NO: 8066458 - DNA, 22 bp, Homo sapiens
tcagaaagacgaaacagatggg

SEQ ID NO: 8066459 - DNA, 22 bp, Homo sapiens
tcagaaaggccacatggtgcag

SEQ ID NO: 8066460 - DNA, 22 bp, Homo sapiens
tcagaaaggttctatgttttac

SEQ ID NO: 8066461 - DNA, 22 bp, Homo sapiens
tcagaacaattcctttataaca

SEQ ID NO: 8066462 - DNA, 22 bp, Homo sapiens
tcagaaaggccacatggtgcag

SEQ ID NO: 8066463 - DNA, 22 bp, Homo sapiens
tcagaacaattgggaaccatta

SEQ ID NO: 8066464 - DNA, 22 bp, Homo sapiens
tcagaacactttctctactgac

SEQ ID NO: 8066465 - DNA, 22 bp, Homo sapiens
tcagaacagaagaaggaacacg

SEQ ID NO: 8066466 - DNA, 22 bp, Homo sapiens
tcactgcaacctccacctcccg

SEQ ID NO: 8066467 - DNA, 22 bp, Homo sapiens
tcactgcatcccatctccagcc

SEQ ID NO: 8066468 - DNA, 22 bp, Homo sapiens
tcactgcaacctccacctcctg

SEQ ID NO: 8066469 - DNA, 22 bp, Homo sapiens
tcacagtcggtgacttcttgct

SEQ ID NO: 8066470 - DNA, 22 bp, Homo sapiens
tcaagaaagggcttcaccagga

SEQ ID NO: 8066471 - DNA, 22 bp, Homo sapiens
tcaagaaaatgcctgctggtgt

SEQ ID NO: 8066472 - DNA, 22 bp, Homo sapiens
tcaaatgagtgactcacacagg

SEQ ID NO: 8066473 - DNA, 22 bp, Homo sapiens
tcaaatgaggctgatgaatgtg

SEQ ID NO: 8066474 - DNA, 22 bp, Homo sapiens
tcacagtgcacccctcacaggg

SEQ ID NO: 8066475 - DNA, 18 bp, Homo sapiens
tcacagtgctcttgccta

SEQ ID NO: 8066476 - DNA, 22 bp, Homo sapiens
tcacagtgatgacgtgggagca

SEQ ID NO: 8066477 - DNA, 22 bp, Homo sapiens
tcacagtgagccatgtcagaga

SEQ ID NO: 8066478 - DNA, 22 bp, Homo sapiens
tcattgtaattatctgtggtat

SEQ ID NO: 8066479 - DNA, 22 bp, Homo sapiens
tcatgcatctgggctggctggt

SEQ ID NO: 8066480 - DNA, 22 bp, Homo sapiens
tcatttataaggatgcaattaa

SEQ ID NO: 8066481 - DNA, 22 bp, Homo sapiens
tcatttaataatttttgagtag

SEQ ID NO: 8066482 - DNA, 22 bp, Homo sapiens
tcatttctcccggccaaaaact

SEQ ID NO: 8066483 - DNA, 22 bp, Homo sapiens
tcatttatattgtattctgtag

SEQ ID NO: 8066484 - DNA, 21 bp, Homo sapiens
tcatttttattgctaccttgc

SEQ ID NO: 8066485 - DNA, 22 bp, Homo sapiens
tcatttttctcttacacgtaga

SEQ ID NO: 8066486 - DNA, 22 bp, Homo sapiens
tccaaacaccctccatgctgca

SEQ ID NO: 8066487 - DNA, 22 bp, Homo sapiens
tccaaagtaatttcacttctgt

SEQ ID NO: 8066488 - DNA, 19 bp, Homo sapiens
tccaaaggacccacctcca

SEQ ID NO: 8066489 - DNA, 19 bp, Homo sapiens
tccaaaggacccacctcca

SEQ ID NO: 8066490 - DNA, 20 bp, Homo sapiens
tccaagttataaagtgccaa

SEQ ID NO: 8066491 - DNA, 22 bp, Homo sapiens
tccaagttctaggaactgctgc

SEQ ID NO: 8066492 - DNA, 22 bp, Homo sapiens
tccaagtttcttctgcacaaca

SEQ ID NO: 8066493 - DNA, 20 bp, Homo sapiens
tccaagggcagcagaatcag

SEQ ID NO: 8066494 - DNA, 23 bp, Homo sapiens
tccaagggctacaaacacagacc

SEQ ID NO: 8066495 - DNA, 22 bp, Homo sapiens
tccaagggcagccatagaactt

SEQ ID NO: 8066496 - DNA, 22 bp, Homo sapiens
tccaagtataaattagatactg

SEQ ID NO: 8066497 - DNA, 22 bp, Homo sapiens
tccaactttctcctccggcttg

SEQ ID NO: 8066498 - DNA, 22 bp, Homo sapiens
tcagggcatactcttcaaggtc

SEQ ID NO: 8066499 - DNA, 22 bp, Homo sapiens
tcagggcatcatcatgaatata

SEQ ID NO: 8066500 - DNA, 22 bp, Homo sapiens
tcagggcatccattgcctgttg

SEQ ID NO: 8066501 - DNA, 22 bp, Homo sapiens
tcagggctcaccagcctctgcc

SEQ ID NO: 8066502 - DNA, 21 bp, Homo sapiens
tcagggcagtgggaggttcct

SEQ ID NO: 8066503 - DNA, 22 bp, Homo sapiens
tcagggcaggttaacttgggtg

SEQ ID NO: 8066504 - DNA, 22 bp, Homo sapiens
tcagggcaggcgagcagctgct

SEQ ID NO: 8066505 - DNA, 22 bp, Homo sapiens
tcagggcaggacagtgtaggcc

SEQ ID NO: 8066506 - DNA, 17 bp, Homo sapiens
tcaggctgggtgcagtg

SEQ ID NO: 8066507 - DNA, 22 bp, Homo sapiens
tcaggctggtggtcagatggct

SEQ ID NO: 8066508 - DNA, 22 bp, Homo sapiens
tcatagatgtgctgtgcacaaa

SEQ ID NO: 8066509 - DNA, 22 bp, Homo sapiens
tcataaattagctgtctttgaa

SEQ ID NO: 8066510 - DNA, 22 bp, Homo sapiens
tcatcttctattaatagggaga

SEQ ID NO: 8066511 - DNA, 22 bp, Homo sapiens
tcagttaagaggccacggcagt

SEQ ID NO: 8066512 - DNA, 22 bp, Homo sapiens
tcataaagttacccaaatttta

SEQ ID NO: 8066513 - DNA, 22 bp, Homo sapiens
tcataaagttctaagaattgta

SEQ ID NO: 8066514 - DNA, 22 bp, Homo sapiens
tcataaagttatcaccaaatcc

SEQ ID NO: 8066515 - DNA, 23 bp, Homo sapiens
tcataaatattagcacagtagga

SEQ ID NO: 8066516 - DNA, 22 bp, Homo sapiens
tcagtcctgatgacaggcccaa

SEQ ID NO: 8066517 - DNA, 23 bp, Homo sapiens
tcagtcctgtaggggctccaggt

SEQ ID NO: 8066518 - DNA, 21 bp, Homo sapiens
tcagtcctgttagcctttggg

SEQ ID NO: 8066519 - DNA, 22 bp, Homo sapiens
tcagtcctccacacaggcaccc

SEQ ID NO: 8066520 - DNA, 22 bp, Homo sapiens
tcagtcctacacgctcagggac

SEQ ID NO: 8066521 - DNA, 22 bp, Homo sapiens
tatgtaaagtagatggcaggta

SEQ ID NO: 8066522 - DNA, 22 bp, Homo sapiens
tatggaaagggagtttaatttg

SEQ ID NO: 8066523 - DNA, 22 bp, Homo sapiens
tatggaaactaattcatttttc

SEQ ID NO: 8066524 - DNA, 22 bp, Homo sapiens
tatggaaaaatgtatcttgtca

SEQ ID NO: 8066525 - DNA, 22 bp, Homo sapiens
tatggaaataattagacaagtg

SEQ ID NO: 8066526 - DNA, 22 bp, Homo sapiens
tattaacatgaactgacttttc

SEQ ID NO: 8066527 - DNA, 22 bp, Homo sapiens
tattaacattttatgaaaataa

SEQ ID NO: 8066528 - DNA, 22 bp, Homo sapiens
tattaaattatggatttaggag

SEQ ID NO: 8066529 - DNA, 22 bp, Homo sapiens
tattaaattatggatttaggag

SEQ ID NO: 8066530 - DNA, 22 bp, Homo sapiens
tatcatttaacagaatcattgc

SEQ ID NO: 8066531 - DNA, 22 bp, Homo sapiens
tatcatttgttattattagtgg

SEQ ID NO: 8066532 - DNA, 22 bp, Homo sapiens
tatgaaaaggtggccaatgtag

SEQ ID NO: 8066533 - DNA, 22 bp, Homo sapiens
tatgaaagaatctcagagcaca

SEQ ID NO: 8066534 - DNA, 23 bp, Homo sapiens
tatctttttcaatgttggaaata

SEQ ID NO: 8066535 - DNA, 22 bp, Homo sapiens
tatcttttgagttctcaagatg

SEQ ID NO: 8066536 - DNA, 18 bp, Homo sapiens
tatcttttccagtggtat

SEQ ID NO: 8066537 - DNA, 22 bp, Homo sapiens
tatgaaatttaaacacagatca

SEQ ID NO: 8066538 - DNA, 22 bp, Homo sapiens
tatcagaaactctggggcaggg

SEQ ID NO: 8066539 - DNA, 22 bp, Homo sapiens
tatcagaaatcaacacacagtg

SEQ ID NO: 8066540 - DNA, 22 bp, Homo sapiens
tatcagaaggcacatggagtct

SEQ ID NO: 8066541 - DNA, 22 bp, Homo sapiens
tatcagaatgcagccatgtgca

SEQ ID NO: 8066542 - DNA, 22 bp, Homo sapiens
tatcagaagacttacagtatcg

SEQ ID NO: 8066543 - DNA, 21 bp, Homo sapiens
tatcagaagagaaagaatgat

SEQ ID NO: 8066544 - DNA, 22 bp, Homo sapiens
tatcagcgtgcaaatctttgga

SEQ ID NO: 8066545 - DNA, 22 bp, Homo sapiens
tataaagctgactcatgaaact

SEQ ID NO: 8066546 - DNA, 22 bp, Homo sapiens
tataaaattctcagtttggggt

SEQ ID NO: 8066547 - DNA, 22 bp, Homo sapiens
tataaaatggcatcagctccaa

SEQ ID NO: 8066548 - DNA, 22 bp, Homo sapiens
tataaaacagaaagcactacct

SEQ ID NO: 8066549 - DNA, 18 bp, Homo sapiens
tataaacacacttaggtt

SEQ ID NO: 8066550 - DNA, 22 bp, Homo sapiens
tcaaataatgccattcatcatc

SEQ ID NO: 8066551 - DNA, 18 bp, Homo sapiens
tcaaagtctggctccact

SEQ ID NO: 8066552 - DNA, 22 bp, Homo sapiens
tcaaagtctatctgtaattact

SEQ ID NO: 8066553 - DNA, 22 bp, Homo sapiens
tcaaagtccttgctttttctgt

SEQ ID NO: 8066554 - DNA, 22 bp, Homo sapiens
tcaaagtcatggctagtaatga

SEQ ID NO: 8066555 - DNA, 19 bp, Homo sapiens
tcaaagtctgagtcacttt

SEQ ID NO: 8066556 - DNA, 22 bp, Homo sapiens
tcaaagtctctgcttctgtaac

SEQ ID NO: 8066557 - DNA, 22 bp, Homo sapiens
tcaaagtcatggcaggctcaga

SEQ ID NO: 8066558 - DNA, 22 bp, Homo sapiens
tcaaagtcacaactctctaatt

SEQ ID NO: 8066559 - DNA, 19 bp, Homo sapiens
tcaaaggcttttaggagac

SEQ ID NO: 8066560 - DNA, 19 bp, Homo sapiens
tcaaaggcttttaggagac

SEQ ID NO: 8066561 - DNA, 22 bp, Homo sapiens
tcaaaggcttgtggttctggga

SEQ ID NO: 8066562 - DNA, 22 bp, Homo sapiens
tcaaaggctgcttgtcttctgg

SEQ ID NO: 8066563 - DNA, 22 bp, Homo sapiens
tcaaataccagcaatttcatgt

SEQ ID NO: 8066564 - DNA, 22 bp, Homo sapiens
tcaaatacatggtcaatcaact

SEQ ID NO: 8066565 - DNA, 22 bp, Homo sapiens
tcaaatgaagacagttgacttg

SEQ ID NO: 8066566 - DNA, 22 bp, Homo sapiens
tcaaatcagcaagcagcttccc

SEQ ID NO: 8066567 - DNA, 22 bp, Homo sapiens
tcaaaggcggtccaggaataaa

SEQ ID NO: 8066568 - DNA, 22 bp, Homo sapiens
tatttcttgttattctcgttga

SEQ ID NO: 8066569 - DNA, 22 bp, Homo sapiens
tatttgcaggacatagatatgg

SEQ ID NO: 8066570 - DNA, 22 bp, Homo sapiens
tatttgatggttctaaaacagc

SEQ ID NO: 8066571 - DNA, 22 bp, Homo sapiens
tatttaaaatagtgctccagca

SEQ ID NO: 8066572 - DNA, 22 bp, Homo sapiens
tatttaactggaaacacaatga

SEQ ID NO: 8066573 - DNA, 22 bp, Homo sapiens
tagagacagaaagtagaatggt

SEQ ID NO: 8066574 - DNA, 21 bp, Homo sapiens
tagagaaaagaagctgttcct

SEQ ID NO: 8066575 - DNA, 22 bp, Homo sapiens
tagagaaataagctttgccttg

SEQ ID NO: 8066576 - DNA, 22 bp, Homo sapiens
tagagaaaagcagggatcagga

SEQ ID NO: 8066577 - DNA, 22 bp, Homo sapiens
tagaagaaaagcacttagagat

SEQ ID NO: 8066578 - DNA, 22 bp, Homo sapiens
tagaagaacatgtcaaactata

SEQ ID NO: 8066579 - DNA, 22 bp, Homo sapiens
tagaacatgctcatgtataaat

SEQ ID NO: 8066580 - DNA, 22 bp, Homo sapiens
tagaacatgtgaaaatatagcc

SEQ ID NO: 8066581 - DNA, 22 bp, Homo sapiens
tagcaagaaaacacaagaatta

SEQ ID NO: 8066582 - DNA, 22 bp, Homo sapiens
tagcagggaaggtgtgctgagc

SEQ ID NO: 8066583 - DNA, 22 bp, Homo sapiens
tagcagggaagatgatcagaat

SEQ ID NO: 8066584 - DNA, 22 bp, Homo sapiens
tagcagggccaggctgggaacc

SEQ ID NO: 8066585 - DNA, 22 bp, Homo sapiens
tagcagggtctcaggagtcagg

SEQ ID NO: 8066586 - DNA, 22 bp, Homo sapiens
tagcagggtaaatgtagatgga

SEQ ID NO: 8066587 - DNA, 22 bp, Homo sapiens
tagcaggggtagatagagtgtg

SEQ ID NO: 8066588 - DNA, 22 bp, Homo sapiens
tagcagggtccaatgtgaggca

SEQ ID NO: 8066589 - DNA, 22 bp, Homo sapiens
taggccagcccttagtcctgtc

SEQ ID NO: 8066590 - DNA, 22 bp, Homo sapiens
tagggcagctgcatcaggcact

SEQ ID NO: 8066591 - DNA, 22 bp, Homo sapiens
tagggcagccttatagctccca

SEQ ID NO: 8066592 - DNA, 23 bp, Homo sapiens
tagggcagctgggagggacatgc

SEQ ID NO: 8066593 - DNA, 22 bp, Homo sapiens
tagggcagccacccaggctgct

SEQ ID NO: 8066594 - DNA, 22 bp, Homo sapiens
tagggcagattcggtggagttt

SEQ ID NO: 8066595 - DNA, 22 bp, Homo sapiens
tagggcagagtccaggatgggc

SEQ ID NO: 8066596 - DNA, 22 bp, Homo sapiens
tagttacagagaaatgatttga

SEQ ID NO: 8066597 - DNA, 22 bp, Homo sapiens
tagtgccattcaagaggtagtt

SEQ ID NO: 8066598 - DNA, 22 bp, Homo sapiens
tagtttcatctccaccctgccc

SEQ ID NO: 8066599 - DNA, 19 bp, Homo sapiens
taccagcctcctgcctgat

SEQ ID NO: 8066600 - DNA, 22 bp, Homo sapiens
taccaggcagctgcacagaggc

SEQ ID NO: 8066601 - DNA, 22 bp, Homo sapiens
tactgtgtgcccagccgagctg

SEQ ID NO: 8066602 - DNA, 22 bp, Homo sapiens
tactcctgctgatcctgccagc

SEQ ID NO: 8066603 - DNA, 22 bp, Homo sapiens
tacttaatgccactgaattgta

SEQ ID NO: 8066604 - DNA, 22 bp, Homo sapiens
tacttaaataattgctgctatt

SEQ ID NO: 8066605 - DNA, 22 bp, Homo sapiens
tacttaatgccactgaattgta

SEQ ID NO: 8066606 - DNA, 22 bp, Homo sapiens
tacatgctcagtaactttcagt

SEQ ID NO: 8066607 - DNA, 22 bp, Homo sapiens
tacatgcttctatatgtgaagt

SEQ ID NO: 8066608 - DNA, 22 bp, Homo sapiens
tacatgggtaggttaagtcata

SEQ ID NO: 8066609 - DNA, 22 bp, Homo sapiens
tacatgcttaaaatgcaatgtt

SEQ ID NO: 8066610 - DNA, 22 bp, Homo sapiens
tacatgctccactttctcctgt

SEQ ID NO: 8066611 - DNA, 22 bp, Homo sapiens
tacatgctccttatgagaatct

SEQ ID NO: 8066612 - DNA, 22 bp, Homo sapiens
tacatgctggtgactgtagaca

SEQ ID NO: 8066613 - DNA, 22 bp, Homo sapiens
tacagtgtgacatttctacaaa

SEQ ID NO: 8066614 - DNA, 22 bp, Homo sapiens
tacagagatttattgctaaggc

SEQ ID NO: 8066615 - DNA, 21 bp, Homo sapiens
tacagtctcccctgttgtcca

SEQ ID NO: 8066616 - DNA, 22 bp, Homo sapiens
tacagtctctgataactgtcag

SEQ ID NO: 8066617 - DNA, 22 bp, Homo sapiens
tacagtgaatgaatggctgtgc

SEQ ID NO: 8066618 - DNA, 22 bp, Homo sapiens
taatatatttctgctaagctca

SEQ ID NO: 8066619 - DNA, 22 bp, Homo sapiens
taatttacttgcaaataacaat

SEQ ID NO: 8066620 - DNA, 22 bp, Homo sapiens
taatttatgatgcaaagaaaag

SEQ ID NO: 8066621 - DNA, 22 bp, Homo sapiens
taattgaaatcatttcaattca

SEQ ID NO: 8066622 - DNA, 22 bp, Homo sapiens
taagctgtgggagattggcata

SEQ ID NO: 8066623 - DNA, 22 bp, Homo sapiens
tacaagaatgtcttaaaagctc

SEQ ID NO: 8066624 - DNA, 22 bp, Homo sapiens
tacaacgtgggactttgtttct

SEQ ID NO: 8066625 - DNA, 22 bp, Homo sapiens
tacacacagaggccatgggatt

SEQ ID NO: 8066626 - DNA, 22 bp, Homo sapiens
tacacacatgcatttgccttat

SEQ ID NO: 8066627 - DNA, 22 bp, Homo sapiens
tacacagaacctggtgtacagt

SEQ ID NO: 8066628 - DNA, 22 bp, Homo sapiens
tacacagaaattgtgtagggat

SEQ ID NO: 8066629 - DNA, 22 bp, Homo sapiens
tacacagtaaatggtaaataca

SEQ ID NO: 8066630 - DNA, 22 bp, Homo sapiens
tacacagtagagtataatgcgt

SEQ ID NO: 8066631 - DNA, 22 bp, Homo sapiens
tacagaatgttatgaagcatag

SEQ ID NO: 8066632 - DNA, 22 bp, Homo sapiens
gtgttctgggatgattgtagtg

SEQ ID NO: 8066633 - DNA, 22 bp, Homo sapiens
gtgttgactcttggacttcaag

SEQ ID NO: 8066634 - DNA, 22 bp, Homo sapiens
gtgttctgcagaccagcatcat

SEQ ID NO: 8066635 - DNA, 17 bp, Homo sapiens
gtgctggcctggggctc

SEQ ID NO: 8066636 - DNA, 21 bp, Homo sapiens
gtgctgggacacagccaggct

SEQ ID NO: 8066637 - DNA, 22 bp, Homo sapiens
gttaaatgcagattctgactca

SEQ ID NO: 8066638 - DNA, 22 bp, Homo sapiens
gtgtttatacagcaaagagcat

SEQ ID NO: 8066639 - DNA, 22 bp, Homo sapiens
gtgtttatacagcaaagagcat

SEQ ID NO: 8066640 - DNA, 22 bp, Homo sapiens
gtgtttatgtttgtgtagggga

SEQ ID NO: 8066641 - DNA, 22 bp, Homo sapiens
gtgtttatttagagtaggccat

SEQ ID NO: 8066642 - DNA, 22 bp, Homo sapiens
gtgtttataggagtgaatgctg

SEQ ID NO: 8066643 - DNA, 22 bp, Homo sapiens
gtgtttatgagtgaccttgtct

SEQ ID NO: 8066644 - DNA, 22 bp, Homo sapiens
gtgtttataggagtgaatgctg

SEQ ID NO: 8066645 - DNA, 22 bp, Homo sapiens
gtgtttattttcatagttggcc

SEQ ID NO: 8066646 - DNA, 22 bp, Homo sapiens
gttctgcttccttgcttgcgca

SEQ ID NO: 8066647 - DNA, 22 bp, Homo sapiens
gttcttcaggctgtgctctaga

SEQ ID NO: 8066648 - DNA, 22 bp, Homo sapiens
gttcttcagtcacatcacagaa

SEQ ID NO: 8066649 - DNA, 22 bp, Homo sapiens
gttataaatgactgcaaaagtt

SEQ ID NO: 8066650 - DNA, 22 bp, Homo sapiens
gttatattggcagaagagaaga

SEQ ID NO: 8066651 - DNA, 22 bp, Homo sapiens
gttatattgccaagtatattgt

SEQ ID NO: 8066652 - DNA, 22 bp, Homo sapiens
gttatattcaaaatgaggctgt

SEQ ID NO: 8066653 - DNA, 22 bp, Homo sapiens
gttatcttccctttgatgattt

SEQ ID NO: 8066654 - DNA, 22 bp, Homo sapiens
gttatcttctatttctcatact

SEQ ID NO: 8066655 - DNA, 22 bp, Homo sapiens
gtttgcatatctgtgaaatgga

SEQ ID NO: 8066656 - DNA, 21 bp, Homo sapiens
gtttgcatgaacaagtcagcc

SEQ ID NO: 8066657 - DNA, 22 bp, Homo sapiens
gtttgcatgtattaagtcaata

SEQ ID NO: 8066658 - DNA, 22 bp, Homo sapiens
gtttgcatgtgtacttaattgg

SEQ ID NO: 8066659 - DNA, 21 bp, Homo sapiens
gttttaagggagaaaacctag

SEQ ID NO: 8066660 - DNA, 22 bp, Homo sapiens
gtttatcacaataaataattct

SEQ ID NO: 8066661 - DNA, 22 bp, Homo sapiens
gtttatcattattattagcaac

SEQ ID NO: 8066662 - DNA, 22 bp, Homo sapiens
gtttatatgtgtgccactctta

SEQ ID NO: 8066663 - DNA, 22 bp, Homo sapiens
gtttatattcaacggagtatct

SEQ ID NO: 8066664 - DNA, 19 bp, Homo sapiens
gttcttttcacctctgtgc

SEQ ID NO: 8066665 - DNA, 22 bp, Homo sapiens
gttctttaggggcccaatttcc

SEQ ID NO: 8066666 - DNA, 22 bp, Homo sapiens
gttctttaagtggagaaggaaa

SEQ ID NO: 8066667 - DNA, 21 bp, Homo sapiens
gttcttcctgactagagtagt

SEQ ID NO: 8066668 - DNA, 22 bp, Homo sapiens
gttctttaacctagtctcattt

SEQ ID NO: 8066669 - DNA, 22 bp, Homo sapiens
taagacaattcttcagtcacaa

SEQ ID NO: 8066670 - DNA, 22 bp, Homo sapiens
taacatctttagcagctcgaac

SEQ ID NO: 8066671 - DNA, 22 bp, Homo sapiens
taacatccacattagatgattc

SEQ ID NO: 8066672 - DNA, 22 bp, Homo sapiens
taacatcctacactgttgtctt

SEQ ID NO: 8066673 - DNA, 20 bp, Homo sapiens
taacatagtccagagaacga

SEQ ID NO: 8066674 - DNA, 22 bp, Homo sapiens
taacataacttttccttgaccc

SEQ ID NO: 8066675 - DNA, 23 bp, Homo sapiens
taaagcaaagtcaagtgcactcc

SEQ ID NO: 8066676 - DNA, 22 bp, Homo sapiens
taaagcaaggaatagagtagtc

SEQ ID NO: 8066677 - DNA, 22 bp, Homo sapiens
taaagacatggtgtaggtgaac

SEQ ID NO: 8066678 - DNA, 22 bp, Homo sapiens
taaatgcaatgtgctttaccag

SEQ ID NO: 8066679 - DNA, 22 bp, Homo sapiens
taaatgcagattcctgagccta

SEQ ID NO: 8066680 - DNA, 22 bp, Homo sapiens
taaatgcagcagtttctgttct

SEQ ID NO: 8066681 - DNA, 22 bp, Homo sapiens
taaatgcagtacaaattgttct

SEQ ID NO: 8066682 - DNA, 18 bp, Homo sapiens
taaatgcatgttaataac

SEQ ID NO: 8066683 - DNA, 20 bp, Homo sapiens
taaatgcatgaatgtaaggc

SEQ ID NO: 8066684 - DNA, 22 bp, Homo sapiens
taaatgcagttagtacttgcca

SEQ ID NO: 8066685 - DNA, 20 bp, Homo sapiens
taaatgcatctgttcaactg

SEQ ID NO: 8066686 - DNA, 22 bp, Homo sapiens
taaagcacgtctatttaatgat

SEQ ID NO: 8066687 - DNA, 22 bp, Homo sapiens
taaatgcaaagcttggcgctta

SEQ ID NO: 8066688 - DNA, 22 bp, Homo sapiens
taaatgatttatgtatgtgaaa

SEQ ID NO: 8066689 - DNA, 22 bp, Homo sapiens
taaatgatttatgtatgtgaaa

SEQ ID NO: 8066690 - DNA, 22 bp, Homo sapiens
taaatgcaagtgctcctgggag

SEQ ID NO: 8066691 - DNA, 22 bp, Homo sapiens
taaatgcaagggaaaggcaaga

SEQ ID NO: 8066692 - DNA, 22 bp, Homo sapiens
taaagacactggttttaatcat

SEQ ID NO: 8066693 - DNA, 22 bp, Homo sapiens
taaaactgaatacatactgagg

SEQ ID NO: 8066694 - DNA, 22 bp, Homo sapiens
taaaactgaatacatactgagg

SEQ ID NO: 8066695 - DNA, 22 bp, Homo sapiens
gacagccaggtctgatgaccca

SEQ ID NO: 8066696 - DNA, 22 bp, Homo sapiens
gacagcagggacatgtaggaag

SEQ ID NO: 8066697 - DNA, 22 bp, Homo sapiens
gacatcaatattctgcagggat

SEQ ID NO: 8066698 - DNA, 22 bp, Homo sapiens
gacatcaggaagacatgagagg

SEQ ID NO: 8066699 - DNA, 22 bp, Homo sapiens
gacatcaggaagacatgagagg

SEQ ID NO: 8066700 - DNA, 22 bp, Homo sapiens
gacagtccttgcccagtatcta

SEQ ID NO: 8066701 - DNA, 22 bp, Homo sapiens
gacatacagcatggtctatgaa

SEQ ID NO: 8066702 - DNA, 22 bp, Homo sapiens
gacatggatacttgataagggg

SEQ ID NO: 8066703 - DNA, 22 bp, Homo sapiens
gacatgctaattactggttcaa

SEQ ID NO: 8066704 - DNA, 22 bp, Homo sapiens
gacctggaatttgtgtgtgttc

SEQ ID NO: 8066705 - DNA, 22 bp, Homo sapiens
gacctggggtaagcttggcaac

SEQ ID NO: 8066706 - DNA, 22 bp, Homo sapiens
gaatgcattctcttagcatcta

SEQ ID NO: 8066707 - DNA, 22 bp, Homo sapiens
gaatgctattatttctgtgtgt

SEQ ID NO: 8066708 - DNA, 22 bp, Homo sapiens
gacaaatgaagtcactgacctt

SEQ ID NO: 8066709 - DNA, 22 bp, Homo sapiens
gacaaatgaatgatgaacacca

SEQ ID NO: 8066710 - DNA, 22 bp, Homo sapiens
gacaaatgagtctcatacccgg

SEQ ID NO: 8066711 - DNA, 22 bp, Homo sapiens
gacaaatgagacatcaattccc

SEQ ID NO: 8066712 - DNA, 22 bp, Homo sapiens
gacaaaggatcagaggttggga

SEQ ID NO: 8066713 - DNA, 22 bp, Homo sapiens
gacaaaactgagatcacactgt

SEQ ID NO: 8066714 - DNA, 22 bp, Homo sapiens
gagaggagtccctatcacagtt

SEQ ID NO: 8066715 - DNA, 22 bp, Homo sapiens
gagaggagaagcctgcgcttca

SEQ ID NO: 8066716 - DNA, 22 bp, Homo sapiens
gagagctgtcagcgtagcaccg

SEQ ID NO: 8066717 - DNA, 22 bp, Homo sapiens
gagagacagcacacagtgtggg

SEQ ID NO: 8066718 - DNA, 22 bp, Homo sapiens
gagagaccttgctaagtgcctt

SEQ ID NO: 8066719 - DNA, 22 bp, Homo sapiens
gagagacctcagaaacaatcta

SEQ ID NO: 8066720 - DNA, 22 bp, Homo sapiens
gagagacccagacaccatgcat

SEQ ID NO: 8066721 - DNA, 22 bp, Homo sapiens
gagagacagcagaacgtgcagc

SEQ ID NO: 8066722 - DNA, 22 bp, Homo sapiens
gagaagccgagtcagctgagcc

SEQ ID NO: 8066723 - DNA, 22 bp, Homo sapiens
gagagaagggggatatgagcct

SEQ ID NO: 8066724 - DNA, 22 bp, Homo sapiens
gagagaagaatgttccgaggcc

SEQ ID NO: 8066725 - DNA, 22 bp, Homo sapiens
gagagaagaatgttccgaggcc

SEQ ID NO: 8066726 - DNA, 22 bp, Homo sapiens
gagagaagaaagccatggtcct

SEQ ID NO: 8066727 - DNA, 22 bp, Homo sapiens
gagaactcagacgcaggtcatg

SEQ ID NO: 8066728 - DNA, 22 bp, Homo sapiens
gagaacctctccacaagtctgg

SEQ ID NO: 8066729 - DNA, 22 bp, Homo sapiens
gagaaagggaacttacagagtg

SEQ ID NO: 8066730 - DNA, 19 bp, Homo sapiens
gactcacaccttccgctgt

SEQ ID NO: 8066731 - DNA, 22 bp, Homo sapiens
gagcacagtaaagcagtgtcac

SEQ ID NO: 8066732 - DNA, 22 bp, Homo sapiens
gagcaccaaggctctgccatgg

SEQ ID NO: 8066733 - DNA, 22 bp, Homo sapiens
gagcagagaatccagctaagtg

SEQ ID NO: 8066734 - DNA, 22 bp, Homo sapiens
gagcagagacagtacaactggc

SEQ ID NO: 8066735 - DNA, 22 bp, Homo sapiens
gagcaacagtttatggtttttc

SEQ ID NO: 8066736 - DNA, 22 bp, Homo sapiens
gagaggcaggaatcctgggtga

SEQ ID NO: 8066737 - DNA, 22 bp, Homo sapiens
gagcacagaatcttcccatgca

SEQ ID NO: 8066738 - DNA, 22 bp, Homo sapiens
gagggcctctgctgctccacat

SEQ ID NO: 8066739 - DNA, 22 bp, Homo sapiens
gagggctgataaatgcgcatgg

SEQ ID NO: 8066740 - DNA, 22 bp, Homo sapiens
gagggccagcagcctcagcatg

SEQ ID NO: 8066741 - DNA, 22 bp, Homo sapiens
gagggccagcagcctcagcatg

SEQ ID NO: 8066742 - DNA, 22 bp, Homo sapiens
gagggccaggcagcaagaaggc

SEQ ID NO: 8066743 - DNA, 22 bp, Homo sapiens
gagggacagctaaagagaaatt

SEQ ID NO: 8066744 - DNA, 22 bp, Homo sapiens
gagggacagctaaagagaaatt

SEQ ID NO: 8066745 - DNA, 22 bp, Homo sapiens
gagggaccccaggctggccctt

SEQ ID NO: 8066746 - DNA, 22 bp, Homo sapiens
gagggacagctaaagagaaatt

SEQ ID NO: 8066747 - DNA, 22 bp, Homo sapiens
gaggcctgtcgctaggcctctg

SEQ ID NO: 8066748 - DNA, 22 bp, Homo sapiens
gaggctggtaggaaaggaaaca

SEQ ID NO: 8066749 - DNA, 22 bp, Homo sapiens
gaggctggtggttagttccatt

SEQ ID NO: 8066750 - DNA, 22 bp, Homo sapiens
gaggctggtaggaaaggaaaca

SEQ ID NO: 8066751 - DNA, 22 bp, Homo sapiens
gagggtggtggcttaaggtgct

SEQ ID NO: 8066752 - DNA, 22 bp, Homo sapiens
gagggctgatgcttacttattt

SEQ ID NO: 8066753 - DNA, 22 bp, Homo sapiens
gagggctgataacaggaataca

SEQ ID NO: 8066754 - DNA, 22 bp, Homo sapiens
gaggtgagaagggggtcagatg

SEQ ID NO: 8066755 - DNA, 22 bp, Homo sapiens
gaggtgagtggatcacgaggtc

SEQ ID NO: 8066756 - DNA, 22 bp, Homo sapiens
gaggtggcttagtctctggaca

SEQ ID NO: 8066757 - DNA, 22 bp, Homo sapiens
gaggtgggagggcagtccctaa

SEQ ID NO: 8066758 - DNA, 22 bp, Homo sapiens
gaggaggttccgggtggagaag

SEQ ID NO: 8066759 - DNA, 22 bp, Homo sapiens
gaggagtgtattccacaccact

SEQ ID NO: 8066760 - DNA, 22 bp, Homo sapiens
gaggagtggagttgctgggttg

SEQ ID NO: 8066761 - DNA, 18 bp, Homo sapiens
gaggatggaaggagatgc

SEQ ID NO: 8066762 - DNA, 18 bp, Homo sapiens
gaggatggaaggagatgc

SEQ ID NO: 8066763 - DNA, 22 bp, Homo sapiens
gaggagagaagctaacggtgct

SEQ ID NO: 8066764 - DNA, 22 bp, Homo sapiens
gaggagagaagctaacggtgct

SEQ ID NO: 8066765 - DNA, 22 bp, Homo sapiens
gaggagagaacattcctccata

SEQ ID NO: 8066766 - DNA, 22 bp, Homo sapiens
gaggccacggttttccttgggg

SEQ ID NO: 8066767 - DNA, 21 bp, Homo sapiens
gaggccactaataggggcaga

SEQ ID NO: 8066768 - DNA, 22 bp, Homo sapiens
gaggatggtatgaggcaagcaa

SEQ ID NO: 8066769 - DNA, 22 bp, Homo sapiens
gaggatggaggcagttagggcc

SEQ ID NO: 8066770 - DNA, 22 bp, Homo sapiens
gagctccagcatctctgccaaa

SEQ ID NO: 8066771 - DNA, 22 bp, Homo sapiens
gagctcagattctggtgtcaga

SEQ ID NO: 8066772 - DNA, 22 bp, Homo sapiens
gagctcagcccaaagagcagtg

SEQ ID NO: 8066773 - DNA, 22 bp, Homo sapiens
gagctcagcactaaaatcatgt

SEQ ID NO: 8066774 - DNA, 22 bp, Homo sapiens
gagctcaggagcatcagaagaa

SEQ ID NO: 8066775 - DNA, 22 bp, Homo sapiens
gagctcaggagcatcagaagaa

SEQ ID NO: 8066776 - DNA, 22 bp, Homo sapiens
gagcaggcctggggtgaggcct

SEQ ID NO: 8066777 - DNA, 19 bp, Homo sapiens
gagcaggccacacatgtgt

SEQ ID NO: 8066778 - DNA, 19 bp, Homo sapiens
gagcaggccacacatgtgt

SEQ ID NO: 8066779 - DNA, 22 bp, Homo sapiens
gagcaggcaactctgcagtgcc

SEQ ID NO: 8066780 - DNA, 22 bp, Homo sapiens
gagctgggcacacgccacttga

SEQ ID NO: 8066781 - DNA, 22 bp, Homo sapiens
gagctccagggaacagcagcta

SEQ ID NO: 8066782 - DNA, 22 bp, Homo sapiens
gagctgtctggggactctgggt

SEQ ID NO: 8066783 - DNA, 22 bp, Homo sapiens
gagctgtctctatatgaatgct

SEQ ID NO: 8066784 - DNA, 22 bp, Homo sapiens
gagctgtgcttataccaattca

SEQ ID NO: 8066785 - DNA, 22 bp, Homo sapiens
gaaacctcttagcctctctttg

SEQ ID NO: 8066786 - DNA, 22 bp, Homo sapiens
cttttttcctaaggcaacatga

SEQ ID NO: 8066787 - DNA, 22 bp, Homo sapiens
gaaaaatgagctgatgtcaggg

SEQ ID NO: 8066788 - DNA, 22 bp, Homo sapiens
cttttgttaggagaaaacatca

SEQ ID NO: 8066789 - DNA, 23 bp, Homo sapiens
ctttggcactttacaataaactc

SEQ ID NO: 8066790 - DNA, 22 bp, Homo sapiens
ctttttctaatcataattgtct

SEQ ID NO: 8066791 - DNA, 22 bp, Homo sapiens
ctttggaagccaggcagttcac

SEQ ID NO: 8066792 - DNA, 22 bp, Homo sapiens
ctttggaaggaagacctttcag

SEQ ID NO: 8066793 - DNA, 22 bp, Homo sapiens
ctttggaaggaacaggattctc

SEQ ID NO: 8066794 - DNA, 22 bp, Homo sapiens
ctttggaagtgaccacaatcct

SEQ ID NO: 8066795 - DNA, 22 bp, Homo sapiens
ctttggaagtgatagatatgat

SEQ ID NO: 8066796 - DNA, 22 bp, Homo sapiens
ctttggagaagaatgcatcctt

SEQ ID NO: 8066797 - DNA, 20 bp, Homo sapiens
gaaattctcgtattagttta

SEQ ID NO: 8066798 - DNA, 22 bp, Homo sapiens
gaaattctgtgtcccagagtgc

SEQ ID NO: 8066799 - DNA, 22 bp, Homo sapiens
gaactttaaaacaaagtacagt

SEQ ID NO: 8066800 - DNA, 22 bp, Homo sapiens
gaaagagaacctgggcctagat

SEQ ID NO: 8066801 - DNA, 22 bp, Homo sapiens
gaaatattcttgtcttgttttc

SEQ ID NO: 8066802 - DNA, 22 bp, Homo sapiens
gaaatattacagtggaggggat

SEQ ID NO: 8066803 - DNA, 22 bp, Homo sapiens
gaaatattgggactcagagctt

SEQ ID NO: 8066804 - DNA, 22 bp, Homo sapiens
gaaatattgtactggagatgtt

SEQ ID NO: 8066805 - DNA, 23 bp, Homo sapiens
ctttcctttctttgacacccagc

SEQ ID NO: 8066806 - DNA, 23 bp, Homo sapiens
ctttcctttctttgacacccagc

SEQ ID NO: 8066807 - DNA, 21 bp, Homo sapiens
ctttgcatacagatgccaatt

SEQ ID NO: 8066808 - DNA, 21 bp, Homo sapiens
ctttgcatctatatgttctca

SEQ ID NO: 8066809 - DNA, 22 bp, Homo sapiens
ctttgcattctcagcacagagc

SEQ ID NO: 8066810 - DNA, 20 bp, Homo sapiens
ctttctctaatttataagta

SEQ ID NO: 8066811 - DNA, 22 bp, Homo sapiens
ctttctctgtgtttcacatgct

SEQ ID NO: 8066812 - DNA, 22 bp, Homo sapiens
cttcacagagtccctgattgtt

SEQ ID NO: 8066813 - DNA, 22 bp, Homo sapiens
cttcacagaataaactcattat

SEQ ID NO: 8066814 - DNA, 22 bp, Homo sapiens
cttcacagtcaccctgctgtgt

SEQ ID NO: 8066815 - DNA, 22 bp, Homo sapiens
cttcacagtcaccctgctgtgt

SEQ ID NO: 8066816 - DNA, 22 bp, Homo sapiens
cttcacagtaaatccagaagaa

SEQ ID NO: 8066817 - DNA, 22 bp, Homo sapiens
cttcactgtttggttcacagca

SEQ ID NO: 8066818 - DNA, 22 bp, Homo sapiens
cttcacagtctttatttcctcc

SEQ ID NO: 8066819 - DNA, 22 bp, Homo sapiens
cttcccagcacctcagtctggc

SEQ ID NO: 8066820 - DNA, 22 bp, Homo sapiens
cttcccagcacctcagtctggc

SEQ ID NO: 8066821 - DNA, 22 bp, Homo sapiens
cttcccagaccttagagtgcag

SEQ ID NO: 8066822 - DNA, 19 bp, Homo sapiens
cttcccctgttacctcact

SEQ ID NO: 8066823 - DNA, 22 bp, Homo sapiens
cttccctgataagagcctcaga

SEQ ID NO: 8066824 - DNA, 22 bp, Homo sapiens
cttcccttggtgaacagagcat

SEQ ID NO: 8066825 - DNA, 20 bp, Homo sapiens
cttcttcagcctatgcttca

SEQ ID NO: 8066826 - DNA, 22 bp, Homo sapiens
ctggagccttcaccaggggaaa

SEQ ID NO: 8066827 - DNA, 22 bp, Homo sapiens
ctggagctaataatccatctga

SEQ ID NO: 8066828 - DNA, 22 bp, Homo sapiens
ctgggagtctggcctctggtcc

SEQ ID NO: 8066829 - DNA, 22 bp, Homo sapiens
ctgggagtcaccaggagcaagg

SEQ ID NO: 8066830 - DNA, 22 bp, Homo sapiens
ctgggaggcggaggttgcagtg

SEQ ID NO: 8066831 - DNA, 22 bp, Homo sapiens
ctgggccagcaactgcaatgga

SEQ ID NO: 8066832 - DNA, 22 bp, Homo sapiens
ctgggatgtctatagaacactt

SEQ ID NO: 8066833 - DNA, 22 bp, Homo sapiens
ctgggagtgttctaggtcacat

SEQ ID NO: 8066834 - DNA, 22 bp, Homo sapiens
ctgggagttgacgaggcttgta

SEQ ID NO: 8066835 - DNA, 22 bp, Homo sapiens
ctgggcctcatcctcagagttt

SEQ ID NO: 8066836 - DNA, 22 bp, Homo sapiens
ctgggcctcaatctcagagttt

SEQ ID NO: 8066837 - DNA, 22 bp, Homo sapiens
ctgggcctagcaacagaggagt

SEQ ID NO: 8066838 - DNA, 22 bp, Homo sapiens
ctgggctcagcccatgctgtcc

SEQ ID NO: 8066839 - DNA, 22 bp, Homo sapiens
ctggggtgagcagaaacagggg

SEQ ID NO: 8066840 - DNA, 22 bp, Homo sapiens
ctggggtggatgggtccaagtt

SEQ ID NO: 8066841 - DNA, 22 bp, Homo sapiens
ctggggtggaggagctcccctg

SEQ ID NO: 8066842 - DNA, 22 bp, Homo sapiens
ctggggtgtctcgtctgccatt

SEQ ID NO: 8066843 - DNA, 22 bp, Homo sapiens
ctggggtggtgcaggcctcatg

SEQ ID NO: 8066844 - DNA, 22 bp, Homo sapiens
ctggggtggtgcaggcctcatg

SEQ ID NO: 8066845 - DNA, 22 bp, Homo sapiens
ctggggctggtgaggcaggctc

SEQ ID NO: 8066846 - DNA, 22 bp, Homo sapiens
ctggggggagctgcgtccagca

SEQ ID NO: 8066847 - DNA, 22 bp, Homo sapiens
ctggtgtctgctccctcacagc

SEQ ID NO: 8066848 - DNA, 22 bp, Homo sapiens
ctggtgtctgattctcccctga

SEQ ID NO: 8066849 - DNA, 22 bp, Homo sapiens
ctggtgtcattttagcctcagg

SEQ ID NO: 8066850 - DNA, 22 bp, Homo sapiens
ctggtgtttattacaggtgctc

SEQ ID NO: 8066851 - DNA, 22 bp, Homo sapiens
ctggtgttgtccgggtgagagt

SEQ ID NO: 8066852 - DNA, 22 bp, Homo sapiens
ctgggtggttttgatgtgaatt

SEQ ID NO: 8066853 - DNA, 22 bp, Homo sapiens
ctgtgttcccctgctgctgagg

SEQ ID NO: 8066854 - DNA, 22 bp, Homo sapiens
ctgtgtttctgagaagtgggga

SEQ ID NO: 8066855 - DNA, 22 bp, Homo sapiens
ctgtgtttctcttgacccaagt

SEQ ID NO: 8066856 - DNA, 22 bp, Homo sapiens
ctgtgttttgattaaaaagcaa

SEQ ID NO: 8066857 - DNA, 22 bp, Homo sapiens
ctgtgtttgatgagaagccacc

SEQ ID NO: 8066858 - DNA, 22 bp, Homo sapiens
ctgtgtttgctatgcaaagaca

SEQ ID NO: 8066859 - DNA, 22 bp, Homo sapiens
ctgtgtgtgagaagcaggttga

SEQ ID NO: 8066860 - DNA, 22 bp, Homo sapiens
ctgtgggctgaaagtgctcccg

SEQ ID NO: 8066861 - DNA, 23 bp, Homo sapiens
ctgtggtgaggccctagaatctg

SEQ ID NO: 8066862 - DNA, 22 bp, Homo sapiens
ctgtggtggcacagcgggctgg

SEQ ID NO: 8066863 - DNA, 22 bp, Homo sapiens
ctgtggtgagcaactgactgaa

SEQ ID NO: 8066864 - DNA, 20 bp, Homo sapiens
ctgtggtgagcaggagagta

SEQ ID NO: 8066865 - DNA, 22 bp, Homo sapiens
ctgtggagtttgtggcgctgac

SEQ ID NO: 8066866 - DNA, 22 bp, Homo sapiens
ctgtggctttctctgcctcctt

SEQ ID NO: 8066867 - DNA, 22 bp, Homo sapiens
ctgtgggatgggacctcagctg

SEQ ID NO: 8066868 - DNA, 21 bp, Homo sapiens
ctgtccccagtgagcaccccc

SEQ ID NO: 8066869 - DNA, 22 bp, Homo sapiens
ctgtccccgcgagtccagagct

SEQ ID NO: 8066870 - DNA, 20 bp, Homo sapiens
ctgtccccgaggtcaccagg

SEQ ID NO: 8066871 - DNA, 22 bp, Homo sapiens
ctgtccatggtgctggacggtc

SEQ ID NO: 8066872 - DNA, 22 bp, Homo sapiens
ctggttttatgttatagatgga

SEQ ID NO: 8066873 - DNA, 22 bp, Homo sapiens
ctggttttggctggcaaggttg

SEQ ID NO: 8066874 - DNA, 22 bp, Homo sapiens
ctggttttgaaaacgcaagctg

SEQ ID NO: 8066875 - DNA, 22 bp, Homo sapiens
ctggttttctagtccactggct

SEQ ID NO: 8066876 - DNA, 22 bp, Homo sapiens
ctggttttgtcagaagctttat

SEQ ID NO: 8066877 - DNA, 22 bp, Homo sapiens
ctggtttttagtgcttaggagt

SEQ ID NO: 8066878 - DNA, 22 bp, Homo sapiens
ctggttggtgccacatggtggc

SEQ ID NO: 8066879 - DNA, 22 bp, Homo sapiens
ctggttggaagtgcagactctc

SEQ ID NO: 8066880 - DNA, 22 bp, Homo sapiens
ctggttggaggagaagtttgga

SEQ ID NO: 8066881 - DNA, 22 bp, Homo sapiens
ctggttgggaggttggctttca

SEQ ID NO: 8066882 - DNA, 22 bp, Homo sapiens
ctgtgagaaataaatgtttgct

SEQ ID NO: 8066883 - DNA, 22 bp, Homo sapiens
ctgtgagatatgcatatgctct

SEQ ID NO: 8066884 - DNA, 22 bp, Homo sapiens
ctgtgacagtttctcagaattt

SEQ ID NO: 8066885 - DNA, 22 bp, Homo sapiens
ctgtgacagtttctcagacttt

SEQ ID NO: 8066886 - DNA, 22 bp, Homo sapiens
ctgtgacagagcttgagtgaga

SEQ ID NO: 8066887 - DNA, 22 bp, Homo sapiens
ctgtgacagggatcagaatgca

SEQ ID NO: 8066888 - DNA, 22 bp, Homo sapiens
ctggagaggctgggaacaggtt

SEQ ID NO: 8066889 - DNA, 22 bp, Homo sapiens
ctggagagatcctcctgaaaaa

SEQ ID NO: 8066890 - DNA, 22 bp, Homo sapiens
ctggagagggagccctggcagt

SEQ ID NO: 8066891 - DNA, 22 bp, Homo sapiens
ctggagcaaaagtgactcctct

SEQ ID NO: 8066892 - DNA, 22 bp, Homo sapiens
ctggagcaggtttaggagtccc

SEQ ID NO: 8066893 - DNA, 22 bp, Homo sapiens
ctggagccccaggctgtgcaga

SEQ ID NO: 8066894 - DNA, 22 bp, Homo sapiens
ctggagcatccatgcccagggt

SEQ ID NO: 8066895 - DNA, 22 bp, Homo sapiens
ctggagcaggtttaggagtccc

SEQ ID NO: 8066896 - DNA, 22 bp, Homo sapiens
ctggagcaggcttgtcccagct

SEQ ID NO: 8066897 - DNA, 22 bp, Homo sapiens
ctggagccgcatggagcaggga

SEQ ID NO: 8066898 - DNA, 22 bp, Homo sapiens
ctggagccggaccagggacggt

SEQ ID NO: 8066899 - DNA, 17 bp, Homo sapiens
ctggagcctccaactcc

SEQ ID NO: 8066900 - DNA, 22 bp, Homo sapiens
ctggagcctgcagttttcactt

SEQ ID NO: 8066901 - DNA, 22 bp, Homo sapiens
ctggagcctaggttgacctggg

SEQ ID NO: 8066902 - DNA, 22 bp, Homo sapiens
ctggagccggcgagccccagcc

SEQ ID NO: 8066903 - DNA, 22 bp, Homo sapiens
ctggagccggcgagccccagcc

SEQ ID NO: 8066904 - DNA, 22 bp, Homo sapiens
ctgctgtctcactggtgtggtt

SEQ ID NO: 8066905 - DNA, 22 bp, Homo sapiens
ctgctgtctagtatcttaaaaa

SEQ ID NO: 8066906 - DNA, 22 bp, Homo sapiens
ctggaagaggaagccagctgga

SEQ ID NO: 8066907 - DNA, 22 bp, Homo sapiens
ctggaagaggaagccagctgga

SEQ ID NO: 8066908 - DNA, 20 bp, Homo sapiens
ctggaagcctttccagagca

SEQ ID NO: 8066909 - DNA, 22 bp, Homo sapiens
ctggaaggttcctcccagctcc

SEQ ID NO: 8066910 - DNA, 22 bp, Homo sapiens
ctggagaacagagctgtttaga

SEQ ID NO: 8066911 - DNA, 22 bp, Homo sapiens
ctggaagggtctacttagcaga

SEQ ID NO: 8066912 - DNA, 22 bp, Homo sapiens
ctggaaggtctgtccccactgc

SEQ ID NO: 8066913 - DNA, 22 bp, Homo sapiens
ctggaaggctctgctgcctgtc

SEQ ID NO: 8066914 - DNA, 22 bp, Homo sapiens
ctgctgggtccccctgctgatt

SEQ ID NO: 8066915 - DNA, 22 bp, Homo sapiens
ctgctgggtctatgcaagtgga

SEQ ID NO: 8066916 - DNA, 19 bp, Homo sapiens
ctgctgggtgctgagggag

SEQ ID NO: 8066917 - DNA, 22 bp, Homo sapiens
ctgctgacagccctgcttcagg

SEQ ID NO: 8066918 - DNA, 22 bp, Homo sapiens
ctgctcttgagggactgcggtc

SEQ ID NO: 8066919 - DNA, 22 bp, Homo sapiens
ctgctcttcccactcactccca

SEQ ID NO: 8066920 - DNA, 22 bp, Homo sapiens
ctgctgggaaggtctgctcagt

SEQ ID NO: 8066921 - DNA, 22 bp, Homo sapiens
ctgctgggaaggtctgctcagt

SEQ ID NO: 8066922 - DNA, 22 bp, Homo sapiens
ctgctctgttaattaaactttg

SEQ ID NO: 8066923 - DNA, 22 bp, Homo sapiens
ctgctcttcacactacacccgt

SEQ ID NO: 8066924 - DNA, 22 bp, Homo sapiens
ctgctctgtttcttagctgggt

SEQ ID NO: 8066925 - DNA, 22 bp, Homo sapiens
ctgctctgaccctttcaccttc

SEQ ID NO: 8066926 - DNA, 22 bp, Homo sapiens
ctgctctgtggtccatgagaca

SEQ ID NO: 8066927 - DNA, 22 bp, Homo sapiens
ctgctctgtggtccatgagaca

SEQ ID NO: 8066928 - DNA, 22 bp, Homo sapiens
ctgccttggccctagttcatgg

SEQ ID NO: 8066929 - DNA, 22 bp, Homo sapiens
ctgccttgtcttgttttcaggg

SEQ ID NO: 8066930 - DNA, 21 bp, Homo sapiens
ctgctctgacagtgaggccag

SEQ ID NO: 8066931 - DNA, 22 bp, Homo sapiens
ctgcctgtggtctgtgatctaa

SEQ ID NO: 8066932 - DNA, 22 bp, Homo sapiens
ctgcctgtttcctcttgctccc

SEQ ID NO: 8066933 - DNA, 22 bp, Homo sapiens
ctgcctgtttcctcttgctccc

SEQ ID NO: 8066934 - DNA, 22 bp, Homo sapiens
ctgccttgaaaatgaagcttta

SEQ ID NO: 8066935 - DNA, 22 bp, Homo sapiens
ctgagcatccagcaggtactgc

SEQ ID NO: 8066936 - DNA, 22 bp, Homo sapiens
ctgagcatggccggtccatggt

SEQ ID NO: 8066937 - DNA, 22 bp, Homo sapiens
ctgagcatttgtgcagcttctc

SEQ ID NO: 8066938 - DNA, 22 bp, Homo sapiens
ctgagccaaaaagcagagcttg

SEQ ID NO: 8066939 - DNA, 22 bp, Homo sapiens
ctcttcctacagtctgctatgc

SEQ ID NO: 8066940 - DNA, 22 bp, Homo sapiens
ctcttcctctcatgcggtcata

SEQ ID NO: 8066941 - DNA, 22 bp, Homo sapiens
ctgagcagtctgactcaagcta

SEQ ID NO: 8066942 - DNA, 22 bp, Homo sapiens
ctgcagctgtctctactgggca

SEQ ID NO: 8066943 - DNA, 22 bp, Homo sapiens
ctgcagctttggaaacctgttt

SEQ ID NO: 8066944 - DNA, 22 bp, Homo sapiens
ctgaggtgctatggaggatacg

SEQ ID NO: 8066945 - DNA, 22 bp, Homo sapiens
ctccttcccctactcagcatcc

SEQ ID NO: 8066946 - DNA, 22 bp, Homo sapiens
ctccttcccttcaagtgttcct

SEQ ID NO: 8066947 - DNA, 22 bp, Homo sapiens
ctccttcctgcagatctgagat

SEQ ID NO: 8066948 - DNA, 22 bp, Homo sapiens
ctccttcctgccccagtgataa

SEQ ID NO: 8066949 - DNA, 22 bp, Homo sapiens
tttcagaagtcacagttgactg

SEQ ID NO: 8066950 - DNA, 22 bp, Homo sapiens
tttcagaatagcaaagcaagct

SEQ ID NO: 8066951 - DNA, 22 bp, Homo sapiens
ctccttcatgtcatgtgtccgg

SEQ ID NO: 8066952 - DNA, 22 bp, Homo sapiens
ctccttcatgtcatgtgtccgg

SEQ ID NO: 8066953 - DNA, 22 bp, Homo sapiens
ctccttcacgcaggctgccatg

SEQ ID NO: 8066954 - DNA, 22 bp, Homo sapiens
tttcagaaccaagagagacatc

SEQ ID NO: 8066955 - DNA, 22 bp, Homo sapiens
tttcagaaggggagaaaggtca

SEQ ID NO: 8066956 - DNA, 22 bp, Homo sapiens
tttcagaaccgctaaaataaat

SEQ ID NO: 8066957 - DNA, 22 bp, Homo sapiens
tttatgattattttaaagcagc

SEQ ID NO: 8066958 - DNA, 22 bp, Homo sapiens
tttatattacctggaatagctt

SEQ ID NO: 8066959 - DNA, 22 bp, Homo sapiens
ctccaggccatggctgcggagg

SEQ ID NO: 8066960 - DNA, 22 bp, Homo sapiens
ctccaggccagggaagtggaca

SEQ ID NO: 8066961 - DNA, 22 bp, Homo sapiens
ctccaggagctgtgtctttctt

SEQ ID NO: 8066962 - DNA, 22 bp, Homo sapiens
ctctctggtttcagcgaagggg

SEQ ID NO: 8066963 - DNA, 22 bp, Homo sapiens
ctctcttcccgtgagtgttgca

SEQ ID NO: 8066964 - DNA, 22 bp, Homo sapiens
tttctcaaaagacagaagtgaa

SEQ ID NO: 8066965 - DNA, 23 bp, Homo sapiens
tttctcaaagagtggcagcttca

SEQ ID NO: 8066966 - DNA, 22 bp, Homo sapiens
tttctcaagtactgcacatgaa

SEQ ID NO: 8066967 - DNA, 22 bp, Homo sapiens
tttccaatgtagatgtctctgg

SEQ ID NO: 8066968 - DNA, 22 bp, Homo sapiens
tttccaagataatacacagaaa

SEQ ID NO: 8066969 - DNA, 18 bp, Homo sapiens
tttccaagaagagagctc

SEQ ID NO: 8066970 - DNA, 22 bp, Homo sapiens
tttccaagtgtcaggtgcaaaa

SEQ ID NO: 8066971 - DNA, 22 bp, Homo sapiens
tttcattatacagcttcataaa

SEQ ID NO: 8066972 - DNA, 22 bp, Homo sapiens
ctctgtgattttgtgagccaga

SEQ ID NO: 8066973 - DNA, 22 bp, Homo sapiens
ctctgtgccctactgctcagct

SEQ ID NO: 8066974 - DNA, 22 bp, Homo sapiens
tttgttctaacttctgcagaca

SEQ ID NO: 8066975 - DNA, 22 bp, Homo sapiens
ctctgtgggggagaggcagctg

SEQ ID NO: 8066976 - DNA, 22 bp, Homo sapiens
ctctgtgtggtcctctgtattg

SEQ ID NO: 8066977 - DNA, 22 bp, Homo sapiens
ctctgtgtggtcctctgtattg

SEQ ID NO: 8066978 - DNA, 22 bp, Homo sapiens
ctctgtgtatccaagttcaggt

SEQ ID NO: 8066979 - DNA, 22 bp, Homo sapiens
ctctgtgtcagctgggtgtgca

SEQ ID NO: 8066980 - DNA, 22 bp, Homo sapiens
ctctgtgttccgggttgctgct

SEQ ID NO: 8066981 - DNA, 21 bp, Homo sapiens
ctctgtgttgagggtgttgag

SEQ ID NO: 8066982 - DNA, 22 bp, Homo sapiens
tttggaataatcagatcctagt

SEQ ID NO: 8066983 - DNA, 22 bp, Homo sapiens
ctctggctatggcacggcgctc

SEQ ID NO: 8066984 - DNA, 22 bp, Homo sapiens
tttggaagtaaatgagtgtttt

SEQ ID NO: 8066985 - DNA, 22 bp, Homo sapiens
ctctgggtcccacgtcattgct

SEQ ID NO: 8066986 - DNA, 22 bp, Homo sapiens
tttgagaaatgggctctgtgct

SEQ ID NO: 8066987 - DNA, 22 bp, Homo sapiens
tttgagaagcatctggtccact

SEQ ID NO: 8066988 - DNA, 22 bp, Homo sapiens
ctctggccagagcctgcgggaa

SEQ ID NO: 8066989 - DNA, 19 bp, Homo sapiens
ctctggcctctggatgctg

SEQ ID NO: 8066990 - DNA, 22 bp, Homo sapiens
ctctggcctgcttcctcaggta

SEQ ID NO: 8066991 - DNA, 22 bp, Homo sapiens
ctctggagtgcagcctggtggc

SEQ ID NO: 8066992 - DNA, 22 bp, Homo sapiens
ctctgaagggagggccaagccc

SEQ ID NO: 8066993 - DNA, 22 bp, Homo sapiens
ctctgaactcttgggcagcatg

SEQ ID NO: 8066994 - DNA, 22 bp, Homo sapiens
ctcagagagtgaattcctgcct

SEQ ID NO: 8066995 - DNA, 21 bp, Homo sapiens
ctcagagacaaatgccatccc

SEQ ID NO: 8066996 - DNA, 22 bp, Homo sapiens
ctcagagaagtctttgctaaac

SEQ ID NO: 8066997 - DNA, 21 bp, Homo sapiens
ctcagagaaatgtctgggagc

SEQ ID NO: 8066998 - DNA, 22 bp, Homo sapiens
ctcagagaaatgtcacaacaat

SEQ ID NO: 8066999 - DNA, 22 bp, Homo sapiens
ctcagaaagggttgctgagggc

SEQ ID NO: 8067000 - DNA, 22 bp, Homo sapiens
ctatagaaaattgtatcacacg

SEQ ID NO: 8067001 - DNA, 22 bp, Homo sapiens
ctcacccatatctccatgactc

SEQ ID NO: 8067002 - DNA, 22 bp, Homo sapiens
ctcacctataagtctcacagtc

SEQ ID NO: 8067003 - DNA, 22 bp, Homo sapiens
cgttggagacacttgaggactt

SEQ ID NO: 8067004 - DNA, 23 bp, Homo sapiens
ttctggaagatttacttgagaca

SEQ ID NO: 8067005 - DNA, 22 bp, Homo sapiens
ttctgcatctatttttctgctg

SEQ ID NO: 8067006 - DNA, 22 bp, Homo sapiens
ctcagggcttgagtgtccagga

SEQ ID NO: 8067007 - DNA, 22 bp, Homo sapiens
ctcagggggaatcaggtcacag

SEQ ID NO: 8067008 - DNA, 22 bp, Homo sapiens
ctcagggcagtatggctgagag

SEQ ID NO: 8067009 - DNA, 18 bp, Homo sapiens
ctcagggcatcagtctgg

SEQ ID NO: 8067010 - DNA, 22 bp, Homo sapiens
ctcagggccaaggatgctgttg

SEQ ID NO: 8067011 - DNA, 22 bp, Homo sapiens
ttgcccaggctggagtgcagtg

SEQ ID NO: 8067012 - DNA, 22 bp, Homo sapiens
ttgcccaggctggagtgcagta

SEQ ID NO: 8067013 - DNA, 22 bp, Homo sapiens
ttgcatcaattccttgtcctga

SEQ ID NO: 8067014 - DNA, 22 bp, Homo sapiens
ttgcatcagaattacttggagg

SEQ ID NO: 8067015 - DNA, 19 bp, Homo sapiens
ctcagctgtagctcatgtg

SEQ ID NO: 8067016 - DNA, 22 bp, Homo sapiens
ctcagctggcaattctggctcc

SEQ ID NO: 8067017 - DNA, 22 bp, Homo sapiens
ctcaggagatgacagaaggtat

SEQ ID NO: 8067018 - DNA, 22 bp, Homo sapiens
ctcaggacccggtccaggtggg

SEQ ID NO: 8067019 - DNA, 22 bp, Homo sapiens
ctcaggaggtggtagaggccct

SEQ ID NO: 8067020 - DNA, 22 bp, Homo sapiens
ttgcagaacttaaagacagagt

SEQ ID NO: 8067021 - DNA, 22 bp, Homo sapiens
ctccagaggaaagcacatagtg

SEQ ID NO: 8067022 - DNA, 22 bp, Homo sapiens
ctccagagtcacactgcctggg

SEQ ID NO: 8067023 - DNA, 22 bp, Homo sapiens
ttggaaggccctgcctagcagg

SEQ ID NO: 8067024 - DNA, 22 bp, Homo sapiens
ttggaagggaacaccatttgac

SEQ ID NO: 8067025 - DNA, 22 bp, Homo sapiens
ttggaagggatattggcatatg

SEQ ID NO: 8067026 - DNA, 23 bp, Homo sapiens
ttggaagggaagagcatttgaga

SEQ ID NO: 8067027 - DNA, 22 bp, Homo sapiens
ttggaaggtgagtccctgggtt

SEQ ID NO: 8067028 - DNA, 22 bp, Homo sapiens
ttggatccatctcaggcatagg

SEQ ID NO: 8067029 - DNA, 22 bp, Homo sapiens
ttggatccatctcaggcatagg

SEQ ID NO: 8067030 - DNA, 22 bp, Homo sapiens
ttggaaggagtcaaccagctga

SEQ ID NO: 8067031 - DNA, 22 bp, Homo sapiens
ttggaaggcagcatttgtccat

SEQ ID NO: 8067032 - DNA, 19 bp, Homo sapiens
ttggaaggagccagagtgg

SEQ ID NO: 8067033 - DNA, 22 bp, Homo sapiens
ttggaagatctaacagaggcat

SEQ ID NO: 8067034 - DNA, 22 bp, Homo sapiens
cggagaggtgggggcagcatct

SEQ ID NO: 8067035 - DNA, 22 bp, Homo sapiens
cggagaggacctgcaactcgct

SEQ ID NO: 8067036 - DNA, 22 bp, Homo sapiens
ttcaaatacattctttgccact

SEQ ID NO: 8067037 - DNA, 22 bp, Homo sapiens
ttcaaagtgcatgttcctcaga

SEQ ID NO: 8067038 - DNA, 22 bp, Homo sapiens
cggcagcatcgaaactacattc

SEQ ID NO: 8067039 - DNA, 18 bp, Homo sapiens
cggcagagtgcttctagc

SEQ ID NO: 8067040 - DNA, 22 bp, Homo sapiens
cggcagcaaaggaagccaggtc

SEQ ID NO: 8067041 - DNA, 22 bp, Homo sapiens
cggcagcaaaggaagccaggtc

SEQ ID NO: 8067042 - DNA, 22 bp, Homo sapiens
cggcagagacggcgctttgaac

SEQ ID NO: 8067043 - DNA, 22 bp, Homo sapiens
cggcagagcttcctgctcagcg

SEQ ID NO: 8067044 - DNA, 22 bp, Homo sapiens
cgtggggcgggtggacacttgc

SEQ ID NO: 8067045 - DNA, 22 bp, Homo sapiens
cggggctgctcgtcctcctgtg

SEQ ID NO: 8067046 - DNA, 22 bp, Homo sapiens
cggggctgcgctcttcctgccg

SEQ ID NO: 8067047 - DNA, 22 bp, Homo sapiens
cggggctgcgctcttcctgccg

SEQ ID NO: 8067048 - DNA, 22 bp, Homo sapiens
cggggctgctcgtcctcctgtg

SEQ ID NO: 8067049 - DNA, 22 bp, Homo sapiens
cggggctgaggcaacgcggaga

SEQ ID NO: 8067050 - DNA, 22 bp, Homo sapiens
cggggccctggggctgaaggtc

SEQ ID NO: 8067051 - DNA, 22 bp, Homo sapiens
cggggccctggggctgaaggtc

SEQ ID NO: 8067052 - DNA, 22 bp, Homo sapiens
cgggctggctgcagctgctgga

SEQ ID NO: 8067053 - DNA, 22 bp, Homo sapiens
cggggagaacactgtgtccttc

SEQ ID NO: 8067054 - DNA, 22 bp, Homo sapiens
cggggacacactggcagctcct

SEQ ID NO: 8067055 - DNA, 22 bp, Homo sapiens
ttattgagtatctgcttggtgt

SEQ ID NO: 8067056 - DNA, 22 bp, Homo sapiens
cgagagttagctaggagtcaca

SEQ ID NO: 8067057 - DNA, 22 bp, Homo sapiens
cctttttccctggagggacagc

SEQ ID NO: 8067058 - DNA, 22 bp, Homo sapiens
cctttttcaatatagaattgca

SEQ ID NO: 8067059 - DNA, 22 bp, Homo sapiens
ccttttgctctcccatccagaa

SEQ ID NO: 8067060 - DNA, 22 bp, Homo sapiens
ccttttctatgtaccagcagtg

SEQ ID NO: 8067061 - DNA, 22 bp, Homo sapiens
cgctggccatagcctcctgtgt

SEQ ID NO: 8067062 - DNA, 22 bp, Homo sapiens
cgctgctccgccttgtccatat

SEQ ID NO: 8067063 - DNA, 22 bp, Homo sapiens
ttatcataagtaattgaaataa

SEQ ID NO: 8067064 - DNA, 22 bp, Homo sapiens
ttatcatagtgcagttttctga

SEQ ID NO: 8067065 - DNA, 22 bp, Homo sapiens
ttatcattgtcgcagtctaatt

SEQ ID NO: 8067066 - DNA, 22 bp, Homo sapiens
ttatattagttagacttgctgt

SEQ ID NO: 8067067 - DNA, 22 bp, Homo sapiens
ttatattgtgtaataagtgaag

SEQ ID NO: 8067068 - DNA, 22 bp, Homo sapiens
ttatatttctggtagccttcag

SEQ ID NO: 8067069 - DNA, 22 bp, Homo sapiens
ttataacatcaatcagagttaa

SEQ ID NO: 8067070 - DNA, 22 bp, Homo sapiens
ttataacaacagtttactttaa

SEQ ID NO: 8067071 - DNA, 22 bp, Homo sapiens
ttataacaacagtttactttaa

SEQ ID NO: 8067072 - DNA, 22 bp, Homo sapiens
ttataacactgccttgtcacca

SEQ ID NO: 8067073 - DNA, 22 bp, Homo sapiens
ccttgactgccttcaggctggg

SEQ ID NO: 8067074 - DNA, 22 bp, Homo sapiens
ccttgcaggggaacaggcagtg

SEQ ID NO: 8067075 - DNA, 22 bp, Homo sapiens
ccttcaatcttaagtcagccca

SEQ ID NO: 8067076 - DNA, 23 bp, Homo sapiens
ccttcagaagaagtaacaggggc

SEQ ID NO: 8067077 - DNA, 22 bp, Homo sapiens
ccttcaatcagcagtctagctt

SEQ ID NO: 8067078 - DNA, 22 bp, Homo sapiens
ccttcagacctagacaggaatc

SEQ ID NO: 8067079 - DNA, 22 bp, Homo sapiens
ccttcagccagttttctttgtt

SEQ ID NO: 8067080 - DNA, 22 bp, Homo sapiens
ccttcagccttcatccttcctt

SEQ ID NO: 8067081 - DNA, 22 bp, Homo sapiens
ccttcagccttcatccttcctt

SEQ ID NO: 8067082 - DNA, 22 bp, Homo sapiens
ccttcagcctcaagatccttca

SEQ ID NO: 8067083 - DNA, 22 bp, Homo sapiens
ccttcagcctcaagatccttca

SEQ ID NO: 8067084 - DNA, 22 bp, Homo sapiens
ccttcagcctagaacttgagag

SEQ ID NO: 8067085 - DNA, 18 bp, Homo sapiens
ccttcagctctgccagta

SEQ ID NO: 8067086 - DNA, 22 bp, Homo sapiens
ccttcagcctttgtttatcaga

SEQ ID NO: 8067087 - DNA, 22 bp, Homo sapiens
ccttcagcgtcccctttacccg

SEQ ID NO: 8067088 - DNA, 22 bp, Homo sapiens
tgtcagagcaatgaggttcagc

SEQ ID NO: 8067089 - DNA, 22 bp, Homo sapiens
ccttagaaggctgaataattct

SEQ ID NO: 8067090 - DNA, 22 bp, Homo sapiens
ccttagcaactgtcatagagca

SEQ ID NO: 8067091 - DNA, 22 bp, Homo sapiens
tgggccacttgaaagtggatgt

SEQ ID NO: 8067092 - DNA, 22 bp, Homo sapiens
tgggccactcttccctgggtct

SEQ ID NO: 8067093 - DNA, 21 bp, Homo sapiens
tggctctgaaagagtgctgca

SEQ ID NO: 8067094 - DNA, 22 bp, Homo sapiens
tggctctgaccaggtagaggag

SEQ ID NO: 8067095 - DNA, 22 bp, Homo sapiens
tggctctcagctcccagcagcc

SEQ ID NO: 8067096 - DNA, 22 bp, Homo sapiens
tggctctcagctcccagcagcc

SEQ ID NO: 8067097 - DNA, 23 bp, Homo sapiens
tggctctctcagtgctgcagagg

SEQ ID NO: 8067098 - DNA, 22 bp, Homo sapiens
tggctctcaggcctgctgcgtt

SEQ ID NO: 8067099 - DNA, 22 bp, Homo sapiens
tgggagcctggcaggccagagg

SEQ ID NO: 8067100 - DNA, 22 bp, Homo sapiens
tgggagctcagaaagggaggtc

SEQ ID NO: 8067101 - DNA, 22 bp, Homo sapiens
tgggggtgtgccagggacctcc

SEQ ID NO: 8067102 - DNA, 22 bp, Homo sapiens
tgggggtgtcctggtgcacaca

SEQ ID NO: 8067103 - DNA, 21 bp, Homo sapiens
cctgagggtggttgtgaagat

SEQ ID NO: 8067104 - DNA, 22 bp, Homo sapiens
cctgccaggccagtgagcttcc

SEQ ID NO: 8067105 - DNA, 22 bp, Homo sapiens
cctgccaggagctggtgctgca

SEQ ID NO: 8067106 - DNA, 22 bp, Homo sapiens
cctgccagagcagcttgtcctc

SEQ ID NO: 8067107 - DNA, 22 bp, Homo sapiens
cctgcacatgtgtgcgcctgta

SEQ ID NO: 8067108 - DNA, 22 bp, Homo sapiens
cctgagaataattctccatagc

SEQ ID NO: 8067109 - DNA, 22 bp, Homo sapiens
cctgagaatgtttaacagagaa

SEQ ID NO: 8067110 - DNA, 19 bp, Homo sapiens
cctggaggtgaaggttctc

SEQ ID NO: 8067111 - DNA, 22 bp, Homo sapiens
cctggaggagcgctgaccagct

SEQ ID NO: 8067112 - DNA, 22 bp, Homo sapiens
cctggagcttttccatcctgga

SEQ ID NO: 8067113 - DNA, 18 bp, Homo sapiens
cctggagctccacagcaa

SEQ ID NO: 8067114 - DNA, 22 bp, Homo sapiens
cctggaggcggaggttgcagtg

SEQ ID NO: 8067115 - DNA, 22 bp, Homo sapiens
cctggaggctctgggagggcag

SEQ ID NO: 8067116 - DNA, 22 bp, Homo sapiens
cctgctttgagatgggcagcag

SEQ ID NO: 8067117 - DNA, 22 bp, Homo sapiens
cctgcttcagggatgatggcac

SEQ ID NO: 8067118 - DNA, 22 bp, Homo sapiens
cctgcttcagggatgatggcac

SEQ ID NO: 8067119 - DNA, 22 bp, Homo sapiens
cctgctgttagatttcagtcac

SEQ ID NO: 8067120 - DNA, 22 bp, Homo sapiens
tgtaataatgaggcatccagcc

SEQ ID NO: 8067121 - DNA, 22 bp, Homo sapiens
cctggagcactctccctggctg

SEQ ID NO: 8067122 - DNA, 22 bp, Homo sapiens
cctgccaggctttgggcttctg

SEQ ID NO: 8067123 - DNA, 22 bp, Homo sapiens
cctgccagtcactatgtcacct

SEQ ID NO: 8067124 - DNA, 18 bp, Homo sapiens
cctgccagtctggagcag

SEQ ID NO: 8067125 - DNA, 18 bp, Homo sapiens
cctgccagtctggagcag

SEQ ID NO: 8067126 - DNA, 22 bp, Homo sapiens
cctgctgtcccctgagcctgga

SEQ ID NO: 8067127 - DNA, 22 bp, Homo sapiens
cctgctgtgaccggggagcagg

SEQ ID NO: 8067128 - DNA, 22 bp, Homo sapiens
cctgctgtgaaactggcatatg

SEQ ID NO: 8067129 - DNA, 22 bp, Homo sapiens
cctgctgtctgctgtgttaagc

SEQ ID NO: 8067130 - DNA, 22 bp, Homo sapiens
cctgctgtctctgggcaggcag

SEQ ID NO: 8067131 - DNA, 22 bp, Homo sapiens
cctgctggccagtggagggctg

SEQ ID NO: 8067132 - DNA, 22 bp, Homo sapiens
cctgctggcggggacccagtga

SEQ ID NO: 8067133 - DNA, 22 bp, Homo sapiens
cctgctggcattcttgctccct

SEQ ID NO: 8067134 - DNA, 22 bp, Homo sapiens
cctgctggctggtagagttccg

SEQ ID NO: 8067135 - DNA, 20 bp, Homo sapiens
cctgctgggaaccctctgaa

SEQ ID NO: 8067136 - DNA, 22 bp, Homo sapiens
cctgctgggcctgagcaatgag

SEQ ID NO: 8067137 - DNA, 22 bp, Homo sapiens
cctgccttccagccttgggctc

SEQ ID NO: 8067138 - DNA, 22 bp, Homo sapiens
tggtctcttcttccaagatggc

SEQ ID NO: 8067139 - DNA, 22 bp, Homo sapiens
cctgctgcttaggccatatttc

SEQ ID NO: 8067140 - DNA, 22 bp, Homo sapiens
cctgctggacaggggtgttcat

SEQ ID NO: 8067141 - DNA, 22 bp, Homo sapiens
tggtctgctgaacagccgtatc

SEQ ID NO: 8067142 - DNA, 20 bp, Homo sapiens
tggtctggagccagtgagga

SEQ ID NO: 8067143 - DNA, 22 bp, Homo sapiens
ccctgcagaccaatgccataga

SEQ ID NO: 8067144 - DNA, 22 bp, Homo sapiens
ccctgcagaaccacagacaaac

SEQ ID NO: 8067145 - DNA, 22 bp, Homo sapiens
ccctgcagccggccagctcatt

SEQ ID NO: 8067146 - DNA, 22 bp, Homo sapiens
tggacaggttgagtaggaggag

SEQ ID NO: 8067147 - DNA, 22 bp, Homo sapiens
tggacaggtttgggtgcctgtt

SEQ ID NO: 8067148 - DNA, 22 bp, Homo sapiens
ccctgcctctgaagctgctcag

SEQ ID NO: 8067149 - DNA, 22 bp, Homo sapiens
ccctgcctacagggttttcttt

SEQ ID NO: 8067150 - DNA, 22 bp, Homo sapiens
ccctgcctgtgggcatcaacat

SEQ ID NO: 8067151 - DNA, 23 bp, Homo sapiens
ccctggagctagtctgagcagag

SEQ ID NO: 8067152 - DNA, 22 bp, Homo sapiens
tggaggtgagtgtggtacagca

SEQ ID NO: 8067153 - DNA, 22 bp, Homo sapiens
tggaggtgagtgtggtacagca

SEQ ID NO: 8067154 - DNA, 22 bp, Homo sapiens
tggaggccagaggtactgggac

SEQ ID NO: 8067155 - DNA, 22 bp, Homo sapiens
ccctgccttggggtccacaccg

SEQ ID NO: 8067156 - DNA, 22 bp, Homo sapiens
ccctgccttcttggcctttaaa

SEQ ID NO: 8067157 - DNA, 22 bp, Homo sapiens
ccctgccttgtctgggctaggt

SEQ ID NO: 8067158 - DNA, 22 bp, Homo sapiens
ccctgccttgttggagcctatg

SEQ ID NO: 8067159 - DNA, 22 bp, Homo sapiens
tgctttatttataaaatagcaa

SEQ ID NO: 8067160 - DNA, 19 bp, Homo sapiens
tgcctgctcctggcttcca

SEQ ID NO: 8067161 - DNA, 22 bp, Homo sapiens
tgcctgctaggccctgctgggt

SEQ ID NO: 8067162 - DNA, 22 bp, Homo sapiens
tgcctgctaggccctgctgggt

SEQ ID NO: 8067163 - DNA, 22 bp, Homo sapiens
tgcctcagtttcatctgcagaa

SEQ ID NO: 8067164 - DNA, 22 bp, Homo sapiens
tgcctcagtttctccatatgaa

SEQ ID NO: 8067165 - DNA, 22 bp, Homo sapiens
tgcctgcctctggcagccctgc

SEQ ID NO: 8067166 - DNA, 22 bp, Homo sapiens
tggaaggcatgggaactgttct

SEQ ID NO: 8067167 - DNA, 20 bp, Homo sapiens
tggaaggcatctgcattatt

SEQ ID NO: 8067168 - DNA, 22 bp, Homo sapiens
tggaaggcctgttgtgtcctag

SEQ ID NO: 8067169 - DNA, 22 bp, Homo sapiens
tggaaagacattcagccgctgg

SEQ ID NO: 8067170 - DNA, 22 bp, Homo sapiens
ccggcgtctcttccacttccta

SEQ ID NO: 8067171 - DNA, 22 bp, Homo sapiens
ccctgtcctggatgggagcact

SEQ ID NO: 8067172 - DNA, 22 bp, Homo sapiens
ccctgtccttggctgtgaggct

SEQ ID NO: 8067173 - DNA, 22 bp, Homo sapiens
cctcacagggccaggcccctca

SEQ ID NO: 8067174 - DNA, 17 bp, Homo sapiens
cctcacagggaccagac

SEQ ID NO: 8067175 - DNA, 22 bp, Homo sapiens
ccgggcgggggctctcgtcacc

SEQ ID NO: 8067176 - DNA, 22 bp, Homo sapiens
ccgggcctcgggacaccgggta

SEQ ID NO: 8067177 - DNA, 22 bp, Homo sapiens
ccggctcggcgaccaggctgaa

SEQ ID NO: 8067178 - DNA, 18 bp, Homo sapiens
ccgggctttggtgacaca

SEQ ID NO: 8067179 - DNA, 22 bp, Homo sapiens
ccggggacttaaagtgaaggaa

SEQ ID NO: 8067180 - DNA, 22 bp, Homo sapiens
cctccctctttcagtcccacag

SEQ ID NO: 8067181 - DNA, 22 bp, Homo sapiens
cctccctctgttagagctgtct

SEQ ID NO: 8067182 - DNA, 19 bp, Homo sapiens
cctccccttggaccagcaa

SEQ ID NO: 8067183 - DNA, 23 bp, Homo sapiens
cctcagcatggcaggagcccagc

SEQ ID NO: 8067184 - DNA, 22 bp, Homo sapiens
cctcagccttggccccaggcag

SEQ ID NO: 8067185 - DNA, 22 bp, Homo sapiens
cctcagctcttccctgtgcaca

SEQ ID NO: 8067186 - DNA, 22 bp, Homo sapiens
tggcctggggacctgtgagacc

SEQ ID NO: 8067187 - DNA, 22 bp, Homo sapiens
tggcctcaagtctgagggcctt

SEQ ID NO: 8067188 - DNA, 21 bp, Homo sapiens
tggcctcccacacttccatgg

SEQ ID NO: 8067189 - DNA, 22 bp, Homo sapiens
tgaaagcagtgccatgattatg

SEQ ID NO: 8067190 - DNA, 22 bp, Homo sapiens
tgaaagcattagtctaaggtag

SEQ ID NO: 8067191 - DNA, 22 bp, Homo sapiens
tgaaagctgtccactaggctgt

SEQ ID NO: 8067192 - DNA, 22 bp, Homo sapiens
ccaggctgctcacaagctgccc

SEQ ID NO: 8067193 - DNA, 22 bp, Homo sapiens
ccaggctgccgaggaaagaaag

SEQ ID NO: 8067194 - DNA, 22 bp, Homo sapiens
ccaggctgagcatgattggagc

SEQ ID NO: 8067195 - DNA, 22 bp, Homo sapiens
tgaagatgtcagcaggggtggt

SEQ ID NO: 8067196 - DNA, 22 bp, Homo sapiens
tctttattttatgcttgtgcaa

SEQ ID NO: 8067197 - DNA, 22 bp, Homo sapiens
tctttattttatgcttgtgcaa

SEQ ID NO: 8067198 - DNA, 22 bp, Homo sapiens
tctttatttctgaatcccccat

SEQ ID NO: 8067199 - DNA, 22 bp, Homo sapiens
tctttatttctgaatcccccat

SEQ ID NO: 8067200 - DNA, 22 bp, Homo sapiens
tctttaatataaaggaatgaat

SEQ ID NO: 8067201 - DNA, 22 bp, Homo sapiens
tctttatttaagtctgttgtaa

SEQ ID NO: 8067202 - DNA, 22 bp, Homo sapiens
ccaggctcaggtgcgagagaca

SEQ ID NO: 8067203 - DNA, 21 bp, Homo sapiens
ccagcctcagatcagggagct

SEQ ID NO: 8067204 - DNA, 21 bp, Homo sapiens
ccagcctcagatcagggagct

SEQ ID NO: 8067205 - DNA, 22 bp, Homo sapiens
tcttgcctcttcccctttccat

SEQ ID NO: 8067206 - DNA, 22 bp, Homo sapiens
tcttgtatgtgtattttgctgt

SEQ ID NO: 8067207 - DNA, 21 bp, Homo sapiens
tcttgtattggatctgtgtgt

SEQ ID NO: 8067208 - DNA, 22 bp, Homo sapiens
tcttgtgtggaactgcttttct

SEQ ID NO: 8067209 - DNA, 22 bp, Homo sapiens
tcttgtcctaagagctggattc

SEQ ID NO: 8067210 - DNA, 21 bp, Homo sapiens
tcttgtccttgctctcccact

SEQ ID NO: 8067211 - DNA, 22 bp, Homo sapiens
tcttgtttggattttgggcagt

SEQ ID NO: 8067212 - DNA, 22 bp, Homo sapiens
ccagcccttgagatggaaggga

SEQ ID NO: 8067213 - DNA, 22 bp, Homo sapiens
ccagcccttgagatggaaggga

SEQ ID NO: 8067214 - DNA, 22 bp, Homo sapiens
ccagcccttgctgaagggtggc

SEQ ID NO: 8067215 - DNA, 22 bp, Homo sapiens
ccagcctcactggcatcaccta

SEQ ID NO: 8067216 - DNA, 22 bp, Homo sapiens
tgagcagacttgatgaggcagc

SEQ ID NO: 8067217 - DNA, 22 bp, Homo sapiens
tgagcagactctgcagagccac

SEQ ID NO: 8067218 - DNA, 22 bp, Homo sapiens
tgagcagaagccctcctggact

SEQ ID NO: 8067219 - DNA, 22 bp, Homo sapiens
tgagcagaaaagaatgctgagc

SEQ ID NO: 8067220 - DNA, 22 bp, Homo sapiens
tgagcagaaaagaatgctgagc

SEQ ID NO: 8067221 - DNA, 22 bp, Homo sapiens
ccagtgtgccaatttacagctg

SEQ ID NO: 8067222 - DNA, 22 bp, Homo sapiens
ccagtgtggactctctcctttg

SEQ ID NO: 8067223 - DNA, 23 bp, Homo sapiens
tgagctggtattgtccatctcca

SEQ ID NO: 8067224 - DNA, 22 bp, Homo sapiens
tgagctgggctgggctgagctg

SEQ ID NO: 8067225 - DNA, 22 bp, Homo sapiens
ccagggtgtgggcgtcggcacg

SEQ ID NO: 8067226 - DNA, 22 bp, Homo sapiens
ccagggtggggcaggcccactg

SEQ ID NO: 8067227 - DNA, 22 bp, Homo sapiens
ccagggtgggaggctgaaggcg

SEQ ID NO: 8067228 - DNA, 22 bp, Homo sapiens
ccagggtgtagggattccagat

SEQ ID NO: 8067229 - DNA, 22 bp, Homo sapiens
ccagggtgtgggcgtcggcacg

SEQ ID NO: 8067230 - DNA, 22 bp, Homo sapiens
ccagggtggggtccaggaacca

SEQ ID NO: 8067231 - DNA, 22 bp, Homo sapiens
tgagagttattctgaatttagc

SEQ ID NO: 8067232 - DNA, 22 bp, Homo sapiens
tgagacttcctgatgaggcccg

SEQ ID NO: 8067233 - DNA, 22 bp, Homo sapiens
tgagaggtgaggcatgaggcat

SEQ ID NO: 8067234 - DNA, 22 bp, Homo sapiens
ccagggccaagagacctcgagg

SEQ ID NO: 8067235 - DNA, 22 bp, Homo sapiens
ccagggcatgtccaagacttag

SEQ ID NO: 8067236 - DNA, 22 bp, Homo sapiens
ccagggcatgtaactaatggtg

SEQ ID NO: 8067237 - DNA, 22 bp, Homo sapiens
ccagggcatgggaagaactgaa

SEQ ID NO: 8067238 - DNA, 22 bp, Homo sapiens
tgaaggagaattaataggcatt

SEQ ID NO: 8067239 - DNA, 22 bp, Homo sapiens
ccagggtctctgctgcctgaga

SEQ ID NO: 8067240 - DNA, 21 bp, Homo sapiens
tgactttatttgacagcccag

SEQ ID NO: 8067241 - DNA, 22 bp, Homo sapiens
tgactttaataggattttgcat

SEQ ID NO: 8067242 - DNA, 22 bp, Homo sapiens
ccagggccaagagacctcgagg

SEQ ID NO: 8067243 - DNA, 22 bp, Homo sapiens
ccagggccagtaagattggcat

SEQ ID NO: 8067244 - DNA, 22 bp, Homo sapiens
tgacatgaaactgtgttgctac

SEQ ID NO: 8067245 - DNA, 22 bp, Homo sapiens
tgcatattgtccttgatattat

SEQ ID NO: 8067246 - DNA, 22 bp, Homo sapiens
tgcatattgtgaaaatgtagat

SEQ ID NO: 8067247 - DNA, 22 bp, Homo sapiens
tgcagcagtgttccttggcttg

SEQ ID NO: 8067248 - DNA, 17 bp, Homo sapiens
tgcagcagttcccatct

SEQ ID NO: 8067249 - DNA, 22 bp, Homo sapiens
tgcagcagtttaatgcagggtt

SEQ ID NO: 8067250 - DNA, 22 bp, Homo sapiens
tgcagcattgcaaagcagtctt

SEQ ID NO: 8067251 - DNA, 22 bp, Homo sapiens
tgcagcattattcacagtagcc

SEQ ID NO: 8067252 - DNA, 22 bp, Homo sapiens
tgcagcattcttggccactact

SEQ ID NO: 8067253 - DNA, 22 bp, Homo sapiens
cccagcatggagtgaggactca

SEQ ID NO: 8067254 - DNA, 22 bp, Homo sapiens
cccagccaagtgatctgaccgc

SEQ ID NO: 8067255 - DNA, 22 bp, Homo sapiens
cccagccagcctcttcccatat

SEQ ID NO: 8067256 - DNA, 22 bp, Homo sapiens
cccagccaaggtgctggtgttg

SEQ ID NO: 8067257 - DNA, 20 bp, Homo sapiens
cccagcccctacctgttgcc

SEQ ID NO: 8067258 - DNA, 22 bp, Homo sapiens
cccagcccccgagtgtctggaa

SEQ ID NO: 8067259 - DNA, 22 bp, Homo sapiens
cccagcccccgagtgtctggaa

SEQ ID NO: 8067260 - DNA, 22 bp, Homo sapiens
cccagcccatctcaaaggtcta

SEQ ID NO: 8067261 - DNA, 22 bp, Homo sapiens
cccagcccatctcaaaggtcta

SEQ ID NO: 8067262 - DNA, 20 bp, Homo sapiens
cccagcccctacctgttgcc

SEQ ID NO: 8067263 - DNA, 20 bp, Homo sapiens
cccagcccgggccgcgctcg

SEQ ID NO: 8067264 - DNA, 22 bp, Homo sapiens
cccagccctgacctattggaaa

SEQ ID NO: 8067265 - DNA, 22 bp, Homo sapiens
cccagccctgacctattggaaa

SEQ ID NO: 8067266 - DNA, 18 bp, Homo sapiens
cccagcccaccatttctc

SEQ ID NO: 8067267 - DNA, 19 bp, Homo sapiens
cccagccaggtcttgcatc

SEQ ID NO: 8067268 - DNA, 22 bp, Homo sapiens
cccagcccacggtcctgggtgg

SEQ ID NO: 8067269 - DNA, 18 bp, Homo sapiens
cccagcccaccatttctc

SEQ ID NO: 8067270 - DNA, 22 bp, Homo sapiens
cccagcccagcgttcgaggggt

SEQ ID NO: 8067271 - DNA, 22 bp, Homo sapiens
cccagcccagcgttcgaggggt

SEQ ID NO: 8067272 - DNA, 22 bp, Homo sapiens
cccagcccatctcaaaggtcta

SEQ ID NO: 8067273 - DNA, 22 bp, Homo sapiens
cccagctcaagcagagagctaa

SEQ ID NO: 8067274 - DNA, 22 bp, Homo sapiens
cccagctcatcaggagccgccc

SEQ ID NO: 8067275 - DNA, 22 bp, Homo sapiens
cccagctcatcaggagccgccc

SEQ ID NO: 8067276 - DNA, 22 bp, Homo sapiens
ccatggccgccgctgctcagga

SEQ ID NO: 8067277 - DNA, 22 bp, Homo sapiens
ccatggcattttatgtgtctta

SEQ ID NO: 8067278 - DNA, 22 bp, Homo sapiens
ccatggccaattgcaccttgct

SEQ ID NO: 8067279 - DNA, 19 bp, Homo sapiens
ccatggcaatgatctgatg

SEQ ID NO: 8067280 - DNA, 22 bp, Homo sapiens
cccaaagtacaagtaaacatgt

SEQ ID NO: 8067281 - DNA, 22 bp, Homo sapiens
tgattatattctaacttcataa

SEQ ID NO: 8067282 - DNA, 22 bp, Homo sapiens
ccagtgtgttccctgcctcact

SEQ ID NO: 8067283 - DNA, 22 bp, Homo sapiens
ccagtgtgtttaatgcattcca

SEQ ID NO: 8067284 - DNA, 22 bp, Homo sapiens
ccagtgtgtttttctctgactc

SEQ ID NO: 8067285 - DNA, 22 bp, Homo sapiens
ccagtgtggtaggtccacaggt

SEQ ID NO: 8067286 - DNA, 22 bp, Homo sapiens
ccagtgtgttagtggatttccc

SEQ ID NO: 8067287 - DNA, 23 bp, Homo sapiens
ccagtgtggctctgtccgctctc

SEQ ID NO: 8067288 - DNA, 22 bp, Homo sapiens
cccagcagccagaatgaggagc

SEQ ID NO: 8067289 - DNA, 23 bp, Homo sapiens
cccagcagattgtaaagtgtcca

SEQ ID NO: 8067290 - DNA, 22 bp, Homo sapiens
tgcagcagtcagtcaggcctgg

SEQ ID NO: 8067291 - DNA, 22 bp, Homo sapiens
tgcagcaggtatggcaagctcc

SEQ ID NO: 8067292 - DNA, 22 bp, Homo sapiens
tgcagcaggtatggcaagctcc

SEQ ID NO: 8067293 - DNA, 22 bp, Homo sapiens
tgcagcaggtgacaacgagtgg

SEQ ID NO: 8067294 - DNA, 22 bp, Homo sapiens
tgcagcaggttccaaagggtta

SEQ ID NO: 8067295 - DNA, 22 bp, Homo sapiens
cccagcagaatctgatgagggc

SEQ ID NO: 8067296 - DNA, 22 bp, Homo sapiens
cccagcagaccgctgtgatggc

SEQ ID NO: 8067297 - DNA, 23 bp, Homo sapiens
cccagcagagatgaggaggggtc

SEQ ID NO: 8067298 - DNA, 22 bp, Homo sapiens
tgcagagtaaaagcagatgcta

SEQ ID NO: 8067299 - DNA, 22 bp, Homo sapiens
cccaccagtacagatggtagat

SEQ ID NO: 8067300 - DNA, 22 bp, Homo sapiens
cccacccagctgagccgctcac

SEQ ID NO: 8067301 - DNA, 20 bp, Homo sapiens
cccaaggtcacagctagcag

SEQ ID NO: 8067302 - DNA, 22 bp, Homo sapiens
cccacaggctaggggtagggca

SEQ ID NO: 8067303 - DNA, 19 bp, Homo sapiens
tctccagctttgggctttt

SEQ ID NO: 8067304 - DNA, 22 bp, Homo sapiens
tctccagagtaaccttggagca

SEQ ID NO: 8067305 - DNA, 22 bp, Homo sapiens
tctcccacagtctcccatggct

SEQ ID NO: 8067306 - DNA, 22 bp, Homo sapiens
tctcccacagtctcccatggct

SEQ ID NO: 8067307 - DNA, 22 bp, Homo sapiens
tctcccacggtacaggataaac

SEQ ID NO: 8067308 - DNA, 22 bp, Homo sapiens
tctccctgtggaggacccctta

SEQ ID NO: 8067309 - DNA, 22 bp, Homo sapiens
tctcaagcttgttggtatgttt

SEQ ID NO: 8067310 - DNA, 22 bp, Homo sapiens
tctcaagagggaggcaatcatg

SEQ ID NO: 8067311 - DNA, 22 bp, Homo sapiens
tctcaacaccacttgctgaaga

SEQ ID NO: 8067312 - DNA, 22 bp, Homo sapiens
ccacctcctaggcctggagaag

SEQ ID NO: 8067313 - DNA, 22 bp, Homo sapiens
ccacctcctcggccatgtgacg

SEQ ID NO: 8067314 - DNA, 22 bp, Homo sapiens
ccacctccacctattgccagcc

SEQ ID NO: 8067315 - DNA, 22 bp, Homo sapiens
ccacctgagataagagagctca

SEQ ID NO: 8067316 - DNA, 16 bp, Homo sapiens
ccacctgcagctctca

SEQ ID NO: 8067317 - DNA, 22 bp, Homo sapiens
tctccacagtcccacctcgctt

SEQ ID NO: 8067318 - DNA, 22 bp, Homo sapiens
tctccacactttctctcccagg

SEQ ID NO: 8067319 - DNA, 18 bp, Homo sapiens
ccactttgcagcctggcc

SEQ ID NO: 8067320 - DNA, 22 bp, Homo sapiens
ccactttgagaagctgatgaaa

SEQ ID NO: 8067321 - DNA, 22 bp, Homo sapiens
ccactttgaaccactgaggtgg

SEQ ID NO: 8067322 - DNA, 22 bp, Homo sapiens
ccacccttccattcttcctctt

SEQ ID NO: 8067323 - DNA, 22 bp, Homo sapiens
ccacccttgggttcggaggccg

SEQ ID NO: 8067324 - DNA, 22 bp, Homo sapiens
ccacccttgggttcggaggccg

SEQ ID NO: 8067325 - DNA, 22 bp, Homo sapiens
tcggggtctttgacacgctctg

SEQ ID NO: 8067326 - DNA, 22 bp, Homo sapiens
tcgggctcgctctcctagcgga

SEQ ID NO: 8067327 - DNA, 22 bp, Homo sapiens
tcgggctcgctctcctagcgga

SEQ ID NO: 8067328 - DNA, 22 bp, Homo sapiens
tcggaggatatcacagagcttt

SEQ ID NO: 8067329 - DNA, 22 bp, Homo sapiens
ccaccaggacagccctgagggg

SEQ ID NO: 8067330 - DNA, 22 bp, Homo sapiens
tcctttccagcctcacctcagc

SEQ ID NO: 8067331 - DNA, 22 bp, Homo sapiens
tcgcgggttgcacatggccatc

SEQ ID NO: 8067332 - DNA, 22 bp, Homo sapiens
ccaccacatttgcctagacttt

SEQ ID NO: 8067333 - DNA, 22 bp, Homo sapiens
tcctgactaggagggctaaggt

SEQ ID NO: 8067334 - DNA, 22 bp, Homo sapiens
tcctgaccattccttgtctcca

SEQ ID NO: 8067335 - DNA, 22 bp, Homo sapiens
tcctgacctcttgctctgacct

SEQ ID NO: 8067336 - DNA, 22 bp, Homo sapiens
tctcttaactggttcagcaatt

SEQ ID NO: 8067337 - DNA, 22 bp, Homo sapiens
tctctgtgtgttggctgtatat

SEQ ID NO: 8067338 - DNA, 22 bp, Homo sapiens
tctctgtgtgccttcatctgcc

SEQ ID NO: 8067339 - DNA, 22 bp, Homo sapiens
ccagcatgagacgatgatgaag

SEQ ID NO: 8067340 - DNA, 22 bp, Homo sapiens
ccagcatgagacgatgatgaag

SEQ ID NO: 8067341 - DNA, 18 bp, Homo sapiens
ccagcatgccagaggctg

SEQ ID NO: 8067342 - DNA, 18 bp, Homo sapiens
ccagcatgccagaggctg

SEQ ID NO: 8067343 - DNA, 22 bp, Homo sapiens
ccagcatcgacttcctgcctga

SEQ ID NO: 8067344 - DNA, 22 bp, Homo sapiens
tctgagagtacgggctgcgcgc

SEQ ID NO: 8067345 - DNA, 22 bp, Homo sapiens
tctgagagctgccatctcattt

SEQ ID NO: 8067346 - DNA, 22 bp, Homo sapiens
tctgagaggtgaattcagcaaa

SEQ ID NO: 8067347 - DNA, 22 bp, Homo sapiens
tctgagagcaaggcattagcag

SEQ ID NO: 8067348 - DNA, 22 bp, Homo sapiens
ccagcccttcccaactggccag

SEQ ID NO: 8067349 - DNA, 22 bp, Homo sapiens
ccagccacagcttccagctcct

SEQ ID NO: 8067350 - DNA, 20 bp, Homo sapiens
ccagcatgtacacatgtgga

SEQ ID NO: 8067351 - DNA, 22 bp, Homo sapiens
ccagcatggcacctgagatgag

SEQ ID NO: 8067352 - DNA, 22 bp, Homo sapiens
ccagccctcactgaggcctctc

SEQ ID NO: 8067353 - DNA, 22 bp, Homo sapiens
ccagccctgcctctcagggccc

SEQ ID NO: 8067354 - DNA, 22 bp, Homo sapiens
ccagccctgtttatgtgtcact

SEQ ID NO: 8067355 - DNA, 19 bp, Homo sapiens
ccagccctgtcacttcttg

SEQ ID NO: 8067356 - DNA, 19 bp, Homo sapiens
ccagccctgtcacttcttg

SEQ ID NO: 8067357 - DNA, 22 bp, Homo sapiens
ccagcccttagataaacctggc

SEQ ID NO: 8067358 - DNA, 22 bp, Homo sapiens
ccagcagggcagtgccctggac

SEQ ID NO: 8067359 - DNA, 22 bp, Homo sapiens
ccagcagctgtggctttgcctc

SEQ ID NO: 8067360 - DNA, 22 bp, Homo sapiens
ccagcagctttattggctctcc

SEQ ID NO: 8067361 - DNA, 22 bp, Homo sapiens
ccagcagctttattggctctcc

SEQ ID NO: 8067362 - DNA, 22 bp, Homo sapiens
ccagcagctccctcagggtccg

SEQ ID NO: 8067363 - DNA, 21 bp, Homo sapiens
ccagcagctcaaggatctctt

SEQ ID NO: 8067364 - DNA, 22 bp, Homo sapiens
ccagcagagttggtttctggta

SEQ ID NO: 8067365 - DNA, 22 bp, Homo sapiens
ccagcagcagcgtccaaggaga

SEQ ID NO: 8067366 - DNA, 22 bp, Homo sapiens
ccagcagccagagaaggacctc

SEQ ID NO: 8067367 - DNA, 22 bp, Homo sapiens
ccagcagcccacaggcgtccct

SEQ ID NO: 8067368 - DNA, 22 bp, Homo sapiens
ccagcagccctcttccaagact

SEQ ID NO: 8067369 - DNA, 22 bp, Homo sapiens
ccagcagcgatagggtgagtgc

SEQ ID NO: 8067370 - DNA, 22 bp, Homo sapiens
ccagcagccaccttctcgaaat

SEQ ID NO: 8067371 - DNA, 21 bp, Homo sapiens
tctctgggaggacttgtgaga

SEQ ID NO: 8067372 - DNA, 22 bp, Homo sapiens
tctctgggaatgggcctgggta

SEQ ID NO: 8067373 - DNA, 22 bp, Homo sapiens
tctctgatgtatatcagagaac

SEQ ID NO: 8067374 - DNA, 22 bp, Homo sapiens
tctctgagttttaaggatgatg

SEQ ID NO: 8067375 - DNA, 21 bp, Homo sapiens
tcccactctaaatggactgaa

SEQ ID NO: 8067376 - DNA, 22 bp, Homo sapiens
tcccactgagcatatgcagatg

SEQ ID NO: 8067377 - DNA, 22 bp, Homo sapiens
cattcattctgtaagtaactat

SEQ ID NO: 8067378 - DNA, 22 bp, Homo sapiens
tcccagagcctctgccactctg

SEQ ID NO: 8067379 - DNA, 22 bp, Homo sapiens
tcccagaggaaatggcagctga

SEQ ID NO: 8067380 - DNA, 22 bp, Homo sapiens
tcccagccacaggtgtagccct

SEQ ID NO: 8067381 - DNA, 22 bp, Homo sapiens
tcccagccacagtttccacctg

SEQ ID NO: 8067382 - DNA, 22 bp, Homo sapiens
tcccagccaggctctaccactt

SEQ ID NO: 8067383 - DNA, 22 bp, Homo sapiens
tcccagccaggctctaccactt

SEQ ID NO: 8067384 - DNA, 22 bp, Homo sapiens
tcccagccattcctttaggtgt

SEQ ID NO: 8067385 - DNA, 22 bp, Homo sapiens
tcccagcccagatttgtgtgac

SEQ ID NO: 8067386 - DNA, 22 bp, Homo sapiens
tcccagcccagacttctccagt

SEQ ID NO: 8067387 - DNA, 22 bp, Homo sapiens
tcccaggacatgggctctgctc

SEQ ID NO: 8067388 - DNA, 22 bp, Homo sapiens
tcccaggaatccgtcctctaga

SEQ ID NO: 8067389 - DNA, 22 bp, Homo sapiens
catgttctaatattgtgacata

SEQ ID NO: 8067390 - DNA, 22 bp, Homo sapiens
catgttctcttaatgttaacta

SEQ ID NO: 8067391 - DNA, 22 bp, Homo sapiens
catgttaatatgcattgagtac

SEQ ID NO: 8067392 - DNA, 22 bp, Homo sapiens
catgttaatgaatttttgcagt

SEQ ID NO: 8067393 - DNA, 22 bp, Homo sapiens
catgttaaattgagtttgcaat

SEQ ID NO: 8067394 - DNA, 22 bp, Homo sapiens
cattcattagaatagatatgta

SEQ ID NO: 8067395 - DNA, 22 bp, Homo sapiens
tccccagattcatgtctgctgt

SEQ ID NO: 8067396 - DNA, 19 bp, Homo sapiens
tccccagcacctctgagtc

SEQ ID NO: 8067397 - DNA, 22 bp, Homo sapiens
tccctagaggtcttcacaagat

SEQ ID NO: 8067398 - DNA, 22 bp, Homo sapiens
tcccggcgctgggaggtgggtc

SEQ ID NO: 8067399 - DNA, 22 bp, Homo sapiens
tccccagctctgtgcttccact

SEQ ID NO: 8067400 - DNA, 22 bp, Homo sapiens
tccccagccgtgaaggagagga

SEQ ID NO: 8067401 - DNA, 22 bp, Homo sapiens
tccccagccgtgaaggagagga

SEQ ID NO: 8067402 - DNA, 22 bp, Homo sapiens
tccccagcattgagggtctctc

SEQ ID NO: 8067403 - DNA, 22 bp, Homo sapiens
tcccagggtcctcttctggaat

SEQ ID NO: 8067404 - DNA, 22 bp, Homo sapiens
tcctcaggagagctcctatgcc

SEQ ID NO: 8067405 - DNA, 22 bp, Homo sapiens
tcctcaggatctaggagtgctt

SEQ ID NO: 8067406 - DNA, 22 bp, Homo sapiens
tcctcaggatgtggagtagaat

SEQ ID NO: 8067407 - DNA, 22 bp, Homo sapiens
tcctcaggatgtggggtagaat

SEQ ID NO: 8067408 - DNA, 22 bp, Homo sapiens
tcctcaggctgcctggaagact

SEQ ID NO: 8067409 - DNA, 22 bp, Homo sapiens
tcctcaggcggtgaggaggggc

SEQ ID NO: 8067410 - DNA, 22 bp, Homo sapiens
catttgtagttaaaaatgtctc

SEQ ID NO: 8067411 - DNA, 22 bp, Homo sapiens
tcctcagggaagatgagcctca

SEQ ID NO: 8067412 - DNA, 22 bp, Homo sapiens
tccagccctgtggcttccaccc

SEQ ID NO: 8067413 - DNA, 22 bp, Homo sapiens
tccagctcttgttgcccactgc

SEQ ID NO: 8067414 - DNA, 22 bp, Homo sapiens
tccagcctaatgttcttcccac

SEQ ID NO: 8067415 - DNA, 22 bp, Homo sapiens
tccagcctaggggaacagctgc

SEQ ID NO: 8067416 - DNA, 22 bp, Homo sapiens
tccagcctcatttctcctgctt

SEQ ID NO: 8067417 - DNA, 22 bp, Homo sapiens
tccagctcttcagttctgcaaa

SEQ ID NO: 8067418 - DNA, 22 bp, Homo sapiens
tccagctcttcagttctgcaaa

SEQ ID NO: 8067419 - DNA, 17 bp, Homo sapiens
tccagcctcctctgctg

SEQ ID NO: 8067420 - DNA, 22 bp, Homo sapiens
tccagcctcctatttaccctaa

SEQ ID NO: 8067421 - DNA, 22 bp, Homo sapiens
catgttaaaatatacattctga

SEQ ID NO: 8067422 - DNA, 22 bp, Homo sapiens
cataacagtggcttcagcaagt

SEQ ID NO: 8067423 - DNA, 22 bp, Homo sapiens
tcatgcaaggctgaaacatggt

SEQ ID NO: 8067424 - DNA, 22 bp, Homo sapiens
catcttttggtaggagccgggc

SEQ ID NO: 8067425 - DNA, 22 bp, Homo sapiens
catcttttcagaagccattctg

SEQ ID NO: 8067426 - DNA, 22 bp, Homo sapiens
catcttttggcctattctgagg

SEQ ID NO: 8067427 - DNA, 19 bp, Homo sapiens
tcattgaacataattactt

SEQ ID NO: 8067428 - DNA, 22 bp, Homo sapiens
tcatttatcgctgccttttaaa

SEQ ID NO: 8067429 - DNA, 21 bp, Homo sapiens
tcatttattgagaaatgactg

SEQ ID NO: 8067430 - DNA, 22 bp, Homo sapiens
tccacatccattgcttgacttt

SEQ ID NO: 8067431 - DNA, 17 bp, Homo sapiens
tccaagccagcttgcct

SEQ ID NO: 8067432 - DNA, 22 bp, Homo sapiens
cagggtgggcacccagcctcca

SEQ ID NO: 8067433 - DNA, 22 bp, Homo sapiens
cagggtggggaaatagcgccct

SEQ ID NO: 8067434 - DNA, 22 bp, Homo sapiens
cagtcccaaggaggaagcagtc

SEQ ID NO: 8067435 - DNA, 21 bp, Homo sapiens
tatttctttgactctctccct

SEQ ID NO: 8067436 - DNA, 22 bp, Homo sapiens
tatttctttcaggtatgtgttg

SEQ ID NO: 8067437 - DNA, 22 bp, Homo sapiens
cagtagccactagacacatgta

SEQ ID NO: 8067438 - DNA, 22 bp, Homo sapiens
tatttccacctattattttctg

SEQ ID NO: 8067439 - DNA, 22 bp, Homo sapiens
tatttccaaaagcctattatga

SEQ ID NO: 8067440 - DNA, 22 bp, Homo sapiens
tatttccaaaagcctattatga

SEQ ID NO: 8067441 - DNA, 22 bp, Homo sapiens
tatttccaagctgaatccaatg

SEQ ID NO: 8067442 - DNA, 22 bp, Homo sapiens
tatttccaagctgaatccaatg

SEQ ID NO: 8067443 - DNA, 22 bp, Homo sapiens
tatttccaccctcagtaaggaa

SEQ ID NO: 8067444 - DNA, 22 bp, Homo sapiens
tcacagcttcttgcgggtctga

SEQ ID NO: 8067445 - DNA, 22 bp, Homo sapiens
tcacaggaaccatcagagaaat

SEQ ID NO: 8067446 - DNA, 22 bp, Homo sapiens
tcacaggaccctgagggtggcg

SEQ ID NO: 8067447 - DNA, 22 bp, Homo sapiens
tcacagtgtggcaactcacaga

SEQ ID NO: 8067448 - DNA, 22 bp, Homo sapiens
tcaatgagaaagacacagtctt

SEQ ID NO: 8067449 - DNA, 22 bp, Homo sapiens
tcaatgaggtgattgctgtcct

SEQ ID NO: 8067450 - DNA, 22 bp, Homo sapiens
tcaatgaggtaatcagtcaccc

SEQ ID NO: 8067451 - DNA, 22 bp, Homo sapiens
tcaatgagctggggacgtgtac

SEQ ID NO: 8067452 - DNA, 22 bp, Homo sapiens
tcaatgagccagaatgtagtac

SEQ ID NO: 8067453 - DNA, 23 bp, Homo sapiens
tcagcagcagaagtgctgggatg

SEQ ID NO: 8067454 - DNA, 21 bp, Homo sapiens
tcagcagcatctgcctagagt

SEQ ID NO: 8067455 - DNA, 22 bp, Homo sapiens
tcagcagcagctcagcatgttt

SEQ ID NO: 8067456 - DNA, 22 bp, Homo sapiens
tcagcagagctcaggctccagc

SEQ ID NO: 8067457 - DNA, 22 bp, Homo sapiens
tcagcagaatgtggcatgtcac

SEQ ID NO: 8067458 - DNA, 22 bp, Homo sapiens
tcagcagaggggaaggcatctg

SEQ ID NO: 8067459 - DNA, 22 bp, Homo sapiens
tcagcagatgggttgtgttggc

SEQ ID NO: 8067460 - DNA, 22 bp, Homo sapiens
tcagcagatgatttccatacaa

SEQ ID NO: 8067461 - DNA, 22 bp, Homo sapiens
tcagcagaagtatagaggccat

SEQ ID NO: 8067462 - DNA, 22 bp, Homo sapiens
cataaactcttgagattcttgt

SEQ ID NO: 8067463 - DNA, 22 bp, Homo sapiens
cataaagtaaagatgtcttcca

SEQ ID NO: 8067464 - DNA, 22 bp, Homo sapiens
cataaaatggcttgttctttaa

SEQ ID NO: 8067465 - DNA, 22 bp, Homo sapiens
cataaaatggcttgttctttaa

SEQ ID NO: 8067466 - DNA, 22 bp, Homo sapiens
tcaggaaagaagatgctcagtg

SEQ ID NO: 8067467 - DNA, 22 bp, Homo sapiens
cagtggctgtttctggaaggca

SEQ ID NO: 8067468 - DNA, 22 bp, Homo sapiens
cagtgggaagggcagaggcttt

SEQ ID NO: 8067469 - DNA, 22 bp, Homo sapiens
cagtgggacatgggcactgggc

SEQ ID NO: 8067470 - DNA, 22 bp, Homo sapiens
cagtggggaggccaggatagaa

SEQ ID NO: 8067471 - DNA, 22 bp, Homo sapiens
tcagagaacacagaggtgatgt

SEQ ID NO: 8067472 - DNA, 22 bp, Homo sapiens
tcagagaacacagaggtgatgt

SEQ ID NO: 8067473 - DNA, 21 bp, Homo sapiens
tcagagaacccggcaggcaag

SEQ ID NO: 8067474 - DNA, 22 bp, Homo sapiens
tcagagaaataattgctgagtt

SEQ ID NO: 8067475 - DNA, 22 bp, Homo sapiens
tcagagaaatgaagtagggatt

SEQ ID NO: 8067476 - DNA, 22 bp, Homo sapiens
tcagagaaatgaagtagggatt

SEQ ID NO: 8067477 - DNA, 23 bp, Homo sapiens
tcagaagtgggatacaaagctga

SEQ ID NO: 8067478 - DNA, 22 bp, Homo sapiens
cagtgtgcctgaatcaagtgtt

SEQ ID NO: 8067479 - DNA, 22 bp, Homo sapiens
caggctgggctggtgttagagt

SEQ ID NO: 8067480 - DNA, 22 bp, Homo sapiens
tagaatcaagcagtagagcaga

SEQ ID NO: 8067481 - DNA, 22 bp, Homo sapiens
tagaatatgtggtgtatacttt

SEQ ID NO: 8067482 - DNA, 22 bp, Homo sapiens
caggctgggcagcctccccggc

SEQ ID NO: 8067483 - DNA, 17 bp, Homo sapiens
tagagctggttcaggag

SEQ ID NO: 8067484 - DNA, 23 bp, Homo sapiens
tagagcttcagcgaatgtgctca

SEQ ID NO: 8067485 - DNA, 22 bp, Homo sapiens
tagagctggaatttgcagcaag

SEQ ID NO: 8067486 - DNA, 22 bp, Homo sapiens
tagagctgggcagtgctctgag

SEQ ID NO: 8067487 - DNA, 22 bp, Homo sapiens
tagagctggccgggacagctgg

SEQ ID NO: 8067488 - DNA, 19 bp, Homo sapiens
tagagctgcttcctggcag

SEQ ID NO: 8067489 - DNA, 22 bp, Homo sapiens
tagagctggaaaactgcaggta

SEQ ID NO: 8067490 - DNA, 22 bp, Homo sapiens
cagggcagaacatatagatagt

SEQ ID NO: 8067491 - DNA, 22 bp, Homo sapiens
cagggcagaaggcactctactc

SEQ ID NO: 8067492 - DNA, 21 bp, Homo sapiens
cagggcacacagaggatggta

SEQ ID NO: 8067493 - DNA, 22 bp, Homo sapiens
cagggcacagttatggaggtgg

SEQ ID NO: 8067494 - DNA, 22 bp, Homo sapiens
tagataatttggcatcatattg

SEQ ID NO: 8067495 - DNA, 22 bp, Homo sapiens
tagcaagatgtcactccaagtt

SEQ ID NO: 8067496 - DNA, 22 bp, Homo sapiens
tagctacacatctaaacagcaa

SEQ ID NO: 8067497 - DNA, 22 bp, Homo sapiens
tactcagtcagattcaacctag

SEQ ID NO: 8067498 - DNA, 22 bp, Homo sapiens
tactatttggaattttaaattg

SEQ ID NO: 8067499 - DNA, 22 bp, Homo sapiens
gtgaggggagtaaagccatgtt

SEQ ID NO: 8067500 - DNA, 17 bp, Homo sapiens
gtgagggcagaggatgg

SEQ ID NO: 8067501 - DNA, 22 bp, Homo sapiens
gtgagggcagaacccccaggcc

SEQ ID NO: 8067502 - DNA, 22 bp, Homo sapiens
caggctggagtgcagtggcgcc

SEQ ID NO: 8067503 - DNA, 22 bp, Homo sapiens
caggctggagtgcagtggcgct

SEQ ID NO: 8067504 - DNA, 22 bp, Homo sapiens
caggctggagtgcagtggggcg

SEQ ID NO: 8067505 - DNA, 22 bp, Homo sapiens
tagaacataagtcattcatttg

SEQ ID NO: 8067506 - DNA, 22 bp, Homo sapiens
tagaatatgattaattttctta

SEQ ID NO: 8067507 - DNA, 22 bp, Homo sapiens
tagaatatacactacagcttaa

SEQ ID NO: 8067508 - DNA, 22 bp, Homo sapiens
tactgtgaatacaaaataaatt

SEQ ID NO: 8067509 - DNA, 22 bp, Homo sapiens
tactgtgacagagtacttaaac

SEQ ID NO: 8067510 - DNA, 22 bp, Homo sapiens
caggggacattaaagctccata

SEQ ID NO: 8067511 - DNA, 22 bp, Homo sapiens
caggggacagtatggtggatga

SEQ ID NO: 8067512 - DNA, 22 bp, Homo sapiens
caggggaagatgccaagggaga

SEQ ID NO: 8067513 - DNA, 21 bp, Homo sapiens
tagggcaggcattggaagaga

SEQ ID NO: 8067514 - DNA, 22 bp, Homo sapiens
tagggcaggtgaagaaaagcta

SEQ ID NO: 8067515 - DNA, 22 bp, Homo sapiens
tagggcaggggaggaatctgaa

SEQ ID NO: 8067516 - DNA, 22 bp, Homo sapiens
tagggcagtttcatgttatctt

SEQ ID NO: 8067517 - DNA, 22 bp, Homo sapiens
tagggcagttataacattagtg

SEQ ID NO: 8067518 - DNA, 22 bp, Homo sapiens
tagggcctgacattcagtaggt

SEQ ID NO: 8067519 - DNA, 22 bp, Homo sapiens
tagggctattctgagtaataat

SEQ ID NO: 8067520 - DNA, 22 bp, Homo sapiens
tagggctataagagaataagac

SEQ ID NO: 8067521 - DNA, 22 bp, Homo sapiens
caggggcaagaatgctgtcagc

SEQ ID NO: 8067522 - DNA, 22 bp, Homo sapiens
tatcataagttaattaaacagt

SEQ ID NO: 8067523 - DNA, 22 bp, Homo sapiens
cagggtggcaggcaccatggcc

SEQ ID NO: 8067524 - DNA, 22 bp, Homo sapiens
cagggtggcactcagcgcatct

SEQ ID NO: 8067525 - DNA, 22 bp, Homo sapiens
tagctattcacttgttgatgga

SEQ ID NO: 8067526 - DNA, 22 bp, Homo sapiens
tagctattcacttgttgatgga

SEQ ID NO: 8067527 - DNA, 22 bp, Homo sapiens
tagctcatgtaatccgaacata

SEQ ID NO: 8067528 - DNA, 22 bp, Homo sapiens
cagggcagccaggccccgtggg

SEQ ID NO: 8067529 - DNA, 22 bp, Homo sapiens
cagggcagcttcctttgttagg

SEQ ID NO: 8067530 - DNA, 22 bp, Homo sapiens
cagggcagagggaaactccttt

SEQ ID NO: 8067531 - DNA, 22 bp, Homo sapiens
cagggcagagccaggatttcaa

SEQ ID NO: 8067532 - DNA, 22 bp, Homo sapiens
cagggcaggaatttgacattgc

SEQ ID NO: 8067533 - DNA, 18 bp, Homo sapiens
taggagagaatttattta

SEQ ID NO: 8067534 - DNA, 22 bp, Homo sapiens
taggagaggtgaatggcacact

SEQ ID NO: 8067535 - DNA, 22 bp, Homo sapiens
taggagagctgaactattgtct

SEQ ID NO: 8067536 - DNA, 19 bp, Homo sapiens
taggaccctggtggccccc

SEQ ID NO: 8067537 - DNA, 22 bp, Homo sapiens
cagggcctgcctggttcctgga

SEQ ID NO: 8067538 - DNA, 22 bp, Homo sapiens
cagggcctgcttccttcttgtt

SEQ ID NO: 8067539 - DNA, 22 bp, Homo sapiens
taggagcttttggagtcctgtg

SEQ ID NO: 8067540 - DNA, 22 bp, Homo sapiens
cagggccttttagcatcttctc

SEQ ID NO: 8067541 - DNA, 22 bp, Homo sapiens
cagggccttatcctgccattga

SEQ ID NO: 8067542 - DNA, 22 bp, Homo sapiens
cagggccttatcctgccattga

SEQ ID NO: 8067543 - DNA, 22 bp, Homo sapiens
tttcagaaagcatcatcaaagt

SEQ ID NO: 8067544 - DNA, 22 bp, Homo sapiens
tttcagaaatcaaaaccagggt

SEQ ID NO: 8067545 - DNA, 22 bp, Homo sapiens
tttcagaaatggcactgaaatc

SEQ ID NO: 8067546 - DNA, 22 bp, Homo sapiens
tttcattgaactaaagaatctg

SEQ ID NO: 8067547 - DNA, 22 bp, Homo sapiens
tttcaagagggaactgaacaca

SEQ ID NO: 8067548 - DNA, 22 bp, Homo sapiens
tttcaacaggatgataataggc

SEQ ID NO: 8067549 - DNA, 22 bp, Homo sapiens
tttcaacatataccataatgcc

SEQ ID NO: 8067550 - DNA, 22 bp, Homo sapiens
tttcacaatgcaatcctacttc

SEQ ID NO: 8067551 - DNA, 22 bp, Homo sapiens
tttcacaattttaaggagcaaa

SEQ ID NO: 8067552 - DNA, 22 bp, Homo sapiens
tttcaaaggtggaagagtgaat

SEQ ID NO: 8067553 - DNA, 23 bp, Homo sapiens
tttcaacaatgcttagagaaaac

SEQ ID NO: 8067554 - DNA, 22 bp, Homo sapiens
tttcaacagctctcaaatgatc

SEQ ID NO: 8067555 - DNA, 22 bp, Homo sapiens
tttattcttgagagtgagaaga

SEQ ID NO: 8067556 - DNA, 22 bp, Homo sapiens
tttattctgtgctacatgaaga

SEQ ID NO: 8067557 - DNA, 22 bp, Homo sapiens
tttattctataggcattaagca

SEQ ID NO: 8067558 - DNA, 22 bp, Homo sapiens
tttaaacatatctgttgaggga

SEQ ID NO: 8067559 - DNA, 22 bp, Homo sapiens
ttgtgtggtagcttcattgaac

SEQ ID NO: 8067560 - DNA, 22 bp, Homo sapiens
tttaatgatagctgtttcacat

SEQ ID NO: 8067561 - DNA, 23 bp, Homo sapiens
tttaatgaccaatagaaggaaca

SEQ ID NO: 8067562 - DNA, 22 bp, Homo sapiens
tttagaagttcacacatttaaa

SEQ ID NO: 8067563 - DNA, 20 bp, Homo sapiens
tttacattttgaaacagtga

SEQ ID NO: 8067564 - DNA, 23 bp, Homo sapiens
tttatattcctaatgtcttgagc

SEQ ID NO: 8067565 - DNA, 22 bp, Homo sapiens
tttatatagagatttgtgcatg

SEQ ID NO: 8067566 - DNA, 22 bp, Homo sapiens
tttatattgggagtcgttttga

SEQ ID NO: 8067567 - DNA, 22 bp, Homo sapiens
tttatattgtaaaaatggttct

SEQ ID NO: 8067568 - DNA, 22 bp, Homo sapiens
tttatatttcccaggattggcc

SEQ ID NO: 8067569 - DNA, 22 bp, Homo sapiens
tttagcagcaaataagtagtgc

SEQ ID NO: 8067570 - DNA, 23 bp, Homo sapiens
ttgcatggagcctgggattcctc

SEQ ID NO: 8067571 - DNA, 22 bp, Homo sapiens
ttgcagagatcagcaggtttga

SEQ ID NO: 8067572 - DNA, 22 bp, Homo sapiens
ttgacaagtggagatatttaag

SEQ ID NO: 8067573 - DNA, 22 bp, Homo sapiens
ttgctcatatttgcatgtgttt

SEQ ID NO: 8067574 - DNA, 22 bp, Homo sapiens
ttgctcatttgcctttaggttt

SEQ ID NO: 8067575 - DNA, 22 bp, Homo sapiens
ttgctctgtaataatctggggt

SEQ ID NO: 8067576 - DNA, 22 bp, Homo sapiens
ttgctctgactggagtgcagtg

SEQ ID NO: 8067577 - DNA, 22 bp, Homo sapiens
ttgcttatttgattaaatgtct

SEQ ID NO: 8067578 - DNA, 22 bp, Homo sapiens
ttggaaagcaagctggacatac

SEQ ID NO: 8067579 - DNA, 21 bp, Homo sapiens
ttggaacaagcagcagtttgc

SEQ ID NO: 8067580 - DNA, 22 bp, Homo sapiens
ttggacagaatttatcttcagt

SEQ ID NO: 8067581 - DNA, 22 bp, Homo sapiens
ttgtacacaattcttaacatac

SEQ ID NO: 8067582 - DNA, 22 bp, Homo sapiens
ttgtcccaggacttgcatagat

SEQ ID NO: 8067583 - DNA, 23 bp, Homo sapiens
ttgtcctgccgatctctgagaat

SEQ ID NO: 8067584 - DNA, 22 bp, Homo sapiens
ttgtggctcgtgagatgttagg

SEQ ID NO: 8067585 - DNA, 22 bp, Homo sapiens
ttggcagggccaggctctctct

SEQ ID NO: 8067586 - DNA, 22 bp, Homo sapiens
ttggagccctgaggatctggat

SEQ ID NO: 8067587 - DNA, 22 bp, Homo sapiens
ttggacagtgcagatctacacg

SEQ ID NO: 8067588 - DNA, 22 bp, Homo sapiens
ttggagagaggctgctcaggct

SEQ ID NO: 8067589 - DNA, 22 bp, Homo sapiens
ttggagagattatcagaccagc

SEQ ID NO: 8067590 - DNA, 22 bp, Homo sapiens
ttgggcaggtgtggctctcctt

SEQ ID NO: 8067591 - DNA, 22 bp, Homo sapiens
ttgggcagggaaaggacaggca

SEQ ID NO: 8067592 - DNA, 22 bp, Homo sapiens
ttgggcagtgattagttcatga

SEQ ID NO: 8067593 - DNA, 22 bp, Homo sapiens
ttggccatctaagcccagccac

SEQ ID NO: 8067594 - DNA, 22 bp, Homo sapiens
ttgggacagcaaccatctgcta

SEQ ID NO: 8067595 - DNA, 22 bp, Homo sapiens
ttccttggtagagagaatattt

SEQ ID NO: 8067596 - DNA, 22 bp, Homo sapiens
ttctcagatccatcagaagtcc

SEQ ID NO: 8067597 - DNA, 22 bp, Homo sapiens
ttctccagaccctcctgcagac

SEQ ID NO: 8067598 - DNA, 22 bp, Homo sapiens
ttctccaaggatacagtcctgt

SEQ ID NO: 8067599 - DNA, 22 bp, Homo sapiens
ttctccaatagctgctcatggc

SEQ ID NO: 8067600 - DNA, 22 bp, Homo sapiens
ttctccaacacaagcatgatgt

SEQ ID NO: 8067601 - DNA, 22 bp, Homo sapiens
ttctctaggttttagatgaaga

SEQ ID NO: 8067602 - DNA, 22 bp, Homo sapiens
ttcctgaatgctgttgtgctgt

SEQ ID NO: 8067603 - DNA, 22 bp, Homo sapiens
ttcctgaatataaagacactag

SEQ ID NO: 8067604 - DNA, 22 bp, Homo sapiens
ttctggaagtgttagaatctgg

SEQ ID NO: 8067605 - DNA, 22 bp, Homo sapiens
ttctggagagaaaccttacaaa

SEQ ID NO: 8067606 - DNA, 22 bp, Homo sapiens
ttctggagacccagcaacaggg

SEQ ID NO: 8067607 - DNA, 22 bp, Homo sapiens
ttctggagatctgcctatggga

SEQ ID NO: 8067608 - DNA, 22 bp, Homo sapiens
ttcttataagttaatatttcca

SEQ ID NO: 8067609 - DNA, 22 bp, Homo sapiens
ttcttagatgattaatgatggg

SEQ ID NO: 8067610 - DNA, 22 bp, Homo sapiens
ttctgtgtgccagagttgtgct

SEQ ID NO: 8067611 - DNA, 22 bp, Homo sapiens
ttctgtgtgcttactggtgttc

SEQ ID NO: 8067612 - DNA, 22 bp, Homo sapiens
ttctgtgtcttcttgttctgtg

SEQ ID NO: 8067613 - DNA, 22 bp, Homo sapiens
ttctgtgaatggccatgacaag

SEQ ID NO: 8067614 - DNA, 22 bp, Homo sapiens
ttctgtgactcctcagagattt

SEQ ID NO: 8067615 - DNA, 22 bp, Homo sapiens
ttcttttaatgttctgaagttt

SEQ ID NO: 8067616 - DNA, 22 bp, Homo sapiens
ttcttttaatgtctggctttca

SEQ ID NO: 8067617 - DNA, 22 bp, Homo sapiens
ttcttcaattattggaaagaaa

SEQ ID NO: 8067618 - DNA, 22 bp, Homo sapiens
ttcttcaaccatctacataaac

SEQ ID NO: 8067619 - DNA, 22 bp, Homo sapiens
ttcttcaaagtccttattcctt

SEQ ID NO: 8067620 - DNA, 22 bp, Homo sapiens
ttcttcaaaatccagcatgatt

SEQ ID NO: 8067621 - DNA, 22 bp, Homo sapiens
ttcttcaaaatccagcatgatt

SEQ ID NO: 8067622 - DNA, 22 bp, Homo sapiens
ttcttcaaagatgtctgttgga

SEQ ID NO: 8067623 - DNA, 22 bp, Homo sapiens
ttcttttcttggcaggagtaga

SEQ ID NO: 8067624 - DNA, 22 bp, Homo sapiens
ttgaaatgagactaattgattg

SEQ ID NO: 8067625 - DNA, 18 bp, Homo sapiens
ttcacaggaaatgtcttt

SEQ ID NO: 8067626 - DNA, 22 bp, Homo sapiens
ttcacaggaatgtaggggtctt

SEQ ID NO: 8067627 - DNA, 22 bp, Homo sapiens
ttcacagagagtatgcagagaa

SEQ ID NO: 8067628 - DNA, 22 bp, Homo sapiens
ttcaaagctgcagactcctggg

SEQ ID NO: 8067629 - DNA, 22 bp, Homo sapiens
ttcagagagtttgtgagtcctt

SEQ ID NO: 8067630 - DNA, 22 bp, Homo sapiens
ttcagagagtccagtatgcagt

SEQ ID NO: 8067631 - DNA, 20 bp, Homo sapiens
ttcagagatagggtctttaa

SEQ ID NO: 8067632 - DNA, 22 bp, Homo sapiens
ttcagagcatctctaaagccag

SEQ ID NO: 8067633 - DNA, 22 bp, Homo sapiens
ttcagagccacttcaagtctaa

SEQ ID NO: 8067634 - DNA, 22 bp, Homo sapiens
ttcagagatgacacctggtgtt

SEQ ID NO: 8067635 - DNA, 22 bp, Homo sapiens
ttcagagatggaaggcagaatg

SEQ ID NO: 8067636 - DNA, 22 bp, Homo sapiens
ttcagagagaaaccagtgggaa

SEQ ID NO: 8067637 - DNA, 22 bp, Homo sapiens
ttcagagagtacagttgctggc

SEQ ID NO: 8067638 - DNA, 22 bp, Homo sapiens
ttcagagagaccaagtggcgtg

SEQ ID NO: 8067639 - DNA, 22 bp, Homo sapiens
ttcagagaagcaaaggcagatt

SEQ ID NO: 8067640 - DNA, 22 bp, Homo sapiens
ttcagagacagcaaccaggaca

SEQ ID NO: 8067641 - DNA, 22 bp, Homo sapiens
ttcagagaaagcagatttactc

SEQ ID NO: 8067642 - DNA, 22 bp, Homo sapiens
ttcagagaacttcatggaagag

SEQ ID NO: 8067643 - DNA, 22 bp, Homo sapiens
ttcagagaagcaaaggcagatt

SEQ ID NO: 8067644 - DNA, 22 bp, Homo sapiens
ttcacaggcttggaggtggggg

SEQ ID NO: 8067645 - DNA, 22 bp, Homo sapiens
ttcacaggagggtggatgcatg

SEQ ID NO: 8067646 - DNA, 22 bp, Homo sapiens
ttcacaggatatatgtgcaggg

SEQ ID NO: 8067647 - DNA, 22 bp, Homo sapiens
ttcacagggcagcagctgagcc

SEQ ID NO: 8067648 - DNA, 22 bp, Homo sapiens
ttcacaggtgactggggataac

SEQ ID NO: 8067649 - DNA, 22 bp, Homo sapiens
ttcacagggccactggcaggag

SEQ ID NO: 8067650 - DNA, 18 bp, Homo sapiens
ttcagcagcagacacact

SEQ ID NO: 8067651 - DNA, 22 bp, Homo sapiens
ttcatttaatcagaatctctaa

SEQ ID NO: 8067652 - DNA, 22 bp, Homo sapiens
ttcatttagcatgctaaacctg

SEQ ID NO: 8067653 - DNA, 22 bp, Homo sapiens
ttcatttaatttgtgtattaac

SEQ ID NO: 8067654 - DNA, 22 bp, Homo sapiens
ttcatttattcagcaggtattt

SEQ ID NO: 8067655 - DNA, 22 bp, Homo sapiens
ttcatttgccatcagtgtaatg

SEQ ID NO: 8067656 - DNA, 23 bp, Homo sapiens
ttcatttaggagttcataagagc

SEQ ID NO: 8067657 - DNA, 22 bp, Homo sapiens
ttcattgtagcttgactaatta

SEQ ID NO: 8067658 - DNA, 22 bp, Homo sapiens
ttcattgcattccagcctgggt

SEQ ID NO: 8067659 - DNA, 22 bp, Homo sapiens
ttcattgatttccttggaataa

SEQ ID NO: 8067660 - DNA, 21 bp, Homo sapiens
ttcataaaccattctcatgca

SEQ ID NO: 8067661 - DNA, 22 bp, Homo sapiens
ttcatttgttgacagagacatg

SEQ ID NO: 8067662 - DNA, 22 bp, Homo sapiens
ttcatttttaccgcgtgtcaaa

SEQ ID NO: 8067663 - DNA, 22 bp, Homo sapiens
ttccaggaacagatgaaggttg

SEQ ID NO: 8067664 - DNA, 22 bp, Homo sapiens
ttccagggctaattcctgtgga

SEQ ID NO: 8067665 - DNA, 22 bp, Homo sapiens
ttccaggggcagcagtgatggt

SEQ ID NO: 8067666 - DNA, 22 bp, Homo sapiens
ttccagtgactaagcttctgct

SEQ ID NO: 8067667 - DNA, 22 bp, Homo sapiens
ttccagtgaaacatgaggtgtg

SEQ ID NO: 8067668 - DNA, 22 bp, Homo sapiens
ttaggaaacgctgctattgact

SEQ ID NO: 8067669 - DNA, 22 bp, Homo sapiens
ttaggaaacgctgctattgact

SEQ ID NO: 8067670 - DNA, 22 bp, Homo sapiens
ttaggaaagaagcagctaggag

SEQ ID NO: 8067671 - DNA, 22 bp, Homo sapiens
ttaggaaagggttttctaacag

SEQ ID NO: 8067672 - DNA, 22 bp, Homo sapiens
ttatagatttttatgaagtctg

SEQ ID NO: 8067673 - DNA, 22 bp, Homo sapiens
ttatactttatactacatcatt

SEQ ID NO: 8067674 - DNA, 17 bp, Homo sapiens
ttatactcgtaggtgga

SEQ ID NO: 8067675 - DNA, 22 bp, Homo sapiens
ttatactaaaacgcattgaatt

SEQ ID NO: 8067676 - DNA, 22 bp, Homo sapiens
ttatataaagataacttttctt

SEQ ID NO: 8067677 - DNA, 22 bp, Homo sapiens
ttatataaagataacttttctt

SEQ ID NO: 8067678 - DNA, 18 bp, Homo sapiens
tcctgcctgtgccccagg

SEQ ID NO: 8067679 - DNA, 22 bp, Homo sapiens
tcctgcctgtttacctgtactt

SEQ ID NO: 8067680 - DNA, 19 bp, Homo sapiens
tcctgcctggggccgcctg

SEQ ID NO: 8067681 - DNA, 18 bp, Homo sapiens
tcctgcctgcgggctccc

SEQ ID NO: 8067682 - DNA, 22 bp, Homo sapiens
tcctgccttagagcaaggaaaa

SEQ ID NO: 8067683 - DNA, 22 bp, Homo sapiens
tcctgctgagcatgttctgccc

SEQ ID NO: 8067684 - DNA, 22 bp, Homo sapiens
tcctgctgctacctggcccacg

SEQ ID NO: 8067685 - DNA, 20 bp, Homo sapiens
tcctgctgccacctcttctt

SEQ ID NO: 8067686 - DNA, 22 bp, Homo sapiens
tcctgctggaaacttcctcttg

SEQ ID NO: 8067687 - DNA, 22 bp, Homo sapiens
ttcaaacattcaaataaaccgg

SEQ ID NO: 8067688 - DNA, 22 bp, Homo sapiens
ttcaaacagtgtagaatatatg

SEQ ID NO: 8067689 - DNA, 22 bp, Homo sapiens
ttcaaacagtgtagaatatatg

SEQ ID NO: 8067690 - DNA, 22 bp, Homo sapiens
ttcaaacacagacagcagcatg

SEQ ID NO: 8067691 - DNA, 22 bp, Homo sapiens
ttattactgtattaatccagag

SEQ ID NO: 8067692 - DNA, 22 bp, Homo sapiens
ttattctttaaacatatatgtt

SEQ ID NO: 8067693 - DNA, 20 bp, Homo sapiens
ttatatcataatgtgccaat

SEQ ID NO: 8067694 - DNA, 22 bp, Homo sapiens
ttatatgagtatcatatcactt

SEQ ID NO: 8067695 - DNA, 22 bp, Homo sapiens
tttttcatattcccctctctgg

SEQ ID NO: 8067696 - DNA, 22 bp, Homo sapiens
tttgatatcttggtatacagat

SEQ ID NO: 8067697 - DNA, 22 bp, Homo sapiens
tttgatatcctatacaagtaaa

SEQ ID NO: 8067698 - DNA, 22 bp, Homo sapiens
tttggaaactgcctcagctctt

SEQ ID NO: 8067699 - DNA, 22 bp, Homo sapiens
tttggaaatttcatcaatagcc

SEQ ID NO: 8067700 - DNA, 22 bp, Homo sapiens
tttgaatatcacaaactttcaa

SEQ ID NO: 8067701 - DNA, 22 bp, Homo sapiens
tttgaaaggaattaggatgaca

SEQ ID NO: 8067702 - DNA, 22 bp, Homo sapiens
tttgaaagggttatgagactga

SEQ ID NO: 8067703 - DNA, 22 bp, Homo sapiens
ttttcattgttactatgagcta

SEQ ID NO: 8067704 - DNA, 22 bp, Homo sapiens
ttttctgtgattctgaggttgg

SEQ ID NO: 8067705 - DNA, 22 bp, Homo sapiens
ttttctgtgccctgctagctgg

SEQ ID NO: 8067706 - DNA, 22 bp, Homo sapiens
ttttctgtgtatccaggcttcc

SEQ ID NO: 8067707 - DNA, 22 bp, Homo sapiens
ttttcttactgtctgtgatcct

SEQ ID NO: 8067708 - DNA, 22 bp, Homo sapiens
ttttcattgttcctcgagcatt

SEQ ID NO: 8067709 - DNA, 22 bp, Homo sapiens
ttttccacagcaccataagatt

SEQ ID NO: 8067710 - DNA, 22 bp, Homo sapiens
ttttccacctggttccagggct

SEQ ID NO: 8067711 - DNA, 22 bp, Homo sapiens
ttttccaccttctagagattgt

SEQ ID NO: 8067712 - DNA, 22 bp, Homo sapiens
ttttaatgggcgactattatgg

SEQ ID NO: 8067713 - DNA, 22 bp, Homo sapiens
tttgtgttgtacttctgtgcat

SEQ ID NO: 8067714 - DNA, 22 bp, Homo sapiens
tttgttataacaataaaaagtc

SEQ ID NO: 8067715 - DNA, 22 bp, Homo sapiens
cacagctaggaggaaagcagag

SEQ ID NO: 8067716 - DNA, 22 bp, Homo sapiens
cacagctgaagtagccatgtgg

SEQ ID NO: 8067717 - DNA, 22 bp, Homo sapiens
cacagcctttagggtacacaca

SEQ ID NO: 8067718 - DNA, 22 bp, Homo sapiens
cacagcctgctgcactcaagaa

SEQ ID NO: 8067719 - DNA, 22 bp, Homo sapiens
cacaggagagctgggaggtgcc

SEQ ID NO: 8067720 - DNA, 22 bp, Homo sapiens
ggaggggcagccatggaactcc

SEQ ID NO: 8067721 - DNA, 22 bp, Homo sapiens
ggaggggcagccatggaactcc

SEQ ID NO: 8067722 - DNA, 22 bp, Homo sapiens
ggaggggccggctgcctgccac

SEQ ID NO: 8067723 - DNA, 22 bp, Homo sapiens
ggaggggccggctgcctgccac

SEQ ID NO: 8067724 - DNA, 22 bp, Homo sapiens
ggagcagcttgcatgctcaggg

SEQ ID NO: 8067725 - DNA, 22 bp, Homo sapiens
ggaggagacagtaaaaagcacg

SEQ ID NO: 8067726 - DNA, 22 bp, Homo sapiens
ggaggagacggagtgattagtg

SEQ ID NO: 8067727 - DNA, 22 bp, Homo sapiens
ggaggagagaggttgcaaacac

SEQ ID NO: 8067728 - DNA, 22 bp, Homo sapiens
ggaggagaccctgtgtcagttt

SEQ ID NO: 8067729 - DNA, 22 bp, Homo sapiens
ggaggagattcccctctcactt

SEQ ID NO: 8067730 - DNA, 22 bp, Homo sapiens
cacagcattcacagaaagacat

SEQ ID NO: 8067731 - DNA, 22 bp, Homo sapiens
cacagccctgcgccccagtttg

SEQ ID NO: 8067732 - DNA, 22 bp, Homo sapiens
ggagcagcctgtgtagacgggg

SEQ ID NO: 8067733 - DNA, 22 bp, Homo sapiens
ggagcagccgcgtctcagggca

SEQ ID NO: 8067734 - DNA, 22 bp, Homo sapiens
ggagcagccacgtctcagggca

SEQ ID NO: 8067735 - DNA, 22 bp, Homo sapiens
cacagcagtctttcactaaata

SEQ ID NO: 8067736 - DNA, 22 bp, Homo sapiens
cacagcattaactgggacagct

SEQ ID NO: 8067737 - DNA, 22 bp, Homo sapiens
cacagagacagatctattttgc

SEQ ID NO: 8067738 - DNA, 22 bp, Homo sapiens
cacagagacagaagcacttatg

SEQ ID NO: 8067739 - DNA, 22 bp, Homo sapiens
cacagagaattcccatatgtga

SEQ ID NO: 8067740 - DNA, 22 bp, Homo sapiens
cacagagacatgatgtcattgc

SEQ ID NO: 8067741 - DNA, 22 bp, Homo sapiens
cacagagaccccttctggggcc

SEQ ID NO: 8067742 - DNA, 22 bp, Homo sapiens
cacagagaatgatgagtcactg

SEQ ID NO: 8067743 - DNA, 22 bp, Homo sapiens
cacagagaatactgctcttgct

SEQ ID NO: 8067744 - DNA, 22 bp, Homo sapiens
cacagagaactgtgggagtgtg

SEQ ID NO: 8067745 - DNA, 22 bp, Homo sapiens
ggagatagacttggtgagccac

SEQ ID NO: 8067746 - DNA, 22 bp, Homo sapiens
ggacacaagctccggggctgca

SEQ ID NO: 8067747 - DNA, 22 bp, Homo sapiens
ggacagagggttgacagagtat

SEQ ID NO: 8067748 - DNA, 19 bp, Homo sapiens
ggaagagaggaaaggtgga

SEQ ID NO: 8067749 - DNA, 22 bp, Homo sapiens
ggaagagagggctgggcctcaa

SEQ ID NO: 8067750 - DNA, 22 bp, Homo sapiens
gctgggagccgtacctgtcacg

SEQ ID NO: 8067751 - DNA, 22 bp, Homo sapiens
gctgggagccctggtctgctcc

SEQ ID NO: 8067752 - DNA, 22 bp, Homo sapiens
gctgggaggaatttggggaata

SEQ ID NO: 8067753 - DNA, 22 bp, Homo sapiens
gctgggagccccgagccagcgc

SEQ ID NO: 8067754 - DNA, 22 bp, Homo sapiens
gctgggagccccgagccagcgc

SEQ ID NO: 8067755 - DNA, 22 bp, Homo sapiens
gctgggagccctggtctgctcc

SEQ ID NO: 8067756 - DNA, 22 bp, Homo sapiens
gctgggagcaagtactcatctt

SEQ ID NO: 8067757 - DNA, 22 bp, Homo sapiens
gctgggagcaaagccatgcata

SEQ ID NO: 8067758 - DNA, 22 bp, Homo sapiens
gctgggagcaaagccatgcata

SEQ ID NO: 8067759 - DNA, 22 bp, Homo sapiens
gctggccatggggagtgaggag

SEQ ID NO: 8067760 - DNA, 22 bp, Homo sapiens
caagtgcacacacatcctgtgc

SEQ ID NO: 8067761 - DNA, 22 bp, Homo sapiens
caagtggggcagattctcttcc

SEQ ID NO: 8067762 - DNA, 22 bp, Homo sapiens
gctggtgagcaaaggagaagga

SEQ ID NO: 8067763 - DNA, 22 bp, Homo sapiens
caatgcttctcattagccaatg

SEQ ID NO: 8067764 - DNA, 22 bp, Homo sapiens
gcttccagacgatcatgtaaga

SEQ ID NO: 8067765 - DNA, 17 bp, Homo sapiens
ggaacaaatactatgca

SEQ ID NO: 8067766 - DNA, 22 bp, Homo sapiens
ggaaatgtgggctgtttctgta

SEQ ID NO: 8067767 - DNA, 19 bp, Homo sapiens
gcttccagcactgcaggag

SEQ ID NO: 8067768 - DNA, 22 bp, Homo sapiens
gcttccagcaaacactggctgc

SEQ ID NO: 8067769 - DNA, 22 bp, Homo sapiens
ggcaggtgccttctgtgctagc

SEQ ID NO: 8067770 - DNA, 22 bp, Homo sapiens
cacatgctagaataaatctcca

SEQ ID NO: 8067771 - DNA, 22 bp, Homo sapiens
ggcagtagccagggactggcag

SEQ ID NO: 8067772 - DNA, 22 bp, Homo sapiens
ggcaggagaaaggtctcttctt

SEQ ID NO: 8067773 - DNA, 22 bp, Homo sapiens
cacatgcagttttccagcagtc

SEQ ID NO: 8067774 - DNA, 22 bp, Homo sapiens
cacatgcatctgtcatgtttgg

SEQ ID NO: 8067775 - DNA, 22 bp, Homo sapiens
ggagtgactcacagctgggaca

SEQ ID NO: 8067776 - DNA, 22 bp, Homo sapiens
ggagtgactctcggggccacta

SEQ ID NO: 8067777 - DNA, 22 bp, Homo sapiens
ggcagcttttatccctgacaga

SEQ ID NO: 8067778 - DNA, 22 bp, Homo sapiens
ggcagctgcaaatctgctctgt

SEQ ID NO: 8067779 - DNA, 22 bp, Homo sapiens
ggcgagggagcagtgcggtggg

SEQ ID NO: 8067780 - DNA, 22 bp, Homo sapiens
ggccccagcttcaaccccgtgg

SEQ ID NO: 8067781 - DNA, 22 bp, Homo sapiens
ggccccagctgtggtgaataga

SEQ ID NO: 8067782 - DNA, 22 bp, Homo sapiens
ggccccaggacctccacggtcc

SEQ ID NO: 8067783 - DNA, 22 bp, Homo sapiens
ggccccaggacctccacggtcc

SEQ ID NO: 8067784 - DNA, 22 bp, Homo sapiens
ggccccaggcctttggtctggc

SEQ ID NO: 8067785 - DNA, 17 bp, Homo sapiens
ggcctgtgtggctgcag

SEQ ID NO: 8067786 - DNA, 22 bp, Homo sapiens
ggccccagggattaggccaacc

SEQ ID NO: 8067787 - DNA, 22 bp, Homo sapiens
ggccccagggaagaaggtggtc

SEQ ID NO: 8067788 - DNA, 22 bp, Homo sapiens
ggcccagaatactttgtaaaat

SEQ ID NO: 8067789 - DNA, 21 bp, Homo sapiens
ggccccagcccatgggttctc

SEQ ID NO: 8067790 - DNA, 22 bp, Homo sapiens
ggccccagcctcagtcccctga

SEQ ID NO: 8067791 - DNA, 19 bp, Homo sapiens
ggccccagccagggtatca

SEQ ID NO: 8067792 - DNA, 22 bp, Homo sapiens
ggccccagcagtgcttgtttat

SEQ ID NO: 8067793 - DNA, 20 bp, Homo sapiens
caccacagaattggggacag

SEQ ID NO: 8067794 - DNA, 22 bp, Homo sapiens
ggccagcctggggctcccagac

SEQ ID NO: 8067795 - DNA, 22 bp, Homo sapiens
cacccagccttcacacaggagt

SEQ ID NO: 8067796 - DNA, 22 bp, Homo sapiens
ggccagctcagggtccttgggc

SEQ ID NO: 8067797 - DNA, 22 bp, Homo sapiens
cacccaggcaaggattctgcaa

SEQ ID NO: 8067798 - DNA, 22 bp, Homo sapiens
cagaacagagtcaaaagtatgt

SEQ ID NO: 8067799 - DNA, 22 bp, Homo sapiens
cagaacagagcctgaatctctc

SEQ ID NO: 8067800 - DNA, 19 bp, Homo sapiens
cagaacagaggtcatggcc

SEQ ID NO: 8067801 - DNA, 23 bp, Homo sapiens
cagaacagtaaaagatgccatgg

SEQ ID NO: 8067802 - DNA, 22 bp, Homo sapiens
cagaacagtacctagcacatag

SEQ ID NO: 8067803 - DNA, 22 bp, Homo sapiens
cagaacagtacctagcacatag

SEQ ID NO: 8067804 - DNA, 23 bp, Homo sapiens
cagaacagtaaaagatgccatgg

SEQ ID NO: 8067805 - DNA, 22 bp, Homo sapiens
ggctgggagctggacaggccgg

SEQ ID NO: 8067806 - DNA, 22 bp, Homo sapiens
ggctgggagctggacaggccgg

SEQ ID NO: 8067807 - DNA, 22 bp, Homo sapiens
ggcttcttcctgtgaacatgtt

SEQ ID NO: 8067808 - DNA, 22 bp, Homo sapiens
ggcttgcttcttgtccaggaat

SEQ ID NO: 8067809 - DNA, 22 bp, Homo sapiens
ggctgggagccccacagagtca

SEQ ID NO: 8067810 - DNA, 23 bp, Homo sapiens
ggctgggagctccgggtgcacgt

SEQ ID NO: 8067811 - DNA, 22 bp, Homo sapiens
cagaacagaagtaaaatttacc

SEQ ID NO: 8067812 - DNA, 22 bp, Homo sapiens
cagaacagaaacgttgttccat

SEQ ID NO: 8067813 - DNA, 22 bp, Homo sapiens
cagaacagaaacgttgttccat

SEQ ID NO: 8067814 - DNA, 22 bp, Homo sapiens
cagaacacaggctaaactgaga

SEQ ID NO: 8067815 - DNA, 22 bp, Homo sapiens
ggctgctggtggaatggtaggc

SEQ ID NO: 8067816 - DNA, 19 bp, Homo sapiens
ggctgctggttacagaggc

SEQ ID NO: 8067817 - DNA, 22 bp, Homo sapiens
ggctgctcaaggactctgatcg

SEQ ID NO: 8067818 - DNA, 19 bp, Homo sapiens
ggctgcctttccttaccag

SEQ ID NO: 8067819 - DNA, 22 bp, Homo sapiens
ggctgcctcaaagctcaagctc

SEQ ID NO: 8067820 - DNA, 22 bp, Homo sapiens
cactgtcttttgtgaagacaat

SEQ ID NO: 8067821 - DNA, 22 bp, Homo sapiens
ggctgccttgaccctggctccg

SEQ ID NO: 8067822 - DNA, 22 bp, Homo sapiens
ggctgcagaggcgatctgaggt

SEQ ID NO: 8067823 - DNA, 22 bp, Homo sapiens
cactgcctccccaggctccaca

SEQ ID NO: 8067824 - DNA, 22 bp, Homo sapiens
ggctgcagcggattggggattg

SEQ ID NO: 8067825 - DNA, 19 bp, Homo sapiens
cactgtcctagtcgaggcc

SEQ ID NO: 8067826 - DNA, 22 bp, Homo sapiens
ggctcctgtcctcctggagctc

SEQ ID NO: 8067827 - DNA, 22 bp, Homo sapiens
ggctcctgtggcaagacagctt

SEQ ID NO: 8067828 - DNA, 22 bp, Homo sapiens
ggctcctgggggtgctcctgcc

SEQ ID NO: 8067829 - DNA, 22 bp, Homo sapiens
ggctcctgtcccctcagctgct

SEQ ID NO: 8067830 - DNA, 19 bp, Homo sapiens
ggctcctgtggctgcagcc

SEQ ID NO: 8067831 - DNA, 19 bp, Homo sapiens
ggctcctgtggctgcagcc

SEQ ID NO: 8067832 - DNA, 22 bp, Homo sapiens
cagctccctatggtgaggcgac

SEQ ID NO: 8067833 - DNA, 22 bp, Homo sapiens
cagctcctgaggactgctggga

SEQ ID NO: 8067834 - DNA, 22 bp, Homo sapiens
cagctccatcttgcttatacca

SEQ ID NO: 8067835 - DNA, 22 bp, Homo sapiens
cagctcccagtggcagctcctt

SEQ ID NO: 8067836 - DNA, 22 bp, Homo sapiens
cagctcccagtggcagctcctt

SEQ ID NO: 8067837 - DNA, 22 bp, Homo sapiens
cagctcccagaactgaccatgt

SEQ ID NO: 8067838 - DNA, 22 bp, Homo sapiens
cagctcccagaactgaccatgt

SEQ ID NO: 8067839 - DNA, 22 bp, Homo sapiens
cagctccagcccaggcagctcc

SEQ ID NO: 8067840 - DNA, 21 bp, Homo sapiens
cagctccactaaagcagctgt

SEQ ID NO: 8067841 - DNA, 22 bp, Homo sapiens
gtgctgaggtgggtgggcagcc

SEQ ID NO: 8067842 - DNA, 22 bp, Homo sapiens
gtgcctggtatgtaggtagcgg

SEQ ID NO: 8067843 - DNA, 22 bp, Homo sapiens
gtgctgaggagagggggtggtc

SEQ ID NO: 8067844 - DNA, 22 bp, Homo sapiens
gtgctgagattggagtgagcag

SEQ ID NO: 8067845 - DNA, 22 bp, Homo sapiens
gtgcctgggacacagcagatac

SEQ ID NO: 8067846 - DNA, 22 bp, Homo sapiens
cagcccttaagagtcatccctc

SEQ ID NO: 8067847 - DNA, 20 bp, Homo sapiens
cagccctttatcctcctatg

SEQ ID NO: 8067848 - DNA, 22 bp, Homo sapiens
gtctctgttatttccagggtca

SEQ ID NO: 8067849 - DNA, 22 bp, Homo sapiens
gtctctgtgtctgagagagccc

SEQ ID NO: 8067850 - DNA, 22 bp, Homo sapiens
gtctcagggactgcttctgggg

SEQ ID NO: 8067851 - DNA, 22 bp, Homo sapiens
gtgcagcagggggaagacagtg

SEQ ID NO: 8067852 - DNA, 22 bp, Homo sapiens
gtgcaaagtgcatggggaaggg

SEQ ID NO: 8067853 - DNA, 22 bp, Homo sapiens
cagcagggttaagtgactcacc

SEQ ID NO: 8067854 - DNA, 22 bp, Homo sapiens
cagcagggaagctgtgctgttt

SEQ ID NO: 8067855 - DNA, 22 bp, Homo sapiens
cagcagagacggtaagcagaac

SEQ ID NO: 8067856 - DNA, 23 bp, Homo sapiens
cagcagagagcagacctttgtgt

SEQ ID NO: 8067857 - DNA, 22 bp, Homo sapiens
cagcagagatgagattcctata

SEQ ID NO: 8067858 - DNA, 20 bp, Homo sapiens
cagcagtggatgagagtttt

SEQ ID NO: 8067859 - DNA, 22 bp, Homo sapiens
cagcagtgacaagactaagaag

SEQ ID NO: 8067860 - DNA, 22 bp, Homo sapiens
cagcagtgatgtgtgagggttc

SEQ ID NO: 8067861 - DNA, 22 bp, Homo sapiens
cagcagtgatgtgtgagggttc

SEQ ID NO: 8067862 - DNA, 19 bp, Homo sapiens
gtcctgcaactggctctcc

SEQ ID NO: 8067863 - DNA, 22 bp, Homo sapiens
gtcctgagccctcagcacagca

SEQ ID NO: 8067864 - DNA, 22 bp, Homo sapiens
gtcctgagatgtcacaaggttt

SEQ ID NO: 8067865 - DNA, 22 bp, Homo sapiens
gtcctcttagccacttaattat

SEQ ID NO: 8067866 - DNA, 22 bp, Homo sapiens
cagcatgcaagtccagatgtgg

SEQ ID NO: 8067867 - DNA, 22 bp, Homo sapiens
cagcatgattggtgtctggtga

SEQ ID NO: 8067868 - DNA, 20 bp, Homo sapiens
gtctcaagtatctcacagtc

SEQ ID NO: 8067869 - DNA, 22 bp, Homo sapiens
cagcatgagaaaatgaatcaga

SEQ ID NO: 8067870 - DNA, 22 bp, Homo sapiens
cagcatgatcccagttgattgc

SEQ ID NO: 8067871 - DNA, 22 bp, Homo sapiens
cagcatgatgagtgcagtttgg

SEQ ID NO: 8067872 - DNA, 22 bp, Homo sapiens
cagcatgatgctcacacaaaac

SEQ ID NO: 8067873 - DNA, 22 bp, Homo sapiens
cagcatgaaaagtgttgctatc

SEQ ID NO: 8067874 - DNA, 22 bp, Homo sapiens
cagcatgaatgtgttcgtaggg

SEQ ID NO: 8067875 - DNA, 22 bp, Homo sapiens
cagcatgaaacaattgagccca

SEQ ID NO: 8067876 - DNA, 22 bp, Homo sapiens
cagcatgacagtctgcagcaga

SEQ ID NO: 8067877 - DNA, 21 bp, Homo sapiens
cagagagctagaacttcatga

SEQ ID NO: 8067878 - DNA, 22 bp, Homo sapiens
cagagagcttagtgtgctgcat

SEQ ID NO: 8067879 - DNA, 22 bp, Homo sapiens
cagagagcatgggaggcccgag

SEQ ID NO: 8067880 - DNA, 22 bp, Homo sapiens
cagagagagtggggtgtggatt

SEQ ID NO: 8067881 - DNA, 22 bp, Homo sapiens
gggccctggacgtggcggcaga

SEQ ID NO: 8067882 - DNA, 21 bp, Homo sapiens
cagagcagcgttctgctgtgg

SEQ ID NO: 8067883 - DNA, 22 bp, Homo sapiens
cagagcagcagagcttccatgg

SEQ ID NO: 8067884 - DNA, 22 bp, Homo sapiens
cagaagcaaatgccttgctgag

SEQ ID NO: 8067885 - DNA, 22 bp, Homo sapiens
cagaagagtagctgaacaagtt

SEQ ID NO: 8067886 - DNA, 22 bp, Homo sapiens
cagaagcactaggaggaaacgt

SEQ ID NO: 8067887 - DNA, 20 bp, Homo sapiens
cagagacctgtcttcacaga

SEQ ID NO: 8067888 - DNA, 22 bp, Homo sapiens
cagagagagtcaaatctttgct

SEQ ID NO: 8067889 - DNA, 18 bp, Homo sapiens
gggctctgatccttcacc

SEQ ID NO: 8067890 - DNA, 22 bp, Homo sapiens
gggctctgcgctcagctccagc

SEQ ID NO: 8067891 - DNA, 22 bp, Homo sapiens
ggggcggggctctgagaagcat

SEQ ID NO: 8067892 - DNA, 22 bp, Homo sapiens
ggggcgccccgagggtgcgcac

SEQ ID NO: 8067893 - DNA, 23 bp, Homo sapiens
gggggagctggactcctagatcc

SEQ ID NO: 8067894 - DNA, 22 bp, Homo sapiens
gggggagctgttattggcaggg

SEQ ID NO: 8067895 - DNA, 22 bp, Homo sapiens
cagaggctgctctgggtggcat

SEQ ID NO: 8067896 - DNA, 22 bp, Homo sapiens
cagaggctgatgtgggatgggc

SEQ ID NO: 8067897 - DNA, 22 bp, Homo sapiens
cagaggctgatgtgggatgggc

SEQ ID NO: 8067898 - DNA, 21 bp, Homo sapiens
cagaggctgagagggcaatct

SEQ ID NO: 8067899 - DNA, 22 bp, Homo sapiens
ggtgcacttcttgctagtcttt

SEQ ID NO: 8067900 - DNA, 22 bp, Homo sapiens
ggtgcagaaggaagggagctgg

SEQ ID NO: 8067901 - DNA, 22 bp, Homo sapiens
ggtgcagaggagccagctgggg

SEQ ID NO: 8067902 - DNA, 22 bp, Homo sapiens
ggtgcagctgcagcctgggagc

SEQ ID NO: 8067903 - DNA, 22 bp, Homo sapiens
ggtgcagatctttctcttcagg

SEQ ID NO: 8067904 - DNA, 22 bp, Homo sapiens
ggtggctggaggagctgatgga

SEQ ID NO: 8067905 - DNA, 22 bp, Homo sapiens
ggtggctggaggagctgatgga

SEQ ID NO: 8067906 - DNA, 22 bp, Homo sapiens
cagcactgctgctgtacacaca

SEQ ID NO: 8067907 - DNA, 22 bp, Homo sapiens
ggtgggacaggtaggagtggct

SEQ ID NO: 8067908 - DNA, 22 bp, Homo sapiens
ggtggcagtgcttgcgggtcta

SEQ ID NO: 8067909 - DNA, 22 bp, Homo sapiens
ggtggcagggagtgtccctggg

SEQ ID NO: 8067910 - DNA, 18 bp, Homo sapiens
ggtggcaggtcagatgcc

SEQ ID NO: 8067911 - DNA, 22 bp, Homo sapiens
ggtgctggttcagggtggctgt

SEQ ID NO: 8067912 - DNA, 22 bp, Homo sapiens
cagatggcaacagctctgtgac

SEQ ID NO: 8067913 - DNA, 22 bp, Homo sapiens
ggtgtctggacagtgagccagg

SEQ ID NO: 8067914 - DNA, 22 bp, Homo sapiens
cagcagagaaattacatatttg

SEQ ID NO: 8067915 - DNA, 22 bp, Homo sapiens
cagcagaagtgcatttgtgatt

SEQ ID NO: 8067916 - DNA, 22 bp, Homo sapiens
atcttccttcactttctcccac

SEQ ID NO: 8067917 - DNA, 22 bp, Homo sapiens
atgaatgaaatacagagtactt

SEQ ID NO: 8067918 - DNA, 22 bp, Homo sapiens
atgaatgaataccatgcaacta

SEQ ID NO: 8067919 - DNA, 22 bp, Homo sapiens
cttgaggttttgactcagcttt

SEQ ID NO: 8067920 - DNA, 23 bp, Homo sapiens
cttgagctcaggaagagctgagt

SEQ ID NO: 8067921 - DNA, 22 bp, Homo sapiens
atgaatgattttatgtaaatga

SEQ ID NO: 8067922 - DNA, 22 bp, Homo sapiens
atgaatgatttgtcagtcacag

SEQ ID NO: 8067923 - DNA, 21 bp, Homo sapiens
atgaatgatttctactcttaa

SEQ ID NO: 8067924 - DNA, 22 bp, Homo sapiens
atgaatgagattaccaatgtga

SEQ ID NO: 8067925 - DNA, 22 bp, Homo sapiens
atgaatgatgcaaaagacactg

SEQ ID NO: 8067926 - DNA, 22 bp, Homo sapiens
atgaatgattaaagagtacagt

SEQ ID NO: 8067927 - DNA, 22 bp, Homo sapiens
ctttttccagcttcagggtggg

SEQ ID NO: 8067928 - DNA, 22 bp, Homo sapiens
atgaatgggtcattatttgatc

SEQ ID NO: 8067929 - DNA, 22 bp, Homo sapiens
gaaaaccacctcccatcaagca

SEQ ID NO: 8067930 - DNA, 21 bp, Homo sapiens
gaaaaccatttgcatcatgag

SEQ ID NO: 8067931 - DNA, 19 bp, Homo sapiens
gaaaacatgggtgagggtc

SEQ ID NO: 8067932 - DNA, 22 bp, Homo sapiens
gaaaagagaacatctgaggatc

SEQ ID NO: 8067933 - DNA, 22 bp, Homo sapiens
gaaaagaactgcatgggattaa

SEQ ID NO: 8067934 - DNA, 22 bp, Homo sapiens
gaaatcttccaatggtcacatc

SEQ ID NO: 8067935 - DNA, 22 bp, Homo sapiens
gaaatcttttaaccattcattt

SEQ ID NO: 8067936 - DNA, 22 bp, Homo sapiens
gaaatctgaacaacagctgtca

SEQ ID NO: 8067937 - DNA, 22 bp, Homo sapiens
gaaaatgtgtcatccctactgt

SEQ ID NO: 8067938 - DNA, 22 bp, Homo sapiens
atgaggcagtctggcctgaggg

SEQ ID NO: 8067939 - DNA, 22 bp, Homo sapiens
gaaatgatgtctgtgctgccac

SEQ ID NO: 8067940 - DNA, 22 bp, Homo sapiens
gaaatgattttagtttatcatg

SEQ ID NO: 8067941 - DNA, 22 bp, Homo sapiens
gaacataattaaatgtcctggg

SEQ ID NO: 8067942 - DNA, 22 bp, Homo sapiens
gaacataactattgtgaatagt

SEQ ID NO: 8067943 - DNA, 22 bp, Homo sapiens
gaacatttccagaaaggaacta

SEQ ID NO: 8067944 - DNA, 22 bp, Homo sapiens
gaactttaccatttaggtaact

SEQ ID NO: 8067945 - DNA, 22 bp, Homo sapiens
atgcaagatgtatagaagactt

SEQ ID NO: 8067946 - DNA, 23 bp, Homo sapiens
atgcaagagtttctcaaactgga

SEQ ID NO: 8067947 - DNA, 22 bp, Homo sapiens
atgcaaatgctagagaatgttg

SEQ ID NO: 8067948 - DNA, 22 bp, Homo sapiens
atgcctggactgacatgcactg

SEQ ID NO: 8067949 - DNA, 22 bp, Homo sapiens
atgcctggactgacatgcactg

SEQ ID NO: 8067950 - DNA, 22 bp, Homo sapiens
gaatcatggctgtgtcttcagc

SEQ ID NO: 8067951 - DNA, 22 bp, Homo sapiens
gaatgtttgactaaaggtagct

SEQ ID NO: 8067952 - DNA, 22 bp, Homo sapiens
gaatgtccctgcagttgctgcc

SEQ ID NO: 8067953 - DNA, 22 bp, Homo sapiens
gaccctctagatggaagcactg

SEQ ID NO: 8067954 - DNA, 22 bp, Homo sapiens
atgcttttaactcctttatccc

SEQ ID NO: 8067955 - DNA, 22 bp, Homo sapiens
atgctttctcttagttcattga

SEQ ID NO: 8067956 - DNA, 22 bp, Homo sapiens
gacagggccgcagatggagact

SEQ ID NO: 8067957 - DNA, 22 bp, Homo sapiens
gacagggcgcccagcctgtttc

SEQ ID NO: 8067958 - DNA, 22 bp, Homo sapiens
gacagggcgagactcagtctca

SEQ ID NO: 8067959 - DNA, 22 bp, Homo sapiens
gacagggcatggtgcagagttc

SEQ ID NO: 8067960 - DNA, 22 bp, Homo sapiens
gacagggcaagactctgtctaa

SEQ ID NO: 8067961 - DNA, 22 bp, Homo sapiens
gacataaaattcaataatttgt

SEQ ID NO: 8067962 - DNA, 22 bp, Homo sapiens
gacataaaatggaattctgttg

SEQ ID NO: 8067963 - DNA, 22 bp, Homo sapiens
gacataaaattcaataatttgt

SEQ ID NO: 8067964 - DNA, 22 bp, Homo sapiens
gacataaaccttgagatattaa

SEQ ID NO: 8067965 - DNA, 22 bp, Homo sapiens
atgctttatacaaaacacttaa

SEQ ID NO: 8067966 - DNA, 22 bp, Homo sapiens
gagaggtggaggttgcagtgag

SEQ ID NO: 8067967 - DNA, 21 bp, Homo sapiens
atggaaaaacaggtagagcat

SEQ ID NO: 8067968 - DNA, 22 bp, Homo sapiens
atgctttttaaacttaattgga

SEQ ID NO: 8067969 - DNA, 22 bp, Homo sapiens
gagaggctgaaatcacaggagc

SEQ ID NO: 8067970 - DNA, 23 bp, Homo sapiens
gagctctgcactaggccctggga

SEQ ID NO: 8067971 - DNA, 22 bp, Homo sapiens
gagccttcatcgcagccttgtt

SEQ ID NO: 8067972 - DNA, 20 bp, Homo sapiens
gagccttcccctcaccactg

SEQ ID NO: 8067973 - DNA, 21 bp, Homo sapiens
gagccttccctctgccctttc

SEQ ID NO: 8067974 - DNA, 22 bp, Homo sapiens
gagcctgtgtttcctgtagcca

SEQ ID NO: 8067975 - DNA, 22 bp, Homo sapiens
gagcctggggaccctcctgagt

SEQ ID NO: 8067976 - DNA, 22 bp, Homo sapiens
gagcctgggactgggggtcatg

SEQ ID NO: 8067977 - DNA, 22 bp, Homo sapiens
gagcctggcctcctgcctcagc

SEQ ID NO: 8067978 - DNA, 22 bp, Homo sapiens
gagcttggtgatgcctcctggt

SEQ ID NO: 8067979 - DNA, 22 bp, Homo sapiens
gaggaagcagggcttggctgag

SEQ ID NO: 8067980 - DNA, 22 bp, Homo sapiens
atgtaattgtagcaaaatgatg

SEQ ID NO: 8067981 - DNA, 22 bp, Homo sapiens
atgtaatttgccctcaagttaa

SEQ ID NO: 8067982 - DNA, 22 bp, Homo sapiens
gagggaaaggttaatacatgat

SEQ ID NO: 8067983 - DNA, 22 bp, Homo sapiens
gaggccacagctatcagggaca

SEQ ID NO: 8067984 - DNA, 22 bp, Homo sapiens
gagtccaggctcagaaacccgt

SEQ ID NO: 8067985 - DNA, 22 bp, Homo sapiens
gaggggggcgccctgcagtgca

SEQ ID NO: 8067986 - DNA, 22 bp, Homo sapiens
gagggggcgtgcaaggctccgc

SEQ ID NO: 8067987 - DNA, 22 bp, Homo sapiens
gagggcagaaaattatgcggtg

SEQ ID NO: 8067988 - DNA, 22 bp, Homo sapiens
atgtttcatttagatatcaggc

SEQ ID NO: 8067989 - DNA, 21 bp, Homo sapiens
gagtgcaggtctgatgccatc

SEQ ID NO: 8067990 - DNA, 22 bp, Homo sapiens
atgtttatgttgggctatattt

SEQ ID NO: 8067991 - DNA, 22 bp, Homo sapiens
atgtttcaccagcaaattacct

SEQ ID NO: 8067992 - DNA, 22 bp, Homo sapiens
atgtttcaaatatatagagttg

SEQ ID NO: 8067993 - DNA, 22 bp, Homo sapiens
gagtccagtgtttaccaggggt

SEQ ID NO: 8067994 - DNA, 22 bp, Homo sapiens
gagtccagttagtgaggctggg

SEQ ID NO: 8067995 - DNA, 23 bp, Homo sapiens
gagtgcagaatagacatgcagtg

SEQ ID NO: 8067996 - DNA, 22 bp, Homo sapiens
gagtccagttctttccagcagt

SEQ ID NO: 8067997 - DNA, 22 bp, Homo sapiens
gagtccagtagttaggacagag

SEQ ID NO: 8067998 - DNA, 22 bp, Homo sapiens
gagtgcaggcctgagcaccatc

SEQ ID NO: 8067999 - DNA, 22 bp, Homo sapiens
gagtgcagatgaacagaagatt

SEQ ID NO: 8068000 - DNA, 18 bp, Homo sapiens
gatcgggggcgccccaag

SEQ ID NO: 8068001 - DNA, 18 bp, Homo sapiens
gatcgggggcgccccaag

SEQ ID NO: 8068002 - DNA, 22 bp, Homo sapiens
gatatttaactctcacaggtcc

SEQ ID NO: 8068003 - DNA, 22 bp, Homo sapiens
gatatttacaaatttgccaata

SEQ ID NO: 8068004 - DNA, 17 bp, Homo sapiens
gctccttctaacttcca

SEQ ID NO: 8068005 - DNA, 22 bp, Homo sapiens
gctcaaagaccagacagaggag

SEQ ID NO: 8068006 - DNA, 22 bp, Homo sapiens
gctacacaatagcgttcactta

SEQ ID NO: 8068007 - DNA, 22 bp, Homo sapiens
gctgagctgctgttcatcctgc

SEQ ID NO: 8068008 - DNA, 22 bp, Homo sapiens
gctgagctgggacagtcctggg

SEQ ID NO: 8068009 - DNA, 22 bp, Homo sapiens
gctgagctgggacagtcctggg

SEQ ID NO: 8068010 - DNA, 22 bp, Homo sapiens
gctctgggtgaacttggagcaa

SEQ ID NO: 8068011 - DNA, 22 bp, Homo sapiens
gctctgagacagtagagatggc

SEQ ID NO: 8068012 - DNA, 20 bp, Homo sapiens
gcccactctaatccactgtc

SEQ ID NO: 8068013 - DNA, 22 bp, Homo sapiens
gcccagccacagtcactttcat

SEQ ID NO: 8068014 - DNA, 22 bp, Homo sapiens
gcccagcccagaaaggttcgga

SEQ ID NO: 8068015 - DNA, 22 bp, Homo sapiens
gcccagccagagctgtgtgatg

SEQ ID NO: 8068016 - DNA, 22 bp, Homo sapiens
gcccagcccctgggtggacgtg

SEQ ID NO: 8068017 - DNA, 22 bp, Homo sapiens
atttcttccttctcctagaaga

SEQ ID NO: 8068018 - DNA, 22 bp, Homo sapiens
atttgcataaggatgctactgt

SEQ ID NO: 8068019 - DNA, 22 bp, Homo sapiens
atttgcaaagtcgtatctgtga

SEQ ID NO: 8068020 - DNA, 22 bp, Homo sapiens
atttgtcttcagtaggttcttc

SEQ ID NO: 8068021 - DNA, 22 bp, Homo sapiens
atttgtctttggacctgtgaga

SEQ ID NO: 8068022 - DNA, 22 bp, Homo sapiens
atttgtctgcttgctgccttcc

SEQ ID NO: 8068023 - DNA, 22 bp, Homo sapiens
atttgcatttagaaagatcact

SEQ ID NO: 8068024 - DNA, 22 bp, Homo sapiens
atttgcatatctgatagactaa

SEQ ID NO: 8068025 - DNA, 20 bp, Homo sapiens
atttgcatctgaataactta

SEQ ID NO: 8068026 - DNA, 22 bp, Homo sapiens
atttgcatgacctttgcaagtg

SEQ ID NO: 8068027 - DNA, 21 bp, Homo sapiens
atttgcattaaaatattacgc

SEQ ID NO: 8068028 - DNA, 22 bp, Homo sapiens
atttgcatttacatagcataga

SEQ ID NO: 8068029 - DNA, 22 bp, Homo sapiens
atttgcatttacatagcataga

SEQ ID NO: 8068030 - DNA, 22 bp, Homo sapiens
gcctgcctagaattgcagcttt

SEQ ID NO: 8068031 - DNA, 19 bp, Homo sapiens
gcagccaggtgctctacct

SEQ ID NO: 8068032 - DNA, 22 bp, Homo sapiens
gcagccaggggctgtgacctgt

SEQ ID NO: 8068033 - DNA, 22 bp, Homo sapiens
gcagccagggagagaaccaggg

SEQ ID NO: 8068034 - DNA, 22 bp, Homo sapiens
gcagccaggaagcccaggacac

SEQ ID NO: 8068035 - DNA, 22 bp, Homo sapiens
gcagatgcagagatggctgggg

SEQ ID NO: 8068036 - DNA, 22 bp, Homo sapiens
gcagatgccagatcatgcaggg

SEQ ID NO: 8068037 - DNA, 22 bp, Homo sapiens
gcaggagagtctgtgccaggtt

SEQ ID NO: 8068038 - DNA, 18 bp, Homo sapiens
gcaggagatgggtggggt

SEQ ID NO: 8068039 - DNA, 22 bp, Homo sapiens
gcagcctgggcaacagagtgag

SEQ ID NO: 8068040 - DNA, 22 bp, Homo sapiens
gcagccaggtttgaggaccact

SEQ ID NO: 8068041 - DNA, 22 bp, Homo sapiens
gcactgtgacagcaagagtgag

SEQ ID NO: 8068042 - DNA, 22 bp, Homo sapiens
gcactgtgacccagagcaggtg

SEQ ID NO: 8068043 - DNA, 22 bp, Homo sapiens
gcagaggctccattttacagat

SEQ ID NO: 8068044 - DNA, 22 bp, Homo sapiens
gcagatcaattgattgttcact

SEQ ID NO: 8068045 - DNA, 22 bp, Homo sapiens
gcagatcaacactctctttcaa

SEQ ID NO: 8068046 - DNA, 22 bp, Homo sapiens
gcaaaaaatgcttgttgcttag

SEQ ID NO: 8068047 - DNA, 22 bp, Homo sapiens
gcaaaacagtcgatgcctccca

SEQ ID NO: 8068048 - DNA, 22 bp, Homo sapiens
gcacacaggcagtttccagcca

SEQ ID NO: 8068049 - DNA, 22 bp, Homo sapiens
gcaaacaagctgcctgaagatt

SEQ ID NO: 8068050 - DNA, 22 bp, Homo sapiens
gcacagggccctgtgcgtaggt

SEQ ID NO: 8068051 - DNA, 22 bp, Homo sapiens
gcacagggcaacaggtctgtta

SEQ ID NO: 8068052 - DNA, 22 bp, Homo sapiens
gcacagggaggctggcctggcc

SEQ ID NO: 8068053 - DNA, 22 bp, Homo sapiens
gcactgtgaatatactagcaaa

SEQ ID NO: 8068054 - DNA, 21 bp, Homo sapiens
gcacagggacagatcatcaca

SEQ ID NO: 8068055 - DNA, 22 bp, Homo sapiens
gcacagggagacagccgtggcc

SEQ ID NO: 8068056 - DNA, 22 bp, Homo sapiens
gcacagggagcaggtctctggt

SEQ ID NO: 8068057 - DNA, 22 bp, Homo sapiens
gcagggactgtgatctcacaga

SEQ ID NO: 8068058 - DNA, 22 bp, Homo sapiens
gcaggctgtgaggctcagatgg

SEQ ID NO: 8068059 - DNA, 22 bp, Homo sapiens
gcaggctgtgaggctcagatgg

SEQ ID NO: 8068060 - DNA, 22 bp, Homo sapiens
gcaggctgtctaaagttagagt

SEQ ID NO: 8068061 - DNA, 22 bp, Homo sapiens
gcagggtcgctctaggagatca

SEQ ID NO: 8068062 - DNA, 21 bp, Homo sapiens
gcagggtcctttccattccta

SEQ ID NO: 8068063 - DNA, 22 bp, Homo sapiens
gcagggtctgaggccacagagg

SEQ ID NO: 8068064 - DNA, 22 bp, Homo sapiens
gcagggtataatacttaggtga

SEQ ID NO: 8068065 - DNA, 22 bp, Homo sapiens
gcagggtaggtgacaggtagtc

SEQ ID NO: 8068066 - DNA, 22 bp, Homo sapiens
gcaggtggatcacctgaggtca

SEQ ID NO: 8068067 - DNA, 22 bp, Homo sapiens
attgtgcagaattggaattgca

SEQ ID NO: 8068068 - DNA, 22 bp, Homo sapiens
attgttaatgttgcactaaggt

SEQ ID NO: 8068069 - DNA, 18 bp, Homo sapiens
attgttaatagagtactt

SEQ ID NO: 8068070 - DNA, 22 bp, Homo sapiens
gcagtgctgatcccatggcaga

SEQ ID NO: 8068071 - DNA, 18 bp, Homo sapiens
gcagtgccagcctctcct

SEQ ID NO: 8068072 - DNA, 22 bp, Homo sapiens
attgtaattttagagaaagtgg

SEQ ID NO: 8068073 - DNA, 22 bp, Homo sapiens
gccactgtactccagcctgcga

SEQ ID NO: 8068074 - DNA, 22 bp, Homo sapiens
gccactgagcccggccattgtt

SEQ ID NO: 8068075 - DNA, 19 bp, Homo sapiens
gccactcctgatgctgccc

SEQ ID NO: 8068076 - DNA, 22 bp, Homo sapiens
gccacgtagaagtgccgcgaga

SEQ ID NO: 8068077 - DNA, 22 bp, Homo sapiens
ccccttccaggaagcagaatcg

SEQ ID NO: 8068078 - DNA, 22 bp, Homo sapiens
ccccttccacagtgcttcctaa

SEQ ID NO: 8068079 - DNA, 22 bp, Homo sapiens
ccctcccagatgggcttgaggt

SEQ ID NO: 8068080 - DNA, 22 bp, Homo sapiens
ccctcccagatgggcttgaggt

SEQ ID NO: 8068081 - DNA, 22 bp, Homo sapiens
ccctcccaggagtggccagaga

SEQ ID NO: 8068082 - DNA, 22 bp, Homo sapiens
ccctcccaagcactctgacata

SEQ ID NO: 8068083 - DNA, 20 bp, Homo sapiens
ccctcccagatgcttcccaa

SEQ ID NO: 8068084 - DNA, 22 bp, Homo sapiens
ccctgctgtcaggtgctgggag

SEQ ID NO: 8068085 - DNA, 22 bp, Homo sapiens
aggctgtctcacctcaggaggg

SEQ ID NO: 8068086 - DNA, 22 bp, Homo sapiens
aggctgtcctctcttgctcagt

SEQ ID NO: 8068087 - DNA, 23 bp, Homo sapiens
cccaggagcctgagtcctctctg

SEQ ID NO: 8068088 - DNA, 22 bp, Homo sapiens
cccaggagcttctctctgcctc

SEQ ID NO: 8068089 - DNA, 22 bp, Homo sapiens
cccatcaggaacccaggagccc

SEQ ID NO: 8068090 - DNA, 22 bp, Homo sapiens
cccatccctgattttcactcgt

SEQ ID NO: 8068091 - DNA, 22 bp, Homo sapiens
cccatctcagtcgtgctaaggg

SEQ ID NO: 8068092 - DNA, 22 bp, Homo sapiens
cccaggcttttctcttgcccca

SEQ ID NO: 8068093 - DNA, 19 bp, Homo sapiens
agggcctgcagctcaagct

SEQ ID NO: 8068094 - DNA, 22 bp, Homo sapiens
agggcctgcatcaggagcttgg

SEQ ID NO: 8068095 - DNA, 22 bp, Homo sapiens
agggcctgaggctgacggggag

SEQ ID NO: 8068096 - DNA, 23 bp, Homo sapiens
agggcctgatggctcccgctggc

SEQ ID NO: 8068097 - DNA, 22 bp, Homo sapiens
agggcctgagctggctgacctc

SEQ ID NO: 8068098 - DNA, 22 bp, Homo sapiens
agggcctgagctggctgacctc

SEQ ID NO: 8068099 - DNA, 20 bp, Homo sapiens
agggcctgctctgtggtgtc

SEQ ID NO: 8068100 - DNA, 22 bp, Homo sapiens
agggcctgctctatcactctca

SEQ ID NO: 8068101 - DNA, 22 bp, Homo sapiens
agggcctgctctatcactctca

SEQ ID NO: 8068102 - DNA, 22 bp, Homo sapiens
agggcctgctctatcactctca

SEQ ID NO: 8068103 - DNA, 22 bp, Homo sapiens
agggcctggaactggagaccac

SEQ ID NO: 8068104 - DNA, 22 bp, Homo sapiens
agggcctggactaattggatcc

SEQ ID NO: 8068105 - DNA, 22 bp, Homo sapiens
agggcctggaactgtgggcagg

SEQ ID NO: 8068106 - DNA, 23 bp, Homo sapiens
agggcctggcgtggagtgtgtgc

SEQ ID NO: 8068107 - DNA, 22 bp, Homo sapiens
agggcctggcgcgtggccgccg

SEQ ID NO: 8068108 - DNA, 20 bp, Homo sapiens
agggcctggagtacagcagg

SEQ ID NO: 8068109 - DNA, 22 bp, Homo sapiens
agggctggcaagggattgaaat

SEQ ID NO: 8068110 - DNA, 22 bp, Homo sapiens
agggctggagggtactagttta

SEQ ID NO: 8068111 - DNA, 22 bp, Homo sapiens
agggctggagccacagctggga

SEQ ID NO: 8068112 - DNA, 22 bp, Homo sapiens
cctcttccactgggccccatcc

SEQ ID NO: 8068113 - DNA, 22 bp, Homo sapiens
agggctggccacatgatttggt

SEQ ID NO: 8068114 - DNA, 22 bp, Homo sapiens
agggctggcatctctaatgctg

SEQ ID NO: 8068115 - DNA, 22 bp, Homo sapiens
aggggagagttaatgtgaatgt

SEQ ID NO: 8068116 - DNA, 22 bp, Homo sapiens
agggctggctccgttaccttga

SEQ ID NO: 8068117 - DNA, 22 bp, Homo sapiens
agggctggctaggtgcgttccc

SEQ ID NO: 8068118 - DNA, 22 bp, Homo sapiens
cctgaagagcactctagagttg

SEQ ID NO: 8068119 - DNA, 22 bp, Homo sapiens
cctgaagatgctgtggcctggt

SEQ ID NO: 8068120 - DNA, 22 bp, Homo sapiens
agggtagggcccggagacagac

SEQ ID NO: 8068121 - DNA, 22 bp, Homo sapiens
aggggtgaaggcccgataggag

SEQ ID NO: 8068122 - DNA, 22 bp, Homo sapiens
agggtataaagagcaagcagaa

SEQ ID NO: 8068123 - DNA, 22 bp, Homo sapiens
agggtatgtttttatctactgt

SEQ ID NO: 8068124 - DNA, 22 bp, Homo sapiens
ccagcaggagatgcctgtgtct

SEQ ID NO: 8068125 - DNA, 22 bp, Homo sapiens
ccagctctggcttcttgctggg

SEQ ID NO: 8068126 - DNA, 22 bp, Homo sapiens
ccagctctgtaagctgtgaaat

SEQ ID NO: 8068127 - DNA, 22 bp, Homo sapiens
ccagctggagccaaggtggact

SEQ ID NO: 8068128 - DNA, 22 bp, Homo sapiens
ccagctcttttggctgagtgag

SEQ ID NO: 8068129 - DNA, 22 bp, Homo sapiens
ccagctcttttggctgagtgag

SEQ ID NO: 8068130 - DNA, 22 bp, Homo sapiens
ccagctgacgatgcctggtctc

SEQ ID NO: 8068131 - DNA, 22 bp, Homo sapiens
ccagctgagaagtgtaaagtga

SEQ ID NO: 8068132 - DNA, 22 bp, Homo sapiens
ccagctggcactgtggctgccc

SEQ ID NO: 8068133 - DNA, 22 bp, Homo sapiens
ccagctggcaggagagtcaggg

SEQ ID NO: 8068134 - DNA, 22 bp, Homo sapiens
aggcctggcatgagacctgaga

SEQ ID NO: 8068135 - DNA, 22 bp, Homo sapiens
aggcctggcctgggcggcattg

SEQ ID NO: 8068136 - DNA, 19 bp, Homo sapiens
ccagcagctttgattctct

SEQ ID NO: 8068137 - DNA, 22 bp, Homo sapiens
ccagagcctggcatctgcataa

SEQ ID NO: 8068138 - DNA, 21 bp, Homo sapiens
ccagagcctgctgagccccct

SEQ ID NO: 8068139 - DNA, 20 bp, Homo sapiens
aggccactgaatgccaatca

SEQ ID NO: 8068140 - DNA, 22 bp, Homo sapiens
ccagagctccagggctacagaa

SEQ ID NO: 8068141 - DNA, 22 bp, Homo sapiens
ccagagctaaacacacaggctg

SEQ ID NO: 8068142 - DNA, 22 bp, Homo sapiens
ccactgggggctgcaggcactc

SEQ ID NO: 8068143 - DNA, 22 bp, Homo sapiens
ccagaaaatgcagaacatagaa

SEQ ID NO: 8068144 - DNA, 22 bp, Homo sapiens
ccagaagaccccgtccacctcc

SEQ ID NO: 8068145 - DNA, 22 bp, Homo sapiens
ccagaagacaagaatgttctta

SEQ ID NO: 8068146 - DNA, 21 bp, Homo sapiens
ccagactggcctatgtggtag

SEQ ID NO: 8068147 - DNA, 22 bp, Homo sapiens
aggctggccctactggctgcct

SEQ ID NO: 8068148 - DNA, 22 bp, Homo sapiens
aggctggccctactggctgcct

SEQ ID NO: 8068149 - DNA, 22 bp, Homo sapiens
aggctggcgacatctggcgggc

SEQ ID NO: 8068150 - DNA, 22 bp, Homo sapiens
aggctgggaaggtaaagttgta

SEQ ID NO: 8068151 - DNA, 22 bp, Homo sapiens
aggctggctggcaggggacaca

SEQ ID NO: 8068152 - DNA, 22 bp, Homo sapiens
ccatttgtattactgccccagg

SEQ ID NO: 8068153 - DNA, 22 bp, Homo sapiens
ccatttgtcacctctgcactcc

SEQ ID NO: 8068154 - DNA, 22 bp, Homo sapiens
aggctgggctccgcccaactcc

SEQ ID NO: 8068155 - DNA, 22 bp, Homo sapiens
aggctgggcaccgttttgatcc

SEQ ID NO: 8068156 - DNA, 22 bp, Homo sapiens
aggctgggtacctgtcatatgc

SEQ ID NO: 8068157 - DNA, 20 bp, Homo sapiens
aggctggggtgttttgccca

SEQ ID NO: 8068158 - DNA, 22 bp, Homo sapiens
aggctggggaattgaatttgct

SEQ ID NO: 8068159 - DNA, 22 bp, Homo sapiens
ccagggctgggtttgtcggtgt

SEQ ID NO: 8068160 - DNA, 22 bp, Homo sapiens
ccagggctggtgggagatgctg

SEQ ID NO: 8068161 - DNA, 22 bp, Homo sapiens
ccagggcctcgtgttctgagtg

SEQ ID NO: 8068162 - DNA, 22 bp, Homo sapiens
ccaggctgcttagccttatctt

SEQ ID NO: 8068163 - DNA, 22 bp, Homo sapiens
ccaggctgctttattactctgt

SEQ ID NO: 8068164 - DNA, 22 bp, Homo sapiens
ccaggctggagtatagtggcgc

SEQ ID NO: 8068165 - DNA, 22 bp, Homo sapiens
ccaggctgggcggggaacctgg

SEQ ID NO: 8068166 - DNA, 22 bp, Homo sapiens
ccaggctgggctacaagttgag

SEQ ID NO: 8068167 - DNA, 22 bp, Homo sapiens
aggcagctggcagcacccaggg

SEQ ID NO: 8068168 - DNA, 22 bp, Homo sapiens
aggcagaggagaatgatcttcc

SEQ ID NO: 8068169 - DNA, 22 bp, Homo sapiens
aggcagaggaagggtggatttg

SEQ ID NO: 8068170 - DNA, 22 bp, Homo sapiens
aggcagagctgggttttgaaat

SEQ ID NO: 8068171 - DNA, 22 bp, Homo sapiens
aggcagagctgatgttctgtga

SEQ ID NO: 8068172 - DNA, 20 bp, Homo sapiens
aggcagagcgcacttttaga

SEQ ID NO: 8068173 - DNA, 23 bp, Homo sapiens
aggcagagccaaggtcaaaaccc

SEQ ID NO: 8068174 - DNA, 22 bp, Homo sapiens
ccaaaggccaagctcaggtaaa

SEQ ID NO: 8068175 - DNA, 22 bp, Homo sapiens
ccaaactgtgtcgtctgcatag

SEQ ID NO: 8068176 - DNA, 22 bp, Homo sapiens
ccaaacaaatccccattcttag

SEQ ID NO: 8068177 - DNA, 22 bp, Homo sapiens
ccaaacaaatccccattcttag

SEQ ID NO: 8068178 - DNA, 22 bp, Homo sapiens
aggcaggctctgggtatgtgca

SEQ ID NO: 8068179 - DNA, 23 bp, Homo sapiens
aggcactgaatgtgtcagtgagt

SEQ ID NO: 8068180 - DNA, 22 bp, Homo sapiens
aggcagagagcagtggccgtct

SEQ ID NO: 8068181 - DNA, 22 bp, Homo sapiens
aggcacaggtggacttcacagt

SEQ ID NO: 8068182 - DNA, 22 bp, Homo sapiens
aggaggctgggcacagtggcct

SEQ ID NO: 8068183 - DNA, 22 bp, Homo sapiens
aggaggctggttcaggccatat

SEQ ID NO: 8068184 - DNA, 22 bp, Homo sapiens
aggaggtgacagcctgcatctg

SEQ ID NO: 8068185 - DNA, 22 bp, Homo sapiens
aggaggtcagagccccatgctg

SEQ ID NO: 8068186 - DNA, 22 bp, Homo sapiens
aggagtgggggcgagaagttaa

SEQ ID NO: 8068187 - DNA, 22 bp, Homo sapiens
aggagtggtgcaggacctgcca

SEQ ID NO: 8068188 - DNA, 22 bp, Homo sapiens
aggagtgtggccagggctctgg

SEQ ID NO: 8068189 - DNA, 22 bp, Homo sapiens
aggagtcactcagggcttcatc

SEQ ID NO: 8068190 - DNA, 19 bp, Homo sapiens
catcagagggcataggatg

SEQ ID NO: 8068191 - DNA, 22 bp, Homo sapiens
catcagaaggaaggacgattat

SEQ ID NO: 8068192 - DNA, 22 bp, Homo sapiens
catcagaagatggctctggaaa

SEQ ID NO: 8068193 - DNA, 22 bp, Homo sapiens
catcagaatagctctgtggata

SEQ ID NO: 8068194 - DNA, 22 bp, Homo sapiens
catcagaacgtgagctccttgt

SEQ ID NO: 8068195 - DNA, 20 bp, Homo sapiens
catcagaaatcctgacccac

SEQ ID NO: 8068196 - DNA, 22 bp, Homo sapiens
cagttcaggccggctgactcag

SEQ ID NO: 8068197 - DNA, 22 bp, Homo sapiens
cagttcagctagaagaaacaaa

SEQ ID NO: 8068198 - DNA, 22 bp, Homo sapiens
cagtgcagccaaggacaggcac

SEQ ID NO: 8068199 - DNA, 23 bp, Homo sapiens
cagtgcagggcaactcagactcc

SEQ ID NO: 8068200 - DNA, 22 bp, Homo sapiens
aggacaaaggaccagatctgga

SEQ ID NO: 8068201 - DNA, 22 bp, Homo sapiens
aggagctgggagaaggactaaa

SEQ ID NO: 8068202 - DNA, 22 bp, Homo sapiens
aggagctggcctagaaaggaga

SEQ ID NO: 8068203 - DNA, 22 bp, Homo sapiens
aggagctgatagtctatggaga

SEQ ID NO: 8068204 - DNA, 20 bp, Homo sapiens
cagtgcttcctcctttcttt

SEQ ID NO: 8068205 - DNA, 22 bp, Homo sapiens
aggagccaagcagaactaagga

SEQ ID NO: 8068206 - DNA, 22 bp, Homo sapiens
aggagccaagatggggcaagta

SEQ ID NO: 8068207 - DNA, 22 bp, Homo sapiens
aggagcagcccactcctgtcct

SEQ ID NO: 8068208 - DNA, 22 bp, Homo sapiens
aggagcagaccgtagtcctgca

SEQ ID NO: 8068209 - DNA, 22 bp, Homo sapiens
agctggtatgaacaggatagga

SEQ ID NO: 8068210 - DNA, 22 bp, Homo sapiens
agctggtcttaaatgtgtccag

SEQ ID NO: 8068211 - DNA, 22 bp, Homo sapiens
agctggtgctcaggggcatgga

SEQ ID NO: 8068212 - DNA, 19 bp, Homo sapiens
agctggggcggtgtgtgtt

SEQ ID NO: 8068213 - DNA, 22 bp, Homo sapiens
caggcagagtgagaagcccttg

SEQ ID NO: 8068214 - DNA, 22 bp, Homo sapiens
agctgggtggagggcccacggt

SEQ ID NO: 8068215 - DNA, 22 bp, Homo sapiens
agctggagatcatgctgatact

SEQ ID NO: 8068216 - DNA, 22 bp, Homo sapiens
agctggagatgcccagcaccgg

SEQ ID NO: 8068217 - DNA, 20 bp, Homo sapiens
agctggagaagggcccttcc

SEQ ID NO: 8068218 - DNA, 22 bp, Homo sapiens
agctggagcttcaagcaggtaa

SEQ ID NO: 8068219 - DNA, 22 bp, Homo sapiens
caggaacctaatgaaggctcac

SEQ ID NO: 8068220 - DNA, 22 bp, Homo sapiens
caggaaatatctcctggcagag

SEQ ID NO: 8068221 - DNA, 22 bp, Homo sapiens
agctgcctcagcaacacagacc

SEQ ID NO: 8068222 - DNA, 22 bp, Homo sapiens
agctgcctccatggtcaaagat

SEQ ID NO: 8068223 - DNA, 22 bp, Homo sapiens
agctgcctggagtcatttcctg

SEQ ID NO: 8068224 - DNA, 21 bp, Homo sapiens
agctgctttcagctcctagag

SEQ ID NO: 8068225 - DNA, 22 bp, Homo sapiens
agctttctggttacagtcttca

SEQ ID NO: 8068226 - DNA, 22 bp, Homo sapiens
cagggacatgactggtctctgt

SEQ ID NO: 8068227 - DNA, 22 bp, Homo sapiens
cagggactgagatccagactgt

SEQ ID NO: 8068228 - DNA, 22 bp, Homo sapiens
cagggacattggtggccaggtt

SEQ ID NO: 8068229 - DNA, 22 bp, Homo sapiens
aggaaaatcgagtctggaggca

SEQ ID NO: 8068230 - DNA, 22 bp, Homo sapiens
aggaaaaataaggcagcagggc

SEQ ID NO: 8068231 - DNA, 22 bp, Homo sapiens
aggaaaaataaggcagcagggc

SEQ ID NO: 8068232 - DNA, 22 bp, Homo sapiens
aggaaaaataaggcagcagggc

SEQ ID NO: 8068233 - DNA, 20 bp, Homo sapiens
aggaaaaatggaaactggag

SEQ ID NO: 8068234 - DNA, 22 bp, Homo sapiens
caggcttgctgctagagcactt

SEQ ID NO: 8068235 - DNA, 22 bp, Homo sapiens
agctttctagactctgtggtca

SEQ ID NO: 8068236 - DNA, 22 bp, Homo sapiens
cagggtttcaccatgttagcag

SEQ ID NO: 8068237 - DNA, 17 bp, Homo sapiens
aggaaacattttctttc

SEQ ID NO: 8068238 - DNA, 22 bp, Homo sapiens
caggtcccgccccgggctgacc

SEQ ID NO: 8068239 - DNA, 22 bp, Homo sapiens
aggaagggctgtttctccaaga

SEQ ID NO: 8068240 - DNA, 22 bp, Homo sapiens
aggaaggggagaagttaaagct

SEQ ID NO: 8068241 - DNA, 22 bp, Homo sapiens
caggtcctggcatcaggcaggt

SEQ ID NO: 8068242 - DNA, 22 bp, Homo sapiens
cttcaatttttggtatgatgga

SEQ ID NO: 8068243 - DNA, 22 bp, Homo sapiens
cttaaccagaaaatgcacttgt

SEQ ID NO: 8068244 - DNA, 22 bp, Homo sapiens
cttaatgaatgctgctgtattt

SEQ ID NO: 8068245 - DNA, 22 bp, Homo sapiens
atccatccactgatgtttctga

SEQ ID NO: 8068246 - DNA, 21 bp, Homo sapiens
atccatccatcttggcctaac

SEQ ID NO: 8068247 - DNA, 22 bp, Homo sapiens
atctgtggatatgaccttcctg

SEQ ID NO: 8068248 - DNA, 22 bp, Homo sapiens
atctggttttggctgtgtccct

SEQ ID NO: 8068249 - DNA, 22 bp, Homo sapiens
cttcttaatcccttatatattt

SEQ ID NO: 8068250 - DNA, 22 bp, Homo sapiens
cttcttaactgtatatactatg

SEQ ID NO: 8068251 - DNA, 22 bp, Homo sapiens
cttcttaaattggattgctatt

SEQ ID NO: 8068252 - DNA, 22 bp, Homo sapiens
cttcttaaagttgtcacagctg

SEQ ID NO: 8068253 - DNA, 22 bp, Homo sapiens
cttctgaggactctaaagagga

SEQ ID NO: 8068254 - DNA, 22 bp, Homo sapiens
cttctgagttaacagtagattt

SEQ ID NO: 8068255 - DNA, 22 bp, Homo sapiens
cttctcggccgtgtggatgcgc

SEQ ID NO: 8068256 - DNA, 20 bp, Homo sapiens
ctgggtggcaagcaaggggg

SEQ ID NO: 8068257 - DNA, 22 bp, Homo sapiens
ctgggtggcagagcctgcagtg

SEQ ID NO: 8068258 - DNA, 22 bp, Homo sapiens
ctgggtggatcgcagccccagg

SEQ ID NO: 8068259 - DNA, 18 bp, Homo sapiens
ctgggtctccaggctgcc

SEQ ID NO: 8068260 - DNA, 22 bp, Homo sapiens
atattcactgagcataaagcca

SEQ ID NO: 8068261 - DNA, 22 bp, Homo sapiens
ctgggtggctgtccagccagcc

SEQ ID NO: 8068262 - DNA, 22 bp, Homo sapiens
ctgggtggctgtccagccagcc

SEQ ID NO: 8068263 - DNA, 22 bp, Homo sapiens
atcaagaacttattttggaaat

SEQ ID NO: 8068264 - DNA, 22 bp, Homo sapiens
ctgggggcaatggtcagagtgt

SEQ ID NO: 8068265 - DNA, 22 bp, Homo sapiens
ctgggggcaagcagacagctgt

SEQ ID NO: 8068266 - DNA, 23 bp, Homo sapiens
ctggggctttcaaatctgggcag

SEQ ID NO: 8068267 - DNA, 22 bp, Homo sapiens
ctggggcttcaatgcttcggtg

SEQ ID NO: 8068268 - DNA, 22 bp, Homo sapiens
ctgggaggtgaacagaaaaact

SEQ ID NO: 8068269 - DNA, 22 bp, Homo sapiens
ctgggaggtgcagcaaaaatca

SEQ ID NO: 8068270 - DNA, 22 bp, Homo sapiens
ctgggaggtggaggttgcattg

SEQ ID NO: 8068271 - DNA, 22 bp, Homo sapiens
ctgggaggcggaggttgtagtg

SEQ ID NO: 8068272 - DNA, 22 bp, Homo sapiens
ctgggaggggtagccaatccta

SEQ ID NO: 8068273 - DNA, 20 bp, Homo sapiens
ctgggaggtcttccaaatca

SEQ ID NO: 8068274 - DNA, 22 bp, Homo sapiens
ctgggaggacaacttggagctc

SEQ ID NO: 8068275 - DNA, 22 bp, Homo sapiens
ctgggaggatacacaagatcag

SEQ ID NO: 8068276 - DNA, 22 bp, Homo sapiens
ctgtctcagcaggaagtcatca

SEQ ID NO: 8068277 - DNA, 22 bp, Homo sapiens
ctgtctcagcaggaagtcatca

SEQ ID NO: 8068278 - DNA, 23 bp, Homo sapiens
ctgtctcctgggctaggtggaat

SEQ ID NO: 8068279 - DNA, 22 bp, Homo sapiens
ctgtctcctccactgcatggga

SEQ ID NO: 8068280 - DNA, 22 bp, Homo sapiens
atcataaaattgcaccatttct

SEQ ID NO: 8068281 - DNA, 22 bp, Homo sapiens
atcataaagtgctatctgattg

SEQ ID NO: 8068282 - DNA, 22 bp, Homo sapiens
atcataaaccactttgtaatct

SEQ ID NO: 8068283 - DNA, 22 bp, Homo sapiens
atcataaaccactttgtaatct

SEQ ID NO: 8068284 - DNA, 22 bp, Homo sapiens
atcagcaggtgctggtggagac

SEQ ID NO: 8068285 - DNA, 22 bp, Homo sapiens
atcagcagtgtctacctcggtg

SEQ ID NO: 8068286 - DNA, 22 bp, Homo sapiens
atcagcaggtgctggtggagac

SEQ ID NO: 8068287 - DNA, 22 bp, Homo sapiens
atcagctgaaaaacaggcagca

SEQ ID NO: 8068288 - DNA, 22 bp, Homo sapiens
ataaaagaagttttggtacttg

SEQ ID NO: 8068289 - DNA, 22 bp, Homo sapiens
ataaaacttattagaattgtgt

SEQ ID NO: 8068290 - DNA, 22 bp, Homo sapiens
agttctcattgcatgagacaga

SEQ ID NO: 8068291 - DNA, 22 bp, Homo sapiens
ataaaatcagagttggattgga

SEQ ID NO: 8068292 - DNA, 22 bp, Homo sapiens
ataaacatctgtttctcttctg

SEQ ID NO: 8068293 - DNA, 22 bp, Homo sapiens
ataaactcatgctgaaaaccca

SEQ ID NO: 8068294 - DNA, 22 bp, Homo sapiens
ataaagcatctagtctgtcact

SEQ ID NO: 8068295 - DNA, 22 bp, Homo sapiens
ataaagcaagcataccattaag

SEQ ID NO: 8068296 - DNA, 22 bp, Homo sapiens
ataaagcaaataggactattgc

SEQ ID NO: 8068297 - DNA, 22 bp, Homo sapiens
ataaagcatactttgtatgact

SEQ ID NO: 8068298 - DNA, 22 bp, Homo sapiens
ctgctgtgggttaagacactgt

SEQ ID NO: 8068299 - DNA, 18 bp, Homo sapiens
ctgctgtgtcgtctgggc

SEQ ID NO: 8068300 - DNA, 22 bp, Homo sapiens
ctgctgggggacacaggtccgg

SEQ ID NO: 8068301 - DNA, 22 bp, Homo sapiens
atacacaggtgctaggtcaata

SEQ ID NO: 8068302 - DNA, 21 bp, Homo sapiens
atacacatacacataaatgtg

SEQ ID NO: 8068303 - DNA, 21 bp, Homo sapiens
atacacatacacataaatgtg

SEQ ID NO: 8068304 - DNA, 22 bp, Homo sapiens
atacacatatatacacgtttaa

SEQ ID NO: 8068305 - DNA, 22 bp, Homo sapiens
ctgctgccattagggcacagac

SEQ ID NO: 8068306 - DNA, 22 bp, Homo sapiens
ctgctgcccagtgtgcattggg

SEQ ID NO: 8068307 - DNA, 22 bp, Homo sapiens
ctgctcagcggaaggaagagcg

SEQ ID NO: 8068308 - DNA, 19 bp, Homo sapiens
ctgctcagagcagctccag

SEQ ID NO: 8068309 - DNA, 22 bp, Homo sapiens
ctgctcaagtgcgcacccaggg

SEQ ID NO: 8068310 - DNA, 22 bp, Homo sapiens
ctgcctggtctcaggcatgggg

SEQ ID NO: 8068311 - DNA, 22 bp, Homo sapiens
ctgcctgggttcaagtcctgtt

SEQ ID NO: 8068312 - DNA, 22 bp, Homo sapiens
ctgcctggaaggagcaagggga

SEQ ID NO: 8068313 - DNA, 22 bp, Homo sapiens
ctgcctgtaactttctgaagca

SEQ ID NO: 8068314 - DNA, 22 bp, Homo sapiens
ctgcctgtgatttttctctagt

SEQ ID NO: 8068315 - DNA, 22 bp, Homo sapiens
ctgcctgtattgtctgcttggg

SEQ ID NO: 8068316 - DNA, 22 bp, Homo sapiens
ctgcctgtgatttttctctagt

SEQ ID NO: 8068317 - DNA, 22 bp, Homo sapiens
ctgcctgtgccaatgctccttt

SEQ ID NO: 8068318 - DNA, 22 bp, Homo sapiens
ctgcctgtgccaccgcctcatt

SEQ ID NO: 8068319 - DNA, 22 bp, Homo sapiens
ctgcctgtgccaatgctccttt

SEQ ID NO: 8068320 - DNA, 22 bp, Homo sapiens
ctggcaggtctcgctgacgtgt

SEQ ID NO: 8068321 - DNA, 22 bp, Homo sapiens
ctggcaggtccagctggactca

SEQ ID NO: 8068322 - DNA, 22 bp, Homo sapiens
ctggcaggtggatggggactcc

SEQ ID NO: 8068323 - DNA, 22 bp, Homo sapiens
ctggcaggttatagagctgccc

SEQ ID NO: 8068324 - DNA, 22 bp, Homo sapiens
ctggcaggtttggtgtctggtg

SEQ ID NO: 8068325 - DNA, 22 bp, Homo sapiens
ctggcccttctcttgcttcctg

SEQ ID NO: 8068326 - DNA, 22 bp, Homo sapiens
ctggcctcacctcagacttact

SEQ ID NO: 8068327 - DNA, 22 bp, Homo sapiens
ctggcctcatagccaagctgtg

SEQ ID NO: 8068328 - DNA, 23 bp, Homo sapiens
ctggcctccgacactggccaaga

SEQ ID NO: 8068329 - DNA, 22 bp, Homo sapiens
ctggccggtatttgcctctggg

SEQ ID NO: 8068330 - DNA, 22 bp, Homo sapiens
ctggcagcttagcactctggtt

SEQ ID NO: 8068331 - DNA, 22 bp, Homo sapiens
atacatgtcatcatatgtttgt

SEQ ID NO: 8068332 - DNA, 22 bp, Homo sapiens
atacacatgcacacatgtgtgt

SEQ ID NO: 8068333 - DNA, 22 bp, Homo sapiens
ctgggagctgtcaggagcgtgt

SEQ ID NO: 8068334 - DNA, 22 bp, Homo sapiens
ctgggagaggaacctcgagggt

SEQ ID NO: 8068335 - DNA, 22 bp, Homo sapiens
atatacacatgtgtatacattt

SEQ ID NO: 8068336 - DNA, 22 bp, Homo sapiens
atatacactccactgatacagg

SEQ ID NO: 8068337 - DNA, 21 bp, Homo sapiens
atagtttggagtgggaaagtc

SEQ ID NO: 8068338 - DNA, 22 bp, Homo sapiens
ctggcctgtgggctgtctccgg

SEQ ID NO: 8068339 - DNA, 23 bp, Homo sapiens
atataaacaccagatagattgta

SEQ ID NO: 8068340 - DNA, 22 bp, Homo sapiens
atataaagaagtggaaaatgag

SEQ ID NO: 8068341 - DNA, 22 bp, Homo sapiens
atagtttgtgaaacacagcagt

SEQ ID NO: 8068342 - DNA, 22 bp, Homo sapiens
ctagcctgggatttgaacttat

SEQ ID NO: 8068343 - DNA, 22 bp, Homo sapiens
agtcacatggactcaggatgac

SEQ ID NO: 8068344 - DNA, 22 bp, Homo sapiens
ctagaattgcattctatgaata

SEQ ID NO: 8068345 - DNA, 22 bp, Homo sapiens
agtcagcagcctggccaggaga

SEQ ID NO: 8068346 - DNA, 22 bp, Homo sapiens
ctatcaaacagccattaatata

SEQ ID NO: 8068347 - DNA, 22 bp, Homo sapiens
ctatatttcttggctttaaaca

SEQ ID NO: 8068348 - DNA, 22 bp, Homo sapiens
ctatcccatccttctagctgac

SEQ ID NO: 8068349 - DNA, 20 bp, Homo sapiens
agtaggggaatgcaagagca

SEQ ID NO: 8068350 - DNA, 22 bp, Homo sapiens
agtaaacataatttacctgtag

SEQ ID NO: 8068351 - DNA, 22 bp, Homo sapiens
ccttccaggtgcaggcaagcct

SEQ ID NO: 8068352 - DNA, 22 bp, Homo sapiens
ccttccagggctctccagaacc

SEQ ID NO: 8068353 - DNA, 22 bp, Homo sapiens
aggtgcagctgacaccatgtgg

SEQ ID NO: 8068354 - DNA, 23 bp, Homo sapiens
aggtgcagccctggacctgcccc

SEQ ID NO: 8068355 - DNA, 22 bp, Homo sapiens
aggtgcagcatgagtccaacgg

SEQ ID NO: 8068356 - DNA, 17 bp, Homo sapiens
aggtgcagaggcagagc

SEQ ID NO: 8068357 - DNA, 21 bp, Homo sapiens
aggtgcagagccagggaccag

SEQ ID NO: 8068358 - DNA, 20 bp, Homo sapiens
cctggggtacactggcatgt

SEQ ID NO: 8068359 - DNA, 22 bp, Homo sapiens
ccttccaagtgcttgccgcttt

SEQ ID NO: 8068360 - DNA, 22 bp, Homo sapiens
ccttccaagtgctgctttttcc

SEQ ID NO: 8068361 - DNA, 22 bp, Homo sapiens
ccttccaggagtctctgcaggt

SEQ ID NO: 8068362 - DNA, 22 bp, Homo sapiens
aggtggcaggaggtcagagaaa

SEQ ID NO: 8068363 - DNA, 22 bp, Homo sapiens
ccttccaaaggagccacatctg

SEQ ID NO: 8068364 - DNA, 22 bp, Homo sapiens
aggtggcagcagaatcagggag

SEQ ID NO: 8068365 - DNA, 22 bp, Homo sapiens
aggtggcagcagcctggtgaaa

SEQ ID NO: 8068366 - DNA, 22 bp, Homo sapiens
aggtggcagactaacagaagga

SEQ ID NO: 8068367 - DNA, 22 bp, Homo sapiens
aggtggcagagctggcccagcg

SEQ ID NO: 8068368 - DNA, 22 bp, Homo sapiens
aggtggcagagtgacaggctga

SEQ ID NO: 8068369 - DNA, 22 bp, Homo sapiens
cctgggaggctgaggctgcagt

SEQ ID NO: 8068370 - DNA, 22 bp, Homo sapiens
cctgggaggtggaggttgcagc

SEQ ID NO: 8068371 - DNA, 22 bp, Homo sapiens
cctgggaggtggaggttgcagt

SEQ ID NO: 8068372 - DNA, 22 bp, Homo sapiens
cctgggaggctgtgggtctgct

SEQ ID NO: 8068373 - DNA, 22 bp, Homo sapiens
cctgggaggctgtttccagcct

SEQ ID NO: 8068374 - DNA, 22 bp, Homo sapiens
cctgggagggcaagtgctgatg

SEQ ID NO: 8068375 - DNA, 22 bp, Homo sapiens
aggtcaccatggcatgctccac

SEQ ID NO: 8068376 - DNA, 22 bp, Homo sapiens
aggtcagaagtgccagggaatt

SEQ ID NO: 8068377 - DNA, 22 bp, Homo sapiens
aggtattgaccacctccttgat

SEQ ID NO: 8068378 - DNA, 22 bp, Homo sapiens
agtgagggatgaagaactgcgg

SEQ ID NO: 8068379 - DNA, 22 bp, Homo sapiens
agtgaggggattcaggcaaggt

SEQ ID NO: 8068380 - DNA, 22 bp, Homo sapiens
agtgaggtcatactggagaggg

SEQ ID NO: 8068381 - DNA, 22 bp, Homo sapiens
agtgagtggaccctgcaaggaa

SEQ ID NO: 8068382 - DNA, 22 bp, Homo sapiens
agtgaggggcagctgagtgggc

SEQ ID NO: 8068383 - DNA, 22 bp, Homo sapiens
agtgaggtaattagagctgctg

SEQ ID NO: 8068384 - DNA, 22 bp, Homo sapiens
agtgagtgggttacagatggga

SEQ ID NO: 8068385 - DNA, 22 bp, Homo sapiens
agtgaggctaataggcaatggt

SEQ ID NO: 8068386 - DNA, 22 bp, Homo sapiens
agtgaaaacactagttcttgcc

SEQ ID NO: 8068387 - DNA, 22 bp, Homo sapiens
agtctacaatcttaaatgaact

SEQ ID NO: 8068388 - DNA, 22 bp, Homo sapiens
agtgccttgggtattttgagta

SEQ ID NO: 8068389 - DNA, 19 bp, Homo sapiens
agtgccttgctctctaggt

SEQ ID NO: 8068390 - DNA, 22 bp, Homo sapiens
agtgccttggctgtgatgggga

SEQ ID NO: 8068391 - DNA, 22 bp, Homo sapiens
agtgccttgtgtgtgggcagcc

SEQ ID NO: 8068392 - DNA, 22 bp, Homo sapiens
agtgccctgctggggcaggaga

SEQ ID NO: 8068393 - DNA, 22 bp, Homo sapiens
agtgccctggcccagctggacc

SEQ ID NO: 8068394 - DNA, 22 bp, Homo sapiens
agtgccctgggccttccaggac

SEQ ID NO: 8068395 - DNA, 20 bp, Homo sapiens
ctgagctgagctccatgggt

SEQ ID NO: 8068396 - DNA, 20 bp, Homo sapiens
ctgagctgagctccatgggt

SEQ ID NO: 8068397 - DNA, 22 bp, Homo sapiens
ctgagctgaaacttgagaggct

SEQ ID NO: 8068398 - DNA, 22 bp, Homo sapiens
agttccagctgtgaccagaaaa

SEQ ID NO: 8068399 - DNA, 22 bp, Homo sapiens
agttaactcattttataatgcc

SEQ ID NO: 8068400 - DNA, 20 bp, Homo sapiens
agtgtgcatttagagtctgc

SEQ ID NO: 8068401 - DNA, 22 bp, Homo sapiens
agtgtgagttacaaagtgtgaa

SEQ ID NO: 8068402 - DNA, 22 bp, Homo sapiens
agtgtgagtttggttgagactt

SEQ ID NO: 8068403 - DNA, 22 bp, Homo sapiens
agtgtgagtgctcatgtccatc

SEQ ID NO: 8068404 - DNA, 19 bp, Homo sapiens
agtgtgagtaattggagtt

SEQ ID NO: 8068405 - DNA, 22 bp, Homo sapiens
agtgtgagtaattgagtctgtc

SEQ ID NO: 8068406 - DNA, 22 bp, Homo sapiens
agttaacaagttggcaatcaac

SEQ ID NO: 8068407 - DNA, 22 bp, Homo sapiens
agtgtttgcatctcattgattt

SEQ ID NO: 8068408 - DNA, 22 bp, Homo sapiens
ctctggagttcttcaagctact

SEQ ID NO: 8068409 - DNA, 22 bp, Homo sapiens
ctctggagttctcatgaggaac

SEQ ID NO: 8068410 - DNA, 22 bp, Homo sapiens
ctctggagtgtctggccagggt

SEQ ID NO: 8068411 - DNA, 22 bp, Homo sapiens
ctctggagttagtgatctgggc

SEQ ID NO: 8068412 - DNA, 22 bp, Homo sapiens
agtggcctggagccccgcctgg

SEQ ID NO: 8068413 - DNA, 22 bp, Homo sapiens
agtggcctggagccccgcctgg

SEQ ID NO: 8068414 - DNA, 22 bp, Homo sapiens
agtggcctggagccccgcctgg

SEQ ID NO: 8068415 - DNA, 22 bp, Homo sapiens
agtggccagtgctgctctgggg

SEQ ID NO: 8068416 - DNA, 22 bp, Homo sapiens
agtggggccgcggtcctgccct

SEQ ID NO: 8068417 - DNA, 22 bp, Homo sapiens
agtgtgagccctggagtggtgc

SEQ ID NO: 8068418 - DNA, 22 bp, Homo sapiens
agtgtgagattaaaccgaatca

SEQ ID NO: 8068419 - DNA, 22 bp, Homo sapiens
agtgtgagctaatagcagagcc

SEQ ID NO: 8068420 - DNA, 22 bp, Homo sapiens
agtgtgagcctacaggccaaag

SEQ ID NO: 8068421 - DNA, 22 bp, Homo sapiens
agtgtgagtaattcagggaggg

SEQ ID NO: 8068422 - DNA, 22 bp, Homo sapiens
agtgtgaggggttctttgatat

SEQ ID NO: 8068423 - DNA, 23 bp, Homo sapiens
agtgtgacttttttgactgtcac

SEQ ID NO: 8068424 - DNA, 22 bp, Homo sapiens
agtgtgagaacggactaataaa

SEQ ID NO: 8068425 - DNA, 19 bp, Homo sapiens
agtgtgagactccatctca

SEQ ID NO: 8068426 - DNA, 22 bp, Homo sapiens
agtgtgagatgattgaggagca

SEQ ID NO: 8068427 - DNA, 22 bp, Homo sapiens
agtgtcagttgccttgtcataa

SEQ ID NO: 8068428 - DNA, 22 bp, Homo sapiens
agtgtcagctaattattcatga

SEQ ID NO: 8068429 - DNA, 22 bp, Homo sapiens
actgagctccctgagggcaggc

SEQ ID NO: 8068430 - DNA, 22 bp, Homo sapiens
actctgaggcaggtcagggcag

SEQ ID NO: 8068431 - DNA, 22 bp, Homo sapiens
actctgaggagtgactagaggt

SEQ ID NO: 8068432 - DNA, 22 bp, Homo sapiens
actctgccttggtgtcacaaga

SEQ ID NO: 8068433 - DNA, 22 bp, Homo sapiens
actctgcctttcagcagatgaa

SEQ ID NO: 8068434 - DNA, 22 bp, Homo sapiens
actctgccccgagttctgggaa

SEQ ID NO: 8068435 - DNA, 22 bp, Homo sapiens
actctgccatcccaggtgctgt

SEQ ID NO: 8068436 - DNA, 22 bp, Homo sapiens
actgcacttcaccctgggtgac

SEQ ID NO: 8068437 - DNA, 22 bp, Homo sapiens
actgcactccagcctgggtgat

SEQ ID NO: 8068438 - DNA, 22 bp, Homo sapiens
actgggcagggaaggagaccga

SEQ ID NO: 8068439 - DNA, 22 bp, Homo sapiens
actgggcatcccatggcagagc

SEQ ID NO: 8068440 - DNA, 19 bp, Homo sapiens
actgcctgaggctcacagg

SEQ ID NO: 8068441 - DNA, 22 bp, Homo sapiens
actgcctgcctctgattctgca

SEQ ID NO: 8068442 - DNA, 22 bp, Homo sapiens
actgcctgccttccaggtactg

SEQ ID NO: 8068443 - DNA, 23 bp, Homo sapiens
actgcctgctactatgcccacgg

SEQ ID NO: 8068444 - DNA, 22 bp, Homo sapiens
actgcctgctcctggctccaca

SEQ ID NO: 8068445 - DNA, 22 bp, Homo sapiens
actgcctggcctggcctcactg

SEQ ID NO: 8068446 - DNA, 22 bp, Homo sapiens
actgccaatggtagtttgatgg

SEQ ID NO: 8068447 - DNA, 22 bp, Homo sapiens
actgccaggatggcactagagg

SEQ ID NO: 8068448 - DNA, 22 bp, Homo sapiens
actcctgcttcttccctgagga

SEQ ID NO: 8068449 - DNA, 22 bp, Homo sapiens
actcctgctgtcactgcagttc

SEQ ID NO: 8068450 - DNA, 22 bp, Homo sapiens
actcctgccacacagatgctgt

SEQ ID NO: 8068451 - DNA, 22 bp, Homo sapiens
actcctgccacacagatgctgt

SEQ ID NO: 8068452 - DNA, 22 bp, Homo sapiens
actcctggggatccattccttt

SEQ ID NO: 8068453 - DNA, 22 bp, Homo sapiens
actcctgggtgctgaccagcgt

SEQ ID NO: 8068454 - DNA, 22 bp, Homo sapiens
actcctggggctgccatcacag

SEQ ID NO: 8068455 - DNA, 22 bp, Homo sapiens
actctcccttggagcctcaggc

SEQ ID NO: 8068456 - DNA, 22 bp, Homo sapiens
aggtggggaaaccagcgatccc

SEQ ID NO: 8068457 - DNA, 22 bp, Homo sapiens
aggtggggaaaccagcgatccc

SEQ ID NO: 8068458 - DNA, 22 bp, Homo sapiens
agtacccttttcactgtcacaa

SEQ ID NO: 8068459 - DNA, 22 bp, Homo sapiens
aggtgactggtttatctggcag

SEQ ID NO: 8068460 - DNA, 22 bp, Homo sapiens
accttttttcagaactctaaag

SEQ ID NO: 8068461 - DNA, 22 bp, Homo sapiens
acgaggagcctgtggcctggta

SEQ ID NO: 8068462 - DNA, 22 bp, Homo sapiens
acctttttgttctgttctcagc

SEQ ID NO: 8068463 - DNA, 22 bp, Homo sapiens
aggtccagctgttgcagcctcc

SEQ ID NO: 8068464 - DNA, 21 bp, Homo sapiens
actttaatatacatgaggagg

SEQ ID NO: 8068465 - DNA, 22 bp, Homo sapiens
acttctcttcataggtggcaat

SEQ ID NO: 8068466 - DNA, 22 bp, Homo sapiens
atagagtgatgtaaggtatgtg

SEQ ID NO: 8068467 - DNA, 22 bp, Homo sapiens
actttgcaatacttaatacaaa

SEQ ID NO: 8068468 - DNA, 22 bp, Homo sapiens
atacatcatgctccatatattt

SEQ ID NO: 8068469 - DNA, 22 bp, Homo sapiens
actttgcaggtacatgagcatc

SEQ ID NO: 8068470 - DNA, 22 bp, Homo sapiens
actttgcacttcaatataactt

SEQ ID NO: 8068471 - DNA, 23 bp, Homo sapiens
actttgcagagccccttgaaaca

SEQ ID NO: 8068472 - DNA, 22 bp, Homo sapiens
acttccagctaggttctgctaa

SEQ ID NO: 8068473 - DNA, 19 bp, Homo sapiens
ataaataaaaagtgggaga

SEQ ID NO: 8068474 - DNA, 22 bp, Homo sapiens
acttcctgttatgtgtgcctct

SEQ ID NO: 8068475 - DNA, 22 bp, Homo sapiens
acttccttgtactgactccatt

SEQ ID NO: 8068476 - DNA, 22 bp, Homo sapiens
acttccttgtcaggtgcatcat

SEQ ID NO: 8068477 - DNA, 21 bp, Homo sapiens
actgggctagcctgacttctg

SEQ ID NO: 8068478 - DNA, 22 bp, Homo sapiens
agttttatgcagtgttctgata

SEQ ID NO: 8068479 - DNA, 22 bp, Homo sapiens
atcccagagaataatgatcagg

SEQ ID NO: 8068480 - DNA, 21 bp, Homo sapiens
atcccagcacccaggagtgca

SEQ ID NO: 8068481 - DNA, 22 bp, Homo sapiens
atcccattcccataagtggaaa

SEQ ID NO: 8068482 - DNA, 22 bp, Homo sapiens
atcccatttcctagtacatcat

SEQ ID NO: 8068483 - DNA, 22 bp, Homo sapiens
atccccagaaaataggtgccta

SEQ ID NO: 8068484 - DNA, 22 bp, Homo sapiens
atccccagaaaataggtgccta

SEQ ID NO: 8068485 - DNA, 22 bp, Homo sapiens
agaacatctaaatatctgagac

SEQ ID NO: 8068486 - DNA, 22 bp, Homo sapiens
atctcagggctggagccctgga

SEQ ID NO: 8068487 - DNA, 22 bp, Homo sapiens
agaacctctggatacagtttaa

SEQ ID NO: 8068488 - DNA, 22 bp, Homo sapiens
agaacctcaattatttttgcac

SEQ ID NO: 8068489 - DNA, 22 bp, Homo sapiens
agaagccaattctgtgtgagtc

SEQ ID NO: 8068490 - DNA, 22 bp, Homo sapiens
agaagccaagaacagacagtgc

SEQ ID NO: 8068491 - DNA, 22 bp, Homo sapiens
agaagccaacagggcaggagag

SEQ ID NO: 8068492 - DNA, 22 bp, Homo sapiens
atctctgtaattacatgatatt

SEQ ID NO: 8068493 - DNA, 22 bp, Homo sapiens
agaaggagtgtacaggtcatgc

SEQ ID NO: 8068494 - DNA, 22 bp, Homo sapiens
agaaagcactctgtcttttacc

SEQ ID NO: 8068495 - DNA, 22 bp, Homo sapiens
atcaaaaccttgacttttaatg

SEQ ID NO: 8068496 - DNA, 22 bp, Homo sapiens
atattttgtaacttggaatagg

SEQ ID NO: 8068497 - DNA, 22 bp, Homo sapiens
atattttggggtgatgtgcatc

SEQ ID NO: 8068498 - DNA, 22 bp, Homo sapiens
atatttctccaaatgttttcaa

SEQ ID NO: 8068499 - DNA, 21 bp, Homo sapiens
agaaaaaccagcatgttttca

SEQ ID NO: 8068500 - DNA, 22 bp, Homo sapiens
agaaaaactaagagtgggtggt

SEQ ID NO: 8068501 - DNA, 21 bp, Homo sapiens
agaaaaaccagcatgttttca

SEQ ID NO: 8068502 - DNA, 22 bp, Homo sapiens
acttttcccttggtagagttgc

SEQ ID NO: 8068503 - DNA, 22 bp, Homo sapiens
acttttctccctcctgccttca

SEQ ID NO: 8068504 - DNA, 23 bp, Homo sapiens
agaaaaacaggattgtgttccta

SEQ ID NO: 8068505 - DNA, 22 bp, Homo sapiens
agggcctctgacgcccccagcc

SEQ ID NO: 8068506 - DNA, 22 bp, Homo sapiens
agggcctgagaccgtggcttga

SEQ ID NO: 8068507 - DNA, 22 bp, Homo sapiens
agggcctgacacccttgccagc

SEQ ID NO: 8068508 - DNA, 22 bp, Homo sapiens
agggcctgagctctcctccagt

SEQ ID NO: 8068509 - DNA, 19 bp, Homo sapiens
agggcctgagcagatgttg

SEQ ID NO: 8068510 - DNA, 22 bp, Homo sapiens
acccagggtagagtgcagtggc

SEQ ID NO: 8068511 - DNA, 22 bp, Homo sapiens
acccagggtagagtgcagtggc

SEQ ID NO: 8068512 - DNA, 22 bp, Homo sapiens
accctgggtcatatacagtgtg

SEQ ID NO: 8068513 - DNA, 22 bp, Homo sapiens
accctgggggtggccagtgcca

SEQ ID NO: 8068514 - DNA, 22 bp, Homo sapiens
accctgggttcccgcagcacca

SEQ ID NO: 8068515 - DNA, 21 bp, Homo sapiens
accctgggttctccataccct

SEQ ID NO: 8068516 - DNA, 22 bp, Homo sapiens
accctgggcttggcctgctcag

SEQ ID NO: 8068517 - DNA, 22 bp, Homo sapiens
acccatccagtgtccctgctag

SEQ ID NO: 8068518 - DNA, 18 bp, Homo sapiens
accctctggcttctgagc

SEQ ID NO: 8068519 - DNA, 22 bp, Homo sapiens
accaggtggccccagcgtggtt

SEQ ID NO: 8068520 - DNA, 22 bp, Homo sapiens
accaggtggccccagcgtggtt

SEQ ID NO: 8068521 - DNA, 22 bp, Homo sapiens
accaggggtgtcaacagcattt

SEQ ID NO: 8068522 - DNA, 22 bp, Homo sapiens
accagggttgagtcagctgcgt

SEQ ID NO: 8068523 - DNA, 22 bp, Homo sapiens
accaggggatggttggcactgt

SEQ ID NO: 8068524 - DNA, 19 bp, Homo sapiens
accaggagtatcagagctg

SEQ ID NO: 8068525 - DNA, 22 bp, Homo sapiens
accaacatgtcctcacacagcc

SEQ ID NO: 8068526 - DNA, 23 bp, Homo sapiens
accaacaagcctctggagagtgg

SEQ ID NO: 8068527 - DNA, 22 bp, Homo sapiens
accaaagggcagaacatgagca

SEQ ID NO: 8068528 - DNA, 22 bp, Homo sapiens
accaaaggcagagctgaacact

SEQ ID NO: 8068529 - DNA, 23 bp, Homo sapiens
aggcttcctatcttagagctggg

SEQ ID NO: 8068530 - DNA, 22 bp, Homo sapiens
accaatctcctattttgtttca

SEQ ID NO: 8068531 - DNA, 20 bp, Homo sapiens
accaggagatggaggcaggg

SEQ ID NO: 8068532 - DNA, 22 bp, Homo sapiens
accaggagccatagagtcaggc

SEQ ID NO: 8068533 - DNA, 22 bp, Homo sapiens
accaggaggcctggagcacaaa

SEQ ID NO: 8068534 - DNA, 22 bp, Homo sapiens
acattccaaaaactagcagata

SEQ ID NO: 8068535 - DNA, 22 bp, Homo sapiens
acattcctgaggaaatacattc

SEQ ID NO: 8068536 - DNA, 22 bp, Homo sapiens
acattctaacattgtacagata

SEQ ID NO: 8068537 - DNA, 22 bp, Homo sapiens
acattctagatatgttatattt

SEQ ID NO: 8068538 - DNA, 22 bp, Homo sapiens
acattaatgaggtgatgacaca

SEQ ID NO: 8068539 - DNA, 22 bp, Homo sapiens
acattcaaggccttctgacaca

SEQ ID NO: 8068540 - DNA, 22 bp, Homo sapiens
aggctccagcagccagaggaag

SEQ ID NO: 8068541 - DNA, 22 bp, Homo sapiens
aggctccagcagccagaggaag

SEQ ID NO: 8068542 - DNA, 22 bp, Homo sapiens
aggctccagcccaaggctgcag

SEQ ID NO: 8068543 - DNA, 22 bp, Homo sapiens
aggctccagcccaaggctgcag

SEQ ID NO: 8068544 - DNA, 22 bp, Homo sapiens
aggctccagccaatgggtctgt

SEQ ID NO: 8068545 - DNA, 23 bp, Homo sapiens
aggctccactccctgggatgtgg

SEQ ID NO: 8068546 - DNA, 22 bp, Homo sapiens
aggctccagggctgtgtgggag

SEQ ID NO: 8068547 - DNA, 22 bp, Homo sapiens
aggctccaggcctccctgcatg

SEQ ID NO: 8068548 - DNA, 22 bp, Homo sapiens
aggctccaggcccttcaccagc

SEQ ID NO: 8068549 - DNA, 22 bp, Homo sapiens
aggctccaggcaatgtttctga

SEQ ID NO: 8068550 - DNA, 22 bp, Homo sapiens
aggctccaggcaaaatttcgga

SEQ ID NO: 8068551 - DNA, 22 bp, Homo sapiens
aggcttcagaaagagtaattgg

SEQ ID NO: 8068552 - DNA, 22 bp, Homo sapiens
aggcttccgagtagctgggact

SEQ ID NO: 8068553 - DNA, 18 bp, Homo sapiens
aggcttcccaggcaggcc

SEQ ID NO: 8068554 - DNA, 22 bp, Homo sapiens
aggcttcccaagcagctgcaaa

SEQ ID NO: 8068555 - DNA, 22 bp, Homo sapiens
aggcttcccagctgagctcagc

SEQ ID NO: 8068556 - DNA, 22 bp, Homo sapiens
aggcagtgttcttctaagggca

SEQ ID NO: 8068557 - DNA, 22 bp, Homo sapiens
acatacatgggattaaaaaatt

SEQ ID NO: 8068558 - DNA, 22 bp, Homo sapiens
aggccagccctcacctgtgttc

SEQ ID NO: 8068559 - DNA, 22 bp, Homo sapiens
aggccagccctgggctgagaga

SEQ ID NO: 8068560 - DNA, 22 bp, Homo sapiens
acatctttgctcttatagagct

SEQ ID NO: 8068561 - DNA, 22 bp, Homo sapiens
acatgaaaactggttccttcag

SEQ ID NO: 8068562 - DNA, 22 bp, Homo sapiens
acatgaaactgttgcattagaa

SEQ ID NO: 8068563 - DNA, 22 bp, Homo sapiens
acatgaaacctgagtctaactc

SEQ ID NO: 8068564 - DNA, 22 bp, Homo sapiens
acagccagtgactgcagaccct

SEQ ID NO: 8068565 - DNA, 22 bp, Homo sapiens
agctgcagcgttcatttttcca

SEQ ID NO: 8068566 - DNA, 22 bp, Homo sapiens
agctgcaggattatggaatgga

SEQ ID NO: 8068567 - DNA, 22 bp, Homo sapiens
agctgcaggcccatgctcagtc

SEQ ID NO: 8068568 - DNA, 20 bp, Homo sapiens
acagccagaggaggcagaca

SEQ ID NO: 8068569 - DNA, 22 bp, Homo sapiens
agctccagtttcctgactgagc

SEQ ID NO: 8068570 - DNA, 22 bp, Homo sapiens
agctccagttacttacctagag

SEQ ID NO: 8068571 - DNA, 20 bp, Homo sapiens
agctccagtgctgacgcttc

SEQ ID NO: 8068572 - DNA, 22 bp, Homo sapiens
acagccagtaatctacccctgt

SEQ ID NO: 8068573 - DNA, 22 bp, Homo sapiens
acagccagtcctcccacagggt

SEQ ID NO: 8068574 - DNA, 22 bp, Homo sapiens
acagccagggtctcaggaggcg

SEQ ID NO: 8068575 - DNA, 22 bp, Homo sapiens
acagccccagcgcggcggggtc

SEQ ID NO: 8068576 - DNA, 23 bp, Homo sapiens
acagccccatgcaggtgtgtttg

SEQ ID NO: 8068577 - DNA, 20 bp, Homo sapiens
agctggcctgtcctaggcct

SEQ ID NO: 8068578 - DNA, 22 bp, Homo sapiens
agctggccttcggtgtcactgg

SEQ ID NO: 8068579 - DNA, 17 bp, Homo sapiens
agcttcagttgcaaaac

SEQ ID NO: 8068580 - DNA, 22 bp, Homo sapiens
aggaaaaaagtctgtgattata

SEQ ID NO: 8068581 - DNA, 22 bp, Homo sapiens
aggaaaaaagtctgtgattata

SEQ ID NO: 8068582 - DNA, 22 bp, Homo sapiens
aggaaaaacctgttaatggtag

SEQ ID NO: 8068583 - DNA, 22 bp, Homo sapiens
aggaaaaagagttgctgccttc

SEQ ID NO: 8068584 - DNA, 22 bp, Homo sapiens
aggaaaaacctgttaatggtag

SEQ ID NO: 8068585 - DNA, 22 bp, Homo sapiens
agctgtgtaggatcataacacg

SEQ ID NO: 8068586 - DNA, 22 bp, Homo sapiens
agctgtgtaggatcataacacg

SEQ ID NO: 8068587 - DNA, 20 bp, Homo sapiens
agcttcaggctcaagagaac

SEQ ID NO: 8068588 - DNA, 22 bp, Homo sapiens
agctgggagcagagccacagcc

SEQ ID NO: 8068589 - DNA, 22 bp, Homo sapiens
agctgggatgataacctcagtc

SEQ ID NO: 8068590 - DNA, 22 bp, Homo sapiens
aggaaggctgatcactgcttgt

SEQ ID NO: 8068591 - DNA, 22 bp, Homo sapiens
aggaaggcacattgttggctaa

SEQ ID NO: 8068592 - DNA, 22 bp, Homo sapiens
acagggtcaagggtgctacaag

SEQ ID NO: 8068593 - DNA, 22 bp, Homo sapiens
acagggtcattttatgatctgt

SEQ ID NO: 8068594 - DNA, 20 bp, Homo sapiens
aggagccattgactgcagca

SEQ ID NO: 8068595 - DNA, 22 bp, Homo sapiens
aggagcagaccgtagtcctgca

SEQ ID NO: 8068596 - DNA, 22 bp, Homo sapiens
aggagccatgagtgacatcaca

SEQ ID NO: 8068597 - DNA, 22 bp, Homo sapiens
aggagcctccatggtcacattc

SEQ ID NO: 8068598 - DNA, 22 bp, Homo sapiens
aggagcctccttctcatgtgca

SEQ ID NO: 8068599 - DNA, 22 bp, Homo sapiens
aggagctgcaaatattagtaat

SEQ ID NO: 8068600 - DNA, 22 bp, Homo sapiens
aggagcccctcttcagtcctgg

SEQ ID NO: 8068601 - DNA, 22 bp, Homo sapiens
aggagccctgcgggaggcagag

SEQ ID NO: 8068602 - DNA, 22 bp, Homo sapiens
aggagctgcagattctgccttg

SEQ ID NO: 8068603 - DNA, 21 bp, Homo sapiens
aggaggggtctttcccactga

SEQ ID NO: 8068604 - DNA, 22 bp, Homo sapiens
aggaggggttctcgggtgctga

SEQ ID NO: 8068605 - DNA, 22 bp, Homo sapiens
aggcaaagcgataccagagcta

SEQ ID NO: 8068606 - DNA, 22 bp, Homo sapiens
aggcaaagaggatattttgggg

SEQ ID NO: 8068607 - DNA, 22 bp, Homo sapiens
aggaggctgtggagcactccat

SEQ ID NO: 8068608 - DNA, 22 bp, Homo sapiens
acataacaatcataggacatag

SEQ ID NO: 8068609 - DNA, 22 bp, Homo sapiens
acatacatcaagtatcacaaga

SEQ ID NO: 8068610 - DNA, 22 bp, Homo sapiens
agaggccagcagtgcctatctg

SEQ ID NO: 8068611 - DNA, 22 bp, Homo sapiens
agaggccagcagtgcctatctg

SEQ ID NO: 8068612 - DNA, 23 bp, Homo sapiens
agaggccagcctttggagacacc

SEQ ID NO: 8068613 - DNA, 22 bp, Homo sapiens
agaggccagaaagtatgccacc

SEQ ID NO: 8068614 - DNA, 22 bp, Homo sapiens
agaggccactttgcctgtgatg

SEQ ID NO: 8068615 - DNA, 23 bp, Homo sapiens
agaggcaggagtggcttgcccgg

SEQ ID NO: 8068616 - DNA, 22 bp, Homo sapiens
agaggccaccactgtcagggac

SEQ ID NO: 8068617 - DNA, 22 bp, Homo sapiens
agaggccaccagaggtggtgcc

SEQ ID NO: 8068618 - DNA, 22 bp, Homo sapiens
agaggcacggaggctgcatgga

SEQ ID NO: 8068619 - DNA, 22 bp, Homo sapiens
agaggcaccgtctgcagcgtgc

SEQ ID NO: 8068620 - DNA, 23 bp, Homo sapiens
agaggcaggagtggcttgcccgg

SEQ ID NO: 8068621 - DNA, 22 bp, Homo sapiens
agaggcacagaggcagtcccct

SEQ ID NO: 8068622 - DNA, 22 bp, Homo sapiens
agaggggagtcctaatctgatt

SEQ ID NO: 8068623 - DNA, 22 bp, Homo sapiens
agaggggctcaagcagtggtct

SEQ ID NO: 8068624 - DNA, 22 bp, Homo sapiens
agagtccatatgtgggaggagt

SEQ ID NO: 8068625 - DNA, 22 bp, Homo sapiens
agagtccatgaagacagctgag

SEQ ID NO: 8068626 - DNA, 22 bp, Homo sapiens
agagtccagaaaacagtgtgct

SEQ ID NO: 8068627 - DNA, 22 bp, Homo sapiens
agagtctgaatgctcagagttg

SEQ ID NO: 8068628 - DNA, 22 bp, Homo sapiens
agagtcagactaagccatggtg

SEQ ID NO: 8068629 - DNA, 23 bp, Homo sapiens
agagtccacaagattttccagtg

SEQ ID NO: 8068630 - DNA, 22 bp, Homo sapiens
agagtattttgattatcctgga

SEQ ID NO: 8068631 - DNA, 19 bp, Homo sapiens
agagtattgaatttgccct

SEQ ID NO: 8068632 - DNA, 22 bp, Homo sapiens
attttagttttagcatccatgc

SEQ ID NO: 8068633 - DNA, 22 bp, Homo sapiens
attttaaccctcttatatatac

SEQ ID NO: 8068634 - DNA, 22 bp, Homo sapiens
attttagcaaatgcaagatgga

SEQ ID NO: 8068635 - DNA, 22 bp, Homo sapiens
agcaagaagggcaaggaagttt

SEQ ID NO: 8068636 - DNA, 17 bp, Homo sapiens
agcaacttctcccacag

SEQ ID NO: 8068637 - DNA, 22 bp, Homo sapiens
caaagatgctgatgttggatca

SEQ ID NO: 8068638 - DNA, 21 bp, Homo sapiens
agatgctgtgctccaggagca

SEQ ID NO: 8068639 - DNA, 22 bp, Homo sapiens
agatcagagtggattgtgctgc

SEQ ID NO: 8068640 - DNA, 22 bp, Homo sapiens
agatcacagcccccagatgcca

SEQ ID NO: 8068641 - DNA, 22 bp, Homo sapiens
atgaaggatggctggctgccct

SEQ ID NO: 8068642 - DNA, 22 bp, Homo sapiens
atgaagcttgaggtgagagctg

SEQ ID NO: 8068643 - DNA, 22 bp, Homo sapiens
agaatatgaggaaactgtgaat

SEQ ID NO: 8068644 - DNA, 18 bp, Homo sapiens
atctgctggcaggtctgg

SEQ ID NO: 8068645 - DNA, 22 bp, Homo sapiens
atctgctggcatctctagccca

SEQ ID NO: 8068646 - DNA, 22 bp, Homo sapiens
atctgctgtcacatgtttgaag

SEQ ID NO: 8068647 - DNA, 22 bp, Homo sapiens
atctgctgttcttcacagcttg

SEQ ID NO: 8068648 - DNA, 22 bp, Homo sapiens
atctgctgtgtgtaatggaatg

SEQ ID NO: 8068649 - DNA, 22 bp, Homo sapiens
atctgctgcccagccacttgct

SEQ ID NO: 8068650 - DNA, 20 bp, Homo sapiens
atctgctgagaatgaaaggc

SEQ ID NO: 8068651 - DNA, 17 bp, Homo sapiens
atctgctgacattctgt

SEQ ID NO: 8068652 - DNA, 23 bp, Homo sapiens
agacactgtaaagaattgcagtt

SEQ ID NO: 8068653 - DNA, 22 bp, Homo sapiens
agacaaggctggagtttaggca

SEQ ID NO: 8068654 - DNA, 22 bp, Homo sapiens
agacaaggcaaggcggccagat

SEQ ID NO: 8068655 - DNA, 22 bp, Homo sapiens
agacaacaccaaatgctagtgt

SEQ ID NO: 8068656 - DNA, 21 bp, Homo sapiens
atgccaagtcttaatgagggc

SEQ ID NO: 8068657 - DNA, 22 bp, Homo sapiens
atgatagctaccgtttatgctg

SEQ ID NO: 8068658 - DNA, 22 bp, Homo sapiens
agacagaatttgtcagataaat

SEQ ID NO: 8068659 - DNA, 22 bp, Homo sapiens
atgcatttgtaaaatataatcg

SEQ ID NO: 8068660 - DNA, 22 bp, Homo sapiens
agactgtgagaagatggctgcg

SEQ ID NO: 8068661 - DNA, 22 bp, Homo sapiens
agacttaggtgagatgtttgta

SEQ ID NO: 8068662 - DNA, 22 bp, Homo sapiens
agacttctcagttttattagta

SEQ ID NO: 8068663 - DNA, 22 bp, Homo sapiens
agactttagatacgtcttcttc

SEQ ID NO: 8068664 - DNA, 22 bp, Homo sapiens
agactttagggccatggtaggt

SEQ ID NO: 8068665 - DNA, 22 bp, Homo sapiens
agactttataaatcttaatttc

SEQ ID NO: 8068666 - DNA, 22 bp, Homo sapiens
agactttgagctcttagagaag

SEQ ID NO: 8068667 - DNA, 22 bp, Homo sapiens
agactttatagtttttggctat

SEQ ID NO: 8068668 - DNA, 22 bp, Homo sapiens
agactttatccctgtttttctc

SEQ ID NO: 8068669 - DNA, 22 bp, Homo sapiens
agactttaatgtgcaaatgaaa

SEQ ID NO: 8068670 - DNA, 22 bp, Homo sapiens
agactttagaatcagatagcct

SEQ ID NO: 8068671 - DNA, 22 bp, Homo sapiens
agactttaacaatgggtatgaa

SEQ ID NO: 8068672 - DNA, 22 bp, Homo sapiens
agagaaaagagttcaggctttg

SEQ ID NO: 8068673 - DNA, 22 bp, Homo sapiens
agagaaaactcattgaggtgtc

SEQ ID NO: 8068674 - DNA, 22 bp, Homo sapiens
agagaaggtcactaaggaccca

SEQ ID NO: 8068675 - DNA, 22 bp, Homo sapiens
agagaggcattcggtgatccca

SEQ ID NO: 8068676 - DNA, 22 bp, Homo sapiens
agagagcctgagtggcagctat

SEQ ID NO: 8068677 - DNA, 22 bp, Homo sapiens
agagagcccgggccagggcaca

SEQ ID NO: 8068678 - DNA, 22 bp, Homo sapiens
agagagcccgggccagggcaca

SEQ ID NO: 8068679 - DNA, 22 bp, Homo sapiens
agagagcccgggccagggcaca

SEQ ID NO: 8068680 - DNA, 22 bp, Homo sapiens
agagaattggagcagtgacagg

SEQ ID NO: 8068681 - DNA, 22 bp, Homo sapiens
agagacaccgcgcatcatggct

SEQ ID NO: 8068682 - DNA, 22 bp, Homo sapiens
agagacaccgcgcatcatggct

SEQ ID NO: 8068683 - DNA, 22 bp, Homo sapiens
agagacacatcatataagtata

SEQ ID NO: 8068684 - DNA, 22 bp, Homo sapiens
agagacaccgcgcatcatggct

SEQ ID NO: 8068685 - DNA, 21 bp, Homo sapiens
agagacagagaaagtaacatt

SEQ ID NO: 8068686 - DNA, 21 bp, Homo sapiens
agagagaaggccatatggtcc

SEQ ID NO: 8068687 - DNA, 22 bp, Homo sapiens
agagctggctggtagccctgat

SEQ ID NO: 8068688 - DNA, 22 bp, Homo sapiens
agagctggatggtcaagatggc

SEQ ID NO: 8068689 - DNA, 22 bp, Homo sapiens
agagctgaaaaagctgacccgg

SEQ ID NO: 8068690 - DNA, 21 bp, Homo sapiens
agagcctgagatcttccagca

SEQ ID NO: 8068691 - DNA, 22 bp, Homo sapiens
agagcctgaggatgtcccagct

SEQ ID NO: 8068692 - DNA, 23 bp, Homo sapiens
agagcctgaaagacttctggcac

SEQ ID NO: 8068693 - DNA, 22 bp, Homo sapiens
agagccctttctccaggcacct

SEQ ID NO: 8068694 - DNA, 22 bp, Homo sapiens
agagccctcttcactgcccctt

SEQ ID NO: 8068695 - DNA, 22 bp, Homo sapiens
agagccctgaagcagagctaaa

SEQ ID NO: 8068696 - DNA, 22 bp, Homo sapiens
agagcagagggctctgggacaa

SEQ ID NO: 8068697 - DNA, 22 bp, Homo sapiens
agagcactgctgatttacagtc

SEQ ID NO: 8068698 - DNA, 22 bp, Homo sapiens
agagcagaggcatggccgtggg

SEQ ID NO: 8068699 - DNA, 22 bp, Homo sapiens
agagccaggcaggcaatgttga

SEQ ID NO: 8068700 - DNA, 22 bp, Homo sapiens
agagcagatggagctggaagag

SEQ ID NO: 8068701 - DNA, 22 bp, Homo sapiens
agctctgggccaggaaccctaa

SEQ ID NO: 8068702 - DNA, 22 bp, Homo sapiens
agctcttccacctcatgatggg

SEQ ID NO: 8068703 - DNA, 22 bp, Homo sapiens
agctccagcctcttctggaggt

SEQ ID NO: 8068704 - DNA, 22 bp, Homo sapiens
agctccagcccatctgctcgtg

SEQ ID NO: 8068705 - DNA, 22 bp, Homo sapiens
agctaggaaattgaggctgaga

SEQ ID NO: 8068706 - DNA, 19 bp, Homo sapiens
agcctggctttgctctgct

SEQ ID NO: 8068707 - DNA, 21 bp, Homo sapiens
agcctgggaggcggaggttgc

SEQ ID NO: 8068708 - DNA, 21 bp, Homo sapiens
agcggcagaccctgcatttga

SEQ ID NO: 8068709 - DNA, 22 bp, Homo sapiens
agcggcagcagatgtgatcagg

SEQ ID NO: 8068710 - DNA, 22 bp, Homo sapiens
agcctgggccctgcctcttctc

SEQ ID NO: 8068711 - DNA, 22 bp, Homo sapiens
agctagagctgagaagcacttg

SEQ ID NO: 8068712 - DNA, 22 bp, Homo sapiens
agctacacccctttacagtcct

SEQ ID NO: 8068713 - DNA, 22 bp, Homo sapiens
agctaagtggaaaatgcagtta

SEQ ID NO: 8068714 - DNA, 22 bp, Homo sapiens
agctaatgaacttagacctgac

SEQ ID NO: 8068715 - DNA, 22 bp, Homo sapiens
agctaatggaacagagatgtca

SEQ ID NO: 8068716 - DNA, 22 bp, Homo sapiens
agctaagagtggaagctcatct

SEQ ID NO: 8068717 - DNA, 22 bp, Homo sapiens
agccagagagtgttggagatgt

SEQ ID NO: 8068718 - DNA, 22 bp, Homo sapiens
agccagccgggggaccacagtg

SEQ ID NO: 8068719 - DNA, 22 bp, Homo sapiens
agccagccagttcactaggaaa

SEQ ID NO: 8068720 - DNA, 22 bp, Homo sapiens
agccagcatgaagacagaggcc

SEQ ID NO: 8068721 - DNA, 22 bp, Homo sapiens
agccagcaggtgagtgcagcct

SEQ ID NO: 8068722 - DNA, 22 bp, Homo sapiens
agccagcagggcttagaggaca

SEQ ID NO: 8068723 - DNA, 22 bp, Homo sapiens
agccagcagggcttagaggaca

SEQ ID NO: 8068724 - DNA, 22 bp, Homo sapiens
agccagcaggaacgtctaggtt

SEQ ID NO: 8068725 - DNA, 19 bp, Homo sapiens
agccagcagcgtagcatct

SEQ ID NO: 8068726 - DNA, 22 bp, Homo sapiens
cagagctcagagctgccaggca

SEQ ID NO: 8068727 - DNA, 22 bp, Homo sapiens
cagagctcagagctgccaggca

SEQ ID NO: 8068728 - DNA, 22 bp, Homo sapiens
cagagctcagagcagggcactc

SEQ ID NO: 8068729 - DNA, 22 bp, Homo sapiens
cagagcctttgtgtccacattt

SEQ ID NO: 8068730 - DNA, 22 bp, Homo sapiens
cagagcggccactagagggcgc

SEQ ID NO: 8068731 - DNA, 22 bp, Homo sapiens
cagagccttcctagcagactct

SEQ ID NO: 8068732 - DNA, 22 bp, Homo sapiens
agccaggccagactcacaccct

SEQ ID NO: 8068733 - DNA, 22 bp, Homo sapiens
cagagccattatggagacttgc

SEQ ID NO: 8068734 - DNA, 22 bp, Homo sapiens
cagagacccttctcagtggcca

SEQ ID NO: 8068735 - DNA, 22 bp, Homo sapiens
cagagaccctaggcaggtgaca

SEQ ID NO: 8068736 - DNA, 22 bp, Homo sapiens
cagagaccccgctgcccttctg

SEQ ID NO: 8068737 - DNA, 20 bp, Homo sapiens
cagagacccaggcttcagct

SEQ ID NO: 8068738 - DNA, 22 bp, Homo sapiens
cagagacatgtggcctgcacgt

SEQ ID NO: 8068739 - DNA, 22 bp, Homo sapiens
cagagacattaagtgccatgat

SEQ ID NO: 8068740 - DNA, 22 bp, Homo sapiens
cagagaacaaagctgagggttt

SEQ ID NO: 8068741 - DNA, 22 bp, Homo sapiens
agccagtgcaacagcagtgaag

SEQ ID NO: 8068742 - DNA, 22 bp, Homo sapiens
cagagctctatgttcatggagg

SEQ ID NO: 8068743 - DNA, 22 bp, Homo sapiens
cagagctctctttgctactaca

SEQ ID NO: 8068744 - DNA, 22 bp, Homo sapiens
agccagttctctagtgatattt

SEQ ID NO: 8068745 - DNA, 22 bp, Homo sapiens
agcccaggttgaggctgcagtg

SEQ ID NO: 8068746 - DNA, 22 bp, Homo sapiens
agccccaggatgggccgcagga

SEQ ID NO: 8068747 - DNA, 22 bp, Homo sapiens
agccccagcccctctctcacaa

SEQ ID NO: 8068748 - DNA, 22 bp, Homo sapiens
agcccaggttgaggctgcagtg

SEQ ID NO: 8068749 - DNA, 22 bp, Homo sapiens
cagatggccagaggcagctgca

SEQ ID NO: 8068750 - DNA, 22 bp, Homo sapiens
cagatgaagtaggtgacgagca

SEQ ID NO: 8068751 - DNA, 22 bp, Homo sapiens
cagatgaaggcctgaatgtcta

SEQ ID NO: 8068752 - DNA, 22 bp, Homo sapiens
agccctggcccggctgtgcttt

SEQ ID NO: 8068753 - DNA, 22 bp, Homo sapiens
agccctgcttcaccatttactt

SEQ ID NO: 8068754 - DNA, 22 bp, Homo sapiens
agcaggaagtagtctgtaagca

SEQ ID NO: 8068755 - DNA, 20 bp, Homo sapiens
agcaggaatgatgctttcat

SEQ ID NO: 8068756 - DNA, 22 bp, Homo sapiens
cacagcagaaagtgtaggagga

SEQ ID NO: 8068757 - DNA, 22 bp, Homo sapiens
caccagccccctcacgctgtca

SEQ ID NO: 8068758 - DNA, 22 bp, Homo sapiens
caccagccagagtgacagctcc

SEQ ID NO: 8068759 - DNA, 22 bp, Homo sapiens
caccagcagaagactgagggtg

SEQ ID NO: 8068760 - DNA, 22 bp, Homo sapiens
agcagggcagctgatgcgcacg

SEQ ID NO: 8068761 - DNA, 22 bp, Homo sapiens
agcagggcagctgatgcgcacg

SEQ ID NO: 8068762 - DNA, 22 bp, Homo sapiens
agcatggctttggaggatagca

SEQ ID NO: 8068763 - DNA, 22 bp, Homo sapiens
agcatggctttggaggatagca

SEQ ID NO: 8068764 - DNA, 19 bp, Homo sapiens
agcatggcctacagtgtgc

SEQ ID NO: 8068765 - DNA, 18 bp, Homo sapiens
agcatggcacaggctccc

SEQ ID NO: 8068766 - DNA, 22 bp, Homo sapiens
agcatggcactcaaggctcctg

SEQ ID NO: 8068767 - DNA, 22 bp, Homo sapiens
agcatgcaggaaccacatggca

SEQ ID NO: 8068768 - DNA, 22 bp, Homo sapiens
agcatgctatattgattgtagt

SEQ ID NO: 8068769 - DNA, 22 bp, Homo sapiens
agcagtgatgcatgacagccta

SEQ ID NO: 8068770 - DNA, 22 bp, Homo sapiens
agcagtgaaacagctgcatatg

SEQ ID NO: 8068771 - DNA, 22 bp, Homo sapiens
agcatcagagagaagttaacta

SEQ ID NO: 8068772 - DNA, 22 bp, Homo sapiens
agcatgaaaggcgtgccaactt

SEQ ID NO: 8068773 - DNA, 22 bp, Homo sapiens
agcatgaaagcataggacagtc

SEQ ID NO: 8068774 - DNA, 22 bp, Homo sapiens
agcagcagaggtcagaaaggta

SEQ ID NO: 8068775 - DNA, 22 bp, Homo sapiens
agcagcagaggtcagaaaggta

SEQ ID NO: 8068776 - DNA, 22 bp, Homo sapiens
agcagcagagctctggtctgca

SEQ ID NO: 8068777 - DNA, 22 bp, Homo sapiens
agcagcagatccaaaaaatgtg

SEQ ID NO: 8068778 - DNA, 22 bp, Homo sapiens
agcagcagatccaaaaaatgtg

SEQ ID NO: 8068779 - DNA, 22 bp, Homo sapiens
agcagcagatcaaacaggcttg

SEQ ID NO: 8068780 - DNA, 19 bp, Homo sapiens
agcagcagaagtgtgcctt

SEQ ID NO: 8068781 - DNA, 16 bp, Homo sapiens
caatacatggcatttc

SEQ ID NO: 8068782 - DNA, 22 bp, Homo sapiens
caatacatcaggtcaaaatgtg

SEQ ID NO: 8068783 - DNA, 22 bp, Homo sapiens
caatacaattaccagttaatca

SEQ ID NO: 8068784 - DNA, 21 bp, Homo sapiens
agcagcagatctggtgagggc

SEQ ID NO: 8068785 - DNA, 22 bp, Homo sapiens
agcagcccgaggatcatgtgtc

SEQ ID NO: 8068786 - DNA, 22 bp, Homo sapiens
cacagagatcggaacagaagta

SEQ ID NO: 8068787 - DNA, 21 bp, Homo sapiens
cacagagatattggtgagcct

SEQ ID NO: 8068788 - DNA, 22 bp, Homo sapiens
cacagagatggccagggcacat

SEQ ID NO: 8068789 - DNA, 22 bp, Homo sapiens
cacagagaggcttgtctccaag

SEQ ID NO: 8068790 - DNA, 22 bp, Homo sapiens
cacagagatggtctggcaggtg

SEQ ID NO: 8068791 - DNA, 22 bp, Homo sapiens
cacagagattagaattagacta

SEQ ID NO: 8068792 - DNA, 22 bp, Homo sapiens
agcagagctgggatcctgggtc

SEQ ID NO: 8068793 - DNA, 22 bp, Homo sapiens
agcagaggacagttcttaggaa

SEQ ID NO: 8068794 - DNA, 22 bp, Homo sapiens
agcagagctattcttgtgcaat

SEQ ID NO: 8068795 - DNA, 22 bp, Homo sapiens
agcagagctgcagtggcctgct

SEQ ID NO: 8068796 - DNA, 22 bp, Homo sapiens
agcagagcggggcctccggaag

SEQ ID NO: 8068797 - DNA, 22 bp, Homo sapiens
agcagagcgcctgctcagaggg

SEQ ID NO: 8068798 - DNA, 22 bp, Homo sapiens
agcagagcgcctgctcagaggg

SEQ ID NO: 8068799 - DNA, 21 bp, Homo sapiens
agcagaggggacatgtttgat

SEQ ID NO: 8068800 - DNA, 22 bp, Homo sapiens
caataatatcctgtgctgtttg

SEQ ID NO: 8068801 - DNA, 22 bp, Homo sapiens
agcacctgtggctcatgctcgt

SEQ ID NO: 8068802 - DNA, 22 bp, Homo sapiens
agcacctgtggctcatgctcgt

SEQ ID NO: 8068803 - DNA, 22 bp, Homo sapiens
caaaggctgccactgtggctgt

SEQ ID NO: 8068804 - DNA, 22 bp, Homo sapiens
caaaggcttccactgcatcctt

SEQ ID NO: 8068805 - DNA, 22 bp, Homo sapiens
caaaggcttcatctcagagcag

SEQ ID NO: 8068806 - DNA, 22 bp, Homo sapiens
caaaggctttgctatgatgcat

SEQ ID NO: 8068807 - DNA, 22 bp, Homo sapiens
agcacctgcttaatgtgcagtg

SEQ ID NO: 8068808 - DNA, 22 bp, Homo sapiens
agcacctggtctcctggcgctg

SEQ ID NO: 8068809 - DNA, 19 bp, Homo sapiens
agcacctgtgagagcctgg

SEQ ID NO: 8068810 - DNA, 22 bp, Homo sapiens
aatcttggttgcagtatatccg

SEQ ID NO: 8068811 - DNA, 22 bp, Homo sapiens
aatctttaaggactcagtctct

SEQ ID NO: 8068812 - DNA, 22 bp, Homo sapiens
aatctttccctattaaatgtgg

SEQ ID NO: 8068813 - DNA, 22 bp, Homo sapiens
aatctttttcacaagaaagcac

SEQ ID NO: 8068814 - DNA, 22 bp, Homo sapiens
aatcttttaggggatcctgagg

SEQ ID NO: 8068815 - DNA, 22 bp, Homo sapiens
aatcttttgattctagggctgt

SEQ ID NO: 8068816 - DNA, 22 bp, Homo sapiens
aatctgtattgttaacaagtaa

SEQ ID NO: 8068817 - DNA, 22 bp, Homo sapiens
agaaaataatttcttggctggt

SEQ ID NO: 8068818 - DNA, 22 bp, Homo sapiens
aatattaatagaaggggttcta

SEQ ID NO: 8068819 - DNA, 22 bp, Homo sapiens
aatatgcatgtatacatgtgta

SEQ ID NO: 8068820 - DNA, 22 bp, Homo sapiens
aatatgaattattgttacaagt

SEQ ID NO: 8068821 - DNA, 22 bp, Homo sapiens
acttccagtgtctgctgctagc

SEQ ID NO: 8068822 - DNA, 22 bp, Homo sapiens
acttcccactgcagtgactgag

SEQ ID NO: 8068823 - DNA, 22 bp, Homo sapiens
acttatcagttgtctctaatgt

SEQ ID NO: 8068824 - DNA, 22 bp, Homo sapiens
actgtggcaaagaagcaggctc

SEQ ID NO: 8068825 - DNA, 22 bp, Homo sapiens
aataaccttacttattacatgg

SEQ ID NO: 8068826 - DNA, 22 bp, Homo sapiens
aataacagattttcaagctgtg

SEQ ID NO: 8068827 - DNA, 22 bp, Homo sapiens
actgtctgccctgagatgccag

SEQ ID NO: 8068828 - DNA, 22 bp, Homo sapiens
actgtctgcaaaactcatactc

SEQ ID NO: 8068829 - DNA, 22 bp, Homo sapiens
aagtgagtggcctggagaggtg

SEQ ID NO: 8068830 - DNA, 22 bp, Homo sapiens
aagtgagattatatgtacggga

SEQ ID NO: 8068831 - DNA, 22 bp, Homo sapiens
aagtgatttgtacaaaatgtcg

SEQ ID NO: 8068832 - DNA, 22 bp, Homo sapiens
aagtgaattcattgtgttatat

SEQ ID NO: 8068833 - DNA, 22 bp, Homo sapiens
aagtgaatagcctatttactag

SEQ ID NO: 8068834 - DNA, 22 bp, Homo sapiens
aagtgaatgatgtgaagtgtaa

SEQ ID NO: 8068835 - DNA, 22 bp, Homo sapiens
aagtgaatctcctttctttatt

SEQ ID NO: 8068836 - DNA, 22 bp, Homo sapiens
acctgggagtcacacctgagaa

SEQ ID NO: 8068837 - DNA, 18 bp, Homo sapiens
acctgcctgttcttctct

SEQ ID NO: 8068838 - DNA, 22 bp, Homo sapiens
aataacagagaagggtggcttc

SEQ ID NO: 8068839 - DNA, 22 bp, Homo sapiens
aataaatgttaagattgtctca

SEQ ID NO: 8068840 - DNA, 22 bp, Homo sapiens
actgacactgactaagacagca

SEQ ID NO: 8068841 - DNA, 22 bp, Homo sapiens
actgagaaatttccagacttgc

SEQ ID NO: 8068842 - DNA, 22 bp, Homo sapiens
aataaaatggtcagttttctca

SEQ ID NO: 8068843 - DNA, 22 bp, Homo sapiens
actgagaagctcgcagtgatgc

SEQ ID NO: 8068844 - DNA, 22 bp, Homo sapiens
actgagaagctcgcagtgatgc

SEQ ID NO: 8068845 - DNA, 22 bp, Homo sapiens
aaggtgtcactgggacaggaaa

SEQ ID NO: 8068846 - DNA, 22 bp, Homo sapiens
aagtaaaacacacagtccaccg

SEQ ID NO: 8068847 - DNA, 22 bp, Homo sapiens
aagggcagctattatcgtcatc

SEQ ID NO: 8068848 - DNA, 22 bp, Homo sapiens
aagggcagcctgactcacggtc

SEQ ID NO: 8068849 - DNA, 22 bp, Homo sapiens
aagggcagctgacagatgctta

SEQ ID NO: 8068850 - DNA, 22 bp, Homo sapiens
aagggcagcttaaattggtagc

SEQ ID NO: 8068851 - DNA, 22 bp, Homo sapiens
acattctgtttccccaaagaga

SEQ ID NO: 8068852 - DNA, 22 bp, Homo sapiens
acattcttaacagttaaaaact

SEQ ID NO: 8068853 - DNA, 22 bp, Homo sapiens
acattctgtatcatctgtctca

SEQ ID NO: 8068854 - DNA, 22 bp, Homo sapiens
acatagaaatttatttcttaca

SEQ ID NO: 8068855 - DNA, 22 bp, Homo sapiens
acatgccaagatcctcgtcttt

SEQ ID NO: 8068856 - DNA, 22 bp, Homo sapiens
acataatgaaatgcagaaatca

SEQ ID NO: 8068857 - DNA, 22 bp, Homo sapiens
acatacaaatagagctgtagta

SEQ ID NO: 8068858 - DNA, 20 bp, Homo sapiens
acagatgaggaaaatgaagt

SEQ ID NO: 8068859 - DNA, 23 bp, Homo sapiens
acagcttgccaattagccttccg

SEQ ID NO: 8068860 - DNA, 22 bp, Homo sapiens
acaggcactgtcaagtcatgaa

SEQ ID NO: 8068861 - DNA, 20 bp, Homo sapiens
acaggagatctgaggaaagg

SEQ ID NO: 8068862 - DNA, 22 bp, Homo sapiens
acaggtgattcaggctctggga

SEQ ID NO: 8068863 - DNA, 22 bp, Homo sapiens
acaggtgtagcaggagcatcaa

SEQ ID NO: 8068864 - DNA, 22 bp, Homo sapiens
acaggtgtgagaacatgccttg

SEQ ID NO: 8068865 - DNA, 22 bp, Homo sapiens
acagtgctgatctagactgacc

SEQ ID NO: 8068866 - DNA, 22 bp, Homo sapiens
acagtgctgaacgacatggaag

SEQ ID NO: 8068867 - DNA, 22 bp, Homo sapiens
acagtgctaatgatgccaagat

SEQ ID NO: 8068868 - DNA, 22 bp, Homo sapiens
acagtttacagggatttgagct

SEQ ID NO: 8068869 - DNA, 22 bp, Homo sapiens
acagtgtagcatggtagcaatg

SEQ ID NO: 8068870 - DNA, 22 bp, Homo sapiens
acaggctgacttcctgccatgt

SEQ ID NO: 8068871 - DNA, 22 bp, Homo sapiens
acaggctctggggcaggatggc

SEQ ID NO: 8068872 - DNA, 22 bp, Homo sapiens
acaggcttctcacagaaaaggg

SEQ ID NO: 8068873 - DNA, 22 bp, Homo sapiens
acaggcttacaggctgcaagta

SEQ ID NO: 8068874 - DNA, 22 bp, Homo sapiens
acaggcttttttagaatgacat

SEQ ID NO: 8068875 - DNA, 21 bp, Homo sapiens
acaggctttagaaaatgactc

SEQ ID NO: 8068876 - DNA, 22 bp, Homo sapiens
acaggtgacctgctcatatgaa

SEQ ID NO: 8068877 - DNA, 22 bp, Homo sapiens
agctcagggcgatctgtctcgg

SEQ ID NO: 8068878 - DNA, 22 bp, Homo sapiens
agcctgttctggtactccaggt

SEQ ID NO: 8068879 - DNA, 22 bp, Homo sapiens
agccttagaggaaaacattagt

SEQ ID NO: 8068880 - DNA, 22 bp, Homo sapiens
agcctgttcagtccactctcca

SEQ ID NO: 8068881 - DNA, 22 bp, Homo sapiens
agcctgtggatccctgcactgg

SEQ ID NO: 8068882 - DNA, 22 bp, Homo sapiens
agcctgtgagggatgctgcagt

SEQ ID NO: 8068883 - DNA, 22 bp, Homo sapiens
agcctggccaggcctgcccagg

SEQ ID NO: 8068884 - DNA, 22 bp, Homo sapiens
agcctgcttccctttgtgcccc

SEQ ID NO: 8068885 - DNA, 22 bp, Homo sapiens
agcctgctgggaagggaggctt

SEQ ID NO: 8068886 - DNA, 22 bp, Homo sapiens
agcctgctggaccaagctcatg

SEQ ID NO: 8068887 - DNA, 21 bp, Homo sapiens
agcctggcccagggggaggct

SEQ ID NO: 8068888 - DNA, 22 bp, Homo sapiens
agccctgccctgccatgtggca

SEQ ID NO: 8068889 - DNA, 22 bp, Homo sapiens
agccctgccattctctggagct

SEQ ID NO: 8068890 - DNA, 22 bp, Homo sapiens
agccctgcacaggtctgtggct

SEQ ID NO: 8068891 - DNA, 22 bp, Homo sapiens
agccctgcacagttcgggagga

SEQ ID NO: 8068892 - DNA, 22 bp, Homo sapiens
agccctgcaggaggtgggagag

SEQ ID NO: 8068893 - DNA, 22 bp, Homo sapiens
agcccaggtccagttcactgca

SEQ ID NO: 8068894 - DNA, 22 bp, Homo sapiens
acagaacaggctgagaaaaaca

SEQ ID NO: 8068895 - DNA, 22 bp, Homo sapiens
agccaggctactccttgctgac

SEQ ID NO: 8068896 - DNA, 22 bp, Homo sapiens
agccaggaattggacaacacat

SEQ ID NO: 8068897 - DNA, 22 bp, Homo sapiens
agccaggaatgcatgctctgct

SEQ ID NO: 8068898 - DNA, 22 bp, Homo sapiens
agcatttaagcttctgcaaagc

SEQ ID NO: 8068899 - DNA, 22 bp, Homo sapiens
agcatgaaaacatgaaacagca

SEQ ID NO: 8068900 - DNA, 22 bp, Homo sapiens
agcatctggcctggttactttt

SEQ ID NO: 8068901 - DNA, 22 bp, Homo sapiens
agcagcagattcagcaggaatg

SEQ ID NO: 8068902 - DNA, 22 bp, Homo sapiens
agcagcagattatggtctacat

SEQ ID NO: 8068903 - DNA, 21 bp, Homo sapiens
agcagcaaccacatagttttt

SEQ ID NO: 8068904 - DNA, 21 bp, Homo sapiens
agcagcagcagtggggcttct

SEQ ID NO: 8068905 - DNA, 19 bp, Homo sapiens
agcagcagcaccagggatt

SEQ ID NO: 8068906 - DNA, 23 bp, Homo sapiens
agcagcagcaattaagtggatat

SEQ ID NO: 8068907 - DNA, 22 bp, Homo sapiens
agcagcagctcagttctcagct

SEQ ID NO: 8068908 - DNA, 19 bp, Homo sapiens
agcagcagctaccacttgt

SEQ ID NO: 8068909 - DNA, 22 bp, Homo sapiens
agcagcagccgtagccttatta

SEQ ID NO: 8068910 - DNA, 22 bp, Homo sapiens
agcagcagcattgagcgcttgt

SEQ ID NO: 8068911 - DNA, 22 bp, Homo sapiens
agcagcagctcattcttcctgt

SEQ ID NO: 8068912 - DNA, 22 bp, Homo sapiens
agcagcagttgctgacgttcta

SEQ ID NO: 8068913 - DNA, 22 bp, Homo sapiens
acacactgagtgccataggacc

SEQ ID NO: 8068914 - DNA, 22 bp, Homo sapiens
agcagaaaattggaaatgacaa

SEQ ID NO: 8068915 - DNA, 22 bp, Homo sapiens
agatttccgttctctcttcagt

SEQ ID NO: 8068916 - DNA, 22 bp, Homo sapiens
agcagggctttggctggctttc

SEQ ID NO: 8068917 - DNA, 22 bp, Homo sapiens
agcaggtgacagggctgtggtg

SEQ ID NO: 8068918 - DNA, 19 bp, Homo sapiens
agcatccagtcatgggatc

SEQ ID NO: 8068919 - DNA, 22 bp, Homo sapiens
agcatcagtactaatctggcca

SEQ ID NO: 8068920 - DNA, 22 bp, Homo sapiens
agcatcagcctctgtcctggag

SEQ ID NO: 8068921 - DNA, 22 bp, Homo sapiens
agcatcagcctctgtcctggag

SEQ ID NO: 8068922 - DNA, 22 bp, Homo sapiens
agcagggctttgcagacttggg

SEQ ID NO: 8068923 - DNA, 23 bp, Homo sapiens
agcaggcatctgtggcacaaggc

SEQ ID NO: 8068924 - DNA, 23 bp, Homo sapiens
agcaggcatctgtggcacaaggc

SEQ ID NO: 8068925 - DNA, 19 bp, Homo sapiens
agcaggcaggtggcccagg

SEQ ID NO: 8068926 - DNA, 22 bp, Homo sapiens
agcaggcatagagtagcactca

SEQ ID NO: 8068927 - DNA, 22 bp, Homo sapiens
agcaggagggttttgtagagtc

SEQ ID NO: 8068928 - DNA, 22 bp, Homo sapiens
agcagctgaaaggcaaacttct

SEQ ID NO: 8068929 - DNA, 17 bp, Homo sapiens
agcagctgaagcagcca

SEQ ID NO: 8068930 - DNA, 22 bp, Homo sapiens
agcagccatagatagcatgcaa

SEQ ID NO: 8068931 - DNA, 17 bp, Homo sapiens
agagagagcatgccacc

SEQ ID NO: 8068932 - DNA, 22 bp, Homo sapiens
agagacagggttttgccatgtt

SEQ ID NO: 8068933 - DNA, 22 bp, Homo sapiens
agagacagggttttgccatgtt

SEQ ID NO: 8068934 - DNA, 22 bp, Homo sapiens
agacactgaaatgtattgaaga

SEQ ID NO: 8068935 - DNA, 22 bp, Homo sapiens
agacactgaatgtttggtggtc

SEQ ID NO: 8068936 - DNA, 22 bp, Homo sapiens
agacactgagcattttcctagc

SEQ ID NO: 8068937 - DNA, 22 bp, Homo sapiens
agacactgatgttcagctcaat

SEQ ID NO: 8068938 - DNA, 22 bp, Homo sapiens
agacactgccacttctgttccc

SEQ ID NO: 8068939 - DNA, 22 bp, Homo sapiens
agacactggcactggggaagcc

SEQ ID NO: 8068940 - DNA, 22 bp, Homo sapiens
aatggaatacctaggtggccca

SEQ ID NO: 8068941 - DNA, 22 bp, Homo sapiens
aatgctgtatatcttagctaat

SEQ ID NO: 8068942 - DNA, 22 bp, Homo sapiens
agaataaatcaaatgtcctgag

SEQ ID NO: 8068943 - DNA, 22 bp, Homo sapiens
agaataaactgctttagggcag

SEQ ID NO: 8068944 - DNA, 22 bp, Homo sapiens
agaataaatgctacctatcaca

SEQ ID NO: 8068945 - DNA, 22 bp, Homo sapiens
agaataaatgttggacttagga

SEQ ID NO: 8068946 - DNA, 22 bp, Homo sapiens
agaatcaggacctgtggctgtc

SEQ ID NO: 8068947 - DNA, 22 bp, Homo sapiens
agaatcagtgctggctattagc

SEQ ID NO: 8068948 - DNA, 22 bp, Homo sapiens
agaatcctgatgaaaaggagag

SEQ ID NO: 8068949 - DNA, 22 bp, Homo sapiens
agaatctggtagaaccaaggat

SEQ ID NO: 8068950 - DNA, 22 bp, Homo sapiens
agaatctgaaggcacctctggt

SEQ ID NO: 8068951 - DNA, 20 bp, Homo sapiens
agaatctgacccagagagac

SEQ ID NO: 8068952 - DNA, 19 bp, Homo sapiens
agaggcagtctccaacagg

SEQ ID NO: 8068953 - DNA, 22 bp, Homo sapiens
agaggcagtatacaatccgagc

SEQ ID NO: 8068954 - DNA, 22 bp, Homo sapiens
agaggccaagccagactgtgca

SEQ ID NO: 8068955 - DNA, 23 bp, Homo sapiens
agaggccaacttcttgcccctcc

SEQ ID NO: 8068956 - DNA, 22 bp, Homo sapiens
aattttgtgtgggatcaaagga

SEQ ID NO: 8068957 - DNA, 22 bp, Homo sapiens
agagggcccatgttgggctgct

SEQ ID NO: 8068958 - DNA, 22 bp, Homo sapiens
agagggcattaactctgtcttg

SEQ ID NO: 8068959 - DNA, 22 bp, Homo sapiens
agagggcatgcttggtggcctg

SEQ ID NO: 8068960 - DNA, 22 bp, Homo sapiens
aatttcaagtggcatctttgat

SEQ ID NO: 8068961 - DNA, 22 bp, Homo sapiens
acaaaaaccgtggattcagcat

SEQ ID NO: 8068962 - DNA, 22 bp, Homo sapiens
agaggtgtcttgcttattgtta

SEQ ID NO: 8068963 - DNA, 22 bp, Homo sapiens
agaggtgtggccaggactcaag

SEQ ID NO: 8068964 - DNA, 21 bp, Homo sapiens
agagtaattcctgctggaaag

SEQ ID NO: 8068965 - DNA, 22 bp, Homo sapiens
agagtctgtgctttcatcagga

SEQ ID NO: 8068966 - DNA, 22 bp, Homo sapiens
agatatcacctctaggctggtg

SEQ ID NO: 8068967 - DNA, 22 bp, Homo sapiens
agatgttttggagacactaacc

SEQ ID NO: 8068968 - DNA, 22 bp, Homo sapiens
aagacagagactctgcaacagg

SEQ ID NO: 8068969 - DNA, 22 bp, Homo sapiens
aagacagagactctgcaacagg

SEQ ID NO: 8068970 - DNA, 22 bp, Homo sapiens
aagacactgatactctgtgatt

SEQ ID NO: 8068971 - DNA, 22 bp, Homo sapiens
aagaggaagtctccatggagag

SEQ ID NO: 8068972 - DNA, 20 bp, Homo sapiens
aagagctacttagcctttcc

SEQ ID NO: 8068973 - DNA, 22 bp, Homo sapiens
aacttttcattccaaaggtgct

SEQ ID NO: 8068974 - DNA, 22 bp, Homo sapiens
aagaatgagctcaaagatctta

SEQ ID NO: 8068975 - DNA, 22 bp, Homo sapiens
aagaatgattacaaagcaacga

SEQ ID NO: 8068976 - DNA, 23 bp, Homo sapiens
aagaatgcttctgaagagctgcc

SEQ ID NO: 8068977 - DNA, 22 bp, Homo sapiens
aagcagaaagaacaactgagtg

SEQ ID NO: 8068978 - DNA, 22 bp, Homo sapiens
aagcactggagatgccagagtg

SEQ ID NO: 8068979 - DNA, 18 bp, Homo sapiens
aagaggaggagcaggttg

SEQ ID NO: 8068980 - DNA, 22 bp, Homo sapiens
aagcaaagagataaccttttgg

SEQ ID NO: 8068981 - DNA, 22 bp, Homo sapiens
aagcaaagagtttagtgggtga

SEQ ID NO: 8068982 - DNA, 22 bp, Homo sapiens
aagcaaagtgaattttgccaag

SEQ ID NO: 8068983 - DNA, 17 bp, Homo sapiens
aaatatgacctcaaagt

SEQ ID NO: 8068984 - DNA, 22 bp, Homo sapiens
aaatatgaatgataagagttat

SEQ ID NO: 8068985 - DNA, 22 bp, Homo sapiens
aacacatatttatatatgcaca

SEQ ID NO: 8068986 - DNA, 22 bp, Homo sapiens
aacagctttgcttctggagaca

SEQ ID NO: 8068987 - DNA, 22 bp, Homo sapiens
aacaattgacacttcattgtga

SEQ ID NO: 8068988 - DNA, 22 bp, Homo sapiens
aacacaaagaagctgcaggatc

SEQ ID NO: 8068989 - DNA, 22 bp, Homo sapiens
aacaaatgtgttttgtaattaa

SEQ ID NO: 8068990 - DNA, 22 bp, Homo sapiens
aacatttcttctgaaactgagt

SEQ ID NO: 8068991 - DNA, 23 bp, Homo sapiens
aactgagataatgtatgtaaagc

SEQ ID NO: 8068992 - DNA, 22 bp, Homo sapiens
aactgagattacaagagacatt

SEQ ID NO: 8068993 - DNA, 22 bp, Homo sapiens
aactcagcatcctgcacagaga

SEQ ID NO: 8068994 - DNA, 22 bp, Homo sapiens
aacagtctactgaatatctgcg

SEQ ID NO: 8068995 - DNA, 22 bp, Homo sapiens
aacagtctgggagttccttata

SEQ ID NO: 8068996 - DNA, 22 bp, Homo sapiens
aacagtcttggaagtcttgtta

SEQ ID NO: 8068997 - DNA, 20 bp, Homo sapiens
aacagtaccatttatctcag

SEQ ID NO: 8068998 - DNA, 22 bp, Homo sapiens
aacatgcaatgtctgaaaatcc

SEQ ID NO: 8068999 - DNA, 22 bp, Homo sapiens
aacattcacctctacctccttc

SEQ ID NO: 8069000 - DNA, 22 bp, Homo sapiens
aacatttcattggaagctatgt

SEQ ID NO: 8069001 - DNA, 22 bp, Homo sapiens
aacatttctgagaatatcagtt

SEQ ID NO: 8069002 - DNA, 22 bp, Homo sapiens
aaaggcattttaattctaaaga

SEQ ID NO: 8069003 - DNA, 22 bp, Homo sapiens
aaagcaatggatgagaatctgt

SEQ ID NO: 8069004 - DNA, 22 bp, Homo sapiens
aaaggcatggatagtgaattca

SEQ ID NO: 8069005 - DNA, 22 bp, Homo sapiens
aaagcaatgcttgtggaatgta

SEQ ID NO: 8069006 - DNA, 23 bp, Homo sapiens
aaagatgtgagtattcatatggc

SEQ ID NO: 8069007 - DNA, 22 bp, Homo sapiens
aaagatgtcagtttgaaataac

SEQ ID NO: 8069008 - DNA, 22 bp, Homo sapiens
aaagtcattttccagaccagta

SEQ ID NO: 8069009 - DNA, 22 bp, Homo sapiens
aaagtcatttgtatataccctt

SEQ ID NO: 8069010 - DNA, 22 bp, Homo sapiens
aaacatagcacacacagctctt

SEQ ID NO: 8069011 - DNA, 22 bp, Homo sapiens
aaacatcataggcatgcatgat

SEQ ID NO: 8069012 - DNA, 22 bp, Homo sapiens
aaatgcctgtgtaaattctagc

SEQ ID NO: 8069013 - DNA, 18 bp, Homo sapiens
aaatgctaggctacatga

SEQ ID NO: 8069014 - DNA, 20 bp, Homo sapiens
aaatgctgagaagtccttaa

SEQ ID NO: 8069015 - DNA, 22 bp, Homo sapiens
aaatccaggtagtttggtttga

SEQ ID NO: 8069016 - DNA, 22 bp, Homo sapiens
aaatattagggagaacagggac

SEQ ID NO: 8069017 - DNA, 22 bp, Homo sapiens
aaatattattgcttaaggggag

SEQ ID NO: 8069018 - DNA, 22 bp, Homo sapiens
aaatcagttcacgttctgaggt

SEQ ID NO: 8069019 - DNA, 22 bp, Homo sapiens
aaatcagttctccctttcttca

SEQ ID NO: 8069020 - DNA, 22 bp, Homo sapiens
aaatactgttgaatgaagtaag

SEQ ID NO: 8069021 - DNA, 22 bp, Homo sapiens
aaatatgtaaccaaggtgaagt

SEQ ID NO: 8069022 - DNA, 22 bp, Homo sapiens
aaatatgtaaccaaggtgaagt

SEQ ID NO: 8069023 - DNA, 22 bp, Homo sapiens
aaatatgtgatcagtgaataaa

SEQ ID NO: 8069024 - DNA, 22 bp, Homo sapiens
aaatatgtgatcagtgaataaa

SEQ ID NO: 8069025 - DNA, 22 bp, Homo sapiens
aaatataatttctgcctcaata

SEQ ID NO: 8069026 - DNA, 22 bp, Homo sapiens
aaactttaagacagtcctcaag

SEQ ID NO: 8069027 - DNA, 22 bp, Homo sapiens
aaagaaggacctggaggaggat

SEQ ID NO: 8069028 - DNA, 22 bp, Homo sapiens
aaagaagatggagacctgacta

SEQ ID NO: 8069029 - DNA, 22 bp, Homo sapiens
aaagagctttagaaatctcaga

SEQ ID NO: 8069030 - DNA, 22 bp, Homo sapiens
aaacatgagcacttgcttcata

SEQ ID NO: 8069031 - DNA, 22 bp, Homo sapiens
aaacaacatggtgggtgtgtag

SEQ ID NO: 8069032 - DNA, 22 bp, Homo sapiens
aaacacaatgtttctttgttct

SEQ ID NO: 8069033 - DNA, 22 bp, Homo sapiens
aaacaaacaattagttgtgtgg

SEQ ID NO: 8069034 - DNA, 22 bp, Homo sapiens
aaacaaagcatcttgctatgca

SEQ ID NO: 8069035 - DNA, 22 bp, Homo sapiens
aaaaatgcttggacttaataaa

SEQ ID NO: 8069036 - DNA, 22 bp, Homo sapiens
aaaaatgtgaccacagggtgtt

SEQ ID NO: 8069037 - DNA, 22 bp, Homo sapiens
aaaaatgcttggacttaataaa

SEQ ID NO: 8069038 - DNA, 22 bp, Homo sapiens
acagaagcaaagactcaggcaa

SEQ ID NO: 8069039 - DNA, 22 bp, Homo sapiens
acagatcctggttacagccatt

SEQ ID NO: 8069040 - DNA, 22 bp, Homo sapiens
acagagctgtactacttactga

SEQ ID NO: 8069041 - DNA, 22 bp, Homo sapiens
acagagcttaggatgactccca

SEQ ID NO: 8069042 - DNA, 22 bp, Homo sapiens
acagaggaaggctgagctgccc

SEQ ID NO: 8069043 - DNA, 18 bp, Homo sapiens
acagaggcagacatgtat

SEQ ID NO: 8069044 - DNA, 22 bp, Homo sapiens
aagaggcagaaatatcgctgaa

SEQ ID NO: 8069045 - DNA, 22 bp, Homo sapiens
aagacatttatttgaatcaatt

SEQ ID NO: 8069046 - DNA, 22 bp, Homo sapiens
acacacaggtaaaggagcctgg

SEQ ID NO: 8069047 - DNA, 22 bp, Homo sapiens
acacacagcgcctaccatgtgc

SEQ ID NO: 8069048 - DNA, 22 bp, Homo sapiens
acacacagagtttatacaggca

SEQ ID NO: 8069049 - DNA, 22 bp, Homo sapiens
acacacagaaggaagccccact

SEQ ID NO: 8069050 - DNA, 20 bp, Homo sapiens
acacacagagacatgcgcat

SEQ ID NO: 8069051 - DNA, 22 bp, Homo sapiens
acacacaggtaaaggagcctgg

SEQ ID NO: 8069052 - DNA, 23 bp, Homo sapiens
acacctgtgctgtagtcactaca

SEQ ID NO: 8069053 - DNA, 22 bp, Homo sapiens
aagagtttaccagtgctgcttc

SEQ ID NO: 8069054 - DNA, 22 bp, Homo sapiens
aagagttatgaaagcaaggcat

SEQ ID NO: 8069055 - DNA, 22 bp, Homo sapiens
aagagtaaattcaggactttaa

SEQ ID NO: 8069056 - DNA, 22 bp, Homo sapiens
aactctttggtctcaggaaagg

SEQ ID NO: 8069057 - DNA, 22 bp, Homo sapiens
aactccttaatgcatttcagag

SEQ ID NO: 8069058 - DNA, 22 bp, Homo sapiens
aatgtcttgagaagagaaatct

SEQ ID NO: 8069059 - DNA, 22 bp, Homo sapiens
aatgtctttaaagtgcaataga

SEQ ID NO: 8069060 - DNA, 22 bp, Homo sapiens
aactttctagagatgagttcgg

SEQ ID NO: 8069061 - DNA, 22 bp, Homo sapiens
aactttattgttaggggctaaa

SEQ ID NO: 8069062 - DNA, 22 bp, Homo sapiens
aatgttttgtatgcctctgagc

SEQ ID NO: 8069063 - DNA, 22 bp, Homo sapiens
aatgttatgtggttcaacttaa

SEQ ID NO: 8069064 - DNA, 22 bp, Homo sapiens
aatgttacgatcaacaacacat

SEQ ID NO: 8069065 - DNA, 22 bp, Homo sapiens
aatgtgaaaccgcacagaataa

SEQ ID NO: 8069066 - DNA, 22 bp, Homo sapiens
aattagaagggagttattgata

SEQ ID NO: 8069067 - DNA, 22 bp, Homo sapiens
aattcaaagactagaattttgc

SEQ ID NO: 8069068 - DNA, 22 bp, Homo sapiens
aattcaaattacaatagttgtt

SEQ ID NO: 8069069 - DNA, 17 bp, Homo sapiens
aagacaagacaaatgca

SEQ ID NO: 8069070 - DNA, 22 bp, Homo sapiens
aagacaagcatcaaatcaggca

SEQ ID NO: 8069071 - DNA, 22 bp, Homo sapiens
aagacaagcatcaaatcaggca

SEQ ID NO: 8069072 - DNA, 22 bp, Homo sapiens
aaggagaaatggtagatgtgca

SEQ ID NO: 8069073 - DNA, 22 bp, Homo sapiens
aagcccagatgagatccctgga

SEQ ID NO: 8069074 - DNA, 22 bp, Homo sapiens
aagccatttgttgtccttcagg

SEQ ID NO: 8069075 - DNA, 22 bp, Homo sapiens
aagctggcaattatcaaaactg

SEQ ID NO: 8069076 - DNA, 22 bp, Homo sapiens
aagccagcattttcccattcct

SEQ ID NO: 8069077 - DNA, 22 bp, Homo sapiens
aagccagccagtgccagtctta

SEQ ID NO: 8069078 - DNA, 22 bp, Homo sapiens
aagggagacagttgtgtgagga

SEQ ID NO: 8069079 - DNA, 22 bp, Homo sapiens
aaggggcacaattgtacccaag

SEQ ID NO: 8069080 - DNA, 22 bp, Homo sapiens
aaggggagttagtgataaaacc

SEQ ID NO: 8069081 - DNA, 21 bp, Homo sapiens
aagggagataggaatcaggcc

SEQ ID NO: 8069082 - DNA, 22 bp, Homo sapiens
aagggaggaggatttattgtac

SEQ ID NO: 8069083 - DNA, 22 bp, Homo sapiens
aacaataggacctttatgttct

SEQ ID NO: 8069084 - DNA, 22 bp, Homo sapiens
aaggggctcttgtcaggcgcag

SEQ ID NO: 8069085 - DNA, 22 bp, Homo sapiens
aacaatgctgaactgaggaaag

SEQ ID NO: 8069086 - DNA, 22 bp, Homo sapiens
aacaatgccaacagcatgctgg

SEQ ID NO: 8069087 - DNA, 22 bp, Homo sapiens
aacaatgcactatcgtaagtgg

SEQ ID NO: 8069088 - DNA, 22 bp, Homo sapiens
aagttgagatgtcataggagac

SEQ ID NO: 8069089 - DNA, 22 bp, Homo sapiens
aagttgagatgtcataggagac

SEQ ID NO: 8069090 - DNA, 22 bp, Homo sapiens
aagtcaagtgttattattgtag

SEQ ID NO: 8069091 - DNA, 22 bp, Homo sapiens
aataaaatggtcagttttctca

SEQ ID NO: 8069092 - DNA, 18 bp, Homo sapiens
aacagtttccagattctc

SEQ ID NO: 8069093 - DNA, 22 bp, Homo sapiens
aatcactttgcactcttatttg

SEQ ID NO: 8069094 - DNA, 22 bp, Homo sapiens
aatcagaaaattcagtggaatt

SEQ ID NO: 8069095 - DNA, 22 bp, Homo sapiens
aatcacatttacattgctaatt

SEQ ID NO: 8069096 - DNA, 22 bp, Homo sapiens
aacatttcagcaaataagaaca

SEQ ID NO: 8069097 - DNA, 22 bp, Homo sapiens
aacatttcagcacctgattcct

SEQ ID NO: 8069098 - DNA, 21 bp, Homo sapiens
aacatttcaggatccaaattg

SEQ ID NO: 8069099 - DNA, 22 bp, Homo sapiens
aatatttgcatcattagctatt

SEQ ID NO: 8069100 - DNA, 20 bp, Homo sapiens
aacattgtttgtaaaagcag

SEQ ID NO: 8069101 - DNA, 22 bp, Homo sapiens
aacattgcattctctatgagat

SEQ ID NO: 8069102 - DNA, 22 bp, Homo sapiens
aacattgctgaaagctgggaca

SEQ ID NO: 8069103 - DNA, 22 bp, Homo sapiens
aacataaatttgaagtggcaaa

SEQ ID NO: 8069104 - DNA, 22 bp, Homo sapiens
aacattctttagctcttcctgc

SEQ ID NO: 8069105 - DNA, 22 bp, Homo sapiens
tccagggagcaagtcaggccgg

SEQ ID NO: 8069106 - DNA, 22 bp, Homo sapiens
tccagggatctttagagtcttt

SEQ ID NO: 8069107 - DNA, 23 bp, Homo sapiens
tccagggattaatgaagtcagtc

SEQ ID NO: 8069108 - DNA, 22 bp, Homo sapiens
tccagggatgtcctgtagcact

SEQ ID NO: 8069109 - DNA, 22 bp, Homo sapiens
tccagggatgccagccatgttg

SEQ ID NO: 8069110 - DNA, 22 bp, Homo sapiens
tccagggatggtaatgagcagt

SEQ ID NO: 8069111 - DNA, 18 bp, Homo sapiens
tccagtcccagctctgcc

SEQ ID NO: 8069112 - DNA, 22 bp, Homo sapiens
tccagtggcactggagactaga

SEQ ID NO: 8069113 - DNA, 22 bp, Homo sapiens
tccagtggagtgtgggggtgaa

SEQ ID NO: 8069114 - DNA, 22 bp, Homo sapiens
tccagtggtagtaaagaggtct

SEQ ID NO: 8069115 - DNA, 22 bp, Homo sapiens
tccagtggtacatggagacact

SEQ ID NO: 8069116 - DNA, 22 bp, Homo sapiens
tccagtggtttgaaaggggtgt

SEQ ID NO: 8069117 - DNA, 22 bp, Homo sapiens
tccagtggtggtttgaagggca

SEQ ID NO: 8069118 - DNA, 22 bp, Homo sapiens
tccagtgggttgctgagggagg

SEQ ID NO: 8069119 - DNA, 22 bp, Homo sapiens
tccagtcctatctgcccttgga

SEQ ID NO: 8069120 - DNA, 22 bp, Homo sapiens
tccagggacagcgctggagcta

SEQ ID NO: 8069121 - DNA, 22 bp, Homo sapiens
tccagggacctccctgagagct

SEQ ID NO: 8069122 - DNA, 22 bp, Homo sapiens
tccagggagatggcagaggctg

SEQ ID NO: 8069123 - DNA, 22 bp, Homo sapiens
tccagggagatactggctgcca

SEQ ID NO: 8069124 - DNA, 22 bp, Homo sapiens
tccagggagatactggctgcca

SEQ ID NO: 8069125 - DNA, 22 bp, Homo sapiens
tccagggagagccgctgctcca

SEQ ID NO: 8069126 - DNA, 22 bp, Homo sapiens
tccagggagagccgctgctcca

SEQ ID NO: 8069127 - DNA, 22 bp, Homo sapiens
tcccactgagcccctgctggtg

SEQ ID NO: 8069128 - DNA, 22 bp, Homo sapiens
tccagtgtgtgtccagctgctg

SEQ ID NO: 8069129 - DNA, 22 bp, Homo sapiens
tccagtgtacaaaagctatctt

SEQ ID NO: 8069130 - DNA, 19 bp, Homo sapiens
tccagtgtagctggtcatt

SEQ ID NO: 8069131 - DNA, 22 bp, Homo sapiens
tcccactgtcttctcgtgctcg

SEQ ID NO: 8069132 - DNA, 22 bp, Homo sapiens
tcccactgtctgtcttgctgca

SEQ ID NO: 8069133 - DNA, 22 bp, Homo sapiens
tcccactgtgaatccaaggcct

SEQ ID NO: 8069134 - DNA, 22 bp, Homo sapiens
tcccactggacgtctgtgctgg

SEQ ID NO: 8069135 - DNA, 22 bp, Homo sapiens
tcccactgctttgctctgctca

SEQ ID NO: 8069136 - DNA, 22 bp, Homo sapiens
tcccagagtgtgggcatcaagg

SEQ ID NO: 8069137 - DNA, 22 bp, Homo sapiens
tcccagcgcggggggaggatcc

SEQ ID NO: 8069138 - DNA, 22 bp, Homo sapiens
tcccagattcttctgtgtgggc

SEQ ID NO: 8069139 - DNA, 22 bp, Homo sapiens
tcccagcctttcttttctgctg

SEQ ID NO: 8069140 - DNA, 22 bp, Homo sapiens
tccagcccatccctagcctggg

SEQ ID NO: 8069141 - DNA, 22 bp, Homo sapiens
tccagcccatccctagcctggg

SEQ ID NO: 8069142 - DNA, 22 bp, Homo sapiens
tccagcccctcctgagccaagc

SEQ ID NO: 8069143 - DNA, 22 bp, Homo sapiens
tccagaaatgcaagccaggtgt

SEQ ID NO: 8069144 - DNA, 22 bp, Homo sapiens
tccagaaaattttacagtgcct

SEQ ID NO: 8069145 - DNA, 22 bp, Homo sapiens
tccagcccgactgggcctgccg

SEQ ID NO: 8069146 - DNA, 22 bp, Homo sapiens
tccagccctctggcccgcggtg

SEQ ID NO: 8069147 - DNA, 17 bp, Homo sapiens
tccagccctgcccgacg

SEQ ID NO: 8069148 - DNA, 22 bp, Homo sapiens
tccagccttccttttcactctc

SEQ ID NO: 8069149 - DNA, 19 bp, Homo sapiens
tccagcctgctgtttctct

SEQ ID NO: 8069150 - DNA, 22 bp, Homo sapiens
tccagcctgaactttgtccaga

SEQ ID NO: 8069151 - DNA, 23 bp, Homo sapiens
tccagcctcttgctctcacatgc

SEQ ID NO: 8069152 - DNA, 21 bp, Homo sapiens
tccagcctttccctcacttcc

SEQ ID NO: 8069153 - DNA, 20 bp, Homo sapiens
tccaggagaactgggagccg

SEQ ID NO: 8069154 - DNA, 22 bp, Homo sapiens
tccaggaggaggaaggctgcca

SEQ ID NO: 8069155 - DNA, 22 bp, Homo sapiens
tccacacttgctgtctgctgag

SEQ ID NO: 8069156 - DNA, 21 bp, Homo sapiens
tccacaatagggaaattcacc

SEQ ID NO: 8069157 - DNA, 22 bp, Homo sapiens
tccacaatggcagagaaatgtc

SEQ ID NO: 8069158 - DNA, 20 bp, Homo sapiens
tcatgtgtgtcctacagaga

SEQ ID NO: 8069159 - DNA, 22 bp, Homo sapiens
tccacgctgtgtgaccttgggc

SEQ ID NO: 8069160 - DNA, 22 bp, Homo sapiens
tccacgtgagcttcgtgtgcag

SEQ ID NO: 8069161 - DNA, 22 bp, Homo sapiens
tccacgtgagcttcgtgtgcag

SEQ ID NO: 8069162 - DNA, 22 bp, Homo sapiens
tccctttggatccaagcttatg

SEQ ID NO: 8069163 - DNA, 22 bp, Homo sapiens
tccgcccgcacgtatggagtgg

SEQ ID NO: 8069164 - DNA, 22 bp, Homo sapiens
tcctcctctatcagacagtgcc

SEQ ID NO: 8069165 - DNA, 22 bp, Homo sapiens
tccctggggatgttggcctgcc

SEQ ID NO: 8069166 - DNA, 22 bp, Homo sapiens
tccctgggcctcctgctatgca

SEQ ID NO: 8069167 - DNA, 19 bp, Homo sapiens
tcccttcctgtcgggctcc

SEQ ID NO: 8069168 - DNA, 22 bp, Homo sapiens
tcccttcatcagtgagcaagcc

SEQ ID NO: 8069169 - DNA, 22 bp, Homo sapiens
tccctgggccacagctgtgagc

SEQ ID NO: 8069170 - DNA, 22 bp, Homo sapiens
tccctgggcatcacgttgcttc

SEQ ID NO: 8069171 - DNA, 22 bp, Homo sapiens
tcccaggattttaggctctcag

SEQ ID NO: 8069172 - DNA, 22 bp, Homo sapiens
tccctgagggcagctcaagtcc

SEQ ID NO: 8069173 - DNA, 22 bp, Homo sapiens
tcagaggaataatgctgcattt

SEQ ID NO: 8069174 - DNA, 22 bp, Homo sapiens
tcagaggacaagctccctggtg

SEQ ID NO: 8069175 - DNA, 22 bp, Homo sapiens
tcagaggaccttactgagaacc

SEQ ID NO: 8069176 - DNA, 22 bp, Homo sapiens
tcagaggattgcctcagcgagc

SEQ ID NO: 8069177 - DNA, 19 bp, Homo sapiens
tcagaggatttggctatga

SEQ ID NO: 8069178 - DNA, 22 bp, Homo sapiens
tcagaggagaagttgggaaaat

SEQ ID NO: 8069179 - DNA, 22 bp, Homo sapiens
tcagaggacgcactagggttgt

SEQ ID NO: 8069180 - DNA, 20 bp, Homo sapiens
tcagaggctgccagctgggg

SEQ ID NO: 8069181 - DNA, 22 bp, Homo sapiens
tcagaagcatgtggggagcctg

SEQ ID NO: 8069182 - DNA, 22 bp, Homo sapiens
tcagaagcatgtggggagcctg

SEQ ID NO: 8069183 - DNA, 22 bp, Homo sapiens
tcagaagcaggagtgtgcacaa

SEQ ID NO: 8069184 - DNA, 22 bp, Homo sapiens
tcagagaagtaaggtggggtgc

SEQ ID NO: 8069185 - DNA, 22 bp, Homo sapiens
tcagagaagtaaggtggggtgc

SEQ ID NO: 8069186 - DNA, 23 bp, Homo sapiens
tcagagaagttgtaggctgggga

SEQ ID NO: 8069187 - DNA, 23 bp, Homo sapiens
tcagagaagttgtaggctgggga

SEQ ID NO: 8069188 - DNA, 22 bp, Homo sapiens
tcagagacaccagagagctgtg

SEQ ID NO: 8069189 - DNA, 22 bp, Homo sapiens
tcagaacattacattttgagct

SEQ ID NO: 8069190 - DNA, 22 bp, Homo sapiens
tcagaacattctcattgactgc

SEQ ID NO: 8069191 - DNA, 22 bp, Homo sapiens
tcagaacatttaaaaagtggtt

SEQ ID NO: 8069192 - DNA, 22 bp, Homo sapiens
tcagaacattgacattcttatt

SEQ ID NO: 8069193 - DNA, 22 bp, Homo sapiens
tcagaagcaaacatcactctag

SEQ ID NO: 8069194 - DNA, 22 bp, Homo sapiens
tcagaagagctggtgctgcctg

SEQ ID NO: 8069195 - DNA, 22 bp, Homo sapiens
tcagaacatatattttgtgatg

SEQ ID NO: 8069196 - DNA, 23 bp, Homo sapiens
tcagaacagttcttggtgcatag

SEQ ID NO: 8069197 - DNA, 22 bp, Homo sapiens
tcactggggcctttggtcagga

SEQ ID NO: 8069198 - DNA, 22 bp, Homo sapiens
tcactaaagttggagaagagct

SEQ ID NO: 8069199 - DNA, 23 bp, Homo sapiens
tcactaaagtgtttagtgcagat

SEQ ID NO: 8069200 - DNA, 22 bp, Homo sapiens
tcactgggagatgtgggaaggg

SEQ ID NO: 8069201 - DNA, 21 bp, Homo sapiens
tcacgtggtcacatgagcttt

SEQ ID NO: 8069202 - DNA, 22 bp, Homo sapiens
tcaccttgtgatctccctgcct

SEQ ID NO: 8069203 - DNA, 22 bp, Homo sapiens
tcacctgggagggctgtggtag

SEQ ID NO: 8069204 - DNA, 22 bp, Homo sapiens
tcaccgaggctggagtgcagtg

SEQ ID NO: 8069205 - DNA, 22 bp, Homo sapiens
tcaaaagtttcacatagagata

SEQ ID NO: 8069206 - DNA, 22 bp, Homo sapiens
tcaaaagtggcctgtaaaatct

SEQ ID NO: 8069207 - DNA, 23 bp, Homo sapiens
tcaaacatattgtgagacacagg

SEQ ID NO: 8069208 - DNA, 22 bp, Homo sapiens
tcaaacatgttagcagtctgtg

SEQ ID NO: 8069209 - DNA, 22 bp, Homo sapiens
tcaaacagaggaacaattgttt

SEQ ID NO: 8069210 - DNA, 22 bp, Homo sapiens
tcaaacaggactacattctcat

SEQ ID NO: 8069211 - DNA, 22 bp, Homo sapiens
tcaatacttaagcttaattcta

SEQ ID NO: 8069212 - DNA, 22 bp, Homo sapiens
tcaatacatacaatgtatagtg

SEQ ID NO: 8069213 - DNA, 22 bp, Homo sapiens
tcacacagcagccccgggtgtt

SEQ ID NO: 8069214 - DNA, 22 bp, Homo sapiens
tcacacagctcctttccttagt

SEQ ID NO: 8069215 - DNA, 23 bp, Homo sapiens
tcacacagctggtcaggtacaga

SEQ ID NO: 8069216 - DNA, 22 bp, Homo sapiens
tcaatgtgaattaagaatactt

SEQ ID NO: 8069217 - DNA, 22 bp, Homo sapiens
tcacagagagtgacttgttgct

SEQ ID NO: 8069218 - DNA, 22 bp, Homo sapiens
tcacagcaaatgctgcttctca

SEQ ID NO: 8069219 - DNA, 20 bp, Homo sapiens
tcacagagtagccttgtctg

SEQ ID NO: 8069220 - DNA, 22 bp, Homo sapiens
tcacagagttaaaagtttcttt

SEQ ID NO: 8069221 - DNA, 22 bp, Homo sapiens
tcacagacaattgttttggtgt

SEQ ID NO: 8069222 - DNA, 22 bp, Homo sapiens
tcacagaatttttgcttccagt

SEQ ID NO: 8069223 - DNA, 22 bp, Homo sapiens
tcacacaggtttgcaatgattt

SEQ ID NO: 8069224 - DNA, 22 bp, Homo sapiens
tcacacagtgagaaagtgcgga

SEQ ID NO: 8069225 - DNA, 22 bp, Homo sapiens
tcacacagggtcggaaagagtg

SEQ ID NO: 8069226 - DNA, 22 bp, Homo sapiens
tcacagcaccctgaggtgctgg

SEQ ID NO: 8069227 - DNA, 22 bp, Homo sapiens
tcacagctaagcttggtcactg

SEQ ID NO: 8069228 - DNA, 22 bp, Homo sapiens
tcacagcctggtcactctgccc

SEQ ID NO: 8069229 - DNA, 22 bp, Homo sapiens
tcacatcaacattatagcatga

SEQ ID NO: 8069230 - DNA, 22 bp, Homo sapiens
tcacatcattaagacttctcct

SEQ ID NO: 8069231 - DNA, 22 bp, Homo sapiens
tcagccagttaaggcttagaca

SEQ ID NO: 8069232 - DNA, 22 bp, Homo sapiens
tcagccagtgtgcacctggagt

SEQ ID NO: 8069233 - DNA, 22 bp, Homo sapiens
tcagccagtgccttgatcttgc

SEQ ID NO: 8069234 - DNA, 22 bp, Homo sapiens
tcagccagttgccccagttagt

SEQ ID NO: 8069235 - DNA, 22 bp, Homo sapiens
tcagccagttaagtcaagaaat

SEQ ID NO: 8069236 - DNA, 22 bp, Homo sapiens
tcagccagtttgattctatttg

SEQ ID NO: 8069237 - DNA, 22 bp, Homo sapiens
tcagccagtttgtttattccgg

SEQ ID NO: 8069238 - DNA, 22 bp, Homo sapiens
tcagcctacactccaacagcat

SEQ ID NO: 8069239 - DNA, 22 bp, Homo sapiens
tcagcctctctgagtccagacc

SEQ ID NO: 8069240 - DNA, 22 bp, Homo sapiens
tcagcctctctgagtccagacc

SEQ ID NO: 8069241 - DNA, 22 bp, Homo sapiens
tcagcttggacagcttggttga

SEQ ID NO: 8069242 - DNA, 22 bp, Homo sapiens
tcagccagggcagagcaggtga

SEQ ID NO: 8069243 - DNA, 22 bp, Homo sapiens
tcagccaggccctaagagattg

SEQ ID NO: 8069244 - DNA, 22 bp, Homo sapiens
tcagccaggccaggcattcaca

SEQ ID NO: 8069245 - DNA, 22 bp, Homo sapiens
tcagccaggtaatgtggagatg

SEQ ID NO: 8069246 - DNA, 22 bp, Homo sapiens
tcagccaggtaatgtggagatg

SEQ ID NO: 8069247 - DNA, 22 bp, Homo sapiens
tcagccagggggagagaatgga

SEQ ID NO: 8069248 - DNA, 22 bp, Homo sapiens
tcagccagggctctggcctcag

SEQ ID NO: 8069249 - DNA, 22 bp, Homo sapiens
tcagccagtgccttgatcttgc

SEQ ID NO: 8069250 - DNA, 22 bp, Homo sapiens
tcagccagtatttgagtgctca

SEQ ID NO: 8069251 - DNA, 22 bp, Homo sapiens
tcagagtcattgcaagtagaag

SEQ ID NO: 8069252 - DNA, 20 bp, Homo sapiens
tcagagtcatcaaagatggt

SEQ ID NO: 8069253 - DNA, 22 bp, Homo sapiens
tcagagtctcccccagtttggg

SEQ ID NO: 8069254 - DNA, 17 bp, Homo sapiens
tcagagggatgagcagg

SEQ ID NO: 8069255 - DNA, 22 bp, Homo sapiens
tcagaggtagtagcagagttga

SEQ ID NO: 8069256 - DNA, 22 bp, Homo sapiens
tcagagggtggctgggagcatc

SEQ ID NO: 8069257 - DNA, 22 bp, Homo sapiens
tcaggcagatgcagggatggat

SEQ ID NO: 8069258 - DNA, 22 bp, Homo sapiens
tcaggcagatgcagggatggat

SEQ ID NO: 8069259 - DNA, 22 bp, Homo sapiens
tcaggcagctccaggaatggta

SEQ ID NO: 8069260 - DNA, 22 bp, Homo sapiens
tcaggcagcattaaacttcagc

SEQ ID NO: 8069261 - DNA, 22 bp, Homo sapiens
tcaggcaggaagcccctgcaca

SEQ ID NO: 8069262 - DNA, 22 bp, Homo sapiens
tcaggcaggatcccagggaagg

SEQ ID NO: 8069263 - DNA, 22 bp, Homo sapiens
tcaggcaggcagagggcaaatg

SEQ ID NO: 8069264 - DNA, 22 bp, Homo sapiens
tcaggcaggcagagggcaaatg

SEQ ID NO: 8069265 - DNA, 21 bp, Homo sapiens
tcaggcaggcgcagagggaag

SEQ ID NO: 8069266 - DNA, 21 bp, Homo sapiens
tcaggcaggcgcagagggaag

SEQ ID NO: 8069267 - DNA, 22 bp, Homo sapiens
tcaggcaggttggctgcaggtc

SEQ ID NO: 8069268 - DNA, 22 bp, Homo sapiens
tcaggcagtagaattgcttgaa

SEQ ID NO: 8069269 - DNA, 22 bp, Homo sapiens
tcaggcaggtggctggctatgg

SEQ ID NO: 8069270 - DNA, 22 bp, Homo sapiens
tcaggcaggctcagaggaaaac

SEQ ID NO: 8069271 - DNA, 21 bp, Homo sapiens
tcaggcaggtcccactgaaca

SEQ ID NO: 8069272 - DNA, 22 bp, Homo sapiens
tcaggaaagagttagatgatta

SEQ ID NO: 8069273 - DNA, 22 bp, Homo sapiens
tcaggaaaggtttgttgaatgg

SEQ ID NO: 8069274 - DNA, 22 bp, Homo sapiens
tcaggagatgtaaccttagctg

SEQ ID NO: 8069275 - DNA, 22 bp, Homo sapiens
tcaggagcagcatgggtgagag

SEQ ID NO: 8069276 - DNA, 22 bp, Homo sapiens
tcaggagcctgaaagaggtcta

SEQ ID NO: 8069277 - DNA, 22 bp, Homo sapiens
tcaggagcagggggaagctctg

SEQ ID NO: 8069278 - DNA, 22 bp, Homo sapiens
tcaggagctcaggctgatggaa

SEQ ID NO: 8069279 - DNA, 22 bp, Homo sapiens
tcaggagctcaggctgatggaa

SEQ ID NO: 8069280 - DNA, 22 bp, Homo sapiens
tcagggcaaaagggaaaccatt

SEQ ID NO: 8069281 - DNA, 22 bp, Homo sapiens
tcagggacttacaaaccagaag

SEQ ID NO: 8069282 - DNA, 22 bp, Homo sapiens
tcagggactaggtgctgcctga

SEQ ID NO: 8069283 - DNA, 22 bp, Homo sapiens
tcagggactgcagagggaagct

SEQ ID NO: 8069284 - DNA, 22 bp, Homo sapiens
tcaggctgaggtcatctgcatc

SEQ ID NO: 8069285 - DNA, 22 bp, Homo sapiens
tcaggctgagaaaatctggacc

SEQ ID NO: 8069286 - DNA, 22 bp, Homo sapiens
tcagggcaaagggcagagtttg

SEQ ID NO: 8069287 - DNA, 22 bp, Homo sapiens
tcagggcaagattggttaataa

SEQ ID NO: 8069288 - DNA, 22 bp, Homo sapiens
tcagggcaagtctcagaaggtt

SEQ ID NO: 8069289 - DNA, 22 bp, Homo sapiens
tcagggcaccaaaaaagatgcc

SEQ ID NO: 8069290 - DNA, 22 bp, Homo sapiens
tcagggcacattctgcagtggc

SEQ ID NO: 8069291 - DNA, 22 bp, Homo sapiens
tcagggcaatgtccctcagaag

SEQ ID NO: 8069292 - DNA, 22 bp, Homo sapiens
tcagggcacaggcctgtgggtt

SEQ ID NO: 8069293 - DNA, 22 bp, Homo sapiens
tcaggctaaccctaggcagaag

SEQ ID NO: 8069294 - DNA, 22 bp, Homo sapiens
tcagggcagaatccaaagaatt

SEQ ID NO: 8069295 - DNA, 22 bp, Homo sapiens
tcagggcagcctaaggcacctc

SEQ ID NO: 8069296 - DNA, 21 bp, Homo sapiens
tcagggcagctgctcttcaga

SEQ ID NO: 8069297 - DNA, 22 bp, Homo sapiens
tcaggggaggttgaatcgtctc

SEQ ID NO: 8069298 - DNA, 22 bp, Homo sapiens
tcaggggacttaggagagaagt

SEQ ID NO: 8069299 - DNA, 22 bp, Homo sapiens
tcaggggacagccagctggagg

SEQ ID NO: 8069300 - DNA, 22 bp, Homo sapiens
tcaggggaaatctctcagcgaa

SEQ ID NO: 8069301 - DNA, 21 bp, Homo sapiens
tcaggggctgtgttttccatc

SEQ ID NO: 8069302 - DNA, 22 bp, Homo sapiens
tcaggggctgtgcatttcccag

SEQ ID NO: 8069303 - DNA, 22 bp, Homo sapiens
tcaggggcccttccctcagcag

SEQ ID NO: 8069304 - DNA, 22 bp, Homo sapiens
tcagtggatatttctgtggctg

SEQ ID NO: 8069305 - DNA, 22 bp, Homo sapiens
tcagtggagctaagcatgagat

SEQ ID NO: 8069306 - DNA, 22 bp, Homo sapiens
tcagtggattgtagaaggctta

SEQ ID NO: 8069307 - DNA, 22 bp, Homo sapiens
tcagtttctaaatcttaccaat

SEQ ID NO: 8069308 - DNA, 22 bp, Homo sapiens
tcagtttcttcatctccctaac

SEQ ID NO: 8069309 - DNA, 22 bp, Homo sapiens
tcagtttctccatcgctccagt

SEQ ID NO: 8069310 - DNA, 22 bp, Homo sapiens
tcagtttgctcataggtgaggg

SEQ ID NO: 8069311 - DNA, 22 bp, Homo sapiens
tcataaaaatagactctaaagt

SEQ ID NO: 8069312 - DNA, 22 bp, Homo sapiens
tcataaaaatagactctaaagt

SEQ ID NO: 8069313 - DNA, 22 bp, Homo sapiens
tcatccagtaccatggaaggca

SEQ ID NO: 8069314 - DNA, 22 bp, Homo sapiens
tcatccagtaccatggaaggca

SEQ ID NO: 8069315 - DNA, 20 bp, Homo sapiens
tcatccaggacaggagtggc

SEQ ID NO: 8069316 - DNA, 22 bp, Homo sapiens
tcatccagcctcatcaggagct

SEQ ID NO: 8069317 - DNA, 23 bp, Homo sapiens
tcatcaaacagctgctcaagaaa

SEQ ID NO: 8069318 - DNA, 22 bp, Homo sapiens
tcataaaatgctcctgatattg

SEQ ID NO: 8069319 - DNA, 22 bp, Homo sapiens
tcataaaatgctcctgatattg

SEQ ID NO: 8069320 - DNA, 22 bp, Homo sapiens
tcataaaagtactcatgttcat

SEQ ID NO: 8069321 - DNA, 20 bp, Homo sapiens
tcataaagaggaaataaata

SEQ ID NO: 8069322 - DNA, 22 bp, Homo sapiens
tcataaagcatttcagcttttg

SEQ ID NO: 8069323 - DNA, 22 bp, Homo sapiens
tcataaagctcttccaaatgta

SEQ ID NO: 8069324 - DNA, 22 bp, Homo sapiens
tcatcccagtgtccatgctcag

SEQ ID NO: 8069325 - DNA, 22 bp, Homo sapiens
tcatcccagaccacttattttc

SEQ ID NO: 8069326 - DNA, 22 bp, Homo sapiens
tcatccagttgtggagagggaa

SEQ ID NO: 8069327 - DNA, 22 bp, Homo sapiens
tcatccagttcacatggtgagt

SEQ ID NO: 8069328 - DNA, 22 bp, Homo sapiens
tcatccttttgcatgggaaggc

SEQ ID NO: 8069329 - DNA, 22 bp, Homo sapiens
tcatctctagacaggaggctgg

SEQ ID NO: 8069330 - DNA, 22 bp, Homo sapiens
tattcacattctcaggcctggt

SEQ ID NO: 8069331 - DNA, 22 bp, Homo sapiens
tattgagttacagaaaatactt

SEQ ID NO: 8069332 - DNA, 22 bp, Homo sapiens
tattcacatgtacatatgctca

SEQ ID NO: 8069333 - DNA, 22 bp, Homo sapiens
tattcacatgaaaacaaatttt

SEQ ID NO: 8069334 - DNA, 22 bp, Homo sapiens
tattcacaggctggagtgatgt

SEQ ID NO: 8069335 - DNA, 22 bp, Homo sapiens
tattcacaaaatgaggtcctca

SEQ ID NO: 8069336 - DNA, 22 bp, Homo sapiens
tattcacagctgccgcactcag

SEQ ID NO: 8069337 - DNA, 22 bp, Homo sapiens
tatgctaatgacactctagaaa

SEQ ID NO: 8069338 - DNA, 22 bp, Homo sapiens
tatgctaaatatgttcacattg

SEQ ID NO: 8069339 - DNA, 22 bp, Homo sapiens
tatgtttacgctggtagaatta

SEQ ID NO: 8069340 - DNA, 22 bp, Homo sapiens
tatgttcagaagaagaatgggg

SEQ ID NO: 8069341 - DNA, 22 bp, Homo sapiens
tatgttattttcatacaacaga

SEQ ID NO: 8069342 - DNA, 22 bp, Homo sapiens
tatttccagcagtaagaagaca

SEQ ID NO: 8069343 - DNA, 22 bp, Homo sapiens
tatttgtcactagaaagggtaa

SEQ ID NO: 8069344 - DNA, 22 bp, Homo sapiens
tatctttagaggaagagaatct

SEQ ID NO: 8069345 - DNA, 22 bp, Homo sapiens
tatctttaacttgcagtattta

SEQ ID NO: 8069346 - DNA, 22 bp, Homo sapiens
tatctataatgttttacttcct

SEQ ID NO: 8069347 - DNA, 22 bp, Homo sapiens
tatcaaaggctatgtgattttt

SEQ ID NO: 8069348 - DNA, 22 bp, Homo sapiens
tatcaaagttgtcctgtgaagt

SEQ ID NO: 8069349 - DNA, 19 bp, Homo sapiens
tatatttgttgaataaaaa

SEQ ID NO: 8069350 - DNA, 22 bp, Homo sapiens
tatatttaatcctagagccatt

SEQ ID NO: 8069351 - DNA, 22 bp, Homo sapiens
tatacttatgctaaaaaatgtt

SEQ ID NO: 8069352 - DNA, 22 bp, Homo sapiens
tatagaacaagttatttatgct

SEQ ID NO: 8069353 - DNA, 22 bp, Homo sapiens
tatactctgagaaacgtgtcac

SEQ ID NO: 8069354 - DNA, 22 bp, Homo sapiens
tatatgatgccaaataacctgt

SEQ ID NO: 8069355 - DNA, 22 bp, Homo sapiens
tatagaggtggaaactgaggtt

SEQ ID NO: 8069356 - DNA, 22 bp, Homo sapiens
tatagacaagcgtaacaagaag

SEQ ID NO: 8069357 - DNA, 22 bp, Homo sapiens
tatatgtaagctatgtaagagt

SEQ ID NO: 8069358 - DNA, 22 bp, Homo sapiens
tatatgtagtcagtcagagtaa

SEQ ID NO: 8069359 - DNA, 22 bp, Homo sapiens
tatatgtagattgtaccaatgt

SEQ ID NO: 8069360 - DNA, 22 bp, Homo sapiens
tatattaaatgaccagttttaa

SEQ ID NO: 8069361 - DNA, 22 bp, Homo sapiens
tatattaaatgaccagttttaa

SEQ ID NO: 8069362 - DNA, 22 bp, Homo sapiens
tatattaaatgaccagttttaa

SEQ ID NO: 8069363 - DNA, 22 bp, Homo sapiens
tatattaaagtgctttgcagtg

SEQ ID NO: 8069364 - DNA, 22 bp, Homo sapiens
tatatgtttcttacaaaatatt

SEQ ID NO: 8069365 - DNA, 22 bp, Homo sapiens
tatattaaaccctctctgtagg

SEQ ID NO: 8069366 - DNA, 22 bp, Homo sapiens
tatattaacttgtgatcctgga

SEQ ID NO: 8069367 - DNA, 22 bp, Homo sapiens
tatattaaccatagggttctag

SEQ ID NO: 8069368 - DNA, 22 bp, Homo sapiens
tatattaacacccacttgcctc

SEQ ID NO: 8069369 - DNA, 22 bp, Homo sapiens
tatattacctgcctgatctata

SEQ ID NO: 8069370 - DNA, 21 bp, Homo sapiens
tagccatgttccttatggttc

SEQ ID NO: 8069371 - DNA, 22 bp, Homo sapiens
tagccaggcgaggtcagtgtcg

SEQ ID NO: 8069372 - DNA, 21 bp, Homo sapiens
tagcacagctgtagacagttt

SEQ ID NO: 8069373 - DNA, 22 bp, Homo sapiens
tagcacagtatttctcaactgg

SEQ ID NO: 8069374 - DNA, 22 bp, Homo sapiens
tagcacaggtcttgttgccatt

SEQ ID NO: 8069375 - DNA, 22 bp, Homo sapiens
tagcaagaggaaacaaggggcc

SEQ ID NO: 8069376 - DNA, 22 bp, Homo sapiens
tagaataagttgatgatatatg

SEQ ID NO: 8069377 - DNA, 20 bp, Homo sapiens
tagaatctactatttggccc

SEQ ID NO: 8069378 - DNA, 22 bp, Homo sapiens
tagagcattagaaattagtgta

SEQ ID NO: 8069379 - DNA, 22 bp, Homo sapiens
tagagctgagttgactccattt

SEQ ID NO: 8069380 - DNA, 22 bp, Homo sapiens
tagagctatttagagcatttta

SEQ ID NO: 8069381 - DNA, 22 bp, Homo sapiens
tagagctactggcagcctcttc

SEQ ID NO: 8069382 - DNA, 22 bp, Homo sapiens
tagagctgataatgaggccaag

SEQ ID NO: 8069383 - DNA, 22 bp, Homo sapiens
tagagctgctggactgtaacag

SEQ ID NO: 8069384 - DNA, 22 bp, Homo sapiens
tagccatgttgttaaaagacaa

SEQ ID NO: 8069385 - DNA, 22 bp, Homo sapiens
taggaagatgagtatcaacttg

SEQ ID NO: 8069386 - DNA, 22 bp, Homo sapiens
tagtatagattgaagcagatca

SEQ ID NO: 8069387 - DNA, 19 bp, Homo sapiens
tagtagtagaaaacaatac

SEQ ID NO: 8069388 - DNA, 22 bp, Homo sapiens
tagtatttcctgtaagctatag

SEQ ID NO: 8069389 - DNA, 22 bp, Homo sapiens
tagtccttgctgggcacagagt

SEQ ID NO: 8069390 - DNA, 22 bp, Homo sapiens
taaatacagtcatttgagccat

SEQ ID NO: 8069391 - DNA, 22 bp, Homo sapiens
taacacaaaagaatatgtgtgt

SEQ ID NO: 8069392 - DNA, 22 bp, Homo sapiens
taagataaggaacattctgtga

SEQ ID NO: 8069393 - DNA, 22 bp, Homo sapiens
taaagacaaacccactagggtt

SEQ ID NO: 8069394 - DNA, 22 bp, Homo sapiens
taaagacaataggaaagttgtt

SEQ ID NO: 8069395 - DNA, 22 bp, Homo sapiens
taaagacaatttcgagctgtag

SEQ ID NO: 8069396 - DNA, 22 bp, Homo sapiens
taaagttcttagaacaaggcct

SEQ ID NO: 8069397 - DNA, 17 bp, Homo sapiens
taaatacacaagggtat

SEQ ID NO: 8069398 - DNA, 22 bp, Homo sapiens
gttttataattgcttcataaga

SEQ ID NO: 8069399 - DNA, 22 bp, Homo sapiens
gttttcaattataagatggctt

SEQ ID NO: 8069400 - DNA, 22 bp, Homo sapiens
gttagaaagtgtctgcttgggt

SEQ ID NO: 8069401 - DNA, 22 bp, Homo sapiens
gttcatttttactttgatctac

SEQ ID NO: 8069402 - DNA, 23 bp, Homo sapiens
gttcattttattgtctgattgct

SEQ ID NO: 8069403 - DNA, 22 bp, Homo sapiens
gttcatttttccctaatgagta

SEQ ID NO: 8069404 - DNA, 22 bp, Homo sapiens
gttcattttactgtaaatagca

SEQ ID NO: 8069405 - DNA, 22 bp, Homo sapiens
gttcattttactgtaaatagca

SEQ ID NO: 8069406 - DNA, 22 bp, Homo sapiens
gttataaatacctaataggatt

SEQ ID NO: 8069407 - DNA, 22 bp, Homo sapiens
gttataaaggtgataatggtca

SEQ ID NO: 8069408 - DNA, 22 bp, Homo sapiens
gttataaaatgcacagttgttt

SEQ ID NO: 8069409 - DNA, 22 bp, Homo sapiens
gtgctttccatcctccctgctg

SEQ ID NO: 8069410 - DNA, 22 bp, Homo sapiens
gtgtgtttagcattagcagggg

SEQ ID NO: 8069411 - DNA, 22 bp, Homo sapiens
gtgttacatattctaaaatgct

SEQ ID NO: 8069412 - DNA, 22 bp, Homo sapiens
gttccacagtgagataaaagca

SEQ ID NO: 8069413 - DNA, 22 bp, Homo sapiens
gttccacatttgtaaaatgagg

SEQ ID NO: 8069414 - DNA, 22 bp, Homo sapiens
gtttaattcccacacctgccct

SEQ ID NO: 8069415 - DNA, 22 bp, Homo sapiens
gtttataaggcccaatatttct

SEQ ID NO: 8069416 - DNA, 22 bp, Homo sapiens
gtttagaacacggaaatactga

SEQ ID NO: 8069417 - DNA, 22 bp, Homo sapiens
gtttatatgaacttcataccca

SEQ ID NO: 8069418 - DNA, 22 bp, Homo sapiens
gtttctctgtctgttacattgg

SEQ ID NO: 8069419 - DNA, 22 bp, Homo sapiens
tacacataggtctgaataaaaa

SEQ ID NO: 8069420 - DNA, 22 bp, Homo sapiens
tacacattctagggcacagtta

SEQ ID NO: 8069421 - DNA, 22 bp, Homo sapiens
tacacattacataatactatct

SEQ ID NO: 8069422 - DNA, 22 bp, Homo sapiens
tacaagctcacaaatttttaag

SEQ ID NO: 8069423 - DNA, 22 bp, Homo sapiens
tacaatgattagctaacttgcc

SEQ ID NO: 8069424 - DNA, 22 bp, Homo sapiens
taatgaatgagaatataacaga

SEQ ID NO: 8069425 - DNA, 22 bp, Homo sapiens
taatgaatgagaatataacaga

SEQ ID NO: 8069426 - DNA, 22 bp, Homo sapiens
taatgaggaaatagagggaatg

SEQ ID NO: 8069427 - DNA, 22 bp, Homo sapiens
taatgaggcatttgagtcacct

SEQ ID NO: 8069428 - DNA, 22 bp, Homo sapiens
taatgaggcaagagtcatggct

SEQ ID NO: 8069429 - DNA, 22 bp, Homo sapiens
taatgactgccgtctctcttca

SEQ ID NO: 8069430 - DNA, 22 bp, Homo sapiens
taatgatgtttcctatcttcca

SEQ ID NO: 8069431 - DNA, 22 bp, Homo sapiens
taatgatgcagttactgtctca

SEQ ID NO: 8069432 - DNA, 22 bp, Homo sapiens
taatgatgctagatttatctgg

SEQ ID NO: 8069433 - DNA, 22 bp, Homo sapiens
taatgatgcagttactgtctca

SEQ ID NO: 8069434 - DNA, 22 bp, Homo sapiens
taatgaggtgatgactaaggtc

SEQ ID NO: 8069435 - DNA, 22 bp, Homo sapiens
taatgcatgtaatgggctgata

SEQ ID NO: 8069436 - DNA, 22 bp, Homo sapiens
taatttcaatagcttgcataat

SEQ ID NO: 8069437 - DNA, 22 bp, Homo sapiens
taatgcttaattttcacaagcc

SEQ ID NO: 8069438 - DNA, 22 bp, Homo sapiens
taatgcttttccttcaaataag

SEQ ID NO: 8069439 - DNA, 22 bp, Homo sapiens
taagttaaccctgttaatagat

SEQ ID NO: 8069440 - DNA, 22 bp, Homo sapiens
taataaatgaaagtgctggcat

SEQ ID NO: 8069441 - DNA, 22 bp, Homo sapiens
taataaatgaaagtgctggcat

SEQ ID NO: 8069442 - DNA, 22 bp, Homo sapiens
tacatacagtggatgctttagg

SEQ ID NO: 8069443 - DNA, 18 bp, Homo sapiens
tacaggaaaagtgttaca

SEQ ID NO: 8069444 - DNA, 22 bp, Homo sapiens
tacataattaatctttaagttc

SEQ ID NO: 8069445 - DNA, 22 bp, Homo sapiens
tacataatgagctagttaagtt

SEQ ID NO: 8069446 - DNA, 22 bp, Homo sapiens
tacatacaagatgtgtttaaaa

SEQ ID NO: 8069447 - DNA, 22 bp, Homo sapiens
tacatacaagatgtgtttaaaa

SEQ ID NO: 8069448 - DNA, 22 bp, Homo sapiens
tactaagtgtttggcagtatca

SEQ ID NO: 8069449 - DNA, 22 bp, Homo sapiens
tactaagtagcagaactaagaa

SEQ ID NO: 8069450 - DNA, 22 bp, Homo sapiens
tactaagtggggcattgttata

SEQ ID NO: 8069451 - DNA, 22 bp, Homo sapiens
tacgcctgtaatcccagcactt

SEQ ID NO: 8069452 - DNA, 22 bp, Homo sapiens
tacctgagcccagtgcagcata

SEQ ID NO: 8069453 - DNA, 22 bp, Homo sapiens
tactgagtggcaaaggcaagaa

SEQ ID NO: 8069454 - DNA, 22 bp, Homo sapiens
tactgcatagacactgggatat

SEQ ID NO: 8069455 - DNA, 20 bp, Homo sapiens
tactggagtgagcctgtagc

SEQ ID NO: 8069456 - DNA, 22 bp, Homo sapiens
tacttcattcctttgtaaaatg

SEQ ID NO: 8069457 - DNA, 22 bp, Homo sapiens
gctcaagccttctgcccacctc

SEQ ID NO: 8069458 - DNA, 22 bp, Homo sapiens
gctcaagccttctgcccacctc

SEQ ID NO: 8069459 - DNA, 22 bp, Homo sapiens
gctcaagagagatgcagttctt

SEQ ID NO: 8069460 - DNA, 21 bp, Homo sapiens
gctcagctgcttggttcctgt

SEQ ID NO: 8069461 - DNA, 22 bp, Homo sapiens
gctcacagcccaggccagcgtg

SEQ ID NO: 8069462 - DNA, 22 bp, Homo sapiens
gctcacagccggctggcagggg

SEQ ID NO: 8069463 - DNA, 22 bp, Homo sapiens
gcggcctgcgctgctcccgacg

SEQ ID NO: 8069464 - DNA, 22 bp, Homo sapiens
gcgctgcgcctcctcttccgca

SEQ ID NO: 8069465 - DNA, 22 bp, Homo sapiens
gcggaggaaactgaggcaagag

SEQ ID NO: 8069466 - DNA, 22 bp, Homo sapiens
gccttgatctgctgtgtttgag

SEQ ID NO: 8069467 - DNA, 22 bp, Homo sapiens
gccttttttgttgctctgtcac

SEQ ID NO: 8069468 - DNA, 22 bp, Homo sapiens
gccttccacgtcaggggaaata

SEQ ID NO: 8069469 - DNA, 22 bp, Homo sapiens
gccttccacctaggcctctgct

SEQ ID NO: 8069470 - DNA, 22 bp, Homo sapiens
gccttctgtgctcctggccttt

SEQ ID NO: 8069471 - DNA, 22 bp, Homo sapiens
gccttctgcgctcgtgtctccg

SEQ ID NO: 8069472 - DNA, 22 bp, Homo sapiens
gcctggggaacttgatcctgtc

SEQ ID NO: 8069473 - DNA, 22 bp, Homo sapiens
gcctgggttccatgatctccag

SEQ ID NO: 8069474 - DNA, 22 bp, Homo sapiens
gcctgggtgagggtctccttca

SEQ ID NO: 8069475 - DNA, 22 bp, Homo sapiens
gcctgggtctcctccgcttccc

SEQ ID NO: 8069476 - DNA, 22 bp, Homo sapiens
gcctggtggtatcctggcaaga

SEQ ID NO: 8069477 - DNA, 22 bp, Homo sapiens
gccttcagccctgactggccag

SEQ ID NO: 8069478 - DNA, 22 bp, Homo sapiens
gccttcagccctgactggccag

SEQ ID NO: 8069479 - DNA, 22 bp, Homo sapiens
gccttcagagtaccatgtcctc

SEQ ID NO: 8069480 - DNA, 22 bp, Homo sapiens
gccttcagagtaccatgtcctc

SEQ ID NO: 8069481 - DNA, 22 bp, Homo sapiens
gccttaggggtcagacagagct

SEQ ID NO: 8069482 - DNA, 22 bp, Homo sapiens
gccttcagtagtatcctcatga

SEQ ID NO: 8069483 - DNA, 22 bp, Homo sapiens
gccttcagtagtgtcagctgta

SEQ ID NO: 8069484 - DNA, 22 bp, Homo sapiens
gccttcagtagtgtcagctgta

SEQ ID NO: 8069485 - DNA, 22 bp, Homo sapiens
gccttcaggtgtccctgtgggc

SEQ ID NO: 8069486 - DNA, 22 bp, Homo sapiens
gccttcaggtgctgccaggcta

SEQ ID NO: 8069487 - DNA, 22 bp, Homo sapiens
gccttcagtagtatcctcatga

SEQ ID NO: 8069488 - DNA, 22 bp, Homo sapiens
gccttcaggagggttccagaca

SEQ ID NO: 8069489 - DNA, 22 bp, Homo sapiens
gccttcaggagggttccagaca

SEQ ID NO: 8069490 - DNA, 22 bp, Homo sapiens
gccttcaggagggttccagaca

SEQ ID NO: 8069491 - DNA, 22 bp, Homo sapiens
gccttcaggaaatcagtccttg

SEQ ID NO: 8069492 - DNA, 22 bp, Homo sapiens
gccttcaggaaatcagtccttg

SEQ ID NO: 8069493 - DNA, 22 bp, Homo sapiens
gccttcaggaaatcagtccttg

SEQ ID NO: 8069494 - DNA, 22 bp, Homo sapiens
gccttcagcggccgctcgctgc

SEQ ID NO: 8069495 - DNA, 22 bp, Homo sapiens
gccttcagcggccgctcgctgc

SEQ ID NO: 8069496 - DNA, 23 bp, Homo sapiens
gccttcagctcgggaaggctccc

SEQ ID NO: 8069497 - DNA, 22 bp, Homo sapiens
gcctggctgtctggcaaggttc

SEQ ID NO: 8069498 - DNA, 22 bp, Homo sapiens
gcctggcttcccttggagcatt

SEQ ID NO: 8069499 - DNA, 22 bp, Homo sapiens
gctcagggaactttttgcaggc

SEQ ID NO: 8069500 - DNA, 22 bp, Homo sapiens
gctcctggtctggagcttcaag

SEQ ID NO: 8069501 - DNA, 22 bp, Homo sapiens
gctctcaggtacaaagctgtgt

SEQ ID NO: 8069502 - DNA, 22 bp, Homo sapiens
gctctgcccaggaccgtccttg

SEQ ID NO: 8069503 - DNA, 18 bp, Homo sapiens
gctctgcccaggctgccc

SEQ ID NO: 8069504 - DNA, 22 bp, Homo sapiens
gctctgcccagtgccctgagac

SEQ ID NO: 8069505 - DNA, 22 bp, Homo sapiens
gctctgctggagggaaagagaa

SEQ ID NO: 8069506 - DNA, 22 bp, Homo sapiens
gctctgctgcttactagatggt

SEQ ID NO: 8069507 - DNA, 22 bp, Homo sapiens
gctctgctgatccgcagccatc

SEQ ID NO: 8069508 - DNA, 22 bp, Homo sapiens
gctctgctgagatatctgggag

SEQ ID NO: 8069509 - DNA, 22 bp, Homo sapiens
gctctggctactgtggctaccg

SEQ ID NO: 8069510 - DNA, 22 bp, Homo sapiens
gctgccagctcactctcctgag

SEQ ID NO: 8069511 - DNA, 22 bp, Homo sapiens
gctgccagcacagttcagctgt

SEQ ID NO: 8069512 - DNA, 22 bp, Homo sapiens
gctgcagctttaggatccagtg

SEQ ID NO: 8069513 - DNA, 23 bp, Homo sapiens
gctgcagctgtggatgttctcag

SEQ ID NO: 8069514 - DNA, 22 bp, Homo sapiens
ggagagagatgccgccttgctc

SEQ ID NO: 8069515 - DNA, 22 bp, Homo sapiens
ggagagagatgccgccttgctc

SEQ ID NO: 8069516 - DNA, 22 bp, Homo sapiens
ggactctgttttcctgatcact

SEQ ID NO: 8069517 - DNA, 22 bp, Homo sapiens
ggactcagcagccaggagtggc

SEQ ID NO: 8069518 - DNA, 22 bp, Homo sapiens
ggagaggcgatgagtcacagcc

SEQ ID NO: 8069519 - DNA, 23 bp, Homo sapiens
ggacactgtgcagatgctagtgc

SEQ ID NO: 8069520 - DNA, 22 bp, Homo sapiens
ggacactggccacatttcaaaa

SEQ ID NO: 8069521 - DNA, 20 bp, Homo sapiens
ggacactgtagatttcaaac

SEQ ID NO: 8069522 - DNA, 22 bp, Homo sapiens
ggacactgtataagttagagta

SEQ ID NO: 8069523 - DNA, 23 bp, Homo sapiens
ggacactgctataaaggatctgc

SEQ ID NO: 8069524 - DNA, 22 bp, Homo sapiens
ggacactgaagaatctcagatg

SEQ ID NO: 8069525 - DNA, 21 bp, Homo sapiens
ggacactgataatcttgttgc

SEQ ID NO: 8069526 - DNA, 22 bp, Homo sapiens
ggacagagccctggtggcctaa

SEQ ID NO: 8069527 - DNA, 22 bp, Homo sapiens
ggacctgaacataaaacgaggc

SEQ ID NO: 8069528 - DNA, 22 bp, Homo sapiens
ggaccctgggcttgctcctggg

SEQ ID NO: 8069529 - DNA, 22 bp, Homo sapiens
ggaaggaagtaaatgatgctat

SEQ ID NO: 8069530 - DNA, 22 bp, Homo sapiens
ggaagccataccctgatttctg

SEQ ID NO: 8069531 - DNA, 22 bp, Homo sapiens
ggaaagggagttttgcttatga

SEQ ID NO: 8069532 - DNA, 22 bp, Homo sapiens
gcttcctgatattcatactgtt

SEQ ID NO: 8069533 - DNA, 22 bp, Homo sapiens
ggaaatatcttgtactatgtga

SEQ ID NO: 8069534 - DNA, 22 bp, Homo sapiens
ggaaagtggtggtggaaagagg

SEQ ID NO: 8069535 - DNA, 22 bp, Homo sapiens
ggaaaggggcctggatcttttg

SEQ ID NO: 8069536 - DNA, 22 bp, Homo sapiens
ggaaagggcagaggccttggag

SEQ ID NO: 8069537 - DNA, 22 bp, Homo sapiens
gcttcctgagaaacaatctgat

SEQ ID NO: 8069538 - DNA, 22 bp, Homo sapiens
gcttcctcgctgggcagaggca

SEQ ID NO: 8069539 - DNA, 17 bp, Homo sapiens
gcttcctcatgcagttc

SEQ ID NO: 8069540 - DNA, 22 bp, Homo sapiens
gcttcccctccaagcactgcct

SEQ ID NO: 8069541 - DNA, 22 bp, Homo sapiens
gcttcctagatctgtggtactc

SEQ ID NO: 8069542 - DNA, 22 bp, Homo sapiens
gcttcctaaatgcacagggcag

SEQ ID NO: 8069543 - DNA, 22 bp, Homo sapiens
gcttcccacagctggactgggg

SEQ ID NO: 8069544 - DNA, 19 bp, Homo sapiens
gcttcccaccagccagccc

SEQ ID NO: 8069545 - DNA, 20 bp, Homo sapiens
gcttcatttgcaagtctagt

SEQ ID NO: 8069546 - DNA, 22 bp, Homo sapiens
gcttccaaacaaaattttgatg

SEQ ID NO: 8069547 - DNA, 21 bp, Homo sapiens
gcttccaagatggcaccttga

SEQ ID NO: 8069548 - DNA, 22 bp, Homo sapiens
gcttccaaatctgttcaaaatg

SEQ ID NO: 8069549 - DNA, 22 bp, Homo sapiens
gcttccaagcggtagatagcat

SEQ ID NO: 8069550 - DNA, 22 bp, Homo sapiens
gcttccaagtcaatcaatgctg

SEQ ID NO: 8069551 - DNA, 22 bp, Homo sapiens
gcttccaatgcttctatcacat

SEQ ID NO: 8069552 - DNA, 22 bp, Homo sapiens
gcttccatgtatgctcttgaca

SEQ ID NO: 8069553 - DNA, 23 bp, Homo sapiens
gctgtgcacgagccactgcctgt

SEQ ID NO: 8069554 - DNA, 22 bp, Homo sapiens
gctgggagtcgcgtctgtggcc

SEQ ID NO: 8069555 - DNA, 22 bp, Homo sapiens
gctggggctgggctgaggaaga

SEQ ID NO: 8069556 - DNA, 20 bp, Homo sapiens
gctgggggtgtgctgagtga

SEQ ID NO: 8069557 - DNA, 22 bp, Homo sapiens
gctggggtctgtgaggagggct

SEQ ID NO: 8069558 - DNA, 22 bp, Homo sapiens
gctgtctgttcgagcgtgtgtt

SEQ ID NO: 8069559 - DNA, 22 bp, Homo sapiens
gctgggagaggccctgaagtga

SEQ ID NO: 8069560 - DNA, 22 bp, Homo sapiens
gctgggaggatctctccctgtc

SEQ ID NO: 8069561 - DNA, 22 bp, Homo sapiens
gctgggactgagacagtgacct

SEQ ID NO: 8069562 - DNA, 22 bp, Homo sapiens
gctgggaagtggcagagctgga

SEQ ID NO: 8069563 - DNA, 22 bp, Homo sapiens
gctgggacggctcagtaagaag

SEQ ID NO: 8069564 - DNA, 22 bp, Homo sapiens
gctgggaaccatgggaaggcag

SEQ ID NO: 8069565 - DNA, 22 bp, Homo sapiens
gctgggaagagatgcacatgat

SEQ ID NO: 8069566 - DNA, 22 bp, Homo sapiens
gctgggaagagatgcacatgat

SEQ ID NO: 8069567 - DNA, 18 bp, Homo sapiens
gctggctgcacttctgct

SEQ ID NO: 8069568 - DNA, 22 bp, Homo sapiens
gctggcagagacaagaagacta

SEQ ID NO: 8069569 - DNA, 22 bp, Homo sapiens
gctggctcagggactagagttt

SEQ ID NO: 8069570 - DNA, 22 bp, Homo sapiens
gctggcagacttcctctggaac

SEQ ID NO: 8069571 - DNA, 22 bp, Homo sapiens
gcccagagagatgctgtagacc

SEQ ID NO: 8069572 - DNA, 18 bp, Homo sapiens
gcccagaggtctgggccc

SEQ ID NO: 8069573 - DNA, 22 bp, Homo sapiens
gccaggcaaattaaggaatgca

SEQ ID NO: 8069574 - DNA, 22 bp, Homo sapiens
gccaggcacagttctaggtgct

SEQ ID NO: 8069575 - DNA, 22 bp, Homo sapiens
gccaggtggctgagtgactgag

SEQ ID NO: 8069576 - DNA, 22 bp, Homo sapiens
gccaggtgtagtggccacacct

SEQ ID NO: 8069577 - DNA, 22 bp, Homo sapiens
gccaggtggtctggctccagag

SEQ ID NO: 8069578 - DNA, 22 bp, Homo sapiens
gccctgagccaccaatgccatt

SEQ ID NO: 8069579 - DNA, 22 bp, Homo sapiens
gcctcagagggccctagggaca

SEQ ID NO: 8069580 - DNA, 22 bp, Homo sapiens
gcctcaggactggcatactcat

SEQ ID NO: 8069581 - DNA, 22 bp, Homo sapiens
gccctctggcagccttggctgg

SEQ ID NO: 8069582 - DNA, 22 bp, Homo sapiens
gcccatcatcactgtggaggct

SEQ ID NO: 8069583 - DNA, 22 bp, Homo sapiens
gccagagctgagtgaggttctt

SEQ ID NO: 8069584 - DNA, 22 bp, Homo sapiens
gccagagctgagacacgagtcc

SEQ ID NO: 8069585 - DNA, 22 bp, Homo sapiens
gccagcaggtggagagatcaag

SEQ ID NO: 8069586 - DNA, 22 bp, Homo sapiens
gccagcaggtggagagatcaag

SEQ ID NO: 8069587 - DNA, 22 bp, Homo sapiens
gccagcaggttgtcaaggagct

SEQ ID NO: 8069588 - DNA, 22 bp, Homo sapiens
gccagcagggcggagccatcta

SEQ ID NO: 8069589 - DNA, 22 bp, Homo sapiens
gccagcagtatgtcctggcagt

SEQ ID NO: 8069590 - DNA, 22 bp, Homo sapiens
gccagcagtccagtccttagtg

SEQ ID NO: 8069591 - DNA, 22 bp, Homo sapiens
gccagccccagacatcctatcg

SEQ ID NO: 8069592 - DNA, 22 bp, Homo sapiens
gccagccccttagggctctccc

SEQ ID NO: 8069593 - DNA, 22 bp, Homo sapiens
gccagcccagctccaggggaaa

SEQ ID NO: 8069594 - DNA, 22 bp, Homo sapiens
gccagagccggcttcacaggat

SEQ ID NO: 8069595 - DNA, 22 bp, Homo sapiens
gccagagcatgcactgcctgca

SEQ ID NO: 8069596 - DNA, 22 bp, Homo sapiens
gccagagcagaatagagtggcc

SEQ ID NO: 8069597 - DNA, 21 bp, Homo sapiens
gccagagcagtacaatgaggt

SEQ ID NO: 8069598 - DNA, 22 bp, Homo sapiens
gccagagcacaggctggtagta

SEQ ID NO: 8069599 - DNA, 22 bp, Homo sapiens
gccagagaggcaaatcctagca

SEQ ID NO: 8069600 - DNA, 22 bp, Homo sapiens
gccagagagactgatacatgct

SEQ ID NO: 8069601 - DNA, 22 bp, Homo sapiens
gccagagagagtccctgggcct

SEQ ID NO: 8069602 - DNA, 18 bp, Homo sapiens
gcagtctctctggtcttc

SEQ ID NO: 8069603 - DNA, 22 bp, Homo sapiens
gcagtcctgggattctgtcctt

SEQ ID NO: 8069604 - DNA, 22 bp, Homo sapiens
gcagtcctctcattggcctcct

SEQ ID NO: 8069605 - DNA, 22 bp, Homo sapiens
gcagtcctcctgcctcagcctc

SEQ ID NO: 8069606 - DNA, 22 bp, Homo sapiens
gcagtcctcgtaaaggtcgaag

SEQ ID NO: 8069607 - DNA, 22 bp, Homo sapiens
gcagtcagacaggaggagctcc

SEQ ID NO: 8069608 - DNA, 22 bp, Homo sapiens
gcatttcctgtgcttggcatat

SEQ ID NO: 8069609 - DNA, 22 bp, Homo sapiens
gcatttcatgtagattgagaac

SEQ ID NO: 8069610 - DNA, 22 bp, Homo sapiens
gcatttgaaatgcaagaaagtg

SEQ ID NO: 8069611 - DNA, 22 bp, Homo sapiens
gcatgagactagctcatgagca

SEQ ID NO: 8069612 - DNA, 23 bp, Homo sapiens
gcatgaagtgctacgtctacagc

SEQ ID NO: 8069613 - DNA, 22 bp, Homo sapiens
gcatcttcacacaaagccagtg

SEQ ID NO: 8069614 - DNA, 22 bp, Homo sapiens
gcatcccaaatctgaaagtcca

SEQ ID NO: 8069615 - DNA, 22 bp, Homo sapiens
gcatccagaggtagccactgtg

SEQ ID NO: 8069616 - DNA, 22 bp, Homo sapiens
gcatccagtcttggctcctgga

SEQ ID NO: 8069617 - DNA, 22 bp, Homo sapiens
gcataaatgttctttcagattt

SEQ ID NO: 8069618 - DNA, 22 bp, Homo sapiens
gcagctggagccagccagacac

SEQ ID NO: 8069619 - DNA, 22 bp, Homo sapiens
gcagctggagccagccagacac

SEQ ID NO: 8069620 - DNA, 22 bp, Homo sapiens
gcagctggatttcaagagggag

SEQ ID NO: 8069621 - DNA, 22 bp, Homo sapiens
gcagctggacccacacggctta

SEQ ID NO: 8069622 - DNA, 22 bp, Homo sapiens
gcaggctgaaactcggggtcta

SEQ ID NO: 8069623 - DNA, 22 bp, Homo sapiens
gcaggctccaaggcctgggaga

SEQ ID NO: 8069624 - DNA, 22 bp, Homo sapiens
gcagggccttagcagcggctgc

SEQ ID NO: 8069625 - DNA, 22 bp, Homo sapiens
gcaggctgatagaggattccat

SEQ ID NO: 8069626 - DNA, 22 bp, Homo sapiens
gcaggctgatgactggagttgg

SEQ ID NO: 8069627 - DNA, 21 bp, Homo sapiens
gcagcagtgttctagaatact

SEQ ID NO: 8069628 - DNA, 22 bp, Homo sapiens
gcagcatcaggttcactgcgtg

SEQ ID NO: 8069629 - DNA, 22 bp, Homo sapiens
gcagcatctagggcactggcct

SEQ ID NO: 8069630 - DNA, 21 bp, Homo sapiens
gcagcatgagaaagccccaaa

SEQ ID NO: 8069631 - DNA, 22 bp, Homo sapiens
gcagcatgagctatacaaagta

SEQ ID NO: 8069632 - DNA, 22 bp, Homo sapiens
gcagctgcagaccctcagtgct

SEQ ID NO: 8069633 - DNA, 22 bp, Homo sapiens
gcagctgccgtgagctcacgcc

SEQ ID NO: 8069634 - DNA, 22 bp, Homo sapiens
gcagcaggaataggataagcaa

SEQ ID NO: 8069635 - DNA, 22 bp, Homo sapiens
gcagcaggaataggataagcaa

SEQ ID NO: 8069636 - DNA, 22 bp, Homo sapiens
gcagcagctcagttctgggagg

SEQ ID NO: 8069637 - DNA, 22 bp, Homo sapiens
gcagcagctcagttctgggagg

SEQ ID NO: 8069638 - DNA, 22 bp, Homo sapiens
gcagcagctgacagtgggtgcc

SEQ ID NO: 8069639 - DNA, 22 bp, Homo sapiens
gcagcagctctgaatgggcccc

SEQ ID NO: 8069640 - DNA, 22 bp, Homo sapiens
gcagcagctccctatccaggct

SEQ ID NO: 8069641 - DNA, 22 bp, Homo sapiens
gcagcagcggggcccctgcgcg

SEQ ID NO: 8069642 - DNA, 23 bp, Homo sapiens
gcagaggagcaagctggacacca

SEQ ID NO: 8069643 - DNA, 22 bp, Homo sapiens
gagggggagatgtgcacacact

SEQ ID NO: 8069644 - DNA, 22 bp, Homo sapiens
gaggggtgtggagccatcagtt

SEQ ID NO: 8069645 - DNA, 22 bp, Homo sapiens
gaggggcttgaggccctgatgg

SEQ ID NO: 8069646 - DNA, 22 bp, Homo sapiens
gaggggctgggtagggcaaccc

SEQ ID NO: 8069647 - DNA, 22 bp, Homo sapiens
gaggggctggggttgactccaa

SEQ ID NO: 8069648 - DNA, 22 bp, Homo sapiens
gcaagagacttttatgtctgcc

SEQ ID NO: 8069649 - DNA, 22 bp, Homo sapiens
gcaagatgttaacatagggaga

SEQ ID NO: 8069650 - DNA, 22 bp, Homo sapiens
gcaagcaagcaggtagagctga

SEQ ID NO: 8069651 - DNA, 22 bp, Homo sapiens
gcaaatgagttgtaacataaaa

SEQ ID NO: 8069652 - DNA, 22 bp, Homo sapiens
gcaaatgctaaagtgtagagac

SEQ ID NO: 8069653 - DNA, 22 bp, Homo sapiens
gcaaatgcactgcatttagatt

SEQ ID NO: 8069654 - DNA, 22 bp, Homo sapiens
gagggtcccgagccctgtcaga

SEQ ID NO: 8069655 - DNA, 22 bp, Homo sapiens
gagggtccccatgcagagctca

SEQ ID NO: 8069656 - DNA, 22 bp, Homo sapiens
gcaagcagactgggcccctgtg

SEQ ID NO: 8069657 - DNA, 22 bp, Homo sapiens
gcacagccactgagtgagaacc

SEQ ID NO: 8069658 - DNA, 21 bp, Homo sapiens
gcacagcatgagtgttggcat

SEQ ID NO: 8069659 - DNA, 22 bp, Homo sapiens
gcacagccagcatctgagggat

SEQ ID NO: 8069660 - DNA, 22 bp, Homo sapiens
gcacagctggggtatgatgcca

SEQ ID NO: 8069661 - DNA, 22 bp, Homo sapiens
gcacaggatgatgggttgaggg

SEQ ID NO: 8069662 - DNA, 22 bp, Homo sapiens
gcagagctctgttcttatctcc

SEQ ID NO: 8069663 - DNA, 22 bp, Homo sapiens
gcagagctgagcggctgcccgg

SEQ ID NO: 8069664 - DNA, 22 bp, Homo sapiens
gcactgagtctgtcatgctgca

SEQ ID NO: 8069665 - DNA, 22 bp, Homo sapiens
gcactggccgcacgcgtagggc

SEQ ID NO: 8069666 - DNA, 22 bp, Homo sapiens
gcactggattttgatctgcaag

SEQ ID NO: 8069667 - DNA, 22 bp, Homo sapiens
gcactgggaatgagggcagctt

SEQ ID NO: 8069668 - DNA, 22 bp, Homo sapiens
gcactgagcaccagccacagat

SEQ ID NO: 8069669 - DNA, 17 bp, Homo sapiens
gcactgagccacagttt

SEQ ID NO: 8069670 - DNA, 22 bp, Homo sapiens
gcacctgggacccagaggcacc

SEQ ID NO: 8069671 - DNA, 22 bp, Homo sapiens
gcactctgtttctcctgtcagc

SEQ ID NO: 8069672 - DNA, 22 bp, Homo sapiens
gggcctccggggtgagctgtgg

SEQ ID NO: 8069673 - DNA, 22 bp, Homo sapiens
gggcctctgtgcagaggggcct

SEQ ID NO: 8069674 - DNA, 22 bp, Homo sapiens
gggcctctccggcctttgcatc

SEQ ID NO: 8069675 - DNA, 22 bp, Homo sapiens
gggcatgagagggcagctggca

SEQ ID NO: 8069676 - DNA, 22 bp, Homo sapiens
gggcagtgttgtggttctctat

SEQ ID NO: 8069677 - DNA, 22 bp, Homo sapiens
gggcctgaggcttccctaatgc

SEQ ID NO: 8069678 - DNA, 22 bp, Homo sapiens
gggcctgccattgctgccccag

SEQ ID NO: 8069679 - DNA, 22 bp, Homo sapiens
gggcctggggacaccaccatga

SEQ ID NO: 8069680 - DNA, 21 bp, Homo sapiens
gggcctggctgcgcaggacgg

SEQ ID NO: 8069681 - DNA, 22 bp, Homo sapiens
gggctccatcggacttgggttt

SEQ ID NO: 8069682 - DNA, 22 bp, Homo sapiens
gggctccagccagctccttgtg

SEQ ID NO: 8069683 - DNA, 22 bp, Homo sapiens
gggctccagcccgggaccaggt

SEQ ID NO: 8069684 - DNA, 22 bp, Homo sapiens
gggctggcatcggttgctgaga

SEQ ID NO: 8069685 - DNA, 20 bp, Homo sapiens
gggctggcgcatggggaaag

SEQ ID NO: 8069686 - DNA, 22 bp, Homo sapiens
gggctggcgggaaaggcaattc

SEQ ID NO: 8069687 - DNA, 22 bp, Homo sapiens
gggctggctcccaggtgttgaa

SEQ ID NO: 8069688 - DNA, 22 bp, Homo sapiens
gggctctcatgagtgtgtggta

SEQ ID NO: 8069689 - DNA, 22 bp, Homo sapiens
ggggcacacttttggtagatat

SEQ ID NO: 8069690 - DNA, 22 bp, Homo sapiens
ggggatggtgggaaggcaatct

SEQ ID NO: 8069691 - DNA, 22 bp, Homo sapiens
ggggcagaaagcccacagagtg

SEQ ID NO: 8069692 - DNA, 22 bp, Homo sapiens
ggggatggaatgtagtagtgat

SEQ ID NO: 8069693 - DNA, 22 bp, Homo sapiens
ggggatggaggcgtgtggtcct

SEQ ID NO: 8069694 - DNA, 22 bp, Homo sapiens
ggggatggtggcatttgtaaaa

SEQ ID NO: 8069695 - DNA, 22 bp, Homo sapiens
ggggatggtagaccggtgacgt

SEQ ID NO: 8069696 - DNA, 22 bp, Homo sapiens
ggggatggattccgggtccctg

SEQ ID NO: 8069697 - DNA, 22 bp, Homo sapiens
gggctggggctcaataatttgt

SEQ ID NO: 8069698 - DNA, 22 bp, Homo sapiens
gggctgggcatggtgttccctc

SEQ ID NO: 8069699 - DNA, 22 bp, Homo sapiens
gggctgggcatggtgttccctc

SEQ ID NO: 8069700 - DNA, 22 bp, Homo sapiens
gggctgggattgcttgctgtga

SEQ ID NO: 8069701 - DNA, 22 bp, Homo sapiens
gggctgggaatggctaagtatg

SEQ ID NO: 8069702 - DNA, 22 bp, Homo sapiens
gggctgggatggcttgaagatt

SEQ ID NO: 8069703 - DNA, 22 bp, Homo sapiens
gggggagagacgagcggctctg

SEQ ID NO: 8069704 - DNA, 22 bp, Homo sapiens
gggggagctacaggtcccttgg

SEQ ID NO: 8069705 - DNA, 22 bp, Homo sapiens
gggggagctagtccagctgagg

SEQ ID NO: 8069706 - DNA, 22 bp, Homo sapiens
gggtcagctgctgggggctgac

SEQ ID NO: 8069707 - DNA, 22 bp, Homo sapiens
ggggcagctcccgagggcagga

SEQ ID NO: 8069708 - DNA, 22 bp, Homo sapiens
ggggctgtttttggaatggctg

SEQ ID NO: 8069709 - DNA, 22 bp, Homo sapiens
gggggagaagattctgctgctt

SEQ ID NO: 8069710 - DNA, 22 bp, Homo sapiens
ggtgcagtggtgtggcaaaggg

SEQ ID NO: 8069711 - DNA, 22 bp, Homo sapiens
ggtgaaggcacaagagggcaag

SEQ ID NO: 8069712 - DNA, 22 bp, Homo sapiens
ggtgaaggaggaagctgatgga

SEQ ID NO: 8069713 - DNA, 22 bp, Homo sapiens
ggtgaagggccttaggagacag

SEQ ID NO: 8069714 - DNA, 22 bp, Homo sapiens
ggtgaaggtctactgtgtgcca

SEQ ID NO: 8069715 - DNA, 22 bp, Homo sapiens
ggtgaagggtgtcatggcattt

SEQ ID NO: 8069716 - DNA, 21 bp, Homo sapiens
ggtcttccaaataaggagaaa

SEQ ID NO: 8069717 - DNA, 22 bp, Homo sapiens
ggtcttcagctttgcatgtctt

SEQ ID NO: 8069718 - DNA, 22 bp, Homo sapiens
ggtctggggcaggcatctgaca

SEQ ID NO: 8069719 - DNA, 22 bp, Homo sapiens
ggtggctgcaatggctaacttc

SEQ ID NO: 8069720 - DNA, 22 bp, Homo sapiens
ggtgccaggctgtagtcagggt

SEQ ID NO: 8069721 - DNA, 22 bp, Homo sapiens
ggtgccagcctagtgcagtggt

SEQ ID NO: 8069722 - DNA, 22 bp, Homo sapiens
ggtggctctgttgtcaactgat

SEQ ID NO: 8069723 - DNA, 22 bp, Homo sapiens
ggtgcccacctgtcttcctgga

SEQ ID NO: 8069724 - DNA, 22 bp, Homo sapiens
gggtccagacactccagaggaa

SEQ ID NO: 8069725 - DNA, 23 bp, Homo sapiens
gggtccagagacaggcatgggtg

SEQ ID NO: 8069726 - DNA, 22 bp, Homo sapiens
gggtccagagttgaagaggtta

SEQ ID NO: 8069727 - DNA, 22 bp, Homo sapiens
ggtcaggggctgctctacagag

SEQ ID NO: 8069728 - DNA, 22 bp, Homo sapiens
ggtcagggctcttccagtggct

SEQ ID NO: 8069729 - DNA, 21 bp, Homo sapiens
ggtcagggggtgcctccaggt

SEQ ID NO: 8069730 - DNA, 22 bp, Homo sapiens
ggtcagggtataatcaagtgag

SEQ ID NO: 8069731 - DNA, 22 bp, Homo sapiens
ggtcagggggatctgtgaggta

SEQ ID NO: 8069732 - DNA, 22 bp, Homo sapiens
ggtccagggaactttgaaggat

SEQ ID NO: 8069733 - DNA, 22 bp, Homo sapiens
ggtcagggttccaggtatcttc

SEQ ID NO: 8069734 - DNA, 16 bp, Homo sapiens
gtagccgtggccgctg

SEQ ID NO: 8069735 - DNA, 23 bp, Homo sapiens
gtaatgatgggaatttacttaga

SEQ ID NO: 8069736 - DNA, 22 bp, Homo sapiens
gtaggaaagtaaatgaaataca

SEQ ID NO: 8069737 - DNA, 22 bp, Homo sapiens
gtaggaagctctgaggctagtt

SEQ ID NO: 8069738 - DNA, 22 bp, Homo sapiens
ggtgggcacccgagactggatc

SEQ ID NO: 8069739 - DNA, 22 bp, Homo sapiens
ggtgggcagctcttggcaggca

SEQ ID NO: 8069740 - DNA, 22 bp, Homo sapiens
ggtgggcagctcttggcaggca

SEQ ID NO: 8069741 - DNA, 22 bp, Homo sapiens
gtaaatgagtcaaatgggggaa

SEQ ID NO: 8069742 - DNA, 22 bp, Homo sapiens
gtaatctcagctacttgggagg

SEQ ID NO: 8069743 - DNA, 19 bp, Homo sapiens
gtaagggctaatggactat

SEQ ID NO: 8069744 - DNA, 17 bp, Homo sapiens
gtaaggcttgcagatgc

SEQ ID NO: 8069745 - DNA, 22 bp, Homo sapiens
gtcaccaggtctgatgcagcca

SEQ ID NO: 8069746 - DNA, 22 bp, Homo sapiens
gtcaccagtgctaagaggtgga

SEQ ID NO: 8069747 - DNA, 22 bp, Homo sapiens
gtcaccaggtctgatgcagcca

SEQ ID NO: 8069748 - DNA, 22 bp, Homo sapiens
gtcaccagtcccagctcctgaa

SEQ ID NO: 8069749 - DNA, 22 bp, Homo sapiens
gtcacagtgtatctcttcagct

SEQ ID NO: 8069750 - DNA, 22 bp, Homo sapiens
gtcacagtggggtcacagtgtg

SEQ ID NO: 8069751 - DNA, 22 bp, Homo sapiens
gtcaggggccatgggccaagga

SEQ ID NO: 8069752 - DNA, 23 bp, Homo sapiens
gtcagggctggggtcagagtgac

SEQ ID NO: 8069753 - DNA, 22 bp, Homo sapiens
gtcagtgtgagttgattccata

SEQ ID NO: 8069754 - DNA, 22 bp, Homo sapiens
gtcctcaggaaagcagataaca

SEQ ID NO: 8069755 - DNA, 22 bp, Homo sapiens
gtccctggatctgggacagctg

SEQ ID NO: 8069756 - DNA, 22 bp, Homo sapiens
gtcatttctgtttcttcagtgc

SEQ ID NO: 8069757 - DNA, 22 bp, Homo sapiens
gtcatttatcatcagaagtcat

SEQ ID NO: 8069758 - DNA, 22 bp, Homo sapiens
gtcctctgcccaggtcaaggtt

SEQ ID NO: 8069759 - DNA, 22 bp, Homo sapiens
gtctctatcatagctgaaccct

SEQ ID NO: 8069760 - DNA, 22 bp, Homo sapiens
gtcttcaattgcatttgatggg

SEQ ID NO: 8069761 - DNA, 22 bp, Homo sapiens
gtgagtctgcctagcacatcac

SEQ ID NO: 8069762 - DNA, 22 bp, Homo sapiens
gtgaggtggtacaatattaact

SEQ ID NO: 8069763 - DNA, 22 bp, Homo sapiens
gtgagtctgtggaccgggcact

SEQ ID NO: 8069764 - DNA, 22 bp, Homo sapiens
gtgagtgttaacccactgcttc

SEQ ID NO: 8069765 - DNA, 22 bp, Homo sapiens
gtgatctgccagcctcagcctc

SEQ ID NO: 8069766 - DNA, 22 bp, Homo sapiens
gtgataactcaggcagagaata

SEQ ID NO: 8069767 - DNA, 22 bp, Homo sapiens
gtgaggtgggctggccagagac

SEQ ID NO: 8069768 - DNA, 22 bp, Homo sapiens
gtgctgggtgctgcagacaggt

SEQ ID NO: 8069769 - DNA, 22 bp, Homo sapiens
gtgctgggattacaggtgtgag

SEQ ID NO: 8069770 - DNA, 22 bp, Homo sapiens
gtgctgggccctgagaccaggg

SEQ ID NO: 8069771 - DNA, 22 bp, Homo sapiens
gtgccctgagtgggtaggagag

SEQ ID NO: 8069772 - DNA, 22 bp, Homo sapiens
gtgcaaattccactggaaagct

SEQ ID NO: 8069773 - DNA, 22 bp, Homo sapiens
ggatgcaggacggcatggatgt

SEQ ID NO: 8069774 - DNA, 22 bp, Homo sapiens
ggatgcaggggcagcagagcct

SEQ ID NO: 8069775 - DNA, 22 bp, Homo sapiens
ggatgcaggagttgaagaagga

SEQ ID NO: 8069776 - DNA, 22 bp, Homo sapiens
ggatggcagacagtgagtggct

SEQ ID NO: 8069777 - DNA, 22 bp, Homo sapiens
ggatggagatgaccatggtgac

SEQ ID NO: 8069778 - DNA, 22 bp, Homo sapiens
ggatggaggttctcagatgctc

SEQ ID NO: 8069779 - DNA, 22 bp, Homo sapiens
ggagatggtggaagctggtgca

SEQ ID NO: 8069780 - DNA, 22 bp, Homo sapiens
ggagatgtagtgtcactggact

SEQ ID NO: 8069781 - DNA, 22 bp, Homo sapiens
ggagatttatagcacacttcag

SEQ ID NO: 8069782 - DNA, 22 bp, Homo sapiens
ggagatggctctgcaaggtcta

SEQ ID NO: 8069783 - DNA, 21 bp, Homo sapiens
ggagatgggtatcgcctgggc

SEQ ID NO: 8069784 - DNA, 21 bp, Homo sapiens
ggagatgggtatcgcctgggc

SEQ ID NO: 8069785 - DNA, 22 bp, Homo sapiens
ggagcagagctgggcttggctg

SEQ ID NO: 8069786 - DNA, 22 bp, Homo sapiens
ggagcagagctcttcatctgca

SEQ ID NO: 8069787 - DNA, 22 bp, Homo sapiens
ggagcagagctgggcttggctg

SEQ ID NO: 8069788 - DNA, 22 bp, Homo sapiens
ggagcagagcatttcacagcct

SEQ ID NO: 8069789 - DNA, 22 bp, Homo sapiens
ggagcagacataaccttacaga

SEQ ID NO: 8069790 - DNA, 22 bp, Homo sapiens
ggagcagagcatttcacagcct

SEQ ID NO: 8069791 - DNA, 22 bp, Homo sapiens
ggagttggtgagcaccaggctt

SEQ ID NO: 8069792 - DNA, 23 bp, Homo sapiens
ggagttggattgtacttgctgct

SEQ ID NO: 8069793 - DNA, 22 bp, Homo sapiens
ggcagcagtccatggcccaagg

SEQ ID NO: 8069794 - DNA, 22 bp, Homo sapiens
ggcagcagtccatggcccaagg

SEQ ID NO: 8069795 - DNA, 20 bp, Homo sapiens
ggcagcaggagtttcctctt

SEQ ID NO: 8069796 - DNA, 22 bp, Homo sapiens
ggcagcaggcgacttccctatt

SEQ ID NO: 8069797 - DNA, 22 bp, Homo sapiens
ggcagcagggctgtctccctac

SEQ ID NO: 8069798 - DNA, 22 bp, Homo sapiens
ggcagcagtaggagctaatctt

SEQ ID NO: 8069799 - DNA, 22 bp, Homo sapiens
ggcagcagggtctagattgatg

SEQ ID NO: 8069800 - DNA, 22 bp, Homo sapiens
ggcagcagggtagccatttctc

SEQ ID NO: 8069801 - DNA, 22 bp, Homo sapiens
ggcagctgtggacgtcgtcatt

SEQ ID NO: 8069802 - DNA, 17 bp, Homo sapiens
ggcagctgtgtgcatgc

SEQ ID NO: 8069803 - DNA, 22 bp, Homo sapiens
ggcagctgtttgtcctcctgtt

SEQ ID NO: 8069804 - DNA, 22 bp, Homo sapiens
ggcagctgttggctctctagga

SEQ ID NO: 8069805 - DNA, 22 bp, Homo sapiens
ggcagcaggagccatctggtag

SEQ ID NO: 8069806 - DNA, 22 bp, Homo sapiens
ggcagcaggagccatctggtag

SEQ ID NO: 8069807 - DNA, 16 bp, Homo sapiens
ggcagcagctccgtgc

SEQ ID NO: 8069808 - DNA, 22 bp, Homo sapiens
ggcagcagcaaggttggagctg

SEQ ID NO: 8069809 - DNA, 22 bp, Homo sapiens
ggcagcagacccctaagtctac

SEQ ID NO: 8069810 - DNA, 22 bp, Homo sapiens
ggcagaaggttgaagtaatttg

SEQ ID NO: 8069811 - DNA, 22 bp, Homo sapiens
ggcagaaggcaattagagactg

SEQ ID NO: 8069812 - DNA, 22 bp, Homo sapiens
ggcagaagacaggcaaatcatg

SEQ ID NO: 8069813 - DNA, 22 bp, Homo sapiens
ggcactgtttttgtattcagtt

SEQ ID NO: 8069814 - DNA, 22 bp, Homo sapiens
ggcactgtgtacacacagagac

SEQ ID NO: 8069815 - DNA, 22 bp, Homo sapiens
ggcactgcccaccctcacaggg

SEQ ID NO: 8069816 - DNA, 21 bp, Homo sapiens
ggcactgctgggccatctgct

SEQ ID NO: 8069817 - DNA, 22 bp, Homo sapiens
ggcctcacccatcggtgccttt

SEQ ID NO: 8069818 - DNA, 22 bp, Homo sapiens
ggcctacgccagtatccccagg

SEQ ID NO: 8069819 - DNA, 22 bp, Homo sapiens
ggcctagggagtggccatgcct

SEQ ID NO: 8069820 - DNA, 21 bp, Homo sapiens
ggccctggttacgcctcctct

SEQ ID NO: 8069821 - DNA, 22 bp, Homo sapiens
ggccgtgctccaaagtcatcgt

SEQ ID NO: 8069822 - DNA, 22 bp, Homo sapiens
ggccctgggcagaggagtgggc

SEQ ID NO: 8069823 - DNA, 22 bp, Homo sapiens
ggccaggaagggaagatcagca

SEQ ID NO: 8069824 - DNA, 22 bp, Homo sapiens
ggcctgctttccgagcctgcag

SEQ ID NO: 8069825 - DNA, 22 bp, Homo sapiens
ggcctgctggggcctcagacac

SEQ ID NO: 8069826 - DNA, 22 bp, Homo sapiens
ggcctgctgtgtactgatgtca

SEQ ID NO: 8069827 - DNA, 22 bp, Homo sapiens
ggcctgcttctcagtgagcttg

SEQ ID NO: 8069828 - DNA, 22 bp, Homo sapiens
ggcctgctgctatgacttcctg

SEQ ID NO: 8069829 - DNA, 22 bp, Homo sapiens
ggcctgctgacccaagtcctgt

SEQ ID NO: 8069830 - DNA, 22 bp, Homo sapiens
ggcctgctctgcagcctctaca

SEQ ID NO: 8069831 - DNA, 22 bp, Homo sapiens
ggcctgctccgggggctgagct

SEQ ID NO: 8069832 - DNA, 22 bp, Homo sapiens
ggcctgctccgggggctgagct

SEQ ID NO: 8069833 - DNA, 22 bp, Homo sapiens
ggcctgctctgcagcctctaca

SEQ ID NO: 8069834 - DNA, 22 bp, Homo sapiens
ggcctggcagagcgcgcggctg

SEQ ID NO: 8069835 - DNA, 22 bp, Homo sapiens
ggcctggcatggggactaaggg

SEQ ID NO: 8069836 - DNA, 22 bp, Homo sapiens
ggcctggctcttgcccagcctg

SEQ ID NO: 8069837 - DNA, 22 bp, Homo sapiens
ggcatcagtatggccatagggt

SEQ ID NO: 8069838 - DNA, 22 bp, Homo sapiens
ggcatcttcaaaattgccaaat

SEQ ID NO: 8069839 - DNA, 22 bp, Homo sapiens
ggcatgcaaaacaactcagaga

SEQ ID NO: 8069840 - DNA, 22 bp, Homo sapiens
ggcaggagctctccagtttgcc

SEQ ID NO: 8069841 - DNA, 22 bp, Homo sapiens
ggcagggtctggactgaaagct

SEQ ID NO: 8069842 - DNA, 22 bp, Homo sapiens
ggcagggtggccctccagtgag

SEQ ID NO: 8069843 - DNA, 22 bp, Homo sapiens
ggctgctgtttcagagactgtt

SEQ ID NO: 8069844 - DNA, 22 bp, Homo sapiens
ggctgcttctcactcatttgca

SEQ ID NO: 8069845 - DNA, 22 bp, Homo sapiens
ggctggaagtccaagatcaaga

SEQ ID NO: 8069846 - DNA, 22 bp, Homo sapiens
ggctggaagtccaagatcaagg

SEQ ID NO: 8069847 - DNA, 22 bp, Homo sapiens
ggctggaaaagacaaagctatt

SEQ ID NO: 8069848 - DNA, 22 bp, Homo sapiens
ggctgctttatcggctgctgaa

SEQ ID NO: 8069849 - DNA, 22 bp, Homo sapiens
ggctgcttgctgtttcttggat

SEQ ID NO: 8069850 - DNA, 22 bp, Homo sapiens
ggctgagggccagggctagtct

SEQ ID NO: 8069851 - DNA, 18 bp, Homo sapiens
ggctgaggttgactagaa

SEQ ID NO: 8069852 - DNA, 22 bp, Homo sapiens
ggctggtggggaaagaggacca

SEQ ID NO: 8069853 - DNA, 22 bp, Homo sapiens
ggctggtgttacagtcggcagc

SEQ ID NO: 8069854 - DNA, 22 bp, Homo sapiens
ggctgggttatttatggccaag

SEQ ID NO: 8069855 - DNA, 22 bp, Homo sapiens
ggctggtcacaccactgcaggg

SEQ ID NO: 8069856 - DNA, 23 bp, Homo sapiens
ggctggtgcccttggccagtcgg

SEQ ID NO: 8069857 - DNA, 22 bp, Homo sapiens
ggctggtgagttcagagaaccc

SEQ ID NO: 8069858 - DNA, 19 bp, Homo sapiens
ggctgggtctggcaggttc

SEQ ID NO: 8069859 - DNA, 22 bp, Homo sapiens
ggctcctgaggaccaggcacag

SEQ ID NO: 8069860 - DNA, 22 bp, Homo sapiens
ggctcctgataggagaatgcgg

SEQ ID NO: 8069861 - DNA, 22 bp, Homo sapiens
ggctcctgaaagactatgggaa

SEQ ID NO: 8069862 - DNA, 23 bp, Homo sapiens
ggctctgtgctgggcctgcagga

SEQ ID NO: 8069863 - DNA, 22 bp, Homo sapiens
ggctctggttgaccatgatggc

SEQ ID NO: 8069864 - DNA, 22 bp, Homo sapiens
ggcgtgggaagtggggcttctg

SEQ ID NO: 8069865 - DNA, 22 bp, Homo sapiens
ggctccaggctcctatttcact

SEQ ID NO: 8069866 - DNA, 22 bp, Homo sapiens
gggcaccagcggccgcactgcc

SEQ ID NO: 8069867 - DNA, 23 bp, Homo sapiens
gggcaccaggagcaccggacagg

SEQ ID NO: 8069868 - DNA, 22 bp, Homo sapiens
gggcactgagtggatgatgcag

SEQ ID NO: 8069869 - DNA, 22 bp, Homo sapiens
gggcactgagtggatgatgcag

SEQ ID NO: 8069870 - DNA, 22 bp, Homo sapiens
gggcagtgacaaaggggatgaa

SEQ ID NO: 8069871 - DNA, 22 bp, Homo sapiens
gggcagtgattttccttagagg

SEQ ID NO: 8069872 - DNA, 22 bp, Homo sapiens
gggcagtgttgctctcaaagtc

SEQ ID NO: 8069873 - DNA, 19 bp, Homo sapiens
gggcagtggcactagggag

SEQ ID NO: 8069874 - DNA, 22 bp, Homo sapiens
gggcagtgaatattggtgggaa

SEQ ID NO: 8069875 - DNA, 22 bp, Homo sapiens
gggagggaggtgatgcttggct

SEQ ID NO: 8069876 - DNA, 16 bp, Homo sapiens
gggagggagttggtgg

SEQ ID NO: 8069877 - DNA, 22 bp, Homo sapiens
gggagggaggtgctggttcacg

SEQ ID NO: 8069878 - DNA, 22 bp, Homo sapiens
gggagggatctgctaggcaatg

SEQ ID NO: 8069879 - DNA, 22 bp, Homo sapiens
gggagggacacaaagagttccc

SEQ ID NO: 8069880 - DNA, 22 bp, Homo sapiens
gggagctggagctggaagactc

SEQ ID NO: 8069881 - DNA, 22 bp, Homo sapiens
gggagctggagctggaagactc

SEQ ID NO: 8069882 - DNA, 22 bp, Homo sapiens
gggaggtgatggcaagcagcgg

SEQ ID NO: 8069883 - DNA, 22 bp, Homo sapiens
gggagggattagttctgcctgg

SEQ ID NO: 8069884 - DNA, 22 bp, Homo sapiens
gggaagggagggcctccagtca

SEQ ID NO: 8069885 - DNA, 22 bp, Homo sapiens
gggaagggtgttgtcttatctt

SEQ ID NO: 8069886 - DNA, 22 bp, Homo sapiens
gggagctgagggacctctgtgg

SEQ ID NO: 8069887 - DNA, 22 bp, Homo sapiens
gggaagggagggacctcagtct

SEQ ID NO: 8069888 - DNA, 22 bp, Homo sapiens
gggaagggagggacctcagtct

SEQ ID NO: 8069889 - DNA, 22 bp, Homo sapiens
ggctttctagatctagctctgt

SEQ ID NO: 8069890 - DNA, 22 bp, Homo sapiens
ggctttgcattttgatggaggt

SEQ ID NO: 8069891 - DNA, 22 bp, Homo sapiens
ggctttgccctggactgaggca

SEQ ID NO: 8069892 - DNA, 23 bp, Homo sapiens
ggctttgctctgggttctagggt

SEQ ID NO: 8069893 - DNA, 22 bp, Homo sapiens
cgcagcagccccgtggtaggtg

SEQ ID NO: 8069894 - DNA, 20 bp, Homo sapiens
cgcagcagtggaagtggaat

SEQ ID NO: 8069895 - DNA, 22 bp, Homo sapiens
cggctgggttcggctgcaggcc

SEQ ID NO: 8069896 - DNA, 22 bp, Homo sapiens
cggctggtgtcgggcacagcaa

SEQ ID NO: 8069897 - DNA, 22 bp, Homo sapiens
ttcctaaaagaatacactggat

SEQ ID NO: 8069898 - DNA, 22 bp, Homo sapiens
ttcctctgaaatggcttggaaa

SEQ ID NO: 8069899 - DNA, 22 bp, Homo sapiens
cgtcccgggttcacgccattct

SEQ ID NO: 8069900 - DNA, 22 bp, Homo sapiens
cgtctcctgtgttcgagccatt

SEQ ID NO: 8069901 - DNA, 22 bp, Homo sapiens
cgtcccctcgttcccactttgg

SEQ ID NO: 8069902 - DNA, 22 bp, Homo sapiens
ttccagaaatctttcagctcaa

SEQ ID NO: 8069903 - DNA, 22 bp, Homo sapiens
ttccagaaatctttcagctcaa

SEQ ID NO: 8069904 - DNA, 22 bp, Homo sapiens
ttctcattctgactcagtgtag

SEQ ID NO: 8069905 - DNA, 22 bp, Homo sapiens
ctaaattatcatgagaattatg

SEQ ID NO: 8069906 - DNA, 22 bp, Homo sapiens
ctacatggagaagaaaattctt

SEQ ID NO: 8069907 - DNA, 22 bp, Homo sapiens
ttctctttttgcatctcaacct

SEQ ID NO: 8069908 - DNA, 22 bp, Homo sapiens
ctataaatctacccagcattgg

SEQ ID NO: 8069909 - DNA, 22 bp, Homo sapiens
ttctgaaaattgggtcatactt

SEQ ID NO: 8069910 - DNA, 22 bp, Homo sapiens
ttcttaatacctattttctacc

SEQ ID NO: 8069911 - DNA, 22 bp, Homo sapiens
ttcttaatctgtgtgggttcga

SEQ ID NO: 8069912 - DNA, 22 bp, Homo sapiens
ttcttaatcccacaaatcttca

SEQ ID NO: 8069913 - DNA, 22 bp, Homo sapiens
ttgaataattaattacactcag

SEQ ID NO: 8069914 - DNA, 20 bp, Homo sapiens
ctcagaaaagctaaggagaa

SEQ ID NO: 8069915 - DNA, 22 bp, Homo sapiens
ttcttcccagccagcacagccc

SEQ ID NO: 8069916 - DNA, 22 bp, Homo sapiens
ttcttcattcccttacttccga

SEQ ID NO: 8069917 - DNA, 22 bp, Homo sapiens
ttcttcatgggttcttttagga

SEQ ID NO: 8069918 - DNA, 22 bp, Homo sapiens
ttgcactccagcccgagcaaca

SEQ ID NO: 8069919 - DNA, 22 bp, Homo sapiens
ttgcacagatgagggtgatgct

SEQ ID NO: 8069920 - DNA, 23 bp, Homo sapiens
ttgctgcctgagccttcctctgg

SEQ ID NO: 8069921 - DNA, 22 bp, Homo sapiens
ttgctgcctgaggagcaacact

SEQ ID NO: 8069922 - DNA, 22 bp, Homo sapiens
ttgctgccttccgaatcctctc

SEQ ID NO: 8069923 - DNA, 21 bp, Homo sapiens
ttgctgccctccctttcctca

SEQ ID NO: 8069924 - DNA, 22 bp, Homo sapiens
ttgctgccagcgccctgcaggg

SEQ ID NO: 8069925 - DNA, 22 bp, Homo sapiens
ttgcaaaagccgaggcactcca

SEQ ID NO: 8069926 - DNA, 22 bp, Homo sapiens
ctcagcagtgacaagagagtat

SEQ ID NO: 8069927 - DNA, 22 bp, Homo sapiens
ctcagaaacggagctgccattt

SEQ ID NO: 8069928 - DNA, 22 bp, Homo sapiens
ctcagaaagcaatctggtgagg

SEQ ID NO: 8069929 - DNA, 22 bp, Homo sapiens
ttgatattctgagaagctgaag

SEQ ID NO: 8069930 - DNA, 22 bp, Homo sapiens
ctcaggccattcttccagctgc

SEQ ID NO: 8069931 - DNA, 22 bp, Homo sapiens
ctcaggcccacagcagacccac

SEQ ID NO: 8069932 - DNA, 22 bp, Homo sapiens
ctcagccagacatgacccagtc

SEQ ID NO: 8069933 - DNA, 22 bp, Homo sapiens
ctcagccatgtcatgcctacct

SEQ ID NO: 8069934 - DNA, 22 bp, Homo sapiens
ctcagcccagcccaggaccagg

SEQ ID NO: 8069935 - DNA, 22 bp, Homo sapiens
cctttacacatggaatgggtct

SEQ ID NO: 8069936 - DNA, 22 bp, Homo sapiens
ttcaaaacaatctgtttgcatt

SEQ ID NO: 8069937 - DNA, 22 bp, Homo sapiens
ttcaaaacagctagatattgga

SEQ ID NO: 8069938 - DNA, 22 bp, Homo sapiens
ttatttttaaaagttcacacag

SEQ ID NO: 8069939 - DNA, 22 bp, Homo sapiens
ttattattttgtgtacagcaaa

SEQ ID NO: 8069940 - DNA, 22 bp, Homo sapiens
ttatgtatggatggctgaaagt

SEQ ID NO: 8069941 - DNA, 22 bp, Homo sapiens
tgttgcccaggttctctcctgc

SEQ ID NO: 8069942 - DNA, 22 bp, Homo sapiens
cctgctcagccccagctcaccc

SEQ ID NO: 8069943 - DNA, 22 bp, Homo sapiens
cctgcgtccacggctgggagac

SEQ ID NO: 8069944 - DNA, 22 bp, Homo sapiens
cctgccttcccagcttggcttt

SEQ ID NO: 8069945 - DNA, 22 bp, Homo sapiens
tggttccaagatggctgccaca

SEQ ID NO: 8069946 - DNA, 22 bp, Homo sapiens
tggttccaatcgcactggctca

SEQ ID NO: 8069947 - DNA, 22 bp, Homo sapiens
tggttccactaacctgagagcc

SEQ ID NO: 8069948 - DNA, 23 bp, Homo sapiens
cctggggagctgtatccagagtg

SEQ ID NO: 8069949 - DNA, 23 bp, Homo sapiens
cctggggagctgtatccagagtg

SEQ ID NO: 8069950 - DNA, 22 bp, Homo sapiens
cctggggagagaaagcccagcc

SEQ ID NO: 8069951 - DNA, 22 bp, Homo sapiens
cctggggagaagagcttccccc

SEQ ID NO: 8069952 - DNA, 22 bp, Homo sapiens
cctggggctcaagatggcgccg

SEQ ID NO: 8069953 - DNA, 22 bp, Homo sapiens
tgtttataccttggtataacca

SEQ ID NO: 8069954 - DNA, 22 bp, Homo sapiens
tgtttatacctgcaacctgtca

SEQ ID NO: 8069955 - DNA, 22 bp, Homo sapiens
tgtttatacctgcaacctgtca

SEQ ID NO: 8069956 - DNA, 17 bp, Homo sapiens
tgttttcattcattgct

SEQ ID NO: 8069957 - DNA, 21 bp, Homo sapiens
tgttttccaccttgaggcaag

SEQ ID NO: 8069958 - DNA, 22 bp, Homo sapiens
tgttttcctcctggtttctgcc

SEQ ID NO: 8069959 - DNA, 22 bp, Homo sapiens
tgtttcttctcacacaaactca

SEQ ID NO: 8069960 - DNA, 19 bp, Homo sapiens
tgtttcttcctccatctga

SEQ ID NO: 8069961 - DNA, 20 bp, Homo sapiens
tgtttctgacggtaggagag

SEQ ID NO: 8069962 - DNA, 22 bp, Homo sapiens
tgtttctgggtgtgtctcacct

SEQ ID NO: 8069963 - DNA, 22 bp, Homo sapiens
ttaatgaatgtgtgctaacgtt

SEQ ID NO: 8069964 - DNA, 22 bp, Homo sapiens
ttaatgaaaggcagtttggaac

SEQ ID NO: 8069965 - DNA, 22 bp, Homo sapiens
ttaatgaaacattgactatgat

SEQ ID NO: 8069966 - DNA, 22 bp, Homo sapiens
cctgtggcacatgcagggattc

SEQ ID NO: 8069967 - DNA, 22 bp, Homo sapiens
ttacaagtttctggcttcatcc

SEQ ID NO: 8069968 - DNA, 22 bp, Homo sapiens
cctgtggctctctttggaggtc

SEQ ID NO: 8069969 - DNA, 22 bp, Homo sapiens
cctgtggctgccacttgggtga

SEQ ID NO: 8069970 - DNA, 22 bp, Homo sapiens
ttacaagtatttaagatgctgt

SEQ ID NO: 8069971 - DNA, 22 bp, Homo sapiens
ttacaagtactgaatatgattt

SEQ ID NO: 8069972 - DNA, 22 bp, Homo sapiens
ttaaaatctaaagcagttgtct

SEQ ID NO: 8069973 - DNA, 22 bp, Homo sapiens
cctggtttttcaaacatacaag

SEQ ID NO: 8069974 - DNA, 22 bp, Homo sapiens
ttaaaatgcagattatgactca

SEQ ID NO: 8069975 - DNA, 22 bp, Homo sapiens
ttaaaatgaatattgattagca

SEQ ID NO: 8069976 - DNA, 22 bp, Homo sapiens
ctgaaggatttagttctttgct

SEQ ID NO: 8069977 - DNA, 22 bp, Homo sapiens
ctgaaggaagcaggtggcctgt

SEQ ID NO: 8069978 - DNA, 22 bp, Homo sapiens
ctgaaggaggtagagtgacata

SEQ ID NO: 8069979 - DNA, 22 bp, Homo sapiens
ctgaaggagcatagtcagtttt

SEQ ID NO: 8069980 - DNA, 22 bp, Homo sapiens
ctgaaggacttggtgatagttg

SEQ ID NO: 8069981 - DNA, 18 bp, Homo sapiens
ctgaaggatccaggtgta

SEQ ID NO: 8069982 - DNA, 22 bp, Homo sapiens
ctgaaagaataagatgtttaca

SEQ ID NO: 8069983 - DNA, 22 bp, Homo sapiens
tttttcttaaatgtgggttggc

SEQ ID NO: 8069984 - DNA, 22 bp, Homo sapiens
tttttcttaaatgtgggttggc

SEQ ID NO: 8069985 - DNA, 22 bp, Homo sapiens
tttttctgagaatatgagagga

SEQ ID NO: 8069986 - DNA, 17 bp, Homo sapiens
ttttctcctgcccattc

SEQ ID NO: 8069987 - DNA, 22 bp, Homo sapiens
ttttctcccgctggctgctctt

SEQ ID NO: 8069988 - DNA, 22 bp, Homo sapiens
ttttctccccagagaccatcat

SEQ ID NO: 8069989 - DNA, 22 bp, Homo sapiens
ttttctctacaaaataaccagc

SEQ ID NO: 8069990 - DNA, 23 bp, Homo sapiens
ttttcctgtggagacatgactgg

SEQ ID NO: 8069991 - DNA, 22 bp, Homo sapiens
ttttcctgtccaggcaattatt

SEQ ID NO: 8069992 - DNA, 22 bp, Homo sapiens
ctctggagtgcagcctggtggc

SEQ ID NO: 8069993 - DNA, 22 bp, Homo sapiens
ctgagaggtgctggtggctgca

SEQ ID NO: 8069994 - DNA, 22 bp, Homo sapiens
ctgagaggtaagcagcgcagtg

SEQ ID NO: 8069995 - DNA, 22 bp, Homo sapiens
ctgagagatgatatagcttaat

SEQ ID NO: 8069996 - DNA, 22 bp, Homo sapiens
ctgagctgggagtggatagtgg

SEQ ID NO: 8069997 - DNA, 22 bp, Homo sapiens
ctgaggaagacagcagctgtgt

SEQ ID NO: 8069998 - DNA, 22 bp, Homo sapiens
ctgagcttccagttcctccagg

SEQ ID NO: 8069999 - DNA, 22 bp, Homo sapiens
ctgagcttccagttcctccagg

SEQ ID NO: 8070000 - DNA, 22 bp, Homo sapiens
ctgagcttggccaggaatgaat

SEQ ID NO: 8070001 - DNA, 22 bp, Homo sapiens
ctgctcctccccatcaggcagc

SEQ ID NO: 8070002 - DNA, 22 bp, Homo sapiens
ctgctcctgtccagcagggcca

SEQ ID NO: 8070003 - DNA, 19 bp, Homo sapiens
ctgctccctccttctggca

SEQ ID NO: 8070004 - DNA, 22 bp, Homo sapiens
ctgctccccagcctgcgccttt

SEQ ID NO: 8070005 - DNA, 22 bp, Homo sapiens
ctgctccacacctccatttcct

SEQ ID NO: 8070006 - DNA, 22 bp, Homo sapiens
ctgcctcttgacagatcgtggc

SEQ ID NO: 8070007 - DNA, 22 bp, Homo sapiens
ctgcctgcatgctgccatagct

SEQ ID NO: 8070008 - DNA, 22 bp, Homo sapiens
ctgcctgccttggcctccagga

SEQ ID NO: 8070009 - DNA, 22 bp, Homo sapiens
ctgcggtgggctgggctgtccc

SEQ ID NO: 8070010 - DNA, 22 bp, Homo sapiens
ctgctctaactgcattagtttt

SEQ ID NO: 8070011 - DNA, 22 bp, Homo sapiens
ctgctctaatatcagatagact

SEQ ID NO: 8070012 - DNA, 22 bp, Homo sapiens
ctgctctagagagcattagtca

SEQ ID NO: 8070013 - DNA, 22 bp, Homo sapiens
ctgctctgaagccaggattctg

SEQ ID NO: 8070014 - DNA, 22 bp, Homo sapiens
ctgctctctgttcccctggatc

SEQ ID NO: 8070015 - DNA, 22 bp, Homo sapiens
ctgctgcccctgagctcagcct

SEQ ID NO: 8070016 - DNA, 22 bp, Homo sapiens
ctgctgccctagacccagtcct

SEQ ID NO: 8070017 - DNA, 20 bp, Homo sapiens
ctgctgccctgtcagcctct

SEQ ID NO: 8070018 - DNA, 22 bp, Homo sapiens
ctgctgccggcgagcctccctt

SEQ ID NO: 8070019 - DNA, 22 bp, Homo sapiens
ctgctgccggcgagcctccctt

SEQ ID NO: 8070020 - DNA, 19 bp, Homo sapiens
ctgctgccggagactcgtc

SEQ ID NO: 8070021 - DNA, 22 bp, Homo sapiens
ctgctggcttctagtcattcaa

SEQ ID NO: 8070022 - DNA, 22 bp, Homo sapiens
ctgctgctcgaccagtcccagg

SEQ ID NO: 8070023 - DNA, 22 bp, Homo sapiens
ctgctgctcagtgtcatcatgt

SEQ ID NO: 8070024 - DNA, 22 bp, Homo sapiens
ctgctgccttccaaaggccagg

SEQ ID NO: 8070025 - DNA, 22 bp, Homo sapiens
ctgctgcctcgacattgggaca

SEQ ID NO: 8070026 - DNA, 22 bp, Homo sapiens
ctgctgcctagtccaagacgtg

SEQ ID NO: 8070027 - DNA, 22 bp, Homo sapiens
ctgctgcctgacaatttaggtt

SEQ ID NO: 8070028 - DNA, 22 bp, Homo sapiens
ctgctgcctgattgcagacctc

SEQ ID NO: 8070029 - DNA, 22 bp, Homo sapiens
ctgctgctgagagctcagcctg

SEQ ID NO: 8070030 - DNA, 22 bp, Homo sapiens
ctgctgctgctatctacccagg

SEQ ID NO: 8070031 - DNA, 22 bp, Homo sapiens
ctgcagtctacctggattttta

SEQ ID NO: 8070032 - DNA, 22 bp, Homo sapiens
ctgcagtgcctgccactgagcc

SEQ ID NO: 8070033 - DNA, 22 bp, Homo sapiens
ctgccctgagggcctgtgtgtt

SEQ ID NO: 8070034 - DNA, 22 bp, Homo sapiens
ctgccctgagtcatgccagatg

SEQ ID NO: 8070035 - DNA, 22 bp, Homo sapiens
ctgcctctgttgggcatggtct

SEQ ID NO: 8070036 - DNA, 22 bp, Homo sapiens
ctgcctctattcactgaggcag

SEQ ID NO: 8070037 - DNA, 22 bp, Homo sapiens
ctccctggtgtcccctccagga

SEQ ID NO: 8070038 - DNA, 22 bp, Homo sapiens
ctcccttcaggagaggctcaca

SEQ ID NO: 8070039 - DNA, 22 bp, Homo sapiens
ctccctctgtcttgtccagaaa

SEQ ID NO: 8070040 - DNA, 22 bp, Homo sapiens
ctccctggctttgtcctgaggc

SEQ ID NO: 8070041 - DNA, 22 bp, Homo sapiens
ctccctgggcagatgtggctct

SEQ ID NO: 8070042 - DNA, 20 bp, Homo sapiens
ttgtttattatgttctgatc

SEQ ID NO: 8070043 - DNA, 22 bp, Homo sapiens
ttgtttattagcaattatcctg

SEQ ID NO: 8070044 - DNA, 22 bp, Homo sapiens
ttgtttatgtaattggcacact

SEQ ID NO: 8070045 - DNA, 22 bp, Homo sapiens
ttgtttatgtgttgtctatggc

SEQ ID NO: 8070046 - DNA, 22 bp, Homo sapiens
ttgtttatggattgtagaaact

SEQ ID NO: 8070047 - DNA, 22 bp, Homo sapiens
ttgtttatcgcttgctcacata

SEQ ID NO: 8070048 - DNA, 22 bp, Homo sapiens
ctccccagcattctgacttcct

SEQ ID NO: 8070049 - DNA, 22 bp, Homo sapiens
ctccccaggttcaggaggtggg

SEQ ID NO: 8070050 - DNA, 22 bp, Homo sapiens
ctccccacatttctccctgtct

SEQ ID NO: 8070051 - DNA, 22 bp, Homo sapiens
ctcccagtgttgttttctgatg

SEQ ID NO: 8070052 - DNA, 22 bp, Homo sapiens
ctcccagggccatcgagtcact

SEQ ID NO: 8070053 - DNA, 22 bp, Homo sapiens
ctcctggacatggagcggagga

SEQ ID NO: 8070054 - DNA, 22 bp, Homo sapiens
tttatatggttgactatgagtt

SEQ ID NO: 8070055 - DNA, 22 bp, Homo sapiens
tttatatgtttgtacaattaag

SEQ ID NO: 8070056 - DNA, 22 bp, Homo sapiens
ctcctgtcagaagcatcctgag

SEQ ID NO: 8070057 - DNA, 22 bp, Homo sapiens
ctcctgtcagaagcatcctgag

SEQ ID NO: 8070058 - DNA, 22 bp, Homo sapiens
ctcctgtcaataggctcctggc

SEQ ID NO: 8070059 - DNA, 22 bp, Homo sapiens
ctcctgtgattcatttaacata

SEQ ID NO: 8070060 - DNA, 22 bp, Homo sapiens
ctccttcctggttagcacctta

SEQ ID NO: 8070061 - DNA, 22 bp, Homo sapiens
ctcgggcttgaggctgtttacc

SEQ ID NO: 8070062 - DNA, 22 bp, Homo sapiens
tttcaaataccataaacctaat

SEQ ID NO: 8070063 - DNA, 22 bp, Homo sapiens
tttcaaataccataaacctaat

SEQ ID NO: 8070064 - DNA, 20 bp, Homo sapiens
ctctctggaaggtgggagcc

SEQ ID NO: 8070065 - DNA, 22 bp, Homo sapiens
ctctgagctcctggaagcgtgc

SEQ ID NO: 8070066 - DNA, 22 bp, Homo sapiens
ctctgagctgaaacatgagcat

SEQ ID NO: 8070067 - DNA, 22 bp, Homo sapiens
ctctgagctgaaacatgagcat

SEQ ID NO: 8070068 - DNA, 22 bp, Homo sapiens
tttctgcatatgtatgtatgga

SEQ ID NO: 8070069 - DNA, 22 bp, Homo sapiens
tttctgcaggtattgcataagt

SEQ ID NO: 8070070 - DNA, 19 bp, Homo sapiens
tttctgcagcccagcagca

SEQ ID NO: 8070071 - DNA, 22 bp, Homo sapiens
tttctgcagcagactcagtgtg

SEQ ID NO: 8070072 - DNA, 22 bp, Homo sapiens
tttctgcaaacttccacgtctc

SEQ ID NO: 8070073 - DNA, 22 bp, Homo sapiens
tttctgatatactgtagaatcc

SEQ ID NO: 8070074 - DNA, 22 bp, Homo sapiens
ctctggagggaggctgagctgg

SEQ ID NO: 8070075 - DNA, 22 bp, Homo sapiens
ctctggaggcctaaggaagtgg

SEQ ID NO: 8070076 - DNA, 21 bp, Homo sapiens
ctctggaggcaagggagagtg

SEQ ID NO: 8070077 - DNA, 22 bp, Homo sapiens
ctctggaggttgagcccagcaa

SEQ ID NO: 8070078 - DNA, 22 bp, Homo sapiens
ctctggaggtcaggtgtggtgg

SEQ ID NO: 8070079 - DNA, 22 bp, Homo sapiens
ctctggaggtggaggttgcagt

SEQ ID NO: 8070080 - DNA, 21 bp, Homo sapiens
ctctggagtcaagagcttcca

SEQ ID NO: 8070081 - DNA, 19 bp, Homo sapiens
ctctggagtcattgctccc

SEQ ID NO: 8070082 - DNA, 20 bp, Homo sapiens
ctctgctttaggagagtcag

SEQ ID NO: 8070083 - DNA, 18 bp, Homo sapiens
tttgaaggatggcctgga

SEQ ID NO: 8070084 - DNA, 22 bp, Homo sapiens
tttgaagtccatctggcccagt

SEQ ID NO: 8070085 - DNA, 22 bp, Homo sapiens
ctctggagcatttcacctacat

SEQ ID NO: 8070086 - DNA, 22 bp, Homo sapiens
ctctggagcgctgcttcccgcg

SEQ ID NO: 8070087 - DNA, 19 bp, Homo sapiens
ctctggagcagacactgga

SEQ ID NO: 8070088 - DNA, 22 bp, Homo sapiens
ctctgctgcccaggcctgctag

SEQ ID NO: 8070089 - DNA, 22 bp, Homo sapiens
ctctgctgggatgtaaagtctt

SEQ ID NO: 8070090 - DNA, 22 bp, Homo sapiens
ctctgctgcttgccagtcattg

SEQ ID NO: 8070091 - DNA, 20 bp, Homo sapiens
ctctgctgcccgccggctgc

SEQ ID NO: 8070092 - DNA, 21 bp, Homo sapiens
ctctgctgtctaccagctgtt

SEQ ID NO: 8070093 - DNA, 22 bp, Homo sapiens
ctctgctggtagctcattccat

SEQ ID NO: 8070094 - DNA, 22 bp, Homo sapiens
ctctgcttcatccaccactggc

SEQ ID NO: 8070095 - DNA, 22 bp, Homo sapiens
gagagggccgggggccagctcc

SEQ ID NO: 8070096 - DNA, 22 bp, Homo sapiens
gagacgtggcctttgcctgagc

SEQ ID NO: 8070097 - DNA, 22 bp, Homo sapiens
gagacctcttggtatcgctagg

SEQ ID NO: 8070098 - DNA, 22 bp, Homo sapiens
gagactttaaaaaacattaaga

SEQ ID NO: 8070099 - DNA, 22 bp, Homo sapiens
gagactttctgatctcactcat

SEQ ID NO: 8070100 - DNA, 22 bp, Homo sapiens
gagactttttaatcactaggaa

SEQ ID NO: 8070101 - DNA, 22 bp, Homo sapiens
gagaaacttggagttattctgg

SEQ ID NO: 8070102 - DNA, 22 bp, Homo sapiens
gagaaagacgtaggctgggagg

SEQ ID NO: 8070103 - DNA, 22 bp, Homo sapiens
gagaccaggaagtacagcagcc

SEQ ID NO: 8070104 - DNA, 22 bp, Homo sapiens
gagaaagatgtaggctgggagg

SEQ ID NO: 8070105 - DNA, 22 bp, Homo sapiens
gaccagaaatcaacacagaatg

SEQ ID NO: 8070106 - DNA, 22 bp, Homo sapiens
gaccagagaaaggcactggaag

SEQ ID NO: 8070107 - DNA, 22 bp, Homo sapiens
gactgagaatcatagaaggcaa

SEQ ID NO: 8070108 - DNA, 22 bp, Homo sapiens
gacagcagatactttcattgaa

SEQ ID NO: 8070109 - DNA, 22 bp, Homo sapiens
gacagagctgctctagattctg

SEQ ID NO: 8070110 - DNA, 22 bp, Homo sapiens
gacagaggcaagaccagaagcc

SEQ ID NO: 8070111 - DNA, 22 bp, Homo sapiens
gacagaggagaagatgctgtgg

SEQ ID NO: 8070112 - DNA, 22 bp, Homo sapiens
gaaggccagttttgagataggt

SEQ ID NO: 8070113 - DNA, 18 bp, Homo sapiens
gaagggagctggaatgca

SEQ ID NO: 8070114 - DNA, 22 bp, Homo sapiens
gaagggagaaggttgggtgacg

SEQ ID NO: 8070115 - DNA, 22 bp, Homo sapiens
gaaaggagagggttaaggagct

SEQ ID NO: 8070116 - DNA, 18 bp, Homo sapiens
gaaaggagagacagtagg

SEQ ID NO: 8070117 - DNA, 22 bp, Homo sapiens
gaagccaagtgcaaatgcctta

SEQ ID NO: 8070118 - DNA, 22 bp, Homo sapiens
gaagccaacattccaagtagaa

SEQ ID NO: 8070119 - DNA, 22 bp, Homo sapiens
gaagggtgtgatttgcctgaga

SEQ ID NO: 8070120 - DNA, 17 bp, Homo sapiens
gaatccttctctgttct

SEQ ID NO: 8070121 - DNA, 22 bp, Homo sapiens
gacagacacaattgatccatga

SEQ ID NO: 8070122 - DNA, 22 bp, Homo sapiens
gacactttaggatttaaaagtc

SEQ ID NO: 8070123 - DNA, 22 bp, Homo sapiens
gaatgaattttggatggtgaag

SEQ ID NO: 8070124 - DNA, 22 bp, Homo sapiens
gaatgacgccctgtggtcactt

SEQ ID NO: 8070125 - DNA, 22 bp, Homo sapiens
gaatgaatctgtaagtgacaag

SEQ ID NO: 8070126 - DNA, 22 bp, Homo sapiens
gaatgaatctgtaagtgacaag

SEQ ID NO: 8070127 - DNA, 22 bp, Homo sapiens
gaggggctgccctggtgtcagg

SEQ ID NO: 8070128 - DNA, 22 bp, Homo sapiens
gaggggctctttaatagtaaca

SEQ ID NO: 8070129 - DNA, 22 bp, Homo sapiens
gaggggctgggcagtccctgga

SEQ ID NO: 8070130 - DNA, 22 bp, Homo sapiens
gaggggctggcacgatggctgc

SEQ ID NO: 8070131 - DNA, 22 bp, Homo sapiens
gagggaggtgatactgaacgta

SEQ ID NO: 8070132 - DNA, 22 bp, Homo sapiens
gagggctgcaatgagacagaga

SEQ ID NO: 8070133 - DNA, 22 bp, Homo sapiens
gagggagagtgatggaccattg

SEQ ID NO: 8070134 - DNA, 22 bp, Homo sapiens
gagggagaattgcagccagcgt

SEQ ID NO: 8070135 - DNA, 22 bp, Homo sapiens
gagggaggcatcatgaatccag

SEQ ID NO: 8070136 - DNA, 22 bp, Homo sapiens
gagggagggccaggtcccaacc

SEQ ID NO: 8070137 - DNA, 22 bp, Homo sapiens
gaggctgcactggctaaaggct

SEQ ID NO: 8070138 - DNA, 22 bp, Homo sapiens
gaggagaggctggacgcggtga

SEQ ID NO: 8070139 - DNA, 22 bp, Homo sapiens
gaggagagggctgcgggcccac

SEQ ID NO: 8070140 - DNA, 22 bp, Homo sapiens
gaggagaggccatcgttgttat

SEQ ID NO: 8070141 - DNA, 22 bp, Homo sapiens
gaggagagcctgcactttgacc

SEQ ID NO: 8070142 - DNA, 22 bp, Homo sapiens
gaggagagatggtagattgggt

SEQ ID NO: 8070143 - DNA, 22 bp, Homo sapiens
gaggagaggggctcccaagagc

SEQ ID NO: 8070144 - DNA, 22 bp, Homo sapiens
gaggagcacatgaggctgaggg

SEQ ID NO: 8070145 - DNA, 22 bp, Homo sapiens
gaggcagcttggggctgtgggt

SEQ ID NO: 8070146 - DNA, 22 bp, Homo sapiens
gaggagccaggaggtctccctg

SEQ ID NO: 8070147 - DNA, 22 bp, Homo sapiens
gaggagcccagcaccatcactt

SEQ ID NO: 8070148 - DNA, 22 bp, Homo sapiens
gaggagcccccactgggctcac

SEQ ID NO: 8070149 - DNA, 16 bp, Homo sapiens
gaggagcccctctgcc

SEQ ID NO: 8070150 - DNA, 22 bp, Homo sapiens
gaggcaggaggattgcttgagc

SEQ ID NO: 8070151 - DNA, 22 bp, Homo sapiens
gaggcaggcactgttatcagca

SEQ ID NO: 8070152 - DNA, 22 bp, Homo sapiens
gaggcaggcagattgcttgagg

SEQ ID NO: 8070153 - DNA, 22 bp, Homo sapiens
gaggcaggccctgaatgagtca

SEQ ID NO: 8070154 - DNA, 22 bp, Homo sapiens
gaggctcagagggagcatggtc

SEQ ID NO: 8070155 - DNA, 22 bp, Homo sapiens
gagccaggtttgaatctcagtc

SEQ ID NO: 8070156 - DNA, 22 bp, Homo sapiens
gagcccagcttgcacatggagc

SEQ ID NO: 8070157 - DNA, 22 bp, Homo sapiens
gagcagtgagtgaatgttgcct

SEQ ID NO: 8070158 - DNA, 22 bp, Homo sapiens
gagcagtgggaaggaacagggt

SEQ ID NO: 8070159 - DNA, 22 bp, Homo sapiens
gagcaggctctgcctgtgtgtc

SEQ ID NO: 8070160 - DNA, 22 bp, Homo sapiens
gagaggggtttgccatcctatg

SEQ ID NO: 8070161 - DNA, 22 bp, Homo sapiens
gagaggggtttgccatcctatg

SEQ ID NO: 8070162 - DNA, 22 bp, Homo sapiens
gagaggggacctgtgtgtctag

SEQ ID NO: 8070163 - DNA, 22 bp, Homo sapiens
gagaggggacctgtgtgtctag

SEQ ID NO: 8070164 - DNA, 22 bp, Homo sapiens
gagaggggcccaagccacatag

SEQ ID NO: 8070165 - DNA, 22 bp, Homo sapiens
gagaggggcccaagccacatag

SEQ ID NO: 8070166 - DNA, 22 bp, Homo sapiens
gagaggggcgcgcagctcgcga

SEQ ID NO: 8070167 - DNA, 22 bp, Homo sapiens
gaggagagagggactgtctgca

SEQ ID NO: 8070168 - DNA, 22 bp, Homo sapiens
gagctgctggctcctcaggtta

SEQ ID NO: 8070169 - DNA, 22 bp, Homo sapiens
gagctgcctacattgccaagag

SEQ ID NO: 8070170 - DNA, 22 bp, Homo sapiens
ctgggccttggattgacactgt

SEQ ID NO: 8070171 - DNA, 22 bp, Homo sapiens
ctgggcctgtcagggctttttg

SEQ ID NO: 8070172 - DNA, 22 bp, Homo sapiens
ctgggagcggctgtcactggtt

SEQ ID NO: 8070173 - DNA, 22 bp, Homo sapiens
ctgggagccctgactagcctgg

SEQ ID NO: 8070174 - DNA, 22 bp, Homo sapiens
ctgggagcccgcgtcctggtgg

SEQ ID NO: 8070175 - DNA, 22 bp, Homo sapiens
ctgggagattgctagagatgca

SEQ ID NO: 8070176 - DNA, 22 bp, Homo sapiens
ctgggagattgctagagatgca

SEQ ID NO: 8070177 - DNA, 22 bp, Homo sapiens
ctgggcagctaccaccactgct

SEQ ID NO: 8070178 - DNA, 22 bp, Homo sapiens
ctgggcagcctcacacaatgtt

SEQ ID NO: 8070179 - DNA, 22 bp, Homo sapiens
ctgggcagctaccaccactgct

SEQ ID NO: 8070180 - DNA, 22 bp, Homo sapiens
ctgggcagctccataccaccca

SEQ ID NO: 8070181 - DNA, 22 bp, Homo sapiens
ctgggcagagctaacacctgag

SEQ ID NO: 8070182 - DNA, 22 bp, Homo sapiens
ctgggcagagctaacacctgag

SEQ ID NO: 8070183 - DNA, 22 bp, Homo sapiens
ctgggacacccagagctgcaga

SEQ ID NO: 8070184 - DNA, 22 bp, Homo sapiens
ctgggagattcaggtgaagttt

SEQ ID NO: 8070185 - DNA, 22 bp, Homo sapiens
ctgggagatgactcagagcagg

SEQ ID NO: 8070186 - DNA, 22 bp, Homo sapiens
ctgggacatgatagaaacagat

SEQ ID NO: 8070187 - DNA, 22 bp, Homo sapiens
ctgggacatggtgctgtcttta

SEQ ID NO: 8070188 - DNA, 22 bp, Homo sapiens
ctgggacagagcagcagtgggg

SEQ ID NO: 8070189 - DNA, 22 bp, Homo sapiens
ctgggacagctgagacaggaga

SEQ ID NO: 8070190 - DNA, 22 bp, Homo sapiens
ctgtgctggcagacctggagtt

SEQ ID NO: 8070191 - DNA, 22 bp, Homo sapiens
ctgtgctgagtgatgtgactta

SEQ ID NO: 8070192 - DNA, 22 bp, Homo sapiens
ctgtgctgattcagcacaggcc

SEQ ID NO: 8070193 - DNA, 22 bp, Homo sapiens
ctgtgctgattcagcacaggcc

SEQ ID NO: 8070194 - DNA, 22 bp, Homo sapiens
ctgtgccctctttgctggcctt

SEQ ID NO: 8070195 - DNA, 22 bp, Homo sapiens
ctgtctgctagaacatctatac

SEQ ID NO: 8070196 - DNA, 17 bp, Homo sapiens
ctgtctgcgcatgaggt

SEQ ID NO: 8070197 - DNA, 22 bp, Homo sapiens
ctgtattttcatgcctacgtac

SEQ ID NO: 8070198 - DNA, 22 bp, Homo sapiens
ctgtcctgtggacctgaggacg

SEQ ID NO: 8070199 - DNA, 22 bp, Homo sapiens
ctgtcaggttggtctcagagct

SEQ ID NO: 8070200 - DNA, 22 bp, Homo sapiens
ctgtctctgttgcctgtaggtg

SEQ ID NO: 8070201 - DNA, 22 bp, Homo sapiens
ctgtctctgttgcctgtaggtg

SEQ ID NO: 8070202 - DNA, 22 bp, Homo sapiens
ctgtcaggggcgggtggagcgg

SEQ ID NO: 8070203 - DNA, 22 bp, Homo sapiens
ctgtacaggtgaggagggggct

SEQ ID NO: 8070204 - DNA, 22 bp, Homo sapiens
ctggtgagacggttgacaggag

SEQ ID NO: 8070205 - DNA, 22 bp, Homo sapiens
ctggtgcaggaaggagctggca

SEQ ID NO: 8070206 - DNA, 22 bp, Homo sapiens
ctgtaaaactgcttaagtatgc

SEQ ID NO: 8070207 - DNA, 22 bp, Homo sapiens
ctgtaattttccagccaatatg

SEQ ID NO: 8070208 - DNA, 22 bp, Homo sapiens
ctggtccttgacgcgtgggagg

SEQ ID NO: 8070209 - DNA, 20 bp, Homo sapiens
ctggggagcctcgcggtggc

SEQ ID NO: 8070210 - DNA, 22 bp, Homo sapiens
ctggtgacatttccggctgcca

SEQ ID NO: 8070211 - DNA, 22 bp, Homo sapiens
ctggtctgagggctcttgaggc

SEQ ID NO: 8070212 - DNA, 20 bp, Homo sapiens
ctggtctgccactcacagtt

SEQ ID NO: 8070213 - DNA, 22 bp, Homo sapiens
ctggggaccgagcaagctctgg

SEQ ID NO: 8070214 - DNA, 22 bp, Homo sapiens
ctggggacttgcagacacaatt

SEQ ID NO: 8070215 - DNA, 22 bp, Homo sapiens
ctgggctttgaagccaggctgc

SEQ ID NO: 8070216 - DNA, 22 bp, Homo sapiens
ctggggaacaatttgccacact

SEQ ID NO: 8070217 - DNA, 22 bp, Homo sapiens
ctgggcttctccccctggcaga

SEQ ID NO: 8070218 - DNA, 22 bp, Homo sapiens
cttccagagatagggcctcaag

SEQ ID NO: 8070219 - DNA, 22 bp, Homo sapiens
cttccagagatccatgaatacc

SEQ ID NO: 8070220 - DNA, 22 bp, Homo sapiens
cttccagaggaactctgcagtg

SEQ ID NO: 8070221 - DNA, 22 bp, Homo sapiens
cttccacattatttaggaatcc

SEQ ID NO: 8070222 - DNA, 20 bp, Homo sapiens
cttccacacaagaagcacag

SEQ ID NO: 8070223 - DNA, 22 bp, Homo sapiens
cttccaagcccaggagccattt

SEQ ID NO: 8070224 - DNA, 22 bp, Homo sapiens
cttccaagatgaacagcaagcg

SEQ ID NO: 8070225 - DNA, 22 bp, Homo sapiens
cttcctggtttgaagctcgccg

SEQ ID NO: 8070226 - DNA, 22 bp, Homo sapiens
cttctcaaacctgaaaggacaa

SEQ ID NO: 8070227 - DNA, 22 bp, Homo sapiens
cttctaggcttctcagggggca

SEQ ID NO: 8070228 - DNA, 22 bp, Homo sapiens
cttataaagtccatctgaacaa

SEQ ID NO: 8070229 - DNA, 22 bp, Homo sapiens
cttccaaacccagggtatgggc

SEQ ID NO: 8070230 - DNA, 22 bp, Homo sapiens
cttccaaagcactttatggacc

SEQ ID NO: 8070231 - DNA, 22 bp, Homo sapiens
cttatagaatgtttttatatgt

SEQ ID NO: 8070232 - DNA, 23 bp, Homo sapiens
cttcattgtagtgttggggagat

SEQ ID NO: 8070233 - DNA, 22 bp, Homo sapiens
cttagaaatcgaactcaggtta

SEQ ID NO: 8070234 - DNA, 22 bp, Homo sapiens
cttagaaatgcagattctcagg

SEQ ID NO: 8070235 - DNA, 22 bp, Homo sapiens
cttaatttttgtagtagatgga

SEQ ID NO: 8070236 - DNA, 22 bp, Homo sapiens
cttaatttaaaatagttcaggc

SEQ ID NO: 8070237 - DNA, 22 bp, Homo sapiens
ctgtttatagcagagcaagcct

SEQ ID NO: 8070238 - DNA, 22 bp, Homo sapiens
ctgtttatcatgtacatttcca

SEQ ID NO: 8070239 - DNA, 22 bp, Homo sapiens
ctgtttatactcaaaagataca

SEQ ID NO: 8070240 - DNA, 21 bp, Homo sapiens
ctgtttcttgtgaagtgacac

SEQ ID NO: 8070241 - DNA, 22 bp, Homo sapiens
ctgtttataaaccaccagttta

SEQ ID NO: 8070242 - DNA, 22 bp, Homo sapiens
ctgttttccctggagttcagca

SEQ ID NO: 8070243 - DNA, 22 bp, Homo sapiens
ctgtttttgtgctgtgtctccc

SEQ ID NO: 8070244 - DNA, 22 bp, Homo sapiens
ctgtttttgtgctgtgtctccc

SEQ ID NO: 8070245 - DNA, 22 bp, Homo sapiens
ctttaattaggaagtataatga

SEQ ID NO: 8070246 - DNA, 22 bp, Homo sapiens
ctttctttgtccaccaacaatg

SEQ ID NO: 8070247 - DNA, 22 bp, Homo sapiens
cttctcttggtagttcttgttg

SEQ ID NO: 8070248 - DNA, 22 bp, Homo sapiens
cttctggaggacactggcccca

SEQ ID NO: 8070249 - DNA, 22 bp, Homo sapiens
cttgtggagatatccatgtctg

SEQ ID NO: 8070250 - DNA, 22 bp, Homo sapiens
cttttcttactcccgcaaggca

SEQ ID NO: 8070251 - DNA, 22 bp, Homo sapiens
cttttccactgagcctcacaaa

SEQ ID NO: 8070252 - DNA, 22 bp, Homo sapiens
gaaacacatgcagctccataga

SEQ ID NO: 8070253 - DNA, 22 bp, Homo sapiens
gaaagaggaaggagatgtatta

SEQ ID NO: 8070254 - DNA, 22 bp, Homo sapiens
tgcagagagatatggcaagagg

SEQ ID NO: 8070255 - DNA, 22 bp, Homo sapiens
tgcagagacttgtgtgcatttg

SEQ ID NO: 8070256 - DNA, 22 bp, Homo sapiens
tgcagagaagaggacagttcta

SEQ ID NO: 8070257 - DNA, 22 bp, Homo sapiens
tgcagagaaagtgtagacaggc

SEQ ID NO: 8070258 - DNA, 22 bp, Homo sapiens
tgcactccaggctgggtgacag

SEQ ID NO: 8070259 - DNA, 22 bp, Homo sapiens
cccagagctccggtcctgccca

SEQ ID NO: 8070260 - DNA, 22 bp, Homo sapiens
cccagagctgagtctgatatat

SEQ ID NO: 8070261 - DNA, 22 bp, Homo sapiens
cccagagctccggtcctgccca

SEQ ID NO: 8070262 - DNA, 22 bp, Homo sapiens
cccagagcctcattctgttggg

SEQ ID NO: 8070263 - DNA, 22 bp, Homo sapiens
cccaagcctttcaaaactcaga

SEQ ID NO: 8070264 - DNA, 23 bp, Homo sapiens
cccaagcctgtgccctctgactc

SEQ ID NO: 8070265 - DNA, 23 bp, Homo sapiens
cccaagcctgtgccctctgactc

SEQ ID NO: 8070266 - DNA, 22 bp, Homo sapiens
cccaagccagaccctgaccctg

SEQ ID NO: 8070267 - DNA, 22 bp, Homo sapiens
cccaagggagtgcctggtcaac

SEQ ID NO: 8070268 - DNA, 22 bp, Homo sapiens
tgcagggccttctagaccatgg

SEQ ID NO: 8070269 - DNA, 22 bp, Homo sapiens
cccagcaggtcggtgctgcctg

SEQ ID NO: 8070270 - DNA, 22 bp, Homo sapiens
tgcaggaatagctacagagctg

SEQ ID NO: 8070271 - DNA, 20 bp, Homo sapiens
tgcaggaatttgcattcctt

SEQ ID NO: 8070272 - DNA, 22 bp, Homo sapiens
tgcaggaatgaggttctcagtt

SEQ ID NO: 8070273 - DNA, 20 bp, Homo sapiens
tgcagctgcaggagggtggg

SEQ ID NO: 8070274 - DNA, 22 bp, Homo sapiens
tgcagctgattaaagggcagac

SEQ ID NO: 8070275 - DNA, 17 bp, Homo sapiens
tgaggccatggcaccat

SEQ ID NO: 8070276 - DNA, 22 bp, Homo sapiens
tgaggccatggaactagcttgg

SEQ ID NO: 8070277 - DNA, 22 bp, Homo sapiens
tgaggccatggtcttcccagtc

SEQ ID NO: 8070278 - DNA, 22 bp, Homo sapiens
tgaggccagggattccatcatt

SEQ ID NO: 8070279 - DNA, 22 bp, Homo sapiens
tgaggccaggcaaaggcgatct

SEQ ID NO: 8070280 - DNA, 22 bp, Homo sapiens
tgaggccagtctcatcacaggc

SEQ ID NO: 8070281 - DNA, 22 bp, Homo sapiens
tgaggccatgcccgtgccggcc

SEQ ID NO: 8070282 - DNA, 22 bp, Homo sapiens
tgaggctgacaaaagatgaggt

SEQ ID NO: 8070283 - DNA, 22 bp, Homo sapiens
ccatcccttctctggccagcag

SEQ ID NO: 8070284 - DNA, 22 bp, Homo sapiens
tgagtccaagagccagtgggaa

SEQ ID NO: 8070285 - DNA, 22 bp, Homo sapiens
tgagtccactttaaaatgtcag

SEQ ID NO: 8070286 - DNA, 22 bp, Homo sapiens
tgagtccaccttagtatatggg

SEQ ID NO: 8070287 - DNA, 22 bp, Homo sapiens
tgagtccaccttagtatatggg

SEQ ID NO: 8070288 - DNA, 22 bp, Homo sapiens
tgagtccaataggggcctggaa

SEQ ID NO: 8070289 - DNA, 22 bp, Homo sapiens
tgagtccatgtggaggggaggt

SEQ ID NO: 8070290 - DNA, 22 bp, Homo sapiens
tgagtccatcgcagggaagtgg

SEQ ID NO: 8070291 - DNA, 22 bp, Homo sapiens
tgagtccattgatggatagtga

SEQ ID NO: 8070292 - DNA, 22 bp, Homo sapiens
ccaggtggcttctgcccgatgt

SEQ ID NO: 8070293 - DNA, 22 bp, Homo sapiens
ccaggtgggaggaaagcagaga

SEQ ID NO: 8070294 - DNA, 22 bp, Homo sapiens
ccaggtggacggcgagtacagg

SEQ ID NO: 8070295 - DNA, 22 bp, Homo sapiens
ccaggtggaggtgtgaggtcct

SEQ ID NO: 8070296 - DNA, 22 bp, Homo sapiens
ccagtcagccaagctgcagcgg

SEQ ID NO: 8070297 - DNA, 22 bp, Homo sapiens
ccagtcagggcaggagcctggt

SEQ ID NO: 8070298 - DNA, 22 bp, Homo sapiens
ccagggctgctgtgggactcca

SEQ ID NO: 8070299 - DNA, 22 bp, Homo sapiens
tgagcagagacgggggcctcca

SEQ ID NO: 8070300 - DNA, 21 bp, Homo sapiens
ccagtgctacagctgcctgac

SEQ ID NO: 8070301 - DNA, 22 bp, Homo sapiens
tgagccatgggactccaaggga

SEQ ID NO: 8070302 - DNA, 22 bp, Homo sapiens
ccaggagcagggctggctgcac

SEQ ID NO: 8070303 - DNA, 22 bp, Homo sapiens
ccaggagcattaagagaacata

SEQ ID NO: 8070304 - DNA, 22 bp, Homo sapiens
ccaggagcaggagctggacaga

SEQ ID NO: 8070305 - DNA, 22 bp, Homo sapiens
ccaggagcagatatggacataa

SEQ ID NO: 8070306 - DNA, 22 bp, Homo sapiens
tctgttcaggtttcagagaact

SEQ ID NO: 8070307 - DNA, 22 bp, Homo sapiens
tctgttcagttgattagacaga

SEQ ID NO: 8070308 - DNA, 22 bp, Homo sapiens
tctgttcagctgcctcagggta

SEQ ID NO: 8070309 - DNA, 20 bp, Homo sapiens
tctgttattgcatgtacata

SEQ ID NO: 8070310 - DNA, 22 bp, Homo sapiens
ccaggaggcggaggttgcagcg

SEQ ID NO: 8070311 - DNA, 22 bp, Homo sapiens
tctgttcctggtctctggagct

SEQ ID NO: 8070312 - DNA, 22 bp, Homo sapiens
tctgttcatgtctttttaagtg

SEQ ID NO: 8070313 - DNA, 22 bp, Homo sapiens
tctgttccagtagaaaggtgca

SEQ ID NO: 8070314 - DNA, 22 bp, Homo sapiens
tctgttccatgttttgttccat

SEQ ID NO: 8070315 - DNA, 22 bp, Homo sapiens
ccagcaccttgatcttggagtt

SEQ ID NO: 8070316 - DNA, 22 bp, Homo sapiens
ccaggagcaacttgaaggcaag

SEQ ID NO: 8070317 - DNA, 22 bp, Homo sapiens
tctggggagtcaaagagacctg

SEQ ID NO: 8070318 - DNA, 22 bp, Homo sapiens
tctggggagggagccacaggtc

SEQ ID NO: 8070319 - DNA, 22 bp, Homo sapiens
tctggggaccatggcatctaaa

SEQ ID NO: 8070320 - DNA, 22 bp, Homo sapiens
tctgggctctgtcagcacctct

SEQ ID NO: 8070321 - DNA, 21 bp, Homo sapiens
ccaggcagagctgtgagttct

SEQ ID NO: 8070322 - DNA, 22 bp, Homo sapiens
ccaggcagagggatccccatcc

SEQ ID NO: 8070323 - DNA, 22 bp, Homo sapiens
ccaggcagagtgctccagaaag

SEQ ID NO: 8070324 - DNA, 22 bp, Homo sapiens
ccaggcagagtgctccagaaag

SEQ ID NO: 8070325 - DNA, 22 bp, Homo sapiens
ccaggcagcaaattttctgaat

SEQ ID NO: 8070326 - DNA, 22 bp, Homo sapiens
tcttaattctgtgtcttcacta

SEQ ID NO: 8070327 - DNA, 22 bp, Homo sapiens
tcttaattgagaacagtgtagg

SEQ ID NO: 8070328 - DNA, 22 bp, Homo sapiens
ccaggaggcggaggttgcagtg

SEQ ID NO: 8070329 - DNA, 22 bp, Homo sapiens
ccaggcagaatgaaacccctgt

SEQ ID NO: 8070330 - DNA, 22 bp, Homo sapiens
ccaggcaggcgatggtgcagtg

SEQ ID NO: 8070331 - DNA, 22 bp, Homo sapiens
ccaggcaggcagcgttctcagg

SEQ ID NO: 8070332 - DNA, 22 bp, Homo sapiens
ccaggcagcctgctccattctg

SEQ ID NO: 8070333 - DNA, 22 bp, Homo sapiens
ccagggcatcctcacatcgcag

SEQ ID NO: 8070334 - DNA, 22 bp, Homo sapiens
ccagggcatcacatccagtgtt

SEQ ID NO: 8070335 - DNA, 22 bp, Homo sapiens
ccagggcagtgggagaaggtgc

SEQ ID NO: 8070336 - DNA, 22 bp, Homo sapiens
ccagggctccattgctcatcct

SEQ ID NO: 8070337 - DNA, 22 bp, Homo sapiens
ccagggctgagctgtgaccatg

SEQ ID NO: 8070338 - DNA, 22 bp, Homo sapiens
ccagggctgccgcatccctggt

SEQ ID NO: 8070339 - DNA, 22 bp, Homo sapiens
ccagggcaacgctgtctcagag

SEQ ID NO: 8070340 - DNA, 22 bp, Homo sapiens
ccagggcaaatgagatcatagc

SEQ ID NO: 8070341 - DNA, 22 bp, Homo sapiens
ccagggcaataggaacactttt

SEQ ID NO: 8070342 - DNA, 22 bp, Homo sapiens
ccagggcaattatttggagggt

SEQ ID NO: 8070343 - DNA, 22 bp, Homo sapiens
ccagggcaggggctggagttca

SEQ ID NO: 8070344 - DNA, 22 bp, Homo sapiens
ccagggcaggagaaagactcac

SEQ ID NO: 8070345 - DNA, 22 bp, Homo sapiens
ccagggcagggaccacgtgtct

SEQ ID NO: 8070346 - DNA, 22 bp, Homo sapiens
ccagggcacgttgggacagtac

SEQ ID NO: 8070347 - DNA, 22 bp, Homo sapiens
ccagggatgccaagctttacca

SEQ ID NO: 8070348 - DNA, 22 bp, Homo sapiens
ccagggatgcagaggttgcagt

SEQ ID NO: 8070349 - DNA, 22 bp, Homo sapiens
tgaaacactttcaattacatat

SEQ ID NO: 8070350 - DNA, 21 bp, Homo sapiens
tgaaacactctttccatgaga

SEQ ID NO: 8070351 - DNA, 22 bp, Homo sapiens
tcttttgtgattctttagttac

SEQ ID NO: 8070352 - DNA, 22 bp, Homo sapiens
tcttttgtgattcttcagttac

SEQ ID NO: 8070353 - DNA, 22 bp, Homo sapiens
tcttttgtgattcttcagttac

SEQ ID NO: 8070354 - DNA, 21 bp, Homo sapiens
tgaaacaatcagacagagtct

SEQ ID NO: 8070355 - DNA, 22 bp, Homo sapiens
ccaggctgtggtttagatagag

SEQ ID NO: 8070356 - DNA, 22 bp, Homo sapiens
ccaggctgtaagagtgatgttg

SEQ ID NO: 8070357 - DNA, 21 bp, Homo sapiens
tgaaatgagaatgctgagcac

SEQ ID NO: 8070358 - DNA, 22 bp, Homo sapiens
tcttttcttgcattattgcact

SEQ ID NO: 8070359 - DNA, 22 bp, Homo sapiens
tcttgcacttcatgaatatgtt

SEQ ID NO: 8070360 - DNA, 22 bp, Homo sapiens
tgggacaggaggcctctggaga

SEQ ID NO: 8070361 - DNA, 22 bp, Homo sapiens
tgggacaggatgaccagaaggt

SEQ ID NO: 8070362 - DNA, 22 bp, Homo sapiens
tgggacaggaggcctctggaga

SEQ ID NO: 8070363 - DNA, 22 bp, Homo sapiens
tgggacagagtgagctttggcc

SEQ ID NO: 8070364 - DNA, 22 bp, Homo sapiens
tgggcagaaatcagtatcagat

SEQ ID NO: 8070365 - DNA, 22 bp, Homo sapiens
tgggcagaaggaagagccacct

SEQ ID NO: 8070366 - DNA, 22 bp, Homo sapiens
tgggcagaatgtgggatccaga

SEQ ID NO: 8070367 - DNA, 22 bp, Homo sapiens
tgggcagacgctgttggaaggc

SEQ ID NO: 8070368 - DNA, 22 bp, Homo sapiens
tgggcagacattgagtttgttc

SEQ ID NO: 8070369 - DNA, 22 bp, Homo sapiens
tgggcagaattgtggtagttaa

SEQ ID NO: 8070370 - DNA, 22 bp, Homo sapiens
tgggcagactaaggtcaaagct

SEQ ID NO: 8070371 - DNA, 22 bp, Homo sapiens
tgggcagacgggagcttgcctt

SEQ ID NO: 8070372 - DNA, 22 bp, Homo sapiens
tggcttccccggagtgacatgt

SEQ ID NO: 8070373 - DNA, 22 bp, Homo sapiens
cctcctggtccagcatctcttt

SEQ ID NO: 8070374 - DNA, 22 bp, Homo sapiens
cctctcccacgtggcagaggct

SEQ ID NO: 8070375 - DNA, 22 bp, Homo sapiens
cctctccagttttaacgtgacc

SEQ ID NO: 8070376 - DNA, 22 bp, Homo sapiens
cctctcccaggcgcggcggcag

SEQ ID NO: 8070377 - DNA, 22 bp, Homo sapiens
cctctcccgggtgccgctgggc

SEQ ID NO: 8070378 - DNA, 19 bp, Homo sapiens
cctctcccatgcttacctc

SEQ ID NO: 8070379 - DNA, 22 bp, Homo sapiens
cctctcccctcccaaggcggga

SEQ ID NO: 8070380 - DNA, 22 bp, Homo sapiens
cctctcccagggagagcctgag

SEQ ID NO: 8070381 - DNA, 22 bp, Homo sapiens
cctcccaccgtatctcagtggc

SEQ ID NO: 8070382 - DNA, 22 bp, Homo sapiens
cctcccaccatttagagagagc

SEQ ID NO: 8070383 - DNA, 22 bp, Homo sapiens
cctcccacattgaggacatgct

SEQ ID NO: 8070384 - DNA, 19 bp, Homo sapiens
cctcccacggattccttcc

SEQ ID NO: 8070385 - DNA, 23 bp, Homo sapiens
cctcccacctatttcactttctt

SEQ ID NO: 8070386 - DNA, 22 bp, Homo sapiens
cctcccacttcttgctgaggtc

SEQ ID NO: 8070387 - DNA, 22 bp, Homo sapiens
cctccaggtgttacatatgact

SEQ ID NO: 8070388 - DNA, 22 bp, Homo sapiens
cctcccacatcctagctctgct

SEQ ID NO: 8070389 - DNA, 17 bp, Homo sapiens
cctcccacaccgccctg

SEQ ID NO: 8070390 - DNA, 22 bp, Homo sapiens
cctccagggcagacggggagca

SEQ ID NO: 8070391 - DNA, 21 bp, Homo sapiens
cctccaggtgattccgtgctc

SEQ ID NO: 8070392 - DNA, 22 bp, Homo sapiens
tggcagtggctttgctggtgga

SEQ ID NO: 8070393 - DNA, 22 bp, Homo sapiens
tggcagtgggaagctggaagtc

SEQ ID NO: 8070394 - DNA, 22 bp, Homo sapiens
tggcagtggtaccggctctcag

SEQ ID NO: 8070395 - DNA, 22 bp, Homo sapiens
tggcagtggtgtctgcacaggc

SEQ ID NO: 8070396 - DNA, 22 bp, Homo sapiens
tggcagtgggaatggacaaaca

SEQ ID NO: 8070397 - DNA, 22 bp, Homo sapiens
tggcagtgggaagctggaagtc

SEQ ID NO: 8070398 - DNA, 22 bp, Homo sapiens
tggcagtgtcttatcaggagtg

SEQ ID NO: 8070399 - DNA, 22 bp, Homo sapiens
tggcagtgtcttgctggggcag

SEQ ID NO: 8070400 - DNA, 22 bp, Homo sapiens
tggcagtgtcctactggttggt

SEQ ID NO: 8070401 - DNA, 22 bp, Homo sapiens
tggcagtgtataggtggctcct

SEQ ID NO: 8070402 - DNA, 22 bp, Homo sapiens
tggcagtgtataggtggctcct

SEQ ID NO: 8070403 - DNA, 19 bp, Homo sapiens
tggcagtgtggcttccaga

SEQ ID NO: 8070404 - DNA, 22 bp, Homo sapiens
tggcagtgtgggaggaaggtac

SEQ ID NO: 8070405 - DNA, 23 bp, Homo sapiens
tggggagagttaccctggaagcg

SEQ ID NO: 8070406 - DNA, 22 bp, Homo sapiens
cctgcagctgtaggagaaggcg

SEQ ID NO: 8070407 - DNA, 22 bp, Homo sapiens
cctgatggagccctgctgcatg

SEQ ID NO: 8070408 - DNA, 22 bp, Homo sapiens
tgggcctggagccctggagagt

SEQ ID NO: 8070409 - DNA, 22 bp, Homo sapiens
tgggcctggagtttgtccagag

SEQ ID NO: 8070410 - DNA, 22 bp, Homo sapiens
tgggccgtggagcactctgaga

SEQ ID NO: 8070411 - DNA, 22 bp, Homo sapiens
tgggcctggacatctgtatttt

SEQ ID NO: 8070412 - DNA, 22 bp, Homo sapiens
tgggcctggacaaggccactag

SEQ ID NO: 8070413 - DNA, 22 bp, Homo sapiens
tgggctccgttgcctggggcag

SEQ ID NO: 8070414 - DNA, 22 bp, Homo sapiens
tgggctccagcacctgtgctct

SEQ ID NO: 8070415 - DNA, 22 bp, Homo sapiens
tgggcctgggagggcagacgct

SEQ ID NO: 8070416 - DNA, 22 bp, Homo sapiens
tgggcctgggagggcagacgct

SEQ ID NO: 8070417 - DNA, 22 bp, Homo sapiens
tgggctcatggcccagcactgg

SEQ ID NO: 8070418 - DNA, 22 bp, Homo sapiens
tgggcctggccctgtggaggag

SEQ ID NO: 8070419 - DNA, 23 bp, Homo sapiens
tgggcctggcctcccagtccagc

SEQ ID NO: 8070420 - DNA, 22 bp, Homo sapiens
cctgcaggtaaggctaactgcc

SEQ ID NO: 8070421 - DNA, 22 bp, Homo sapiens
cctgcaggggagagacttctag

SEQ ID NO: 8070422 - DNA, 17 bp, Homo sapiens
cctgcagtgcctgtcgg

SEQ ID NO: 8070423 - DNA, 22 bp, Homo sapiens
cctgcatccgaaagtgatcata

SEQ ID NO: 8070424 - DNA, 22 bp, Homo sapiens
tgggtggcagcttcagcatgtt

SEQ ID NO: 8070425 - DNA, 22 bp, Homo sapiens
tgggtggcacttctggggtcca

SEQ ID NO: 8070426 - DNA, 18 bp, Homo sapiens
tgggtggctagggagttt

SEQ ID NO: 8070427 - DNA, 22 bp, Homo sapiens
tgggtggcggcctggttctgag

SEQ ID NO: 8070428 - DNA, 22 bp, Homo sapiens
tgggtggaataaatcagttctg

SEQ ID NO: 8070429 - DNA, 22 bp, Homo sapiens
cctgcccagcttcacctcaggc

SEQ ID NO: 8070430 - DNA, 22 bp, Homo sapiens
tggtactgagaatagcgtctac

SEQ ID NO: 8070431 - DNA, 22 bp, Homo sapiens
cctgcctatgagacgttttgcc

SEQ ID NO: 8070432 - DNA, 22 bp, Homo sapiens
cctgcctcatcaacttgtcgtg

SEQ ID NO: 8070433 - DNA, 22 bp, Homo sapiens
tgctgccttctaggcgtgccct

SEQ ID NO: 8070434 - DNA, 22 bp, Homo sapiens
tgctctgcaagcaggagcaaga

SEQ ID NO: 8070435 - DNA, 22 bp, Homo sapiens
tgctctgaggcacatgccatcg

SEQ ID NO: 8070436 - DNA, 22 bp, Homo sapiens
tgctcaggtcgttctgcccctt

SEQ ID NO: 8070437 - DNA, 22 bp, Homo sapiens
cccagtcctaaagcagacgcca

SEQ ID NO: 8070438 - DNA, 19 bp, Homo sapiens
cccagtctaggtcctagga

SEQ ID NO: 8070439 - DNA, 22 bp, Homo sapiens
tgcagggctaagtcagagcctg

SEQ ID NO: 8070440 - DNA, 22 bp, Homo sapiens
tgctacactcaatcagtgctat

SEQ ID NO: 8070441 - DNA, 22 bp, Homo sapiens
tgctacataccacgatgcagta

SEQ ID NO: 8070442 - DNA, 22 bp, Homo sapiens
tgctcagcttcagaggatcccc

SEQ ID NO: 8070443 - DNA, 22 bp, Homo sapiens
tgctcaggaaataatgtctgtg

SEQ ID NO: 8070444 - DNA, 20 bp, Homo sapiens
tgctcaggatggagaggtgt

SEQ ID NO: 8070445 - DNA, 22 bp, Homo sapiens
tgctcagggacaatggagaggg

SEQ ID NO: 8070446 - DNA, 22 bp, Homo sapiens
tgctgggggtgtctcaccaggc

SEQ ID NO: 8070447 - DNA, 22 bp, Homo sapiens
tgctgggggtgtctcaccaggc

SEQ ID NO: 8070448 - DNA, 22 bp, Homo sapiens
tgctgggggtgtctcaccaggc

SEQ ID NO: 8070449 - DNA, 22 bp, Homo sapiens
tgctgggggttcagatgagtaa

SEQ ID NO: 8070450 - DNA, 22 bp, Homo sapiens
tgctgggggctttctggatacc

SEQ ID NO: 8070451 - DNA, 22 bp, Homo sapiens
tgctggggctctgaccactcca

SEQ ID NO: 8070452 - DNA, 22 bp, Homo sapiens
ccccagctgcatacttgccaag

SEQ ID NO: 8070453 - DNA, 18 bp, Homo sapiens
tgctggggtagaatccac

SEQ ID NO: 8070454 - DNA, 22 bp, Homo sapiens
cccagtgttccttgaggggctg

SEQ ID NO: 8070455 - DNA, 22 bp, Homo sapiens
cccagtgtctcttgtgcctttc

SEQ ID NO: 8070456 - DNA, 22 bp, Homo sapiens
cccagtgtctccaacatcagat

SEQ ID NO: 8070457 - DNA, 20 bp, Homo sapiens
cccagtgtccagccttgcca

SEQ ID NO: 8070458 - DNA, 22 bp, Homo sapiens
cccagtgtcattctaagggagg

SEQ ID NO: 8070459 - DNA, 22 bp, Homo sapiens
cccagtgtcaccaacaggacac

SEQ ID NO: 8070460 - DNA, 22 bp, Homo sapiens
cccagtgtctgggcctgcaggg

SEQ ID NO: 8070461 - DNA, 22 bp, Homo sapiens
cccagtgtgatgaggttgctaa

SEQ ID NO: 8070462 - DNA, 22 bp, Homo sapiens
cccagtgtggttgtgaattctg

SEQ ID NO: 8070463 - DNA, 22 bp, Homo sapiens
cccagtgtggttctttggagaa

SEQ ID NO: 8070464 - DNA, 22 bp, Homo sapiens
cccagtgtgatgaggttgctaa

SEQ ID NO: 8070465 - DNA, 22 bp, Homo sapiens
cccagtgtgcccctcctgcagc

SEQ ID NO: 8070466 - DNA, 22 bp, Homo sapiens
tgctgctcaatgagatgccatc

SEQ ID NO: 8070467 - DNA, 22 bp, Homo sapiens
tgcttccttcccgttcttctcc

SEQ ID NO: 8070468 - DNA, 22 bp, Homo sapiens
tgcttccttgagctctccaatc

SEQ ID NO: 8070469 - DNA, 19 bp, Homo sapiens
tgcttcctcaccatctccc

SEQ ID NO: 8070470 - DNA, 22 bp, Homo sapiens
tgcttcctgaggccgtcttctc

SEQ ID NO: 8070471 - DNA, 22 bp, Homo sapiens
ccctccccacaaagcttcacac

SEQ ID NO: 8070472 - DNA, 22 bp, Homo sapiens
tggaaagaattcctatggttca

SEQ ID NO: 8070473 - DNA, 22 bp, Homo sapiens
tggaaagaaagtaaaggcgtat

SEQ ID NO: 8070474 - DNA, 22 bp, Homo sapiens
tggagacacaggaccagactgc

SEQ ID NO: 8070475 - DNA, 20 bp, Homo sapiens
tggagacaattgcccttttt

SEQ ID NO: 8070476 - DNA, 22 bp, Homo sapiens
tggaaagaaaaacaggccatga

SEQ ID NO: 8070477 - DNA, 22 bp, Homo sapiens
tggaggcataggcctgggccct

SEQ ID NO: 8070478 - DNA, 22 bp, Homo sapiens
tggaggcatcagagtgcttggc

SEQ ID NO: 8070479 - DNA, 22 bp, Homo sapiens
ccctggagggatttctcaatca

SEQ ID NO: 8070480 - DNA, 22 bp, Homo sapiens
ccctggaggaccccaatgtggc

SEQ ID NO: 8070481 - DNA, 22 bp, Homo sapiens
tggaggcattttaggttgtcac

SEQ ID NO: 8070482 - DNA, 22 bp, Homo sapiens
tggaggaatcagggcttaggct

SEQ ID NO: 8070483 - DNA, 22 bp, Homo sapiens
tggaggaataacagcaacctta

SEQ ID NO: 8070484 - DNA, 22 bp, Homo sapiens
tggaggaagtggacagttgtgt

SEQ ID NO: 8070485 - DNA, 22 bp, Homo sapiens
tggaggaagttgctggaagtca

SEQ ID NO: 8070486 - DNA, 22 bp, Homo sapiens
tggaggaagtggctggccagaa

SEQ ID NO: 8070487 - DNA, 22 bp, Homo sapiens
tggcagagaacacacatgattc

SEQ ID NO: 8070488 - DNA, 22 bp, Homo sapiens
tggcagagaacacacatgattc

SEQ ID NO: 8070489 - DNA, 21 bp, Homo sapiens
tggcagacaggaggagctcac

SEQ ID NO: 8070490 - DNA, 22 bp, Homo sapiens
ccctggagtgtgacgaggcatt

SEQ ID NO: 8070491 - DNA, 22 bp, Homo sapiens
tggcagaagtacacaagcatgc

SEQ ID NO: 8070492 - DNA, 22 bp, Homo sapiens
ccctggagtccggagctcacct

SEQ ID NO: 8070493 - DNA, 22 bp, Homo sapiens
ccctggagtgccggaatcaaga

SEQ ID NO: 8070494 - DNA, 22 bp, Homo sapiens
ccctggagtcaggttggcctgg

SEQ ID NO: 8070495 - DNA, 22 bp, Homo sapiens
ccctggagtagcactgggtcgc

SEQ ID NO: 8070496 - DNA, 23 bp, Homo sapiens
ccctggagtaaattcttggaagg

SEQ ID NO: 8070497 - DNA, 22 bp, Homo sapiens
ccctggaggtggaggttgcagg

SEQ ID NO: 8070498 - DNA, 22 bp, Homo sapiens
ccctggaggttgaggctgcagt

SEQ ID NO: 8070499 - DNA, 22 bp, Homo sapiens
ccctggagggcagacagatgcc

SEQ ID NO: 8070500 - DNA, 22 bp, Homo sapiens
ccctggaggtcagaggcctggg

SEQ ID NO: 8070501 - DNA, 22 bp, Homo sapiens
ccctgggacccgctgcagaggc

SEQ ID NO: 8070502 - DNA, 22 bp, Homo sapiens
tggcaggctgagttggcctggt

SEQ ID NO: 8070503 - DNA, 19 bp, Homo sapiens
tggcaggcccaggatggac

SEQ ID NO: 8070504 - DNA, 22 bp, Homo sapiens
cccttgggtgccagccacaagt

SEQ ID NO: 8070505 - DNA, 22 bp, Homo sapiens
tggcagggaatacagatgttta

SEQ ID NO: 8070506 - DNA, 19 bp, Homo sapiens
tggcagggagagtttgaag

SEQ ID NO: 8070507 - DNA, 21 bp, Homo sapiens
tcctgccttagtccagagcag

SEQ ID NO: 8070508 - DNA, 22 bp, Homo sapiens
tcctggagccacggagctttca

SEQ ID NO: 8070509 - DNA, 22 bp, Homo sapiens
tcctgccttgcctgggacatca

SEQ ID NO: 8070510 - DNA, 22 bp, Homo sapiens
tcctgccttcatactgctgtat

SEQ ID NO: 8070511 - DNA, 21 bp, Homo sapiens
ccaagagcaatgctaaggaga

SEQ ID NO: 8070512 - DNA, 20 bp, Homo sapiens
ccaagagcatgcatgaggaa

SEQ ID NO: 8070513 - DNA, 22 bp, Homo sapiens
ccaagagccatcctggtcaaca

SEQ ID NO: 8070514 - DNA, 22 bp, Homo sapiens
ccacagggaacatgacagcctt

SEQ ID NO: 8070515 - DNA, 22 bp, Homo sapiens
ccacagggactgttaaaaccct

SEQ ID NO: 8070516 - DNA, 22 bp, Homo sapiens
ccacagggataggaatggggct

SEQ ID NO: 8070517 - DNA, 16 bp, Homo sapiens
ccacagggcaaggggc

SEQ ID NO: 8070518 - DNA, 22 bp, Homo sapiens
ccacagggcacaagggaggttg

SEQ ID NO: 8070519 - DNA, 22 bp, Homo sapiens
ccacagggcacagacaggaagc

SEQ ID NO: 8070520 - DNA, 22 bp, Homo sapiens
ccacagggcctttcctgctggc

SEQ ID NO: 8070521 - DNA, 22 bp, Homo sapiens
tcctggagcttccttcatggta

SEQ ID NO: 8070522 - DNA, 22 bp, Homo sapiens
ccacagctgacaatggatagac

SEQ ID NO: 8070523 - DNA, 22 bp, Homo sapiens
ccacaggggtctctgtagctga

SEQ ID NO: 8070524 - DNA, 21 bp, Homo sapiens
ccacaggggctcccctgtcag

SEQ ID NO: 8070525 - DNA, 22 bp, Homo sapiens
ccacagggctctaggcgcttcc

SEQ ID NO: 8070526 - DNA, 22 bp, Homo sapiens
ccacaggggcccacgagccgct

SEQ ID NO: 8070527 - DNA, 22 bp, Homo sapiens
ccaccaggacagccctgagggg

SEQ ID NO: 8070528 - DNA, 22 bp, Homo sapiens
catttccactctgggagtcaga

SEQ ID NO: 8070529 - DNA, 22 bp, Homo sapiens
catttcatagttgtcacaataa

SEQ ID NO: 8070530 - DNA, 21 bp, Homo sapiens
catttcatgattatagaaatg

SEQ ID NO: 8070531 - DNA, 22 bp, Homo sapiens
cattttctcaatgaaccctctt

SEQ ID NO: 8070532 - DNA, 22 bp, Homo sapiens
ccagagcccagggtcatgcagg

SEQ ID NO: 8070533 - DNA, 22 bp, Homo sapiens
ccagagcccagcacacggtgct

SEQ ID NO: 8070534 - DNA, 22 bp, Homo sapiens
ccagagccagagaggtgcctgc

SEQ ID NO: 8070535 - DNA, 22 bp, Homo sapiens
ccagagcagggcagcagggctc

SEQ ID NO: 8070536 - DNA, 22 bp, Homo sapiens
ccagagagggcgccacctggag

SEQ ID NO: 8070537 - DNA, 22 bp, Homo sapiens
ccagagccggctccctcagctt

SEQ ID NO: 8070538 - DNA, 22 bp, Homo sapiens
ccagagcccgggacctggactt

SEQ ID NO: 8070539 - DNA, 22 bp, Homo sapiens
ccagagccggattgtgaagtgc

SEQ ID NO: 8070540 - DNA, 22 bp, Homo sapiens
ccagagcccctgagcttccctg

SEQ ID NO: 8070541 - DNA, 19 bp, Homo sapiens
ccagagcccgccagatggg

SEQ ID NO: 8070542 - DNA, 22 bp, Homo sapiens
ccagagcctaagatctgatcct

SEQ ID NO: 8070543 - DNA, 22 bp, Homo sapiens
ccagagcctcgcccggagcctc

SEQ ID NO: 8070544 - DNA, 22 bp, Homo sapiens
ccagagcctcttatgaagatcg

SEQ ID NO: 8070545 - DNA, 22 bp, Homo sapiens
ccagaggctgggttcacctcag

SEQ ID NO: 8070546 - DNA, 22 bp, Homo sapiens
tctctgggataaactgggccag

SEQ ID NO: 8070547 - DNA, 22 bp, Homo sapiens
tctctgtacagtacatgccgtg

SEQ ID NO: 8070548 - DNA, 22 bp, Homo sapiens
tctctgtaaaatgtggatgata

SEQ ID NO: 8070549 - DNA, 22 bp, Homo sapiens
tctctgtattctgatattcact

SEQ ID NO: 8070550 - DNA, 22 bp, Homo sapiens
tctctgtatcccagaaccaaaa

SEQ ID NO: 8070551 - DNA, 21 bp, Homo sapiens
tctctgtatccatgggttcca

SEQ ID NO: 8070552 - DNA, 22 bp, Homo sapiens
tctctgtagagacagcactgtg

SEQ ID NO: 8070553 - DNA, 22 bp, Homo sapiens
tctctgtagggctgcttgagta

SEQ ID NO: 8070554 - DNA, 22 bp, Homo sapiens
tctctgtagttgggcagctgct

SEQ ID NO: 8070555 - DNA, 22 bp, Homo sapiens
tctataaattatgcagtctcag

SEQ ID NO: 8070556 - DNA, 22 bp, Homo sapiens
tctataaatgcagatatgtgtg

SEQ ID NO: 8070557 - DNA, 22 bp, Homo sapiens
tctcaggaatagagtggcagca

SEQ ID NO: 8070558 - DNA, 20 bp, Homo sapiens
tctcaggccccagttttctt

SEQ ID NO: 8070559 - DNA, 22 bp, Homo sapiens
tcctgtgttacccttgcagtga

SEQ ID NO: 8070560 - DNA, 20 bp, Homo sapiens
tcctgtgtgtctcatcaacc

SEQ ID NO: 8070561 - DNA, 22 bp, Homo sapiens
tccaggggtaccggccaggcag

SEQ ID NO: 8070562 - DNA, 22 bp, Homo sapiens
tccagggccaagtcatggaacc

SEQ ID NO: 8070563 - DNA, 22 bp, Homo sapiens
cattaataaacatttcagaaga

SEQ ID NO: 8070564 - DNA, 22 bp, Homo sapiens
catgtggtattgtgagatccac

SEQ ID NO: 8070565 - DNA, 22 bp, Homo sapiens
catgctaaccagagacataaag

SEQ ID NO: 8070566 - DNA, 22 bp, Homo sapiens
catgctaagtcataaaagagta

SEQ ID NO: 8070567 - DNA, 22 bp, Homo sapiens
tccaagatctacagcagtttag

SEQ ID NO: 8070568 - DNA, 18 bp, Homo sapiens
tccagaggtgttggagcc

SEQ ID NO: 8070569 - DNA, 20 bp, Homo sapiens
catggtggaggagcagggcc

SEQ ID NO: 8070570 - DNA, 22 bp, Homo sapiens
catgggctcttctggactgcac

SEQ ID NO: 8070571 - DNA, 19 bp, Homo sapiens
tccagatgatatggattac

SEQ ID NO: 8070572 - DNA, 22 bp, Homo sapiens
tccagatggatttaagacctaa

SEQ ID NO: 8070573 - DNA, 22 bp, Homo sapiens
catgcttcacacactgaatgac

SEQ ID NO: 8070574 - DNA, 22 bp, Homo sapiens
catcagagtggtggcctggtgt

SEQ ID NO: 8070575 - DNA, 22 bp, Homo sapiens
catcagtaaggcaacatagctt

SEQ ID NO: 8070576 - DNA, 22 bp, Homo sapiens
catcaggaaaaaactggagcca

SEQ ID NO: 8070577 - DNA, 22 bp, Homo sapiens
catcagtcagtctcttcagtat

SEQ ID NO: 8070578 - DNA, 22 bp, Homo sapiens
catcagtctgaaagccagggag

SEQ ID NO: 8070579 - DNA, 22 bp, Homo sapiens
catcagtgtggcagttcactgt

SEQ ID NO: 8070580 - DNA, 19 bp, Homo sapiens
tcagtgtgacttggtcagt

SEQ ID NO: 8070581 - DNA, 22 bp, Homo sapiens
tcagtgtgaggtcttccacccg

SEQ ID NO: 8070582 - DNA, 22 bp, Homo sapiens
tcagtgtgaattcattttagat

SEQ ID NO: 8070583 - DNA, 22 bp, Homo sapiens
tcagtgtgtaattctttgtttc

SEQ ID NO: 8070584 - DNA, 22 bp, Homo sapiens
tcagtgtggaaaatcctttggc

SEQ ID NO: 8070585 - DNA, 22 bp, Homo sapiens
tcatcagagctcccccaaacgt

SEQ ID NO: 8070586 - DNA, 22 bp, Homo sapiens
tcatcagaggcatctggcaagg

SEQ ID NO: 8070587 - DNA, 22 bp, Homo sapiens
tcagtttcctcatctacaaaag

SEQ ID NO: 8070588 - DNA, 22 bp, Homo sapiens
catccgcatgcaagtgctgtcc

SEQ ID NO: 8070589 - DNA, 22 bp, Homo sapiens
tcagtgtgtctctgcatttggg

SEQ ID NO: 8070590 - DNA, 22 bp, Homo sapiens
tcagtgtgtagtaaattgtagg

SEQ ID NO: 8070591 - DNA, 22 bp, Homo sapiens
catcctggttaccccatagtca

SEQ ID NO: 8070592 - DNA, 22 bp, Homo sapiens
tcaggcagaggatggggagcgt

SEQ ID NO: 8070593 - DNA, 22 bp, Homo sapiens
tcaggcagaggatggggagcgt

SEQ ID NO: 8070594 - DNA, 22 bp, Homo sapiens
tcaggcagaccaccgtgggcag

SEQ ID NO: 8070595 - DNA, 22 bp, Homo sapiens
tcaggcagagctgtggagctct

SEQ ID NO: 8070596 - DNA, 22 bp, Homo sapiens
tcaggcagagctgtggagctct

SEQ ID NO: 8070597 - DNA, 22 bp, Homo sapiens
tcaggcagaattatcaaaagat

SEQ ID NO: 8070598 - DNA, 22 bp, Homo sapiens
tcaggcagaccaccgtgggcag

SEQ ID NO: 8070599 - DNA, 22 bp, Homo sapiens
catcaaatctgacttttcttcc

SEQ ID NO: 8070600 - DNA, 21 bp, Homo sapiens
catattaaatcggtgccttta

SEQ ID NO: 8070601 - DNA, 22 bp, Homo sapiens
tcaggctgcccgttcagggctc

SEQ ID NO: 8070602 - DNA, 22 bp, Homo sapiens
catcagagtcagagctctttct

SEQ ID NO: 8070603 - DNA, 22 bp, Homo sapiens
tcaggctgcctatcagactgtg

SEQ ID NO: 8070604 - DNA, 22 bp, Homo sapiens
tcaggcagaaaaatcactaatt

SEQ ID NO: 8070605 - DNA, 22 bp, Homo sapiens
cagtgtcctcagccagcagcta

SEQ ID NO: 8070606 - DNA, 22 bp, Homo sapiens
cagggagaagtctggtcagtcc

SEQ ID NO: 8070607 - DNA, 22 bp, Homo sapiens
cagggagaggcatcatagggaa

SEQ ID NO: 8070608 - DNA, 22 bp, Homo sapiens
tagaacaatgaatttctggagg

SEQ ID NO: 8070609 - DNA, 22 bp, Homo sapiens
cagggacagccttggggtggcg

SEQ ID NO: 8070610 - DNA, 22 bp, Homo sapiens
caggctgatagggtccaaagtt

SEQ ID NO: 8070611 - DNA, 22 bp, Homo sapiens
caggctgcagcagcagtggccc

SEQ ID NO: 8070612 - DNA, 22 bp, Homo sapiens
caggctgcagaggcctttcatg

SEQ ID NO: 8070613 - DNA, 22 bp, Homo sapiens
tacctcaagttccaggaaagcg

SEQ ID NO: 8070614 - DNA, 22 bp, Homo sapiens
cagggcagtttgtgcctatgag

SEQ ID NO: 8070615 - DNA, 22 bp, Homo sapiens
cagggcagtgaagaacacacgt

SEQ ID NO: 8070616 - DNA, 22 bp, Homo sapiens
cagggcagtaccgccctctggc

SEQ ID NO: 8070617 - DNA, 22 bp, Homo sapiens
cagggcaggacagatacattac

SEQ ID NO: 8070618 - DNA, 22 bp, Homo sapiens
cagggccaagctgcagcatctg

SEQ ID NO: 8070619 - DNA, 22 bp, Homo sapiens
cagggccaagcccctttggctg

SEQ ID NO: 8070620 - DNA, 22 bp, Homo sapiens
cagggcagttttacttctctct

SEQ ID NO: 8070621 - DNA, 22 bp, Homo sapiens
tagcataacaggtaagagtgag

SEQ ID NO: 8070622 - DNA, 22 bp, Homo sapiens
tagcagcaatttcagaagtttg

SEQ ID NO: 8070623 - DNA, 22 bp, Homo sapiens
cagggagtttttgttcctctag

SEQ ID NO: 8070624 - DNA, 22 bp, Homo sapiens
cagggagggacaattgtcacct

SEQ ID NO: 8070625 - DNA, 22 bp, Homo sapiens
caggctcccaccctcctgcagc

SEQ ID NO: 8070626 - DNA, 22 bp, Homo sapiens
caggccctcgcccgcagcgacc

SEQ ID NO: 8070627 - DNA, 22 bp, Homo sapiens
caggccctgcactaggccctgg

SEQ ID NO: 8070628 - DNA, 22 bp, Homo sapiens
caggccacaagttgggttcaag

SEQ ID NO: 8070629 - DNA, 22 bp, Homo sapiens
cagctctgccacttcctagcta

SEQ ID NO: 8070630 - DNA, 22 bp, Homo sapiens
gtggagcaggactagctgagaa

SEQ ID NO: 8070631 - DNA, 22 bp, Homo sapiens
gtggagccaggatctccgcaca

SEQ ID NO: 8070632 - DNA, 23 bp, Homo sapiens
gtggagccacatcacaggctcct

SEQ ID NO: 8070633 - DNA, 22 bp, Homo sapiens
tacacagatttaaaagcaggga

SEQ ID NO: 8070634 - DNA, 22 bp, Homo sapiens
tacacagatttcagtatcatca

SEQ ID NO: 8070635 - DNA, 22 bp, Homo sapiens
tacacagatatgtgatcaatca

SEQ ID NO: 8070636 - DNA, 22 bp, Homo sapiens
tacacagagactcaaaagggca

SEQ ID NO: 8070637 - DNA, 22 bp, Homo sapiens
tacacagaggcagctgtctgct

SEQ ID NO: 8070638 - DNA, 22 bp, Homo sapiens
tacacagaggctgatgtcttag

SEQ ID NO: 8070639 - DNA, 22 bp, Homo sapiens
tacacagaggctgatgtcttag

SEQ ID NO: 8070640 - DNA, 22 bp, Homo sapiens
tacacagaagccagaaggcctg

SEQ ID NO: 8070641 - DNA, 22 bp, Homo sapiens
tacacagactcttcaattcaga

SEQ ID NO: 8070642 - DNA, 22 bp, Homo sapiens
gtggagccaggggctgtaggta

SEQ ID NO: 8070643 - DNA, 19 bp, Homo sapiens
cagtggagattggaggagg

SEQ ID NO: 8070644 - DNA, 22 bp, Homo sapiens
tcacaccagtttcctttcaatt

SEQ ID NO: 8070645 - DNA, 22 bp, Homo sapiens
cagtggaggccttgggaccttt

SEQ ID NO: 8070646 - DNA, 22 bp, Homo sapiens
cagtggaggctcaagtgtgctt

SEQ ID NO: 8070647 - DNA, 22 bp, Homo sapiens
cagtgcagttggtggcaggggt

SEQ ID NO: 8070648 - DNA, 22 bp, Homo sapiens
cagtgcagtttcccagatgctg

SEQ ID NO: 8070649 - DNA, 22 bp, Homo sapiens
tcactgcactccagcactcagg

SEQ ID NO: 8070650 - DNA, 22 bp, Homo sapiens
tcactgcagagacctctagtca

SEQ ID NO: 8070651 - DNA, 22 bp, Homo sapiens
tcactgcagcctctgcctcccg

SEQ ID NO: 8070652 - DNA, 22 bp, Homo sapiens
tcactgcaacctctgcctcccg

SEQ ID NO: 8070653 - DNA, 22 bp, Homo sapiens
tcactgcaagctcctcctcctg

SEQ ID NO: 8070654 - DNA, 22 bp, Homo sapiens
cagtctggaggtcagctggctt

SEQ ID NO: 8070655 - DNA, 22 bp, Homo sapiens
tcaaaggcggtccaggaataaa

SEQ ID NO: 8070656 - DNA, 22 bp, Homo sapiens
tcaaatgcttctactcctaaga

SEQ ID NO: 8070657 - DNA, 22 bp, Homo sapiens
tcaaaggcattgccaataagta

SEQ ID NO: 8070658 - DNA, 22 bp, Homo sapiens
tcaaaggcattgccaataagta

SEQ ID NO: 8070659 - DNA, 22 bp, Homo sapiens
tcaaaggcccattgtcccgttg

SEQ ID NO: 8070660 - DNA, 19 bp, Homo sapiens
tcaaaggcaaggaggaact

SEQ ID NO: 8070661 - DNA, 20 bp, Homo sapiens
tcaaaggcaaaggtgggtgt

SEQ ID NO: 8070662 - DNA, 22 bp, Homo sapiens
tcaaaggcaccaaggtcactgc

SEQ ID NO: 8070663 - DNA, 22 bp, Homo sapiens
tatattcaatgattagtatcag

SEQ ID NO: 8070664 - DNA, 22 bp, Homo sapiens
tatattcaacaggctaatgtca

SEQ ID NO: 8070665 - DNA, 22 bp, Homo sapiens
tatataatttgtaaaagcacct

SEQ ID NO: 8070666 - DNA, 22 bp, Homo sapiens
tatataatttgtaaaagcacct

SEQ ID NO: 8070667 - DNA, 22 bp, Homo sapiens
tatataactactattttgctca

SEQ ID NO: 8070668 - DNA, 22 bp, Homo sapiens
tatataatttgtaaaagcacct

SEQ ID NO: 8070669 - DNA, 22 bp, Homo sapiens
tagtttgagaattgaaatagaa

SEQ ID NO: 8070670 - DNA, 22 bp, Homo sapiens
tagtttgcgaaattcctgcctc

SEQ ID NO: 8070671 - DNA, 22 bp, Homo sapiens
cagggctgctggccgtgccctc

SEQ ID NO: 8070672 - DNA, 22 bp, Homo sapiens
cagggctggatcctccagactc

SEQ ID NO: 8070673 - DNA, 22 bp, Homo sapiens
cagggccaagttggtgcctttt

SEQ ID NO: 8070674 - DNA, 22 bp, Homo sapiens
cagggccaccgtgtttgctgct

SEQ ID NO: 8070675 - DNA, 22 bp, Homo sapiens
cagggccaccctctgctgggtg

SEQ ID NO: 8070676 - DNA, 20 bp, Homo sapiens
cagggccacgctccaaggca

SEQ ID NO: 8070677 - DNA, 22 bp, Homo sapiens
caggtggggcagctgtgggagc

SEQ ID NO: 8070678 - DNA, 22 bp, Homo sapiens
caggtggggagagtgtggagca

SEQ ID NO: 8070679 - DNA, 22 bp, Homo sapiens
caggtggggcgccctcaggcag

SEQ ID NO: 8070680 - DNA, 22 bp, Homo sapiens
caggtggggcagctgtgggagc

SEQ ID NO: 8070681 - DNA, 22 bp, Homo sapiens
caggtggggcgccctcaggcag

SEQ ID NO: 8070682 - DNA, 22 bp, Homo sapiens
caggtggggggcttccgagcct

SEQ ID NO: 8070683 - DNA, 22 bp, Homo sapiens
caggtggggagagtgtggagca

SEQ ID NO: 8070684 - DNA, 22 bp, Homo sapiens
caggtgggcttgggagaacact

SEQ ID NO: 8070685 - DNA, 22 bp, Homo sapiens
caggtgggcttgggagaacact

SEQ ID NO: 8070686 - DNA, 22 bp, Homo sapiens
caggtggcttagtcccatttta

SEQ ID NO: 8070687 - DNA, 22 bp, Homo sapiens
caggtgggctgcctctccagct

SEQ ID NO: 8070688 - DNA, 22 bp, Homo sapiens
caggtgggcgtggcgagaaggc

SEQ ID NO: 8070689 - DNA, 22 bp, Homo sapiens
caggtgggccggggtttgttct

SEQ ID NO: 8070690 - DNA, 22 bp, Homo sapiens
caggtgggcgtggcgagaaggc

SEQ ID NO: 8070691 - DNA, 22 bp, Homo sapiens
tatgaagaaacctatcctctag

SEQ ID NO: 8070692 - DNA, 22 bp, Homo sapiens
tatgaacatgttcattgactta

SEQ ID NO: 8070693 - DNA, 22 bp, Homo sapiens
tatattcattttaaagccatct

SEQ ID NO: 8070694 - DNA, 22 bp, Homo sapiens
tatgatgactctagataaagtc

SEQ ID NO: 8070695 - DNA, 22 bp, Homo sapiens
ttgaccactgaatggttctgaa

SEQ ID NO: 8070696 - DNA, 22 bp, Homo sapiens
ttctttttaaagtgtgtatgca

SEQ ID NO: 8070697 - DNA, 22 bp, Homo sapiens
ttgaaaaaattggtagaggatg

SEQ ID NO: 8070698 - DNA, 18 bp, Homo sapiens
ttgagaaataagcactaa

SEQ ID NO: 8070699 - DNA, 18 bp, Homo sapiens
ttgagggaggggcagagt

SEQ ID NO: 8070700 - DNA, 22 bp, Homo sapiens
ttgagggtctggatctgctgct

SEQ ID NO: 8070701 - DNA, 22 bp, Homo sapiens
ttgagggtctggatctgctgct

SEQ ID NO: 8070702 - DNA, 22 bp, Homo sapiens
ttctggagtcccacagccaggg

SEQ ID NO: 8070703 - DNA, 22 bp, Homo sapiens
ttctggagtattcctggcacct

SEQ ID NO: 8070704 - DNA, 22 bp, Homo sapiens
ttctgggacatctggacagttt

SEQ ID NO: 8070705 - DNA, 22 bp, Homo sapiens
ttcttcctcagcagggctgcct

SEQ ID NO: 8070706 - DNA, 22 bp, Homo sapiens
ttcttcctctgtaaaaggtgac

SEQ ID NO: 8070707 - DNA, 22 bp, Homo sapiens
ttctaaacttcaattctaaatt

SEQ ID NO: 8070708 - DNA, 20 bp, Homo sapiens
ttctaaactgttaggcttgc

SEQ ID NO: 8070709 - DNA, 22 bp, Homo sapiens
ttctaaactgaagtattttaaa

SEQ ID NO: 8070710 - DNA, 22 bp, Homo sapiens
ttcgtttagtccacaaatgcat

SEQ ID NO: 8070711 - DNA, 22 bp, Homo sapiens
ttctcaagtgagtggtaaatga

SEQ ID NO: 8070712 - DNA, 22 bp, Homo sapiens
ttctggaggccccttccttctc

SEQ ID NO: 8070713 - DNA, 20 bp, Homo sapiens
ttctggaggctacaagtctg

SEQ ID NO: 8070714 - DNA, 22 bp, Homo sapiens
ttctgcattatacacaacctaa

SEQ ID NO: 8070715 - DNA, 22 bp, Homo sapiens
ttctctttatgtatttagtggg

SEQ ID NO: 8070716 - DNA, 22 bp, Homo sapiens
ttctgagtctcctgtcgacagt

SEQ ID NO: 8070717 - DNA, 22 bp, Homo sapiens
ttctgattgctgatgaggccca

SEQ ID NO: 8070718 - DNA, 22 bp, Homo sapiens
ttctccgctaagttctctgcag

SEQ ID NO: 8070719 - DNA, 22 bp, Homo sapiens
ttctcttctgttcagtgcccaa

SEQ ID NO: 8070720 - DNA, 22 bp, Homo sapiens
ttccaatggaatcatgtcttga

SEQ ID NO: 8070721 - DNA, 20 bp, Homo sapiens
ttccaaggtctatgcttctt

SEQ ID NO: 8070722 - DNA, 22 bp, Homo sapiens
ttccaagtgcccatatttcatc

SEQ ID NO: 8070723 - DNA, 20 bp, Homo sapiens
ttcatcagcaaagcacagca

SEQ ID NO: 8070724 - DNA, 22 bp, Homo sapiens
ttcatcaggcatcatgctcaag

SEQ ID NO: 8070725 - DNA, 22 bp, Homo sapiens
ttcccaggctgtgctaccagag

SEQ ID NO: 8070726 - DNA, 22 bp, Homo sapiens
ttccccagtagtgacaatcaaa

SEQ ID NO: 8070727 - DNA, 22 bp, Homo sapiens
ttccccagtaacatacatgtga

SEQ ID NO: 8070728 - DNA, 22 bp, Homo sapiens
ttccatgcctagaacaggattc

SEQ ID NO: 8070729 - DNA, 22 bp, Homo sapiens
ttccatgcctctatttagaatt

SEQ ID NO: 8070730 - DNA, 22 bp, Homo sapiens
ttccatgcaagaagtatggctc

SEQ ID NO: 8070731 - DNA, 22 bp, Homo sapiens
ttccatgaaggagactgagaag

SEQ ID NO: 8070732 - DNA, 22 bp, Homo sapiens
ttccatgaaagtgaaatggagc

SEQ ID NO: 8070733 - DNA, 22 bp, Homo sapiens
ttccatgactgaagcaggggcg

SEQ ID NO: 8070734 - DNA, 22 bp, Homo sapiens
ttcccagaatgaatggatggag

SEQ ID NO: 8070735 - DNA, 22 bp, Homo sapiens
ttcagaataactttttattgaa

SEQ ID NO: 8070736 - DNA, 22 bp, Homo sapiens
ttcagaataatgtgttagagaa

SEQ ID NO: 8070737 - DNA, 22 bp, Homo sapiens
ttcagaatatccgtttaagttt

SEQ ID NO: 8070738 - DNA, 22 bp, Homo sapiens
ttcagaatatttgttttacatg

SEQ ID NO: 8070739 - DNA, 22 bp, Homo sapiens
ttcagaatattattttaaaggc

SEQ ID NO: 8070740 - DNA, 22 bp, Homo sapiens
ttcagaaatgaatattggtatt

SEQ ID NO: 8070741 - DNA, 22 bp, Homo sapiens
ttcagaaataaaatatcccaac

SEQ ID NO: 8070742 - DNA, 22 bp, Homo sapiens
ttcaatcatttttacatagtcc

SEQ ID NO: 8070743 - DNA, 22 bp, Homo sapiens
ttcatatttgaaacagaagtta

SEQ ID NO: 8070744 - DNA, 22 bp, Homo sapiens
ttcagaatgtgaccttatttgg

SEQ ID NO: 8070745 - DNA, 22 bp, Homo sapiens
ttcagaatgtactgatagaaca

SEQ ID NO: 8070746 - DNA, 16 bp, Homo sapiens
ttcagaatttgtagaa

SEQ ID NO: 8070747 - DNA, 19 bp, Homo sapiens
ttcagaattgggaggtgat

SEQ ID NO: 8070748 - DNA, 22 bp, Homo sapiens
ttcagaatctatgtgccagctc

SEQ ID NO: 8070749 - DNA, 22 bp, Homo sapiens
ttcagaatgagaatggatgggt

SEQ ID NO: 8070750 - DNA, 22 bp, Homo sapiens
ttcagaatgacttatgtaaggc

SEQ ID NO: 8070751 - DNA, 22 bp, Homo sapiens
ttcagaatgattacattctggt

SEQ ID NO: 8070752 - DNA, 22 bp, Homo sapiens
ttcagaatgatttcagcgagca

SEQ ID NO: 8070753 - DNA, 22 bp, Homo sapiens
ttcagaatgctatttctgaaat

SEQ ID NO: 8070754 - DNA, 22 bp, Homo sapiens
ttatttaatgtgatctgaagag

SEQ ID NO: 8070755 - DNA, 22 bp, Homo sapiens
ttatttaatgtgatctgaagag

SEQ ID NO: 8070756 - DNA, 22 bp, Homo sapiens
ttatttaaaagtggtaagattc

SEQ ID NO: 8070757 - DNA, 22 bp, Homo sapiens
ttattaaaatgcggatttggct

SEQ ID NO: 8070758 - DNA, 22 bp, Homo sapiens
ttcaagactgcgactaatgccc

SEQ ID NO: 8070759 - DNA, 23 bp, Homo sapiens
ttcaaaactggaaaatcagatgc

SEQ ID NO: 8070760 - DNA, 23 bp, Homo sapiens
ttcaaaactggaaaatcagatgc

SEQ ID NO: 8070761 - DNA, 22 bp, Homo sapiens
ttattttctcctcagaaagtgg

SEQ ID NO: 8070762 - DNA, 22 bp, Homo sapiens
ttattttaccttcctctgagct

SEQ ID NO: 8070763 - DNA, 22 bp, Homo sapiens
ttataagagtatatagtgtact

SEQ ID NO: 8070764 - DNA, 22 bp, Homo sapiens
ttgttgtcattgtagaggattt

SEQ ID NO: 8070765 - DNA, 22 bp, Homo sapiens
tttaggaatgtggtttttgagc

SEQ ID NO: 8070766 - DNA, 22 bp, Homo sapiens
tttagcatgtgtgccatgtggc

SEQ ID NO: 8070767 - DNA, 22 bp, Homo sapiens
tttagccaactatatgactagt

SEQ ID NO: 8070768 - DNA, 22 bp, Homo sapiens
tttatctttaggactttgcaga

SEQ ID NO: 8070769 - DNA, 22 bp, Homo sapiens
tttatcttctgcagttctggct

SEQ ID NO: 8070770 - DNA, 22 bp, Homo sapiens
tttatctttggatcttcagaaa

SEQ ID NO: 8070771 - DNA, 22 bp, Homo sapiens
tttcaagcataactgggaagag

SEQ ID NO: 8070772 - DNA, 22 bp, Homo sapiens
tttcacaagtaaagtcctaagt

SEQ ID NO: 8070773 - DNA, 22 bp, Homo sapiens
tttcacaagtttcaggattctg

SEQ ID NO: 8070774 - DNA, 22 bp, Homo sapiens
tttcacaactgcttatttgaga

SEQ ID NO: 8070775 - DNA, 22 bp, Homo sapiens
tttcacatgtggaatgccaggt

SEQ ID NO: 8070776 - DNA, 23 bp, Homo sapiens
tttcacagcttttattctgcatc

SEQ ID NO: 8070777 - DNA, 22 bp, Homo sapiens
tttcataaacagtagaagacta

SEQ ID NO: 8070778 - DNA, 22 bp, Homo sapiens
tttccatgtgtactggccagaa

SEQ ID NO: 8070779 - DNA, 22 bp, Homo sapiens
tttccatgttatcttgcagact

SEQ ID NO: 8070780 - DNA, 22 bp, Homo sapiens
tttccatgttggtgaaatgagg

SEQ ID NO: 8070781 - DNA, 22 bp, Homo sapiens
tttccatgatcgttatagaact

SEQ ID NO: 8070782 - DNA, 22 bp, Homo sapiens
tttccagggctctgtagaagaa

SEQ ID NO: 8070783 - DNA, 22 bp, Homo sapiens
tttccagagggtgctcagggcg

SEQ ID NO: 8070784 - DNA, 22 bp, Homo sapiens
tttccagattaagataccactt

SEQ ID NO: 8070785 - DNA, 22 bp, Homo sapiens
tttcatctctctaaaagacagt

SEQ ID NO: 8070786 - DNA, 22 bp, Homo sapiens
tttcataatagtgcagtttgtt

SEQ ID NO: 8070787 - DNA, 22 bp, Homo sapiens
ttgaggtcttgagtactgggga

SEQ ID NO: 8070788 - DNA, 22 bp, Homo sapiens
ttgcatttgctcatttgatatg

SEQ ID NO: 8070789 - DNA, 22 bp, Homo sapiens
ttgccaagtgttttaaaatatt

SEQ ID NO: 8070790 - DNA, 22 bp, Homo sapiens
ttgccaggagctcatctgaggg

SEQ ID NO: 8070791 - DNA, 22 bp, Homo sapiens
ttgctcatactcatgttgtgat

SEQ ID NO: 8070792 - DNA, 23 bp, Homo sapiens
ttggcaaagcctatgaagtcctc

SEQ ID NO: 8070793 - DNA, 22 bp, Homo sapiens
ttggcaaaatttaaagaagtga

SEQ ID NO: 8070794 - DNA, 22 bp, Homo sapiens
ttggaagagtagagttgaataa

SEQ ID NO: 8070795 - DNA, 22 bp, Homo sapiens
ttggaagagagccacagttaat

SEQ ID NO: 8070796 - DNA, 22 bp, Homo sapiens
ttggaagacagtgaaacagcac

SEQ ID NO: 8070797 - DNA, 22 bp, Homo sapiens
ttggaggcaatgggaaggaggc

SEQ ID NO: 8070798 - DNA, 22 bp, Homo sapiens
ttggaagacaatgctgattctc

SEQ ID NO: 8070799 - DNA, 22 bp, Homo sapiens
ttgctttattcacatctatatt

SEQ ID NO: 8070800 - DNA, 23 bp, Homo sapiens
ttgcttctgtgcaattcagtact

SEQ ID NO: 8070801 - DNA, 22 bp, Homo sapiens
ttgtgctctgtgttatttaagg

SEQ ID NO: 8070802 - DNA, 22 bp, Homo sapiens
ttgtgctgtgagaatgctcatt

SEQ ID NO: 8070803 - DNA, 22 bp, Homo sapiens
ttgtgccattaataaggagttg

SEQ ID NO: 8070804 - DNA, 22 bp, Homo sapiens
ttgtgccataaccaccctgact

SEQ ID NO: 8070805 - DNA, 22 bp, Homo sapiens
ttgtgccatgaactgtatgaag

SEQ ID NO: 8070806 - DNA, 22 bp, Homo sapiens
ttgtgccaagaacatggaattt

SEQ ID NO: 8070807 - DNA, 19 bp, Homo sapiens
ttgtgccaagggtcagaag

SEQ ID NO: 8070808 - DNA, 22 bp, Homo sapiens
ttgtgccagagaaagcacaaga

SEQ ID NO: 8070809 - DNA, 22 bp, Homo sapiens
ttgtgcattagggaaaggaact

SEQ ID NO: 8070810 - DNA, 22 bp, Homo sapiens
ttgtgcatgactgtgaatagct

SEQ ID NO: 8070811 - DNA, 22 bp, Homo sapiens
ttgtagctgaaagtaaagaagt

SEQ ID NO: 8070812 - DNA, 22 bp, Homo sapiens
ttgtatagcccagagagtgaga

SEQ ID NO: 8070813 - DNA, 22 bp, Homo sapiens
ttgtagcttatcaaggctgttt

SEQ ID NO: 8070814 - DNA, 22 bp, Homo sapiens
ttgtagctttttaatgtgctgc

SEQ ID NO: 8070815 - DNA, 22 bp, Homo sapiens
ttgtatatattcttaaagatgt

SEQ ID NO: 8070816 - DNA, 18 bp, Homo sapiens
ttggctttgagaactggt

SEQ ID NO: 8070817 - DNA, 22 bp, Homo sapiens
ttggcttttatgcagcttaggt

SEQ ID NO: 8070818 - DNA, 22 bp, Homo sapiens
ttggcttcttcgcacagcagta

SEQ ID NO: 8070819 - DNA, 22 bp, Homo sapiens
ttggggagaaatgaaatgaagt

SEQ ID NO: 8070820 - DNA, 22 bp, Homo sapiens
ttggggagttaatgccaaagat

SEQ ID NO: 8070821 - DNA, 22 bp, Homo sapiens
ttgggctggcagaggtggtctt

SEQ ID NO: 8070822 - DNA, 22 bp, Homo sapiens
ttgggctgaagtagagggcaga

SEQ ID NO: 8070823 - DNA, 22 bp, Homo sapiens
ttgggctcctgttgatcctgtc

SEQ ID NO: 8070824 - DNA, 22 bp, Homo sapiens
ttggcgcccaggacgccgccgc

SEQ ID NO: 8070825 - DNA, 21 bp, Homo sapiens
ttggcctgatatcttggagca

SEQ ID NO: 8070826 - DNA, 21 bp, Homo sapiens
ttggccgtgcagatgaacagc

SEQ ID NO: 8070827 - DNA, 17 bp, Homo sapiens
ttttgttcatcttcaaa

SEQ ID NO: 8070828 - DNA, 22 bp, Homo sapiens
ttttgtatagtcaaagacaaga

SEQ ID NO: 8070829 - DNA, 22 bp, Homo sapiens
tttttgtatatgcttcgaggat

SEQ ID NO: 8070830 - DNA, 22 bp, Homo sapiens
ttttccagatgaattccacagt

SEQ ID NO: 8070831 - DNA, 22 bp, Homo sapiens
ttttcctctgcagagcagttag

SEQ ID NO: 8070832 - DNA, 22 bp, Homo sapiens
ttttagaaatactgatttagtg

SEQ ID NO: 8070833 - DNA, 22 bp, Homo sapiens
ttttcacacaaggtgataagtt

SEQ ID NO: 8070834 - DNA, 22 bp, Homo sapiens
ttttcaagagagtgttctatgt

SEQ ID NO: 8070835 - DNA, 23 bp, Homo sapiens
ttttaatttggacataagaagat

SEQ ID NO: 8070836 - DNA, 22 bp, Homo sapiens
tttgtcttatccaatctctcag

SEQ ID NO: 8070837 - DNA, 22 bp, Homo sapiens
tttgtcttaaatcttgttactg

SEQ ID NO: 8070838 - DNA, 22 bp, Homo sapiens
tttgtcttccccctttaatcag

SEQ ID NO: 8070839 - DNA, 22 bp, Homo sapiens
tttgcttaaaagcggagcaaga

SEQ ID NO: 8070840 - DNA, 22 bp, Homo sapiens
tttgcattgtttcaaaagtgaa

SEQ ID NO: 8070841 - DNA, 22 bp, Homo sapiens
tttgagaatggtaagtggatcg

SEQ ID NO: 8070842 - DNA, 21 bp, Homo sapiens
tttgagaattggtcagagtgc

SEQ ID NO: 8070843 - DNA, 22 bp, Homo sapiens
tttggcatgggctatttgcttt

SEQ ID NO: 8070844 - DNA, 22 bp, Homo sapiens
tttgaagactactgggagtgaa

SEQ ID NO: 8070845 - DNA, 22 bp, Homo sapiens
tttgacaggactaacatatggc

SEQ ID NO: 8070846 - DNA, 22 bp, Homo sapiens
tttctagaggctccaggggagt

SEQ ID NO: 8070847 - DNA, 22 bp, Homo sapiens
tttctattgatctaataaacat

SEQ ID NO: 8070848 - DNA, 22 bp, Homo sapiens
tttctatatgaggagctaaagt

SEQ ID NO: 8070849 - DNA, 22 bp, Homo sapiens
tttgaaatgtatcagtataggt

SEQ ID NO: 8070850 - DNA, 22 bp, Homo sapiens
tttgaaatatgaggcattatga

SEQ ID NO: 8070851 - DNA, 21 bp, Homo sapiens
ttttttcttgcgtgaggcctg

SEQ ID NO: 8070852 - DNA, 22 bp, Homo sapiens
attattgtactttcaataaggt

SEQ ID NO: 8070853 - DNA, 21 bp, Homo sapiens
attcagagtaattcatcttta

SEQ ID NO: 8070854 - DNA, 22 bp, Homo sapiens
gcagagctgggatttgtactgg

SEQ ID NO: 8070855 - DNA, 22 bp, Homo sapiens
gcagagctgtctaagtcacttc

SEQ ID NO: 8070856 - DNA, 20 bp, Homo sapiens
gcagagctgttctgtgggga

SEQ ID NO: 8070857 - DNA, 22 bp, Homo sapiens
gcagagctgttaatggagctga

SEQ ID NO: 8070858 - DNA, 18 bp, Homo sapiens
gcagagctgggattccca

SEQ ID NO: 8070859 - DNA, 22 bp, Homo sapiens
gcagagctgcagcgaggcctgg

SEQ ID NO: 8070860 - DNA, 23 bp, Homo sapiens
gcagagctgccctattgccttgg

SEQ ID NO: 8070861 - DNA, 22 bp, Homo sapiens
gcagagctgcagcgaggcctgg

SEQ ID NO: 8070862 - DNA, 22 bp, Homo sapiens
attcttaattgccatgctgtat

SEQ ID NO: 8070863 - DNA, 22 bp, Homo sapiens
attcttaaatttaggtctgtga

SEQ ID NO: 8070864 - DNA, 22 bp, Homo sapiens
attcttcactgtttcagaatga

SEQ ID NO: 8070865 - DNA, 22 bp, Homo sapiens
attcttcactgtttcagaatga

SEQ ID NO: 8070866 - DNA, 22 bp, Homo sapiens
attcttcaccatggataatttg

SEQ ID NO: 8070867 - DNA, 22 bp, Homo sapiens
attcttcacaaatatatagaag

SEQ ID NO: 8070868 - DNA, 22 bp, Homo sapiens
attcttcacaaatatatagaag

SEQ ID NO: 8070869 - DNA, 22 bp, Homo sapiens
attctcaaagccagagtcaacg

SEQ ID NO: 8070870 - DNA, 22 bp, Homo sapiens
attctcaatggctactttcata

SEQ ID NO: 8070871 - DNA, 22 bp, Homo sapiens
attctcaaaacataacttcact

SEQ ID NO: 8070872 - DNA, 22 bp, Homo sapiens
attctatagacagaaggtcaat

SEQ ID NO: 8070873 - DNA, 22 bp, Homo sapiens
attgacaaatctgaacatacgg

SEQ ID NO: 8070874 - DNA, 22 bp, Homo sapiens
attgaatgtcctttagtaaaaa

SEQ ID NO: 8070875 - DNA, 22 bp, Homo sapiens
attgaatctgcactagtatttt

SEQ ID NO: 8070876 - DNA, 20 bp, Homo sapiens
attgaaatttttctgagatt

SEQ ID NO: 8070877 - DNA, 22 bp, Homo sapiens
attcttcagatcagcagggcct

SEQ ID NO: 8070878 - DNA, 22 bp, Homo sapiens
attcttcagcaggggacactat

SEQ ID NO: 8070879 - DNA, 22 bp, Homo sapiens
attagaatgaagtataggattt

SEQ ID NO: 8070880 - DNA, 21 bp, Homo sapiens
gcaaggcttttgtgtttccca

SEQ ID NO: 8070881 - DNA, 22 bp, Homo sapiens
gcaaggctttgtgaattttaaa

SEQ ID NO: 8070882 - DNA, 22 bp, Homo sapiens
attattcaatcatattaaaagt

SEQ ID NO: 8070883 - DNA, 20 bp, Homo sapiens
attagagctacatggctaca

SEQ ID NO: 8070884 - DNA, 22 bp, Homo sapiens
attacaagatgcatccatattt

SEQ ID NO: 8070885 - DNA, 22 bp, Homo sapiens
attacaagtttcagtgttttgc

SEQ ID NO: 8070886 - DNA, 22 bp, Homo sapiens
attacaagtagactaactttca

SEQ ID NO: 8070887 - DNA, 22 bp, Homo sapiens
gcaaggctgctgccacccatct

SEQ ID NO: 8070888 - DNA, 22 bp, Homo sapiens
gcaaggctgtgcactttgcatt

SEQ ID NO: 8070889 - DNA, 22 bp, Homo sapiens
gcaaggctgagcacatttgcat

SEQ ID NO: 8070890 - DNA, 22 bp, Homo sapiens
attaatgaaactttggttaagc

SEQ ID NO: 8070891 - DNA, 22 bp, Homo sapiens
attaatgagcttctgcactcat

SEQ ID NO: 8070892 - DNA, 22 bp, Homo sapiens
gatgatcatctgtaaagttaga

SEQ ID NO: 8070893 - DNA, 22 bp, Homo sapiens
gatgatcatctgtaaagttaga

SEQ ID NO: 8070894 - DNA, 22 bp, Homo sapiens
attaatatacactgttagcatg

SEQ ID NO: 8070895 - DNA, 22 bp, Homo sapiens
attaaatgttggacgtatacat

SEQ ID NO: 8070896 - DNA, 22 bp, Homo sapiens
attaaatgttggcatattttgt

SEQ ID NO: 8070897 - DNA, 22 bp, Homo sapiens
attaaatgttggacgtatacat

SEQ ID NO: 8070898 - DNA, 22 bp, Homo sapiens
gatgagggcctggtggctgtgc

SEQ ID NO: 8070899 - DNA, 22 bp, Homo sapiens
gatgaggggtcattggctggga

SEQ ID NO: 8070900 - DNA, 22 bp, Homo sapiens
gatgagggcctggtggctgtgc

SEQ ID NO: 8070901 - DNA, 22 bp, Homo sapiens
gatgaggggtcattggctggga

SEQ ID NO: 8070902 - DNA, 22 bp, Homo sapiens
attaaatgatggcatgtcttat

SEQ ID NO: 8070903 - DNA, 22 bp, Homo sapiens
attaaatgttccttaaattata

SEQ ID NO: 8070904 - DNA, 22 bp, Homo sapiens
atgtgttaatgagcaatgacct

SEQ ID NO: 8070905 - DNA, 22 bp, Homo sapiens
atttaattttctcaacagtgct

SEQ ID NO: 8070906 - DNA, 22 bp, Homo sapiens
atttaatttggagagagaaacc

SEQ ID NO: 8070907 - DNA, 22 bp, Homo sapiens
atttaatttatagatgtggata

SEQ ID NO: 8070908 - DNA, 22 bp, Homo sapiens
atttaatttggagagagaaacc

SEQ ID NO: 8070909 - DNA, 22 bp, Homo sapiens
atttaatgggtagacattgtta

SEQ ID NO: 8070910 - DNA, 19 bp, Homo sapiens
gccaggagggctctggctg

SEQ ID NO: 8070911 - DNA, 22 bp, Homo sapiens
atttagaagctaatttttcaga

SEQ ID NO: 8070912 - DNA, 22 bp, Homo sapiens
atttagaaattccaaaagtatt

SEQ ID NO: 8070913 - DNA, 22 bp, Homo sapiens
gccaggcattctagaagtagtg

SEQ ID NO: 8070914 - DNA, 22 bp, Homo sapiens
gccaggcatttgttaggtgctg

SEQ ID NO: 8070915 - DNA, 22 bp, Homo sapiens
atttagaagctaatttttcaga

SEQ ID NO: 8070916 - DNA, 22 bp, Homo sapiens
gccaggcctgcaagtgctggtg

SEQ ID NO: 8070917 - DNA, 22 bp, Homo sapiens
atttccttcggacagtttgggt

SEQ ID NO: 8070918 - DNA, 22 bp, Homo sapiens
atttccttcccagatttggttc

SEQ ID NO: 8070919 - DNA, 22 bp, Homo sapiens
atttcatagattgtaaatccct

SEQ ID NO: 8070920 - DNA, 22 bp, Homo sapiens
atttcagcccagtatgagcccc

SEQ ID NO: 8070921 - DNA, 22 bp, Homo sapiens
gcctgggagagggatagtgcag

SEQ ID NO: 8070922 - DNA, 22 bp, Homo sapiens
gcctggagctcatgtgggcatt

SEQ ID NO: 8070923 - DNA, 22 bp, Homo sapiens
gcctggagctcggctgagggcg

SEQ ID NO: 8070924 - DNA, 22 bp, Homo sapiens
gcctggagctcggctgagggcg

SEQ ID NO: 8070925 - DNA, 22 bp, Homo sapiens
gcctgctctggaatccatgtaa

SEQ ID NO: 8070926 - DNA, 18 bp, Homo sapiens
gcctgctctgctctcccc

SEQ ID NO: 8070927 - DNA, 18 bp, Homo sapiens
gcctgctctgctctcccc

SEQ ID NO: 8070928 - DNA, 18 bp, Homo sapiens
gcctgcctagagcttgcc

SEQ ID NO: 8070929 - DNA, 22 bp, Homo sapiens
gcctctctctacccagtatgat

SEQ ID NO: 8070930 - DNA, 22 bp, Homo sapiens
gcctctctctacccagtatgat

SEQ ID NO: 8070931 - DNA, 22 bp, Homo sapiens
gcctgctggaggagcctcaggg

SEQ ID NO: 8070932 - DNA, 22 bp, Homo sapiens
gcctcgaggctgagaaggcaca

SEQ ID NO: 8070933 - DNA, 19 bp, Homo sapiens
gcctcggatggagagcagg

SEQ ID NO: 8070934 - DNA, 21 bp, Homo sapiens
gcctctccaaatcctgccttc

SEQ ID NO: 8070935 - DNA, 22 bp, Homo sapiens
gcctccagtttttttctgaact

SEQ ID NO: 8070936 - DNA, 18 bp, Homo sapiens
gcctgggaggaggaaatg

SEQ ID NO: 8070937 - DNA, 22 bp, Homo sapiens
gcctgtcctatacaggcggctg

SEQ ID NO: 8070938 - DNA, 22 bp, Homo sapiens
caaaaaacacctgtgtgagtat

SEQ ID NO: 8070939 - DNA, 22 bp, Homo sapiens
caaaacattcagagagctcact

SEQ ID NO: 8070940 - DNA, 22 bp, Homo sapiens
caaaaaacacagatgtctgtgt

SEQ ID NO: 8070941 - DNA, 22 bp, Homo sapiens
caaaactgtctagagagagaag

SEQ ID NO: 8070942 - DNA, 22 bp, Homo sapiens
caaaacattcagagagctcact

SEQ ID NO: 8070943 - DNA, 22 bp, Homo sapiens
caaaacattcagagagctcact

SEQ ID NO: 8070944 - DNA, 22 bp, Homo sapiens
gctcaggaaacagcagggcttg

SEQ ID NO: 8070945 - DNA, 22 bp, Homo sapiens
gctcaggagctcttggtggcgc

SEQ ID NO: 8070946 - DNA, 22 bp, Homo sapiens
gctcaggatcagccacctcttt

SEQ ID NO: 8070947 - DNA, 22 bp, Homo sapiens
atggggctgggattctcctcgg

SEQ ID NO: 8070948 - DNA, 22 bp, Homo sapiens
atgggttcaagtgattctcctg

SEQ ID NO: 8070949 - DNA, 22 bp, Homo sapiens
atggggctctgcggctgctccc

SEQ ID NO: 8070950 - DNA, 23 bp, Homo sapiens
atggtcagaattttccagctgag

SEQ ID NO: 8070951 - DNA, 21 bp, Homo sapiens
gagctgggcgaggctccgggg

SEQ ID NO: 8070952 - DNA, 22 bp, Homo sapiens
gaggcctgggttacctactcgt

SEQ ID NO: 8070953 - DNA, 22 bp, Homo sapiens
gaggccagggtaccatcaacat

SEQ ID NO: 8070954 - DNA, 23 bp, Homo sapiens
gaggcctggccctgccacatctc

SEQ ID NO: 8070955 - DNA, 22 bp, Homo sapiens
atgtgaaacctgtgagtagagt

SEQ ID NO: 8070956 - DNA, 22 bp, Homo sapiens
gaggctgcggggaggagcctgc

SEQ ID NO: 8070957 - DNA, 22 bp, Homo sapiens
atgtgaaaaatttcttattaca

SEQ ID NO: 8070958 - DNA, 22 bp, Homo sapiens
gagagctgtgttcattctacca

SEQ ID NO: 8070959 - DNA, 22 bp, Homo sapiens
gagagctgtggtttgaccaggc

SEQ ID NO: 8070960 - DNA, 22 bp, Homo sapiens
atggcaggcccaggtgttcatt

SEQ ID NO: 8070961 - DNA, 22 bp, Homo sapiens
gagaacagaagcattcctaatt

SEQ ID NO: 8070962 - DNA, 22 bp, Homo sapiens
atggcagggcagcctctcagag

SEQ ID NO: 8070963 - DNA, 22 bp, Homo sapiens
gagccagcgccttgcctctggg

SEQ ID NO: 8070964 - DNA, 22 bp, Homo sapiens
gagccagctacatggtctgcaa

SEQ ID NO: 8070965 - DNA, 22 bp, Homo sapiens
gagccagctgagctgcactgtc

SEQ ID NO: 8070966 - DNA, 22 bp, Homo sapiens
gagccaggcccgtacttgctgt

SEQ ID NO: 8070967 - DNA, 22 bp, Homo sapiens
gagccaggcaccttctgtgttg

SEQ ID NO: 8070968 - DNA, 22 bp, Homo sapiens
atggccagtctgttggacagca

SEQ ID NO: 8070969 - DNA, 22 bp, Homo sapiens
gagcagtgactggagcatgaga

SEQ ID NO: 8070970 - DNA, 22 bp, Homo sapiens
gagccagccttcttctgaggtc

SEQ ID NO: 8070971 - DNA, 22 bp, Homo sapiens
atggcccaggcctcctgtggct

SEQ ID NO: 8070972 - DNA, 22 bp, Homo sapiens
gacagaggcaagaccagaagcc

SEQ ID NO: 8070973 - DNA, 22 bp, Homo sapiens
gacagaggctggagcacctcct

SEQ ID NO: 8070974 - DNA, 22 bp, Homo sapiens
atgccactgcgctccagcctgg

SEQ ID NO: 8070975 - DNA, 22 bp, Homo sapiens
atggaacatcaggttaagaaat

SEQ ID NO: 8070976 - DNA, 22 bp, Homo sapiens
atggaaggtcctacagagcgca

SEQ ID NO: 8070977 - DNA, 22 bp, Homo sapiens
atggaatgtgaacatgatggca

SEQ ID NO: 8070978 - DNA, 21 bp, Homo sapiens
atggagcctaagagtggaggt

SEQ ID NO: 8070979 - DNA, 23 bp, Homo sapiens
atggagctggtactagctacctc

SEQ ID NO: 8070980 - DNA, 22 bp, Homo sapiens
gagaaagggataatttgaagag

SEQ ID NO: 8070981 - DNA, 22 bp, Homo sapiens
gagaacaaggaagagtcggcag

SEQ ID NO: 8070982 - DNA, 22 bp, Homo sapiens
gagaaatgcatgcatgtcatca

SEQ ID NO: 8070983 - DNA, 22 bp, Homo sapiens
cttggcctcttctcagggtggg

SEQ ID NO: 8070984 - DNA, 22 bp, Homo sapiens
cttggcatgttcatctgcttgg

SEQ ID NO: 8070985 - DNA, 22 bp, Homo sapiens
cttggcagcttttggaggagcc

SEQ ID NO: 8070986 - DNA, 22 bp, Homo sapiens
cttggcagctacacaggtaaga

SEQ ID NO: 8070987 - DNA, 22 bp, Homo sapiens
cttggcagatccaaaaatgaca

SEQ ID NO: 8070988 - DNA, 22 bp, Homo sapiens
cttggcagatccaaaaatgaca

SEQ ID NO: 8070989 - DNA, 22 bp, Homo sapiens
cttgcctttgtcttcaaaggct

SEQ ID NO: 8070990 - DNA, 22 bp, Homo sapiens
cttgcctttgtcttcaaaggct

SEQ ID NO: 8070991 - DNA, 22 bp, Homo sapiens
cttgcctgggactgaggcattt

SEQ ID NO: 8070992 - DNA, 22 bp, Homo sapiens
atctacagctgtctgcacagta

SEQ ID NO: 8070993 - DNA, 19 bp, Homo sapiens
atctacaattattctcagt

SEQ ID NO: 8070994 - DNA, 22 bp, Homo sapiens
atctacaggattttacagagtt

SEQ ID NO: 8070995 - DNA, 22 bp, Homo sapiens
atctacagtgcacaggacagcc

SEQ ID NO: 8070996 - DNA, 22 bp, Homo sapiens
atctacaggctgaggtgggagg

SEQ ID NO: 8070997 - DNA, 22 bp, Homo sapiens
atgaaatgtctggatctttttc

SEQ ID NO: 8070998 - DNA, 22 bp, Homo sapiens
atgaaatggtggttttccattt

SEQ ID NO: 8070999 - DNA, 22 bp, Homo sapiens
atgaaatatcttgaagaaattc

SEQ ID NO: 8071000 - DNA, 22 bp, Homo sapiens
cttttattttgaattaagggct

SEQ ID NO: 8071001 - DNA, 22 bp, Homo sapiens
cttgtggcccatggcttcctgc

SEQ ID NO: 8071002 - DNA, 22 bp, Homo sapiens
cttgtttaataataccttagca

SEQ ID NO: 8071003 - DNA, 22 bp, Homo sapiens
atctttgttgctctcatttctg

SEQ ID NO: 8071004 - DNA, 22 bp, Homo sapiens
atcttgattccattatctttgt

SEQ ID NO: 8071005 - DNA, 22 bp, Homo sapiens
atctttttatctgtttggaaca

SEQ ID NO: 8071006 - DNA, 22 bp, Homo sapiens
atgaaaacggaccagagctatt

SEQ ID NO: 8071007 - DNA, 22 bp, Homo sapiens
atgcatgaaagaatccaagcct

SEQ ID NO: 8071008 - DNA, 22 bp, Homo sapiens
atgcatgcagggaagacagtag

SEQ ID NO: 8071009 - DNA, 22 bp, Homo sapiens
atgcattatcaattgatgtagg

SEQ ID NO: 8071010 - DNA, 22 bp, Homo sapiens
atgcaaaattaccattctgttc

SEQ ID NO: 8071011 - DNA, 22 bp, Homo sapiens
atgcaaataaagcaactataca

SEQ ID NO: 8071012 - DNA, 22 bp, Homo sapiens
atgcaaataaacagtctagttg

SEQ ID NO: 8071013 - DNA, 22 bp, Homo sapiens
atgcagaaggagccatgcttgc

SEQ ID NO: 8071014 - DNA, 22 bp, Homo sapiens
atgagtgatgggtacattggct

SEQ ID NO: 8071015 - DNA, 22 bp, Homo sapiens
atgagttcatactttcagtacc

SEQ ID NO: 8071016 - DNA, 22 bp, Homo sapiens
atgagtgttgctcattgcagaa

SEQ ID NO: 8071017 - DNA, 22 bp, Homo sapiens
atgaggaacagacttgctggat

SEQ ID NO: 8071018 - DNA, 22 bp, Homo sapiens
atgagcttccagacaaaggcat

SEQ ID NO: 8071019 - DNA, 22 bp, Homo sapiens
gctgcagcagaagttctcagag

SEQ ID NO: 8071020 - DNA, 22 bp, Homo sapiens
gctgcagcaagccctccagggg

SEQ ID NO: 8071021 - DNA, 22 bp, Homo sapiens
gctgcagcagctgcagggttgt

SEQ ID NO: 8071022 - DNA, 22 bp, Homo sapiens
gctgcagccaaattcattgtca

SEQ ID NO: 8071023 - DNA, 22 bp, Homo sapiens
gctgcagcccggcgcgcctgag

SEQ ID NO: 8071024 - DNA, 18 bp, Homo sapiens
gctcctggaccaggtcac

SEQ ID NO: 8071025 - DNA, 22 bp, Homo sapiens
gctcctgccctcttgcaattcc

SEQ ID NO: 8071026 - DNA, 22 bp, Homo sapiens
gctcctcttctcccactgaatg

SEQ ID NO: 8071027 - DNA, 22 bp, Homo sapiens
gctcctcttctcccactgaatg

SEQ ID NO: 8071028 - DNA, 22 bp, Homo sapiens
caaagtaattacggttttggcc

SEQ ID NO: 8071029 - DNA, 22 bp, Homo sapiens
gctgcagtgagccaagatcgtg

SEQ ID NO: 8071030 - DNA, 22 bp, Homo sapiens
gctgcatgacagacaggcctgg

SEQ ID NO: 8071031 - DNA, 22 bp, Homo sapiens
gctgcatgacagacaggcctgg

SEQ ID NO: 8071032 - DNA, 17 bp, Homo sapiens
gctgcagcggtaggcag

SEQ ID NO: 8071033 - DNA, 22 bp, Homo sapiens
gctgcatggagggtgcccagga

SEQ ID NO: 8071034 - DNA, 22 bp, Homo sapiens
caacagtgttgcaatctgaaaa

SEQ ID NO: 8071035 - DNA, 22 bp, Homo sapiens
caagagctcaccggagagcatt

SEQ ID NO: 8071036 - DNA, 22 bp, Homo sapiens
caagagctcaccggagagcatt

SEQ ID NO: 8071037 - DNA, 22 bp, Homo sapiens
gctgccttttgctcctcccacc

SEQ ID NO: 8071038 - DNA, 22 bp, Homo sapiens
gctgcctgccttgcctggagga

SEQ ID NO: 8071039 - DNA, 22 bp, Homo sapiens
caagatgcccctggtagggatc

SEQ ID NO: 8071040 - DNA, 22 bp, Homo sapiens
caagaggctaaactgggctatt

SEQ ID NO: 8071041 - DNA, 22 bp, Homo sapiens
caagagctttagaaatgctcat

SEQ ID NO: 8071042 - DNA, 22 bp, Homo sapiens
caagatgaaactacagggagga

SEQ ID NO: 8071043 - DNA, 22 bp, Homo sapiens
caagatgatccctgaaggcagc

SEQ ID NO: 8071044 - DNA, 22 bp, Homo sapiens
cacacgagccctggagccagca

SEQ ID NO: 8071045 - DNA, 22 bp, Homo sapiens
cacacctcacacctcgcatgct

SEQ ID NO: 8071046 - DNA, 22 bp, Homo sapiens
cacacctgtaataccagctact

SEQ ID NO: 8071047 - DNA, 22 bp, Homo sapiens
cacaattctatcagaaagcaga

SEQ ID NO: 8071048 - DNA, 22 bp, Homo sapiens
ggaaaagaattgcagtgaagta

SEQ ID NO: 8071049 - DNA, 22 bp, Homo sapiens
cacaaagtctgcagctgctgta

SEQ ID NO: 8071050 - DNA, 22 bp, Homo sapiens
ggaaaaggccacagggacacat

SEQ ID NO: 8071051 - DNA, 22 bp, Homo sapiens
cacaagtctgtggtctccaaca

SEQ ID NO: 8071052 - DNA, 22 bp, Homo sapiens
gctgtggagtacagagctggtt

SEQ ID NO: 8071053 - DNA, 22 bp, Homo sapiens
gctgtgcttgggaagaatctct

SEQ ID NO: 8071054 - DNA, 22 bp, Homo sapiens
gctgtgcttgcatgagtgtctg

SEQ ID NO: 8071055 - DNA, 22 bp, Homo sapiens
gctgtgctgcgggaggattccg

SEQ ID NO: 8071056 - DNA, 22 bp, Homo sapiens
gctgtgctggaaggggacctgc

SEQ ID NO: 8071057 - DNA, 22 bp, Homo sapiens
gctgtctgctgggtcgctcagg

SEQ ID NO: 8071058 - DNA, 21 bp, Homo sapiens
gctgtctctggctcctgggaa

SEQ ID NO: 8071059 - DNA, 22 bp, Homo sapiens
gctgtctcggggctttctcctg

SEQ ID NO: 8071060 - DNA, 22 bp, Homo sapiens
gctgtctgagaacatggtggaa

SEQ ID NO: 8071061 - DNA, 18 bp, Homo sapiens
gctgtctgaggtctgagg

SEQ ID NO: 8071062 - DNA, 22 bp, Homo sapiens
gctgtctgactccaagttggag

SEQ ID NO: 8071063 - DNA, 22 bp, Homo sapiens
gctgtctgagaacatggtggaa

SEQ ID NO: 8071064 - DNA, 22 bp, Homo sapiens
gctgtctgcatctctagagctt

SEQ ID NO: 8071065 - DNA, 22 bp, Homo sapiens
gctgtctgcaagccaggaaatg

SEQ ID NO: 8071066 - DNA, 19 bp, Homo sapiens
gctgtctgatgctgaggtc

SEQ ID NO: 8071067 - DNA, 22 bp, Homo sapiens
gctgtctccatagctgtgtgtc

SEQ ID NO: 8071068 - DNA, 22 bp, Homo sapiens
gctgtctccccgcacccgaccg

SEQ ID NO: 8071069 - DNA, 22 bp, Homo sapiens
gcttccaggtcattctcaccct

SEQ ID NO: 8071070 - DNA, 22 bp, Homo sapiens
gcttctcgggcctgatgtcgtc

SEQ ID NO: 8071071 - DNA, 19 bp, Homo sapiens
gcttgggagagggagctaa

SEQ ID NO: 8071072 - DNA, 22 bp, Homo sapiens
gcttgggagagggtccccagga

SEQ ID NO: 8071073 - DNA, 22 bp, Homo sapiens
gcttgggaggcaagcattccat

SEQ ID NO: 8071074 - DNA, 22 bp, Homo sapiens
gcttgggaagggccctgtgtac

SEQ ID NO: 8071075 - DNA, 22 bp, Homo sapiens
gcttgggaaacgtagttcctag

SEQ ID NO: 8071076 - DNA, 22 bp, Homo sapiens
gcttgggagaggcttcctcttt

SEQ ID NO: 8071077 - DNA, 22 bp, Homo sapiens
ggcagtgtccttgcagctctac

SEQ ID NO: 8071078 - DNA, 22 bp, Homo sapiens
cacccagagcctgagagggata

SEQ ID NO: 8071079 - DNA, 22 bp, Homo sapiens
ggcagtgtggcataacatgtag

SEQ ID NO: 8071080 - DNA, 22 bp, Homo sapiens
ggcagtgttctggttgtcagga

SEQ ID NO: 8071081 - DNA, 22 bp, Homo sapiens
ggcagctgagatcatgctgttg
